United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 8

SEQ ID NO: 292424 - DNA, 19 bp, Homo sapiens
ccagttagcccggccaagg

SEQ ID NO: 292425 - DNA, 16 bp, Homo sapiens
ccagttcatctctgct

SEQ ID NO: 292426 - DNA, 17 bp, Homo sapiens
ccagttcatctctgctg

SEQ ID NO: 292427 - DNA, 18 bp, Homo sapiens
ccagttccagcttcatct

SEQ ID NO: 292428 - DNA, 21 bp, Homo sapiens
ccagttccttaggagatgtca

SEQ ID NO: 292429 - DNA, 22 bp, Homo sapiens
ccagttctaggggagaagagcc

SEQ ID NO: 292430 - DNA, 16 bp, Homo sapiens
ccagttctctttgtaa

SEQ ID NO: 292431 - DNA, 13 bp, Homo sapiens
ccagttctgatga

SEQ ID NO: 292432 - DNA, 14 bp, Homo sapiens
ccagttctgatgag

SEQ ID NO: 292433 - DNA, 17 bp, Homo sapiens
ccagttgaataaaagtg

SEQ ID NO: 292434 - DNA, 16 bp, Homo sapiens
ccagttggactgtggc

SEQ ID NO: 292435 - DNA, 20 bp, Homo sapiens
ccagttggactgtggcctca

SEQ ID NO: 292436 - DNA, 21 bp, Homo sapiens
ccagttggactgtggcctcag

SEQ ID NO: 292437 - DNA, 17 bp, Homo sapiens
ccagttgggagcactgg

SEQ ID NO: 292438 - DNA, 18 bp, Homo sapiens
ccagttgggagcactgga

SEQ ID NO: 292439 - DNA, 19 bp, Homo sapiens
ccagttgggagcactggag

SEQ ID NO: 292440 - DNA, 20 bp, Homo sapiens
ccagttgggagcactggagt

SEQ ID NO: 292441 - DNA, 18 bp, Homo sapiens
ccagttgtatattattct

SEQ ID NO: 292442 - DNA, 15 bp, Homo sapiens
ccagttgtatttaat

SEQ ID NO: 292443 - DNA, 22 bp, Homo sapiens
ccagttgtcccgattgtaactc

SEQ ID NO: 292444 - DNA, 14 bp, Homo sapiens
ccagttttcatttt

SEQ ID NO: 292445 - DNA, 12 bp, Homo sapiens
ccagttttgctg

SEQ ID NO: 292446 - DNA, 14 bp, Homo sapiens
ccataaaataaata

SEQ ID NO: 292447 - DNA, 21 bp, Homo sapiens
ccataagcctccatttagttc

SEQ ID NO: 292448 - DNA, 15 bp, Homo sapiens
ccataaggaatgtag

SEQ ID NO: 292449 - DNA, 18 bp, Homo sapiens
ccataatagttagccctc

SEQ ID NO: 292450 - DNA, 21 bp, Homo sapiens
ccataatctggactcctctgt

SEQ ID NO: 292451 - DNA, 15 bp, Homo sapiens
ccataatgttcctta

SEQ ID NO: 292452 - DNA, 13 bp, Homo sapiens
ccatacagcctct

SEQ ID NO: 292453 - DNA, 13 bp, Homo sapiens
ccatacagctcta

SEQ ID NO: 292454 - DNA, 15 bp, Homo sapiens
ccataccaggtgcta

SEQ ID NO: 292455 - DNA, 17 bp, Homo sapiens
ccataccccctgcccca

SEQ ID NO: 292456 - DNA, 16 bp, Homo sapiens
ccataccttgagacca

SEQ ID NO: 292457 - DNA, 17 bp, Homo sapiens
ccatacttttgagaggg

SEQ ID NO: 292458 - DNA, 21 bp, Homo sapiens
ccatagaaaacaatctgccca

SEQ ID NO: 292459 - DNA, 17 bp, Homo sapiens
ccatagatcttctgaaa

SEQ ID NO: 292460 - DNA, 16 bp, Homo sapiens
ccatagctgagctgga

SEQ ID NO: 292461 - DNA, 15 bp, Homo sapiens
ccataggaatcatgt

SEQ ID NO: 292462 - DNA, 18 bp, Homo sapiens
ccataggagcagccttag

SEQ ID NO: 292463 - DNA, 17 bp, Homo sapiens
ccatagtcaatccaaga

SEQ ID NO: 292464 - DNA, 13 bp, Homo sapiens
ccatatataaatt

SEQ ID NO: 292465 - DNA, 14 bp, Homo sapiens
ccatatataaatta

SEQ ID NO: 292466 - DNA, 18 bp, Homo sapiens
ccatatataaattattac

SEQ ID NO: 292467 - DNA, 21 bp, Homo sapiens
ccatatataaattattacttt

SEQ ID NO: 292468 - DNA, 15 bp, Homo sapiens
ccatatcagacctct

SEQ ID NO: 292469 - DNA, 16 bp, Homo sapiens
ccatatcttaaagaaa

SEQ ID NO: 292470 - DNA, 12 bp, Homo sapiens
ccatatgctctt

SEQ ID NO: 292471 - DNA, 22 bp, Homo sapiens
ccatatgtgtgaattctgcaac

SEQ ID NO: 292472 - DNA, 14 bp, Homo sapiens
ccatatgttacact

SEQ ID NO: 292473 - DNA, 15 bp, Homo sapiens
ccatatttgtgttca

SEQ ID NO: 292474 - DNA, 18 bp, Homo sapiens
ccatattttacttggaaa

SEQ ID NO: 292475 - DNA, 19 bp, Homo sapiens
ccatattttacttggaaat

SEQ ID NO: 292476 - DNA, 15 bp, Homo sapiens
ccatcaaaaatattc

SEQ ID NO: 292477 - DNA, 17 bp, Homo sapiens
ccatcaataaagtaccc

SEQ ID NO: 292478 - DNA, 16 bp, Homo sapiens
ccatcacaaacttaaa

SEQ ID NO: 292479 - DNA, 12 bp, Homo sapiens
ccatcacagcca

SEQ ID NO: 292480 - DNA, 13 bp, Homo sapiens
ccatcacagccag

SEQ ID NO: 292481 - DNA, 17 bp, Homo sapiens
ccatcacagccagccca

SEQ ID NO: 292482 - DNA, 18 bp, Homo sapiens
ccatcacagccagcccag

SEQ ID NO: 292483 - DNA, 20 bp, Homo sapiens
ccatcacagccagcccagct

SEQ ID NO: 292484 - DNA, 15 bp, Homo sapiens
ccatcacagcttgtt

SEQ ID NO: 292485 - DNA, 20 bp, Homo sapiens
ccatcacagggttgggccca

SEQ ID NO: 292486 - DNA, 13 bp, Homo sapiens
ccatcaccagaaa

SEQ ID NO: 292487 - DNA, 17 bp, Homo sapiens
ccatcacttctccccgc

SEQ ID NO: 292488 - DNA, 20 bp, Homo sapiens
ccatcacttctccccgcagc

SEQ ID NO: 292489 - DNA, 12 bp, Homo sapiens
ccatcagaggcc

SEQ ID NO: 292490 - DNA, 14 bp, Homo sapiens
ccatcagcagtgat

SEQ ID NO: 292491 - DNA, 21 bp, Homo sapiens
ccatcagcccaacgggaagca

SEQ ID NO: 292492 - DNA, 17 bp, Homo sapiens
ccatcagcccctgctgc

SEQ ID NO: 292493 - DNA, 15 bp, Homo sapiens
ccatcagctctctgc

SEQ ID NO: 292494 - DNA, 19 bp, Homo sapiens
ccatcagctgtaagaagag

SEQ ID NO: 292495 - DNA, 14 bp, Homo sapiens
ccatcagtgcatga

SEQ ID NO: 292496 - DNA, 13 bp, Homo sapiens
ccatcagttactg

SEQ ID NO: 292497 - DNA, 16 bp, Homo sapiens
ccatcagttcccccag

SEQ ID NO: 292498 - DNA, 21 bp, Homo sapiens
ccatcatacgcatggtcctgg

SEQ ID NO: 292499 - DNA, 15 bp, Homo sapiens
ccatcatctctgcct

SEQ ID NO: 292500 - DNA, 16 bp, Homo sapiens
ccatcatctctgcctt

SEQ ID NO: 292501 - DNA, 17 bp, Homo sapiens
ccatcatctctgccttt

SEQ ID NO: 292502 - DNA, 17 bp, Homo sapiens
ccatcatctctgtaaac

SEQ ID NO: 292503 - DNA, 23 bp, Homo sapiens
ccatcatgtaccaagtgcttggc

SEQ ID NO: 292504 - DNA, 16 bp, Homo sapiens
ccatccaccaccttgc

SEQ ID NO: 292505 - DNA, 17 bp, Homo sapiens
ccatccagcatgtgtgt

SEQ ID NO: 292506 - DNA, 18 bp, Homo sapiens
ccatccagcatgtgtgtg

SEQ ID NO: 292507 - DNA, 13 bp, Homo sapiens
ccatccagccagg

SEQ ID NO: 292508 - DNA, 15 bp, Homo sapiens
ccatccagccagggg

SEQ ID NO: 292509 - DNA, 21 bp, Homo sapiens
ccatccagggatgccatctgt

SEQ ID NO: 292510 - DNA, 18 bp, Homo sapiens
ccatccccaccagctcgt

SEQ ID NO: 292511 - DNA, 11 bp, Homo sapiens
ccatcccctcc

SEQ ID NO: 292512 - DNA, 15 bp, Homo sapiens
ccatcccctccctgc

SEQ ID NO: 292513 - DNA, 18 bp, Homo sapiens
ccatcccctccctgcctg

SEQ ID NO: 292514 - DNA, 17 bp, Homo sapiens
ccatggctcaggcaagc

SEQ ID NO: 292515 - DNA, 14 bp, Homo sapiens
ccatggcttcctga

SEQ ID NO: 292516 - DNA, 16 bp, Homo sapiens
ccatggcttcctgaga

SEQ ID NO: 292517 - DNA, 17 bp, Homo sapiens
ccatggctttcatcctg

SEQ ID NO: 292518 - DNA, 14 bp, Homo sapiens
ccatgggcagaaga

SEQ ID NO: 292519 - DNA, 13 bp, Homo sapiens
ccatgggcctgct

SEQ ID NO: 292520 - DNA, 16 bp, Homo sapiens
ccatgggcctgctgcg

SEQ ID NO: 292521 - DNA, 21 bp, Homo sapiens
ccatgggcctgctgcgtcaga

SEQ ID NO: 292522 - DNA, 13 bp, Homo sapiens
ccatgggcctggg

SEQ ID NO: 292523 - DNA, 16 bp, Homo sapiens
ccatgggcctgggcct

SEQ ID NO: 292524 - DNA, 20 bp, Homo sapiens
ccatgggcctgggcctgctt

SEQ ID NO: 292525 - DNA, 21 bp, Homo sapiens
ccatgggcttggacttcctgg

SEQ ID NO: 292526 - DNA, 13 bp, Homo sapiens
ccatgggggcagg

SEQ ID NO: 292527 - DNA, 17 bp, Homo sapiens
ccatggtggtttcagaa

SEQ ID NO: 292528 - DNA, 20 bp, Homo sapiens
ccatggtggtttcagaaagg

SEQ ID NO: 292529 - DNA, 21 bp, Homo sapiens
ccatggtggtttcagaaaggg

SEQ ID NO: 292530 - DNA, 14 bp, Homo sapiens
ccatggttgagaaa

SEQ ID NO: 292531 - DNA, 14 bp, Homo sapiens
ccatgtaaaacaaa

SEQ ID NO: 292532 - DNA, 23 bp, Homo sapiens
ccatgtaaataccagactgcagg

SEQ ID NO: 292533 - DNA, 16 bp, Homo sapiens
ccatgtaccagtgtac

SEQ ID NO: 292534 - DNA, 18 bp, Homo sapiens
ccatgtaccagtgtactg

SEQ ID NO: 292535 - DNA, 13 bp, Homo sapiens
ccatgtactgtag

SEQ ID NO: 292536 - DNA, 22 bp, Homo sapiens
ccatgtactgtagtttttcttc

SEQ ID NO: 292537 - DNA, 16 bp, Homo sapiens
ccatgtagaagaggga

SEQ ID NO: 292538 - DNA, 15 bp, Homo sapiens
ccatgtatctacctc

SEQ ID NO: 292539 - DNA, 20 bp, Homo sapiens
ccatgtccaagttcttcacc

SEQ ID NO: 292540 - DNA, 23 bp, Homo sapiens
ccatgtccaagttcttcacctct

SEQ ID NO: 292541 - DNA, 12 bp, Homo sapiens
ccatgtcgcctc

SEQ ID NO: 292542 - DNA, 19 bp, Homo sapiens
ccatgtgccatctgtacat

SEQ ID NO: 292543 - DNA, 13 bp, Homo sapiens
ccatgtgcccagt

SEQ ID NO: 292544 - DNA, 12 bp, Homo sapiens
ccatgtgcctgt

SEQ ID NO: 292545 - DNA, 15 bp, Homo sapiens
ccatgtggccccagg

SEQ ID NO: 292546 - DNA, 18 bp, Homo sapiens
ccatgtggccccaggtgc

SEQ ID NO: 292547 - DNA, 13 bp, Homo sapiens
ccatgtggctgaa

SEQ ID NO: 292548 - DNA, 19 bp, Homo sapiens
ccatgtgggtgaccaggtc

SEQ ID NO: 292549 - DNA, 17 bp, Homo sapiens
ccatgtgtgagtgtgtg

SEQ ID NO: 292550 - DNA, 12 bp, Homo sapiens
ccatgtgtgtgc

SEQ ID NO: 292551 - DNA, 23 bp, Homo sapiens
ccatgtttaaactttgtgccttt

SEQ ID NO: 292552 - DNA, 20 bp, Homo sapiens
ccattaaatccgcaaacagc

SEQ ID NO: 292553 - DNA, 19 bp, Homo sapiens
ccattagcaacgcctgcct

SEQ ID NO: 292554 - DNA, 15 bp, Homo sapiens
ccattagtatcctgt

SEQ ID NO: 292555 - DNA, 16 bp, Homo sapiens
ccattataaaatcttt

SEQ ID NO: 292556 - DNA, 12 bp, Homo sapiens
ccattcactgat

SEQ ID NO: 292557 - DNA, 22 bp, Homo sapiens
ccattcagcccatttcacacct

SEQ ID NO: 292558 - DNA, 12 bp, Homo sapiens
ccattcaggaac

SEQ ID NO: 292559 - DNA, 15 bp, Homo sapiens
ccattcaggaacctg

SEQ ID NO: 292560 - DNA, 16 bp, Homo sapiens
ccattcatctgggctg

SEQ ID NO: 292561 - DNA, 16 bp, Homo sapiens
ccattccagaatatct

SEQ ID NO: 292562 - DNA, 15 bp, Homo sapiens
ccattccctgtagga

SEQ ID NO: 292563 - DNA, 14 bp, Homo sapiens
ccattcccttggaa

SEQ ID NO: 292564 - DNA, 17 bp, Homo sapiens
ccattccgaccttcacc

SEQ ID NO: 292565 - DNA, 13 bp, Homo sapiens
ccattcctccctc

SEQ ID NO: 292566 - DNA, 14 bp, Homo sapiens
ccattcctgttctc

SEQ ID NO: 292567 - DNA, 17 bp, Homo sapiens
ccattcgtctgtcccag

SEQ ID NO: 292568 - DNA, 15 bp, Homo sapiens
ccattctagatcctg

SEQ ID NO: 292569 - DNA, 22 bp, Homo sapiens
ccattctagatcctgcacccca

SEQ ID NO: 292570 - DNA, 23 bp, Homo sapiens
ccattctagatcctgcaccccag

SEQ ID NO: 292571 - DNA, 19 bp, Homo sapiens
ccattctcctgcctcagcc

SEQ ID NO: 292572 - DNA, 22 bp, Homo sapiens
ccattctcctgcctcagccttc

SEQ ID NO: 292573 - DNA, 23 bp, Homo sapiens
ccattctgctttcttgccacaca

SEQ ID NO: 292574 - DNA, 11 bp, Homo sapiens
ccattcttggt

SEQ ID NO: 292575 - DNA, 12 bp, Homo sapiens
ccattctttctt

SEQ ID NO: 292576 - DNA, 15 bp, Homo sapiens
ccattctttcttcct

SEQ ID NO: 292577 - DNA, 16 bp, Homo sapiens
ccattgacctcagctg

SEQ ID NO: 292578 - DNA, 21 bp, Homo sapiens
ccattgacctcagctgcacat

SEQ ID NO: 292579 - DNA, 15 bp, Homo sapiens
ccattgccaccagga

SEQ ID NO: 292580 - DNA, 10 bp, Homo sapiens
ccattgcttc

SEQ ID NO: 292581 - DNA, 14 bp, Homo sapiens
ccattgcttcacta

SEQ ID NO: 292582 - DNA, 16 bp, Homo sapiens
ccattggtctgcatgt

SEQ ID NO: 292583 - DNA, 22 bp, Homo sapiens
ccattgtctcattgccagtggt

SEQ ID NO: 292584 - DNA, 18 bp, Homo sapiens
ccatttaaactaaccttt

SEQ ID NO: 292585 - DNA, 19 bp, Homo sapiens
ccatttaactagcacttta

SEQ ID NO: 292586 - DNA, 22 bp, Homo sapiens
ccatttaatcatttccagcaaa

SEQ ID NO: 292587 - DNA, 22 bp, Homo sapiens
ccatttagtcctcaccttctgt

SEQ ID NO: 292588 - DNA, 19 bp, Homo sapiens
ccatttagttctttgttat

SEQ ID NO: 292589 - DNA, 20 bp, Homo sapiens
ccatttatgtgagtgtgtgt

SEQ ID NO: 292590 - DNA, 19 bp, Homo sapiens
ccatttcatccatatttct

SEQ ID NO: 292591 - DNA, 20 bp, Homo sapiens
ccatttcattgagggaaaac

SEQ ID NO: 292592 - DNA, 16 bp, Homo sapiens
ccatttcctcttcctt

SEQ ID NO: 292593 - DNA, 13 bp, Homo sapiens
ccatttctcactg

SEQ ID NO: 292594 - DNA, 19 bp, Homo sapiens
ccatttcttggttttgtat

SEQ ID NO: 292595 - DNA, 18 bp, Homo sapiens
ccatttgcaacaggaaga

SEQ ID NO: 292596 - DNA, 18 bp, Homo sapiens
ccatttgccatgctgcta

SEQ ID NO: 292597 - DNA, 18 bp, Homo sapiens
ccatttgtaataaagtat

SEQ ID NO: 292598 - DNA, 12 bp, Homo sapiens
ccatttgtaatg

SEQ ID NO: 292599 - DNA, 14 bp, Homo sapiens
ccatttgtaatgta

SEQ ID NO: 292600 - DNA, 12 bp, Homo sapiens
ccatttgtttat

SEQ ID NO: 292601 - DNA, 15 bp, Homo sapiens
ccattttaagaaaac

SEQ ID NO: 292602 - DNA, 12 bp, Homo sapiens
ccattttcgctt

SEQ ID NO: 292603 - DNA, 16 bp, Homo sapiens
ccattttctaaactgt

SEQ ID NO: 292604 - DNA, 14 bp, Homo sapiens
ccattttgaaatat

SEQ ID NO: 292605 - DNA, 14 bp, Homo sapiens
ccattttgcaaaat

SEQ ID NO: 292606 - DNA, 19 bp, Homo sapiens
ccattttgccacctttcct

SEQ ID NO: 292607 - DNA, 14 bp, Homo sapiens
ccattttgtaactg

SEQ ID NO: 292608 - DNA, 18 bp, Homo sapiens
ccattttgtctggctgtg

SEQ ID NO: 292609 - DNA, 16 bp, Homo sapiens
ccatttttactaaagc

SEQ ID NO: 292610 - DNA, 18 bp, Homo sapiens
ccatttttactaaagcag

SEQ ID NO: 292611 - DNA, 22 bp, Homo sapiens
ccatttttactaaagcagtgtt

SEQ ID NO: 292612 - DNA, 17 bp, Homo sapiens
ccatttttcccaggaca

SEQ ID NO: 292613 - DNA, 21 bp, Homo sapiens
ccatttttttcactcagaatt

SEQ ID NO: 292614 - DNA, 14 bp, Homo sapiens
cccaaaaccacagc

SEQ ID NO: 292615 - DNA, 17 bp, Homo sapiens
cccaaacaaatatgcaa

SEQ ID NO: 292616 - DNA, 20 bp, Homo sapiens
cccaaacaaatatgcaaaag

SEQ ID NO: 292617 - DNA, 12 bp, Homo sapiens
cccaaaccccag

SEQ ID NO: 292618 - DNA, 12 bp, Homo sapiens
cccaaacccttc

SEQ ID NO: 292619 - DNA, 23 bp, Homo sapiens
cccaaactgttgattattagcca

SEQ ID NO: 292620 - DNA, 14 bp, Homo sapiens
cccaaagccagaca

SEQ ID NO: 292621 - DNA, 13 bp, Homo sapiens
cccaaagcccagc

SEQ ID NO: 292622 - DNA, 15 bp, Homo sapiens
cccaaagctttcctg

SEQ ID NO: 292623 - DNA, 23 bp, Homo sapiens
cccaaaggaagctttctctgctt

SEQ ID NO: 292624 - DNA, 13 bp, Homo sapiens
cccaaagggtgtg

SEQ ID NO: 292625 - DNA, 20 bp, Homo sapiens
cccaaagtgctaagattaca

SEQ ID NO: 292626 - DNA, 14 bp, Homo sapiens
cccaaatcttcctc

SEQ ID NO: 292627 - DNA, 20 bp, Homo sapiens
cccaaattatcaagctaata

SEQ ID NO: 292628 - DNA, 15 bp, Homo sapiens
cccaaattgccttca

SEQ ID NO: 292629 - DNA, 16 bp, Homo sapiens
cccaaattgccttcag

SEQ ID NO: 292630 - DNA, 20 bp, Homo sapiens
cccaacaatactttgtgtct

SEQ ID NO: 292631 - DNA, 23 bp, Homo sapiens
cccaacaatactttgtgtctttt

SEQ ID NO: 292632 - DNA, 13 bp, Homo sapiens
cccaacaccaccc

SEQ ID NO: 292633 - DNA, 18 bp, Homo sapiens
cccaacagaaggaaggag

SEQ ID NO: 292634 - DNA, 22 bp, Homo sapiens
cccaacaggtgctgaactgtgc

SEQ ID NO: 292635 - DNA, 14 bp, Homo sapiens
cccaacccccaccc

SEQ ID NO: 292636 - DNA, 13 bp, Homo sapiens
cccaaccctgccc

SEQ ID NO: 292637 - DNA, 14 bp, Homo sapiens
cccaaccctgcccc

SEQ ID NO: 292638 - DNA, 15 bp, Homo sapiens
cccaaccctgcccct

SEQ ID NO: 292639 - DNA, 21 bp, Homo sapiens
cccaacctcaatgccctgcca

SEQ ID NO: 292640 - DNA, 15 bp, Homo sapiens
cccaacgaaaagcac

SEQ ID NO: 292641 - DNA, 19 bp, Homo sapiens
cccaacgtactcctcagac

SEQ ID NO: 292642 - DNA, 15 bp, Homo sapiens
cccaacgtcccctcc

SEQ ID NO: 292643 - DNA, 23 bp, Homo sapiens
cccaacgtcccctccgccgtgcc

SEQ ID NO: 292644 - DNA, 14 bp, Homo sapiens
cccaactcccagcc

SEQ ID NO: 292645 - DNA, 22 bp, Homo sapiens
cccagccaccaccactgtccct

SEQ ID NO: 292646 - DNA, 14 bp, Homo sapiens
cccagccaccccgg

SEQ ID NO: 292647 - DNA, 19 bp, Homo sapiens
cccagccaccccgggctct

SEQ ID NO: 292648 - DNA, 22 bp, Homo sapiens
cccagccacccggatctccagg

SEQ ID NO: 292649 - DNA, 15 bp, Homo sapiens
cccagccaccttcct

SEQ ID NO: 292650 - DNA, 21 bp, Homo sapiens
cccagccactcctcaaccttg

SEQ ID NO: 292651 - DNA, 14 bp, Homo sapiens
cccagccagccctt

SEQ ID NO: 292652 - DNA, 15 bp, Homo sapiens
cccagccagcccttc

SEQ ID NO: 292653 - DNA, 16 bp, Homo sapiens
cccagccagcccttcc

SEQ ID NO: 292654 - DNA, 21 bp, Homo sapiens
cccagccagcccttcccaggc

SEQ ID NO: 292655 - DNA, 22 bp, Homo sapiens
cccagccagcccttcccaggcc

SEQ ID NO: 292656 - DNA, 23 bp, Homo sapiens
cccagccagcccttcccaggcca

SEQ ID NO: 292657 - DNA, 11 bp, Homo sapiens
cccagcccaat

SEQ ID NO: 292658 - DNA, 12 bp, Homo sapiens
cccagcccaata

SEQ ID NO: 292659 - DNA, 17 bp, Homo sapiens
cccagcccaataaaggt

SEQ ID NO: 292660 - DNA, 21 bp, Homo sapiens
cccagcccaataaaggtccct

SEQ ID NO: 292661 - DNA, 15 bp, Homo sapiens
cccagcccaccctgc

SEQ ID NO: 292662 - DNA, 19 bp, Homo sapiens
cccagcccaccctgctcct

SEQ ID NO: 292663 - DNA, 20 bp, Homo sapiens
cccagcccaccctgctcctc

SEQ ID NO: 292664 - DNA, 17 bp, Homo sapiens
cccagcccagcccagct

SEQ ID NO: 292665 - DNA, 20 bp, Homo sapiens
cccagcccagctgctctgcc

SEQ ID NO: 292666 - DNA, 22 bp, Homo sapiens
cccagcccagctgctctgccca

SEQ ID NO: 292667 - DNA, 21 bp, Homo sapiens
cccagcccagggttcccccag

SEQ ID NO: 292668 - DNA, 12 bp, Homo sapiens
cccagccccagc

SEQ ID NO: 292669 - DNA, 20 bp, Homo sapiens
cccagcccggaccttggcag

SEQ ID NO: 292670 - DNA, 17 bp, Homo sapiens
cccagccctgtcctggt

SEQ ID NO: 292671 - DNA, 16 bp, Homo sapiens
cccagcccttctgcct

SEQ ID NO: 292672 - DNA, 18 bp, Homo sapiens
cccagcccttctgccttt

SEQ ID NO: 292673 - DNA, 17 bp, Homo sapiens
cccagccggggtggggt

SEQ ID NO: 292674 - DNA, 14 bp, Homo sapiens
cccagcctccaggc

SEQ ID NO: 292675 - DNA, 12 bp, Homo sapiens
cccagcctcccc

SEQ ID NO: 292676 - DNA, 17 bp, Homo sapiens
cccagcctcccccaggc

SEQ ID NO: 292677 - DNA, 20 bp, Homo sapiens
cccagcctcccccaggctgc

SEQ ID NO: 292678 - DNA, 23 bp, Homo sapiens
cccagcctctccccgctctggat

SEQ ID NO: 292679 - DNA, 15 bp, Homo sapiens
cccagcctgacctga

SEQ ID NO: 292680 - DNA, 19 bp, Homo sapiens
cccagcctgacctgagact

SEQ ID NO: 292681 - DNA, 15 bp, Homo sapiens
cccagcctgctgaga

SEQ ID NO: 292682 - DNA, 20 bp, Homo sapiens
cccagcctgctgagagcccc

SEQ ID NO: 292683 - DNA, 13 bp, Homo sapiens
cccagcctggccc

SEQ ID NO: 292684 - DNA, 15 bp, Homo sapiens
cccagcctggcccca

SEQ ID NO: 292685 - DNA, 21 bp, Homo sapiens
cccagcctgtcctggtacagc

SEQ ID NO: 292686 - DNA, 15 bp, Homo sapiens
cccagcgagtctgga

SEQ ID NO: 292687 - DNA, 20 bp, Homo sapiens
cccagcggcccctcccacac

SEQ ID NO: 292688 - DNA, 19 bp, Homo sapiens
cccagctaatctgtagggc

SEQ ID NO: 292689 - DNA, 20 bp, Homo sapiens
cccagctaatctgtagggct

SEQ ID NO: 292690 - DNA, 19 bp, Homo sapiens
cccagctacattcctcagc

SEQ ID NO: 292691 - DNA, 16 bp, Homo sapiens
cccagctactctgtcc

SEQ ID NO: 292692 - DNA, 18 bp, Homo sapiens
cccagctactctgtccag

SEQ ID NO: 292693 - DNA, 16 bp, Homo sapiens
cccagctacttgggaa

SEQ ID NO: 292694 - DNA, 18 bp, Homo sapiens
cccagctacttgggaagc

SEQ ID NO: 292695 - DNA, 19 bp, Homo sapiens
cccagctacttgggaagct

SEQ ID NO: 292696 - DNA, 17 bp, Homo sapiens
cccagctcaggggcagc

SEQ ID NO: 292697 - DNA, 17 bp, Homo sapiens
cccagctccactcaggg

SEQ ID NO: 292698 - DNA, 18 bp, Homo sapiens
cccagctccactcagggc

SEQ ID NO: 292699 - DNA, 22 bp, Homo sapiens
cccagctccactcagggctggc

SEQ ID NO: 292700 - DNA, 13 bp, Homo sapiens
cccagctccaggg

SEQ ID NO: 292701 - DNA, 14 bp, Homo sapiens
cccagctccagggg

SEQ ID NO: 292702 - DNA, 20 bp, Homo sapiens
cccagctccttttgtcccca

SEQ ID NO: 292703 - DNA, 9 bp, Homo sapiens
cccagctct

SEQ ID NO: 292704 - DNA, 14 bp, Homo sapiens
cccagctctagaca

SEQ ID NO: 292705 - DNA, 13 bp, Homo sapiens
cccagctctccca

SEQ ID NO: 292706 - DNA, 15 bp, Homo sapiens
cccagctctcccaca

SEQ ID NO: 292707 - DNA, 20 bp, Homo sapiens
cccagctcttctccccaggt

SEQ ID NO: 292708 - DNA, 17 bp, Homo sapiens
cccagctgactgtggcc

SEQ ID NO: 292709 - DNA, 13 bp, Homo sapiens
cccagctgctcct

SEQ ID NO: 292710 - DNA, 17 bp, Homo sapiens
cccagctgctcctcgca

SEQ ID NO: 292711 - DNA, 14 bp, Homo sapiens
cccagctgctctgc

SEQ ID NO: 292712 - DNA, 17 bp, Homo sapiens
cccagctgctctgccca

SEQ ID NO: 292713 - DNA, 20 bp, Homo sapiens
cccagctgctctgcccagag

SEQ ID NO: 292714 - DNA, 16 bp, Homo sapiens
cccagctggcagcgcc

SEQ ID NO: 292715 - DNA, 17 bp, Homo sapiens
cccagctggcagcgcct

SEQ ID NO: 292716 - DNA, 20 bp, Homo sapiens
cccagctggcagcgcctccc

SEQ ID NO: 292717 - DNA, 12 bp, Homo sapiens
cccagctggctg

SEQ ID NO: 292718 - DNA, 15 bp, Homo sapiens
cccagctggctgggt

SEQ ID NO: 292719 - DNA, 16 bp, Homo sapiens
cccagctggctgggtc

SEQ ID NO: 292720 - DNA, 23 bp, Homo sapiens
cccagctggctgggtcgcccctc

SEQ ID NO: 292721 - DNA, 12 bp, Homo sapiens
cccagctgggct

SEQ ID NO: 292722 - DNA, 22 bp, Homo sapiens
cccagctgggctgttggctggg

SEQ ID NO: 292723 - DNA, 23 bp, Homo sapiens
cccagctggtgtcactctgcctc

SEQ ID NO: 292724 - DNA, 14 bp, Homo sapiens
cccagctgtagcca

SEQ ID NO: 292725 - DNA, 16 bp, Homo sapiens
cccagctgtagccatg

SEQ ID NO: 292726 - DNA, 17 bp, Homo sapiens
cccagctgtagccatgg

SEQ ID NO: 292727 - DNA, 21 bp, Homo sapiens
cccagctgtagccatggctca

SEQ ID NO: 292728 - DNA, 12 bp, Homo sapiens
cccagctgtgac

SEQ ID NO: 292729 - DNA, 21 bp, Homo sapiens
cccagctgtgactgagggcct

SEQ ID NO: 292730 - DNA, 12 bp, Homo sapiens
cccagcttcctg

SEQ ID NO: 292731 - DNA, 23 bp, Homo sapiens
cccagcttgggcccagctgggct

SEQ ID NO: 292732 - DNA, 19 bp, Homo sapiens
cccagcttttcttgccagc

SEQ ID NO: 292733 - DNA, 23 bp, Homo sapiens
cccagcttttcttgccagctcag

SEQ ID NO: 292734 - DNA, 13 bp, Homo sapiens
cccaggaagcagg

SEQ ID NO: 292735 - DNA, 14 bp, Homo sapiens
cccaggaagcaggg

SEQ ID NO: 292736 - DNA, 12 bp, Homo sapiens
cccaggaaggga

SEQ ID NO: 292737 - DNA, 21 bp, Homo sapiens
cccaggaagtccagaacgtag

SEQ ID NO: 292738 - DNA, 13 bp, Homo sapiens
cccaggacaggaa

SEQ ID NO: 292739 - DNA, 14 bp, Homo sapiens
cccaggacaggaaa

SEQ ID NO: 292740 - DNA, 15 bp, Homo sapiens
cccaggacgcaggga

SEQ ID NO: 292741 - DNA, 17 bp, Homo sapiens
cccaggacgcagggaga

SEQ ID NO: 292742 - DNA, 15 bp, Homo sapiens
cccaggacgcttctg

SEQ ID NO: 292743 - DNA, 21 bp, Homo sapiens
cccaggagcggcgatgcactc

SEQ ID NO: 292744 - DNA, 22 bp, Homo sapiens
cccaggagctgagtcacctcct

SEQ ID NO: 292745 - DNA, 13 bp, Homo sapiens
cccaggaggacct

SEQ ID NO: 292746 - DNA, 16 bp, Homo sapiens
cccaggaggagagaga

SEQ ID NO: 292747 - DNA, 13 bp, Homo sapiens
cccaggaggggcc

SEQ ID NO: 292748 - DNA, 14 bp, Homo sapiens
cccaggaggggcct

SEQ ID NO: 292749 - DNA, 18 bp, Homo sapiens
cccaggaggggcctctga

SEQ ID NO: 292750 - DNA, 20 bp, Homo sapiens
cccaggagtttgagacaagc

SEQ ID NO: 292751 - DNA, 18 bp, Homo sapiens
cccaggatatttctgaga

SEQ ID NO: 292752 - DNA, 17 bp, Homo sapiens
cccaggatcccctgcta

SEQ ID NO: 292753 - DNA, 17 bp, Homo sapiens
cccaggcagcacctgga

SEQ ID NO: 292754 - DNA, 11 bp, Homo sapiens
cccaggcaggg

SEQ ID NO: 292755 - DNA, 13 bp, Homo sapiens
cccaggcagggag

SEQ ID NO: 292756 - DNA, 12 bp, Homo sapiens
cccaggccaggt

SEQ ID NO: 292757 - DNA, 19 bp, Homo sapiens
cccaggccataccaggtgc

SEQ ID NO: 292758 - DNA, 20 bp, Homo sapiens
cccaggccataccaggtgct

SEQ ID NO: 292759 - DNA, 13 bp, Homo sapiens
cccaggcccgaga

SEQ ID NO: 292760 - DNA, 13 bp, Homo sapiens
cccaggccctcca

SEQ ID NO: 292761 - DNA, 15 bp, Homo sapiens
cccaggccctccatg

SEQ ID NO: 292762 - DNA, 16 bp, Homo sapiens
cccaggccctccatgg

SEQ ID NO: 292763 - DNA, 15 bp, Homo sapiens
cccaggccgtggctg

SEQ ID NO: 292764 - DNA, 19 bp, Homo sapiens
cccaggcctccagcctctc

SEQ ID NO: 292765 - DNA, 15 bp, Homo sapiens
cccaggcctgcctgt

SEQ ID NO: 292766 - DNA, 11 bp, Homo sapiens
cccaggcctgg

SEQ ID NO: 292767 - DNA, 16 bp, Homo sapiens
cccaggcctggcctcg

SEQ ID NO: 292768 - DNA, 14 bp, Homo sapiens
cccaggctcccctg

SEQ ID NO: 292769 - DNA, 12 bp, Homo sapiens
cccaggctctgc

SEQ ID NO: 292770 - DNA, 13 bp, Homo sapiens
cccaggctgcact

SEQ ID NO: 292771 - DNA, 16 bp, Homo sapiens
cccaggctgcactgca

SEQ ID NO: 292772 - DNA, 19 bp, Homo sapiens
cccaggctgcactgcagtg

SEQ ID NO: 292773 - DNA, 19 bp, Homo sapiens
cccaggctgcgcctgcccg

SEQ ID NO: 292774 - DNA, 21 bp, Homo sapiens
cccaggctgcgcctgcccgcc

SEQ ID NO: 292775 - DNA, 17 bp, Homo sapiens
cccaggctggagtgcaa

SEQ ID NO: 292776 - DNA, 23 bp, Homo sapiens
ccccaaacattaatcaccaaagt

SEQ ID NO: 292777 - DNA, 15 bp, Homo sapiens
ccccaaaccccagcc

SEQ ID NO: 292778 - DNA, 20 bp, Homo sapiens
ccccaaaccccagccccaac

SEQ ID NO: 292779 - DNA, 12 bp, Homo sapiens
ccccaaaccctg

SEQ ID NO: 292780 - DNA, 23 bp, Homo sapiens
ccccaaaccctgcttctgctgcc

SEQ ID NO: 292781 - DNA, 18 bp, Homo sapiens
ccccaaactgtagtaatt

SEQ ID NO: 292782 - DNA, 14 bp, Homo sapiens
ccccaaagcccagc

SEQ ID NO: 292783 - DNA, 17 bp, Homo sapiens
ccccaaagcccagcccg

SEQ ID NO: 292784 - DNA, 16 bp, Homo sapiens
ccccaaagctttcctg

SEQ ID NO: 292785 - DNA, 18 bp, Homo sapiens
ccccaaagctttcctgcc

SEQ ID NO: 292786 - DNA, 14 bp, Homo sapiens
ccccaaaggcatcc

SEQ ID NO: 292787 - DNA, 16 bp, Homo sapiens
ccccaaattgccttca

SEQ ID NO: 292788 - DNA, 22 bp, Homo sapiens
ccccaaccactctttctttctc

SEQ ID NO: 292789 - DNA, 16 bp, Homo sapiens
ccccaaccccgcggtg

SEQ ID NO: 292790 - DNA, 14 bp, Homo sapiens
ccccaacctgctga

SEQ ID NO: 292791 - DNA, 16 bp, Homo sapiens
ccccaacgaaaagcac

SEQ ID NO: 292792 - DNA, 20 bp, Homo sapiens
ccccaacgaaaagcacatcc

SEQ ID NO: 292793 - DNA, 16 bp, Homo sapiens
ccccaacgtcccctcc

SEQ ID NO: 292794 - DNA, 11 bp, Homo sapiens
ccccaactccc

SEQ ID NO: 292795 - DNA, 14 bp, Homo sapiens
ccccaactcccagc

SEQ ID NO: 292796 - DNA, 15 bp, Homo sapiens
ccccaactccttcct

SEQ ID NO: 292797 - DNA, 16 bp, Homo sapiens
ccccaactctccccag

SEQ ID NO: 292798 - DNA, 17 bp, Homo sapiens
ccccaactctccccagt

SEQ ID NO: 292799 - DNA, 19 bp, Homo sapiens
ccccaacttaagtttagaa

SEQ ID NO: 292800 - DNA, 16 bp, Homo sapiens
ccccaagaaggctggg

SEQ ID NO: 292801 - DNA, 23 bp, Homo sapiens
ccccaagacttggtgtcctttcc

SEQ ID NO: 292802 - DNA, 16 bp, Homo sapiens
ccccaagaggctagcc

SEQ ID NO: 292803 - DNA, 20 bp, Homo sapiens
ccccaagaggctagccccag

SEQ ID NO: 292804 - DNA, 13 bp, Homo sapiens
ccccaagcagcca

SEQ ID NO: 292805 - DNA, 16 bp, Homo sapiens
ccccaaggggcagtct

SEQ ID NO: 292806 - DNA, 18 bp, Homo sapiens
ccccaaggggcagtctgg

SEQ ID NO: 292807 - DNA, 12 bp, Homo sapiens
ccccaataaaag

SEQ ID NO: 292808 - DNA, 22 bp, Homo sapiens
ccccaatatggtggccctgggg

SEQ ID NO: 292809 - DNA, 19 bp, Homo sapiens
ccccaatcgggtccagaga

SEQ ID NO: 292810 - DNA, 18 bp, Homo sapiens
ccccaattaactgaagca

SEQ ID NO: 292811 - DNA, 13 bp, Homo sapiens
ccccacacaggcc

SEQ ID NO: 292812 - DNA, 17 bp, Homo sapiens
ccccacacaggcctggc

SEQ ID NO: 292813 - DNA, 14 bp, Homo sapiens
ccccacacctcagt

SEQ ID NO: 292814 - DNA, 21 bp, Homo sapiens
ccccacacgccggggctggcc

SEQ ID NO: 292815 - DNA, 13 bp, Homo sapiens
ccccacacggact

SEQ ID NO: 292816 - DNA, 20 bp, Homo sapiens
ccccacacggactcccgggc

SEQ ID NO: 292817 - DNA, 13 bp, Homo sapiens
ccccacataccat

SEQ ID NO: 292818 - DNA, 14 bp, Homo sapiens
ccccaccaccccag

SEQ ID NO: 292819 - DNA, 14 bp, Homo sapiens
ccccaccagcagca

SEQ ID NO: 292820 - DNA, 13 bp, Homo sapiens
ccccaccagctcg

SEQ ID NO: 292821 - DNA, 19 bp, Homo sapiens
ccccaccattccacatccc

SEQ ID NO: 292822 - DNA, 19 bp, Homo sapiens
ccccacccaagcttggcag

SEQ ID NO: 292823 - DNA, 12 bp, Homo sapiens
ccccacccagga

SEQ ID NO: 292824 - DNA, 23 bp, Homo sapiens
ccccacccccgggtgcctgtgac

SEQ ID NO: 292825 - DNA, 12 bp, Homo sapiens
ccccacccctac

SEQ ID NO: 292826 - DNA, 19 bp, Homo sapiens
ccccacccctacagcctgc

SEQ ID NO: 292827 - DNA, 22 bp, Homo sapiens
ccccaccctcaaaccctgtggg

SEQ ID NO: 292828 - DNA, 21 bp, Homo sapiens
ccccaccctcgtggacacctg

SEQ ID NO: 292829 - DNA, 20 bp, Homo sapiens
ccccaccgaggttcccaggg

SEQ ID NO: 292830 - DNA, 23 bp, Homo sapiens
ccccaccgaggttcccagggctg

SEQ ID NO: 292831 - DNA, 13 bp, Homo sapiens
ccccacctctcca

SEQ ID NO: 292832 - DNA, 17 bp, Homo sapiens
ccccacctcttttccta

SEQ ID NO: 292833 - DNA, 13 bp, Homo sapiens
ccccacctgccac

SEQ ID NO: 292834 - DNA, 12 bp, Homo sapiens
ccccaccttccc

SEQ ID NO: 292835 - DNA, 14 bp, Homo sapiens
ccccacctttggga

SEQ ID NO: 292836 - DNA, 22 bp, Homo sapiens
ccccacgagtcacctgcaagcc

SEQ ID NO: 292837 - DNA, 23 bp, Homo sapiens
ccccacgagtcacctgcaagccc

SEQ ID NO: 292838 - DNA, 17 bp, Homo sapiens
ccccacggccctgtcag

SEQ ID NO: 292839 - DNA, 16 bp, Homo sapiens
ccccacggccgtccct

SEQ ID NO: 292840 - DNA, 21 bp, Homo sapiens
ccccacggggcctcgggacct

SEQ ID NO: 292841 - DNA, 12 bp, Homo sapiens
ccccactccctg

SEQ ID NO: 292842 - DNA, 13 bp, Homo sapiens
ccccactccctgc

SEQ ID NO: 292843 - DNA, 17 bp, Homo sapiens
ccccactccctgccacc

SEQ ID NO: 292844 - DNA, 18 bp, Homo sapiens
ccccactcctcctccagc

SEQ ID NO: 292845 - DNA, 20 bp, Homo sapiens
ccccactctgctcccagccc

SEQ ID NO: 292846 - DNA, 21 bp, Homo sapiens
ccccactgacagcctcccacc

SEQ ID NO: 292847 - DNA, 16 bp, Homo sapiens
ccccactgcctgccca

SEQ ID NO: 292848 - DNA, 15 bp, Homo sapiens
ccccactgggagagc

SEQ ID NO: 292849 - DNA, 22 bp, Homo sapiens
ccccactgtccccctacccacc

SEQ ID NO: 292850 - DNA, 22 bp, Homo sapiens
ccccacttatgctgctgtgaat

SEQ ID NO: 292851 - DNA, 14 bp, Homo sapiens
ccccagaaagcctc

SEQ ID NO: 292852 - DNA, 19 bp, Homo sapiens
ccccagaaagcctcctgcc

SEQ ID NO: 292853 - DNA, 19 bp, Homo sapiens
ccccagaaccccaactccc

SEQ ID NO: 292854 - DNA, 17 bp, Homo sapiens
ccccagaccccagggca

SEQ ID NO: 292855 - DNA, 10 bp, Homo sapiens
ccccagagac

SEQ ID NO: 292856 - DNA, 16 bp, Homo sapiens
ccccagagactgccca

SEQ ID NO: 292857 - DNA, 17 bp, Homo sapiens
ccccagagactgcccac

SEQ ID NO: 292858 - DNA, 12 bp, Homo sapiens
ccccagagccag

SEQ ID NO: 292859 - DNA, 15 bp, Homo sapiens
ccccagagccagggc

SEQ ID NO: 292860 - DNA, 22 bp, Homo sapiens
ccccagagccagggctgtcctt

SEQ ID NO: 292861 - DNA, 15 bp, Homo sapiens
ccccagagccccact

SEQ ID NO: 292862 - DNA, 11 bp, Homo sapiens
ccccagagctg

SEQ ID NO: 292863 - DNA, 16 bp, Homo sapiens
ccccagaggctcccaa

SEQ ID NO: 292864 - DNA, 16 bp, Homo sapiens
ccccagatctgcctgg

SEQ ID NO: 292865 - DNA, 17 bp, Homo sapiens
ccccagatctgcctggg

SEQ ID NO: 292866 - DNA, 22 bp, Homo sapiens
ccccagatctgcctgggcctgt

SEQ ID NO: 292867 - DNA, 16 bp, Homo sapiens
ccccagcattccagct

SEQ ID NO: 292868 - DNA, 18 bp, Homo sapiens
ccccagcattccagctct

SEQ ID NO: 292869 - DNA, 11 bp, Homo sapiens
ccccagccaag

SEQ ID NO: 292870 - DNA, 16 bp, Homo sapiens
ccccagccagcccttc

SEQ ID NO: 292871 - DNA, 23 bp, Homo sapiens
ccccagccagcccttccctggcc

SEQ ID NO: 292872 - DNA, 15 bp, Homo sapiens
ccccagcccaataaa

SEQ ID NO: 292873 - DNA, 18 bp, Homo sapiens
ccccagcccactggatca

SEQ ID NO: 292874 - DNA, 11 bp, Homo sapiens
ccccagcccag

SEQ ID NO: 292875 - DNA, 17 bp, Homo sapiens
ccccagcccagcccagc

SEQ ID NO: 292876 - DNA, 17 bp, Homo sapiens
ccccagccccctggccc

SEQ ID NO: 292877 - DNA, 14 bp, Homo sapiens
ccccagccccttct

SEQ ID NO: 292878 - DNA, 13 bp, Homo sapiens
ccccagccctgtg

SEQ ID NO: 292879 - DNA, 11 bp, Homo sapiens
ccccagccctt

SEQ ID NO: 292880 - DNA, 15 bp, Homo sapiens
ccccagcccttctgc

SEQ ID NO: 292881 - DNA, 10 bp, Homo sapiens
ccccagcctc

SEQ ID NO: 292882 - DNA, 18 bp, Homo sapiens
ccccagcctcccccaggc

SEQ ID NO: 292883 - DNA, 17 bp, Homo sapiens
ccccagcctgacctgag

SEQ ID NO: 292884 - DNA, 16 bp, Homo sapiens
ccccagcctggccacg

SEQ ID NO: 292885 - DNA, 22 bp, Homo sapiens
ccccagcctggccacgcagcca

SEQ ID NO: 292886 - DNA, 19 bp, Homo sapiens
ccccagcgagtctggagac

SEQ ID NO: 292887 - DNA, 17 bp, Homo sapiens
ccccagctcaggggcag

SEQ ID NO: 292888 - DNA, 16 bp, Homo sapiens
ccccagctggctgggt

SEQ ID NO: 292889 - DNA, 22 bp, Homo sapiens
ccccagctggctgggtcgcccc

SEQ ID NO: 292890 - DNA, 22 bp, Homo sapiens
ccccagctgtgactgagggcct

SEQ ID NO: 292891 - DNA, 18 bp, Homo sapiens
ccccagcttttcttgcca

SEQ ID NO: 292892 - DNA, 19 bp, Homo sapiens
ccccagcttttcttgccag

SEQ ID NO: 292893 - DNA, 22 bp, Homo sapiens
ccccagcttttcttgccagctc

SEQ ID NO: 292894 - DNA, 14 bp, Homo sapiens
ccccaggaccctga

SEQ ID NO: 292895 - DNA, 16 bp, Homo sapiens
ccccaggagctcaggt

SEQ ID NO: 292896 - DNA, 18 bp, Homo sapiens
ccccaggcaggctgtgcg

SEQ ID NO: 292897 - DNA, 23 bp, Homo sapiens
ccccaggcaggctgtgcgctgac

SEQ ID NO: 292898 - DNA, 23 bp, Homo sapiens
ccccaggcctgaaagaggctgag

SEQ ID NO: 292899 - DNA, 19 bp, Homo sapiens
ccccaggcggaggggcttg

SEQ ID NO: 292900 - DNA, 23 bp, Homo sapiens
ccccaggcggaggggcttggagc

SEQ ID NO: 292901 - DNA, 16 bp, Homo sapiens
ccccaggctcccctgg

SEQ ID NO: 292902 - DNA, 14 bp, Homo sapiens
ccccagggcagggt

SEQ ID NO: 292903 - DNA, 17 bp, Homo sapiens
ccccagggccctgctca

SEQ ID NO: 292904 - DNA, 22 bp, Homo sapiens
ccccaggggtcccagccacccc

SEQ ID NO: 292905 - DNA, 16 bp, Homo sapiens
ccccagggtcttccct

SEQ ID NO: 292906 - DNA, 13 bp, Homo sapiens
ccccagggtgagc

SEQ ID NO: 292907 - DNA, 19 bp, Homo sapiens
ccccgcgcgtgcccccagc

SEQ ID NO: 292908 - DNA, 12 bp, Homo sapiens
ccccgctctgga

SEQ ID NO: 292909 - DNA, 12 bp, Homo sapiens
ccccgctgcctg

SEQ ID NO: 292910 - DNA, 17 bp, Homo sapiens
ccccggacgctggctcg

SEQ ID NO: 292911 - DNA, 22 bp, Homo sapiens
ccccggaggcgcccacctgccc

SEQ ID NO: 292912 - DNA, 13 bp, Homo sapiens
ccccggcaggccc

SEQ ID NO: 292913 - DNA, 19 bp, Homo sapiens
ccccggccacgctccctct

SEQ ID NO: 292914 - DNA, 15 bp, Homo sapiens
ccccggcctccaggc

SEQ ID NO: 292915 - DNA, 16 bp, Homo sapiens
ccccgggctctctgct

SEQ ID NO: 292916 - DNA, 17 bp, Homo sapiens
ccccgggctctctgctg

SEQ ID NO: 292917 - DNA, 18 bp, Homo sapiens
ccccgggtttggcgggcc

SEQ ID NO: 292918 - DNA, 19 bp, Homo sapiens
ccccgggtttggcgggcca

SEQ ID NO: 292919 - DNA, 23 bp, Homo sapiens
ccccgggtttggcgggccaagga

SEQ ID NO: 292920 - DNA, 20 bp, Homo sapiens
ccccgtagccactctctgcc

SEQ ID NO: 292921 - DNA, 15 bp, Homo sapiens
ccccgtccctttccc

SEQ ID NO: 292922 - DNA, 14 bp, Homo sapiens
ccccgtctgcccct

SEQ ID NO: 292923 - DNA, 15 bp, Homo sapiens
ccccgtgcagactgg

SEQ ID NO: 292924 - DNA, 14 bp, Homo sapiens
ccccgtgcggcccg

SEQ ID NO: 292925 - DNA, 21 bp, Homo sapiens
ccccgttccctgtcagaggct

SEQ ID NO: 292926 - DNA, 13 bp, Homo sapiens
ccccgttttgggg

SEQ ID NO: 292927 - DNA, 22 bp, Homo sapiens
cccctaaagatggcgcacccgg

SEQ ID NO: 292928 - DNA, 13 bp, Homo sapiens
cccctaagtgccc

SEQ ID NO: 292929 - DNA, 14 bp, Homo sapiens
cccctaagtgccca

SEQ ID NO: 292930 - DNA, 14 bp, Homo sapiens
cccctacagcctgc

SEQ ID NO: 292931 - DNA, 13 bp, Homo sapiens
cccctacccaccg

SEQ ID NO: 292932 - DNA, 23 bp, Homo sapiens
cccctacccccttgtctgctgct

SEQ ID NO: 292933 - DNA, 18 bp, Homo sapiens
cccctagtatctggctgg

SEQ ID NO: 292934 - DNA, 19 bp, Homo sapiens
cccctagtatctggctggg

SEQ ID NO: 292935 - DNA, 15 bp, Homo sapiens
cccctatcctgcacc

SEQ ID NO: 292936 - DNA, 17 bp, Homo sapiens
cccctatcctgcaccct

SEQ ID NO: 292937 - DNA, 18 bp, Homo sapiens
cccctatcctgttcttcc

SEQ ID NO: 292938 - DNA, 21 bp, Homo sapiens
cccctcaagccaggagaccct

SEQ ID NO: 292939 - DNA, 21 bp, Homo sapiens
cccctcacccgctgcccagcc

SEQ ID NO: 292940 - DNA, 16 bp, Homo sapiens
cccctcaccctgcctt

SEQ ID NO: 292941 - DNA, 17 bp, Homo sapiens
cccctcagaacaccctg

SEQ ID NO: 292942 - DNA, 13 bp, Homo sapiens
cccctcagccctt

SEQ ID NO: 292943 - DNA, 23 bp, Homo sapiens
cccctcagcgctccctgtcgcct

SEQ ID NO: 292944 - DNA, 18 bp, Homo sapiens
cccctcatttatcactct

SEQ ID NO: 292945 - DNA, 14 bp, Homo sapiens
cccctccacatccc

SEQ ID NO: 292946 - DNA, 15 bp, Homo sapiens
cccctccagaccctg

SEQ ID NO: 292947 - DNA, 13 bp, Homo sapiens
cccctccagtgct

SEQ ID NO: 292948 - DNA, 23 bp, Homo sapiens
cccctccagtgcttggctgcccc

SEQ ID NO: 292949 - DNA, 12 bp, Homo sapiens
cccctccccaag

SEQ ID NO: 292950 - DNA, 13 bp, Homo sapiens
cccctccccaccc

SEQ ID NO: 292951 - DNA, 12 bp, Homo sapiens
cccctccccagt

SEQ ID NO: 292952 - DNA, 12 bp, Homo sapiens
cccctccccatg

SEQ ID NO: 292953 - DNA, 21 bp, Homo sapiens
cccctcccccaacccccaccc

SEQ ID NO: 292954 - DNA, 14 bp, Homo sapiens
cccctcccccgcag

SEQ ID NO: 292955 - DNA, 19 bp, Homo sapiens
cccctcccctggggacgcc

SEQ ID NO: 292956 - DNA, 17 bp, Homo sapiens
cccctccctacctcaac

SEQ ID NO: 292957 - DNA, 17 bp, Homo sapiens
cccctccctctgcccca

SEQ ID NO: 292958 - DNA, 16 bp, Homo sapiens
cccctccctgcctgct

SEQ ID NO: 292959 - DNA, 17 bp, Homo sapiens
cccctccctggcctgtt

SEQ ID NO: 292960 - DNA, 13 bp, Homo sapiens
cccctccctggct

SEQ ID NO: 292961 - DNA, 13 bp, Homo sapiens
cccctccctgggt

SEQ ID NO: 292962 - DNA, 14 bp, Homo sapiens
cccctccctgggtt

SEQ ID NO: 292963 - DNA, 18 bp, Homo sapiens
cccctccgccgtgccggc

SEQ ID NO: 292964 - DNA, 12 bp, Homo sapiens
cccctcctctgt

SEQ ID NO: 292965 - DNA, 17 bp, Homo sapiens
cccctcctctgtgctcc

SEQ ID NO: 292966 - DNA, 15 bp, Homo sapiens
cccctcctcttccct

SEQ ID NO: 292967 - DNA, 20 bp, Homo sapiens
cccctccttccctggtccag

SEQ ID NO: 292968 - DNA, 13 bp, Homo sapiens
cccctccttctcc

SEQ ID NO: 292969 - DNA, 16 bp, Homo sapiens
cccctccttctcccct

SEQ ID NO: 292970 - DNA, 14 bp, Homo sapiens
cccctcgcttcata

SEQ ID NO: 292971 - DNA, 18 bp, Homo sapiens
cccctcgtcctgtcccag

SEQ ID NO: 292972 - DNA, 17 bp, Homo sapiens
cccctctcccagttgtc

SEQ ID NO: 292973 - DNA, 13 bp, Homo sapiens
cccctctccctgg

SEQ ID NO: 292974 - DNA, 22 bp, Homo sapiens
cccctctcctgagcctgtctct

SEQ ID NO: 292975 - DNA, 13 bp, Homo sapiens
cccctctcgcccc

SEQ ID NO: 292976 - DNA, 12 bp, Homo sapiens
cccctctgccgg

SEQ ID NO: 292977 - DNA, 13 bp, Homo sapiens
cccctctgctgtc

SEQ ID NO: 292978 - DNA, 21 bp, Homo sapiens
cccctctgtcatcactccctg

SEQ ID NO: 292979 - DNA, 22 bp, Homo sapiens
cccctcttagcttacaggaagc

SEQ ID NO: 292980 - DNA, 20 bp, Homo sapiens
cccctcttcctggagcccca

SEQ ID NO: 292981 - DNA, 18 bp, Homo sapiens
cccctcttgagaggggtg

SEQ ID NO: 292982 - DNA, 12 bp, Homo sapiens
cccctcttgccc

SEQ ID NO: 292983 - DNA, 18 bp, Homo sapiens
cccctgacctcactgtga

SEQ ID NO: 292984 - DNA, 16 bp, Homo sapiens
cccctgacctgtccag

SEQ ID NO: 292985 - DNA, 15 bp, Homo sapiens
cccctgaggactgga

SEQ ID NO: 292986 - DNA, 16 bp, Homo sapiens
cccctgaggactggag

SEQ ID NO: 292987 - DNA, 21 bp, Homo sapiens
cccctgagtgggctgggccct

SEQ ID NO: 292988 - DNA, 15 bp, Homo sapiens
cccctgcacccaccc

SEQ ID NO: 292989 - DNA, 19 bp, Homo sapiens
cccctgcacccacccctgc

SEQ ID NO: 292990 - DNA, 16 bp, Homo sapiens
cccctgcactgtaaaa

SEQ ID NO: 292991 - DNA, 17 bp, Homo sapiens
cccctgcccctgcccga

SEQ ID NO: 292992 - DNA, 15 bp, Homo sapiens
cccctgccctgctgc

SEQ ID NO: 292993 - DNA, 13 bp, Homo sapiens
cccctgccctggt

SEQ ID NO: 292994 - DNA, 17 bp, Homo sapiens
cccctgccgcctgtgcc

SEQ ID NO: 292995 - DNA, 15 bp, Homo sapiens
cccctgccggccttg

SEQ ID NO: 292996 - DNA, 15 bp, Homo sapiens
cccctgcgcaggccc

SEQ ID NO: 292997 - DNA, 23 bp, Homo sapiens
cccctgcgccctccctccctcca

SEQ ID NO: 292998 - DNA, 22 bp, Homo sapiens
cccctgctactccactgacctg

SEQ ID NO: 292999 - DNA, 19 bp, Homo sapiens
cccctgctccatgggcacc

SEQ ID NO: 293000 - DNA, 17 bp, Homo sapiens
cccctgctcccagcctg

SEQ ID NO: 293001 - DNA, 23 bp, Homo sapiens
cccctgctgccgccactggctgt

SEQ ID NO: 293002 - DNA, 13 bp, Homo sapiens
cccctggaaccag

SEQ ID NO: 293003 - DNA, 16 bp, Homo sapiens
cccctggaccacacct

SEQ ID NO: 293004 - DNA, 19 bp, Homo sapiens
cccctggaccaccagcccc

SEQ ID NO: 293005 - DNA, 20 bp, Homo sapiens
cccctggaccaccagcccca

SEQ ID NO: 293006 - DNA, 11 bp, Homo sapiens
cccctggagcc

SEQ ID NO: 293007 - DNA, 21 bp, Homo sapiens
cccctggagccagcagggctg

SEQ ID NO: 293008 - DNA, 17 bp, Homo sapiens
cccctggagctcctgct

SEQ ID NO: 293009 - DNA, 22 bp, Homo sapiens
cccctggatgggcattgggctg

SEQ ID NO: 293010 - DNA, 15 bp, Homo sapiens
cccctggatgtcccc

SEQ ID NO: 293011 - DNA, 19 bp, Homo sapiens
cccctggcacctgggtgct

SEQ ID NO: 293012 - DNA, 19 bp, Homo sapiens
cccctggcacgtcctccac

SEQ ID NO: 293013 - DNA, 15 bp, Homo sapiens
cccctggcccatctc

SEQ ID NO: 293014 - DNA, 19 bp, Homo sapiens
cccctggcccatctcagcc

SEQ ID NO: 293015 - DNA, 20 bp, Homo sapiens
cccctggcccatctcagcct

SEQ ID NO: 293016 - DNA, 17 bp, Homo sapiens
cccctgggccacccttc

SEQ ID NO: 293017 - DNA, 18 bp, Homo sapiens
cccctgggccacccttca

SEQ ID NO: 293018 - DNA, 18 bp, Homo sapiens
cccctggggcttctcctg

SEQ ID NO: 293019 - DNA, 20 bp, Homo sapiens
cccctggggcttctcctgac

SEQ ID NO: 293020 - DNA, 18 bp, Homo sapiens
cccctggggggcacagcc

SEQ ID NO: 293021 - DNA, 21 bp, Homo sapiens
cccctggggggcacagccaga

SEQ ID NO: 293022 - DNA, 22 bp, Homo sapiens
cccctggggggcacagccagaa

SEQ ID NO: 293023 - DNA, 11 bp, Homo sapiens
cccctggtggc

SEQ ID NO: 293024 - DNA, 14 bp, Homo sapiens
cccctgtacccagc

SEQ ID NO: 293025 - DNA, 19 bp, Homo sapiens
cccctgtacccagccacct

SEQ ID NO: 293026 - DNA, 22 bp, Homo sapiens
cccctgtcccaccaactctgca

SEQ ID NO: 293027 - DNA, 14 bp, Homo sapiens
cccctgtcccattc

SEQ ID NO: 293028 - DNA, 12 bp, Homo sapiens
cccctgtcctga

SEQ ID NO: 293029 - DNA, 23 bp, Homo sapiens
cccctgtctgcgccgctgtgctg

SEQ ID NO: 293030 - DNA, 21 bp, Homo sapiens
cccctgtgcccacccagggcc

SEQ ID NO: 293031 - DNA, 22 bp, Homo sapiens
ccccttaagggttgaaggcagt

SEQ ID NO: 293032 - DNA, 12 bp, Homo sapiens
ccccttcccacg

SEQ ID NO: 293033 - DNA, 15 bp, Homo sapiens
ccccttcccctgctg

SEQ ID NO: 293034 - DNA, 14 bp, Homo sapiens
ccccttccctgcaa

SEQ ID NO: 293035 - DNA, 19 bp, Homo sapiens
ccccttcctgtctggccca

SEQ ID NO: 293036 - DNA, 21 bp, Homo sapiens
ccccttcctgtctggcccaaa

SEQ ID NO: 293037 - DNA, 14 bp, Homo sapiens
ccccttctctgctc

SEQ ID NO: 293038 - DNA, 20 bp, Homo sapiens
ccctccctacctcaacctgt

SEQ ID NO: 293039 - DNA, 21 bp, Homo sapiens
ccctccctatatgcacccctg

SEQ ID NO: 293040 - DNA, 13 bp, Homo sapiens
ccctccctcagcc

SEQ ID NO: 293041 - DNA, 16 bp, Homo sapiens
ccctccctcagcccct

SEQ ID NO: 293042 - DNA, 15 bp, Homo sapiens
ccctccctccctcca

SEQ ID NO: 293043 - DNA, 13 bp, Homo sapiens
ccctccctcctct

SEQ ID NO: 293044 - DNA, 16 bp, Homo sapiens
ccctccctcctggctc

SEQ ID NO: 293045 - DNA, 14 bp, Homo sapiens
ccctccctctccca

SEQ ID NO: 293046 - DNA, 13 bp, Homo sapiens
ccctccctctgct

SEQ ID NO: 293047 - DNA, 17 bp, Homo sapiens
ccctccctgcagggtag

SEQ ID NO: 293048 - DNA, 14 bp, Homo sapiens
ccctccctgcccct

SEQ ID NO: 293049 - DNA, 13 bp, Homo sapiens
ccctccctgcctg

SEQ ID NO: 293050 - DNA, 14 bp, Homo sapiens
ccctccctgcctgc

SEQ ID NO: 293051 - DNA, 15 bp, Homo sapiens
ccctccctgcctgct

SEQ ID NO: 293052 - DNA, 16 bp, Homo sapiens
ccctccctgcctgctc

SEQ ID NO: 293053 - DNA, 16 bp, Homo sapiens
ccctccctggctccca

SEQ ID NO: 293054 - DNA, 19 bp, Homo sapiens
ccctccctggctgtgagca

SEQ ID NO: 293055 - DNA, 21 bp, Homo sapiens
ccctcccttggaaacctgccc

SEQ ID NO: 293056 - DNA, 16 bp, Homo sapiens
ccctccgcgggggaca

SEQ ID NO: 293057 - DNA, 14 bp, Homo sapiens
ccctccgggcaggg

SEQ ID NO: 293058 - DNA, 22 bp, Homo sapiens
ccctccgggcaggggagccagg

SEQ ID NO: 293059 - DNA, 16 bp, Homo sapiens
ccctccgtccccaggg

SEQ ID NO: 293060 - DNA, 19 bp, Homo sapiens
ccctccgtccccagggtgc

SEQ ID NO: 293061 - DNA, 18 bp, Homo sapiens
ccctcctcacctctggac

SEQ ID NO: 293062 - DNA, 12 bp, Homo sapiens
ccctcctccagt

SEQ ID NO: 293063 - DNA, 13 bp, Homo sapiens
ccctcctcccatc

SEQ ID NO: 293064 - DNA, 18 bp, Homo sapiens
ccctcctcgctgtgccac

SEQ ID NO: 293065 - DNA, 20 bp, Homo sapiens
ccctcctctgagcagcctct

SEQ ID NO: 293066 - DNA, 23 bp, Homo sapiens
ccctcctcttcccttagcctctc

SEQ ID NO: 293067 - DNA, 18 bp, Homo sapiens
ccctcctgaaacttacac

SEQ ID NO: 293068 - DNA, 13 bp, Homo sapiens
ccctcctgcaggc

SEQ ID NO: 293069 - DNA, 17 bp, Homo sapiens
ccctcctggagcatccc

SEQ ID NO: 293070 - DNA, 14 bp, Homo sapiens
ccctcctggctcac

SEQ ID NO: 293071 - DNA, 17 bp, Homo sapiens
ccctcctgggcccaggc

SEQ ID NO: 293072 - DNA, 17 bp, Homo sapiens
ccctcctgttgccacac

SEQ ID NO: 293073 - DNA, 19 bp, Homo sapiens
ccctcctgttgccacactt

SEQ ID NO: 293074 - DNA, 12 bp, Homo sapiens
ccctccttccag

SEQ ID NO: 293075 - DNA, 13 bp, Homo sapiens
ccctccttccctg

SEQ ID NO: 293076 - DNA, 15 bp, Homo sapiens
ccctccttctcccct

SEQ ID NO: 293077 - DNA, 17 bp, Homo sapiens
ccctccttctcccctcc

SEQ ID NO: 293078 - DNA, 21 bp, Homo sapiens
ccctccttctcccctccagac

SEQ ID NO: 293079 - DNA, 16 bp, Homo sapiens
ccctccttcttgccct

SEQ ID NO: 293080 - DNA, 22 bp, Homo sapiens
ccctccttcttgccctgagctt

SEQ ID NO: 293081 - DNA, 16 bp, Homo sapiens
ccctccttgccacccc

SEQ ID NO: 293082 - DNA, 19 bp, Homo sapiens
ccctccttgccgctgggag

SEQ ID NO: 293083 - DNA, 17 bp, Homo sapiens
ccctccttgcctcctgt

SEQ ID NO: 293084 - DNA, 14 bp, Homo sapiens
ccctcctttgtctt

SEQ ID NO: 293085 - DNA, 24 bp, Homo sapiens
ccctcgaaccaaggcagcctccag

SEQ ID NO: 293086 - DNA, 13 bp, Homo sapiens
ccctcgctccggg

SEQ ID NO: 293087 - DNA, 13 bp, Homo sapiens
ccctcgctgctgc

SEQ ID NO: 293088 - DNA, 16 bp, Homo sapiens
ccctcgcttcataggc

SEQ ID NO: 293089 - DNA, 20 bp, Homo sapiens
ccctcgcttcataggcagag

SEQ ID NO: 293090 - DNA, 14 bp, Homo sapiens
ccctcggacccacc

SEQ ID NO: 293091 - DNA, 13 bp, Homo sapiens
ccctcggagcctg

SEQ ID NO: 293092 - DNA, 15 bp, Homo sapiens
ccctcggagcctgtg

SEQ ID NO: 293093 - DNA, 20 bp, Homo sapiens
ccctcggtcacctgtgctac

SEQ ID NO: 293094 - DNA, 14 bp, Homo sapiens
ccctcggtcagcac

SEQ ID NO: 293095 - DNA, 20 bp, Homo sapiens
ccctcggtcagcaccgtggt

SEQ ID NO: 293096 - DNA, 15 bp, Homo sapiens
ccctcggtcttcggc

SEQ ID NO: 293097 - DNA, 16 bp, Homo sapiens
ccctcgtcctgtccca

SEQ ID NO: 293098 - DNA, 17 bp, Homo sapiens
ccctcgtctccctggcc

SEQ ID NO: 293099 - DNA, 16 bp, Homo sapiens
ccctctcaggcatgcc

SEQ ID NO: 293100 - DNA, 21 bp, Homo sapiens
ccctctcaggcatgcctgtgt

SEQ ID NO: 293101 - DNA, 12 bp, Homo sapiens
ccctctccacac

SEQ ID NO: 293102 - DNA, 23 bp, Homo sapiens
ccctctccacacccatgactgcc

SEQ ID NO: 293103 - DNA, 19 bp, Homo sapiens
ccctctcctatgtggcagc

SEQ ID NO: 293104 - DNA, 19 bp, Homo sapiens
ccctctcctgagcctgtct

SEQ ID NO: 293105 - DNA, 22 bp, Homo sapiens
ccctctcctgagcctgtctctc

SEQ ID NO: 293106 - DNA, 15 bp, Homo sapiens
ccctctcctgcccag

SEQ ID NO: 293107 - DNA, 19 bp, Homo sapiens
ccctctcctgcccagatgc

SEQ ID NO: 293108 - DNA, 16 bp, Homo sapiens
ccctctcgccccatcc

SEQ ID NO: 293109 - DNA, 18 bp, Homo sapiens
ccctctctgtttaccctc

SEQ ID NO: 293110 - DNA, 17 bp, Homo sapiens
ccctctcttaccccgtc

SEQ ID NO: 293111 - DNA, 20 bp, Homo sapiens
ccctctgagcaactgtgcag

SEQ ID NO: 293112 - DNA, 21 bp, Homo sapiens
ccctctgagcaactgtgcagc

SEQ ID NO: 293113 - DNA, 15 bp, Homo sapiens
ccctctgcagggcag

SEQ ID NO: 293114 - DNA, 16 bp, Homo sapiens
ccctctgccccaagca

SEQ ID NO: 293115 - DNA, 15 bp, Homo sapiens
ccctctgcccccagc

SEQ ID NO: 293116 - DNA, 18 bp, Homo sapiens
ccctctgccgaccgcctg

SEQ ID NO: 293117 - DNA, 23 bp, Homo sapiens
ccctctgccgaccgcctgcttca

SEQ ID NO: 293118 - DNA, 20 bp, Homo sapiens
ccctctgctccgtgtgtctc

SEQ ID NO: 293119 - DNA, 13 bp, Homo sapiens
ccctctgctctca

SEQ ID NO: 293120 - DNA, 15 bp, Homo sapiens
ccctctgctctcata

SEQ ID NO: 293121 - DNA, 23 bp, Homo sapiens
ccctctgctggccgggcacagct

SEQ ID NO: 293122 - DNA, 12 bp, Homo sapiens
ccctctgctgtc

SEQ ID NO: 293123 - DNA, 17 bp, Homo sapiens
ccctctgctgtcctgca

SEQ ID NO: 293124 - DNA, 22 bp, Homo sapiens
ccctctggtccttctgacccca

SEQ ID NO: 293125 - DNA, 20 bp, Homo sapiens
ccctctgtagctccctcctc

SEQ ID NO: 293126 - DNA, 20 bp, Homo sapiens
ccctctgtcatcactccctg

SEQ ID NO: 293127 - DNA, 23 bp, Homo sapiens
ccctctgtcatcactccctggat

SEQ ID NO: 293128 - DNA, 17 bp, Homo sapiens
ccctctgtgcctaataa

SEQ ID NO: 293129 - DNA, 23 bp, Homo sapiens
ccctctgttcagtaacagggcct

SEQ ID NO: 293130 - DNA, 20 bp, Homo sapiens
ccctcttattgttcctctta

SEQ ID NO: 293131 - DNA, 13 bp, Homo sapiens
ccctcttcccagc

SEQ ID NO: 293132 - DNA, 12 bp, Homo sapiens
ccctcttccccc

SEQ ID NO: 293133 - DNA, 15 bp, Homo sapiens
ccctcttctcaagtg

SEQ ID NO: 293134 - DNA, 13 bp, Homo sapiens
ccctcttctctgg

SEQ ID NO: 293135 - DNA, 11 bp, Homo sapiens
ccctcttgaga

SEQ ID NO: 293136 - DNA, 17 bp, Homo sapiens
ccctctttcctgtgcca

SEQ ID NO: 293137 - DNA, 18 bp, Homo sapiens
ccctctttcctgtgccag

SEQ ID NO: 293138 - DNA, 19 bp, Homo sapiens
ccctctttcctgtgccagg

SEQ ID NO: 293139 - DNA, 17 bp, Homo sapiens
ccctctttctctctgtg

SEQ ID NO: 293140 - DNA, 22 bp, Homo sapiens
ccctctttctctctgtgtggca

SEQ ID NO: 293141 - DNA, 17 bp, Homo sapiens
ccctcttttggccttgt

SEQ ID NO: 293142 - DNA, 22 bp, Homo sapiens
ccctgaaactgagtctgtggac

SEQ ID NO: 293143 - DNA, 19 bp, Homo sapiens
ccctgaagctgtgcggagc

SEQ ID NO: 293144 - DNA, 15 bp, Homo sapiens
ccctgaagtcttgca

SEQ ID NO: 293145 - DNA, 20 bp, Homo sapiens
ccctgaatggttccatgcct

SEQ ID NO: 293146 - DNA, 15 bp, Homo sapiens
ccctgaattgtttga

SEQ ID NO: 293147 - DNA, 17 bp, Homo sapiens
ccctgaattgtttgata

SEQ ID NO: 293148 - DNA, 15 bp, Homo sapiens
ccctgaccctgcaga

SEQ ID NO: 293149 - DNA, 15 bp, Homo sapiens
ccctgacctcactgt

SEQ ID NO: 293150 - DNA, 15 bp, Homo sapiens
ccctgacctgtccag

SEQ ID NO: 293151 - DNA, 21 bp, Homo sapiens
ccctgaccttagcgttctgga

SEQ ID NO: 293152 - DNA, 14 bp, Homo sapiens
ccctgacttcccag

SEQ ID NO: 293153 - DNA, 15 bp, Homo sapiens
ccctgacttcccagc

SEQ ID NO: 293154 - DNA, 19 bp, Homo sapiens
ccctgacttcccagctggc

SEQ ID NO: 293155 - DNA, 16 bp, Homo sapiens
ccctgagaagcctcat

SEQ ID NO: 293156 - DNA, 19 bp, Homo sapiens
ccctgagactccagaatct

SEQ ID NO: 293157 - DNA, 16 bp, Homo sapiens
ccctgagagcatgtgg

SEQ ID NO: 293158 - DNA, 21 bp, Homo sapiens
ccctgagagcatgtgggggaa

SEQ ID NO: 293159 - DNA, 12 bp, Homo sapiens
ccctgagcctgc

SEQ ID NO: 293160 - DNA, 13 bp, Homo sapiens
ccctgagcctgcc

SEQ ID NO: 293161 - DNA, 21 bp, Homo sapiens
ccctgagcctgccccagctgg

SEQ ID NO: 293162 - DNA, 22 bp, Homo sapiens
ccctgaggaaggaggggaagct

SEQ ID NO: 293163 - DNA, 18 bp, Homo sapiens
ccctgaggactggagacc

SEQ ID NO: 293164 - DNA, 19 bp, Homo sapiens
ccctgatgcttaataaacg

SEQ ID NO: 293165 - DNA, 18 bp, Homo sapiens
ccctgcaaggcccacagg

SEQ ID NO: 293166 - DNA, 23 bp, Homo sapiens
ccctgcaatgtatcccttctcac

SEQ ID NO: 293167 - DNA, 16 bp, Homo sapiens
ccctgcacaagccagg

SEQ ID NO: 293168 - DNA, 15 bp, Homo sapiens
ccctgcacccacccc

SEQ ID NO: 293169 - DNA, 20 bp, Homo sapiens
ccctgggtcaccttcctggg

SEQ ID NO: 293170 - DNA, 23 bp, Homo sapiens
ccctgggttcagaaatgctgcct

SEQ ID NO: 293171 - DNA, 16 bp, Homo sapiens
ccctggtaggaaagca

SEQ ID NO: 293172 - DNA, 19 bp, Homo sapiens
ccctggtccagattgtagc

SEQ ID NO: 293173 - DNA, 18 bp, Homo sapiens
ccctggtccagggaagct

SEQ ID NO: 293174 - DNA, 13 bp, Homo sapiens
ccctggtgctgcc

SEQ ID NO: 293175 - DNA, 15 bp, Homo sapiens
ccctggtgctgccac

SEQ ID NO: 293176 - DNA, 21 bp, Homo sapiens
ccctggtgctgccacacttca

SEQ ID NO: 293177 - DNA, 21 bp, Homo sapiens
ccctggttctccatccccatg

SEQ ID NO: 293178 - DNA, 21 bp, Homo sapiens
ccctggttttaccccagctcc

SEQ ID NO: 293179 - DNA, 17 bp, Homo sapiens
ccctgtacccagccacc

SEQ ID NO: 293180 - DNA, 14 bp, Homo sapiens
ccctgtacccagct

SEQ ID NO: 293181 - DNA, 17 bp, Homo sapiens
ccctgtacccagctcct

SEQ ID NO: 293182 - DNA, 18 bp, Homo sapiens
ccctgtacctctctctgc

SEQ ID NO: 293183 - DNA, 19 bp, Homo sapiens
ccctgtagactagtgccgt

SEQ ID NO: 293184 - DNA, 17 bp, Homo sapiens
ccctgtatggagctaga

SEQ ID NO: 293185 - DNA, 14 bp, Homo sapiens
ccctgtatggcact

SEQ ID NO: 293186 - DNA, 23 bp, Homo sapiens
ccctgtattcccacccctggact

SEQ ID NO: 293187 - DNA, 13 bp, Homo sapiens
ccctgtcagaggc

SEQ ID NO: 293188 - DNA, 14 bp, Homo sapiens
ccctgtcagtgcag

SEQ ID NO: 293189 - DNA, 17 bp, Homo sapiens
ccctgtcagtgcagccc

SEQ ID NO: 293190 - DNA, 17 bp, Homo sapiens
ccctgtcccaccaactc

SEQ ID NO: 293191 - DNA, 18 bp, Homo sapiens
ccctgtcccattctagat

SEQ ID NO: 293192 - DNA, 21 bp, Homo sapiens
ccctgtccccctcccctccca

SEQ ID NO: 293193 - DNA, 12 bp, Homo sapiens
ccctgtcccctg

SEQ ID NO: 293194 - DNA, 12 bp, Homo sapiens
ccctgtccctgc

SEQ ID NO: 293195 - DNA, 18 bp, Homo sapiens
ccctgtccctgccccgcc

SEQ ID NO: 293196 - DNA, 16 bp, Homo sapiens
ccctgtccctgtcccc

SEQ ID NO: 293197 - DNA, 22 bp, Homo sapiens
ccctgtcctgatggtcagctcc

SEQ ID NO: 293198 - DNA, 22 bp, Homo sapiens
ccctgtccttcccacggccact

SEQ ID NO: 293199 - DNA, 16 bp, Homo sapiens
ccctgtcgagacactt

SEQ ID NO: 293200 - DNA, 20 bp, Homo sapiens
ccctgtcgagacacttgcct

SEQ ID NO: 293201 - DNA, 13 bp, Homo sapiens
ccctgtctccagg

SEQ ID NO: 293202 - DNA, 15 bp, Homo sapiens
ccctgtctccagggc

SEQ ID NO: 293203 - DNA, 23 bp, Homo sapiens
ccctgtctccagggcccccaccg

SEQ ID NO: 293204 - DNA, 18 bp, Homo sapiens
ccctgtcttccccacctt

SEQ ID NO: 293205 - DNA, 23 bp, Homo sapiens
ccctgtctttgctgtttatatat

SEQ ID NO: 293206 - DNA, 13 bp, Homo sapiens
ccctgtgcccacc

SEQ ID NO: 293207 - DNA, 18 bp, Homo sapiens
ccctgtggcaaatgccag

SEQ ID NO: 293208 - DNA, 23 bp, Homo sapiens
ccctgtggcaaatgccaggacag

SEQ ID NO: 293209 - DNA, 15 bp, Homo sapiens
ccctgtgggagtcca

SEQ ID NO: 293210 - DNA, 22 bp, Homo sapiens
ccctgtgggagtccactttcct

SEQ ID NO: 293211 - DNA, 23 bp, Homo sapiens
ccctgtggtaccctggcagagaa

SEQ ID NO: 293212 - DNA, 19 bp, Homo sapiens
ccctgtggtgatgtgcctg

SEQ ID NO: 293213 - DNA, 16 bp, Homo sapiens
ccctgtgtgggagggc

SEQ ID NO: 293214 - DNA, 23 bp, Homo sapiens
ccctgtgtgggagggcgaggcgg

SEQ ID NO: 293215 - DNA, 17 bp, Homo sapiens
ccctgtgttctgcacat

SEQ ID NO: 293216 - DNA, 13 bp, Homo sapiens
ccctgtgttgtct

SEQ ID NO: 293217 - DNA, 23 bp, Homo sapiens
ccctgtgttgtctctagagcagg

SEQ ID NO: 293218 - DNA, 17 bp, Homo sapiens
ccctgttatctgctaga

SEQ ID NO: 293219 - DNA, 23 bp, Homo sapiens
ccctgttgagtatttgctgtttg

SEQ ID NO: 293220 - DNA, 15 bp, Homo sapiens
ccctgttttctgttt

SEQ ID NO: 293221 - DNA, 14 bp, Homo sapiens
cccttaaaatagaa

SEQ ID NO: 293222 - DNA, 13 bp, Homo sapiens
cccttaccttccc

SEQ ID NO: 293223 - DNA, 17 bp, Homo sapiens
cccttacgtgagtcctg

SEQ ID NO: 293224 - DNA, 20 bp, Homo sapiens
cccttagagattgccccaga

SEQ ID NO: 293225 - DNA, 21 bp, Homo sapiens
cccttagagattgccccagag

SEQ ID NO: 293226 - DNA, 14 bp, Homo sapiens
cccttagcctccct

SEQ ID NO: 293227 - DNA, 18 bp, Homo sapiens
cccttagcctctcccacc

SEQ ID NO: 293228 - DNA, 20 bp, Homo sapiens
cccttagccttgctgtagag

SEQ ID NO: 293229 - DNA, 17 bp, Homo sapiens
cccttcacgctggcttc

SEQ ID NO: 293230 - DNA, 15 bp, Homo sapiens
cccttcactgccatg

SEQ ID NO: 293231 - DNA, 17 bp, Homo sapiens
cccttcacttctgacca

SEQ ID NO: 293232 - DNA, 22 bp, Homo sapiens
cccttcacttctgaccacactt

SEQ ID NO: 293233 - DNA, 23 bp, Homo sapiens
cccttcacttctgaccacacttc

SEQ ID NO: 293234 - DNA, 19 bp, Homo sapiens
cccttcaggacccttctac

SEQ ID NO: 293235 - DNA, 15 bp, Homo sapiens
cccttcatctccagg

SEQ ID NO: 293236 - DNA, 18 bp, Homo sapiens
cccttcatctccagggag

SEQ ID NO: 293237 - DNA, 14 bp, Homo sapiens
cccttccacctcac

SEQ ID NO: 293238 - DNA, 21 bp, Homo sapiens
cccttccacctcacaactcct

SEQ ID NO: 293239 - DNA, 12 bp, Homo sapiens
cccttccactgc

SEQ ID NO: 293240 - DNA, 13 bp, Homo sapiens
cccttccactgcc

SEQ ID NO: 293241 - DNA, 14 bp, Homo sapiens
cccttccactgcct

SEQ ID NO: 293242 - DNA, 17 bp, Homo sapiens
cccttccaggccatcag

SEQ ID NO: 293243 - DNA, 23 bp, Homo sapiens
cccttccaggccatcagaggcct

SEQ ID NO: 293244 - DNA, 20 bp, Homo sapiens
cccttccatgtcgcctctgc

SEQ ID NO: 293245 - DNA, 15 bp, Homo sapiens
cccttcccaggccag

SEQ ID NO: 293246 - DNA, 16 bp, Homo sapiens
cccttcccaggccagc

SEQ ID NO: 293247 - DNA, 14 bp, Homo sapiens
cccttcccagtggg

SEQ ID NO: 293248 - DNA, 13 bp, Homo sapiens
cccttccccactc

SEQ ID NO: 293249 - DNA, 14 bp, Homo sapiens
cccttccccactcc

SEQ ID NO: 293250 - DNA, 15 bp, Homo sapiens
cccttccccactccc

SEQ ID NO: 293251 - DNA, 18 bp, Homo sapiens
cccttccccactcccgtg

SEQ ID NO: 293252 - DNA, 17 bp, Homo sapiens
cccttccccactctgct

SEQ ID NO: 293253 - DNA, 12 bp, Homo sapiens
cccttccccatt

SEQ ID NO: 293254 - DNA, 15 bp, Homo sapiens
cccttccctctgttg

SEQ ID NO: 293255 - DNA, 13 bp, Homo sapiens
cccttccctgcaa

SEQ ID NO: 293256 - DNA, 12 bp, Homo sapiens
cccttcctcctg

SEQ ID NO: 293257 - DNA, 22 bp, Homo sapiens
cccttcctcctgaagcctctgc

SEQ ID NO: 293258 - DNA, 22 bp, Homo sapiens
cccttcctggactggcccttgc

SEQ ID NO: 293259 - DNA, 14 bp, Homo sapiens
cccttcctggcctc

SEQ ID NO: 293260 - DNA, 15 bp, Homo sapiens
cccttcctggcctca

SEQ ID NO: 293261 - DNA, 18 bp, Homo sapiens
cccttcctggcctcactg

SEQ ID NO: 293262 - DNA, 21 bp, Homo sapiens
cccttcctggcctcactggct

SEQ ID NO: 293263 - DNA, 24 bp, Homo sapiens
cccttcctggcctcactggctggg

SEQ ID NO: 293264 - DNA, 17 bp, Homo sapiens
cccttcctgtccgccct

SEQ ID NO: 293265 - DNA, 16 bp, Homo sapiens
cccttcctgtcctgct

SEQ ID NO: 293266 - DNA, 14 bp, Homo sapiens
cccttcgtgtgtgc

SEQ ID NO: 293267 - DNA, 14 bp, Homo sapiens
cccttctacactct

SEQ ID NO: 293268 - DNA, 18 bp, Homo sapiens
cccttctactttttcctt

SEQ ID NO: 293269 - DNA, 19 bp, Homo sapiens
cccttctactttttccttc

SEQ ID NO: 293270 - DNA, 20 bp, Homo sapiens
cccttctactttttccttcc

SEQ ID NO: 293271 - DNA, 16 bp, Homo sapiens
cccttctcccctgcac

SEQ ID NO: 293272 - DNA, 16 bp, Homo sapiens
cccttctcccctgccc

SEQ ID NO: 293273 - DNA, 14 bp, Homo sapiens
cccttctctgctcc

SEQ ID NO: 293274 - DNA, 16 bp, Homo sapiens
cccttctctgctccac

SEQ ID NO: 293275 - DNA, 23 bp, Homo sapiens
cccttctctgtagggaactctgg

SEQ ID NO: 293276 - DNA, 12 bp, Homo sapiens
cccttctgcctt

SEQ ID NO: 293277 - DNA, 12 bp, Homo sapiens
cccttctgcttt

SEQ ID NO: 293278 - DNA, 18 bp, Homo sapiens
cccttctgctttctatta

SEQ ID NO: 293279 - DNA, 12 bp, Homo sapiens
cccttctgggca

SEQ ID NO: 293280 - DNA, 16 bp, Homo sapiens
cccttctgtctgtaag

SEQ ID NO: 293281 - DNA, 15 bp, Homo sapiens
cccttctgtgcccag

SEQ ID NO: 293282 - DNA, 17 bp, Homo sapiens
cccttctgtgcccagct

SEQ ID NO: 293283 - DNA, 20 bp, Homo sapiens
cccttctgtgcccagctcag

SEQ ID NO: 293284 - DNA, 21 bp, Homo sapiens
cccttcttggtgcttacacat

SEQ ID NO: 293285 - DNA, 22 bp, Homo sapiens
cccttcttttgaccccttcctg

SEQ ID NO: 293286 - DNA, 23 bp, Homo sapiens
cccttgaagaggggaggggccta

SEQ ID NO: 293287 - DNA, 16 bp, Homo sapiens
cccttgaatctgcagg

SEQ ID NO: 293288 - DNA, 14 bp, Homo sapiens
cccttgaccccaca

SEQ ID NO: 293289 - DNA, 14 bp, Homo sapiens
cccttgagaaacct

SEQ ID NO: 293290 - DNA, 14 bp, Homo sapiens
cccttgcacaggcc

SEQ ID NO: 293291 - DNA, 15 bp, Homo sapiens
cccttgcacaggcca

SEQ ID NO: 293292 - DNA, 20 bp, Homo sapiens
cccttgcacaggccacttgc

SEQ ID NO: 293293 - DNA, 22 bp, Homo sapiens
cccttgcactaaagtatgtaaa

SEQ ID NO: 293294 - DNA, 16 bp, Homo sapiens
cccttgcagctagttt

SEQ ID NO: 293295 - DNA, 19 bp, Homo sapiens
cccttgcagctagttttct

SEQ ID NO: 293296 - DNA, 15 bp, Homo sapiens
cccttgccaaggccg

SEQ ID NO: 293297 - DNA, 18 bp, Homo sapiens
cccttgcccccatccctc

SEQ ID NO: 293298 - DNA, 18 bp, Homo sapiens
cccttgcccgccagccag

SEQ ID NO: 293299 - DNA, 21 bp, Homo sapiens
ccgggaccacagctgctggcc

SEQ ID NO: 293300 - DNA, 11 bp, Homo sapiens
ccgggagctgg

SEQ ID NO: 293301 - DNA, 12 bp, Homo sapiens
ccgggagctggt

SEQ ID NO: 293302 - DNA, 20 bp, Homo sapiens
ccgggagctggtgacagcct

SEQ ID NO: 293303 - DNA, 21 bp, Homo sapiens
ccgggatgcgcctgatcacca

SEQ ID NO: 293304 - DNA, 11 bp, Homo sapiens
ccgggcagggg

SEQ ID NO: 293305 - DNA, 17 bp, Homo sapiens
ccgggcaggggagccag

SEQ ID NO: 293306 - DNA, 20 bp, Homo sapiens
ccgggcccagaggagctggg

SEQ ID NO: 293307 - DNA, 13 bp, Homo sapiens
ccgggccctccct

SEQ ID NO: 293308 - DNA, 18 bp, Homo sapiens
ccgggccctcccttggaa

SEQ ID NO: 293309 - DNA, 17 bp, Homo sapiens
ccgggccctctgtagct

SEQ ID NO: 293310 - DNA, 18 bp, Homo sapiens
ccgggccctctgtagctc

SEQ ID NO: 293311 - DNA, 23 bp, Homo sapiens
ccgggcccttcagtccctgagca

SEQ ID NO: 293312 - DNA, 19 bp, Homo sapiens
ccgggcctggagaactaga

SEQ ID NO: 293313 - DNA, 17 bp, Homo sapiens
ccgggcctgggcctcct

SEQ ID NO: 293314 - DNA, 13 bp, Homo sapiens
ccgggctctctgc

SEQ ID NO: 293315 - DNA, 23 bp, Homo sapiens
ccgggctgctgctgatgtaggag

SEQ ID NO: 293316 - DNA, 13 bp, Homo sapiens
ccggggaggagcc

SEQ ID NO: 293317 - DNA, 14 bp, Homo sapiens
ccggggaggagcct

SEQ ID NO: 293318 - DNA, 20 bp, Homo sapiens
ccggggcactggctgctctg

SEQ ID NO: 293319 - DNA, 19 bp, Homo sapiens
ccggggcagctgccagaga

SEQ ID NO: 293320 - DNA, 15 bp, Homo sapiens
ccggggcagctggca

SEQ ID NO: 293321 - DNA, 21 bp, Homo sapiens
ccggggcatggacagggccag

SEQ ID NO: 293322 - DNA, 13 bp, Homo sapiens
ccggggctggccc

SEQ ID NO: 293323 - DNA, 17 bp, Homo sapiens
ccggggctggccctgcc

SEQ ID NO: 293324 - DNA, 19 bp, Homo sapiens
ccggggggagcaggaggag

SEQ ID NO: 293325 - DNA, 19 bp, Homo sapiens
ccgggggtgggggcctgct

SEQ ID NO: 293326 - DNA, 14 bp, Homo sapiens
ccggggtctgtgct

SEQ ID NO: 293327 - DNA, 18 bp, Homo sapiens
ccggggtctgtgctgtgc

SEQ ID NO: 293328 - DNA, 16 bp, Homo sapiens
ccgggtgccattccca

SEQ ID NO: 293329 - DNA, 15 bp, Homo sapiens
ccgggtgcctgtgac

SEQ ID NO: 293330 - DNA, 19 bp, Homo sapiens
ccgggtgggcctggcctga

SEQ ID NO: 293331 - DNA, 21 bp, Homo sapiens
ccgggtgggcctggcctgagc

SEQ ID NO: 293332 - DNA, 16 bp, Homo sapiens
ccgggtgtggcacgca

SEQ ID NO: 293333 - DNA, 21 bp, Homo sapiens
ccgggttcacgccattctcct

SEQ ID NO: 293334 - DNA, 17 bp, Homo sapiens
ccgggttctagtctcct

SEQ ID NO: 293335 - DNA, 14 bp, Homo sapiens
ccgggttggaggcc

SEQ ID NO: 293336 - DNA, 16 bp, Homo sapiens
ccgggttggaggcctc

SEQ ID NO: 293337 - DNA, 20 bp, Homo sapiens
ccgggtttggcgggccaagg

SEQ ID NO: 293338 - DNA, 13 bp, Homo sapiens
ccggtcccaggcc

SEQ ID NO: 293339 - DNA, 15 bp, Homo sapiens
ccggtcccaggccgc

SEQ ID NO: 293340 - DNA, 23 bp, Homo sapiens
ccggtcccggctgacacctccct

SEQ ID NO: 293341 - DNA, 22 bp, Homo sapiens
ccggtgcatgcaggtctccatg

SEQ ID NO: 293342 - DNA, 21 bp, Homo sapiens
ccggtgcccacctaagggcta

SEQ ID NO: 293343 - DNA, 15 bp, Homo sapiens
ccggtggaaggcctt

SEQ ID NO: 293344 - DNA, 23 bp, Homo sapiens
ccggtgtggccctgcaagggcgt

SEQ ID NO: 293345 - DNA, 15 bp, Homo sapiens
ccggttgcttctggg

SEQ ID NO: 293346 - DNA, 19 bp, Homo sapiens
ccgtaccatcggtcagcag

SEQ ID NO: 293347 - DNA, 13 bp, Homo sapiens
ccgtagccactct

SEQ ID NO: 293348 - DNA, 19 bp, Homo sapiens
ccgtagccactctctgccc

SEQ ID NO: 293349 - DNA, 20 bp, Homo sapiens
ccgtagccactctctgccca

SEQ ID NO: 293350 - DNA, 14 bp, Homo sapiens
ccgtaggcagcctc

SEQ ID NO: 293351 - DNA, 12 bp, Homo sapiens
ccgtatttattt

SEQ ID NO: 293352 - DNA, 23 bp, Homo sapiens
ccgtcacccttggtagagtttat

SEQ ID NO: 293353 - DNA, 12 bp, Homo sapiens
ccgtcacgcttt

SEQ ID NO: 293354 - DNA, 17 bp, Homo sapiens
ccgtccacccaggctgc

SEQ ID NO: 293355 - DNA, 15 bp, Homo sapiens
ccgtccatggcacca

SEQ ID NO: 293356 - DNA, 13 bp, Homo sapiens
ccgtccccagggt

SEQ ID NO: 293357 - DNA, 20 bp, Homo sapiens
ccgtcccctgggccaccctt

SEQ ID NO: 293358 - DNA, 18 bp, Homo sapiens
ccgtccctctgccttgca

SEQ ID NO: 293359 - DNA, 13 bp, Homo sapiens
ccgtccctttccc

SEQ ID NO: 293360 - DNA, 12 bp, Homo sapiens
ccgtccgcccgc

SEQ ID NO: 293361 - DNA, 13 bp, Homo sapiens
ccgtccgcccgcc

SEQ ID NO: 293362 - DNA, 15 bp, Homo sapiens
ccgtccgcccgccca

SEQ ID NO: 293363 - DNA, 17 bp, Homo sapiens
ccgtccgcccgcccacc

SEQ ID NO: 293364 - DNA, 18 bp, Homo sapiens
ccgtccgcccgcccaccc

SEQ ID NO: 293365 - DNA, 14 bp, Homo sapiens
ccgtcctcccgggc

SEQ ID NO: 293366 - DNA, 18 bp, Homo sapiens
ccgtcctggactctgtgt

SEQ ID NO: 293367 - DNA, 21 bp, Homo sapiens
ccgtcctggcagggcaggcag

SEQ ID NO: 293368 - DNA, 19 bp, Homo sapiens
ccgtcggactgcccccaga

SEQ ID NO: 293369 - DNA, 13 bp, Homo sapiens
ccgtctcctctcc

SEQ ID NO: 293370 - DNA, 16 bp, Homo sapiens
ccgtctcctctccagc

SEQ ID NO: 293371 - DNA, 22 bp, Homo sapiens
ccgtctcctgccgggcaggtcc

SEQ ID NO: 293372 - DNA, 14 bp, Homo sapiens
ccgtctctgtcccg

SEQ ID NO: 293373 - DNA, 22 bp, Homo sapiens
ccgtcttggggctcgccccacc

SEQ ID NO: 293374 - DNA, 13 bp, Homo sapiens
ccgtgagacacaa

SEQ ID NO: 293375 - DNA, 21 bp, Homo sapiens
ccgtgagcaggaaggcctggg

SEQ ID NO: 293376 - DNA, 13 bp, Homo sapiens
ccgtgagcaggct

SEQ ID NO: 293377 - DNA, 14 bp, Homo sapiens
ccgtgagcaggctt

SEQ ID NO: 293378 - DNA, 21 bp, Homo sapiens
ccgtgagcgccccgcccccac

SEQ ID NO: 293379 - DNA, 16 bp, Homo sapiens
ccgtgatttggaagag

SEQ ID NO: 293380 - DNA, 13 bp, Homo sapiens
ccgtgcagactgg

SEQ ID NO: 293381 - DNA, 16 bp, Homo sapiens
ccgtgcagtacaggca

SEQ ID NO: 293382 - DNA, 14 bp, Homo sapiens
ccgtgcatggctcc

SEQ ID NO: 293383 - DNA, 19 bp, Homo sapiens
ccgtgcatggctcctgtct

SEQ ID NO: 293384 - DNA, 19 bp, Homo sapiens
ccgtgccaaatcctgggca

SEQ ID NO: 293385 - DNA, 17 bp, Homo sapiens
ccgtgcccgcccacctc

SEQ ID NO: 293386 - DNA, 21 bp, Homo sapiens
ccgtgcccgcccacctctgct

SEQ ID NO: 293387 - DNA, 23 bp, Homo sapiens
ccgtgccggcggcagccccactt

SEQ ID NO: 293388 - DNA, 19 bp, Homo sapiens
ccgtgcctgcattcgcagc

SEQ ID NO: 293389 - DNA, 14 bp, Homo sapiens
ccgtgccttcagct

SEQ ID NO: 293390 - DNA, 16 bp, Homo sapiens
ccgtgccttcagctct

SEQ ID NO: 293391 - DNA, 21 bp, Homo sapiens
ccgtggacagcccgccgtcag

SEQ ID NO: 293392 - DNA, 23 bp, Homo sapiens
ccgtggagatgggatgcttgcct

SEQ ID NO: 293393 - DNA, 22 bp, Homo sapiens
ccgtggattgcacgtggcctct

SEQ ID NO: 293394 - DNA, 18 bp, Homo sapiens
ccgtggccccgccctcag

SEQ ID NO: 293395 - DNA, 19 bp, Homo sapiens
ccgtgggcactgaaggctt

SEQ ID NO: 293396 - DNA, 15 bp, Homo sapiens
ccgtgggccatggca

SEQ ID NO: 293397 - DNA, 21 bp, Homo sapiens
ccgtggtgtgaggcccccgga

SEQ ID NO: 293398 - DNA, 23 bp, Homo sapiens
ccgtggtgtgaggcccccggagg

SEQ ID NO: 293399 - DNA, 15 bp, Homo sapiens
ccgtgtcccaaggag

SEQ ID NO: 293400 - DNA, 17 bp, Homo sapiens
ccgtgtcccaaggagct

SEQ ID NO: 293401 - DNA, 14 bp, Homo sapiens
ccgtgtccccccag

SEQ ID NO: 293402 - DNA, 18 bp, Homo sapiens
ccgtgtccccccaggtgc

SEQ ID NO: 293403 - DNA, 19 bp, Homo sapiens
ccgttaggaataacactgc

SEQ ID NO: 293404 - DNA, 13 bp, Homo sapiens
ccgttcacttccc

SEQ ID NO: 293405 - DNA, 17 bp, Homo sapiens
ccgttcatctgaggagt

SEQ ID NO: 293406 - DNA, 20 bp, Homo sapiens
ccgttcatctgaggagtcca

SEQ ID NO: 293407 - DNA, 21 bp, Homo sapiens
ccgttcatctgaggagtccaa

SEQ ID NO: 293408 - DNA, 18 bp, Homo sapiens
ccgttcccacctctgagg

SEQ ID NO: 293409 - DNA, 15 bp, Homo sapiens
ccgttgccgggcctg

SEQ ID NO: 293410 - DNA, 17 bp, Homo sapiens
ccgttgccgggcctgga

SEQ ID NO: 293411 - DNA, 20 bp, Homo sapiens
ccgttgccgggcctggactg

SEQ ID NO: 293412 - DNA, 13 bp, Homo sapiens
ccgttgctttcgt

SEQ ID NO: 293413 - DNA, 14 bp, Homo sapiens
ccgtttccaagcct

SEQ ID NO: 293414 - DNA, 18 bp, Homo sapiens
ccgttttcatcctggcct

SEQ ID NO: 293415 - DNA, 23 bp, Homo sapiens
cctaaaaggaaatctcaccccat

SEQ ID NO: 293416 - DNA, 16 bp, Homo sapiens
cctaaagaaaaagata

SEQ ID NO: 293417 - DNA, 15 bp, Homo sapiens
cctaaagcagccagc

SEQ ID NO: 293418 - DNA, 13 bp, Homo sapiens
cctaacttaacat

SEQ ID NO: 293419 - DNA, 13 bp, Homo sapiens
cctaacttattgc

SEQ ID NO: 293420 - DNA, 13 bp, Homo sapiens
cctaactttcttg

SEQ ID NO: 293421 - DNA, 12 bp, Homo sapiens
cctaagaaaaag

SEQ ID NO: 293422 - DNA, 16 bp, Homo sapiens
cctaagaaaaaggaaa

SEQ ID NO: 293423 - DNA, 14 bp, Homo sapiens
cctaagaattccca

SEQ ID NO: 293424 - DNA, 18 bp, Homo sapiens
cctaagaattcccagata

SEQ ID NO: 293425 - DNA, 22 bp, Homo sapiens
cctaagcagtgcttgtaaacca

SEQ ID NO: 293426 - DNA, 18 bp, Homo sapiens
cctaagccactcccgcca

SEQ ID NO: 293427 - DNA, 12 bp, Homo sapiens
cctaagcctgtt

SEQ ID NO: 293428 - DNA, 16 bp, Homo sapiens
cctaagctccaggtgc

SEQ ID NO: 293429 - DNA, 17 bp, Homo sapiens
cctaagctccaggtgcc

SEQ ID NO: 293430 - DNA, 24 bp, Homo sapiens
cctattgctgtaaataaaaatagc

SEQ ID NO: 293431 - DNA, 16 bp, Homo sapiens
cctattgtaaatacaa

SEQ ID NO: 293432 - DNA, 13 bp, Homo sapiens
cctatttaagccc

SEQ ID NO: 293433 - DNA, 19 bp, Homo sapiens
cctatttactggaaacctg

SEQ ID NO: 293434 - DNA, 13 bp, Homo sapiens
cctatttgactgc

SEQ ID NO: 293435 - DNA, 20 bp, Homo sapiens
cctattttggacgtgtgagg

SEQ ID NO: 293436 - DNA, 14 bp, Homo sapiens
cctatttttcagaa

SEQ ID NO: 293437 - DNA, 12 bp, Homo sapiens
cctcaaaagaaa

SEQ ID NO: 293438 - DNA, 13 bp, Homo sapiens
cctcaaagctttt

SEQ ID NO: 293439 - DNA, 19 bp, Homo sapiens
cctcaaatgggtctggggg

SEQ ID NO: 293440 - DNA, 22 bp, Homo sapiens
cctcaacaaagaagaaccatct

SEQ ID NO: 293441 - DNA, 15 bp, Homo sapiens
cctcaacaagggaga

SEQ ID NO: 293442 - DNA, 18 bp, Homo sapiens
cctcaacaagggagagac

SEQ ID NO: 293443 - DNA, 22 bp, Homo sapiens
cctcaacaagggagagacctca

SEQ ID NO: 293444 - DNA, 16 bp, Homo sapiens
cctcaaccctccctca

SEQ ID NO: 293445 - DNA, 15 bp, Homo sapiens
cctcaagagaaggca

SEQ ID NO: 293446 - DNA, 17 bp, Homo sapiens
cctcaagatgaaggcaa

SEQ ID NO: 293447 - DNA, 24 bp, Homo sapiens
cctcaagcaaggaagcagagcact

SEQ ID NO: 293448 - DNA, 22 bp, Homo sapiens
cctcaagccaggagaccctgtc

SEQ ID NO: 293449 - DNA, 20 bp, Homo sapiens
cctcaaggacttgaaagcat

SEQ ID NO: 293450 - DNA, 21 bp, Homo sapiens
cctcaaggacttgaaagcatc

SEQ ID NO: 293451 - DNA, 22 bp, Homo sapiens
cctcaaggacttgaaagcatcc

SEQ ID NO: 293452 - DNA, 19 bp, Homo sapiens
cctcaagggggactgtctt

SEQ ID NO: 293453 - DNA, 15 bp, Homo sapiens
cctcaatgccctgcc

SEQ ID NO: 293454 - DNA, 12 bp, Homo sapiens
cctcacaactcc

SEQ ID NO: 293455 - DNA, 15 bp, Homo sapiens
cctcacaactccttc

SEQ ID NO: 293456 - DNA, 15 bp, Homo sapiens
cctcacacacacagc

SEQ ID NO: 293457 - DNA, 16 bp, Homo sapiens
cctcacacacacagct

SEQ ID NO: 293458 - DNA, 21 bp, Homo sapiens
cctcacacacacagctgggca

SEQ ID NO: 293459 - DNA, 16 bp, Homo sapiens
cctcacatgcccgctg

SEQ ID NO: 293460 - DNA, 14 bp, Homo sapiens
cctcaccaataact

SEQ ID NO: 293461 - DNA, 15 bp, Homo sapiens
cctcaccaataactt

SEQ ID NO: 293462 - DNA, 23 bp, Homo sapiens
cctcaccaataacttcagagaag

SEQ ID NO: 293463 - DNA, 18 bp, Homo sapiens
cctcacccaaaagaatta

SEQ ID NO: 293464 - DNA, 15 bp, Homo sapiens
cctcaccccagtgcc

SEQ ID NO: 293465 - DNA, 18 bp, Homo sapiens
cctcaccccagtgcctgt

SEQ ID NO: 293466 - DNA, 18 bp, Homo sapiens
cctcacccccacccctgt

SEQ ID NO: 293467 - DNA, 16 bp, Homo sapiens
cctcaccccttccttt

SEQ ID NO: 293468 - DNA, 20 bp, Homo sapiens
cctcacccgctgcccagccc

SEQ ID NO: 293469 - DNA, 22 bp, Homo sapiens
cctcaccctgccttatcttgca

SEQ ID NO: 293470 - DNA, 22 bp, Homo sapiens
cctcacctcaggaccccagagg

SEQ ID NO: 293471 - DNA, 11 bp, Homo sapiens
cctcacctcca

SEQ ID NO: 293472 - DNA, 17 bp, Homo sapiens
cctcacctctgccattt

SEQ ID NO: 293473 - DNA, 18 bp, Homo sapiens
cctcacctctggactggc

SEQ ID NO: 293474 - DNA, 13 bp, Homo sapiens
cctcacctggctt

SEQ ID NO: 293475 - DNA, 18 bp, Homo sapiens
cctcacctggcttcccag

SEQ ID NO: 293476 - DNA, 14 bp, Homo sapiens
cctcacctgggcac

SEQ ID NO: 293477 - DNA, 22 bp, Homo sapiens
cctcacctgggcacctggggag

SEQ ID NO: 293478 - DNA, 17 bp, Homo sapiens
cctcacctgggcctttc

SEQ ID NO: 293479 - DNA, 20 bp, Homo sapiens
cctcacctgggcctttcctg

SEQ ID NO: 293480 - DNA, 22 bp, Homo sapiens
cctcacctgggcctttcctgtg

SEQ ID NO: 293481 - DNA, 19 bp, Homo sapiens
cctcaccttgcaacacaca

SEQ ID NO: 293482 - DNA, 17 bp, Homo sapiens
cctcacggggttggctg

SEQ ID NO: 293483 - DNA, 13 bp, Homo sapiens
cctcactctgcca

SEQ ID NO: 293484 - DNA, 14 bp, Homo sapiens
cctcactctgccag

SEQ ID NO: 293485 - DNA, 18 bp, Homo sapiens
cctcactgcccgcacacc

SEQ ID NO: 293486 - DNA, 21 bp, Homo sapiens
cctcactgcccgcacaccctc

SEQ ID NO: 293487 - DNA, 20 bp, Homo sapiens
cctcactgccctccctcggc

SEQ ID NO: 293488 - DNA, 17 bp, Homo sapiens
cctcactgctggggagt

SEQ ID NO: 293489 - DNA, 13 bp, Homo sapiens
cctcactgggtgg

SEQ ID NO: 293490 - DNA, 21 bp, Homo sapiens
cctcactgggtggggtgagga

SEQ ID NO: 293491 - DNA, 18 bp, Homo sapiens
cctcactggtgcatttaa

SEQ ID NO: 293492 - DNA, 21 bp, Homo sapiens
cctcactggtgcatttaaaat

SEQ ID NO: 293493 - DNA, 21 bp, Homo sapiens
cctcacttccatacagctcta

SEQ ID NO: 293494 - DNA, 22 bp, Homo sapiens
cctcagactcatacagaaggtg

SEQ ID NO: 293495 - DNA, 17 bp, Homo sapiens
cctcagacttaccagga

SEQ ID NO: 293496 - DNA, 14 bp, Homo sapiens
cctcagagacagcg

SEQ ID NO: 293497 - DNA, 14 bp, Homo sapiens
cctcagagggtccc

SEQ ID NO: 293498 - DNA, 13 bp, Homo sapiens
cctcagagtccag

SEQ ID NO: 293499 - DNA, 16 bp, Homo sapiens
cctcagagtccaggcc

SEQ ID NO: 293500 - DNA, 17 bp, Homo sapiens
cctcagatctgaacaca

SEQ ID NO: 293501 - DNA, 19 bp, Homo sapiens
cctcagccccagggccctg

SEQ ID NO: 293502 - DNA, 21 bp, Homo sapiens
cctcagccccagggccctgct

SEQ ID NO: 293503 - DNA, 23 bp, Homo sapiens
cctcagccccagggccctgctca

SEQ ID NO: 293504 - DNA, 18 bp, Homo sapiens
cctcagcccctcttgccc

SEQ ID NO: 293505 - DNA, 17 bp, Homo sapiens
cctcagcccttgccccc

SEQ ID NO: 293506 - DNA, 14 bp, Homo sapiens
cctcagcctcctga

SEQ ID NO: 293507 - DNA, 13 bp, Homo sapiens
cctcagcgctccc

SEQ ID NO: 293508 - DNA, 15 bp, Homo sapiens
cctcagcgctccctg

SEQ ID NO: 293509 - DNA, 18 bp, Homo sapiens
cctcagcgctccctgtcg

SEQ ID NO: 293510 - DNA, 20 bp, Homo sapiens
cctcagcgctccctgtcgcc

SEQ ID NO: 293511 - DNA, 14 bp, Homo sapiens
cctcagctctctgg

SEQ ID NO: 293512 - DNA, 17 bp, Homo sapiens
cctcagctctgggagag

SEQ ID NO: 293513 - DNA, 13 bp, Homo sapiens
cctcagctgcctc

SEQ ID NO: 293514 - DNA, 14 bp, Homo sapiens
cctcagctgcctca

SEQ ID NO: 293515 - DNA, 21 bp, Homo sapiens
cctcagctggcggaacctggc

SEQ ID NO: 293516 - DNA, 22 bp, Homo sapiens
cctcagctggcggaacctggct

SEQ ID NO: 293517 - DNA, 18 bp, Homo sapiens
cctcaggaccccagaggg

SEQ ID NO: 293518 - DNA, 19 bp, Homo sapiens
cctcaggcaggaagggcag

SEQ ID NO: 293519 - DNA, 18 bp, Homo sapiens
cctcaggcataggcctgg

SEQ ID NO: 293520 - DNA, 16 bp, Homo sapiens
cctcaggctgctggag

SEQ ID NO: 293521 - DNA, 17 bp, Homo sapiens
cctcaggctgctggagg

SEQ ID NO: 293522 - DNA, 21 bp, Homo sapiens
cctcagggctctaccaagaca

SEQ ID NO: 293523 - DNA, 16 bp, Homo sapiens
cctcagggcttcctta

SEQ ID NO: 293524 - DNA, 21 bp, Homo sapiens
cctcagggcttccttatgtcc

SEQ ID NO: 293525 - DNA, 20 bp, Homo sapiens
cctcagtcagttcccggagc

SEQ ID NO: 293526 - DNA, 13 bp, Homo sapiens
cctcagtccctcc

SEQ ID NO: 293527 - DNA, 14 bp, Homo sapiens
cctcagtccctccc

SEQ ID NO: 293528 - DNA, 19 bp, Homo sapiens
cctcagtccctccctcctg

SEQ ID NO: 293529 - DNA, 21 bp, Homo sapiens
cctcagtccctccctcctggc

SEQ ID NO: 293530 - DNA, 14 bp, Homo sapiens
cctcagtgccactt

SEQ ID NO: 293531 - DNA, 16 bp, Homo sapiens
cctcagtgccacttga

SEQ ID NO: 293532 - DNA, 23 bp, Homo sapiens
cctcagtgtcatttatgaaaaga

SEQ ID NO: 293533 - DNA, 15 bp, Homo sapiens
cctcagtgtgaagcc

SEQ ID NO: 293534 - DNA, 18 bp, Homo sapiens
cctcagttcccttggcct

SEQ ID NO: 293535 - DNA, 16 bp, Homo sapiens
cctcagttggaatcat

SEQ ID NO: 293536 - DNA, 19 bp, Homo sapiens
cctcagtttctccatcagc

SEQ ID NO: 293537 - DNA, 13 bp, Homo sapiens
cctcagtttctgt

SEQ ID NO: 293538 - DNA, 13 bp, Homo sapiens
cctcatcaggatg

SEQ ID NO: 293539 - DNA, 15 bp, Homo sapiens
cctcatcaggatgaa

SEQ ID NO: 293540 - DNA, 13 bp, Homo sapiens
cctcatcctcctg

SEQ ID NO: 293541 - DNA, 11 bp, Homo sapiens
cctcatctcca

SEQ ID NO: 293542 - DNA, 16 bp, Homo sapiens
cctcatcttgaagggc

SEQ ID NO: 293543 - DNA, 21 bp, Homo sapiens
cctcatcttgaagggcccagg

SEQ ID NO: 293544 - DNA, 20 bp, Homo sapiens
cctcatgccacaccttcttc

SEQ ID NO: 293545 - DNA, 15 bp, Homo sapiens
cctcatgcctggccc

SEQ ID NO: 293546 - DNA, 19 bp, Homo sapiens
cctcatggctgttatctgt

SEQ ID NO: 293547 - DNA, 13 bp, Homo sapiens
cctcatgggagtc

SEQ ID NO: 293548 - DNA, 14 bp, Homo sapiens
cctcatgggagtca

SEQ ID NO: 293549 - DNA, 21 bp, Homo sapiens
cctcattaaatggtgatttct

SEQ ID NO: 293550 - DNA, 13 bp, Homo sapiens
cctcattgcattt

SEQ ID NO: 293551 - DNA, 16 bp, Homo sapiens
cctcatttctgccagc

SEQ ID NO: 293552 - DNA, 15 bp, Homo sapiens
cctcatttgttcatt

SEQ ID NO: 293553 - DNA, 15 bp, Homo sapiens
cctccaaaagcactt

SEQ ID NO: 293554 - DNA, 15 bp, Homo sapiens
cctccaaactcctgc

SEQ ID NO: 293555 - DNA, 17 bp, Homo sapiens
cctccaaagcctgggca

SEQ ID NO: 293556 - DNA, 13 bp, Homo sapiens
cctccaaatgctg

SEQ ID NO: 293557 - DNA, 16 bp, Homo sapiens
cctccaagaagccctc

SEQ ID NO: 293558 - DNA, 17 bp, Homo sapiens
cctccaaggtcctctta

SEQ ID NO: 293559 - DNA, 23 bp, Homo sapiens
cctccaatcccaccaaccctcag

SEQ ID NO: 293560 - DNA, 13 bp, Homo sapiens
cctccctggctcc

SEQ ID NO: 293561 - DNA, 15 bp, Homo sapiens
cctccctggctccca

SEQ ID NO: 293562 - DNA, 18 bp, Homo sapiens
cctccctggctcccatga

SEQ ID NO: 293563 - DNA, 20 bp, Homo sapiens
cctccctggctcccatgacc

SEQ ID NO: 293564 - DNA, 22 bp, Homo sapiens
cctccctggctgtgagcagcct

SEQ ID NO: 293565 - DNA, 12 bp, Homo sapiens
cctccctgggtt

SEQ ID NO: 293566 - DNA, 12 bp, Homo sapiens
cctccctgtcaa

SEQ ID NO: 293567 - DNA, 12 bp, Homo sapiens
cctcccttccca

SEQ ID NO: 293568 - DNA, 13 bp, Homo sapiens
cctcccttcccca

SEQ ID NO: 293569 - DNA, 11 bp, Homo sapiens
cctcccttcct

SEQ ID NO: 293570 - DNA, 12 bp, Homo sapiens
cctcccttcctc

SEQ ID NO: 293571 - DNA, 21 bp, Homo sapiens
cctcccttgctcagtgcctcc

SEQ ID NO: 293572 - DNA, 22 bp, Homo sapiens
cctcccttggaaacctgccctg

SEQ ID NO: 293573 - DNA, 19 bp, Homo sapiens
cctcccttgggttctgata

SEQ ID NO: 293574 - DNA, 14 bp, Homo sapiens
cctccctttctggg

SEQ ID NO: 293575 - DNA, 16 bp, Homo sapiens
cctccgactccagata

SEQ ID NO: 293576 - DNA, 16 bp, Homo sapiens
cctccgagggacgcgg

SEQ ID NO: 293577 - DNA, 16 bp, Homo sapiens
cctccgccgtgccggc

SEQ ID NO: 293578 - DNA, 13 bp, Homo sapiens
cctccggccctgc

SEQ ID NO: 293579 - DNA, 18 bp, Homo sapiens
cctccggccctgccccac

SEQ ID NO: 293580 - DNA, 13 bp, Homo sapiens
cctccgggcaggg

SEQ ID NO: 293581 - DNA, 15 bp, Homo sapiens
cctccgtccacccag

SEQ ID NO: 293582 - DNA, 18 bp, Homo sapiens
cctccgtccacccaggct

SEQ ID NO: 293583 - DNA, 19 bp, Homo sapiens
cctccgtccacccaggctg

SEQ ID NO: 293584 - DNA, 15 bp, Homo sapiens
cctccgtccccaggg

SEQ ID NO: 293585 - DNA, 16 bp, Homo sapiens
cctccgtccccagggt

SEQ ID NO: 293586 - DNA, 16 bp, Homo sapiens
cctccgtcctggcagg

SEQ ID NO: 293587 - DNA, 18 bp, Homo sapiens
cctccgtgatccatccat

SEQ ID NO: 293588 - DNA, 21 bp, Homo sapiens
cctccgttcccacctctgagg

SEQ ID NO: 293589 - DNA, 24 bp, Homo sapiens
cctccgttcccacctctgaggact

SEQ ID NO: 293590 - DNA, 20 bp, Homo sapiens
cctccgtttatgggccttgc

SEQ ID NO: 293591 - DNA, 21 bp, Homo sapiens
cctcctaaatgtcagctgttg

SEQ ID NO: 293592 - DNA, 17 bp, Homo sapiens
cctcctaccctcccacc

SEQ ID NO: 293593 - DNA, 19 bp, Homo sapiens
cctcctagaggtgggcagc

SEQ ID NO: 293594 - DNA, 20 bp, Homo sapiens
cctcctagaggtgggcagct

SEQ ID NO: 293595 - DNA, 21 bp, Homo sapiens
cctcctagaggtgggcagctg

SEQ ID NO: 293596 - DNA, 22 bp, Homo sapiens
cctcctagaggtgggcagctgg

SEQ ID NO: 293597 - DNA, 20 bp, Homo sapiens
cctcctagggaaaagttcat

SEQ ID NO: 293598 - DNA, 19 bp, Homo sapiens
cctcctatcacctcccctc

SEQ ID NO: 293599 - DNA, 19 bp, Homo sapiens
cctcctatccttggagagc

SEQ ID NO: 293600 - DNA, 23 bp, Homo sapiens
cctcctatccttggagagcagct

SEQ ID NO: 293601 - DNA, 16 bp, Homo sapiens
cctcctcacctctgga

SEQ ID NO: 293602 - DNA, 14 bp, Homo sapiens
cctcctccacagtg

SEQ ID NO: 293603 - DNA, 17 bp, Homo sapiens
cctcctccacagtgctg

SEQ ID NO: 293604 - DNA, 13 bp, Homo sapiens
cctcctccactca

SEQ ID NO: 293605 - DNA, 14 bp, Homo sapiens
cctcctccagactc

SEQ ID NO: 293606 - DNA, 12 bp, Homo sapiens
cctcctcctgac

SEQ ID NO: 293607 - DNA, 19 bp, Homo sapiens
cctcctcgctgtgccacca

SEQ ID NO: 293608 - DNA, 21 bp, Homo sapiens
cctcctcgctgtgccaccacc

SEQ ID NO: 293609 - DNA, 16 bp, Homo sapiens
cctcctcgggcacaga

SEQ ID NO: 293610 - DNA, 22 bp, Homo sapiens
cctcctcgggcgcctgcgctcc

SEQ ID NO: 293611 - DNA, 13 bp, Homo sapiens
cctcctctcctcg

SEQ ID NO: 293612 - DNA, 19 bp, Homo sapiens
cctcctctcctgcccagct

SEQ ID NO: 293613 - DNA, 17 bp, Homo sapiens
cctcctctctccctgcc

SEQ ID NO: 293614 - DNA, 20 bp, Homo sapiens
cctcctctctccctgcctca

SEQ ID NO: 293615 - DNA, 13 bp, Homo sapiens
cctcctctctgct

SEQ ID NO: 293616 - DNA, 11 bp, Homo sapiens
cctcctctgcc

SEQ ID NO: 293617 - DNA, 15 bp, Homo sapiens
cctcctctgccccct

SEQ ID NO: 293618 - DNA, 14 bp, Homo sapiens
cctcctctgtgctc

SEQ ID NO: 293619 - DNA, 19 bp, Homo sapiens
cctcctcttcaccccggca

SEQ ID NO: 293620 - DNA, 20 bp, Homo sapiens
cctcctcttcaccccggcag

SEQ ID NO: 293621 - DNA, 21 bp, Homo sapiens
cctcctgaaacttacacacaa

SEQ ID NO: 293622 - DNA, 22 bp, Homo sapiens
cctcctgaagcctctgccctgc

SEQ ID NO: 293623 - DNA, 13 bp, Homo sapiens
cctcctgaccctg

SEQ ID NO: 293624 - DNA, 20 bp, Homo sapiens
cctcctgagaaggcgaggag

SEQ ID NO: 293625 - DNA, 17 bp, Homo sapiens
cctcctgagcctgtggg

SEQ ID NO: 293626 - DNA, 16 bp, Homo sapiens
cctcctgcaagagtgg

SEQ ID NO: 293627 - DNA, 12 bp, Homo sapiens
cctcctgcaggc

SEQ ID NO: 293628 - DNA, 14 bp, Homo sapiens
cctcctgcaggctg

SEQ ID NO: 293629 - DNA, 14 bp, Homo sapiens
cctcctgccccctg

SEQ ID NO: 293630 - DNA, 18 bp, Homo sapiens
cctcctgccccctgccag

SEQ ID NO: 293631 - DNA, 17 bp, Homo sapiens
cctcctgccctgtccct

SEQ ID NO: 293632 - DNA, 14 bp, Homo sapiens
cctcctgctggctg

SEQ ID NO: 293633 - DNA, 15 bp, Homo sapiens
cctcctgctggctga

SEQ ID NO: 293634 - DNA, 17 bp, Homo sapiens
cctcctgctggctgagg

SEQ ID NO: 293635 - DNA, 18 bp, Homo sapiens
cctcctggagcagcagct

SEQ ID NO: 293636 - DNA, 21 bp, Homo sapiens
cctcctggccggggcccctca

SEQ ID NO: 293637 - DNA, 23 bp, Homo sapiens
cctcctggccggggcccctcacc

SEQ ID NO: 293638 - DNA, 13 bp, Homo sapiens
cctcctggctcac

SEQ ID NO: 293639 - DNA, 18 bp, Homo sapiens
cctcctggctcacagcca

SEQ ID NO: 293640 - DNA, 19 bp, Homo sapiens
cctcctggctcacagccac

SEQ ID NO: 293641 - DNA, 22 bp, Homo sapiens
cctcctgggaaggagggagctg

SEQ ID NO: 293642 - DNA, 15 bp, Homo sapiens
cctcctgtctcctct

SEQ ID NO: 293643 - DNA, 17 bp, Homo sapiens
cctcctgtctcctctgt

SEQ ID NO: 293644 - DNA, 15 bp, Homo sapiens
cctcctgttcctgcc

SEQ ID NO: 293645 - DNA, 17 bp, Homo sapiens
cctcctgttcctgcctt

SEQ ID NO: 293646 - DNA, 18 bp, Homo sapiens
cctcctgttcctgccttc

SEQ ID NO: 293647 - DNA, 15 bp, Homo sapiens
cctcctgttgccaca

SEQ ID NO: 293648 - DNA, 22 bp, Homo sapiens
cctccttagccctgtctgctag

SEQ ID NO: 293649 - DNA, 14 bp, Homo sapiens
cctccttcccatgc

SEQ ID NO: 293650 - DNA, 17 bp, Homo sapiens
cctccttcccatgcctg

SEQ ID NO: 293651 - DNA, 15 bp, Homo sapiens
cctccttctcccctc

SEQ ID NO: 293652 - DNA, 17 bp, Homo sapiens
cctccttctcccctcca

SEQ ID NO: 293653 - DNA, 18 bp, Homo sapiens
cctccttctcccctccag

SEQ ID NO: 293654 - DNA, 15 bp, Homo sapiens
cctccttctcccttt

SEQ ID NO: 293655 - DNA, 12 bp, Homo sapiens
cctccttgccac

SEQ ID NO: 293656 - DNA, 14 bp, Homo sapiens
cctccttgccaccc

SEQ ID NO: 293657 - DNA, 15 bp, Homo sapiens
cctccttgccacccc

SEQ ID NO: 293658 - DNA, 17 bp, Homo sapiens
cctccttgccacccccc

SEQ ID NO: 293659 - DNA, 20 bp, Homo sapiens
cctccttgccgctgggagag

SEQ ID NO: 293660 - DNA, 14 bp, Homo sapiens
cctccttgtccagg

SEQ ID NO: 293661 - DNA, 13 bp, Homo sapiens
cctcctttatcac

SEQ ID NO: 293662 - DNA, 15 bp, Homo sapiens
cctcctttgtctttt

SEQ ID NO: 293663 - DNA, 18 bp, Homo sapiens
cctccttttcacagttct

SEQ ID NO: 293664 - DNA, 17 bp, Homo sapiens
cctcgaaccaaggcagc

SEQ ID NO: 293665 - DNA, 23 bp, Homo sapiens
cctcgaaccaaggcagcctccag

SEQ ID NO: 293666 - DNA, 16 bp, Homo sapiens
cctcgaacccacactg

SEQ ID NO: 293667 - DNA, 22 bp, Homo sapiens
cctcgaactcctgggctcaagc

SEQ ID NO: 293668 - DNA, 15 bp, Homo sapiens
cctcgaattctcaga

SEQ ID NO: 293669 - DNA, 18 bp, Homo sapiens
cctcgaattctcagacga

SEQ ID NO: 293670 - DNA, 12 bp, Homo sapiens
cctcgaggcacc

SEQ ID NO: 293671 - DNA, 13 bp, Homo sapiens
cctcgcccctcca

SEQ ID NO: 293672 - DNA, 16 bp, Homo sapiens
cctcgcctaggcctgt

SEQ ID NO: 293673 - DNA, 15 bp, Homo sapiens
cctcgctgctgctac

SEQ ID NO: 293674 - DNA, 16 bp, Homo sapiens
cctcgctgctgctact

SEQ ID NO: 293675 - DNA, 17 bp, Homo sapiens
cctcgctgctgctacta

SEQ ID NO: 293676 - DNA, 13 bp, Homo sapiens
cctcgctgcttct

SEQ ID NO: 293677 - DNA, 14 bp, Homo sapiens
cctcgctgtatgat

SEQ ID NO: 293678 - DNA, 14 bp, Homo sapiens
cctcgctgtgccac

SEQ ID NO: 293679 - DNA, 21 bp, Homo sapiens
cctcggcagaactctctgtct

SEQ ID NO: 293680 - DNA, 23 bp, Homo sapiens
cctcggcagaactctctgtcttc

SEQ ID NO: 293681 - DNA, 19 bp, Homo sapiens
cctcggccagagctcccag

SEQ ID NO: 293682 - DNA, 14 bp, Homo sapiens
cctcggctgtgtgg

SEQ ID NO: 293683 - DNA, 15 bp, Homo sapiens
cctcggctgtgtggg

SEQ ID NO: 293684 - DNA, 15 bp, Homo sapiens
cctcggcttgtgggc

SEQ ID NO: 293685 - DNA, 19 bp, Homo sapiens
cctcggcttgtgggctggt

SEQ ID NO: 293686 - DNA, 18 bp, Homo sapiens
cctcgggccgcctcctcc

SEQ ID NO: 293687 - DNA, 22 bp, Homo sapiens
cctcgggccgcctcctccagac

SEQ ID NO: 293688 - DNA, 20 bp, Homo sapiens
cctcgggcgcctgcgctcct

SEQ ID NO: 293689 - DNA, 16 bp, Homo sapiens
cctcggggcaggaagt

SEQ ID NO: 293690 - DNA, 16 bp, Homo sapiens
cctcggtcacctgtgc

SEQ ID NO: 293691 - DNA, 23 bp, Homo sapiens
cctgcccccatctccccaggcct

SEQ ID NO: 293692 - DNA, 12 bp, Homo sapiens
cctgcccccctt

SEQ ID NO: 293693 - DNA, 13 bp, Homo sapiens
cctgccccccttc

SEQ ID NO: 293694 - DNA, 15 bp, Homo sapiens
cctgccccccttccc

SEQ ID NO: 293695 - DNA, 20 bp, Homo sapiens
cctgccccccttcccacccc

SEQ ID NO: 293696 - DNA, 16 bp, Homo sapiens
cctgcccccgccctgc

SEQ ID NO: 293697 - DNA, 17 bp, Homo sapiens
cctgcccccgctctgcc

SEQ ID NO: 293698 - DNA, 17 bp, Homo sapiens
cctgcccccgtcccacc

SEQ ID NO: 293699 - DNA, 15 bp, Homo sapiens
cctgccccctgccag

SEQ ID NO: 293700 - DNA, 18 bp, Homo sapiens
cctgcccccttctcccac

SEQ ID NO: 293701 - DNA, 21 bp, Homo sapiens
cctgcccccttctcccacact

SEQ ID NO: 293702 - DNA, 22 bp, Homo sapiens
cctgcccccttctcccacactg

SEQ ID NO: 293703 - DNA, 19 bp, Homo sapiens
cctgccccgccccccagag

SEQ ID NO: 293704 - DNA, 23 bp, Homo sapiens
cctgccccgccccccagagccag

SEQ ID NO: 293705 - DNA, 18 bp, Homo sapiens
cctgcccctgcccgagag

SEQ ID NO: 293706 - DNA, 22 bp, Homo sapiens
cctgccccttctacactctcct

SEQ ID NO: 293707 - DNA, 15 bp, Homo sapiens
cctgcccgagagctc

SEQ ID NO: 293708 - DNA, 17 bp, Homo sapiens
cctgcccgagagctctt

SEQ ID NO: 293709 - DNA, 13 bp, Homo sapiens
cctgcccgcacag

SEQ ID NO: 293710 - DNA, 13 bp, Homo sapiens
cctgcccgcccgc

SEQ ID NO: 293711 - DNA, 15 bp, Homo sapiens
cctgcccgcccgccg

SEQ ID NO: 293712 - DNA, 22 bp, Homo sapiens
cctgcccggtggtttgccatgt

SEQ ID NO: 293713 - DNA, 23 bp, Homo sapiens
cctgcccgttgccgggcctggac

SEQ ID NO: 293714 - DNA, 20 bp, Homo sapiens
cctgccctacagaggtctct

SEQ ID NO: 293715 - DNA, 23 bp, Homo sapiens
cctgccctacagaggtctctgcc

SEQ ID NO: 293716 - DNA, 12 bp, Homo sapiens
cctgccctcact

SEQ ID NO: 293717 - DNA, 13 bp, Homo sapiens
cctgccctcactc

SEQ ID NO: 293718 - DNA, 18 bp, Homo sapiens
cctgccctcactccactc

SEQ ID NO: 293719 - DNA, 20 bp, Homo sapiens
cctgccctcactccactccc

SEQ ID NO: 293720 - DNA, 14 bp, Homo sapiens
cctgccctcccatg

SEQ ID NO: 293721 - DNA, 24 bp, Homo sapiens
cctgccctcccatgttgcatgcct

SEQ ID NO: 293722 - DNA, 20 bp, Homo sapiens
cctgccctccccagagcact

SEQ ID NO: 293723 - DNA, 16 bp, Homo sapiens
cctgccctcccccacg

SEQ ID NO: 293724 - DNA, 17 bp, Homo sapiens
cctgccctcccccacgg

SEQ ID NO: 293725 - DNA, 14 bp, Homo sapiens
cctgccctgcacct

SEQ ID NO: 293726 - DNA, 15 bp, Homo sapiens
cctgccctgccctgc

SEQ ID NO: 293727 - DNA, 13 bp, Homo sapiens
cctgccctgcctg

SEQ ID NO: 293728 - DNA, 12 bp, Homo sapiens
cctgccctggtc

SEQ ID NO: 293729 - DNA, 12 bp, Homo sapiens
cctgccctgtac

SEQ ID NO: 293730 - DNA, 14 bp, Homo sapiens
cctgccctgtacct

SEQ ID NO: 293731 - DNA, 20 bp, Homo sapiens
cctgccctgtacctctctct

SEQ ID NO: 293732 - DNA, 21 bp, Homo sapiens
cctgccctgtccctgtccccc

SEQ ID NO: 293733 - DNA, 13 bp, Homo sapiens
cctgcccttccct

SEQ ID NO: 293734 - DNA, 20 bp, Homo sapiens
cctgccgacacgctccctcc

SEQ ID NO: 293735 - DNA, 12 bp, Homo sapiens
cctgccgagggg

SEQ ID NO: 293736 - DNA, 14 bp, Homo sapiens
cctgccggccttgg

SEQ ID NO: 293737 - DNA, 21 bp, Homo sapiens
cctgccggccttggccttggg

SEQ ID NO: 293738 - DNA, 16 bp, Homo sapiens
cctgccgggcaggtcc

SEQ ID NO: 293739 - DNA, 15 bp, Homo sapiens
cctgcctagcactca

SEQ ID NO: 293740 - DNA, 10 bp, Homo sapiens
cctgcctcac

SEQ ID NO: 293741 - DNA, 19 bp, Homo sapiens
cctgcctcacatctccctt

SEQ ID NO: 293742 - DNA, 12 bp, Homo sapiens
cctgcctcagcc

SEQ ID NO: 293743 - DNA, 14 bp, Homo sapiens
cctgcctcagcctc

SEQ ID NO: 293744 - DNA, 15 bp, Homo sapiens
cctgcctcatgctct

SEQ ID NO: 293745 - DNA, 13 bp, Homo sapiens
cctgcctcccaag

SEQ ID NO: 293746 - DNA, 21 bp, Homo sapiens
cctgcctctgaactgctgctg

SEQ ID NO: 293747 - DNA, 18 bp, Homo sapiens
cctgcctgagcccaggag

SEQ ID NO: 293748 - DNA, 21 bp, Homo sapiens
cctgcctgagcccaggagctg

SEQ ID NO: 293749 - DNA, 12 bp, Homo sapiens
cctgcctgctcc

SEQ ID NO: 293750 - DNA, 19 bp, Homo sapiens
cctgcctggatttcttcct

SEQ ID NO: 293751 - DNA, 20 bp, Homo sapiens
cctgcctggatttcttccta

SEQ ID NO: 293752 - DNA, 22 bp, Homo sapiens
cctgcctggccaggcagatctg

SEQ ID NO: 293753 - DNA, 13 bp, Homo sapiens
cctgcctgtctgt

SEQ ID NO: 293754 - DNA, 17 bp, Homo sapiens
cctgcctgtctgtctct

SEQ ID NO: 293755 - DNA, 22 bp, Homo sapiens
cctgcctgtctgtctctccatc

SEQ ID NO: 293756 - DNA, 13 bp, Homo sapiens
cctgcctgtgcat

SEQ ID NO: 293757 - DNA, 14 bp, Homo sapiens
cctgcctgtgcatg

SEQ ID NO: 293758 - DNA, 16 bp, Homo sapiens
cctgccttatcttgca

SEQ ID NO: 293759 - DNA, 12 bp, Homo sapiens
cctgccttctgg

SEQ ID NO: 293760 - DNA, 13 bp, Homo sapiens
cctgcctttgatg

SEQ ID NO: 293761 - DNA, 13 bp, Homo sapiens
cctgcgcaggccc

SEQ ID NO: 293762 - DNA, 17 bp, Homo sapiens
cctgcgcaggccctccg

SEQ ID NO: 293763 - DNA, 21 bp, Homo sapiens
cctgcgccctccctccctcca

SEQ ID NO: 293764 - DNA, 15 bp, Homo sapiens
cctgcgcctggctct

SEQ ID NO: 293765 - DNA, 13 bp, Homo sapiens
cctgcgctcctct

SEQ ID NO: 293766 - DNA, 14 bp, Homo sapiens
cctgcgctcctctg

SEQ ID NO: 293767 - DNA, 20 bp, Homo sapiens
cctgcgctcctctgcagcct

SEQ ID NO: 293768 - DNA, 17 bp, Homo sapiens
cctgcggactccatggc

SEQ ID NO: 293769 - DNA, 20 bp, Homo sapiens
cctgcggactccatggccct

SEQ ID NO: 293770 - DNA, 15 bp, Homo sapiens
cctgcggagctgcat

SEQ ID NO: 293771 - DNA, 17 bp, Homo sapiens
cctgcggcctgctggag

SEQ ID NO: 293772 - DNA, 13 bp, Homo sapiens
cctgcggctgctg

SEQ ID NO: 293773 - DNA, 18 bp, Homo sapiens
cctgcggctgctggcaca

SEQ ID NO: 293774 - DNA, 21 bp, Homo sapiens
cctgcggctgctggcacagac

SEQ ID NO: 293775 - DNA, 12 bp, Homo sapiens
cctgcgggctgc

SEQ ID NO: 293776 - DNA, 16 bp, Homo sapiens
cctgcgtcatggctca

SEQ ID NO: 293777 - DNA, 15 bp, Homo sapiens
cctgcgtggcctggg

SEQ ID NO: 293778 - DNA, 22 bp, Homo sapiens
cctgcgtggcctggggctgccg

SEQ ID NO: 293779 - DNA, 13 bp, Homo sapiens
cctgcgttctgat

SEQ ID NO: 293780 - DNA, 13 bp, Homo sapiens
cctgcgttggagc

SEQ ID NO: 293781 - DNA, 17 bp, Homo sapiens
cctgcgttggagccact

SEQ ID NO: 293782 - DNA, 20 bp, Homo sapiens
cctgcgttggagccactcct

SEQ ID NO: 293783 - DNA, 16 bp, Homo sapiens
cctgctaaggctcctc

SEQ ID NO: 293784 - DNA, 19 bp, Homo sapiens
cctgctacaacttcagcag

SEQ ID NO: 293785 - DNA, 15 bp, Homo sapiens
cctgctagagcaacc

SEQ ID NO: 293786 - DNA, 19 bp, Homo sapiens
cctgctagagcaacccctg

SEQ ID NO: 293787 - DNA, 20 bp, Homo sapiens
cctgctagagcaacccctgt

SEQ ID NO: 293788 - DNA, 18 bp, Homo sapiens
cctgctatttcccaagct

SEQ ID NO: 293789 - DNA, 16 bp, Homo sapiens
cctgctcaggcctcac

SEQ ID NO: 293790 - DNA, 19 bp, Homo sapiens
cctgctcaggcctcacctg

SEQ ID NO: 293791 - DNA, 22 bp, Homo sapiens
cctgctccacgaagccttaagc

SEQ ID NO: 293792 - DNA, 16 bp, Homo sapiens
cctgctcccagcagcc

SEQ ID NO: 293793 - DNA, 23 bp, Homo sapiens
cctgctcccagcagccctaagga

SEQ ID NO: 293794 - DNA, 18 bp, Homo sapiens
cctgctcccagcctgctg

SEQ ID NO: 293795 - DNA, 22 bp, Homo sapiens
cctgctcccattcctccctccg

SEQ ID NO: 293796 - DNA, 17 bp, Homo sapiens
cctgctcctcctgccct

SEQ ID NO: 293797 - DNA, 16 bp, Homo sapiens
cctgctctacccatga

SEQ ID NO: 293798 - DNA, 17 bp, Homo sapiens
cctgctctacccatgag

SEQ ID NO: 293799 - DNA, 18 bp, Homo sapiens
cctgctctacccatgagc

SEQ ID NO: 293800 - DNA, 23 bp, Homo sapiens
cctgctctacccatgagcctgcc

SEQ ID NO: 293801 - DNA, 18 bp, Homo sapiens
cctgctctccttgccctg

SEQ ID NO: 293802 - DNA, 15 bp, Homo sapiens
cctgctctctaccca

SEQ ID NO: 293803 - DNA, 13 bp, Homo sapiens
cctgctctgcagc

SEQ ID NO: 293804 - DNA, 19 bp, Homo sapiens
cctgctctgcagcccacag

SEQ ID NO: 293805 - DNA, 23 bp, Homo sapiens
cctgctgagtggtccacattctg

SEQ ID NO: 293806 - DNA, 10 bp, Homo sapiens
cctgctgcat

SEQ ID NO: 293807 - DNA, 13 bp, Homo sapiens
cctgctgccccag

SEQ ID NO: 293808 - DNA, 15 bp, Homo sapiens
cctgctgccgccact

SEQ ID NO: 293809 - DNA, 15 bp, Homo sapiens
cctgctgccgcctcc

SEQ ID NO: 293810 - DNA, 18 bp, Homo sapiens
cctgctgccgcctcccag

SEQ ID NO: 293811 - DNA, 20 bp, Homo sapiens
cctgctgcctccccaaccct

SEQ ID NO: 293812 - DNA, 21 bp, Homo sapiens
cctgctgcctccccaaccctg

SEQ ID NO: 293813 - DNA, 22 bp, Homo sapiens
cctgctgccttctgacggccct

SEQ ID NO: 293814 - DNA, 18 bp, Homo sapiens
cctgctgcgtcagaccag

SEQ ID NO: 293815 - DNA, 14 bp, Homo sapiens
cctgctgctccatg

SEQ ID NO: 293816 - DNA, 17 bp, Homo sapiens
cctgctgctcgggaagg

SEQ ID NO: 293817 - DNA, 16 bp, Homo sapiens
cctgctgctgcctgcc

SEQ ID NO: 293818 - DNA, 18 bp, Homo sapiens
cctgctgctgcctgcctg

SEQ ID NO: 293819 - DNA, 17 bp, Homo sapiens
cctgctgcttcctaact

SEQ ID NO: 293820 - DNA, 20 bp, Homo sapiens
cctgctggaaaccacacttc

SEQ ID NO: 293821 - DNA, 17 bp, Homo sapiens
cctgctggccaaagtca

SEQ ID NO: 293822 - DNA, 14 bp, Homo sapiens
cctggcctggctcc

SEQ ID NO: 293823 - DNA, 16 bp, Homo sapiens
cctggcctggctcccc

SEQ ID NO: 293824 - DNA, 13 bp, Homo sapiens
cctggcgtggggg

SEQ ID NO: 293825 - DNA, 20 bp, Homo sapiens
cctggcgtggggggagctct

SEQ ID NO: 293826 - DNA, 23 bp, Homo sapiens
cctggcgtggggggagctctggt

SEQ ID NO: 293827 - DNA, 20 bp, Homo sapiens
cctggctcacagccaccacc

SEQ ID NO: 293828 - DNA, 20 bp, Homo sapiens
cctggctccaggctccaggc

SEQ ID NO: 293829 - DNA, 23 bp, Homo sapiens
cctggctccaggctccaggctga

SEQ ID NO: 293830 - DNA, 19 bp, Homo sapiens
cctggctcccaagggaggc

SEQ ID NO: 293831 - DNA, 23 bp, Homo sapiens
cctggctcccacaggcccttcct

SEQ ID NO: 293832 - DNA, 14 bp, Homo sapiens
cctggctcccagga

SEQ ID NO: 293833 - DNA, 16 bp, Homo sapiens
cctggctcccaggaca

SEQ ID NO: 293834 - DNA, 18 bp, Homo sapiens
cctggctccccacgagtc

SEQ ID NO: 293835 - DNA, 22 bp, Homo sapiens
cctggctccccacgagtcacct

SEQ ID NO: 293836 - DNA, 18 bp, Homo sapiens
cctggctccgctgtgtgg

SEQ ID NO: 293837 - DNA, 19 bp, Homo sapiens
cctggctccgctgtgtgga

SEQ ID NO: 293838 - DNA, 15 bp, Homo sapiens
cctggctcctgaggg

SEQ ID NO: 293839 - DNA, 13 bp, Homo sapiens
cctggctgccagg

SEQ ID NO: 293840 - DNA, 18 bp, Homo sapiens
cctggctgccaggcgttg

SEQ ID NO: 293841 - DNA, 19 bp, Homo sapiens
cctggctgcgaactgtgca

SEQ ID NO: 293842 - DNA, 13 bp, Homo sapiens
cctggctgtgagc

SEQ ID NO: 293843 - DNA, 14 bp, Homo sapiens
cctggctgtgagca

SEQ ID NO: 293844 - DNA, 20 bp, Homo sapiens
cctggctgtgagcagcctcc

SEQ ID NO: 293845 - DNA, 21 bp, Homo sapiens
cctggctgtgagcagcctcca

SEQ ID NO: 293846 - DNA, 16 bp, Homo sapiens
cctggctgtggaggcc

SEQ ID NO: 293847 - DNA, 18 bp, Homo sapiens
cctggctgtggaggcctg

SEQ ID NO: 293848 - DNA, 21 bp, Homo sapiens
cctggctgtggaggcctgatg

SEQ ID NO: 293849 - DNA, 22 bp, Homo sapiens
cctggctgtggaggcctgatgc

SEQ ID NO: 293850 - DNA, 15 bp, Homo sapiens
cctggcttcccagga

SEQ ID NO: 293851 - DNA, 16 bp, Homo sapiens
cctggcttcccaggac

SEQ ID NO: 293852 - DNA, 20 bp, Homo sapiens
cctggcttcccaggaccctg

SEQ ID NO: 293853 - DNA, 15 bp, Homo sapiens
cctggcttgctccag

SEQ ID NO: 293854 - DNA, 16 bp, Homo sapiens
cctggcttgctccagg

SEQ ID NO: 293855 - DNA, 17 bp, Homo sapiens
cctggcttgctccaggg

SEQ ID NO: 293856 - DNA, 20 bp, Homo sapiens
cctggcttgctccagggtct

SEQ ID NO: 293857 - DNA, 20 bp, Homo sapiens
cctggctttcccttccagtt

SEQ ID NO: 293858 - DNA, 16 bp, Homo sapiens
cctggctttgcccaac

SEQ ID NO: 293859 - DNA, 22 bp, Homo sapiens
cctggcttttcactgctggctg

SEQ ID NO: 293860 - DNA, 14 bp, Homo sapiens
cctggcttttctgg

SEQ ID NO: 293861 - DNA, 21 bp, Homo sapiens
cctgggaaaggacccacccat

SEQ ID NO: 293862 - DNA, 23 bp, Homo sapiens
cctgggaaaggacccacccatct

SEQ ID NO: 293863 - DNA, 22 bp, Homo sapiens
cctgggaaggagggagctgctc

SEQ ID NO: 293864 - DNA, 16 bp, Homo sapiens
cctgggacccagctac

SEQ ID NO: 293865 - DNA, 14 bp, Homo sapiens
cctgggaccccctc

SEQ ID NO: 293866 - DNA, 17 bp, Homo sapiens
cctgggactcccagtga

SEQ ID NO: 293867 - DNA, 18 bp, Homo sapiens
cctgggactcccagtgaa

SEQ ID NO: 293868 - DNA, 17 bp, Homo sapiens
cctgggactgctgcttc

SEQ ID NO: 293869 - DNA, 22 bp, Homo sapiens
cctgggagagtgaggtcatccc

SEQ ID NO: 293870 - DNA, 15 bp, Homo sapiens
cctgggagatgctgg

SEQ ID NO: 293871 - DNA, 18 bp, Homo sapiens
cctgggagtgggtggagg

SEQ ID NO: 293872 - DNA, 16 bp, Homo sapiens
cctgggcaacagagca

SEQ ID NO: 293873 - DNA, 22 bp, Homo sapiens
cctgggcaacagagcaagactc

SEQ ID NO: 293874 - DNA, 23 bp, Homo sapiens
cctgggcaagtgaggcaagagaa

SEQ ID NO: 293875 - DNA, 22 bp, Homo sapiens
cctgggcacccacctccacccc

SEQ ID NO: 293876 - DNA, 19 bp, Homo sapiens
cctgggcagccaggctgcc

SEQ ID NO: 293877 - DNA, 13 bp, Homo sapiens
cctgggcagccca

SEQ ID NO: 293878 - DNA, 16 bp, Homo sapiens
cctgggcagtgcccac

SEQ ID NO: 293879 - DNA, 20 bp, Homo sapiens
cctgggcatccccagccccc

SEQ ID NO: 293880 - DNA, 23 bp, Homo sapiens
cctgggccacagggcgagactcc

SEQ ID NO: 293881 - DNA, 16 bp, Homo sapiens
cctgggccactggcat

SEQ ID NO: 293882 - DNA, 13 bp, Homo sapiens
cctgggccagaga

SEQ ID NO: 293883 - DNA, 14 bp, Homo sapiens
cctgggccagccca

SEQ ID NO: 293884 - DNA, 17 bp, Homo sapiens
cctgggccagcccagga

SEQ ID NO: 293885 - DNA, 21 bp, Homo sapiens
cctgggccagggtctcgtcag

SEQ ID NO: 293886 - DNA, 23 bp, Homo sapiens
cctgggccagggtctcgtcagga

SEQ ID NO: 293887 - DNA, 13 bp, Homo sapiens
cctgggcccaggc

SEQ ID NO: 293888 - DNA, 17 bp, Homo sapiens
cctgggcccaggcagca

SEQ ID NO: 293889 - DNA, 15 bp, Homo sapiens
cctgggcccctccct

SEQ ID NO: 293890 - DNA, 12 bp, Homo sapiens
cctgggccctgg

SEQ ID NO: 293891 - DNA, 14 bp, Homo sapiens
cctgggccctggtt

SEQ ID NO: 293892 - DNA, 17 bp, Homo sapiens
cctgggcctcccatagt

SEQ ID NO: 293893 - DNA, 15 bp, Homo sapiens
cctgggcctcccgtc

SEQ ID NO: 293894 - DNA, 12 bp, Homo sapiens
cctgggcctgct

SEQ ID NO: 293895 - DNA, 13 bp, Homo sapiens
cctgggcctgtcc

SEQ ID NO: 293896 - DNA, 14 bp, Homo sapiens
cctgggcctgtccc

SEQ ID NO: 293897 - DNA, 15 bp, Homo sapiens
cctgggcctgtctca

SEQ ID NO: 293898 - DNA, 14 bp, Homo sapiens
cctgggcctgtgca

SEQ ID NO: 293899 - DNA, 21 bp, Homo sapiens
cctgggcctgtgcagcagccc

SEQ ID NO: 293900 - DNA, 15 bp, Homo sapiens
cctgggcgccctgga

SEQ ID NO: 293901 - DNA, 22 bp, Homo sapiens
cctgggctcaagcaatcctcct

SEQ ID NO: 293902 - DNA, 13 bp, Homo sapiens
cctgggctggact

SEQ ID NO: 293903 - DNA, 16 bp, Homo sapiens
cctgggctggactgga

SEQ ID NO: 293904 - DNA, 17 bp, Homo sapiens
cctgggctgggagaagg

SEQ ID NO: 293905 - DNA, 15 bp, Homo sapiens
cctgggcttaagttt

SEQ ID NO: 293906 - DNA, 13 bp, Homo sapiens
cctgggctttctg

SEQ ID NO: 293907 - DNA, 18 bp, Homo sapiens
cctggggaagaggccttg

SEQ ID NO: 293908 - DNA, 20 bp, Homo sapiens
cctggggaagaggccttggg

SEQ ID NO: 293909 - DNA, 15 bp, Homo sapiens
cctggggaggctgag

SEQ ID NO: 293910 - DNA, 22 bp, Homo sapiens
cctggggatgtaaccaagctgt

SEQ ID NO: 293911 - DNA, 18 bp, Homo sapiens
cctggggccccgctggga

SEQ ID NO: 293912 - DNA, 21 bp, Homo sapiens
cctggggcctggacctgcctc

SEQ ID NO: 293913 - DNA, 13 bp, Homo sapiens
cctggggcctggc

SEQ ID NO: 293914 - DNA, 14 bp, Homo sapiens
cctggggcctggca

SEQ ID NO: 293915 - DNA, 14 bp, Homo sapiens
cctggggctccctt

SEQ ID NO: 293916 - DNA, 16 bp, Homo sapiens
cctggggctcctttct

SEQ ID NO: 293917 - DNA, 21 bp, Homo sapiens
cctggggcttctcctgaccca

SEQ ID NO: 293918 - DNA, 23 bp, Homo sapiens
cctgggggcagtgactggcaggt

SEQ ID NO: 293919 - DNA, 18 bp, Homo sapiens
cctggggggcacagccag

SEQ ID NO: 293920 - DNA, 20 bp, Homo sapiens
cctggggggcacagccagaa

SEQ ID NO: 293921 - DNA, 16 bp, Homo sapiens
cctgggggtcccagga

SEQ ID NO: 293922 - DNA, 17 bp, Homo sapiens
cctgggggtcccaggat

SEQ ID NO: 293923 - DNA, 14 bp, Homo sapiens
cctgggggtggggg

SEQ ID NO: 293924 - DNA, 18 bp, Homo sapiens
cctgggggttctttcttc

SEQ ID NO: 293925 - DNA, 23 bp, Homo sapiens
cctgggggttctttcttcctctg

SEQ ID NO: 293926 - DNA, 16 bp, Homo sapiens
cctggggtacttctgt

SEQ ID NO: 293927 - DNA, 14 bp, Homo sapiens
cctggggtctctga

SEQ ID NO: 293928 - DNA, 16 bp, Homo sapiens
cctggggtgccctcca

SEQ ID NO: 293929 - DNA, 22 bp, Homo sapiens
cctggggtggcgtctgcctagg

SEQ ID NO: 293930 - DNA, 15 bp, Homo sapiens
cctggggtggggagg

SEQ ID NO: 293931 - DNA, 18 bp, Homo sapiens
cctggggtggggaggcag

SEQ ID NO: 293932 - DNA, 21 bp, Homo sapiens
cctggggtgggtttagcaggc

SEQ ID NO: 293933 - DNA, 23 bp, Homo sapiens
cctggggtgggtttagcaggctg

SEQ ID NO: 293934 - DNA, 19 bp, Homo sapiens
cctggggtggttggaggcc

SEQ ID NO: 293935 - DNA, 20 bp, Homo sapiens
cctggggtggttggaggcct

SEQ ID NO: 293936 - DNA, 23 bp, Homo sapiens
cctggggtttccacacaggccca

SEQ ID NO: 293937 - DNA, 15 bp, Homo sapiens
cctgggtcaccttcc

SEQ ID NO: 293938 - DNA, 14 bp, Homo sapiens
cctgggtctgtgtc

SEQ ID NO: 293939 - DNA, 16 bp, Homo sapiens
cctgggtctgtgtctc

SEQ ID NO: 293940 - DNA, 23 bp, Homo sapiens
cctgggtgctggctgcccagacc

SEQ ID NO: 293941 - DNA, 19 bp, Homo sapiens
cctgggtggggcagggcct

SEQ ID NO: 293942 - DNA, 23 bp, Homo sapiens
cctgggtggtatagggcgtttgg

SEQ ID NO: 293943 - DNA, 23 bp, Homo sapiens
cctgggttcagaaatgctgcctg

SEQ ID NO: 293944 - DNA, 14 bp, Homo sapiens
cctggtacagcagg

SEQ ID NO: 293945 - DNA, 15 bp, Homo sapiens
cctggtacagcaggg

SEQ ID NO: 293946 - DNA, 20 bp, Homo sapiens
cctggtactcccccagccct

SEQ ID NO: 293947 - DNA, 15 bp, Homo sapiens
cctggtaggaaagca

SEQ ID NO: 293948 - DNA, 20 bp, Homo sapiens
cctggtcaacccgctgcttc

SEQ ID NO: 293949 - DNA, 21 bp, Homo sapiens
cctggtcacaggactctgcct

SEQ ID NO: 293950 - DNA, 22 bp, Homo sapiens
cctggtcacaggactctgcctc

SEQ ID NO: 293951 - DNA, 14 bp, Homo sapiens
ccttcactgccatg

SEQ ID NO: 293952 - DNA, 20 bp, Homo sapiens
ccttcacttctgaccacact

SEQ ID NO: 293953 - DNA, 15 bp, Homo sapiens
ccttcagaccccagt

SEQ ID NO: 293954 - DNA, 14 bp, Homo sapiens
ccttcagatcctac

SEQ ID NO: 293955 - DNA, 21 bp, Homo sapiens
ccttcagcatcctcagttcct

SEQ ID NO: 293956 - DNA, 19 bp, Homo sapiens
ccttcagccgagcccagac

SEQ ID NO: 293957 - DNA, 21 bp, Homo sapiens
ccttcagggagacaggcaggg

SEQ ID NO: 293958 - DNA, 22 bp, Homo sapiens
ccttcagggccagaaggagggc

SEQ ID NO: 293959 - DNA, 13 bp, Homo sapiens
ccttcagtatcaa

SEQ ID NO: 293960 - DNA, 19 bp, Homo sapiens
ccttcagtatcaaggctgc

SEQ ID NO: 293961 - DNA, 23 bp, Homo sapiens
ccttcagtatcaaggctgcctgg

SEQ ID NO: 293962 - DNA, 15 bp, Homo sapiens
ccttcagtgagcccc

SEQ ID NO: 293963 - DNA, 22 bp, Homo sapiens
ccttcagtgagcccctccccag

SEQ ID NO: 293964 - DNA, 14 bp, Homo sapiens
ccttcatctccagg

SEQ ID NO: 293965 - DNA, 21 bp, Homo sapiens
ccttcatgcttttctcatggt

SEQ ID NO: 293966 - DNA, 15 bp, Homo sapiens
ccttcattaaatgtt

SEQ ID NO: 293967 - DNA, 17 bp, Homo sapiens
ccttcattccgttagga

SEQ ID NO: 293968 - DNA, 13 bp, Homo sapiens
ccttcattctccg

SEQ ID NO: 293969 - DNA, 18 bp, Homo sapiens
ccttcatttcaggaggga

SEQ ID NO: 293970 - DNA, 17 bp, Homo sapiens
ccttcatttcatcctgt

SEQ ID NO: 293971 - DNA, 17 bp, Homo sapiens
ccttccaactgctgccc

SEQ ID NO: 293972 - DNA, 14 bp, Homo sapiens
ccttccacctcaca

SEQ ID NO: 293973 - DNA, 20 bp, Homo sapiens
ccttccacctcacaactcct

SEQ ID NO: 293974 - DNA, 18 bp, Homo sapiens
ccttccacgctgtctcca

SEQ ID NO: 293975 - DNA, 19 bp, Homo sapiens
ccttccacgctgtctccag

SEQ ID NO: 293976 - DNA, 19 bp, Homo sapiens
ccttccacgtgtatgcaag

SEQ ID NO: 293977 - DNA, 23 bp, Homo sapiens
ccttccaggggtcaccttgagag

SEQ ID NO: 293978 - DNA, 12 bp, Homo sapiens
ccttccataatt

SEQ ID NO: 293979 - DNA, 12 bp, Homo sapiens
ccttccatccct

SEQ ID NO: 293980 - DNA, 19 bp, Homo sapiens
ccttccatccctaccccct

SEQ ID NO: 293981 - DNA, 23 bp, Homo sapiens
ccttcccaacgtactcctcagac

SEQ ID NO: 293982 - DNA, 13 bp, Homo sapiens
ccttcccacccct

SEQ ID NO: 293983 - DNA, 19 bp, Homo sapiens
ccttcccacggccactgca

SEQ ID NO: 293984 - DNA, 13 bp, Homo sapiens
ccttcccactgtc

SEQ ID NO: 293985 - DNA, 12 bp, Homo sapiens
ccttcccaggcc

SEQ ID NO: 293986 - DNA, 15 bp, Homo sapiens
ccttcccaggccagc

SEQ ID NO: 293987 - DNA, 18 bp, Homo sapiens
ccttcccaggccagcgag

SEQ ID NO: 293988 - DNA, 20 bp, Homo sapiens
ccttcccaggccagcgaggc

SEQ ID NO: 293989 - DNA, 22 bp, Homo sapiens
ccttcccagtgggctgtgttga

SEQ ID NO: 293990 - DNA, 11 bp, Homo sapiens
ccttccccact

SEQ ID NO: 293991 - DNA, 12 bp, Homo sapiens
ccttccccactc

SEQ ID NO: 293992 - DNA, 15 bp, Homo sapiens
ccttcccccagccca

SEQ ID NO: 293993 - DNA, 16 bp, Homo sapiens
ccttcccccagcccaa

SEQ ID NO: 293994 - DNA, 23 bp, Homo sapiens
ccttcccccttttttgtccccca

SEQ ID NO: 293995 - DNA, 17 bp, Homo sapiens
ccttcccctccctggct

SEQ ID NO: 293996 - DNA, 15 bp, Homo sapiens
ccttcccctccctgt

SEQ ID NO: 293997 - DNA, 16 bp, Homo sapiens
ccttcccctccttctc

SEQ ID NO: 293998 - DNA, 16 bp, Homo sapiens
ccttcccctgcgccct

SEQ ID NO: 293999 - DNA, 23 bp, Homo sapiens
ccttcccctgcgccctccctccc

SEQ ID NO: 294000 - DNA, 14 bp, Homo sapiens
ccttcccctgctga

SEQ ID NO: 294001 - DNA, 19 bp, Homo sapiens
ccttccctcactcttcctc

SEQ ID NO: 294002 - DNA, 14 bp, Homo sapiens
ccttccctggcccc

SEQ ID NO: 294003 - DNA, 14 bp, Homo sapiens
ccttccctggtcca

SEQ ID NO: 294004 - DNA, 12 bp, Homo sapiens
ccttccgctctg

SEQ ID NO: 294005 - DNA, 15 bp, Homo sapiens
ccttccgctctgagg

SEQ ID NO: 294006 - DNA, 20 bp, Homo sapiens
ccttccgtgggtcatcccag

SEQ ID NO: 294007 - DNA, 15 bp, Homo sapiens
ccttcctatgcccag

SEQ ID NO: 294008 - DNA, 15 bp, Homo sapiens
ccttcctcacttcca

SEQ ID NO: 294009 - DNA, 23 bp, Homo sapiens
ccttcctccgctcccctttccca

SEQ ID NO: 294010 - DNA, 20 bp, Homo sapiens
ccttcctctccactgccttc

SEQ ID NO: 294011 - DNA, 14 bp, Homo sapiens
ccttcctctggggc

SEQ ID NO: 294012 - DNA, 15 bp, Homo sapiens
ccttcctctggggct

SEQ ID NO: 294013 - DNA, 13 bp, Homo sapiens
ccttcctgccctg

SEQ ID NO: 294014 - DNA, 19 bp, Homo sapiens
ccttcctgccctgtacctc

SEQ ID NO: 294015 - DNA, 16 bp, Homo sapiens
ccttcctggactggcc

SEQ ID NO: 294016 - DNA, 11 bp, Homo sapiens
ccttcctggcc

SEQ ID NO: 294017 - DNA, 20 bp, Homo sapiens
ccttcctggcctcactggct

SEQ ID NO: 294018 - DNA, 16 bp, Homo sapiens
ccttcctgggcagccc

SEQ ID NO: 294019 - DNA, 18 bp, Homo sapiens
ccttcctgggcagcccag

SEQ ID NO: 294020 - DNA, 22 bp, Homo sapiens
ccttcctgggcagcccagagag

SEQ ID NO: 294021 - DNA, 13 bp, Homo sapiens
ccttcctgtcctg

SEQ ID NO: 294022 - DNA, 15 bp, Homo sapiens
ccttcctgtcctgct

SEQ ID NO: 294023 - DNA, 17 bp, Homo sapiens
ccttcctgtcctgctca

SEQ ID NO: 294024 - DNA, 15 bp, Homo sapiens
ccttcctgtctggcc

SEQ ID NO: 294025 - DNA, 16 bp, Homo sapiens
ccttcctgtctggccc

SEQ ID NO: 294026 - DNA, 22 bp, Homo sapiens
ccttcctgttctgtgtctgctg

SEQ ID NO: 294027 - DNA, 22 bp, Homo sapiens
ccttccttccattgctcccagt

SEQ ID NO: 294028 - DNA, 14 bp, Homo sapiens
ccttccttgacctt

SEQ ID NO: 294029 - DNA, 14 bp, Homo sapiens
ccttcctttgtctt

SEQ ID NO: 294030 - DNA, 15 bp, Homo sapiens
ccttcgatacaccgg

SEQ ID NO: 294031 - DNA, 22 bp, Homo sapiens
ccttcgatacaccgggcctgga

SEQ ID NO: 294032 - DNA, 22 bp, Homo sapiens
ccttcggaatccagtgcttcca

SEQ ID NO: 294033 - DNA, 20 bp, Homo sapiens
ccttctaacatgttatcaaa

SEQ ID NO: 294034 - DNA, 19 bp, Homo sapiens
ccttctacactctcctggg

SEQ ID NO: 294035 - DNA, 21 bp, Homo sapiens
ccttctacactctcctgggcc

SEQ ID NO: 294036 - DNA, 16 bp, Homo sapiens
ccttctacctgcagga

SEQ ID NO: 294037 - DNA, 18 bp, Homo sapiens
ccttctagattcactgtc

SEQ ID NO: 294038 - DNA, 18 bp, Homo sapiens
ccttctaggcatctcctc

SEQ ID NO: 294039 - DNA, 23 bp, Homo sapiens
ccttctaggcatctcctctcccc

SEQ ID NO: 294040 - DNA, 13 bp, Homo sapiens
ccttctcagctct

SEQ ID NO: 294041 - DNA, 15 bp, Homo sapiens
ccttctccaaatgag

SEQ ID NO: 294042 - DNA, 12 bp, Homo sapiens
ccttctccacag

SEQ ID NO: 294043 - DNA, 19 bp, Homo sapiens
ccttctccatggccctgcc

SEQ ID NO: 294044 - DNA, 14 bp, Homo sapiens
ccttctcccacact

SEQ ID NO: 294045 - DNA, 16 bp, Homo sapiens
ccttctcccacactgc

SEQ ID NO: 294046 - DNA, 16 bp, Homo sapiens
ccttctcccctccaga

SEQ ID NO: 294047 - DNA, 22 bp, Homo sapiens
ccttctcccctccagaccccta

SEQ ID NO: 294048 - DNA, 15 bp, Homo sapiens
ccttctcccctgcac

SEQ ID NO: 294049 - DNA, 15 bp, Homo sapiens
ccttctcccctgccc

SEQ ID NO: 294050 - DNA, 21 bp, Homo sapiens
ccttctcctccccacccgccc

SEQ ID NO: 294051 - DNA, 14 bp, Homo sapiens
ccttctcctctctg

SEQ ID NO: 294052 - DNA, 16 bp, Homo sapiens
ccttctcctctctggg

SEQ ID NO: 294053 - DNA, 18 bp, Homo sapiens
ccttctctactcatgcca

SEQ ID NO: 294054 - DNA, 14 bp, Homo sapiens
ccttctctgctcca

SEQ ID NO: 294055 - DNA, 16 bp, Homo sapiens
ccttctctgctccacc

SEQ ID NO: 294056 - DNA, 14 bp, Homo sapiens
ccttctcttaattt

SEQ ID NO: 294057 - DNA, 16 bp, Homo sapiens
ccttctgacggccctg

SEQ ID NO: 294058 - DNA, 19 bp, Homo sapiens
ccttctgacggccctgcaa

SEQ ID NO: 294059 - DNA, 21 bp, Homo sapiens
ccttctgacggccctgcaatg

SEQ ID NO: 294060 - DNA, 19 bp, Homo sapiens
ccttctgataagactggaa

SEQ ID NO: 294061 - DNA, 22 bp, Homo sapiens
ccttctgcccccgttccagctg

SEQ ID NO: 294062 - DNA, 12 bp, Homo sapiens
ccttctggcctt

SEQ ID NO: 294063 - DNA, 12 bp, Homo sapiens
ccttctgggaaa

SEQ ID NO: 294064 - DNA, 14 bp, Homo sapiens
ccttctgtggctca

SEQ ID NO: 294065 - DNA, 21 bp, Homo sapiens
ccttctgtggctcacagaacc

SEQ ID NO: 294066 - DNA, 15 bp, Homo sapiens
ccttcttcacccagc

SEQ ID NO: 294067 - DNA, 23 bp, Homo sapiens
ccttcttcacccagctaatctgt

SEQ ID NO: 294068 - DNA, 18 bp, Homo sapiens
ccttcttccacagcaaat

SEQ ID NO: 294069 - DNA, 17 bp, Homo sapiens
ccttcttggcttctggg

SEQ ID NO: 294070 - DNA, 21 bp, Homo sapiens
ccttcttggcttctgggacct

SEQ ID NO: 294071 - DNA, 15 bp, Homo sapiens
ccttcttgggcccca

SEQ ID NO: 294072 - DNA, 11 bp, Homo sapiens
ccttcttgtca

SEQ ID NO: 294073 - DNA, 15 bp, Homo sapiens
ccttcttgtcaccag

SEQ ID NO: 294074 - DNA, 17 bp, Homo sapiens
ccttctttaccttcatt

SEQ ID NO: 294075 - DNA, 17 bp, Homo sapiens
ccttgaacctcattaaa

SEQ ID NO: 294076 - DNA, 14 bp, Homo sapiens
ccttgaactcctgg

SEQ ID NO: 294077 - DNA, 17 bp, Homo sapiens
ccttgaatgatgccatg

SEQ ID NO: 294078 - DNA, 14 bp, Homo sapiens
ccttgaatttctag

SEQ ID NO: 294079 - DNA, 14 bp, Homo sapiens
ccttgaccccacac

SEQ ID NO: 294080 - DNA, 14 bp, Homo sapiens
ccttgacctttcca

SEQ ID NO: 294081 - DNA, 13 bp, Homo sapiens
ccttgactctttc

SEQ ID NO: 294082 - DNA, 16 bp, Homo sapiens
cgagcccagacctccc

SEQ ID NO: 294083 - DNA, 22 bp, Homo sapiens
cgagcccagacctcccctcttc

SEQ ID NO: 294084 - DNA, 14 bp, Homo sapiens
cgagccccctggat

SEQ ID NO: 294085 - DNA, 16 bp, Homo sapiens
cgagcccttagccttg

SEQ ID NO: 294086 - DNA, 19 bp, Homo sapiens
cgagccgagctctcctggg

SEQ ID NO: 294087 - DNA, 20 bp, Homo sapiens
cgagccgagctctcctgggc

SEQ ID NO: 294088 - DNA, 15 bp, Homo sapiens
cgagccgggcctggg

SEQ ID NO: 294089 - DNA, 16 bp, Homo sapiens
cgagctactctcttgc

SEQ ID NO: 294090 - DNA, 22 bp, Homo sapiens
cgagctctcctgggccagggtc

SEQ ID NO: 294091 - DNA, 18 bp, Homo sapiens
cgagctctgtcctctgtc

SEQ ID NO: 294092 - DNA, 15 bp, Homo sapiens
cgagctgggggccat

SEQ ID NO: 294093 - DNA, 21 bp, Homo sapiens
cgagctggtgcattacagaga

SEQ ID NO: 294094 - DNA, 20 bp, Homo sapiens
cgaggaagggccagagcctg

SEQ ID NO: 294095 - DNA, 20 bp, Homo sapiens
cgaggactttgattgcacat

SEQ ID NO: 294096 - DNA, 19 bp, Homo sapiens
cgaggcaatgactgtgagc

SEQ ID NO: 294097 - DNA, 15 bp, Homo sapiens
cgaggcaccggcgct

SEQ ID NO: 294098 - DNA, 19 bp, Homo sapiens
cgaggcagaatggtgggct

SEQ ID NO: 294099 - DNA, 15 bp, Homo sapiens
cgaggcagaggacag

SEQ ID NO: 294100 - DNA, 16 bp, Homo sapiens
cgaggcaggggctctg

SEQ ID NO: 294101 - DNA, 18 bp, Homo sapiens
cgaggcaggggctctgct

SEQ ID NO: 294102 - DNA, 19 bp, Homo sapiens
cgaggcaggggctgggcag

SEQ ID NO: 294103 - DNA, 21 bp, Homo sapiens
cgaggcaggggctgggcagag

SEQ ID NO: 294104 - DNA, 15 bp, Homo sapiens
cgaggccttcagaaa

SEQ ID NO: 294105 - DNA, 16 bp, Homo sapiens
cgaggcgaagctgagc

SEQ ID NO: 294106 - DNA, 13 bp, Homo sapiens
cgaggcgaggctg

SEQ ID NO: 294107 - DNA, 18 bp, Homo sapiens
cgaggcgaggctgcctct

SEQ ID NO: 294108 - DNA, 22 bp, Homo sapiens
cgaggcgaggctgcctctgggt

SEQ ID NO: 294109 - DNA, 17 bp, Homo sapiens
cgaggcgatgccacgct

SEQ ID NO: 294110 - DNA, 15 bp, Homo sapiens
cgaggcgggggagcc

SEQ ID NO: 294111 - DNA, 17 bp, Homo sapiens
cgaggcgggggagcctg

SEQ ID NO: 294112 - DNA, 20 bp, Homo sapiens
cgaggcgggggagcctggag

SEQ ID NO: 294113 - DNA, 15 bp, Homo sapiens
cgaggcgggggatcc

SEQ ID NO: 294114 - DNA, 19 bp, Homo sapiens
cgaggcgggggatcctgga

SEQ ID NO: 294115 - DNA, 13 bp, Homo sapiens
cgaggctccccgc

SEQ ID NO: 294116 - DNA, 18 bp, Homo sapiens
cgaggctccccgcctcca

SEQ ID NO: 294117 - DNA, 19 bp, Homo sapiens
cgaggctccccgcctccac

SEQ ID NO: 294118 - DNA, 18 bp, Homo sapiens
cgaggctgggccaagcca

SEQ ID NO: 294119 - DNA, 13 bp, Homo sapiens
cgagggaagcagt

SEQ ID NO: 294120 - DNA, 10 bp, Homo sapiens
cgagggaggg

SEQ ID NO: 294121 - DNA, 15 bp, Homo sapiens
cgagggaggggaggt

SEQ ID NO: 294122 - DNA, 18 bp, Homo sapiens
cgagggaggggaggtggc

SEQ ID NO: 294123 - DNA, 19 bp, Homo sapiens
cgagggatgggatttcatg

SEQ ID NO: 294124 - DNA, 19 bp, Homo sapiens
cgaggggagggtggcaggt

SEQ ID NO: 294125 - DNA, 23 bp, Homo sapiens
cgagggtcctggctcctgagggg

SEQ ID NO: 294126 - DNA, 18 bp, Homo sapiens
cgaggtgtcaccctgcag

SEQ ID NO: 294127 - DNA, 23 bp, Homo sapiens
cgaggtgtcaccctgcagagcta

SEQ ID NO: 294128 - DNA, 23 bp, Homo sapiens
cgagtactatgtattaccagccc

SEQ ID NO: 294129 - DNA, 19 bp, Homo sapiens
cgagtagctgggattacag

SEQ ID NO: 294130 - DNA, 14 bp, Homo sapiens
cgagtatctgtaac

SEQ ID NO: 294131 - DNA, 13 bp, Homo sapiens
cgagtcacctgca

SEQ ID NO: 294132 - DNA, 15 bp, Homo sapiens
cgagtcaccttccag

SEQ ID NO: 294133 - DNA, 14 bp, Homo sapiens
cgagtctggagacc

SEQ ID NO: 294134 - DNA, 20 bp, Homo sapiens
cgagtctggagaccaggact

SEQ ID NO: 294135 - DNA, 21 bp, Homo sapiens
cgagtgcccctgcaggggagg

SEQ ID NO: 294136 - DNA, 22 bp, Homo sapiens
cgagtggtctcctctcagcttc

SEQ ID NO: 294137 - DNA, 14 bp, Homo sapiens
cgatagtggtggtg

SEQ ID NO: 294138 - DNA, 20 bp, Homo sapiens
cgatccacctgtctcagcct

SEQ ID NO: 294139 - DNA, 22 bp, Homo sapiens
cgatccacctgtctcagcctcc

SEQ ID NO: 294140 - DNA, 18 bp, Homo sapiens
cgatccccgacagtggct

SEQ ID NO: 294141 - DNA, 13 bp, Homo sapiens
cgatctcagctca

SEQ ID NO: 294142 - DNA, 16 bp, Homo sapiens
cgatctcattcagtat

SEQ ID NO: 294143 - DNA, 17 bp, Homo sapiens
cgatctcttattttaca

SEQ ID NO: 294144 - DNA, 20 bp, Homo sapiens
cgatgcaagtgtttctgttc

SEQ ID NO: 294145 - DNA, 17 bp, Homo sapiens
cgatggagcccccagat

SEQ ID NO: 294146 - DNA, 21 bp, Homo sapiens
cgatgtcaaccttgtgtgagt

SEQ ID NO: 294147 - DNA, 23 bp, Homo sapiens
cgatgtggacctctactttccag

SEQ ID NO: 294148 - DNA, 13 bp, Homo sapiens
cgatgtggtgacc

SEQ ID NO: 294149 - DNA, 13 bp, Homo sapiens
cgatgtgttttat

SEQ ID NO: 294150 - DNA, 17 bp, Homo sapiens
cgattattatctaaagt

SEQ ID NO: 294151 - DNA, 12 bp, Homo sapiens
cgattgtaactc

SEQ ID NO: 294152 - DNA, 19 bp, Homo sapiens
cgcaaggcctgtgctgcat

SEQ ID NO: 294153 - DNA, 14 bp, Homo sapiens
cgcaagtctgcagc

SEQ ID NO: 294154 - DNA, 22 bp, Homo sapiens
cgcaattgtgggatgtcctctt

SEQ ID NO: 294155 - DNA, 15 bp, Homo sapiens
cgcacagcagcctgc

SEQ ID NO: 294156 - DNA, 17 bp, Homo sapiens
cgcaccagctgctctgc

SEQ ID NO: 294157 - DNA, 23 bp, Homo sapiens
cgcaccagctgctctgccccttg

SEQ ID NO: 294158 - DNA, 13 bp, Homo sapiens
cgcacccccaccc

SEQ ID NO: 294159 - DNA, 15 bp, Homo sapiens
cgcacccccaccctt

SEQ ID NO: 294160 - DNA, 20 bp, Homo sapiens
cgcacctaaagcagccagcc

SEQ ID NO: 294161 - DNA, 18 bp, Homo sapiens
cgcacgtgggtcttcagg

SEQ ID NO: 294162 - DNA, 12 bp, Homo sapiens
cgcagacacaca

SEQ ID NO: 294163 - DNA, 13 bp, Homo sapiens
cgcagacacacac

SEQ ID NO: 294164 - DNA, 14 bp, Homo sapiens
cgcagacacacaca

SEQ ID NO: 294165 - DNA, 16 bp, Homo sapiens
cgcagacagacagaca

SEQ ID NO: 294166 - DNA, 19 bp, Homo sapiens
cgcagagccccggagcacc

SEQ ID NO: 294167 - DNA, 13 bp, Homo sapiens
cgcagcaccagcc

SEQ ID NO: 294168 - DNA, 15 bp, Homo sapiens
cgcagcaccagcctg

SEQ ID NO: 294169 - DNA, 16 bp, Homo sapiens
cgcagcaccagcctga

SEQ ID NO: 294170 - DNA, 18 bp, Homo sapiens
cgcagcaccagcctgagc

SEQ ID NO: 294171 - DNA, 19 bp, Homo sapiens
cgcagcaccagcctgagcc

SEQ ID NO: 294172 - DNA, 21 bp, Homo sapiens
cgcagcaccagcctgagccac

SEQ ID NO: 294173 - DNA, 14 bp, Homo sapiens
cgcagccaggacac

SEQ ID NO: 294174 - DNA, 19 bp, Homo sapiens
cgcagcccgcctgccgtgc

SEQ ID NO: 294175 - DNA, 17 bp, Homo sapiens
cgcagcccgtgaagcag

SEQ ID NO: 294176 - DNA, 19 bp, Homo sapiens
cgcagcccgtgaagcagtg

SEQ ID NO: 294177 - DNA, 22 bp, Homo sapiens
cgcagccctagtgggagcccag

SEQ ID NO: 294178 - DNA, 24 bp, Homo sapiens
cgcagccctgctttgggctgccct

SEQ ID NO: 294179 - DNA, 20 bp, Homo sapiens
cgcagccgcgctctgcccct

SEQ ID NO: 294180 - DNA, 21 bp, Homo sapiens
cgcagccgcgctctgcccctc

SEQ ID NO: 294181 - DNA, 14 bp, Homo sapiens
cgcagcctccagtt

SEQ ID NO: 294182 - DNA, 13 bp, Homo sapiens
cgcaggagagaga

SEQ ID NO: 294183 - DNA, 17 bp, Homo sapiens
cgcaggagagagagaga

SEQ ID NO: 294184 - DNA, 20 bp, Homo sapiens
cgcaggagagagagagagaa

SEQ ID NO: 294185 - DNA, 21 bp, Homo sapiens
cgcaggagtctctgccaccca

SEQ ID NO: 294186 - DNA, 18 bp, Homo sapiens
cgcaggatccgctgccac

SEQ ID NO: 294187 - DNA, 23 bp, Homo sapiens
cgcaggccctggtggagaggcct

SEQ ID NO: 294188 - DNA, 13 bp, Homo sapiens
cgcagggagaccc

SEQ ID NO: 294189 - DNA, 18 bp, Homo sapiens
cgcagggcgctccggcag

SEQ ID NO: 294190 - DNA, 15 bp, Homo sapiens
cgcagtccccagccc

SEQ ID NO: 294191 - DNA, 15 bp, Homo sapiens
cgcagtggccctgag

SEQ ID NO: 294192 - DNA, 22 bp, Homo sapiens
cgcagtggcttttgccccagaa

SEQ ID NO: 294193 - DNA, 22 bp, Homo sapiens
cgcatagtgtgctcggacacag

SEQ ID NO: 294194 - DNA, 15 bp, Homo sapiens
cgcatatgcatgcca

SEQ ID NO: 294195 - DNA, 12 bp, Homo sapiens
cgcatcctccag

SEQ ID NO: 294196 - DNA, 14 bp, Homo sapiens
cgcatgcagcagct

SEQ ID NO: 294197 - DNA, 17 bp, Homo sapiens
cgcatgctgcctgcctc

SEQ ID NO: 294198 - DNA, 23 bp, Homo sapiens
cgcatggagtgtgtattgttccc

SEQ ID NO: 294199 - DNA, 16 bp, Homo sapiens
cgcatggcccctccag

SEQ ID NO: 294200 - DNA, 20 bp, Homo sapiens
cgcatggcccctccaggaac

SEQ ID NO: 294201 - DNA, 21 bp, Homo sapiens
cgcatgtctgcatggcagaag

SEQ ID NO: 294202 - DNA, 11 bp, Homo sapiens
cgcatgtgtgt

SEQ ID NO: 294203 - DNA, 20 bp, Homo sapiens
cgccaaagtgcagcccttcc

SEQ ID NO: 294204 - DNA, 17 bp, Homo sapiens
cgccaagccatcacagg

SEQ ID NO: 294205 - DNA, 23 bp, Homo sapiens
cgccaataataaaaaacaagaaa

SEQ ID NO: 294206 - DNA, 19 bp, Homo sapiens
cgccacacgctcactccag

SEQ ID NO: 294207 - DNA, 19 bp, Homo sapiens
cgccacatccccgctggct

SEQ ID NO: 294208 - DNA, 13 bp, Homo sapiens
cgccaccatcctg

SEQ ID NO: 294209 - DNA, 11 bp, Homo sapiens
cgccacccgcc

SEQ ID NO: 294210 - DNA, 13 bp, Homo sapiens
cgccacggccacc

SEQ ID NO: 294211 - DNA, 15 bp, Homo sapiens
cgccacggccaccct

SEQ ID NO: 294212 - DNA, 16 bp, Homo sapiens
cggagggatgcaggtg

SEQ ID NO: 294213 - DNA, 17 bp, Homo sapiens
cggagggattcccctaa

SEQ ID NO: 294214 - DNA, 13 bp, Homo sapiens
cggagtagaaatt

SEQ ID NO: 294215 - DNA, 18 bp, Homo sapiens
cggagtatctgggaactg

SEQ ID NO: 294216 - DNA, 13 bp, Homo sapiens
cggagttgggggt

SEQ ID NO: 294217 - DNA, 14 bp, Homo sapiens
cggatctccaggcc

SEQ ID NO: 294218 - DNA, 15 bp, Homo sapiens
cggatctccaggccc

SEQ ID NO: 294219 - DNA, 18 bp, Homo sapiens
cggatctccaggcccagc

SEQ ID NO: 294220 - DNA, 20 bp, Homo sapiens
cggatctccaggcccagcct

SEQ ID NO: 294221 - DNA, 13 bp, Homo sapiens
cggatgcccaccc

SEQ ID NO: 294222 - DNA, 13 bp, Homo sapiens
cggatggaaggag

SEQ ID NO: 294223 - DNA, 20 bp, Homo sapiens
cggattattatttgtacttt

SEQ ID NO: 294224 - DNA, 15 bp, Homo sapiens
cggcaacctgtaact

SEQ ID NO: 294225 - DNA, 16 bp, Homo sapiens
cggcaacctgtaactg

SEQ ID NO: 294226 - DNA, 17 bp, Homo sapiens
cggcaccgcccacccac

SEQ ID NO: 294227 - DNA, 13 bp, Homo sapiens
cggcaccttcccc

SEQ ID NO: 294228 - DNA, 11 bp, Homo sapiens
cggcagagagg

SEQ ID NO: 294229 - DNA, 13 bp, Homo sapiens
cggcagagaggac

SEQ ID NO: 294230 - DNA, 14 bp, Homo sapiens
cggcagaggcaggg

SEQ ID NO: 294231 - DNA, 11 bp, Homo sapiens
cggcagcccca

SEQ ID NO: 294232 - DNA, 13 bp, Homo sapiens
cggcagccccact

SEQ ID NO: 294233 - DNA, 14 bp, Homo sapiens
cggcagccccactt

SEQ ID NO: 294234 - DNA, 12 bp, Homo sapiens
cggcagcctggt

SEQ ID NO: 294235 - DNA, 20 bp, Homo sapiens
cggcagcctggttccctctt

SEQ ID NO: 294236 - DNA, 13 bp, Homo sapiens
cggcaggccctgc

SEQ ID NO: 294237 - DNA, 16 bp, Homo sapiens
cggcaggccctgcagt

SEQ ID NO: 294238 - DNA, 20 bp, Homo sapiens
cggcaggggcccctcctctg

SEQ ID NO: 294239 - DNA, 21 bp, Homo sapiens
cggcatgggaaagccacctct

SEQ ID NO: 294240 - DNA, 16 bp, Homo sapiens
cggcattcacacacag

SEQ ID NO: 294241 - DNA, 23 bp, Homo sapiens
cggcattggttccctttgctcca

SEQ ID NO: 294242 - DNA, 16 bp, Homo sapiens
cggccactccctgcca

SEQ ID NO: 294243 - DNA, 16 bp, Homo sapiens
cggccagagctcccag

SEQ ID NO: 294244 - DNA, 22 bp, Homo sapiens
cggcccaagcccgacttgctgt

SEQ ID NO: 294245 - DNA, 19 bp, Homo sapiens
cggcccacgcagagccccg

SEQ ID NO: 294246 - DNA, 15 bp, Homo sapiens
cggccccaggctccc

SEQ ID NO: 294247 - DNA, 19 bp, Homo sapiens
cggccccaggctcccctgg

SEQ ID NO: 294248 - DNA, 21 bp, Homo sapiens
cggcccccagagcgcccctcc

SEQ ID NO: 294249 - DNA, 17 bp, Homo sapiens
cggccccgcgcgtgccc

SEQ ID NO: 294250 - DNA, 18 bp, Homo sapiens
cggccccgcgcgtgcccc

SEQ ID NO: 294251 - DNA, 19 bp, Homo sapiens
cggccccgcgcgtgccccc

SEQ ID NO: 294252 - DNA, 14 bp, Homo sapiens
cggcccgccacctt

SEQ ID NO: 294253 - DNA, 19 bp, Homo sapiens
cggcccgccgtgcctgcat

SEQ ID NO: 294254 - DNA, 18 bp, Homo sapiens
cggcccggcccacgcaga

SEQ ID NO: 294255 - DNA, 18 bp, Homo sapiens
cggccctaccagcgcccg

SEQ ID NO: 294256 - DNA, 20 bp, Homo sapiens
cggccctaccagcgcccgct

SEQ ID NO: 294257 - DNA, 20 bp, Homo sapiens
cggccctgccccacacaggc

SEQ ID NO: 294258 - DNA, 20 bp, Homo sapiens
cggccctgtcagagccgcca

SEQ ID NO: 294259 - DNA, 20 bp, Homo sapiens
cggccgcatgtctgcatggc

SEQ ID NO: 294260 - DNA, 18 bp, Homo sapiens
cggccgcccagacaccac

SEQ ID NO: 294261 - DNA, 22 bp, Homo sapiens
cggccgccccgccccagagctc

SEQ ID NO: 294262 - DNA, 23 bp, Homo sapiens
cggccgccccgccccagagctcc

SEQ ID NO: 294263 - DNA, 14 bp, Homo sapiens
cggccggcctgggg

SEQ ID NO: 294264 - DNA, 10 bp, Homo sapiens
cggcctccac

SEQ ID NO: 294265 - DNA, 13 bp, Homo sapiens
cggcctccaggct

SEQ ID NO: 294266 - DNA, 23 bp, Homo sapiens
cggcctcctcttcaccccggcag

SEQ ID NO: 294267 - DNA, 17 bp, Homo sapiens
cggcctgatgctccctc

SEQ ID NO: 294268 - DNA, 19 bp, Homo sapiens
cggcctgatgctccctccc

SEQ ID NO: 294269 - DNA, 15 bp, Homo sapiens
cggcctgcagcccag

SEQ ID NO: 294270 - DNA, 15 bp, Homo sapiens
cggcctgctcccagc

SEQ ID NO: 294271 - DNA, 10 bp, Homo sapiens
cggcctgctt

SEQ ID NO: 294272 - DNA, 16 bp, Homo sapiens
cggcctgggagggtgg

SEQ ID NO: 294273 - DNA, 16 bp, Homo sapiens
cggccttggccttggg

SEQ ID NO: 294274 - DNA, 17 bp, Homo sapiens
cggcctttgttgctcag

SEQ ID NO: 294275 - DNA, 14 bp, Homo sapiens
cggcgcagcccctg

SEQ ID NO: 294276 - DNA, 15 bp, Homo sapiens
cggcgcagcccctgg

SEQ ID NO: 294277 - DNA, 18 bp, Homo sapiens
cggcgcagcccctggagc

SEQ ID NO: 294278 - DNA, 15 bp, Homo sapiens
cggcgccaccatcct

SEQ ID NO: 294279 - DNA, 15 bp, Homo sapiens
cggcgcccccagtgt

SEQ ID NO: 294280 - DNA, 15 bp, Homo sapiens
cggctaagaggctgc

SEQ ID NO: 294281 - DNA, 21 bp, Homo sapiens
cggctaccccccgtctcctgc

SEQ ID NO: 294282 - DNA, 18 bp, Homo sapiens
cggctccgagggcggcca

SEQ ID NO: 294283 - DNA, 21 bp, Homo sapiens
cggctccgagggcggccaggg

SEQ ID NO: 294284 - DNA, 18 bp, Homo sapiens
cggctctaggtggggcgg

SEQ ID NO: 294285 - DNA, 22 bp, Homo sapiens
cggctctcgtccctctgctccg

SEQ ID NO: 294286 - DNA, 16 bp, Homo sapiens
cggctctttccttgct

SEQ ID NO: 294287 - DNA, 18 bp, Homo sapiens
cggctgagagccccagct

SEQ ID NO: 294288 - DNA, 19 bp, Homo sapiens
cggctgagagccccagctg

SEQ ID NO: 294289 - DNA, 16 bp, Homo sapiens
cggctgaggacggggc

SEQ ID NO: 294290 - DNA, 20 bp, Homo sapiens
cggctgaggacggggcagag

SEQ ID NO: 294291 - DNA, 22 bp, Homo sapiens
cggctgaggacggggcagagct

SEQ ID NO: 294292 - DNA, 15 bp, Homo sapiens
cggctgcctgacact

SEQ ID NO: 294293 - DNA, 19 bp, Homo sapiens
cggctgcctgacactgagc

SEQ ID NO: 294294 - DNA, 13 bp, Homo sapiens
cggctgctggcac

SEQ ID NO: 294295 - DNA, 18 bp, Homo sapiens
cggctgctggcacagact

SEQ ID NO: 294296 - DNA, 21 bp, Homo sapiens
cggctggaaagaggagaagga

SEQ ID NO: 294297 - DNA, 18 bp, Homo sapiens
cggctggccggtccaccc

SEQ ID NO: 294298 - DNA, 20 bp, Homo sapiens
cggctggccggtccaccccg

SEQ ID NO: 294299 - DNA, 16 bp, Homo sapiens
cggctgggagcctcgc

SEQ ID NO: 294300 - DNA, 13 bp, Homo sapiens
cggctgggcaggg

SEQ ID NO: 294301 - DNA, 14 bp, Homo sapiens
cggctgggcagggc

SEQ ID NO: 294302 - DNA, 14 bp, Homo sapiens
cggctgtgtatttc

SEQ ID NO: 294303 - DNA, 15 bp, Homo sapiens
cggctgtgtatttct

SEQ ID NO: 294304 - DNA, 17 bp, Homo sapiens
cggcttccgagggcact

SEQ ID NO: 294305 - DNA, 14 bp, Homo sapiens
cggcttcctgtcca

SEQ ID NO: 294306 - DNA, 14 bp, Homo sapiens
cggcttgtgggctg

SEQ ID NO: 294307 - DNA, 15 bp, Homo sapiens
cggcttgtgggctgg

SEQ ID NO: 294308 - DNA, 19 bp, Homo sapiens
cggcttgtgggctggtgcc

SEQ ID NO: 294309 - DNA, 15 bp, Homo sapiens
cggctttgcagggag

SEQ ID NO: 294310 - DNA, 18 bp, Homo sapiens
cggcttttcagaagaaat

SEQ ID NO: 294311 - DNA, 20 bp, Homo sapiens
cgggaaaggatggagtgttt

SEQ ID NO: 294312 - DNA, 20 bp, Homo sapiens
cgggaaaggccggtgggaag

SEQ ID NO: 294313 - DNA, 18 bp, Homo sapiens
cgggaaattctgctgctt

SEQ ID NO: 294314 - DNA, 20 bp, Homo sapiens
cgggaacagtgtttcccata

SEQ ID NO: 294315 - DNA, 22 bp, Homo sapiens
cgggaacagtgtttcccataat

SEQ ID NO: 294316 - DNA, 18 bp, Homo sapiens
cgggaagagaggagttca

SEQ ID NO: 294317 - DNA, 22 bp, Homo sapiens
cgggaagagaggagttcaatga

SEQ ID NO: 294318 - DNA, 16 bp, Homo sapiens
cgggacagcggcccgg

SEQ ID NO: 294319 - DNA, 16 bp, Homo sapiens
cgggaccacagctgct

SEQ ID NO: 294320 - DNA, 17 bp, Homo sapiens
cgggaccacagctgctg

SEQ ID NO: 294321 - DNA, 22 bp, Homo sapiens
cgggaccattgacctcagctgc

SEQ ID NO: 294322 - DNA, 23 bp, Homo sapiens
cgggacccccggcctccaggctg

SEQ ID NO: 294323 - DNA, 22 bp, Homo sapiens
cgggactgtcttcaaccctgcc

SEQ ID NO: 294324 - DNA, 12 bp, Homo sapiens
cgggagagagtg

SEQ ID NO: 294325 - DNA, 17 bp, Homo sapiens
cgggagatccgccctgg

SEQ ID NO: 294326 - DNA, 19 bp, Homo sapiens
cgggagatccgccctgggc

SEQ ID NO: 294327 - DNA, 21 bp, Homo sapiens
cgggagatggacccctccctt

SEQ ID NO: 294328 - DNA, 14 bp, Homo sapiens
cgggagcagtgtct

SEQ ID NO: 294329 - DNA, 18 bp, Homo sapiens
cgggagcattctgcctgc

SEQ ID NO: 294330 - DNA, 15 bp, Homo sapiens
cgggagcctgcgtgg

SEQ ID NO: 294331 - DNA, 22 bp, Homo sapiens
cgggagctggtgacagccttgg

SEQ ID NO: 294332 - DNA, 18 bp, Homo sapiens
cgggaggaatttctgagt

SEQ ID NO: 294333 - DNA, 13 bp, Homo sapiens
cgggaggcaccag

SEQ ID NO: 294334 - DNA, 21 bp, Homo sapiens
cgggaggcaccagctctgtgg

SEQ ID NO: 294335 - DNA, 23 bp, Homo sapiens
cgggaggcaccagctctgtggcc

SEQ ID NO: 294336 - DNA, 11 bp, Homo sapiens
cgggcagcccc

SEQ ID NO: 294337 - DNA, 12 bp, Homo sapiens
cgggcagccccg

SEQ ID NO: 294338 - DNA, 14 bp, Homo sapiens
cgggcagcccctgc

SEQ ID NO: 294339 - DNA, 21 bp, Homo sapiens
cgggcagcccctgctggacca

SEQ ID NO: 294340 - DNA, 13 bp, Homo sapiens
cgggcagcctggc

SEQ ID NO: 294341 - DNA, 18 bp, Homo sapiens
cgggcagcctggctccca

SEQ ID NO: 294342 - DNA, 22 bp, Homo sapiens
cgggcagcctggctcccaggac

SEQ ID NO: 294343 - DNA, 20 bp, Homo sapiens
cgtgggctctggctccctgg

SEQ ID NO: 294344 - DNA, 23 bp, Homo sapiens
cgtgggtcatcccagcacctgcc

SEQ ID NO: 294345 - DNA, 22 bp, Homo sapiens
cgtgggtcttcagggggccagg

SEQ ID NO: 294346 - DNA, 19 bp, Homo sapiens
cgtggtcagggcagggctc

SEQ ID NO: 294347 - DNA, 14 bp, Homo sapiens
cgtggtgtgaggcc

SEQ ID NO: 294348 - DNA, 16 bp, Homo sapiens
cgtggtgtgaggcccc

SEQ ID NO: 294349 - DNA, 19 bp, Homo sapiens
cgtggtgtgaggcccccgg

SEQ ID NO: 294350 - DNA, 20 bp, Homo sapiens
cgtggttcagagactggcag

SEQ ID NO: 294351 - DNA, 21 bp, Homo sapiens
cgtggttcagagactggcagc

SEQ ID NO: 294352 - DNA, 22 bp, Homo sapiens
cgtgtagtggaagagcagcctg

SEQ ID NO: 294353 - DNA, 23 bp, Homo sapiens
cgtgtagtggaagagcagcctga

SEQ ID NO: 294354 - DNA, 13 bp, Homo sapiens
cgtgtattcagga

SEQ ID NO: 294355 - DNA, 13 bp, Homo sapiens
cgtgtccaggaga

SEQ ID NO: 294356 - DNA, 18 bp, Homo sapiens
cgtgtccccccaggtgct

SEQ ID NO: 294357 - DNA, 23 bp, Homo sapiens
cgtgtccctcctcttcctgtagt

SEQ ID NO: 294358 - DNA, 14 bp, Homo sapiens
cgtgtctctcccac

SEQ ID NO: 294359 - DNA, 20 bp, Homo sapiens
cgtgtgatttgtctctgagc

SEQ ID NO: 294360 - DNA, 18 bp, Homo sapiens
cgtgtgcacacacaccac

SEQ ID NO: 294361 - DNA, 15 bp, Homo sapiens
cgtgtgcatgagaat

SEQ ID NO: 294362 - DNA, 19 bp, Homo sapiens
cgtgtgccccaagaggcta

SEQ ID NO: 294363 - DNA, 14 bp, Homo sapiens
cgtgtggccctgtg

SEQ ID NO: 294364 - DNA, 15 bp, Homo sapiens
cgtgtggccctgtgg

SEQ ID NO: 294365 - DNA, 17 bp, Homo sapiens
cgtgtggccctgtggga

SEQ ID NO: 294366 - DNA, 19 bp, Homo sapiens
cgtgtggccctgtgggagt

SEQ ID NO: 294367 - DNA, 20 bp, Homo sapiens
cgtgtggccctgtgggagtc

SEQ ID NO: 294368 - DNA, 20 bp, Homo sapiens
cgtgtgtctcatgccagcag

SEQ ID NO: 294369 - DNA, 23 bp, Homo sapiens
cgtgtgtgcgcccctccccaccc

SEQ ID NO: 294370 - DNA, 16 bp, Homo sapiens
cgtgtgtgttgtctga

SEQ ID NO: 294371 - DNA, 21 bp, Homo sapiens
cgtgttctgaaggtgcccagg

SEQ ID NO: 294372 - DNA, 16 bp, Homo sapiens
cgttcacttccccttc

SEQ ID NO: 294373 - DNA, 12 bp, Homo sapiens
cgttcatttgtg

SEQ ID NO: 294374 - DNA, 17 bp, Homo sapiens
cgttcccacctctgagg

SEQ ID NO: 294375 - DNA, 14 bp, Homo sapiens
cgttccccttggct

SEQ ID NO: 294376 - DNA, 19 bp, Homo sapiens
cgttccccttggcttcctc

SEQ ID NO: 294377 - DNA, 13 bp, Homo sapiens
cgttccctgtcag

SEQ ID NO: 294378 - DNA, 21 bp, Homo sapiens
cgttcccttgtgtctgttgct

SEQ ID NO: 294379 - DNA, 18 bp, Homo sapiens
cgttccggttatgttgtg

SEQ ID NO: 294380 - DNA, 16 bp, Homo sapiens
cgttcctggccttctg

SEQ ID NO: 294381 - DNA, 17 bp, Homo sapiens
cgttcctgggactgtca

SEQ ID NO: 294382 - DNA, 11 bp, Homo sapiens
cgttctcctgc

SEQ ID NO: 294383 - DNA, 20 bp, Homo sapiens
cgttctcgtgacccagtggc

SEQ ID NO: 294384 - DNA, 16 bp, Homo sapiens
cgttgaggatgaggcc

SEQ ID NO: 294385 - DNA, 20 bp, Homo sapiens
cgttgaggccgcatctttct

SEQ ID NO: 294386 - DNA, 12 bp, Homo sapiens
cgttgcatggta

SEQ ID NO: 294387 - DNA, 17 bp, Homo sapiens
cgttgccgggcctggac

SEQ ID NO: 294388 - DNA, 20 bp, Homo sapiens
cgttggaattaaaacaatgt

SEQ ID NO: 294389 - DNA, 18 bp, Homo sapiens
cgttggacttttcgttaa

SEQ ID NO: 294390 - DNA, 23 bp, Homo sapiens
cgttggacttttcgttaacattg

SEQ ID NO: 294391 - DNA, 16 bp, Homo sapiens
cgttgtgggcaggcta

SEQ ID NO: 294392 - DNA, 16 bp, Homo sapiens
cgtttatgggccttgc

SEQ ID NO: 294393 - DNA, 14 bp, Homo sapiens
cgtttcattcattt

SEQ ID NO: 294394 - DNA, 16 bp, Homo sapiens
cgtttggtgtctgatg

SEQ ID NO: 294395 - DNA, 9 bp, Homo sapiens
cgtttgttt

SEQ ID NO: 294396 - DNA, 22 bp, Homo sapiens
cgttttaataatttttgctgaa

SEQ ID NO: 294397 - DNA, 13 bp, Homo sapiens
cgttttacagata

SEQ ID NO: 294398 - DNA, 18 bp, Homo sapiens
cgttttattgtgttttta

SEQ ID NO: 294399 - DNA, 17 bp, Homo sapiens
cgttttcatcctggcct

SEQ ID NO: 294400 - DNA, 20 bp, Homo sapiens
cgttttcatcctggcctcct

SEQ ID NO: 294401 - DNA, 23 bp, Homo sapiens
cgtttttatattacttttgtaaa

SEQ ID NO: 294402 - DNA, 14 bp, Homo sapiens
ctaaaaaataactg

SEQ ID NO: 294403 - DNA, 14 bp, Homo sapiens
ctaaaaacatttta

SEQ ID NO: 294404 - DNA, 17 bp, Homo sapiens
ctaaaaacattttaaaa

SEQ ID NO: 294405 - DNA, 23 bp, Homo sapiens
ctaaaaacattttaaaatcaact

SEQ ID NO: 294406 - DNA, 17 bp, Homo sapiens
ctaaaaataaaatgatg

SEQ ID NO: 294407 - DNA, 17 bp, Homo sapiens
ctaaaacaaaatctgaa

SEQ ID NO: 294408 - DNA, 18 bp, Homo sapiens
ctaaaacattaattgagg

SEQ ID NO: 294409 - DNA, 21 bp, Homo sapiens
ctaaaaccagttttgctgcta

SEQ ID NO: 294410 - DNA, 19 bp, Homo sapiens
ctaaaactagataacttaa

SEQ ID NO: 294411 - DNA, 13 bp, Homo sapiens
ctaaaactatggt

SEQ ID NO: 294412 - DNA, 19 bp, Homo sapiens
ctaaaagacagcagggaca

SEQ ID NO: 294413 - DNA, 12 bp, Homo sapiens
ctaaaagcacct

SEQ ID NO: 294414 - DNA, 17 bp, Homo sapiens
ctaaaagcatccctgtg

SEQ ID NO: 294415 - DNA, 20 bp, Homo sapiens
ctaaaagtgatgtgatttat

SEQ ID NO: 294416 - DNA, 22 bp, Homo sapiens
ctaaaagttaagtgtcatttct

SEQ ID NO: 294417 - DNA, 21 bp, Homo sapiens
ctaaaagttctcaaatattgg

SEQ ID NO: 294418 - DNA, 21 bp, Homo sapiens
ctaaaataaaatttaaaaaac

SEQ ID NO: 294419 - DNA, 14 bp, Homo sapiens
ctaaaatacattta

SEQ ID NO: 294420 - DNA, 15 bp, Homo sapiens
ctaaaattcaacaaa

SEQ ID NO: 294421 - DNA, 12 bp, Homo sapiens
ctaaaattctag

SEQ ID NO: 294422 - DNA, 14 bp, Homo sapiens
ctaaaattctagtc

SEQ ID NO: 294423 - DNA, 21 bp, Homo sapiens
ctaaaattctagtctctgatt

SEQ ID NO: 294424 - DNA, 13 bp, Homo sapiens
ctaaaccaaaaca

SEQ ID NO: 294425 - DNA, 17 bp, Homo sapiens
ctaaactgttttcatgt

SEQ ID NO: 294426 - DNA, 15 bp, Homo sapiens
ctaaagaaaaagata

SEQ ID NO: 294427 - DNA, 16 bp, Homo sapiens
ctaaagaagacacaca

SEQ ID NO: 294428 - DNA, 19 bp, Homo sapiens
ctaaagagagaatgtagat

SEQ ID NO: 294429 - DNA, 14 bp, Homo sapiens
ctaaagaggaagcc

SEQ ID NO: 294430 - DNA, 20 bp, Homo sapiens
ctaaagaggaagccttgccc

SEQ ID NO: 294431 - DNA, 20 bp, Homo sapiens
ctaaagaggtggggtgaagc

SEQ ID NO: 294432 - DNA, 22 bp, Homo sapiens
ctaaagaggtggggtgaagctg

SEQ ID NO: 294433 - DNA, 20 bp, Homo sapiens
ctaaagatatcagagctctt

SEQ ID NO: 294434 - DNA, 22 bp, Homo sapiens
ctaaagatatcagagctcttaa

SEQ ID NO: 294435 - DNA, 22 bp, Homo sapiens
ctaaagatggcgcacccggcag

SEQ ID NO: 294436 - DNA, 14 bp, Homo sapiens
ctaaagcagccagc

SEQ ID NO: 294437 - DNA, 14 bp, Homo sapiens
ctaaagcatcacac

SEQ ID NO: 294438 - DNA, 12 bp, Homo sapiens
ctaaagccctct

SEQ ID NO: 294439 - DNA, 14 bp, Homo sapiens
ctaaaggaaaaaac

SEQ ID NO: 294440 - DNA, 21 bp, Homo sapiens
ctaaaggactggttaaatcaa

SEQ ID NO: 294441 - DNA, 21 bp, Homo sapiens
ctaaaggggacagatcttgag

SEQ ID NO: 294442 - DNA, 19 bp, Homo sapiens
ctaaagggtgtgggtcagg

SEQ ID NO: 294443 - DNA, 16 bp, Homo sapiens
ctaaagtatgtaaagt

SEQ ID NO: 294444 - DNA, 20 bp, Homo sapiens
ctaaagtatgtaaagtatgt

SEQ ID NO: 294445 - DNA, 9 bp, Homo sapiens
ctaaagtgt

SEQ ID NO: 294446 - DNA, 19 bp, Homo sapiens
ctaaagtgtgttgttgctt

SEQ ID NO: 294447 - DNA, 10 bp, Homo sapiens
ctaaagtgtt

SEQ ID NO: 294448 - DNA, 23 bp, Homo sapiens
ctaaagttttattgatgtgaaat

SEQ ID NO: 294449 - DNA, 23 bp, Homo sapiens
ctaaataaagcttgcaacaaaat

SEQ ID NO: 294450 - DNA, 21 bp, Homo sapiens
ctaaataatatcctgaataac

SEQ ID NO: 294451 - DNA, 19 bp, Homo sapiens
ctaaatagatacttttgat

SEQ ID NO: 294452 - DNA, 15 bp, Homo sapiens
ctaaatagttctatc

SEQ ID NO: 294453 - DNA, 17 bp, Homo sapiens
ctaaatatccaaagact

SEQ ID NO: 294454 - DNA, 18 bp, Homo sapiens
ctaaatatccaaagactg

SEQ ID NO: 294455 - DNA, 20 bp, Homo sapiens
ctaaatatccaaagactgta

SEQ ID NO: 294456 - DNA, 23 bp, Homo sapiens
ctaaatatccaaagactgtactg

SEQ ID NO: 294457 - DNA, 15 bp, Homo sapiens
ctaaatcataatcat

SEQ ID NO: 294458 - DNA, 19 bp, Homo sapiens
ctaaatccattttctaaac

SEQ ID NO: 294459 - DNA, 23 bp, Homo sapiens
ctaaatccattttctaaactgtt

SEQ ID NO: 294460 - DNA, 22 bp, Homo sapiens
ctaaatctgtaagctctttgaa

SEQ ID NO: 294461 - DNA, 12 bp, Homo sapiens
ctaaatgaatgt

SEQ ID NO: 294462 - DNA, 14 bp, Homo sapiens
ctaaatgacttatt

SEQ ID NO: 294463 - DNA, 18 bp, Homo sapiens
ctaaatgcagttttaaga

SEQ ID NO: 294464 - DNA, 21 bp, Homo sapiens
ctaaatgcatatcctgagcca

SEQ ID NO: 294465 - DNA, 13 bp, Homo sapiens
ctaaatgttcatg

SEQ ID NO: 294466 - DNA, 18 bp, Homo sapiens
ctaaattaacttctattt

SEQ ID NO: 294467 - DNA, 21 bp, Homo sapiens
ctaaattgtatacattttgtt

SEQ ID NO: 294468 - DNA, 20 bp, Homo sapiens
ctaaatttacgtatatttca

SEQ ID NO: 294469 - DNA, 13 bp, Homo sapiens
ctaaatttctcag

SEQ ID NO: 294470 - DNA, 14 bp, Homo sapiens
ctaaatttgataat

SEQ ID NO: 294471 - DNA, 19 bp, Homo sapiens
ctaacaaaagatgaaagca

SEQ ID NO: 294472 - DNA, 16 bp, Homo sapiens
ctaacacagcatgtgt

SEQ ID NO: 294473 - DNA, 17 bp, Homo sapiens
ctaacacagcatgtgta

SEQ ID NO: 294474 - DNA, 19 bp, Homo sapiens
ctaacaccacactgaccac

SEQ ID NO: 294475 - DNA, 20 bp, Homo sapiens
ctaacaccacactgaccaca

SEQ ID NO: 294476 - DNA, 21 bp, Homo sapiens
ctaacagacatagactgcaaa

SEQ ID NO: 294477 - DNA, 17 bp, Homo sapiens
ctaacagataagcaaga

SEQ ID NO: 294478 - DNA, 18 bp, Homo sapiens
ctaacagataagcaagag

SEQ ID NO: 294479 - DNA, 18 bp, Homo sapiens
ctaacagatcagaacatg

SEQ ID NO: 294480 - DNA, 18 bp, Homo sapiens
ctaacataaaatctgtga

SEQ ID NO: 294481 - DNA, 20 bp, Homo sapiens
ctaacatagtgtctgctgct

SEQ ID NO: 294482 - DNA, 15 bp, Homo sapiens
ctaacatgttatcaa

SEQ ID NO: 294483 - DNA, 17 bp, Homo sapiens
ctaacatttaggagaag

SEQ ID NO: 294484 - DNA, 21 bp, Homo sapiens
ctaacattttaaataaaagaa

SEQ ID NO: 294485 - DNA, 20 bp, Homo sapiens
ctaaccacgtctgtcttcac

SEQ ID NO: 294486 - DNA, 10 bp, Homo sapiens
ctaaccacta

SEQ ID NO: 294487 - DNA, 12 bp, Homo sapiens
ctaaccatcccc

SEQ ID NO: 294488 - DNA, 13 bp, Homo sapiens
ctaaccatcccca

SEQ ID NO: 294489 - DNA, 14 bp, Homo sapiens
ctaaccatccccaa

SEQ ID NO: 294490 - DNA, 17 bp, Homo sapiens
ctaaccatccccaactc

SEQ ID NO: 294491 - DNA, 14 bp, Homo sapiens
ctaaccatttctta

SEQ ID NO: 294492 - DNA, 15 bp, Homo sapiens
ctaaccatttcttat

SEQ ID NO: 294493 - DNA, 19 bp, Homo sapiens
ctaaccctacatgcatgtt

SEQ ID NO: 294494 - DNA, 19 bp, Homo sapiens
ctaacctcttttctgcatc

SEQ ID NO: 294495 - DNA, 14 bp, Homo sapiens
ctaaccttttatca

SEQ ID NO: 294496 - DNA, 14 bp, Homo sapiens
ctaacgggcgcctt

SEQ ID NO: 294497 - DNA, 13 bp, Homo sapiens
ctaactaaactaa

SEQ ID NO: 294498 - DNA, 19 bp, Homo sapiens
ctaactccttgaggtcttg

SEQ ID NO: 294499 - DNA, 14 bp, Homo sapiens
ctaactgagctgcc

SEQ ID NO: 294500 - DNA, 16 bp, Homo sapiens
ctaactgagctgccag

SEQ ID NO: 294501 - DNA, 19 bp, Homo sapiens
ctaacttattttatttcca

SEQ ID NO: 294502 - DNA, 14 bp, Homo sapiens
ctaacttggagccg

SEQ ID NO: 294503 - DNA, 12 bp, Homo sapiens
ctaactttcttg

SEQ ID NO: 294504 - DNA, 14 bp, Homo sapiens
ctaagaaaaaggaa

SEQ ID NO: 294505 - DNA, 15 bp, Homo sapiens
ctaagaaaaaggaaa

SEQ ID NO: 294506 - DNA, 23 bp, Homo sapiens
ctaagaaacacatcaaataaact

SEQ ID NO: 294507 - DNA, 21 bp, Homo sapiens
ctaagaataaataaagaagaa

SEQ ID NO: 294508 - DNA, 13 bp, Homo sapiens
ctaagaattccca

SEQ ID NO: 294509 - DNA, 23 bp, Homo sapiens
ctaagacatagtctctacctata

SEQ ID NO: 294510 - DNA, 16 bp, Homo sapiens
ctaagagccacaataa

SEQ ID NO: 294511 - DNA, 12 bp, Homo sapiens
ctaagaggctgc

SEQ ID NO: 294512 - DNA, 22 bp, Homo sapiens
ctaagataattaaatgaaatac

SEQ ID NO: 294513 - DNA, 20 bp, Homo sapiens
ctaagatgagatttgccagc

SEQ ID NO: 294514 - DNA, 13 bp, Homo sapiens
ctaagattgtaca

SEQ ID NO: 294515 - DNA, 23 bp, Homo sapiens
ctaagcaaaagggaaaaggagcg

SEQ ID NO: 294516 - DNA, 20 bp, Homo sapiens
ctaagcactgtgtttatatg

SEQ ID NO: 294517 - DNA, 11 bp, Homo sapiens
ctaagccaagg

SEQ ID NO: 294518 - DNA, 17 bp, Homo sapiens
ctaagccactcccgcca

SEQ ID NO: 294519 - DNA, 18 bp, Homo sapiens
ctaagccagttttcattt

SEQ ID NO: 294520 - DNA, 20 bp, Homo sapiens
ctaagccctgtcgagacact

SEQ ID NO: 294521 - DNA, 16 bp, Homo sapiens
ctaagctcaaatgtat

SEQ ID NO: 294522 - DNA, 15 bp, Homo sapiens
ctaagctccaggtgc

SEQ ID NO: 294523 - DNA, 18 bp, Homo sapiens
ctaagctgttggaagggg

SEQ ID NO: 294524 - DNA, 17 bp, Homo sapiens
ctaagctttctcctttg

SEQ ID NO: 294525 - DNA, 22 bp, Homo sapiens
ctaaggaatatccagtcaaaga

SEQ ID NO: 294526 - DNA, 14 bp, Homo sapiens
ctaaggacacacta

SEQ ID NO: 294527 - DNA, 18 bp, Homo sapiens
ctaaggatagcctttgta

SEQ ID NO: 294528 - DNA, 18 bp, Homo sapiens
ctaaggatctctcaggag

SEQ ID NO: 294529 - DNA, 20 bp, Homo sapiens
ctaaggatctctcaggagca

SEQ ID NO: 294530 - DNA, 17 bp, Homo sapiens
ctaaggcatgctcccag

SEQ ID NO: 294531 - DNA, 18 bp, Homo sapiens
ctaaggcatgctcccagc

SEQ ID NO: 294532 - DNA, 16 bp, Homo sapiens
ctaaggccaaggcctc

SEQ ID NO: 294533 - DNA, 18 bp, Homo sapiens
ctaaggccaaggcctcag

SEQ ID NO: 294534 - DNA, 13 bp, Homo sapiens
ctaaggcccccaa

SEQ ID NO: 294535 - DNA, 22 bp, Homo sapiens
ctaaggcccccaaacatagccc

SEQ ID NO: 294536 - DNA, 16 bp, Homo sapiens
ctaaggctcctccttg

SEQ ID NO: 294537 - DNA, 15 bp, Homo sapiens
ctaagggaagaactc

SEQ ID NO: 294538 - DNA, 22 bp, Homo sapiens
ctaaggggcaggaatcaaggag

SEQ ID NO: 294539 - DNA, 18 bp, Homo sapiens
ctaagggtgtaagtaatt

SEQ ID NO: 294540 - DNA, 14 bp, Homo sapiens
ctaaggttctcata

SEQ ID NO: 294541 - DNA, 16 bp, Homo sapiens
ctaagtaaaagggtgg

SEQ ID NO: 294542 - DNA, 17 bp, Homo sapiens
ctaagtaaatctaaatt

SEQ ID NO: 294543 - DNA, 14 bp, Homo sapiens
ctaagtccagctct

SEQ ID NO: 294544 - DNA, 18 bp, Homo sapiens
ctaagtccctgccccctc

SEQ ID NO: 294545 - DNA, 18 bp, Homo sapiens
ctaagtgaggatgaaaaa

SEQ ID NO: 294546 - DNA, 23 bp, Homo sapiens
ctaagtggattggctttgtgctt

SEQ ID NO: 294547 - DNA, 13 bp, Homo sapiens
ctaagtgtaaaaa

SEQ ID NO: 294548 - DNA, 22 bp, Homo sapiens
ctaagttcatgtttgtaaatta

SEQ ID NO: 294549 - DNA, 17 bp, Homo sapiens
ctaagttctaagttcat

SEQ ID NO: 294550 - DNA, 20 bp, Homo sapiens
ctaagtttaattacaacagc

SEQ ID NO: 294551 - DNA, 22 bp, Homo sapiens
ctaagttttgtcatcaatccag

SEQ ID NO: 294552 - DNA, 13 bp, Homo sapiens
ctaataaaaaggt

SEQ ID NO: 294553 - DNA, 14 bp, Homo sapiens
ctaataaaatatca

SEQ ID NO: 294554 - DNA, 16 bp, Homo sapiens
ctaataaaatatcatt

SEQ ID NO: 294555 - DNA, 17 bp, Homo sapiens
ctaataaaatatcattc

SEQ ID NO: 294556 - DNA, 19 bp, Homo sapiens
ctaataaaatatcattcag

SEQ ID NO: 294557 - DNA, 20 bp, Homo sapiens
ctaataaaatatcattcagc

SEQ ID NO: 294558 - DNA, 11 bp, Homo sapiens
ctaataaactg

SEQ ID NO: 294559 - DNA, 23 bp, Homo sapiens
ctaataaagtctctttttctcac

SEQ ID NO: 294560 - DNA, 18 bp, Homo sapiens
ctaataaatgaccagttt

SEQ ID NO: 294561 - DNA, 20 bp, Homo sapiens
ctaataaatgaccagtttac

SEQ ID NO: 294562 - DNA, 18 bp, Homo sapiens
ctaatacactaatagtaa

SEQ ID NO: 294563 - DNA, 19 bp, Homo sapiens
ctaatactggttatcctgt

SEQ ID NO: 294564 - DNA, 20 bp, Homo sapiens
ctaatagaactcagttttaa

SEQ ID NO: 294565 - DNA, 19 bp, Homo sapiens
ctaatagagtacttaatat

SEQ ID NO: 294566 - DNA, 22 bp, Homo sapiens
ctaatagagtacttaatatact

SEQ ID NO: 294567 - DNA, 21 bp, Homo sapiens
ctaatatatttttatatttag

SEQ ID NO: 294568 - DNA, 11 bp, Homo sapiens
ctaatatcatt

SEQ ID NO: 294569 - DNA, 17 bp, Homo sapiens
ctaatatcattttattc

SEQ ID NO: 294570 - DNA, 18 bp, Homo sapiens
ctaatatcattttattca

SEQ ID NO: 294571 - DNA, 13 bp, Homo sapiens
ctaatatggcaaa

SEQ ID NO: 294572 - DNA, 16 bp, Homo sapiens
ctaatattaaaaatat

SEQ ID NO: 294573 - DNA, 18 bp, Homo sapiens
ctaatattaaaaatatgg

SEQ ID NO: 294574 - DNA, 19 bp, Homo sapiens
ctaatcaagagtgagtgaa

SEQ ID NO: 294575 - DNA, 22 bp, Homo sapiens
ctaatcagaaatttttatcagt

SEQ ID NO: 294576 - DNA, 16 bp, Homo sapiens
ctaatcagagtggcca

SEQ ID NO: 294577 - DNA, 18 bp, Homo sapiens
ctaatcagctcccttccc

SEQ ID NO: 294578 - DNA, 19 bp, Homo sapiens
ctaatcagggaggtcattt

SEQ ID NO: 294579 - DNA, 21 bp, Homo sapiens
ctaatcagggaggtcattttg

SEQ ID NO: 294580 - DNA, 18 bp, Homo sapiens
ctaatccccttctcccct

SEQ ID NO: 294581 - DNA, 20 bp, Homo sapiens
ctaatccccttctcccctgc

SEQ ID NO: 294582 - DNA, 15 bp, Homo sapiens
ctaatcgaactatga

SEQ ID NO: 294583 - DNA, 14 bp, Homo sapiens
ctaatctattgggt

SEQ ID NO: 294584 - DNA, 19 bp, Homo sapiens
ctaatctattgggttcatt

SEQ ID NO: 294585 - DNA, 21 bp, Homo sapiens
ctaatctgtagggctggacct

SEQ ID NO: 294586 - DNA, 22 bp, Homo sapiens
ctaatctgtagggctggaccta

SEQ ID NO: 294587 - DNA, 19 bp, Homo sapiens
ctaatgaaggccatcatct

SEQ ID NO: 294588 - DNA, 11 bp, Homo sapiens
ctaatgaattt

SEQ ID NO: 294589 - DNA, 21 bp, Homo sapiens
ctaatgaattttaaaagcata

SEQ ID NO: 294590 - DNA, 16 bp, Homo sapiens
ctaatgagaagtcaac

SEQ ID NO: 294591 - DNA, 18 bp, Homo sapiens
ctaatgagatatatcttt

SEQ ID NO: 294592 - DNA, 23 bp, Homo sapiens
ctaatgagatatatctttatact

SEQ ID NO: 294593 - DNA, 12 bp, Homo sapiens
ctaatgcattaa

SEQ ID NO: 294594 - DNA, 16 bp, Homo sapiens
ctaatgcattaacttt

SEQ ID NO: 294595 - DNA, 19 bp, Homo sapiens
ctaatgggtatttaaacaa

SEQ ID NO: 294596 - DNA, 14 bp, Homo sapiens
ctaatggtacgtgg

SEQ ID NO: 294597 - DNA, 21 bp, Homo sapiens
ctaatgtaatcatttatctta

SEQ ID NO: 294598 - DNA, 19 bp, Homo sapiens
ctaatgtcttcatttcatt

SEQ ID NO: 294599 - DNA, 20 bp, Homo sapiens
ctaatgttagaattgatttc

SEQ ID NO: 294600 - DNA, 20 bp, Homo sapiens
ctaattaaaacactttcaaa

SEQ ID NO: 294601 - DNA, 14 bp, Homo sapiens
ctaattaacatata

SEQ ID NO: 294602 - DNA, 15 bp, Homo sapiens
ctaattaacatataa

SEQ ID NO: 294603 - DNA, 16 bp, Homo sapiens
ctagccagcattccat

SEQ ID NO: 294604 - DNA, 14 bp, Homo sapiens
ctagccaggagtct

SEQ ID NO: 294605 - DNA, 19 bp, Homo sapiens
ctagccaggagtctgtgct

SEQ ID NO: 294606 - DNA, 17 bp, Homo sapiens
ctagccatatattttct

SEQ ID NO: 294607 - DNA, 19 bp, Homo sapiens
ctagccatggctggcagag

SEQ ID NO: 294608 - DNA, 14 bp, Homo sapiens
ctagccccagggtg

SEQ ID NO: 294609 - DNA, 23 bp, Homo sapiens
ctagccccagggtgagcagggcc

SEQ ID NO: 294610 - DNA, 20 bp, Homo sapiens
ctagcctctttgtgtttttg

SEQ ID NO: 294611 - DNA, 14 bp, Homo sapiens
ctagctagaaatat

SEQ ID NO: 294612 - DNA, 21 bp, Homo sapiens
ctagctataacaactctattt

SEQ ID NO: 294613 - DNA, 14 bp, Homo sapiens
ctagctggcaggac

SEQ ID NO: 294614 - DNA, 15 bp, Homo sapiens
ctagctggcaggaca

SEQ ID NO: 294615 - DNA, 13 bp, Homo sapiens
ctaggaaaggcag

SEQ ID NO: 294616 - DNA, 16 bp, Homo sapiens
ctaggaaaggcagaaa

SEQ ID NO: 294617 - DNA, 19 bp, Homo sapiens
ctaggaaaggcagaaacac

SEQ ID NO: 294618 - DNA, 23 bp, Homo sapiens
ctaggacacctgtggtatcttta

SEQ ID NO: 294619 - DNA, 19 bp, Homo sapiens
ctaggactcaggcctgcca

SEQ ID NO: 294620 - DNA, 21 bp, Homo sapiens
ctaggactcaggcctgccaat

SEQ ID NO: 294621 - DNA, 13 bp, Homo sapiens
ctaggactgagga

SEQ ID NO: 294622 - DNA, 15 bp, Homo sapiens
ctaggactgaggagt

SEQ ID NO: 294623 - DNA, 20 bp, Homo sapiens
ctaggactttagggatctgg

SEQ ID NO: 294624 - DNA, 17 bp, Homo sapiens
ctaggagagccaacctc

SEQ ID NO: 294625 - DNA, 22 bp, Homo sapiens
ctaggagagccaacctcggctt

SEQ ID NO: 294626 - DNA, 19 bp, Homo sapiens
ctaggagggagccttgtga

SEQ ID NO: 294627 - DNA, 16 bp, Homo sapiens
ctaggataatttttaa

SEQ ID NO: 294628 - DNA, 14 bp, Homo sapiens
ctaggatcccactg

SEQ ID NO: 294629 - DNA, 17 bp, Homo sapiens
ctaggattcctccccca

SEQ ID NO: 294630 - DNA, 22 bp, Homo sapiens
ctaggattcctcccccagagcc

SEQ ID NO: 294631 - DNA, 13 bp, Homo sapiens
ctaggatttcatg

SEQ ID NO: 294632 - DNA, 17 bp, Homo sapiens
ctaggcatactctccag

SEQ ID NO: 294633 - DNA, 22 bp, Homo sapiens
ctaggcatactctccaggattg

SEQ ID NO: 294634 - DNA, 14 bp, Homo sapiens
ctaggcatctcctc

SEQ ID NO: 294635 - DNA, 21 bp, Homo sapiens
ctaggcatttgtaaatattaa

SEQ ID NO: 294636 - DNA, 12 bp, Homo sapiens
ctaggccgggcg

SEQ ID NO: 294637 - DNA, 15 bp, Homo sapiens
ctaggcgtgagaagc

SEQ ID NO: 294638 - DNA, 14 bp, Homo sapiens
ctaggctgagatgc

SEQ ID NO: 294639 - DNA, 18 bp, Homo sapiens
ctaggctgagatgcacca

SEQ ID NO: 294640 - DNA, 12 bp, Homo sapiens
ctaggctgggtg

SEQ ID NO: 294641 - DNA, 20 bp, Homo sapiens
ctaggctgggtgcccacagc

SEQ ID NO: 294642 - DNA, 21 bp, Homo sapiens
ctagggaaggccacctgcagg

SEQ ID NO: 294643 - DNA, 23 bp, Homo sapiens
ctagggaggaccttatctgtgcg

SEQ ID NO: 294644 - DNA, 14 bp, Homo sapiens
ctagggctgggtgt

SEQ ID NO: 294645 - DNA, 23 bp, Homo sapiens
ctaggggagaagagccctggaca

SEQ ID NO: 294646 - DNA, 23 bp, Homo sapiens
ctaggggccgagggaaatgctgt

SEQ ID NO: 294647 - DNA, 22 bp, Homo sapiens
ctaggggtgcgctcacctgcag

SEQ ID NO: 294648 - DNA, 15 bp, Homo sapiens
ctagggtgcctgctc

SEQ ID NO: 294649 - DNA, 17 bp, Homo sapiens
ctagggtggcccttgca

SEQ ID NO: 294650 - DNA, 18 bp, Homo sapiens
ctagggttgctggagcct

SEQ ID NO: 294651 - DNA, 18 bp, Homo sapiens
ctagggttttggcctgcc

SEQ ID NO: 294652 - DNA, 15 bp, Homo sapiens
ctaggtagaggcatt

SEQ ID NO: 294653 - DNA, 13 bp, Homo sapiens
ctaggtagtgggg

SEQ ID NO: 294654 - DNA, 20 bp, Homo sapiens
ctaggtataaaaaataagta

SEQ ID NO: 294655 - DNA, 19 bp, Homo sapiens
ctaggtcaaggcctgtccc

SEQ ID NO: 294656 - DNA, 19 bp, Homo sapiens
ctaggtcagtacccacctg

SEQ ID NO: 294657 - DNA, 21 bp, Homo sapiens
ctaggtcagtacccacctgag

SEQ ID NO: 294658 - DNA, 16 bp, Homo sapiens
ctaggtctccacccct

SEQ ID NO: 294659 - DNA, 19 bp, Homo sapiens
ctaggtctccacccctcaa

SEQ ID NO: 294660 - DNA, 17 bp, Homo sapiens
ctaggtctcctcagggt

SEQ ID NO: 294661 - DNA, 23 bp, Homo sapiens
ctaggtgcacatatacatctagc

SEQ ID NO: 294662 - DNA, 15 bp, Homo sapiens
ctaggtgggccagcc

SEQ ID NO: 294663 - DNA, 18 bp, Homo sapiens
ctaggtgggccagcccct

SEQ ID NO: 294664 - DNA, 23 bp, Homo sapiens
ctaggtgggccagcccctcccac

SEQ ID NO: 294665 - DNA, 21 bp, Homo sapiens
ctaggtgggtcaactccaagg

SEQ ID NO: 294666 - DNA, 14 bp, Homo sapiens
ctaggtgtccccaa

SEQ ID NO: 294667 - DNA, 17 bp, Homo sapiens
ctaggttaacatttgta

SEQ ID NO: 294668 - DNA, 17 bp, Homo sapiens
ctaggttaataggagga

SEQ ID NO: 294669 - DNA, 14 bp, Homo sapiens
ctaggttgttttta

SEQ ID NO: 294670 - DNA, 15 bp, Homo sapiens
ctaggttgtttttaa

SEQ ID NO: 294671 - DNA, 14 bp, Homo sapiens
ctaggtttaactca

SEQ ID NO: 294672 - DNA, 18 bp, Homo sapiens
ctaggtttaactcagatc

SEQ ID NO: 294673 - DNA, 22 bp, Homo sapiens
ctaggtttaactcagatcacta

SEQ ID NO: 294674 - DNA, 21 bp, Homo sapiens
ctagtaaagacataggaacat

SEQ ID NO: 294675 - DNA, 22 bp, Homo sapiens
ctagtactctctgctctagcca

SEQ ID NO: 294676 - DNA, 15 bp, Homo sapiens
ctagtagaacaatgt

SEQ ID NO: 294677 - DNA, 16 bp, Homo sapiens
ctagtaggtctgcaca

SEQ ID NO: 294678 - DNA, 17 bp, Homo sapiens
ctagtatacccactgca

SEQ ID NO: 294679 - DNA, 18 bp, Homo sapiens
ctagtattgtccatatca

SEQ ID NO: 294680 - DNA, 13 bp, Homo sapiens
ctagtcaataaac

SEQ ID NO: 294681 - DNA, 16 bp, Homo sapiens
ctagtcagatggatgt

SEQ ID NO: 294682 - DNA, 16 bp, Homo sapiens
ctagtcagccacatgg

SEQ ID NO: 294683 - DNA, 15 bp, Homo sapiens
ctagtcccttcccct

SEQ ID NO: 294684 - DNA, 22 bp, Homo sapiens
ctagtcccttcccctccctggc

SEQ ID NO: 294685 - DNA, 21 bp, Homo sapiens
ctagtccggacccacctcacc

SEQ ID NO: 294686 - DNA, 23 bp, Homo sapiens
ctagtctcctttgcactgagggc

SEQ ID NO: 294687 - DNA, 14 bp, Homo sapiens
ctagtctctgattt

SEQ ID NO: 294688 - DNA, 18 bp, Homo sapiens
ctagtctctgatttgcaa

SEQ ID NO: 294689 - DNA, 23 bp, Homo sapiens
ctagtctctgatttgcaaatgca

SEQ ID NO: 294690 - DNA, 16 bp, Homo sapiens
ctagtctgtcagggcc

SEQ ID NO: 294691 - DNA, 13 bp, Homo sapiens
ctagtctgtgtgc

SEQ ID NO: 294692 - DNA, 14 bp, Homo sapiens
ctagtctgtgtgct

SEQ ID NO: 294693 - DNA, 18 bp, Homo sapiens
ctagtgacccggaggcca

SEQ ID NO: 294694 - DNA, 20 bp, Homo sapiens
ctagtgacttgtgtcccatg

SEQ ID NO: 294695 - DNA, 18 bp, Homo sapiens
ctagtgagctgggcatgg

SEQ ID NO: 294696 - DNA, 19 bp, Homo sapiens
ctagtgatacactgtatct

SEQ ID NO: 294697 - DNA, 19 bp, Homo sapiens
ctagtgcagctgattttaa

SEQ ID NO: 294698 - DNA, 21 bp, Homo sapiens
ctagtgcagctgattttaaca

SEQ ID NO: 294699 - DNA, 16 bp, Homo sapiens
ctagtgccatatattt

SEQ ID NO: 294700 - DNA, 16 bp, Homo sapiens
ctagtgctgaagctta

SEQ ID NO: 294701 - DNA, 22 bp, Homo sapiens
ctagtgctgaagcttattaatg

SEQ ID NO: 294702 - DNA, 22 bp, Homo sapiens
ctagtggaaagattgtgtctgg

SEQ ID NO: 294703 - DNA, 18 bp, Homo sapiens
ctagtggcttcagcccct

SEQ ID NO: 294704 - DNA, 15 bp, Homo sapiens
ctagtgggagcccag

SEQ ID NO: 294705 - DNA, 19 bp, Homo sapiens
ctagtgtgagtggcagcca

SEQ ID NO: 294706 - DNA, 15 bp, Homo sapiens
ctagtgtttctgcag

SEQ ID NO: 294707 - DNA, 16 bp, Homo sapiens
ctagtgtttctgcaga

SEQ ID NO: 294708 - DNA, 22 bp, Homo sapiens
ctagtgtttctgcagaggcagc

SEQ ID NO: 294709 - DNA, 15 bp, Homo sapiens
ctagttaaaagcctt

SEQ ID NO: 294710 - DNA, 21 bp, Homo sapiens
ctagttaacctagaagtattt

SEQ ID NO: 294711 - DNA, 19 bp, Homo sapiens
ctagttacccaccctaatt

SEQ ID NO: 294712 - DNA, 17 bp, Homo sapiens
ctagttagcaggaaata

SEQ ID NO: 294713 - DNA, 20 bp, Homo sapiens
ctagttagcaggaaatagtg

SEQ ID NO: 294714 - DNA, 18 bp, Homo sapiens
ctagttcatccaatcctc

SEQ ID NO: 294715 - DNA, 20 bp, Homo sapiens
ctagttcatccaatcctcac

SEQ ID NO: 294716 - DNA, 24 bp, Homo sapiens
ctagttcatccaatcctcactggg

SEQ ID NO: 294717 - DNA, 20 bp, Homo sapiens
ctagttccctcagtgtgaag

SEQ ID NO: 294718 - DNA, 13 bp, Homo sapiens
ctagttctagatg

SEQ ID NO: 294719 - DNA, 23 bp, Homo sapiens
ctagttctcaatcactgctcccc

SEQ ID NO: 294720 - DNA, 21 bp, Homo sapiens
ctagttcttcatcccactcca

SEQ ID NO: 294721 - DNA, 18 bp, Homo sapiens
ctagttctttgcattcgt

SEQ ID NO: 294722 - DNA, 21 bp, Homo sapiens
ctagtttaaaattattaaaaa

SEQ ID NO: 294723 - DNA, 18 bp, Homo sapiens
ctagtttcagtaaataat

SEQ ID NO: 294724 - DNA, 22 bp, Homo sapiens
ctagtttcagtaaataatgaaa

SEQ ID NO: 294725 - DNA, 12 bp, Homo sapiens
ctagtttgcata

SEQ ID NO: 294726 - DNA, 21 bp, Homo sapiens
ctagttttacagattgcctcc

SEQ ID NO: 294727 - DNA, 14 bp, Homo sapiens
ctataaaagtgata

SEQ ID NO: 294728 - DNA, 17 bp, Homo sapiens
ctataaagtaaagctaa

SEQ ID NO: 294729 - DNA, 12 bp, Homo sapiens
ctataaatatat

SEQ ID NO: 294730 - DNA, 13 bp, Homo sapiens
ctataaatggact

SEQ ID NO: 294731 - DNA, 19 bp, Homo sapiens
ctataaatggacttgcttc

SEQ ID NO: 294732 - DNA, 18 bp, Homo sapiens
ctcaccatttcatccata

SEQ ID NO: 294733 - DNA, 17 bp, Homo sapiens
ctcacccattgtctcat

SEQ ID NO: 294734 - DNA, 12 bp, Homo sapiens
ctcaccccaagg

SEQ ID NO: 294735 - DNA, 21 bp, Homo sapiens
ctcaccccagtgcctgtctgg

SEQ ID NO: 294736 - DNA, 19 bp, Homo sapiens
ctcaccccatcccacaccc

SEQ ID NO: 294737 - DNA, 14 bp, Homo sapiens
ctcacccccatccc

SEQ ID NO: 294738 - DNA, 13 bp, Homo sapiens
ctcacccctgggc

SEQ ID NO: 294739 - DNA, 15 bp, Homo sapiens
ctcacccctgggcag

SEQ ID NO: 294740 - DNA, 18 bp, Homo sapiens
ctcacccctgggcaggcg

SEQ ID NO: 294741 - DNA, 15 bp, Homo sapiens
ctcaccccttccttt

SEQ ID NO: 294742 - DNA, 16 bp, Homo sapiens
ctcacccgctgcccag

SEQ ID NO: 294743 - DNA, 17 bp, Homo sapiens
ctcacccgctgcccagc

SEQ ID NO: 294744 - DNA, 18 bp, Homo sapiens
ctcacccgctgcccagcc

SEQ ID NO: 294745 - DNA, 21 bp, Homo sapiens
ctcacccgctgcccagccctc

SEQ ID NO: 294746 - DNA, 13 bp, Homo sapiens
ctcaccctgcctt

SEQ ID NO: 294747 - DNA, 15 bp, Homo sapiens
ctcaccctgcttggg

SEQ ID NO: 294748 - DNA, 18 bp, Homo sapiens
ctcaccgctcaccctcct

SEQ ID NO: 294749 - DNA, 16 bp, Homo sapiens
ctcacctacttcctcc

SEQ ID NO: 294750 - DNA, 19 bp, Homo sapiens
ctcacctcaggaccccaga

SEQ ID NO: 294751 - DNA, 22 bp, Homo sapiens
ctcacctcaggaccccagaggg

SEQ ID NO: 294752 - DNA, 12 bp, Homo sapiens
ctcacctcctcc

SEQ ID NO: 294753 - DNA, 20 bp, Homo sapiens
ctcacctctaggcctcagtg

SEQ ID NO: 294754 - DNA, 14 bp, Homo sapiens
ctcacctctggact

SEQ ID NO: 294755 - DNA, 20 bp, Homo sapiens
ctcacctgggcacctgggga

SEQ ID NO: 294756 - DNA, 21 bp, Homo sapiens
ctcacctgggcacctggggag

SEQ ID NO: 294757 - DNA, 20 bp, Homo sapiens
ctcaccttgaacaccacgct

SEQ ID NO: 294758 - DNA, 19 bp, Homo sapiens
ctcaccttgcaacacacag

SEQ ID NO: 294759 - DNA, 22 bp, Homo sapiens
ctcaccttgcaacacacagaca

SEQ ID NO: 294760 - DNA, 14 bp, Homo sapiens
ctcacgactcttcc

SEQ ID NO: 294761 - DNA, 18 bp, Homo sapiens
ctcacgagatttgccagg

SEQ ID NO: 294762 - DNA, 22 bp, Homo sapiens
ctcacgagatttgccaggggca

SEQ ID NO: 294763 - DNA, 15 bp, Homo sapiens
ctcacgagccttgcg

SEQ ID NO: 294764 - DNA, 13 bp, Homo sapiens
ctcacgcctgtaa

SEQ ID NO: 294765 - DNA, 20 bp, Homo sapiens
ctcacgctcccaacacaagg

SEQ ID NO: 294766 - DNA, 13 bp, Homo sapiens
ctcacgctctgga

SEQ ID NO: 294767 - DNA, 17 bp, Homo sapiens
ctcacggggcctccaac

SEQ ID NO: 294768 - DNA, 23 bp, Homo sapiens
ctcacggggttggctgttccaga

SEQ ID NO: 294769 - DNA, 20 bp, Homo sapiens
ctcactatgtttctcagact

SEQ ID NO: 294770 - DNA, 13 bp, Homo sapiens
ctcactccactcc

SEQ ID NO: 294771 - DNA, 16 bp, Homo sapiens
ctcactccactcccct

SEQ ID NO: 294772 - DNA, 18 bp, Homo sapiens
ctcactccactcccctca

SEQ ID NO: 294773 - DNA, 21 bp, Homo sapiens
ctcactccaggaaggggctgg

SEQ ID NO: 294774 - DNA, 15 bp, Homo sapiens
ctcactcccagtcca

SEQ ID NO: 294775 - DNA, 12 bp, Homo sapiens
ctcactccccag

SEQ ID NO: 294776 - DNA, 13 bp, Homo sapiens
ctcactccccagc

SEQ ID NO: 294777 - DNA, 12 bp, Homo sapiens
ctcactcccctc

SEQ ID NO: 294778 - DNA, 22 bp, Homo sapiens
ctcactcccctcctttcccaac

SEQ ID NO: 294779 - DNA, 24 bp, Homo sapiens
ctcactccctaaagccctcttcag

SEQ ID NO: 294780 - DNA, 11 bp, Homo sapiens
ctcactctgcc

SEQ ID NO: 294781 - DNA, 18 bp, Homo sapiens
ctcactctgccagggcag

SEQ ID NO: 294782 - DNA, 13 bp, Homo sapiens
ctcactctgcttt

SEQ ID NO: 294783 - DNA, 13 bp, Homo sapiens
ctcactcttcctc

SEQ ID NO: 294784 - DNA, 19 bp, Homo sapiens
ctcactctttcttctctct

SEQ ID NO: 294785 - DNA, 15 bp, Homo sapiens
ctcactgcagcctcg

SEQ ID NO: 294786 - DNA, 18 bp, Homo sapiens
ctcactgcccgcacaccc

SEQ ID NO: 294787 - DNA, 19 bp, Homo sapiens
ctcactgctggggagtccc

SEQ ID NO: 294788 - DNA, 20 bp, Homo sapiens
ctcactgctggggagtccct

SEQ ID NO: 294789 - DNA, 12 bp, Homo sapiens
ctcactggccag

SEQ ID NO: 294790 - DNA, 21 bp, Homo sapiens
ctcactggccagtagctgcca

SEQ ID NO: 294791 - DNA, 16 bp, Homo sapiens
ctcactggctggggca

SEQ ID NO: 294792 - DNA, 17 bp, Homo sapiens
ctcactggctggggcag

SEQ ID NO: 294793 - DNA, 12 bp, Homo sapiens
ctcactgggtgg

SEQ ID NO: 294794 - DNA, 22 bp, Homo sapiens
ctcactggtgcatttaaaatgg

SEQ ID NO: 294795 - DNA, 18 bp, Homo sapiens
ctcactgttccctctgct

SEQ ID NO: 294796 - DNA, 13 bp, Homo sapiens
ctcacttatacca

SEQ ID NO: 294797 - DNA, 12 bp, Homo sapiens
ctcacttggggg

SEQ ID NO: 294798 - DNA, 14 bp, Homo sapiens
ctcacttttcactt

SEQ ID NO: 294799 - DNA, 18 bp, Homo sapiens
ctcacttttcacttgtct

SEQ ID NO: 294800 - DNA, 15 bp, Homo sapiens
ctcacttttctccat

SEQ ID NO: 294801 - DNA, 15 bp, Homo sapiens
ctcagaacacattct

SEQ ID NO: 294802 - DNA, 17 bp, Homo sapiens
ctcagaacacattcttt

SEQ ID NO: 294803 - DNA, 20 bp, Homo sapiens
ctcagaacaccccgctctgg

SEQ ID NO: 294804 - DNA, 20 bp, Homo sapiens
ctcagaactgttggctgctc

SEQ ID NO: 294805 - DNA, 14 bp, Homo sapiens
ctcagaatgctcta

SEQ ID NO: 294806 - DNA, 21 bp, Homo sapiens
ctcagaccaactctctcctgt

SEQ ID NO: 294807 - DNA, 18 bp, Homo sapiens
ctcagacgagacacccta

SEQ ID NO: 294808 - DNA, 19 bp, Homo sapiens
ctcagacgggctgagagga

SEQ ID NO: 294809 - DNA, 16 bp, Homo sapiens
ctcagactctaaacac

SEQ ID NO: 294810 - DNA, 20 bp, Homo sapiens
ctcagagaaggaaaagactg

SEQ ID NO: 294811 - DNA, 12 bp, Homo sapiens
ctcagagacagc

SEQ ID NO: 294812 - DNA, 23 bp, Homo sapiens
ctcagagacagcgcgagtagcac

SEQ ID NO: 294813 - DNA, 14 bp, Homo sapiens
ctcagagcagagca

SEQ ID NO: 294814 - DNA, 15 bp, Homo sapiens
ctcagagcagcctct

SEQ ID NO: 294815 - DNA, 14 bp, Homo sapiens
ctcagagcatgtgt

SEQ ID NO: 294816 - DNA, 11 bp, Homo sapiens
ctcagagccaa

SEQ ID NO: 294817 - DNA, 13 bp, Homo sapiens
ctcagagccaagt

SEQ ID NO: 294818 - DNA, 14 bp, Homo sapiens
ctcagagccccgca

SEQ ID NO: 294819 - DNA, 16 bp, Homo sapiens
ctcagagccctgccct

SEQ ID NO: 294820 - DNA, 17 bp, Homo sapiens
ctcagaggctgacactg

SEQ ID NO: 294821 - DNA, 19 bp, Homo sapiens
ctcagagggtccctaggtg

SEQ ID NO: 294822 - DNA, 18 bp, Homo sapiens
ctcagagggttgttctcc

SEQ ID NO: 294823 - DNA, 15 bp, Homo sapiens
ctcagagtccaggcc

SEQ ID NO: 294824 - DNA, 17 bp, Homo sapiens
ctcagattatttttcct

SEQ ID NO: 294825 - DNA, 16 bp, Homo sapiens
ctcagcaaattcttga

SEQ ID NO: 294826 - DNA, 15 bp, Homo sapiens
ctcagcaacctgtaa

SEQ ID NO: 294827 - DNA, 22 bp, Homo sapiens
ctcagcaactgttagctgggaa

SEQ ID NO: 294828 - DNA, 23 bp, Homo sapiens
ctcagcaactgttagctgggaag

SEQ ID NO: 294829 - DNA, 18 bp, Homo sapiens
ctcagcaaggggctctgc

SEQ ID NO: 294830 - DNA, 14 bp, Homo sapiens
ctcagcaagtgctg

SEQ ID NO: 294831 - DNA, 13 bp, Homo sapiens
ctcagcaagtgta

SEQ ID NO: 294832 - DNA, 16 bp, Homo sapiens
ctcagcaagtgtacag

SEQ ID NO: 294833 - DNA, 19 bp, Homo sapiens
ctcagcaatagggtgcagt

SEQ ID NO: 294834 - DNA, 14 bp, Homo sapiens
ctcagcacagcctc

SEQ ID NO: 294835 - DNA, 21 bp, Homo sapiens
ctcagcacagcctcacccctg

SEQ ID NO: 294836 - DNA, 12 bp, Homo sapiens
ctcagcacttgg

SEQ ID NO: 294837 - DNA, 12 bp, Homo sapiens
ctcagcagttca

SEQ ID NO: 294838 - DNA, 14 bp, Homo sapiens
ctcagcagttcact

SEQ ID NO: 294839 - DNA, 18 bp, Homo sapiens
ctcagccaagacaaggag

SEQ ID NO: 294840 - DNA, 23 bp, Homo sapiens
ctcagccccagcccagcccagct

SEQ ID NO: 294841 - DNA, 15 bp, Homo sapiens
ctcagccccagggcc

SEQ ID NO: 294842 - DNA, 20 bp, Homo sapiens
ctcagccccagggccctgct

SEQ ID NO: 294843 - DNA, 16 bp, Homo sapiens
ctcagccccggccact

SEQ ID NO: 294844 - DNA, 20 bp, Homo sapiens
ctcagccccggccactccct

SEQ ID NO: 294845 - DNA, 11 bp, Homo sapiens
ctcagcccctc

SEQ ID NO: 294846 - DNA, 16 bp, Homo sapiens
ctcagcccctcttgcc

SEQ ID NO: 294847 - DNA, 15 bp, Homo sapiens
ctcagccctagaggc

SEQ ID NO: 294848 - DNA, 13 bp, Homo sapiens
ctcagccctgagg

SEQ ID NO: 294849 - DNA, 13 bp, Homo sapiens
ctcagcccttgcc

SEQ ID NO: 294850 - DNA, 13 bp, Homo sapiens
ctcagcctcccag

SEQ ID NO: 294851 - DNA, 14 bp, Homo sapiens
ctcagcctcctgag

SEQ ID NO: 294852 - DNA, 17 bp, Homo sapiens
ctcagcctcctgagcct

SEQ ID NO: 294853 - DNA, 15 bp, Homo sapiens
ctcagcctcctgtgt

SEQ ID NO: 294854 - DNA, 23 bp, Homo sapiens
ctcagcctcctgtgtagctggga

SEQ ID NO: 294855 - DNA, 13 bp, Homo sapiens
ctcagcctctcaa

SEQ ID NO: 294856 - DNA, 21 bp, Homo sapiens
ctcagccttccgagtagctgg

SEQ ID NO: 294857 - DNA, 16 bp, Homo sapiens
ctcagcgctccctgtc

SEQ ID NO: 294858 - DNA, 22 bp, Homo sapiens
ctcagcgctccctgtcgcctgc

SEQ ID NO: 294859 - DNA, 19 bp, Homo sapiens
ctcagctcactgcaagctc

SEQ ID NO: 294860 - DNA, 16 bp, Homo sapiens
ctcagctccactctga

SEQ ID NO: 294861 - DNA, 17 bp, Homo sapiens
ctcagctccactctgaa

SEQ ID NO: 294862 - DNA, 20 bp, Homo sapiens
ctcagctctcagttgcagcc

SEQ ID NO: 294863 - DNA, 15 bp, Homo sapiens
ctccaggccagctcc

SEQ ID NO: 294864 - DNA, 18 bp, Homo sapiens
ctccaggccagctccttt

SEQ ID NO: 294865 - DNA, 23 bp, Homo sapiens
ctccaggccagctccttttctgt

SEQ ID NO: 294866 - DNA, 16 bp, Homo sapiens
ctccaggcccagcctg

SEQ ID NO: 294867 - DNA, 22 bp, Homo sapiens
ctccaggcccagcctggcccca

SEQ ID NO: 294868 - DNA, 18 bp, Homo sapiens
ctccaggcccccaactcc

SEQ ID NO: 294869 - DNA, 14 bp, Homo sapiens
ctccaggccctcag

SEQ ID NO: 294870 - DNA, 17 bp, Homo sapiens
ctccaggccctcagatg

SEQ ID NO: 294871 - DNA, 18 bp, Homo sapiens
ctccaggccctcagatgg

SEQ ID NO: 294872 - DNA, 16 bp, Homo sapiens
ctccaggctccaggct

SEQ ID NO: 294873 - DNA, 18 bp, Homo sapiens
ctccaggctccaggctga

SEQ ID NO: 294874 - DNA, 20 bp, Homo sapiens
ctccaggctccaggctgact

SEQ ID NO: 294875 - DNA, 13 bp, Homo sapiens
ctccaggctgact

SEQ ID NO: 294876 - DNA, 23 bp, Homo sapiens
ctccaggctgactgggggcctct

SEQ ID NO: 294877 - DNA, 13 bp, Homo sapiens
ctccaggctgggg

SEQ ID NO: 294878 - DNA, 14 bp, Homo sapiens
ctccaggctggggc

SEQ ID NO: 294879 - DNA, 16 bp, Homo sapiens
ctccaggctggggcct

SEQ ID NO: 294880 - DNA, 18 bp, Homo sapiens
ctccagggagcaagacag

SEQ ID NO: 294881 - DNA, 20 bp, Homo sapiens
ctccagggagcaagacagag

SEQ ID NO: 294882 - DNA, 22 bp, Homo sapiens
ctccagggagcaagacagagac

SEQ ID NO: 294883 - DNA, 14 bp, Homo sapiens
ctccagggagtccc

SEQ ID NO: 294884 - DNA, 17 bp, Homo sapiens
ctccagggagtcccctc

SEQ ID NO: 294885 - DNA, 20 bp, Homo sapiens
ctccagggagtcccctcccc

SEQ ID NO: 294886 - DNA, 17 bp, Homo sapiens
ctccagggcccccaccg

SEQ ID NO: 294887 - DNA, 18 bp, Homo sapiens
ctccagggcccccaccga

SEQ ID NO: 294888 - DNA, 21 bp, Homo sapiens
ctccagggggcctgcaggccc

SEQ ID NO: 294889 - DNA, 23 bp, Homo sapiens
ctccagggggcctgcaggcccca

SEQ ID NO: 294890 - DNA, 13 bp, Homo sapiens
ctccagggtcttg

SEQ ID NO: 294891 - DNA, 18 bp, Homo sapiens
ctccagggtcttgggcta

SEQ ID NO: 294892 - DNA, 22 bp, Homo sapiens
ctccaggtgccctgtgggagag

SEQ ID NO: 294893 - DNA, 21 bp, Homo sapiens
ctccaggttcgtatagaaaaa

SEQ ID NO: 294894 - DNA, 14 bp, Homo sapiens
ctccagtattcttg

SEQ ID NO: 294895 - DNA, 16 bp, Homo sapiens
ctccagtcaggaggca

SEQ ID NO: 294896 - DNA, 22 bp, Homo sapiens
ctccagtcctgctctctaccca

SEQ ID NO: 294897 - DNA, 20 bp, Homo sapiens
ctccagtctgctgccctcca

SEQ ID NO: 294898 - DNA, 14 bp, Homo sapiens
ctccagtgcttggc

SEQ ID NO: 294899 - DNA, 16 bp, Homo sapiens
ctccagtgcttggctg

SEQ ID NO: 294900 - DNA, 19 bp, Homo sapiens
ctccagtgcttggctgccc

SEQ ID NO: 294901 - DNA, 19 bp, Homo sapiens
ctccagtggaagaagaaaa

SEQ ID NO: 294902 - DNA, 15 bp, Homo sapiens
ctccagttctttata

SEQ ID NO: 294903 - DNA, 14 bp, Homo sapiens
ctccatacagcctc

SEQ ID NO: 294904 - DNA, 15 bp, Homo sapiens
ctccatacagcctct

SEQ ID NO: 294905 - DNA, 15 bp, Homo sapiens
ctccatatcagctct

SEQ ID NO: 294906 - DNA, 22 bp, Homo sapiens
ctccatatcagctctctgcaga

SEQ ID NO: 294907 - DNA, 12 bp, Homo sapiens
ctccatcccctc

SEQ ID NO: 294908 - DNA, 18 bp, Homo sapiens
ctccatcccctccctgcc

SEQ ID NO: 294909 - DNA, 20 bp, Homo sapiens
ctccatcccctccctgcctg

SEQ ID NO: 294910 - DNA, 14 bp, Homo sapiens
ctccatcctgccag

SEQ ID NO: 294911 - DNA, 16 bp, Homo sapiens
ctccatcctgccagga

SEQ ID NO: 294912 - DNA, 19 bp, Homo sapiens
ctccatccttgcatcactg

SEQ ID NO: 294913 - DNA, 13 bp, Homo sapiens
ctccatctccact

SEQ ID NO: 294914 - DNA, 17 bp, Homo sapiens
ctccatctggggatgga

SEQ ID NO: 294915 - DNA, 22 bp, Homo sapiens
ctccatcttggtagttctgtgc

SEQ ID NO: 294916 - DNA, 17 bp, Homo sapiens
ctccatgaccaggccac

SEQ ID NO: 294917 - DNA, 17 bp, Homo sapiens
ctccatgagttttttct

SEQ ID NO: 294918 - DNA, 19 bp, Homo sapiens
ctccatgcagatctagcca

SEQ ID NO: 294919 - DNA, 21 bp, Homo sapiens
ctccatgctcctcacctgtct

SEQ ID NO: 294920 - DNA, 15 bp, Homo sapiens
ctccatgctgcctcc

SEQ ID NO: 294921 - DNA, 16 bp, Homo sapiens
ctccatgctgcctcca

SEQ ID NO: 294922 - DNA, 15 bp, Homo sapiens
ctccatggcaggaag

SEQ ID NO: 294923 - DNA, 12 bp, Homo sapiens
ctccatggccac

SEQ ID NO: 294924 - DNA, 21 bp, Homo sapiens
ctccatggccaccccgtgcca

SEQ ID NO: 294925 - DNA, 22 bp, Homo sapiens
ctccatggccaccccgtgccac

SEQ ID NO: 294926 - DNA, 15 bp, Homo sapiens
ctccatggccctgcc

SEQ ID NO: 294927 - DNA, 20 bp, Homo sapiens
ctccatggccctgccatgct

SEQ ID NO: 294928 - DNA, 14 bp, Homo sapiens
ctccatggcccttc

SEQ ID NO: 294929 - DNA, 17 bp, Homo sapiens
ctccatggcccttcctg

SEQ ID NO: 294930 - DNA, 17 bp, Homo sapiens
ctccatgggctagtgtg

SEQ ID NO: 294931 - DNA, 17 bp, Homo sapiens
ctccatggggttcgaga

SEQ ID NO: 294932 - DNA, 18 bp, Homo sapiens
ctccatggggttcgagac

SEQ ID NO: 294933 - DNA, 13 bp, Homo sapiens
ctccatgtggccc

SEQ ID NO: 294934 - DNA, 20 bp, Homo sapiens
ctccatgtttagaaataaat

SEQ ID NO: 294935 - DNA, 23 bp, Homo sapiens
ctccatgtttagaaataaatgaa

SEQ ID NO: 294936 - DNA, 18 bp, Homo sapiens
ctccattcccatcactgc

SEQ ID NO: 294937 - DNA, 15 bp, Homo sapiens
ctccatttagttctt

SEQ ID NO: 294938 - DNA, 21 bp, Homo sapiens
ctccatttataaccccagcct

SEQ ID NO: 294939 - DNA, 22 bp, Homo sapiens
ctccatttcttggttttgtatt

SEQ ID NO: 294940 - DNA, 15 bp, Homo sapiens
ctccattttcttgtc

SEQ ID NO: 294941 - DNA, 13 bp, Homo sapiens
ctccatttttccc

SEQ ID NO: 294942 - DNA, 13 bp, Homo sapiens
ctccatttttgtt

SEQ ID NO: 294943 - DNA, 21 bp, Homo sapiens
ctcccaaagagctgcctaaga

SEQ ID NO: 294944 - DNA, 12 bp, Homo sapiens
ctcccaacctca

SEQ ID NO: 294945 - DNA, 16 bp, Homo sapiens
ctcccaactctggcct

SEQ ID NO: 294946 - DNA, 19 bp, Homo sapiens
ctcccaagctcagagcagc

SEQ ID NO: 294947 - DNA, 17 bp, Homo sapiens
ctcccaaggtcctctca

SEQ ID NO: 294948 - DNA, 16 bp, Homo sapiens
ctcccaataaagctgg

SEQ ID NO: 294949 - DNA, 18 bp, Homo sapiens
ctcccaataaagctggac

SEQ ID NO: 294950 - DNA, 15 bp, Homo sapiens
ctcccacacttgctg

SEQ ID NO: 294951 - DNA, 20 bp, Homo sapiens
ctcccacacttgctggggct

SEQ ID NO: 294952 - DNA, 13 bp, Homo sapiens
ctcccacagagac

SEQ ID NO: 294953 - DNA, 16 bp, Homo sapiens
ctcccacaggcccttc

SEQ ID NO: 294954 - DNA, 13 bp, Homo sapiens
ctcccaccacagc

SEQ ID NO: 294955 - DNA, 14 bp, Homo sapiens
ctcccaccacagca

SEQ ID NO: 294956 - DNA, 19 bp, Homo sapiens
ctcccaccacagcaggtgt

SEQ ID NO: 294957 - DNA, 22 bp, Homo sapiens
ctcccaccagaacgcaccccac

SEQ ID NO: 294958 - DNA, 15 bp, Homo sapiens
ctcccacccccatct

SEQ ID NO: 294959 - DNA, 20 bp, Homo sapiens
ctcccacccccatctctccc

SEQ ID NO: 294960 - DNA, 18 bp, Homo sapiens
ctcccacccccttctctg

SEQ ID NO: 294961 - DNA, 23 bp, Homo sapiens
ctcccacccccttctctgctcca

SEQ ID NO: 294962 - DNA, 18 bp, Homo sapiens
ctcccaccccggcctcca

SEQ ID NO: 294963 - DNA, 19 bp, Homo sapiens
ctcccaccccggcctccac

SEQ ID NO: 294964 - DNA, 23 bp, Homo sapiens
ctcccaccccttgattcccataa

SEQ ID NO: 294965 - DNA, 19 bp, Homo sapiens
ctcccacccggccacagct

SEQ ID NO: 294966 - DNA, 14 bp, Homo sapiens
ctcccactcctgtt

SEQ ID NO: 294967 - DNA, 17 bp, Homo sapiens
ctcccagacaggccctc

SEQ ID NO: 294968 - DNA, 22 bp, Homo sapiens
ctcccagacaggccctccctgt

SEQ ID NO: 294969 - DNA, 23 bp, Homo sapiens
ctcccagacaggccctccctgtc

SEQ ID NO: 294970 - DNA, 13 bp, Homo sapiens
ctcccagacccag

SEQ ID NO: 294971 - DNA, 21 bp, Homo sapiens
ctcccagacccagggcagtgt

SEQ ID NO: 294972 - DNA, 16 bp, Homo sapiens
ctcccagacttgtttc

SEQ ID NO: 294973 - DNA, 18 bp, Homo sapiens
ctcccagacttgtttcct

SEQ ID NO: 294974 - DNA, 20 bp, Homo sapiens
ctcccagacttgtttcctgt

SEQ ID NO: 294975 - DNA, 14 bp, Homo sapiens
ctcccagccaccac

SEQ ID NO: 294976 - DNA, 21 bp, Homo sapiens
ctcccagccaccaccactgtc

SEQ ID NO: 294977 - DNA, 22 bp, Homo sapiens
ctcccagcctcttgctcagagc

SEQ ID NO: 294978 - DNA, 11 bp, Homo sapiens
ctcccagcctg

SEQ ID NO: 294979 - DNA, 15 bp, Homo sapiens
ctcccagctggtgtc

SEQ ID NO: 294980 - DNA, 16 bp, Homo sapiens
ctcccagctggtgtca

SEQ ID NO: 294981 - DNA, 20 bp, Homo sapiens
ctcccaggacctggagacag

SEQ ID NO: 294982 - DNA, 18 bp, Homo sapiens
ctcccaggccccctgcat

SEQ ID NO: 294983 - DNA, 12 bp, Homo sapiens
ctcccaggcccg

SEQ ID NO: 294984 - DNA, 22 bp, Homo sapiens
ctcccaggcgccccttccccct

SEQ ID NO: 294985 - DNA, 19 bp, Homo sapiens
ctcccagggcccgagcgcg

SEQ ID NO: 294986 - DNA, 23 bp, Homo sapiens
ctcccagggcccgagcgcgtgcc

SEQ ID NO: 294987 - DNA, 22 bp, Homo sapiens
ctcccaggtggattttgtggag

SEQ ID NO: 294988 - DNA, 15 bp, Homo sapiens
ctcccagtcctccag

SEQ ID NO: 294989 - DNA, 18 bp, Homo sapiens
ctcccagtcctccagacc

SEQ ID NO: 294990 - DNA, 17 bp, Homo sapiens
ctcccagttatgaatca

SEQ ID NO: 294991 - DNA, 16 bp, Homo sapiens
ctcccatctccttccc

SEQ ID NO: 294992 - DNA, 20 bp, Homo sapiens
ctcccatctccttcccccag

SEQ ID NO: 294993 - DNA, 13 bp, Homo sapiens
ctcctctctgctg

SEQ ID NO: 294994 - DNA, 14 bp, Homo sapiens
ctcctctctgctgg

SEQ ID NO: 294995 - DNA, 12 bp, Homo sapiens
ctcctctctggg

SEQ ID NO: 294996 - DNA, 13 bp, Homo sapiens
ctcctctctgggc

SEQ ID NO: 294997 - DNA, 16 bp, Homo sapiens
ctcctctctgggcctt

SEQ ID NO: 294998 - DNA, 12 bp, Homo sapiens
ctcctctgagca

SEQ ID NO: 294999 - DNA, 13 bp, Homo sapiens
ctcctctgagcag

SEQ ID NO: 295000 - DNA, 16 bp, Homo sapiens
ctcctctgcagcctga

SEQ ID NO: 295001 - DNA, 17 bp, Homo sapiens
ctcctctgcagtgcctt

SEQ ID NO: 295002 - DNA, 14 bp, Homo sapiens
ctcctctgccccct

SEQ ID NO: 295003 - DNA, 15 bp, Homo sapiens
ctcctctgccttgga

SEQ ID NO: 295004 - DNA, 18 bp, Homo sapiens
ctcctctgccttggacac

SEQ ID NO: 295005 - DNA, 12 bp, Homo sapiens
ctcctctgggca

SEQ ID NO: 295006 - DNA, 13 bp, Homo sapiens
ctcctctgtcagt

SEQ ID NO: 295007 - DNA, 12 bp, Homo sapiens
ctcctctgtcca

SEQ ID NO: 295008 - DNA, 13 bp, Homo sapiens
ctcctctgtccct

SEQ ID NO: 295009 - DNA, 16 bp, Homo sapiens
ctcctctgtgctccct

SEQ ID NO: 295010 - DNA, 22 bp, Homo sapiens
ctcctctgtgctccctcggtca

SEQ ID NO: 295011 - DNA, 22 bp, Homo sapiens
ctcctcttcaccccggcaggcc

SEQ ID NO: 295012 - DNA, 21 bp, Homo sapiens
ctcctcttggagctgagatga

SEQ ID NO: 295013 - DNA, 16 bp, Homo sapiens
ctcctgaagcctctgc

SEQ ID NO: 295014 - DNA, 19 bp, Homo sapiens
ctcctgaagcctctgccct

SEQ ID NO: 295015 - DNA, 20 bp, Homo sapiens
ctcctgaagcctctgccctg

SEQ ID NO: 295016 - DNA, 22 bp, Homo sapiens
ctcctgacatcaggtgatccac

SEQ ID NO: 295017 - DNA, 20 bp, Homo sapiens
ctcctgagaaggcgaggaga

SEQ ID NO: 295018 - DNA, 21 bp, Homo sapiens
ctcctgagaaggcgaggagag

SEQ ID NO: 295019 - DNA, 18 bp, Homo sapiens
ctcctgagcctgtctctc

SEQ ID NO: 295020 - DNA, 18 bp, Homo sapiens
ctcctgagcctgtgggtc

SEQ ID NO: 295021 - DNA, 19 bp, Homo sapiens
ctcctgagcctgtgggtcc

SEQ ID NO: 295022 - DNA, 23 bp, Homo sapiens
ctcctgaggggcatctgcccctc

SEQ ID NO: 295023 - DNA, 17 bp, Homo sapiens
ctcctgaggtctggatt

SEQ ID NO: 295024 - DNA, 16 bp, Homo sapiens
ctcctgagtgatccca

SEQ ID NO: 295025 - DNA, 19 bp, Homo sapiens
ctcctgatagtcacctgct

SEQ ID NO: 295026 - DNA, 14 bp, Homo sapiens
ctcctgatggccaa

SEQ ID NO: 295027 - DNA, 17 bp, Homo sapiens
ctcctgatggccaagag

SEQ ID NO: 295028 - DNA, 20 bp, Homo sapiens
ctcctgatttgagtttcctt

SEQ ID NO: 295029 - DNA, 21 bp, Homo sapiens
ctcctgatttttatctagaac

SEQ ID NO: 295030 - DNA, 17 bp, Homo sapiens
ctcctgcaggctggctg

SEQ ID NO: 295031 - DNA, 13 bp, Homo sapiens
ctcctgcatgcag

SEQ ID NO: 295032 - DNA, 16 bp, Homo sapiens
ctcctgcccagctctg

SEQ ID NO: 295033 - DNA, 17 bp, Homo sapiens
ctcctgccccctgccag

SEQ ID NO: 295034 - DNA, 13 bp, Homo sapiens
ctcctgccctcgt

SEQ ID NO: 295035 - DNA, 14 bp, Homo sapiens
ctcctgcctgtgtt

SEQ ID NO: 295036 - DNA, 15 bp, Homo sapiens
ctcctgcctgtgttt

SEQ ID NO: 295037 - DNA, 15 bp, Homo sapiens
ctcctgctcctcagg

SEQ ID NO: 295038 - DNA, 16 bp, Homo sapiens
ctcctgctcctcagga

SEQ ID NO: 295039 - DNA, 13 bp, Homo sapiens
ctcctgctgagtg

SEQ ID NO: 295040 - DNA, 12 bp, Homo sapiens
ctcctgctggct

SEQ ID NO: 295041 - DNA, 18 bp, Homo sapiens
ctcctgctggctgaggct

SEQ ID NO: 295042 - DNA, 22 bp, Homo sapiens
ctcctgctggggggcagggccc

SEQ ID NO: 295043 - DNA, 11 bp, Homo sapiens
ctcctgctgtg

SEQ ID NO: 295044 - DNA, 19 bp, Homo sapiens
ctcctggagcagcagctga

SEQ ID NO: 295045 - DNA, 22 bp, Homo sapiens
ctcctggagcagcagctgaggc

SEQ ID NO: 295046 - DNA, 16 bp, Homo sapiens
ctcctggagcatccca

SEQ ID NO: 295047 - DNA, 12 bp, Homo sapiens
ctcctggagcca

SEQ ID NO: 295048 - DNA, 12 bp, Homo sapiens
ctcctggagcct

SEQ ID NO: 295049 - DNA, 20 bp, Homo sapiens
ctcctggccggggcccctca

SEQ ID NO: 295050 - DNA, 23 bp, Homo sapiens
ctcctggcctcaagccatcttcc

SEQ ID NO: 295051 - DNA, 14 bp, Homo sapiens
ctcctggctcacag

SEQ ID NO: 295052 - DNA, 16 bp, Homo sapiens
ctcctggctcacagcc

SEQ ID NO: 295053 - DNA, 21 bp, Homo sapiens
ctcctggctcacagccaccac

SEQ ID NO: 295054 - DNA, 19 bp, Homo sapiens
ctcctggctgccaggcgtt

SEQ ID NO: 295055 - DNA, 22 bp, Homo sapiens
ctcctgggaaggagggagctgc

SEQ ID NO: 295056 - DNA, 21 bp, Homo sapiens
ctcctgggcatgtttgtctgt

SEQ ID NO: 295057 - DNA, 20 bp, Homo sapiens
ctcctgggcccctccctacc

SEQ ID NO: 295058 - DNA, 18 bp, Homo sapiens
ctcctgggggttctttct

SEQ ID NO: 295059 - DNA, 23 bp, Homo sapiens
ctcctgggggttctttcttcctc

SEQ ID NO: 295060 - DNA, 20 bp, Homo sapiens
ctcctggtagcatgaccttt

SEQ ID NO: 295061 - DNA, 22 bp, Homo sapiens
ctcctggtagcatgaccttttg

SEQ ID NO: 295062 - DNA, 22 bp, Homo sapiens
ctcctggtatgggtttctccca

SEQ ID NO: 295063 - DNA, 18 bp, Homo sapiens
ctcctgtaattttgtagt

SEQ ID NO: 295064 - DNA, 20 bp, Homo sapiens
ctcctgtataaccccacctt

SEQ ID NO: 295065 - DNA, 15 bp, Homo sapiens
ctcctgtgagctccc

SEQ ID NO: 295066 - DNA, 16 bp, Homo sapiens
ctcctgtgagctcccc

SEQ ID NO: 295067 - DNA, 21 bp, Homo sapiens
ctcctgtgcccacatcccagg

SEQ ID NO: 295068 - DNA, 11 bp, Homo sapiens
ctcctgtgcta

SEQ ID NO: 295069 - DNA, 16 bp, Homo sapiens
ctcctgttgccacact

SEQ ID NO: 295070 - DNA, 18 bp, Homo sapiens
ctcctgtttaactcccta

SEQ ID NO: 295071 - DNA, 12 bp, Homo sapiens
ctcctgtttcca

SEQ ID NO: 295072 - DNA, 22 bp, Homo sapiens
ctcctgtttgcaggcccagagg

SEQ ID NO: 295073 - DNA, 14 bp, Homo sapiens
ctccttaaactgac

SEQ ID NO: 295074 - DNA, 18 bp, Homo sapiens
ctccttaaccacctagtc

SEQ ID NO: 295075 - DNA, 17 bp, Homo sapiens
ctccttaatatgatctg

SEQ ID NO: 295076 - DNA, 14 bp, Homo sapiens
ctccttactctgag

SEQ ID NO: 295077 - DNA, 17 bp, Homo sapiens
ctccttactctgagccc

SEQ ID NO: 295078 - DNA, 18 bp, Homo sapiens
ctccttactctgagccca

SEQ ID NO: 295079 - DNA, 21 bp, Homo sapiens
ctccttatagacacttgctcc

SEQ ID NO: 295080 - DNA, 21 bp, Homo sapiens
ctccttatttatcaacatctt

SEQ ID NO: 295081 - DNA, 16 bp, Homo sapiens
ctccttccacctccct

SEQ ID NO: 295082 - DNA, 22 bp, Homo sapiens
ctccttcccatttctctacact

SEQ ID NO: 295083 - DNA, 14 bp, Homo sapiens
ctccttcccccagc

SEQ ID NO: 295084 - DNA, 17 bp, Homo sapiens
ctccttcccccagccca

SEQ ID NO: 295085 - DNA, 20 bp, Homo sapiens
ctccttcctctttgcttggg

SEQ ID NO: 295086 - DNA, 18 bp, Homo sapiens
ctccttccttcacctctg

SEQ ID NO: 295087 - DNA, 12 bp, Homo sapiens
ctccttctcccc

SEQ ID NO: 295088 - DNA, 14 bp, Homo sapiens
ctccttctccccaa

SEQ ID NO: 295089 - DNA, 16 bp, Homo sapiens
ctccttctccccaatc

SEQ ID NO: 295090 - DNA, 18 bp, Homo sapiens
ctccttctcccctccaga

SEQ ID NO: 295091 - DNA, 11 bp, Homo sapiens
ctccttcttcc

SEQ ID NO: 295092 - DNA, 20 bp, Homo sapiens
ctccttcttgccctgagctt

SEQ ID NO: 295093 - DNA, 16 bp, Homo sapiens
ctccttgagttttcct

SEQ ID NO: 295094 - DNA, 13 bp, Homo sapiens
ctccttgccccag

SEQ ID NO: 295095 - DNA, 19 bp, Homo sapiens
ctccttgccccagtcctgg

SEQ ID NO: 295096 - DNA, 17 bp, Homo sapiens
ctccttgcctcctgtgt

SEQ ID NO: 295097 - DNA, 18 bp, Homo sapiens
ctccttgcctcctgtgta

SEQ ID NO: 295098 - DNA, 16 bp, Homo sapiens
ctccttggatttgcat

SEQ ID NO: 295099 - DNA, 16 bp, Homo sapiens
ctccttggcaccccca

SEQ ID NO: 295100 - DNA, 10 bp, Homo sapiens
ctccttggcc

SEQ ID NO: 295101 - DNA, 17 bp, Homo sapiens
ctccttggcctagccca

SEQ ID NO: 295102 - DNA, 17 bp, Homo sapiens
ctccttgggctcctggc

SEQ ID NO: 295103 - DNA, 18 bp, Homo sapiens
ctccttgggctcctggct

SEQ ID NO: 295104 - DNA, 17 bp, Homo sapiens
ctccttgtccaggtctc

SEQ ID NO: 295105 - DNA, 13 bp, Homo sapiens
ctccttgttccta

SEQ ID NO: 295106 - DNA, 13 bp, Homo sapiens
ctcctttcacaac

SEQ ID NO: 295107 - DNA, 20 bp, Homo sapiens
ctcctttcacaaccttctgt

SEQ ID NO: 295108 - DNA, 13 bp, Homo sapiens
ctcctttcccaca

SEQ ID NO: 295109 - DNA, 14 bp, Homo sapiens
ctcctttctccagc

SEQ ID NO: 295110 - DNA, 13 bp, Homo sapiens
ctcctttcttttt

SEQ ID NO: 295111 - DNA, 21 bp, Homo sapiens
ctcctttctttttcttcttcc

SEQ ID NO: 295112 - DNA, 15 bp, Homo sapiens
ctcctttgcactgag

SEQ ID NO: 295113 - DNA, 22 bp, Homo sapiens
ctcctttgcactgagggccaca

SEQ ID NO: 295114 - DNA, 12 bp, Homo sapiens
ctccttttctct

SEQ ID NO: 295115 - DNA, 15 bp, Homo sapiens
ctccttttctctttg

SEQ ID NO: 295116 - DNA, 14 bp, Homo sapiens
ctcgaaccaaggca

SEQ ID NO: 295117 - DNA, 17 bp, Homo sapiens
ctcgaaccaaggcagcc

SEQ ID NO: 295118 - DNA, 15 bp, Homo sapiens
ctcgaacccacactg

SEQ ID NO: 295119 - DNA, 22 bp, Homo sapiens
ctcgaacttgaagcacaagttc

SEQ ID NO: 295120 - DNA, 15 bp, Homo sapiens
ctcgaagtcttccat

SEQ ID NO: 295121 - DNA, 22 bp, Homo sapiens
ctcgactggaggaccacactca

SEQ ID NO: 295122 - DNA, 18 bp, Homo sapiens
ctcgagaccatcctggcc

SEQ ID NO: 295123 - DNA, 19 bp, Homo sapiens
ctcgagaccatcctggccc

SEQ ID NO: 295124 - DNA, 15 bp, Homo sapiens
ctctcaaaatgtgcc

SEQ ID NO: 295125 - DNA, 16 bp, Homo sapiens
ctctcaaatgatacag

SEQ ID NO: 295126 - DNA, 19 bp, Homo sapiens
ctctcaatattcaataaag

SEQ ID NO: 295127 - DNA, 21 bp, Homo sapiens
ctctcaatattcaataaagct

SEQ ID NO: 295128 - DNA, 13 bp, Homo sapiens
ctctcacatgtgg

SEQ ID NO: 295129 - DNA, 16 bp, Homo sapiens
ctctcaccatttggat

SEQ ID NO: 295130 - DNA, 23 bp, Homo sapiens
ctctcaccatttggatcctgtgt

SEQ ID NO: 295131 - DNA, 13 bp, Homo sapiens
ctctcacccccat

SEQ ID NO: 295132 - DNA, 19 bp, Homo sapiens
ctctcacctacttcctcct

SEQ ID NO: 295133 - DNA, 15 bp, Homo sapiens
ctctcactaaacttt

SEQ ID NO: 295134 - DNA, 15 bp, Homo sapiens
ctctcactgtgtccc

SEQ ID NO: 295135 - DNA, 17 bp, Homo sapiens
ctctcagatccctcggt

SEQ ID NO: 295136 - DNA, 17 bp, Homo sapiens
ctctcaggagcacaggc

SEQ ID NO: 295137 - DNA, 16 bp, Homo sapiens
ctctcaggagtatctt

SEQ ID NO: 295138 - DNA, 16 bp, Homo sapiens
ctctcaggcatgcctg

SEQ ID NO: 295139 - DNA, 18 bp, Homo sapiens
ctctcaggcatgcctgtg

SEQ ID NO: 295140 - DNA, 20 bp, Homo sapiens
ctctcaggcatgcctgtgtg

SEQ ID NO: 295141 - DNA, 15 bp, Homo sapiens
ctctcagttctctcc

SEQ ID NO: 295142 - DNA, 16 bp, Homo sapiens
ctctcagttctctccc

SEQ ID NO: 295143 - DNA, 17 bp, Homo sapiens
ctctcagttctctccct

SEQ ID NO: 295144 - DNA, 19 bp, Homo sapiens
ctctcatccaggtcctttc

SEQ ID NO: 295145 - DNA, 13 bp, Homo sapiens
ctctcatgtgggg

SEQ ID NO: 295146 - DNA, 23 bp, Homo sapiens
ctctcatgtttccctactaacat

SEQ ID NO: 295147 - DNA, 22 bp, Homo sapiens
ctctcatttctttcaagacagc

SEQ ID NO: 295148 - DNA, 19 bp, Homo sapiens
ctctccaaaggggctgctg

SEQ ID NO: 295149 - DNA, 20 bp, Homo sapiens
ctctccaaaggggctgctgg

SEQ ID NO: 295150 - DNA, 23 bp, Homo sapiens
ctctccaaaggggctgctggggc

SEQ ID NO: 295151 - DNA, 17 bp, Homo sapiens
ctctccaagtctctctg

SEQ ID NO: 295152 - DNA, 19 bp, Homo sapiens
ctctccaagtctctctgtg

SEQ ID NO: 295153 - DNA, 16 bp, Homo sapiens
ctctccaccctccggc

SEQ ID NO: 295154 - DNA, 15 bp, Homo sapiens
ctctccactgccttc

SEQ ID NO: 295155 - DNA, 16 bp, Homo sapiens
ctctccactgccttcg

SEQ ID NO: 295156 - DNA, 17 bp, Homo sapiens
ctctccaggattgtcca

SEQ ID NO: 295157 - DNA, 18 bp, Homo sapiens
ctctccaggattgtccac

SEQ ID NO: 295158 - DNA, 15 bp, Homo sapiens
ctctcccaagtccac

SEQ ID NO: 295159 - DNA, 17 bp, Homo sapiens
ctctcccacatcccact

SEQ ID NO: 295160 - DNA, 12 bp, Homo sapiens
ctctcccagttg

SEQ ID NO: 295161 - DNA, 14 bp, Homo sapiens
ctctccccacacta

SEQ ID NO: 295162 - DNA, 12 bp, Homo sapiens
ctctccccagtg

SEQ ID NO: 295163 - DNA, 13 bp, Homo sapiens
ctctccccagtgc

SEQ ID NO: 295164 - DNA, 22 bp, Homo sapiens
ctctccccagtgcctgccactc

SEQ ID NO: 295165 - DNA, 17 bp, Homo sapiens
ctctccccgctctggat

SEQ ID NO: 295166 - DNA, 16 bp, Homo sapiens
ctctcccctgccctgc

SEQ ID NO: 295167 - DNA, 15 bp, Homo sapiens
ctctcccggctgcct

SEQ ID NO: 295168 - DNA, 17 bp, Homo sapiens
ctctcccggctgcctgc

SEQ ID NO: 295169 - DNA, 15 bp, Homo sapiens
ctctccctaccctct

SEQ ID NO: 295170 - DNA, 22 bp, Homo sapiens
ctctccctaccctcttctcagc

SEQ ID NO: 295171 - DNA, 17 bp, Homo sapiens
ctctccctcccctgcca

SEQ ID NO: 295172 - DNA, 14 bp, Homo sapiens
ctctccctgcctca

SEQ ID NO: 295173 - DNA, 14 bp, Homo sapiens
ctctcccttcttta

SEQ ID NO: 295174 - DNA, 21 bp, Homo sapiens
ctctcctaccccacctcatgc

SEQ ID NO: 295175 - DNA, 22 bp, Homo sapiens
ctctcctaccccacctcatgcc

SEQ ID NO: 295176 - DNA, 23 bp, Homo sapiens
ctctcctatgtggcagctgggga

SEQ ID NO: 295177 - DNA, 14 bp, Homo sapiens
ctctcctcatctct

SEQ ID NO: 295178 - DNA, 14 bp, Homo sapiens
ctctcctcctcccc

SEQ ID NO: 295179 - DNA, 17 bp, Homo sapiens
ctctcctcctcccctcc

SEQ ID NO: 295180 - DNA, 13 bp, Homo sapiens
ctctcctcctttt

SEQ ID NO: 295181 - DNA, 23 bp, Homo sapiens
ctctcctcggtggcatttgctga

SEQ ID NO: 295182 - DNA, 17 bp, Homo sapiens
ctctcctctctctccct

SEQ ID NO: 295183 - DNA, 21 bp, Homo sapiens
ctctcctctctctccctccac

SEQ ID NO: 295184 - DNA, 14 bp, Homo sapiens
ctctcctcttgcca

SEQ ID NO: 295185 - DNA, 20 bp, Homo sapiens
ctctcctgaagcagtgtcgc

SEQ ID NO: 295186 - DNA, 21 bp, Homo sapiens
ctctcctgacttttaatgtca

SEQ ID NO: 295187 - DNA, 16 bp, Homo sapiens
ctctcctgagcctgtc

SEQ ID NO: 295188 - DNA, 19 bp, Homo sapiens
ctctcctgagcctgtctct

SEQ ID NO: 295189 - DNA, 13 bp, Homo sapiens
ctctcctgcatcc

SEQ ID NO: 295190 - DNA, 17 bp, Homo sapiens
ctctcctgcccagctct

SEQ ID NO: 295191 - DNA, 16 bp, Homo sapiens
ctctcctgctcctcag

SEQ ID NO: 295192 - DNA, 18 bp, Homo sapiens
ctctcctgggccagggtc

SEQ ID NO: 295193 - DNA, 23 bp, Homo sapiens
ctctcctgggcccctccctacct

SEQ ID NO: 295194 - DNA, 22 bp, Homo sapiens
ctctcctgtataaccccacctt

SEQ ID NO: 295195 - DNA, 20 bp, Homo sapiens
ctctcctgtataatctctct

SEQ ID NO: 295196 - DNA, 19 bp, Homo sapiens
ctctcctgtgagctcccca

SEQ ID NO: 295197 - DNA, 16 bp, Homo sapiens
ctctccttcgtgtctc

SEQ ID NO: 295198 - DNA, 19 bp, Homo sapiens
ctctccttgccccagtcct

SEQ ID NO: 295199 - DNA, 21 bp, Homo sapiens
ctctccttgccccagtcctgg

SEQ ID NO: 295200 - DNA, 15 bp, Homo sapiens
ctctccttgccctgg

SEQ ID NO: 295201 - DNA, 19 bp, Homo sapiens
ctctccttgccctgggcca

SEQ ID NO: 295202 - DNA, 15 bp, Homo sapiens
ctctccttgggctcc

SEQ ID NO: 295203 - DNA, 17 bp, Homo sapiens
ctctccttgggctcctg

SEQ ID NO: 295204 - DNA, 19 bp, Homo sapiens
ctctccttgggctcctggc

SEQ ID NO: 295205 - DNA, 20 bp, Homo sapiens
ctctccttgggctcctggct

SEQ ID NO: 295206 - DNA, 21 bp, Homo sapiens
ctctccttgggctcctggctg

SEQ ID NO: 295207 - DNA, 16 bp, Homo sapiens
ctctcctttctttttc

SEQ ID NO: 295208 - DNA, 23 bp, Homo sapiens
ctctccttttgaggcttctcctt

SEQ ID NO: 295209 - DNA, 18 bp, Homo sapiens
ctctcgccccatccctgc

SEQ ID NO: 295210 - DNA, 21 bp, Homo sapiens
ctctcgccccatccctgcttg

SEQ ID NO: 295211 - DNA, 15 bp, Homo sapiens
ctctcgctcccctct

SEQ ID NO: 295212 - DNA, 19 bp, Homo sapiens
ctctcggaactgcatgctg

SEQ ID NO: 295213 - DNA, 20 bp, Homo sapiens
ctctcggaactgcatgctgc

SEQ ID NO: 295214 - DNA, 13 bp, Homo sapiens
ctctctaacataa

SEQ ID NO: 295215 - DNA, 16 bp, Homo sapiens
ctctctacccagccca

SEQ ID NO: 295216 - DNA, 16 bp, Homo sapiens
ctctctatatatacat

SEQ ID NO: 295217 - DNA, 21 bp, Homo sapiens
ctctctcacctacttcctcct

SEQ ID NO: 295218 - DNA, 20 bp, Homo sapiens
ctctctcagacccttgaaga

SEQ ID NO: 295219 - DNA, 11 bp, Homo sapiens
ctctctcatgt

SEQ ID NO: 295220 - DNA, 13 bp, Homo sapiens
ctctctccctcca

SEQ ID NO: 295221 - DNA, 14 bp, Homo sapiens
ctctctccctccac

SEQ ID NO: 295222 - DNA, 16 bp, Homo sapiens
ctctctccctgcctca

SEQ ID NO: 295223 - DNA, 13 bp, Homo sapiens
ctctctcctctct

SEQ ID NO: 295224 - DNA, 22 bp, Homo sapiens
ctctctcctgtttcccttccct

SEQ ID NO: 295225 - DNA, 15 bp, Homo sapiens
ctctctcctttgctg

SEQ ID NO: 295226 - DNA, 13 bp, Homo sapiens
ctctctctatata

SEQ ID NO: 295227 - DNA, 13 bp, Homo sapiens
ctctctctctctg

SEQ ID NO: 295228 - DNA, 14 bp, Homo sapiens
ctctctctctgttc

SEQ ID NO: 295229 - DNA, 9 bp, Homo sapiens
ctctctctg

SEQ ID NO: 295230 - DNA, 18 bp, Homo sapiens
ctctctctttttcttttc

SEQ ID NO: 295231 - DNA, 13 bp, Homo sapiens
ctctctgctgtac

SEQ ID NO: 295232 - DNA, 17 bp, Homo sapiens
ctctctggccactctgc

SEQ ID NO: 295233 - DNA, 12 bp, Homo sapiens
ctctctgggcct

SEQ ID NO: 295234 - DNA, 20 bp, Homo sapiens
ctctctgtcttctctccact

SEQ ID NO: 295235 - DNA, 15 bp, Homo sapiens
ctctctgtctttttc

SEQ ID NO: 295236 - DNA, 16 bp, Homo sapiens
ctctctgtgaatacaa

SEQ ID NO: 295237 - DNA, 14 bp, Homo sapiens
ctctctgtgtggca

SEQ ID NO: 295238 - DNA, 21 bp, Homo sapiens
ctctctgtgtggcaaacattt

SEQ ID NO: 295239 - DNA, 22 bp, Homo sapiens
ctctctgttccaagtgtgtgtg

SEQ ID NO: 295240 - DNA, 15 bp, Homo sapiens
ctctctgtttaccct

SEQ ID NO: 295241 - DNA, 21 bp, Homo sapiens
ctctctgtttaccctccctgt

SEQ ID NO: 295242 - DNA, 23 bp, Homo sapiens
ctctctgtttaccctccctgtcc

SEQ ID NO: 295243 - DNA, 16 bp, Homo sapiens
ctctcttaccccgtcc

SEQ ID NO: 295244 - DNA, 22 bp, Homo sapiens
ctctcttaccccgtccctttcc

SEQ ID NO: 295245 - DNA, 15 bp, Homo sapiens
ctctcttacccttct

SEQ ID NO: 295246 - DNA, 19 bp, Homo sapiens
ctctcttatagaatattta

SEQ ID NO: 295247 - DNA, 17 bp, Homo sapiens
ctctcttcaatctctgg

SEQ ID NO: 295248 - DNA, 22 bp, Homo sapiens
ctctcttccagaagatgccctc

SEQ ID NO: 295249 - DNA, 24 bp, Homo sapiens
ctctcttccagaagatgccctcca

SEQ ID NO: 295250 - DNA, 12 bp, Homo sapiens
ctctcttctctc

SEQ ID NO: 295251 - DNA, 22 bp, Homo sapiens
ctctcttctctccccttttcct

SEQ ID NO: 295252 - DNA, 16 bp, Homo sapiens
ctctcttctgctccac

SEQ ID NO: 295253 - DNA, 18 bp, Homo sapiens
ctctcttctgctccaccc

SEQ ID NO: 295254 - DNA, 19 bp, Homo sapiens
ctctgctttgactgagcag

SEQ ID NO: 295255 - DNA, 22 bp, Homo sapiens
ctctgcttttagtcacgtgtat

SEQ ID NO: 295256 - DNA, 21 bp, Homo sapiens
ctctggaaaggggggagctgg

SEQ ID NO: 295257 - DNA, 15 bp, Homo sapiens
ctctggaagcctgct

SEQ ID NO: 295258 - DNA, 21 bp, Homo sapiens
ctctggaatgacatgtgtcaa

SEQ ID NO: 295259 - DNA, 16 bp, Homo sapiens
ctctggacaaagcgtt

SEQ ID NO: 295260 - DNA, 13 bp, Homo sapiens
ctctggactggct

SEQ ID NO: 295261 - DNA, 15 bp, Homo sapiens
ctctggactggctag

SEQ ID NO: 295262 - DNA, 16 bp, Homo sapiens
ctctggaggcctctgg

SEQ ID NO: 295263 - DNA, 17 bp, Homo sapiens
ctctggaggcctctggg

SEQ ID NO: 295264 - DNA, 18 bp, Homo sapiens
ctctggagtgtgtggggg

SEQ ID NO: 295265 - DNA, 18 bp, Homo sapiens
ctctggattgtgggaatt

SEQ ID NO: 295266 - DNA, 20 bp, Homo sapiens
ctctggcaggtggccagggc

SEQ ID NO: 295267 - DNA, 21 bp, Homo sapiens
ctctggcaggtggccagggct

SEQ ID NO: 295268 - DNA, 19 bp, Homo sapiens
ctctggcagttctggaatg

SEQ ID NO: 295269 - DNA, 17 bp, Homo sapiens
ctctggccaccctggcc

SEQ ID NO: 295270 - DNA, 15 bp, Homo sapiens
ctctggccaggatgg

SEQ ID NO: 295271 - DNA, 22 bp, Homo sapiens
ctctggccttggttcctccagc

SEQ ID NO: 295272 - DNA, 16 bp, Homo sapiens
ctctggctagaggcca

SEQ ID NO: 295273 - DNA, 20 bp, Homo sapiens
ctctggctagaggccagccc

SEQ ID NO: 295274 - DNA, 21 bp, Homo sapiens
ctctggctcagggcccacctc

SEQ ID NO: 295275 - DNA, 11 bp, Homo sapiens
ctctggctgcc

SEQ ID NO: 295276 - DNA, 12 bp, Homo sapiens
ctctggctgcct

SEQ ID NO: 295277 - DNA, 15 bp, Homo sapiens
ctctggctgcctggc

SEQ ID NO: 295278 - DNA, 20 bp, Homo sapiens
ctctggctgcctggcccagg

SEQ ID NO: 295279 - DNA, 19 bp, Homo sapiens
ctctgggccaggttggaaa

SEQ ID NO: 295280 - DNA, 16 bp, Homo sapiens
ctctgggcccagagag

SEQ ID NO: 295281 - DNA, 24 bp, Homo sapiens
ctctgggccctgcaggaggcctgg

SEQ ID NO: 295282 - DNA, 20 bp, Homo sapiens
ctctgggctcagggctggag

SEQ ID NO: 295283 - DNA, 22 bp, Homo sapiens
ctctgggctgagcctactgtct

SEQ ID NO: 295284 - DNA, 17 bp, Homo sapiens
ctctgggctgccatgtg

SEQ ID NO: 295285 - DNA, 22 bp, Homo sapiens
ctctgggctttgattccatctc

SEQ ID NO: 295286 - DNA, 23 bp, Homo sapiens
ctctgggctttgattccatctcc

SEQ ID NO: 295287 - DNA, 20 bp, Homo sapiens
ctctggggtcccccatcccc

SEQ ID NO: 295288 - DNA, 19 bp, Homo sapiens
ctctgggtgagtggctgac

SEQ ID NO: 295289 - DNA, 21 bp, Homo sapiens
ctctgggtttacaacaaacac

SEQ ID NO: 295290 - DNA, 21 bp, Homo sapiens
ctctgggtttcatatccagct

SEQ ID NO: 295291 - DNA, 14 bp, Homo sapiens
ctctggtgggaaaa

SEQ ID NO: 295292 - DNA, 18 bp, Homo sapiens
ctctggtgttcctggcct

SEQ ID NO: 295293 - DNA, 16 bp, Homo sapiens
ctctggtttaattaca

SEQ ID NO: 295294 - DNA, 20 bp, Homo sapiens
ctctggtttggggcgaggca

SEQ ID NO: 295295 - DNA, 14 bp, Homo sapiens
ctctgtagaattta

SEQ ID NO: 295296 - DNA, 17 bp, Homo sapiens
ctctgtagctccctcct

SEQ ID NO: 295297 - DNA, 19 bp, Homo sapiens
ctctgtagctccctcctcc

SEQ ID NO: 295298 - DNA, 22 bp, Homo sapiens
ctctgtagctccctcctcccat

SEQ ID NO: 295299 - DNA, 24 bp, Homo sapiens
ctctgtagctccctcctcccatct

SEQ ID NO: 295300 - DNA, 22 bp, Homo sapiens
ctctgtagggaactctggggtc

SEQ ID NO: 295301 - DNA, 23 bp, Homo sapiens
ctctgtattctgcaacagcctgt

SEQ ID NO: 295302 - DNA, 22 bp, Homo sapiens
ctctgtcagtcatgcgtccact

SEQ ID NO: 295303 - DNA, 18 bp, Homo sapiens
ctctgtcagtttgtgaag

SEQ ID NO: 295304 - DNA, 16 bp, Homo sapiens
ctctgtcatcactccc

SEQ ID NO: 295305 - DNA, 20 bp, Homo sapiens
ctctgtccaattccagagct

SEQ ID NO: 295306 - DNA, 22 bp, Homo sapiens
ctctgtccaattccagagctgt

SEQ ID NO: 295307 - DNA, 12 bp, Homo sapiens
ctctgtccaggc

SEQ ID NO: 295308 - DNA, 15 bp, Homo sapiens
ctctgtccccgagcc

SEQ ID NO: 295309 - DNA, 13 bp, Homo sapiens
ctctgtcctctgt

SEQ ID NO: 295310 - DNA, 15 bp, Homo sapiens
ctctgtcgtggacac

SEQ ID NO: 295311 - DNA, 20 bp, Homo sapiens
ctctgtctaccatctccctc

SEQ ID NO: 295312 - DNA, 13 bp, Homo sapiens
ctctgtcttcctg

SEQ ID NO: 295313 - DNA, 17 bp, Homo sapiens
ctctgtcttcctggtca

SEQ ID NO: 295314 - DNA, 14 bp, Homo sapiens
ctctgtctttttcc

SEQ ID NO: 295315 - DNA, 16 bp, Homo sapiens
ctctgtctttttcctt

SEQ ID NO: 295316 - DNA, 21 bp, Homo sapiens
ctctgtgcaggtgctgccttg

SEQ ID NO: 295317 - DNA, 14 bp, Homo sapiens
ctctgtgcctaata

SEQ ID NO: 295318 - DNA, 14 bp, Homo sapiens
ctctgtgcctggga

SEQ ID NO: 295319 - DNA, 19 bp, Homo sapiens
ctctgtgctaagttgtctt

SEQ ID NO: 295320 - DNA, 10 bp, Homo sapiens
ctctgtgctc

SEQ ID NO: 295321 - DNA, 15 bp, Homo sapiens
ctctgtgctccctcg

SEQ ID NO: 295322 - DNA, 14 bp, Homo sapiens
ctctgtggcctgtg

SEQ ID NO: 295323 - DNA, 22 bp, Homo sapiens
ctctgtggcctgtgtccagcag

SEQ ID NO: 295324 - DNA, 13 bp, Homo sapiens
ctctgtggggcca

SEQ ID NO: 295325 - DNA, 16 bp, Homo sapiens
ctctgtggggccacac

SEQ ID NO: 295326 - DNA, 13 bp, Homo sapiens
ctctgtgtaatct

SEQ ID NO: 295327 - DNA, 22 bp, Homo sapiens
ctctgtgtgagcgtgtccacag

SEQ ID NO: 295328 - DNA, 12 bp, Homo sapiens
ctctgtgtggca

SEQ ID NO: 295329 - DNA, 19 bp, Homo sapiens
ctctgtgtttgttcctaca

SEQ ID NO: 295330 - DNA, 13 bp, Homo sapiens
ctctgtgttttgt

SEQ ID NO: 295331 - DNA, 11 bp, Homo sapiens
ctctgttccaa

SEQ ID NO: 295332 - DNA, 12 bp, Homo sapiens
ctctgttccaag

SEQ ID NO: 295333 - DNA, 13 bp, Homo sapiens
ctctgttccaagt

SEQ ID NO: 295334 - DNA, 18 bp, Homo sapiens
ctctgttccaagtgtgtg

SEQ ID NO: 295335 - DNA, 20 bp, Homo sapiens
ctctgttccaagtgtgtgtg

SEQ ID NO: 295336 - DNA, 13 bp, Homo sapiens
ctctgttccccca

SEQ ID NO: 295337 - DNA, 22 bp, Homo sapiens
ctctgttctgctcccagatgcc

SEQ ID NO: 295338 - DNA, 19 bp, Homo sapiens
ctctgttgcaggtgtccgg

SEQ ID NO: 295339 - DNA, 22 bp, Homo sapiens
ctctgttgcccaggctggagtg

SEQ ID NO: 295340 - DNA, 11 bp, Homo sapiens
ctctgttgcct

SEQ ID NO: 295341 - DNA, 12 bp, Homo sapiens
ctctgttgcctc

SEQ ID NO: 295342 - DNA, 16 bp, Homo sapiens
ctctgttgcctcctct

SEQ ID NO: 295343 - DNA, 21 bp, Homo sapiens
ctctgttgcctcctctctccc

SEQ ID NO: 295344 - DNA, 20 bp, Homo sapiens
ctctgttggaaattgggtgt

SEQ ID NO: 295345 - DNA, 21 bp, Homo sapiens
ctctgttgtcctccccttggg

SEQ ID NO: 295346 - DNA, 15 bp, Homo sapiens
ctctgtttaccctcc

SEQ ID NO: 295347 - DNA, 21 bp, Homo sapiens
ctctgtttaccctccctgtcc

SEQ ID NO: 295348 - DNA, 17 bp, Homo sapiens
ctctgtttcccctcaga

SEQ ID NO: 295349 - DNA, 14 bp, Homo sapiens
ctcttaagacacta

SEQ ID NO: 295350 - DNA, 23 bp, Homo sapiens
ctcttaccccgtccctttccctg

SEQ ID NO: 295351 - DNA, 15 bp, Homo sapiens
ctcttacccttctgt

SEQ ID NO: 295352 - DNA, 22 bp, Homo sapiens
ctcttacccttctgtgcccagc

SEQ ID NO: 295353 - DNA, 23 bp, Homo sapiens
ctcttacccttctgtgcccagct

SEQ ID NO: 295354 - DNA, 18 bp, Homo sapiens
ctcttaccgtagcctccg

SEQ ID NO: 295355 - DNA, 18 bp, Homo sapiens
ctcttacggctatctagt

SEQ ID NO: 295356 - DNA, 15 bp, Homo sapiens
ctcttagaaatactt

SEQ ID NO: 295357 - DNA, 21 bp, Homo sapiens
ctcttaggtctaatgatattt

SEQ ID NO: 295358 - DNA, 22 bp, Homo sapiens
ctcttagtccctcttaggagta

SEQ ID NO: 295359 - DNA, 13 bp, Homo sapiens
ctcttagtgcccg

SEQ ID NO: 295360 - DNA, 16 bp, Homo sapiens
ctcttagtgcccgcct

SEQ ID NO: 295361 - DNA, 20 bp, Homo sapiens
ctcttagtgcccgcctagga

SEQ ID NO: 295362 - DNA, 16 bp, Homo sapiens
ctcttatagaatattt

SEQ ID NO: 295363 - DNA, 14 bp, Homo sapiens
ctcttattctaata

SEQ ID NO: 295364 - DNA, 18 bp, Homo sapiens
ctcttattgttcctctta

SEQ ID NO: 295365 - DNA, 15 bp, Homo sapiens
ctcttcaaggccaag

SEQ ID NO: 295366 - DNA, 15 bp, Homo sapiens
ctcttcaatctctgg

SEQ ID NO: 295367 - DNA, 14 bp, Homo sapiens
ctcttcaatctctt

SEQ ID NO: 295368 - DNA, 13 bp, Homo sapiens
ctcttcaccagga

SEQ ID NO: 295369 - DNA, 23 bp, Homo sapiens
ctcttcaccccggcaggccctgc

SEQ ID NO: 295370 - DNA, 21 bp, Homo sapiens
ctcttcagcctcattcactgt

SEQ ID NO: 295371 - DNA, 18 bp, Homo sapiens
ctcttcaggggtcacctc

SEQ ID NO: 295372 - DNA, 19 bp, Homo sapiens
ctcttcaggggtcacctcc

SEQ ID NO: 295373 - DNA, 20 bp, Homo sapiens
ctcttcaggggtcacctcct

SEQ ID NO: 295374 - DNA, 14 bp, Homo sapiens
ctcttcaggttctt

SEQ ID NO: 295375 - DNA, 18 bp, Homo sapiens
ctcttcagtgtgttgact

SEQ ID NO: 295376 - DNA, 14 bp, Homo sapiens
ctcttcattcccac

SEQ ID NO: 295377 - DNA, 17 bp, Homo sapiens
ctcttcatttattttga

SEQ ID NO: 295378 - DNA, 18 bp, Homo sapiens
ctcttccagaagatgccc

SEQ ID NO: 295379 - DNA, 20 bp, Homo sapiens
ctcttccagaagatgccctc

SEQ ID NO: 295380 - DNA, 14 bp, Homo sapiens
ctcttccagcccag

SEQ ID NO: 295381 - DNA, 12 bp, Homo sapiens
ctcttcccatga

SEQ ID NO: 295382 - DNA, 20 bp, Homo sapiens
ctcttcccatgactgcaccc

SEQ ID NO: 295383 - DNA, 18 bp, Homo sapiens
ctcttccccctctcccag

SEQ ID NO: 295384 - DNA, 22 bp, Homo sapiens
ctgacggcgcccccagtgtgca

SEQ ID NO: 295385 - DNA, 23 bp, Homo sapiens
ctgacggctgtgtatttctgtag

SEQ ID NO: 295386 - DNA, 17 bp, Homo sapiens
ctgacgtttgacaccag

SEQ ID NO: 295387 - DNA, 22 bp, Homo sapiens
ctgactagaagggccagtcctg

SEQ ID NO: 295388 - DNA, 23 bp, Homo sapiens
ctgactagaagggccagtcctgc

SEQ ID NO: 295389 - DNA, 22 bp, Homo sapiens
ctgactcacattgccttgagct

SEQ ID NO: 295390 - DNA, 12 bp, Homo sapiens
ctgactccagag

SEQ ID NO: 295391 - DNA, 20 bp, Homo sapiens
ctgactccagagtctgagcc

SEQ ID NO: 295392 - DNA, 20 bp, Homo sapiens
ctgactcccaaagagctgcc

SEQ ID NO: 295393 - DNA, 23 bp, Homo sapiens
ctgactcccaaagagctgcctaa

SEQ ID NO: 295394 - DNA, 19 bp, Homo sapiens
ctgactctgagtccactgc

SEQ ID NO: 295395 - DNA, 20 bp, Homo sapiens
ctgactctgagtccactgct

SEQ ID NO: 295396 - DNA, 13 bp, Homo sapiens
ctgactgatcctg

SEQ ID NO: 295397 - DNA, 20 bp, Homo sapiens
ctgactgatcctgaacaaga

SEQ ID NO: 295398 - DNA, 22 bp, Homo sapiens
ctgactgcaacttctgtccctt

SEQ ID NO: 295399 - DNA, 16 bp, Homo sapiens
ctgactgggggcctct

SEQ ID NO: 295400 - DNA, 20 bp, Homo sapiens
ctgactgggggcctctgcct

SEQ ID NO: 295401 - DNA, 21 bp, Homo sapiens
ctgactgggggcctctgcctc

SEQ ID NO: 295402 - DNA, 13 bp, Homo sapiens
ctgactgtggccc

SEQ ID NO: 295403 - DNA, 16 bp, Homo sapiens
ctgactgtggccccct

SEQ ID NO: 295404 - DNA, 15 bp, Homo sapiens
ctgacttaacaactg

SEQ ID NO: 295405 - DNA, 13 bp, Homo sapiens
ctgacttcccagc

SEQ ID NO: 295406 - DNA, 14 bp, Homo sapiens
ctgacttcccagct

SEQ ID NO: 295407 - DNA, 15 bp, Homo sapiens
ctgacttcccagctg

SEQ ID NO: 295408 - DNA, 18 bp, Homo sapiens
ctgacttcccagctggca

SEQ ID NO: 295409 - DNA, 22 bp, Homo sapiens
ctgacttcccagctggcagcgc

SEQ ID NO: 295410 - DNA, 23 bp, Homo sapiens
ctgacttcccagctggcagcgcc

SEQ ID NO: 295411 - DNA, 13 bp, Homo sapiens
ctgactttctccc

SEQ ID NO: 295412 - DNA, 19 bp, Homo sapiens
ctgacttttacagcttttc

SEQ ID NO: 295413 - DNA, 19 bp, Homo sapiens
ctgagaaaacgaaactgct

SEQ ID NO: 295414 - DNA, 21 bp, Homo sapiens
ctgagaaagcccacctgggct

SEQ ID NO: 295415 - DNA, 22 bp, Homo sapiens
ctgagaacagatctccaaagct

SEQ ID NO: 295416 - DNA, 23 bp, Homo sapiens
ctgagaacagatctccaaagctt

SEQ ID NO: 295417 - DNA, 18 bp, Homo sapiens
ctgagaactgactttctc

SEQ ID NO: 295418 - DNA, 22 bp, Homo sapiens
ctgagaagaggagccctcatct

SEQ ID NO: 295419 - DNA, 18 bp, Homo sapiens
ctgagaagcctcatggga

SEQ ID NO: 295420 - DNA, 19 bp, Homo sapiens
ctgagaagcctcatgggag

SEQ ID NO: 295421 - DNA, 20 bp, Homo sapiens
ctgagaaggctaaagaagac

SEQ ID NO: 295422 - DNA, 18 bp, Homo sapiens
ctgagaaggggaggacct

SEQ ID NO: 295423 - DNA, 21 bp, Homo sapiens
ctgagaaggggaggacctctg

SEQ ID NO: 295424 - DNA, 23 bp, Homo sapiens
ctgagaaggggaggacctctggg

SEQ ID NO: 295425 - DNA, 18 bp, Homo sapiens
ctgagaatttaattttta

SEQ ID NO: 295426 - DNA, 15 bp, Homo sapiens
ctgagacaatgcctt

SEQ ID NO: 295427 - DNA, 23 bp, Homo sapiens
ctgagaccagttgggagcactgg

SEQ ID NO: 295428 - DNA, 19 bp, Homo sapiens
ctgagacggatggaaggag

SEQ ID NO: 295429 - DNA, 21 bp, Homo sapiens
ctgagacggatggaaggagag

SEQ ID NO: 295430 - DNA, 22 bp, Homo sapiens
ctgagacggatggaaggagaga

SEQ ID NO: 295431 - DNA, 14 bp, Homo sapiens
ctgagactcagaca

SEQ ID NO: 295432 - DNA, 21 bp, Homo sapiens
ctgagactcagacaggaaagg

SEQ ID NO: 295433 - DNA, 18 bp, Homo sapiens
ctgagactgcagaggagc

SEQ ID NO: 295434 - DNA, 19 bp, Homo sapiens
ctgagactgcagaggagcc

SEQ ID NO: 295435 - DNA, 19 bp, Homo sapiens
ctgagactgtcggagaggc

SEQ ID NO: 295436 - DNA, 16 bp, Homo sapiens
ctgagagacttttaat

SEQ ID NO: 295437 - DNA, 16 bp, Homo sapiens
ctgagagcaaagggaa

SEQ ID NO: 295438 - DNA, 22 bp, Homo sapiens
ctgagagcatgtgggggaaggc

SEQ ID NO: 295439 - DNA, 23 bp, Homo sapiens
ctgagagcatgtgggggaaggcc

SEQ ID NO: 295440 - DNA, 14 bp, Homo sapiens
ctgagagccccagc

SEQ ID NO: 295441 - DNA, 20 bp, Homo sapiens
ctgagaggaggggtaaatat

SEQ ID NO: 295442 - DNA, 13 bp, Homo sapiens
ctgagagggctgt

SEQ ID NO: 295443 - DNA, 20 bp, Homo sapiens
ctgagagggctgtggctggg

SEQ ID NO: 295444 - DNA, 17 bp, Homo sapiens
ctgagagtagagtcact

SEQ ID NO: 295445 - DNA, 19 bp, Homo sapiens
ctgagagtatttaggcaga

SEQ ID NO: 295446 - DNA, 22 bp, Homo sapiens
ctgagagtgaaaccatgactgt

SEQ ID NO: 295447 - DNA, 15 bp, Homo sapiens
ctgagagtgtctctg

SEQ ID NO: 295448 - DNA, 15 bp, Homo sapiens
ctgagatgagcccca

SEQ ID NO: 295449 - DNA, 23 bp, Homo sapiens
ctgagatggaacccttttggccc

SEQ ID NO: 295450 - DNA, 18 bp, Homo sapiens
ctgagatgtaggctccac

SEQ ID NO: 295451 - DNA, 13 bp, Homo sapiens
ctgagattcttca

SEQ ID NO: 295452 - DNA, 21 bp, Homo sapiens
ctgagcaaatgtggctcctgg

SEQ ID NO: 295453 - DNA, 21 bp, Homo sapiens
ctgagcaactgtgcagcaccc

SEQ ID NO: 295454 - DNA, 13 bp, Homo sapiens
ctgagcacccgct

SEQ ID NO: 295455 - DNA, 18 bp, Homo sapiens
ctgagcacccgctgacat

SEQ ID NO: 295456 - DNA, 16 bp, Homo sapiens
ctgagcaccctctccg

SEQ ID NO: 295457 - DNA, 16 bp, Homo sapiens
ctgagcagactggtga

SEQ ID NO: 295458 - DNA, 18 bp, Homo sapiens
ctgagcagcctctgccag

SEQ ID NO: 295459 - DNA, 21 bp, Homo sapiens
ctgagcagcctctgccaggcc

SEQ ID NO: 295460 - DNA, 21 bp, Homo sapiens
ctgagcaggacgttaggcccg

SEQ ID NO: 295461 - DNA, 22 bp, Homo sapiens
ctgagcaggacgttaggcccgg

SEQ ID NO: 295462 - DNA, 15 bp, Homo sapiens
ctgagcagtctactt

SEQ ID NO: 295463 - DNA, 17 bp, Homo sapiens
ctgagcagttgttatat

SEQ ID NO: 295464 - DNA, 21 bp, Homo sapiens
ctgagccaaaaacaataaacg

SEQ ID NO: 295465 - DNA, 15 bp, Homo sapiens
ctgagccactcgcag

SEQ ID NO: 295466 - DNA, 13 bp, Homo sapiens
ctgagccaggagc

SEQ ID NO: 295467 - DNA, 14 bp, Homo sapiens
ctgagccaggagcc

SEQ ID NO: 295468 - DNA, 21 bp, Homo sapiens
ctgagccaggagcctcctgac

SEQ ID NO: 295469 - DNA, 22 bp, Homo sapiens
ctgagccaggagcctcctgacc

SEQ ID NO: 295470 - DNA, 19 bp, Homo sapiens
ctgagcccaggccgttccc

SEQ ID NO: 295471 - DNA, 16 bp, Homo sapiens
ctgagcccccggctag

SEQ ID NO: 295472 - DNA, 15 bp, Homo sapiens
ctgagccccctctcc

SEQ ID NO: 295473 - DNA, 17 bp, Homo sapiens
ctgagccccctctcctg

SEQ ID NO: 295474 - DNA, 21 bp, Homo sapiens
ctgagccccctctcctgaagc

SEQ ID NO: 295475 - DNA, 15 bp, Homo sapiens
ctgagccccctgtgc

SEQ ID NO: 295476 - DNA, 22 bp, Homo sapiens
ctgagccccctgtgcccaccca

SEQ ID NO: 295477 - DNA, 23 bp, Homo sapiens
ctgagccccctgtgcccacccag

SEQ ID NO: 295478 - DNA, 19 bp, Homo sapiens
ctgagcccctaccccacac

SEQ ID NO: 295479 - DNA, 14 bp, Homo sapiens
ctgagcccctcctc

SEQ ID NO: 295480 - DNA, 19 bp, Homo sapiens
ctgagcccctcctctcctc

SEQ ID NO: 295481 - DNA, 22 bp, Homo sapiens
ctgagcccctgggactgctgct

SEQ ID NO: 295482 - DNA, 10 bp, Homo sapiens
ctgagcccga

SEQ ID NO: 295483 - DNA, 17 bp, Homo sapiens
ctgagcccgaatttctc

SEQ ID NO: 295484 - DNA, 23 bp, Homo sapiens
ctgagccctccctcttcccagca

SEQ ID NO: 295485 - DNA, 23 bp, Homo sapiens
ctgagccctccttcttgccctga

SEQ ID NO: 295486 - DNA, 13 bp, Homo sapiens
ctgagcccttgca

SEQ ID NO: 295487 - DNA, 18 bp, Homo sapiens
ctgagcccttgcacaggc

SEQ ID NO: 295488 - DNA, 19 bp, Homo sapiens
ctgagccgtgcagctggga

SEQ ID NO: 295489 - DNA, 17 bp, Homo sapiens
ctgagcctactgtctcc

SEQ ID NO: 295490 - DNA, 20 bp, Homo sapiens
ctgagcctgaggccttccag

SEQ ID NO: 295491 - DNA, 23 bp, Homo sapiens
ctgagcctgccccagctgggctg

SEQ ID NO: 295492 - DNA, 15 bp, Homo sapiens
ctgagcctgtctctc

SEQ ID NO: 295493 - DNA, 19 bp, Homo sapiens
ctgagcctgtctctcccta

SEQ ID NO: 295494 - DNA, 16 bp, Homo sapiens
ctgagcctgtgggtcc

SEQ ID NO: 295495 - DNA, 22 bp, Homo sapiens
ctgagcctgtgggtccccactc

SEQ ID NO: 295496 - DNA, 16 bp, Homo sapiens
ctgagccttgtaattc

SEQ ID NO: 295497 - DNA, 17 bp, Homo sapiens
ctgagcggccgcctgtc

SEQ ID NO: 295498 - DNA, 17 bp, Homo sapiens
ctgagctataacatttg

SEQ ID NO: 295499 - DNA, 16 bp, Homo sapiens
ctgagctccaccctcc

SEQ ID NO: 295500 - DNA, 17 bp, Homo sapiens
ctgagctccaccctccc

SEQ ID NO: 295501 - DNA, 14 bp, Homo sapiens
ctgagctcctctgg

SEQ ID NO: 295502 - DNA, 18 bp, Homo sapiens
ctgagctcctctgggcag

SEQ ID NO: 295503 - DNA, 15 bp, Homo sapiens
ctgagctgccagtgg

SEQ ID NO: 295504 - DNA, 16 bp, Homo sapiens
ctgagctgccatccag

SEQ ID NO: 295505 - DNA, 12 bp, Homo sapiens
ctgagctggggc

SEQ ID NO: 295506 - DNA, 16 bp, Homo sapiens
ctgagctggggccaca

SEQ ID NO: 295507 - DNA, 21 bp, Homo sapiens
ctgagctgtgttttgtctgag

SEQ ID NO: 295508 - DNA, 17 bp, Homo sapiens
ctgagctgttatcttgt

SEQ ID NO: 295509 - DNA, 15 bp, Homo sapiens
ctgagcttagccttg

SEQ ID NO: 295510 - DNA, 16 bp, Homo sapiens
ctgagcttctctgtga

SEQ ID NO: 295511 - DNA, 21 bp, Homo sapiens
ctgagcttgattctaaagggg

SEQ ID NO: 295512 - DNA, 21 bp, Homo sapiens
ctgcagagctatggtgaggtg

SEQ ID NO: 295513 - DNA, 15 bp, Homo sapiens
ctgcagagctggggg

SEQ ID NO: 295514 - DNA, 16 bp, Homo sapiens
ctgcagaggaccacag

SEQ ID NO: 295515 - DNA, 12 bp, Homo sapiens
ctgcagaggagc

SEQ ID NO: 295516 - DNA, 15 bp, Homo sapiens
ctgcagaggagccac

SEQ ID NO: 295517 - DNA, 18 bp, Homo sapiens
ctgcagaggagccacctg

SEQ ID NO: 295518 - DNA, 13 bp, Homo sapiens
ctgcagaggcagc

SEQ ID NO: 295519 - DNA, 13 bp, Homo sapiens
ctgcagcagagcc

SEQ ID NO: 295520 - DNA, 18 bp, Homo sapiens
ctgcagcaggcagaggag

SEQ ID NO: 295521 - DNA, 19 bp, Homo sapiens
ctgcagcaggcagaggaga

SEQ ID NO: 295522 - DNA, 21 bp, Homo sapiens
ctgcagcaggcagaggagagt

SEQ ID NO: 295523 - DNA, 22 bp, Homo sapiens
ctgcagcatgacctgtgaccag

SEQ ID NO: 295524 - DNA, 16 bp, Homo sapiens
ctgcagcccacagagg

SEQ ID NO: 295525 - DNA, 17 bp, Homo sapiens
ctgcagcccacagagga

SEQ ID NO: 295526 - DNA, 21 bp, Homo sapiens
ctgcagcccacagaggacagt

SEQ ID NO: 295527 - DNA, 16 bp, Homo sapiens
ctgcagcccttgggca

SEQ ID NO: 295528 - DNA, 18 bp, Homo sapiens
ctgcagcccttgggcagt

SEQ ID NO: 295529 - DNA, 19 bp, Homo sapiens
ctgcagcccttgggcagtt

SEQ ID NO: 295530 - DNA, 13 bp, Homo sapiens
ctgcagcctcctc

SEQ ID NO: 295531 - DNA, 20 bp, Homo sapiens
ctgcagcctcctcctgacca

SEQ ID NO: 295532 - DNA, 20 bp, Homo sapiens
ctgcagcctcgaactcctgg

SEQ ID NO: 295533 - DNA, 21 bp, Homo sapiens
ctgcagcctcgaactcctggg

SEQ ID NO: 295534 - DNA, 23 bp, Homo sapiens
ctgcagcctcgaactcctgggct

SEQ ID NO: 295535 - DNA, 20 bp, Homo sapiens
ctgcagcctctgcctcccag

SEQ ID NO: 295536 - DNA, 14 bp, Homo sapiens
ctgcagcctgagct

SEQ ID NO: 295537 - DNA, 23 bp, Homo sapiens
ctgcagcctgagctccaccctcc

SEQ ID NO: 295538 - DNA, 18 bp, Homo sapiens
ctgcagcctttgcctccc

SEQ ID NO: 295539 - DNA, 17 bp, Homo sapiens
ctgcagcgcctcctgga

SEQ ID NO: 295540 - DNA, 19 bp, Homo sapiens
ctgcagcgcctcctggaca

SEQ ID NO: 295541 - DNA, 20 bp, Homo sapiens
ctgcagcgcctcctggacac

SEQ ID NO: 295542 - DNA, 21 bp, Homo sapiens
ctgcagctgacctctgttgtc

SEQ ID NO: 295543 - DNA, 10 bp, Homo sapiens
ctgcagctgc

SEQ ID NO: 295544 - DNA, 19 bp, Homo sapiens
ctgcagctgcaccagcagg

SEQ ID NO: 295545 - DNA, 12 bp, Homo sapiens
ctgcagcttggg

SEQ ID NO: 295546 - DNA, 22 bp, Homo sapiens
ctgcagcttgggagagcccctg

SEQ ID NO: 295547 - DNA, 21 bp, Homo sapiens
ctgcagctttacatgcaattt

SEQ ID NO: 295548 - DNA, 23 bp, Homo sapiens
ctgcaggaacgagcactggccag

SEQ ID NO: 295549 - DNA, 13 bp, Homo sapiens
ctgcaggatcctt

SEQ ID NO: 295550 - DNA, 16 bp, Homo sapiens
ctgcaggccaccagct

SEQ ID NO: 295551 - DNA, 12 bp, Homo sapiens
ctgcaggcccca

SEQ ID NO: 295552 - DNA, 11 bp, Homo sapiens
ctgcaggctgg

SEQ ID NO: 295553 - DNA, 23 bp, Homo sapiens
ctgcaggtacttcctcctgatgg

SEQ ID NO: 295554 - DNA, 13 bp, Homo sapiens
ctgcaggtgccca

SEQ ID NO: 295555 - DNA, 17 bp, Homo sapiens
ctgcaggttggacccca

SEQ ID NO: 295556 - DNA, 16 bp, Homo sapiens
ctgcagtcacccctgt

SEQ ID NO: 295557 - DNA, 17 bp, Homo sapiens
ctgcagtcacccctgtc

SEQ ID NO: 295558 - DNA, 22 bp, Homo sapiens
ctgcagtgatggcgcgggaggc

SEQ ID NO: 295559 - DNA, 13 bp, Homo sapiens
ctgcagtgtccat

SEQ ID NO: 295560 - DNA, 12 bp, Homo sapiens
ctgcagtgtgag

SEQ ID NO: 295561 - DNA, 15 bp, Homo sapiens
ctgcagtgtgagatt

SEQ ID NO: 295562 - DNA, 17 bp, Homo sapiens
ctgcagtgttcgcttgg

SEQ ID NO: 295563 - DNA, 14 bp, Homo sapiens
ctgcagttcctgag

SEQ ID NO: 295564 - DNA, 14 bp, Homo sapiens
ctgcagtttttcag

SEQ ID NO: 295565 - DNA, 20 bp, Homo sapiens
ctgcataagtgaaaatctta

SEQ ID NO: 295566 - DNA, 13 bp, Homo sapiens
ctgcatagacaaa

SEQ ID NO: 295567 - DNA, 17 bp, Homo sapiens
ctgcatcagcctctggc

SEQ ID NO: 295568 - DNA, 16 bp, Homo sapiens
ctgcatccaggcctga

SEQ ID NO: 295569 - DNA, 20 bp, Homo sapiens
ctgcatccaggcctgaggct

SEQ ID NO: 295570 - DNA, 21 bp, Homo sapiens
ctgcatccaggcctgaggctg

SEQ ID NO: 295571 - DNA, 19 bp, Homo sapiens
ctgcatccctccaccccag

SEQ ID NO: 295572 - DNA, 15 bp, Homo sapiens
ctgcatcccttggcc

SEQ ID NO: 295573 - DNA, 20 bp, Homo sapiens
ctgcatcctcagccccaggg

SEQ ID NO: 295574 - DNA, 13 bp, Homo sapiens
ctgcatctttcat

SEQ ID NO: 295575 - DNA, 14 bp, Homo sapiens
ctgcatctttcata

SEQ ID NO: 295576 - DNA, 16 bp, Homo sapiens
ctgcatgcaagctcag

SEQ ID NO: 295577 - DNA, 23 bp, Homo sapiens
ctgcatgcagcaacacccaagtc

SEQ ID NO: 295578 - DNA, 18 bp, Homo sapiens
ctgcatgcgacagcgtcc

SEQ ID NO: 295579 - DNA, 18 bp, Homo sapiens
ctgcatgctgctggacag

SEQ ID NO: 295580 - DNA, 17 bp, Homo sapiens
ctgcatggacctaacat

SEQ ID NO: 295581 - DNA, 15 bp, Homo sapiens
ctgcatggacgcctg

SEQ ID NO: 295582 - DNA, 18 bp, Homo sapiens
ctgcatggacgcctggct

SEQ ID NO: 295583 - DNA, 21 bp, Homo sapiens
ctgcatggacgcctggctcca

SEQ ID NO: 295584 - DNA, 22 bp, Homo sapiens
ctgcatggacgcctggctccag

SEQ ID NO: 295585 - DNA, 15 bp, Homo sapiens
ctgcattacattcct

SEQ ID NO: 295586 - DNA, 23 bp, Homo sapiens
ctgcattactattaactctgcat

SEQ ID NO: 295587 - DNA, 20 bp, Homo sapiens
ctgcattcaggatcaaaccc

SEQ ID NO: 295588 - DNA, 20 bp, Homo sapiens
ctgcattgttattgtggaag

SEQ ID NO: 295589 - DNA, 22 bp, Homo sapiens
ctgcatttggggcctttcccat

SEQ ID NO: 295590 - DNA, 15 bp, Homo sapiens
ctgcattttctgggt

SEQ ID NO: 295591 - DNA, 18 bp, Homo sapiens
ctgcatttttaaaggaca

SEQ ID NO: 295592 - DNA, 18 bp, Homo sapiens
ctgcatttttagaccatt

SEQ ID NO: 295593 - DNA, 15 bp, Homo sapiens
ctgccaaaaagaaca

SEQ ID NO: 295594 - DNA, 19 bp, Homo sapiens
ctgccaactccatgaccag

SEQ ID NO: 295595 - DNA, 22 bp, Homo sapiens
ctgccaactccatgaccaggcc

SEQ ID NO: 295596 - DNA, 14 bp, Homo sapiens
ctgccaactttcca

SEQ ID NO: 295597 - DNA, 23 bp, Homo sapiens
ctgccaacttttagtgggtgaga

SEQ ID NO: 295598 - DNA, 24 bp, Homo sapiens
ctgccaagcactcgagaccatcct

SEQ ID NO: 295599 - DNA, 14 bp, Homo sapiens
ctgccaagcctgga

SEQ ID NO: 295600 - DNA, 16 bp, Homo sapiens
ctgccaagcctggagc

SEQ ID NO: 295601 - DNA, 17 bp, Homo sapiens
ctgccaagcctggagcc

SEQ ID NO: 295602 - DNA, 23 bp, Homo sapiens
ctgccaaggccagagtggcctgg

SEQ ID NO: 295603 - DNA, 14 bp, Homo sapiens
ctgccaagtcctgc

SEQ ID NO: 295604 - DNA, 17 bp, Homo sapiens
ctgccaagtcctgcctt

SEQ ID NO: 295605 - DNA, 18 bp, Homo sapiens
ctgccaagtcctgccttt

SEQ ID NO: 295606 - DNA, 20 bp, Homo sapiens
ctgccaagtcctgcctttgg

SEQ ID NO: 295607 - DNA, 12 bp, Homo sapiens
ctgccaatgcca

SEQ ID NO: 295608 - DNA, 17 bp, Homo sapiens
ctgccaatgccacagcc

SEQ ID NO: 295609 - DNA, 17 bp, Homo sapiens
ctgccacacatgctcat

SEQ ID NO: 295610 - DNA, 23 bp, Homo sapiens
ctgccacacgtctgaccctctcc

SEQ ID NO: 295611 - DNA, 18 bp, Homo sapiens
ctgccaccaaatctgtct

SEQ ID NO: 295612 - DNA, 19 bp, Homo sapiens
ctgccaccaaatctgtcta

SEQ ID NO: 295613 - DNA, 20 bp, Homo sapiens
ctgccaccacgtctgccagg

SEQ ID NO: 295614 - DNA, 23 bp, Homo sapiens
ctgccaccacgtctgccaggccc

SEQ ID NO: 295615 - DNA, 13 bp, Homo sapiens
ctgccacccactc

SEQ ID NO: 295616 - DNA, 22 bp, Homo sapiens
ctgccacccaggcaggccctgc

SEQ ID NO: 295617 - DNA, 19 bp, Homo sapiens
ctgccacccgcttcctgtt

SEQ ID NO: 295618 - DNA, 15 bp, Homo sapiens
ctgccaccctacctg

SEQ ID NO: 295619 - DNA, 17 bp, Homo sapiens
ctgccacctccctgacc

SEQ ID NO: 295620 - DNA, 18 bp, Homo sapiens
ctgccacctggggcagtc

SEQ ID NO: 295621 - DNA, 17 bp, Homo sapiens
ctgccacctgtctgtct

SEQ ID NO: 295622 - DNA, 19 bp, Homo sapiens
ctgccactaggctgggtgc

SEQ ID NO: 295623 - DNA, 23 bp, Homo sapiens
ctgccactaggctgggtgcccac

SEQ ID NO: 295624 - DNA, 17 bp, Homo sapiens
ctgccactctctgggac

SEQ ID NO: 295625 - DNA, 23 bp, Homo sapiens
ctgccactctctgggactctcct

SEQ ID NO: 295626 - DNA, 21 bp, Homo sapiens
ctgccactgactgcagggaca

SEQ ID NO: 295627 - DNA, 17 bp, Homo sapiens
ctgccacttgcactgtg

SEQ ID NO: 295628 - DNA, 19 bp, Homo sapiens
ctgccacttgcactgtgct

SEQ ID NO: 295629 - DNA, 13 bp, Homo sapiens
ctgccagaagtgt

SEQ ID NO: 295630 - DNA, 13 bp, Homo sapiens
ctgccagagaagc

SEQ ID NO: 295631 - DNA, 20 bp, Homo sapiens
ctgccagagaagcatcggag

SEQ ID NO: 295632 - DNA, 11 bp, Homo sapiens
ctgccagagct

SEQ ID NO: 295633 - DNA, 15 bp, Homo sapiens
ctgccagcacagagc

SEQ ID NO: 295634 - DNA, 15 bp, Homo sapiens
ctgccagccttggag

SEQ ID NO: 295635 - DNA, 12 bp, Homo sapiens
ctgccagctcca

SEQ ID NO: 295636 - DNA, 15 bp, Homo sapiens
ctgccaggagcagcc

SEQ ID NO: 295637 - DNA, 21 bp, Homo sapiens
ctgccaggagcagcctccaag

SEQ ID NO: 295638 - DNA, 14 bp, Homo sapiens
ctgccaggcacctg

SEQ ID NO: 295639 - DNA, 15 bp, Homo sapiens
ctgccaggcacctgg

SEQ ID NO: 295640 - DNA, 22 bp, Homo sapiens
ctgccaggcccatctcaggtgc

SEQ ID NO: 295641 - DNA, 14 bp, Homo sapiens
ctgccaggcgttgg

SEQ ID NO: 295642 - DNA, 14 bp, Homo sapiens
ctgccttgctgcac

SEQ ID NO: 295643 - DNA, 19 bp, Homo sapiens
ctgccttgtccctctcact

SEQ ID NO: 295644 - DNA, 23 bp, Homo sapiens
ctgccttgtccctctcactcccc

SEQ ID NO: 295645 - DNA, 23 bp, Homo sapiens
ctgcctttctcccccgacactgc

SEQ ID NO: 295646 - DNA, 14 bp, Homo sapiens
ctgcctttcttcca

SEQ ID NO: 295647 - DNA, 15 bp, Homo sapiens
ctgcctttcttccat

SEQ ID NO: 295648 - DNA, 20 bp, Homo sapiens
ctgcctttgcagttggactc

SEQ ID NO: 295649 - DNA, 23 bp, Homo sapiens
ctgcctttgcagttggactctca

SEQ ID NO: 295650 - DNA, 21 bp, Homo sapiens
ctgccttttctcattctgtta

SEQ ID NO: 295651 - DNA, 14 bp, Homo sapiens
ctgcgaaacccagc

SEQ ID NO: 295652 - DNA, 15 bp, Homo sapiens
ctgcgaactgtgcag

SEQ ID NO: 295653 - DNA, 13 bp, Homo sapiens
ctgcgccacctgc

SEQ ID NO: 295654 - DNA, 15 bp, Homo sapiens
ctgcgccctccctcc

SEQ ID NO: 295655 - DNA, 20 bp, Homo sapiens
ctgcgccctccctccctcca

SEQ ID NO: 295656 - DNA, 17 bp, Homo sapiens
ctgcgcccttaccttcc

SEQ ID NO: 295657 - DNA, 16 bp, Homo sapiens
ctgcgcccttccccag

SEQ ID NO: 295658 - DNA, 15 bp, Homo sapiens
ctgcgccgctgtgct

SEQ ID NO: 295659 - DNA, 16 bp, Homo sapiens
ctgcgcctgcacctgc

SEQ ID NO: 295660 - DNA, 19 bp, Homo sapiens
ctgcgcctgcacctgcgcc

SEQ ID NO: 295661 - DNA, 12 bp, Homo sapiens
ctgcgcctgccc

SEQ ID NO: 295662 - DNA, 13 bp, Homo sapiens
ctgcgcctgcccg

SEQ ID NO: 295663 - DNA, 22 bp, Homo sapiens
ctgcgctcctctgcagcctgag

SEQ ID NO: 295664 - DNA, 23 bp, Homo sapiens
ctgcgctcctctgcagcctgagc

SEQ ID NO: 295665 - DNA, 17 bp, Homo sapiens
ctgcggactccatggcc

SEQ ID NO: 295666 - DNA, 23 bp, Homo sapiens
ctgcggactccatggcccttcct

SEQ ID NO: 295667 - DNA, 21 bp, Homo sapiens
ctgcggctgctggcacagact

SEQ ID NO: 295668 - DNA, 16 bp, Homo sapiens
ctgcgggcccagctga

SEQ ID NO: 295669 - DNA, 17 bp, Homo sapiens
ctgcgggtctgaaggaa

SEQ ID NO: 295670 - DNA, 15 bp, Homo sapiens
ctgcggtgaggcagg

SEQ ID NO: 295671 - DNA, 13 bp, Homo sapiens
ctgcggtgggcag

SEQ ID NO: 295672 - DNA, 15 bp, Homo sapiens
ctgcgtcatggctca

SEQ ID NO: 295673 - DNA, 23 bp, Homo sapiens
ctgcgtcatggctcaaggattca

SEQ ID NO: 295674 - DNA, 19 bp, Homo sapiens
ctgcgtcccactgagtctc

SEQ ID NO: 295675 - DNA, 12 bp, Homo sapiens
ctgcgtgccatc

SEQ ID NO: 295676 - DNA, 13 bp, Homo sapiens
ctgcgtggcctgg

SEQ ID NO: 295677 - DNA, 22 bp, Homo sapiens
ctgcgttggagccactcctgtc

SEQ ID NO: 295678 - DNA, 19 bp, Homo sapiens
ctgctaaggctcctccttg

SEQ ID NO: 295679 - DNA, 15 bp, Homo sapiens
ctgctaataaatgac

SEQ ID NO: 295680 - DNA, 16 bp, Homo sapiens
ctgctaataaatgacc

SEQ ID NO: 295681 - DNA, 17 bp, Homo sapiens
ctgctaataaatgacca

SEQ ID NO: 295682 - DNA, 17 bp, Homo sapiens
ctgctaccgccctgggc

SEQ ID NO: 295683 - DNA, 21 bp, Homo sapiens
ctgctaccgccctgggctgga

SEQ ID NO: 295684 - DNA, 23 bp, Homo sapiens
ctgctaccgccctgggctggact

SEQ ID NO: 295685 - DNA, 15 bp, Homo sapiens
ctgctagagcaaccc

SEQ ID NO: 295686 - DNA, 16 bp, Homo sapiens
ctgctagcaaatggca

SEQ ID NO: 295687 - DNA, 16 bp, Homo sapiens
ctgctagctgtagaaa

SEQ ID NO: 295688 - DNA, 19 bp, Homo sapiens
ctgctagctgtagaaatgt

SEQ ID NO: 295689 - DNA, 15 bp, Homo sapiens
ctgctaggtgggcca

SEQ ID NO: 295690 - DNA, 21 bp, Homo sapiens
ctgctaggtgggccagcccct

SEQ ID NO: 295691 - DNA, 20 bp, Homo sapiens
ctgctataattctatactgt

SEQ ID NO: 295692 - DNA, 19 bp, Homo sapiens
ctgctatattttcatgact

SEQ ID NO: 295693 - DNA, 12 bp, Homo sapiens
ctgctatccagc

SEQ ID NO: 295694 - DNA, 16 bp, Homo sapiens
ctgctatccagccgca

SEQ ID NO: 295695 - DNA, 16 bp, Homo sapiens
ctgctatcctgccaaa

SEQ ID NO: 295696 - DNA, 21 bp, Homo sapiens
ctgctatgaaaatgagcatca

SEQ ID NO: 295697 - DNA, 22 bp, Homo sapiens
ctgctatgaaaatgagcatcag

SEQ ID NO: 295698 - DNA, 14 bp, Homo sapiens
ctgctatgaagact

SEQ ID NO: 295699 - DNA, 23 bp, Homo sapiens
ctgctatgcagatgtctaagaca

SEQ ID NO: 295700 - DNA, 19 bp, Homo sapiens
ctgctatttcccaagctgg

SEQ ID NO: 295701 - DNA, 21 bp, Homo sapiens
ctgctatttcccaagctggag

SEQ ID NO: 295702 - DNA, 23 bp, Homo sapiens
ctgctcaagaagacatggagact

SEQ ID NO: 295703 - DNA, 19 bp, Homo sapiens
ctgctcaatgaaaccttcc

SEQ ID NO: 295704 - DNA, 20 bp, Homo sapiens
ctgctcaatgaaaccttcct

SEQ ID NO: 295705 - DNA, 15 bp, Homo sapiens
ctgctcacattccct

SEQ ID NO: 295706 - DNA, 16 bp, Homo sapiens
ctgctcacattccctc

SEQ ID NO: 295707 - DNA, 16 bp, Homo sapiens
ctgctcacgtctgtga

SEQ ID NO: 295708 - DNA, 18 bp, Homo sapiens
ctgctcacgtctgtgagt

SEQ ID NO: 295709 - DNA, 12 bp, Homo sapiens
ctgctcaggcct

SEQ ID NO: 295710 - DNA, 13 bp, Homo sapiens
ctgctcaggcctc

SEQ ID NO: 295711 - DNA, 15 bp, Homo sapiens
ctgctcatctgatat

SEQ ID NO: 295712 - DNA, 16 bp, Homo sapiens
ctgctccaccacatcc

SEQ ID NO: 295713 - DNA, 11 bp, Homo sapiens
ctgctccaccc

SEQ ID NO: 295714 - DNA, 12 bp, Homo sapiens
ctgctccaccct

SEQ ID NO: 295715 - DNA, 16 bp, Homo sapiens
ctgctccacccttggc

SEQ ID NO: 295716 - DNA, 18 bp, Homo sapiens
ctgctccacgaagcctta

SEQ ID NO: 295717 - DNA, 21 bp, Homo sapiens
ctgctccacgaagccttaagc

SEQ ID NO: 295718 - DNA, 13 bp, Homo sapiens
ctgctccatgact

SEQ ID NO: 295719 - DNA, 11 bp, Homo sapiens
ctgctccatgg

SEQ ID NO: 295720 - DNA, 16 bp, Homo sapiens
ctgctccatgggcacc

SEQ ID NO: 295721 - DNA, 19 bp, Homo sapiens
ctgctcccagatgccttct

SEQ ID NO: 295722 - DNA, 14 bp, Homo sapiens
ctgctcccagcagc

SEQ ID NO: 295723 - DNA, 15 bp, Homo sapiens
ctgctcccagcagcc

SEQ ID NO: 295724 - DNA, 17 bp, Homo sapiens
ctgctcccagcagccct

SEQ ID NO: 295725 - DNA, 21 bp, Homo sapiens
ctgctcccagcagccctaagg

SEQ ID NO: 295726 - DNA, 14 bp, Homo sapiens
ctgctcccagcctg

SEQ ID NO: 295727 - DNA, 20 bp, Homo sapiens
ctgctcccagcctgctgaga

SEQ ID NO: 295728 - DNA, 14 bp, Homo sapiens
ctgctcccattcct

SEQ ID NO: 295729 - DNA, 18 bp, Homo sapiens
ctgctcccattcctccct

SEQ ID NO: 295730 - DNA, 13 bp, Homo sapiens
ctgctcccctccc

SEQ ID NO: 295731 - DNA, 14 bp, Homo sapiens
ctgctcccgcctga

SEQ ID NO: 295732 - DNA, 15 bp, Homo sapiens
ctgctccgtgtgtct

SEQ ID NO: 295733 - DNA, 22 bp, Homo sapiens
ctgctccgtgtgtctcatgcca

SEQ ID NO: 295734 - DNA, 13 bp, Homo sapiens
ctgctcctcatgg

SEQ ID NO: 295735 - DNA, 13 bp, Homo sapiens
ctgctcctcgcag

SEQ ID NO: 295736 - DNA, 17 bp, Homo sapiens
ctgctcctcgcagttcg

SEQ ID NO: 295737 - DNA, 22 bp, Homo sapiens
ctgctcctcggccagagctccc

SEQ ID NO: 295738 - DNA, 15 bp, Homo sapiens
ctgctcctctttccc

SEQ ID NO: 295739 - DNA, 19 bp, Homo sapiens
ctgctccttggcaccccca

SEQ ID NO: 295740 - DNA, 23 bp, Homo sapiens
ctgctccttggcacccccatgct

SEQ ID NO: 295741 - DNA, 12 bp, Homo sapiens
ctgctcgggaag

SEQ ID NO: 295742 - DNA, 14 bp, Homo sapiens
ctgctcgggaaggc

SEQ ID NO: 295743 - DNA, 20 bp, Homo sapiens
ctgctctacccatgagcctg

SEQ ID NO: 295744 - DNA, 22 bp, Homo sapiens
ctgctctacccatgagcctgcc

SEQ ID NO: 295745 - DNA, 23 bp, Homo sapiens
ctgctctacccatgagcctgccc

SEQ ID NO: 295746 - DNA, 15 bp, Homo sapiens
ctgctctagccagga

SEQ ID NO: 295747 - DNA, 23 bp, Homo sapiens
ctgctctagccaggagtctgtgc

SEQ ID NO: 295748 - DNA, 15 bp, Homo sapiens
ctgctctattgtagc

SEQ ID NO: 295749 - DNA, 23 bp, Homo sapiens
ctgctctattgtagcatttcttg

SEQ ID NO: 295750 - DNA, 21 bp, Homo sapiens
ctgctctccttcactctgaca

SEQ ID NO: 295751 - DNA, 21 bp, Homo sapiens
ctgctctccttgccctgggcc

SEQ ID NO: 295752 - DNA, 13 bp, Homo sapiens
ctgctctgagacg

SEQ ID NO: 295753 - DNA, 17 bp, Homo sapiens
ctgctctgcaagcccac

SEQ ID NO: 295754 - DNA, 12 bp, Homo sapiens
ctgctctgcaca

SEQ ID NO: 295755 - DNA, 13 bp, Homo sapiens
ctgctctgcagcc

SEQ ID NO: 295756 - DNA, 14 bp, Homo sapiens
ctgctctgcagccc

SEQ ID NO: 295757 - DNA, 19 bp, Homo sapiens
ctgctctgcagcccacaga

SEQ ID NO: 295758 - DNA, 21 bp, Homo sapiens
ctgctctgcagcccacagagg

SEQ ID NO: 295759 - DNA, 24 bp, Homo sapiens
ctgctctgcagcccacagaggaca

SEQ ID NO: 295760 - DNA, 11 bp, Homo sapiens
ctgctctgccc

SEQ ID NO: 295761 - DNA, 23 bp, Homo sapiens
ctgctctgccccttgggcatcca

SEQ ID NO: 295762 - DNA, 16 bp, Homo sapiens
ctgctctgtcttggtc

SEQ ID NO: 295763 - DNA, 13 bp, Homo sapiens
ctgctctgtgcct

SEQ ID NO: 295764 - DNA, 19 bp, Homo sapiens
ctgctctgtgcctgggatc

SEQ ID NO: 295765 - DNA, 18 bp, Homo sapiens
ctgctcttagtgcccgcc

SEQ ID NO: 295766 - DNA, 15 bp, Homo sapiens
ctgctctttctctgc

SEQ ID NO: 295767 - DNA, 14 bp, Homo sapiens
ctgctcttttacta

SEQ ID NO: 295768 - DNA, 21 bp, Homo sapiens
ctgctgaaaaccatctggcct

SEQ ID NO: 295769 - DNA, 19 bp, Homo sapiens
ctgctgacagatgttccat

SEQ ID NO: 295770 - DNA, 20 bp, Homo sapiens
ctgctgagagcccccacctt

SEQ ID NO: 295771 - DNA, 11 bp, Homo sapiens
ctgctgagcca

SEQ ID NO: 295772 - DNA, 21 bp, Homo sapiens
ctggatgggcattgggctgac

SEQ ID NO: 295773 - DNA, 21 bp, Homo sapiens
ctggatgtcccctgtcccacc

SEQ ID NO: 295774 - DNA, 17 bp, Homo sapiens
ctggatgtgtggggcat

SEQ ID NO: 295775 - DNA, 19 bp, Homo sapiens
ctggattaatgttttgtac

SEQ ID NO: 295776 - DNA, 21 bp, Homo sapiens
ctggattaatgttttgtacaa

SEQ ID NO: 295777 - DNA, 22 bp, Homo sapiens
ctggattgatcggagcctcctc

SEQ ID NO: 295778 - DNA, 15 bp, Homo sapiens
ctggatttcttccta

SEQ ID NO: 295779 - DNA, 22 bp, Homo sapiens
ctggatttgggagctctgcttg

SEQ ID NO: 295780 - DNA, 23 bp, Homo sapiens
ctggatttgggagctctgcttgc

SEQ ID NO: 295781 - DNA, 12 bp, Homo sapiens
ctggattttctt

SEQ ID NO: 295782 - DNA, 19 bp, Homo sapiens
ctggattttctttctatgt

SEQ ID NO: 295783 - DNA, 20 bp, Homo sapiens
ctggattttctttctatgta

SEQ ID NO: 295784 - DNA, 23 bp, Homo sapiens
ctggatttttacaaataaagatg

SEQ ID NO: 295785 - DNA, 21 bp, Homo sapiens
ctggcaagagctctttgtctc

SEQ ID NO: 295786 - DNA, 13 bp, Homo sapiens
ctggcaagattga

SEQ ID NO: 295787 - DNA, 14 bp, Homo sapiens
ctggcaagcaggga

SEQ ID NO: 295788 - DNA, 19 bp, Homo sapiens
ctggcaatagtgtgttctg

SEQ ID NO: 295789 - DNA, 18 bp, Homo sapiens
ctggcacagaaagggcag

SEQ ID NO: 295790 - DNA, 22 bp, Homo sapiens
ctggcacatttccccagacctg

SEQ ID NO: 295791 - DNA, 14 bp, Homo sapiens
ctggcacccactcc

SEQ ID NO: 295792 - DNA, 20 bp, Homo sapiens
ctggcacctgggtgctctgg

SEQ ID NO: 295793 - DNA, 15 bp, Homo sapiens
ctggcacgtcctcca

SEQ ID NO: 295794 - DNA, 23 bp, Homo sapiens
ctggcacgtcctccaccggtgcc

SEQ ID NO: 295795 - DNA, 18 bp, Homo sapiens
ctggcactccagaacaaa

SEQ ID NO: 295796 - DNA, 20 bp, Homo sapiens
ctggcagaactgagctcctc

SEQ ID NO: 295797 - DNA, 15 bp, Homo sapiens
ctggcagagaagaga

SEQ ID NO: 295798 - DNA, 15 bp, Homo sapiens
ctggcagaggggaca

SEQ ID NO: 295799 - DNA, 16 bp, Homo sapiens
ctggcagaggggacag

SEQ ID NO: 295800 - DNA, 15 bp, Homo sapiens
ctggcagccagggag

SEQ ID NO: 295801 - DNA, 14 bp, Homo sapiens
ctggcagcgcctcc

SEQ ID NO: 295802 - DNA, 17 bp, Homo sapiens
ctggcagcgcctcccgc

SEQ ID NO: 295803 - DNA, 22 bp, Homo sapiens
ctggcagcgcctcccgccgcct

SEQ ID NO: 295804 - DNA, 22 bp, Homo sapiens
ctggcagctcctctccttgggc

SEQ ID NO: 295805 - DNA, 23 bp, Homo sapiens
ctggcagctcctctccttgggct

SEQ ID NO: 295806 - DNA, 12 bp, Homo sapiens
ctggcagctctc

SEQ ID NO: 295807 - DNA, 23 bp, Homo sapiens
ctggcagctctccagtcaggagg

SEQ ID NO: 295808 - DNA, 14 bp, Homo sapiens
ctggcaggagacac

SEQ ID NO: 295809 - DNA, 16 bp, Homo sapiens
ctggcaggagacactg

SEQ ID NO: 295810 - DNA, 21 bp, Homo sapiens
ctggcaggagacactggtctc

SEQ ID NO: 295811 - DNA, 23 bp, Homo sapiens
ctggcaggagagagccttggcct

SEQ ID NO: 295812 - DNA, 16 bp, Homo sapiens
ctggcaggagggtggc

SEQ ID NO: 295813 - DNA, 17 bp, Homo sapiens
ctggcagggcaggcaga

SEQ ID NO: 295814 - DNA, 18 bp, Homo sapiens
ctggcagggcaggcagag

SEQ ID NO: 295815 - DNA, 16 bp, Homo sapiens
ctggcaggtgcagatg

SEQ ID NO: 295816 - DNA, 21 bp, Homo sapiens
ctggcaggtgcagatgggctg

SEQ ID NO: 295817 - DNA, 20 bp, Homo sapiens
ctggcaggtgttgggacctg

SEQ ID NO: 295818 - DNA, 17 bp, Homo sapiens
ctggcatagccctcctg

SEQ ID NO: 295819 - DNA, 17 bp, Homo sapiens
ctggcatctctggagtg

SEQ ID NO: 295820 - DNA, 16 bp, Homo sapiens
ctggcatcttggaaat

SEQ ID NO: 295821 - DNA, 17 bp, Homo sapiens
ctggcatgacactctag

SEQ ID NO: 295822 - DNA, 19 bp, Homo sapiens
ctggcatgggaatgaatgt

SEQ ID NO: 295823 - DNA, 24 bp, Homo sapiens
ctggcatgggaatgaatgtcagtg

SEQ ID NO: 295824 - DNA, 21 bp, Homo sapiens
ctggcattctacacctggacc

SEQ ID NO: 295825 - DNA, 19 bp, Homo sapiens
ctggcattgtccctgtgcc

SEQ ID NO: 295826 - DNA, 14 bp, Homo sapiens
ctggccaaatatgc

SEQ ID NO: 295827 - DNA, 21 bp, Homo sapiens
ctggccaaatatgcactttcc

SEQ ID NO: 295828 - DNA, 10 bp, Homo sapiens
ctggccaccc

SEQ ID NO: 295829 - DNA, 14 bp, Homo sapiens
ctggccaccctggc

SEQ ID NO: 295830 - DNA, 15 bp, Homo sapiens
ctggccaccctggcc

SEQ ID NO: 295831 - DNA, 16 bp, Homo sapiens
ctggccaccctggccc

SEQ ID NO: 295832 - DNA, 14 bp, Homo sapiens
ctggccacccttgg

SEQ ID NO: 295833 - DNA, 15 bp, Homo sapiens
ctggccacccttggc

SEQ ID NO: 295834 - DNA, 18 bp, Homo sapiens
ctggccacctctctcctt

SEQ ID NO: 295835 - DNA, 20 bp, Homo sapiens
ctggccacgcagccaggaca

SEQ ID NO: 295836 - DNA, 13 bp, Homo sapiens
ctggccactctgc

SEQ ID NO: 295837 - DNA, 14 bp, Homo sapiens
ctggccagacggcc

SEQ ID NO: 295838 - DNA, 11 bp, Homo sapiens
ctggccagaga

SEQ ID NO: 295839 - DNA, 14 bp, Homo sapiens
ctggccagagaggg

SEQ ID NO: 295840 - DNA, 18 bp, Homo sapiens
ctggccagagagggccca

SEQ ID NO: 295841 - DNA, 16 bp, Homo sapiens
ctggccagaggcagct

SEQ ID NO: 295842 - DNA, 13 bp, Homo sapiens
ctggccagaggct

SEQ ID NO: 295843 - DNA, 17 bp, Homo sapiens
ctggccagcaaggcagg

SEQ ID NO: 295844 - DNA, 14 bp, Homo sapiens
ctggccagcctggg

SEQ ID NO: 295845 - DNA, 20 bp, Homo sapiens
ctggccagcctggggcctgg

SEQ ID NO: 295846 - DNA, 23 bp, Homo sapiens
ctggccagcctggggcctggcag

SEQ ID NO: 295847 - DNA, 11 bp, Homo sapiens
ctggccaggca

SEQ ID NO: 295848 - DNA, 13 bp, Homo sapiens
ctggccaggcaga

SEQ ID NO: 295849 - DNA, 19 bp, Homo sapiens
ctggccagtagctgccaaa

SEQ ID NO: 295850 - DNA, 17 bp, Homo sapiens
ctggccagttggaacca

SEQ ID NO: 295851 - DNA, 15 bp, Homo sapiens
ctggcccagccagca

SEQ ID NO: 295852 - DNA, 16 bp, Homo sapiens
ctggcccagccagcag

SEQ ID NO: 295853 - DNA, 17 bp, Homo sapiens
ctggcccagccagcagg

SEQ ID NO: 295854 - DNA, 21 bp, Homo sapiens
ctggcccatctcagcctcctg

SEQ ID NO: 295855 - DNA, 22 bp, Homo sapiens
ctggcccatctcagcctcctga

SEQ ID NO: 295856 - DNA, 11 bp, Homo sapiens
ctggccccagg

SEQ ID NO: 295857 - DNA, 13 bp, Homo sapiens
ctggccccaggcg

SEQ ID NO: 295858 - DNA, 18 bp, Homo sapiens
ctggccccaggcggaggg

SEQ ID NO: 295859 - DNA, 15 bp, Homo sapiens
ctggcccccctccag

SEQ ID NO: 295860 - DNA, 19 bp, Homo sapiens
ctggccccgggctctggcc

SEQ ID NO: 295861 - DNA, 21 bp, Homo sapiens
ctggccccgggctctggccac

SEQ ID NO: 295862 - DNA, 20 bp, Homo sapiens
ctggcccctagaatcagcct

SEQ ID NO: 295863 - DNA, 14 bp, Homo sapiens
ctggcccctcccac

SEQ ID NO: 295864 - DNA, 15 bp, Homo sapiens
ctggcccctcccaca

SEQ ID NO: 295865 - DNA, 16 bp, Homo sapiens
ctggccctgccctccc

SEQ ID NO: 295866 - DNA, 15 bp, Homo sapiens
ctggccctgccctga

SEQ ID NO: 295867 - DNA, 13 bp, Homo sapiens
ctggccctgttgt

SEQ ID NO: 295868 - DNA, 14 bp, Homo sapiens
ctggcccttgccca

SEQ ID NO: 295869 - DNA, 18 bp, Homo sapiens
ctggcccttgcccaactc

SEQ ID NO: 295870 - DNA, 17 bp, Homo sapiens
ctggccgagggtcctgg

SEQ ID NO: 295871 - DNA, 20 bp, Homo sapiens
ctggccgagggtcctggctc

SEQ ID NO: 295872 - DNA, 14 bp, Homo sapiens
ctggccgggcacag

SEQ ID NO: 295873 - DNA, 17 bp, Homo sapiens
ctggccgggcacagctg

SEQ ID NO: 295874 - DNA, 20 bp, Homo sapiens
ctggccgggcacagctgtgg

SEQ ID NO: 295875 - DNA, 19 bp, Homo sapiens
ctggccggggcccctcacc

SEQ ID NO: 295876 - DNA, 20 bp, Homo sapiens
ctggccgggttggaggcctc

SEQ ID NO: 295877 - DNA, 13 bp, Homo sapiens
ctggcctatttaa

SEQ ID NO: 295878 - DNA, 16 bp, Homo sapiens
ctggcctatttaagcc

SEQ ID NO: 295879 - DNA, 14 bp, Homo sapiens
ctggcctcactggc

SEQ ID NO: 295880 - DNA, 21 bp, Homo sapiens
ctggcctcagactcatacaga

SEQ ID NO: 295881 - DNA, 23 bp, Homo sapiens
ctggcctcagccagctgcccaca

SEQ ID NO: 295882 - DNA, 19 bp, Homo sapiens
ctggcctcccaataaagct

SEQ ID NO: 295883 - DNA, 15 bp, Homo sapiens
ctggcctgagctggg

SEQ ID NO: 295884 - DNA, 18 bp, Homo sapiens
ctggcctgagctggggcc

SEQ ID NO: 295885 - DNA, 19 bp, Homo sapiens
ctggcctgagctggggcca

SEQ ID NO: 295886 - DNA, 12 bp, Homo sapiens
ctggcctgccag

SEQ ID NO: 295887 - DNA, 16 bp, Homo sapiens
ctggcctgcgcctgca

SEQ ID NO: 295888 - DNA, 17 bp, Homo sapiens
ctggcctgctgggaacc

SEQ ID NO: 295889 - DNA, 23 bp, Homo sapiens
ctggcctgctgggaaccccgcag

SEQ ID NO: 295890 - DNA, 12 bp, Homo sapiens
ctggcctggatc

SEQ ID NO: 295891 - DNA, 15 bp, Homo sapiens
ctggcctggatctcc

SEQ ID NO: 295892 - DNA, 14 bp, Homo sapiens
ctggcctggccctg

SEQ ID NO: 295893 - DNA, 16 bp, Homo sapiens
ctggcctggccctgcc

SEQ ID NO: 295894 - DNA, 23 bp, Homo sapiens
ctggcctggccctgccctgagga

SEQ ID NO: 295895 - DNA, 15 bp, Homo sapiens
ctggcctggcctggc

SEQ ID NO: 295896 - DNA, 12 bp, Homo sapiens
ctggcctgttct

SEQ ID NO: 295897 - DNA, 17 bp, Homo sapiens
ctggcctgttctgtagg

SEQ ID NO: 295898 - DNA, 22 bp, Homo sapiens
ctggcctgttctgtaggagaga

SEQ ID NO: 295899 - DNA, 19 bp, Homo sapiens
ctggccttggttcctccag

SEQ ID NO: 295900 - DNA, 16 bp, Homo sapiens
ctggcggaacctggct

SEQ ID NO: 295901 - DNA, 17 bp, Homo sapiens
ctggcggccctaagcca

SEQ ID NO: 295902 - DNA, 13 bp, Homo sapiens
ctggggccccacc

SEQ ID NO: 295903 - DNA, 15 bp, Homo sapiens
ctggggccccaccgt

SEQ ID NO: 295904 - DNA, 18 bp, Homo sapiens
ctggggccccgctgggat

SEQ ID NO: 295905 - DNA, 19 bp, Homo sapiens
ctggggcctagactctgta

SEQ ID NO: 295906 - DNA, 12 bp, Homo sapiens
ctggggcctggc

SEQ ID NO: 295907 - DNA, 13 bp, Homo sapiens
ctggggcctggca

SEQ ID NO: 295908 - DNA, 19 bp, Homo sapiens
ctggggcctggcagggagg

SEQ ID NO: 295909 - DNA, 12 bp, Homo sapiens
ctggggctccct

SEQ ID NO: 295910 - DNA, 23 bp, Homo sapiens
ctggggctcctttctccagccag

SEQ ID NO: 295911 - DNA, 13 bp, Homo sapiens
ctggggctgccgt

SEQ ID NO: 295912 - DNA, 14 bp, Homo sapiens
ctggggctgggccc

SEQ ID NO: 295913 - DNA, 20 bp, Homo sapiens
ctggggcttcaccagtctgt

SEQ ID NO: 295914 - DNA, 20 bp, Homo sapiens
ctggggcttctcctgaccca

SEQ ID NO: 295915 - DNA, 17 bp, Homo sapiens
ctggggcttttgtgcca

SEQ ID NO: 295916 - DNA, 19 bp, Homo sapiens
ctggggcttttgtgccagg

SEQ ID NO: 295917 - DNA, 19 bp, Homo sapiens
ctgggggatttcaagggac

SEQ ID NO: 295918 - DNA, 14 bp, Homo sapiens
ctgggggcaggagg

SEQ ID NO: 295919 - DNA, 20 bp, Homo sapiens
ctgggggcagtgactggcag

SEQ ID NO: 295920 - DNA, 23 bp, Homo sapiens
ctgggggcatgggggaggctctg

SEQ ID NO: 295921 - DNA, 14 bp, Homo sapiens
ctgggggccatgag

SEQ ID NO: 295922 - DNA, 12 bp, Homo sapiens
ctgggggcctca

SEQ ID NO: 295923 - DNA, 13 bp, Homo sapiens
ctgggggcctcac

SEQ ID NO: 295924 - DNA, 14 bp, Homo sapiens
ctgggggcctctgc

SEQ ID NO: 295925 - DNA, 19 bp, Homo sapiens
ctgggggcctctgcctcca

SEQ ID NO: 295926 - DNA, 13 bp, Homo sapiens
ctggggggcacag

SEQ ID NO: 295927 - DNA, 20 bp, Homo sapiens
ctggggggcacagccagaaa

SEQ ID NO: 295928 - DNA, 16 bp, Homo sapiens
ctggggggctgtcctg

SEQ ID NO: 295929 - DNA, 16 bp, Homo sapiens
ctggggtacacagtga

SEQ ID NO: 295930 - DNA, 17 bp, Homo sapiens
ctggggtccccactccc

SEQ ID NO: 295931 - DNA, 16 bp, Homo sapiens
ctggggtctctgagca

SEQ ID NO: 295932 - DNA, 19 bp, Homo sapiens
ctggggtctctgagcagtg

SEQ ID NO: 295933 - DNA, 21 bp, Homo sapiens
ctggggtctctgagcagtggg

SEQ ID NO: 295934 - DNA, 23 bp, Homo sapiens
ctggggtctctgagcagtgggga

SEQ ID NO: 295935 - DNA, 16 bp, Homo sapiens
ctggggtgagagagga

SEQ ID NO: 295936 - DNA, 19 bp, Homo sapiens
ctggggtgagagaggaaag

SEQ ID NO: 295937 - DNA, 23 bp, Homo sapiens
ctggggtgccctccactgccctc

SEQ ID NO: 295938 - DNA, 17 bp, Homo sapiens
ctggggtggggaggcag

SEQ ID NO: 295939 - DNA, 17 bp, Homo sapiens
ctggggtggttggaggc

SEQ ID NO: 295940 - DNA, 19 bp, Homo sapiens
ctggggtttccacacaggc

SEQ ID NO: 295941 - DNA, 20 bp, Homo sapiens
ctggggtttccacacaggcc

SEQ ID NO: 295942 - DNA, 24 bp, Homo sapiens
ctggggtttccacacaggcccatg

SEQ ID NO: 295943 - DNA, 14 bp, Homo sapiens
ctgggtaccaggcc

SEQ ID NO: 295944 - DNA, 15 bp, Homo sapiens
ctgggtaccaggcca

SEQ ID NO: 295945 - DNA, 16 bp, Homo sapiens
ctgggtaccaggccac

SEQ ID NO: 295946 - DNA, 22 bp, Homo sapiens
ctgggtcaaagtggtacaggaa

SEQ ID NO: 295947 - DNA, 17 bp, Homo sapiens
ctgggtcaccttcctgg

SEQ ID NO: 295948 - DNA, 20 bp, Homo sapiens
ctgggtcaccttcctgggca

SEQ ID NO: 295949 - DNA, 22 bp, Homo sapiens
ctgggtcaccttcctgggcagc

SEQ ID NO: 295950 - DNA, 16 bp, Homo sapiens
ctgggtcggccctgcc

SEQ ID NO: 295951 - DNA, 14 bp, Homo sapiens
ctgggtctccctgg

SEQ ID NO: 295952 - DNA, 22 bp, Homo sapiens
ctgggtctcgctttgttgccca

SEQ ID NO: 295953 - DNA, 16 bp, Homo sapiens
ctgggtctgtgtctct

SEQ ID NO: 295954 - DNA, 23 bp, Homo sapiens
ctgggtgacagagcaagactctg

SEQ ID NO: 295955 - DNA, 17 bp, Homo sapiens
ctgggtgacagagcgag

SEQ ID NO: 295956 - DNA, 19 bp, Homo sapiens
ctgggtgacagagtgagtg

SEQ ID NO: 295957 - DNA, 15 bp, Homo sapiens
ctgggtgagtggctg

SEQ ID NO: 295958 - DNA, 17 bp, Homo sapiens
ctgggtgagtggctgac

SEQ ID NO: 295959 - DNA, 18 bp, Homo sapiens
ctgggtgagtggggagac

SEQ ID NO: 295960 - DNA, 18 bp, Homo sapiens
ctgggtgagtttttcttt

SEQ ID NO: 295961 - DNA, 14 bp, Homo sapiens
ctgggtgcagctga

SEQ ID NO: 295962 - DNA, 15 bp, Homo sapiens
ctgggtgcagctgag

SEQ ID NO: 295963 - DNA, 19 bp, Homo sapiens
ctgggtgccattcccagcg

SEQ ID NO: 295964 - DNA, 17 bp, Homo sapiens
ctgggtgcctcccacac

SEQ ID NO: 295965 - DNA, 22 bp, Homo sapiens
ctgggtgcctcccacacttgct

SEQ ID NO: 295966 - DNA, 21 bp, Homo sapiens
ctgggtgctctggctggagag

SEQ ID NO: 295967 - DNA, 12 bp, Homo sapiens
ctgggtggcctg

SEQ ID NO: 295968 - DNA, 17 bp, Homo sapiens
ctgggtgggcccagaac

SEQ ID NO: 295969 - DNA, 19 bp, Homo sapiens
ctgggtgggcccagaactg

SEQ ID NO: 295970 - DNA, 14 bp, Homo sapiens
ctgggtggggacag

SEQ ID NO: 295971 - DNA, 19 bp, Homo sapiens
ctgggtggggcagggcctg

SEQ ID NO: 295972 - DNA, 22 bp, Homo sapiens
ctgggttaatggctagtactgt

SEQ ID NO: 295973 - DNA, 16 bp, Homo sapiens
ctgggttctgggtggt

SEQ ID NO: 295974 - DNA, 16 bp, Homo sapiens
ctgggtttacaacaaa

SEQ ID NO: 295975 - DNA, 22 bp, Homo sapiens
ctgggtttccacacagcctgtc

SEQ ID NO: 295976 - DNA, 14 bp, Homo sapiens
ctgggtttgggcag

SEQ ID NO: 295977 - DNA, 19 bp, Homo sapiens
ctgggtttgggcagtggag

SEQ ID NO: 295978 - DNA, 20 bp, Homo sapiens
ctgggttttcaggggctttg

SEQ ID NO: 295979 - DNA, 16 bp, Homo sapiens
ctggtaaactatttgt

SEQ ID NO: 295980 - DNA, 13 bp, Homo sapiens
ctggtaagttgga

SEQ ID NO: 295981 - DNA, 21 bp, Homo sapiens
ctggtaatttgtatctgaagg

SEQ ID NO: 295982 - DNA, 15 bp, Homo sapiens
ctggtacagcagggt

SEQ ID NO: 295983 - DNA, 17 bp, Homo sapiens
ctggtacagcagggtct

SEQ ID NO: 295984 - DNA, 22 bp, Homo sapiens
ctggtacagcagggtcttgctg

SEQ ID NO: 295985 - DNA, 23 bp, Homo sapiens
ctggtacagcagggtcttgctgt

SEQ ID NO: 295986 - DNA, 13 bp, Homo sapiens
ctggtactctcct

SEQ ID NO: 295987 - DNA, 13 bp, Homo sapiens
ctggtagagacta

SEQ ID NO: 295988 - DNA, 15 bp, Homo sapiens
ctggtagatagaaat

SEQ ID NO: 295989 - DNA, 13 bp, Homo sapiens
ctggtaggaaagc

SEQ ID NO: 295990 - DNA, 18 bp, Homo sapiens
ctggtaggttctgtctgt

SEQ ID NO: 295991 - DNA, 19 bp, Homo sapiens
ctggtatgggtttctccca

SEQ ID NO: 295992 - DNA, 20 bp, Homo sapiens
ctggtcacaggactctgcct

SEQ ID NO: 295993 - DNA, 21 bp, Homo sapiens
ctggtcacaggactctgcctc

SEQ ID NO: 295994 - DNA, 22 bp, Homo sapiens
ctggtcactgccatggaggcac

SEQ ID NO: 295995 - DNA, 18 bp, Homo sapiens
ctggtcagtgaagcccag

SEQ ID NO: 295996 - DNA, 23 bp, Homo sapiens
ctggtcagtgaagcccaggagga

SEQ ID NO: 295997 - DNA, 13 bp, Homo sapiens
ctggtcatacatt

SEQ ID NO: 295998 - DNA, 20 bp, Homo sapiens
ctggtcataggctcactctt

SEQ ID NO: 295999 - DNA, 18 bp, Homo sapiens
ctggtccacacaccacag

SEQ ID NO: 296000 - DNA, 13 bp, Homo sapiens
ctggtccaggcat

SEQ ID NO: 296001 - DNA, 17 bp, Homo sapiens
ctggtccaggcatgggt

SEQ ID NO: 296002 - DNA, 19 bp, Homo sapiens
ctggtccaggcatgggtcc

SEQ ID NO: 296003 - DNA, 14 bp, Homo sapiens
ctggtccaggccag

SEQ ID NO: 296004 - DNA, 17 bp, Homo sapiens
ctggtccagggaagctg

SEQ ID NO: 296005 - DNA, 21 bp, Homo sapiens
ctggtccagggaagctggccg

SEQ ID NO: 296006 - DNA, 22 bp, Homo sapiens
ctggtccagggaagctggccga

SEQ ID NO: 296007 - DNA, 13 bp, Homo sapiens
ctggtccagggct

SEQ ID NO: 296008 - DNA, 14 bp, Homo sapiens
ctggtccagggcta

SEQ ID NO: 296009 - DNA, 21 bp, Homo sapiens
ctggtcccttgcagctagttt

SEQ ID NO: 296010 - DNA, 18 bp, Homo sapiens
ctggtctcaaactcctga

SEQ ID NO: 296011 - DNA, 22 bp, Homo sapiens
ctggtctcctctttgttttgtt

SEQ ID NO: 296012 - DNA, 18 bp, Homo sapiens
ctggtctcgaactcctga

SEQ ID NO: 296013 - DNA, 21 bp, Homo sapiens
ctggtctcgaactcctggcct

SEQ ID NO: 296014 - DNA, 13 bp, Homo sapiens
ctggtctgtactc

SEQ ID NO: 296015 - DNA, 18 bp, Homo sapiens
ctggtcttatttgtaaag

SEQ ID NO: 296016 - DNA, 17 bp, Homo sapiens
ctggtcttccattttgc

SEQ ID NO: 296017 - DNA, 16 bp, Homo sapiens
ctggtgacagccttgg

SEQ ID NO: 296018 - DNA, 17 bp, Homo sapiens
ctggtgacagccttggg

SEQ ID NO: 296019 - DNA, 14 bp, Homo sapiens
ctggtgacaggcag

SEQ ID NO: 296020 - DNA, 13 bp, Homo sapiens
ctggtgaggaagc

SEQ ID NO: 296021 - DNA, 18 bp, Homo sapiens
ctggtgaggaagctccag

SEQ ID NO: 296022 - DNA, 12 bp, Homo sapiens
ctggtgaggaca

SEQ ID NO: 296023 - DNA, 14 bp, Homo sapiens
ctggtgaggcccag

SEQ ID NO: 296024 - DNA, 16 bp, Homo sapiens
ctggtgaggcccagcc

SEQ ID NO: 296025 - DNA, 19 bp, Homo sapiens
ctggtgaggcccagcctgt

SEQ ID NO: 296026 - DNA, 19 bp, Homo sapiens
ctggtgcactggccccacc

SEQ ID NO: 296027 - DNA, 15 bp, Homo sapiens
ctggtgcatgttctt

SEQ ID NO: 296028 - DNA, 16 bp, Homo sapiens
ctggtgcatgttcttt

SEQ ID NO: 296029 - DNA, 20 bp, Homo sapiens
ctggtgcatgttcttttctg

SEQ ID NO: 296030 - DNA, 16 bp, Homo sapiens
ctggtgcattacagag

SEQ ID NO: 296031 - DNA, 17 bp, Homo sapiens
ctggtgcattacagaga

SEQ ID NO: 296032 - DNA, 18 bp, Homo sapiens
ctggtgcattacagagag

SEQ ID NO: 296033 - DNA, 14 bp, Homo sapiens
ctggtgcatttaaa

SEQ ID NO: 296034 - DNA, 18 bp, Homo sapiens
ctggtgccaatcctgtag

SEQ ID NO: 296035 - DNA, 17 bp, Homo sapiens
ctggtgccagccttcct

SEQ ID NO: 296036 - DNA, 12 bp, Homo sapiens
ctggtgccccac

SEQ ID NO: 296037 - DNA, 14 bp, Homo sapiens
ctggtgccccacag

SEQ ID NO: 296038 - DNA, 18 bp, Homo sapiens
ctggtgccccacagctac

SEQ ID NO: 296039 - DNA, 19 bp, Homo sapiens
ctggtgccccacagctacc

SEQ ID NO: 296040 - DNA, 16 bp, Homo sapiens
ctggtgcgctgtgctc

SEQ ID NO: 296041 - DNA, 19 bp, Homo sapiens
ctggtgcgctgtgctccag

SEQ ID NO: 296042 - DNA, 18 bp, Homo sapiens
ctggtgcgtgtggccctg

SEQ ID NO: 296043 - DNA, 20 bp, Homo sapiens
ctggtgcgtgtggccctgtg

SEQ ID NO: 296044 - DNA, 22 bp, Homo sapiens
ctggtgcgtgtggccctgtggg

SEQ ID NO: 296045 - DNA, 13 bp, Homo sapiens
ctggtgctgccac

SEQ ID NO: 296046 - DNA, 20 bp, Homo sapiens
ctggtgctgccacacttcag

SEQ ID NO: 296047 - DNA, 22 bp, Homo sapiens
ctggtgctgccacacttcaggc

SEQ ID NO: 296048 - DNA, 18 bp, Homo sapiens
ctggtggatggtgacttt

SEQ ID NO: 296049 - DNA, 22 bp, Homo sapiens
ctggtggcccgacagcctggca

SEQ ID NO: 296050 - DNA, 16 bp, Homo sapiens
ctggtgggcagctgag

SEQ ID NO: 296051 - DNA, 17 bp, Homo sapiens
ctggtgggcagctgagg

SEQ ID NO: 296052 - DNA, 13 bp, Homo sapiens
ctggtggggctga

SEQ ID NO: 296053 - DNA, 19 bp, Homo sapiens
ctggtggggctgagcctga

SEQ ID NO: 296054 - DNA, 15 bp, Homo sapiens
ctggtgggtggagtc

SEQ ID NO: 296055 - DNA, 18 bp, Homo sapiens
ctggtggtgcagccttcc

SEQ ID NO: 296056 - DNA, 21 bp, Homo sapiens
ctggtggtgcagccttcccct

SEQ ID NO: 296057 - DNA, 17 bp, Homo sapiens
ctggtggtttttgctct

SEQ ID NO: 296058 - DNA, 11 bp, Homo sapiens
ctggtgtcccc

SEQ ID NO: 296059 - DNA, 13 bp, Homo sapiens
ctggtgtctagtt

SEQ ID NO: 296060 - DNA, 22 bp, Homo sapiens
ctggtgttctcaatgcttttct

SEQ ID NO: 296061 - DNA, 14 bp, Homo sapiens
ctggttactcagct

SEQ ID NO: 296062 - DNA, 14 bp, Homo sapiens
ctggttagctcagc

SEQ ID NO: 296063 - DNA, 16 bp, Homo sapiens
ctggttagctcagccc

SEQ ID NO: 296064 - DNA, 20 bp, Homo sapiens
ctggttagctcagccccagc

SEQ ID NO: 296065 - DNA, 21 bp, Homo sapiens
ctggttagctcagccccagcc

SEQ ID NO: 296066 - DNA, 22 bp, Homo sapiens
ctggttcactctaattggtcat

SEQ ID NO: 296067 - DNA, 15 bp, Homo sapiens
ctggttccactcagc

SEQ ID NO: 296068 - DNA, 15 bp, Homo sapiens
ctggttcccccagga

SEQ ID NO: 296069 - DNA, 23 bp, Homo sapiens
ctggttcccccaggaccctgagg

SEQ ID NO: 296070 - DNA, 21 bp, Homo sapiens
ctggttccctctttcctgtgc

SEQ ID NO: 296071 - DNA, 22 bp, Homo sapiens
ctggttccctctttcctgtgcc

SEQ ID NO: 296072 - DNA, 19 bp, Homo sapiens
ctggttctccatccccatg

SEQ ID NO: 296073 - DNA, 20 bp, Homo sapiens
ctggttctccatccccatgt

SEQ ID NO: 296074 - DNA, 17 bp, Homo sapiens
ctggttcttgccttccc

SEQ ID NO: 296075 - DNA, 20 bp, Homo sapiens
ctggttcttgccttcccctt

SEQ ID NO: 296076 - DNA, 13 bp, Homo sapiens
ctggttggaggcc

SEQ ID NO: 296077 - DNA, 13 bp, Homo sapiens
ctggttgtatttc

SEQ ID NO: 296078 - DNA, 14 bp, Homo sapiens
ctggttgtcatttt

SEQ ID NO: 296079 - DNA, 22 bp, Homo sapiens
ctggttgttgccaggttgcagc

SEQ ID NO: 296080 - DNA, 17 bp, Homo sapiens
ctggtttcactggccca

SEQ ID NO: 296081 - DNA, 12 bp, Homo sapiens
ctggtttctgag

SEQ ID NO: 296082 - DNA, 16 bp, Homo sapiens
ctggtttggggcgagg

SEQ ID NO: 296083 - DNA, 17 bp, Homo sapiens
ctggtttgtatgatgta

SEQ ID NO: 296084 - DNA, 18 bp, Homo sapiens
ctggttttaccccagctc

SEQ ID NO: 296085 - DNA, 19 bp, Homo sapiens
ctggttttaccccagctcc

SEQ ID NO: 296086 - DNA, 16 bp, Homo sapiens
ctggttttggtttcca

SEQ ID NO: 296087 - DNA, 18 bp, Homo sapiens
ctgtaaaaaagaaaaaca

SEQ ID NO: 296088 - DNA, 13 bp, Homo sapiens
ctgtaaaacttta

SEQ ID NO: 296089 - DNA, 20 bp, Homo sapiens
ctgtaaaactttattttata

SEQ ID NO: 296090 - DNA, 19 bp, Homo sapiens
ctgtaaaatgggtatattg

SEQ ID NO: 296091 - DNA, 19 bp, Homo sapiens
ctgtaaactcaaaacttaa

SEQ ID NO: 296092 - DNA, 21 bp, Homo sapiens
ctgtaaagttgaggggagagg

SEQ ID NO: 296093 - DNA, 16 bp, Homo sapiens
ctgtaaataaaaatag

SEQ ID NO: 296094 - DNA, 17 bp, Homo sapiens
ctgtaaataaaaatagc

SEQ ID NO: 296095 - DNA, 17 bp, Homo sapiens
ctgtaaatacatgtgtg

SEQ ID NO: 296096 - DNA, 18 bp, Homo sapiens
ctgtaaatacatgtgtgg

SEQ ID NO: 296097 - DNA, 15 bp, Homo sapiens
ctgtaaatatcccag

SEQ ID NO: 296098 - DNA, 22 bp, Homo sapiens
ctgtaaatatcccagagaacaa

SEQ ID NO: 296099 - DNA, 16 bp, Homo sapiens
ctgtaaattattttaa

SEQ ID NO: 296100 - DNA, 22 bp, Homo sapiens
ctgtaaattattttaaattata

SEQ ID NO: 296101 - DNA, 19 bp, Homo sapiens
ctgtaaatttaactgcata

SEQ ID NO: 296102 - DNA, 20 bp, Homo sapiens
ctgtaaatttaactgcatat

SEQ ID NO: 296103 - DNA, 16 bp, Homo sapiens
ctgtaacatatatgaa

SEQ ID NO: 296104 - DNA, 17 bp, Homo sapiens
ctgtaacatatatgaaa

SEQ ID NO: 296105 - DNA, 21 bp, Homo sapiens
ctgtaacatcactatccatgc

SEQ ID NO: 296106 - DNA, 19 bp, Homo sapiens
ctgtaaccacctctctgtc

SEQ ID NO: 296107 - DNA, 17 bp, Homo sapiens
ctgtaactgccctttta

SEQ ID NO: 296108 - DNA, 16 bp, Homo sapiens
ctgtaactgctgagcc

SEQ ID NO: 296109 - DNA, 19 bp, Homo sapiens
ctgtaactgctgagccact

SEQ ID NO: 296110 - DNA, 12 bp, Homo sapiens
ctgtaactgtcc

SEQ ID NO: 296111 - DNA, 17 bp, Homo sapiens
ctgtaagaagagactgg

SEQ ID NO: 296112 - DNA, 23 bp, Homo sapiens
ctgtaagaagagactgggaagat

SEQ ID NO: 296113 - DNA, 16 bp, Homo sapiens
ctgtaagacggccttg

SEQ ID NO: 296114 - DNA, 13 bp, Homo sapiens
ctgtaagatgttg

SEQ ID NO: 296115 - DNA, 17 bp, Homo sapiens
ctgtaagcacctgggct

SEQ ID NO: 296116 - DNA, 23 bp, Homo sapiens
ctgtaagcacctgggctgaggag

SEQ ID NO: 296117 - DNA, 13 bp, Homo sapiens
ctgtaatatcttt

SEQ ID NO: 296118 - DNA, 20 bp, Homo sapiens
ctgtaatcccagcactttgg

SEQ ID NO: 296119 - DNA, 14 bp, Homo sapiens
ctgtaatcccagct

SEQ ID NO: 296120 - DNA, 18 bp, Homo sapiens
ctgtaatcccagctactt

SEQ ID NO: 296121 - DNA, 15 bp, Homo sapiens
ctgtaatttaattcc

SEQ ID NO: 296122 - DNA, 14 bp, Homo sapiens
ctgtaattttgtag

SEQ ID NO: 296123 - DNA, 19 bp, Homo sapiens
ctgtaattttgtagtagtt

SEQ ID NO: 296124 - DNA, 12 bp, Homo sapiens
ctgtacacaccc

SEQ ID NO: 296125 - DNA, 13 bp, Homo sapiens
ctgtacatacatt

SEQ ID NO: 296126 - DNA, 18 bp, Homo sapiens
ctgtacatacattgtata

SEQ ID NO: 296127 - DNA, 20 bp, Homo sapiens
ctgtaccaagccccttggcc

SEQ ID NO: 296128 - DNA, 15 bp, Homo sapiens
ctgtaccatccatgg

SEQ ID NO: 296129 - DNA, 14 bp, Homo sapiens
ctgtacccagccac

SEQ ID NO: 296130 - DNA, 16 bp, Homo sapiens
ctgtacccagccacct

SEQ ID NO: 296131 - DNA, 17 bp, Homo sapiens
ctgtacccagccacctt

SEQ ID NO: 296132 - DNA, 20 bp, Homo sapiens
ctgtacccagccaccttcct

SEQ ID NO: 296133 - DNA, 21 bp, Homo sapiens
ctgtacccagccaccttcctg

SEQ ID NO: 296134 - DNA, 13 bp, Homo sapiens
ctgtacccagctc

SEQ ID NO: 296135 - DNA, 14 bp, Homo sapiens
ctgtacccagctcc

SEQ ID NO: 296136 - DNA, 21 bp, Homo sapiens
ctgtacccttccacctcctag

SEQ ID NO: 296137 - DNA, 14 bp, Homo sapiens
ctgtacctctctct

SEQ ID NO: 296138 - DNA, 17 bp, Homo sapiens
ctgtacctctctctgct

SEQ ID NO: 296139 - DNA, 18 bp, Homo sapiens
ctgtacctgtaggaaaca

SEQ ID NO: 296140 - DNA, 23 bp, Homo sapiens
ctgtacctttctgacaataaata

SEQ ID NO: 296141 - DNA, 16 bp, Homo sapiens
ctgtactcagagcaga

SEQ ID NO: 296142 - DNA, 15 bp, Homo sapiens
ctgtactcctcccag

SEQ ID NO: 296143 - DNA, 21 bp, Homo sapiens
ctgtactccttggatttgcat

SEQ ID NO: 296144 - DNA, 15 bp, Homo sapiens
ctgtactggccagtg

SEQ ID NO: 296145 - DNA, 22 bp, Homo sapiens
ctgtactggccagtgtcatttt

SEQ ID NO: 296146 - DNA, 21 bp, Homo sapiens
ctgtagaaaggttgattctca

SEQ ID NO: 296147 - DNA, 22 bp, Homo sapiens
ctgtagacctagggaggacctt

SEQ ID NO: 296148 - DNA, 21 bp, Homo sapiens
ctgtagacttactttcctatt

SEQ ID NO: 296149 - DNA, 23 bp, Homo sapiens
ctgtagacttctggttgtatttc

SEQ ID NO: 296150 - DNA, 13 bp, Homo sapiens
ctgtagagacttc

SEQ ID NO: 296151 - DNA, 19 bp, Homo sapiens
ctgtagaggagcctggagt

SEQ ID NO: 296152 - DNA, 19 bp, Homo sapiens
ctgtagagttggaactgca

SEQ ID NO: 296153 - DNA, 20 bp, Homo sapiens
ctgtagccatggctcaggca

SEQ ID NO: 296154 - DNA, 21 bp, Homo sapiens
ctgtagccatggctcaggcaa

SEQ ID NO: 296155 - DNA, 23 bp, Homo sapiens
ctgtagccatggctcaggcaagc

SEQ ID NO: 296156 - DNA, 24 bp, Homo sapiens
ctgtagccatggctcaggcaagcc

SEQ ID NO: 296157 - DNA, 20 bp, Homo sapiens
ctgtagcctgcgtcatggct

SEQ ID NO: 296158 - DNA, 18 bp, Homo sapiens
ctgtagccttagtgtcac

SEQ ID NO: 296159 - DNA, 23 bp, Homo sapiens
ctgtagctccctcctcccatctc

SEQ ID NO: 296160 - DNA, 22 bp, Homo sapiens
ctgtagctgatgaaactcctga

SEQ ID NO: 296161 - DNA, 24 bp, Homo sapiens
ctgtgcagcagcccagcttcctgg

SEQ ID NO: 296162 - DNA, 15 bp, Homo sapiens
ctgtgcaggtgctgc

SEQ ID NO: 296163 - DNA, 15 bp, Homo sapiens
ctgtgcataaaagtt

SEQ ID NO: 296164 - DNA, 20 bp, Homo sapiens
ctgtgcatgggtgaagggag

SEQ ID NO: 296165 - DNA, 22 bp, Homo sapiens
ctgtgcatgggtgaagggagag

SEQ ID NO: 296166 - DNA, 17 bp, Homo sapiens
ctgtgcatttgtgtctg

SEQ ID NO: 296167 - DNA, 18 bp, Homo sapiens
ctgtgccaaagcaggtca

SEQ ID NO: 296168 - DNA, 14 bp, Homo sapiens
ctgtgccaagggca

SEQ ID NO: 296169 - DNA, 16 bp, Homo sapiens
ctgtgccaccacccct

SEQ ID NO: 296170 - DNA, 17 bp, Homo sapiens
ctgtgccaccacccctc

SEQ ID NO: 296171 - DNA, 18 bp, Homo sapiens
ctgtgccaccacccctcc

SEQ ID NO: 296172 - DNA, 21 bp, Homo sapiens
ctgtgccaccacccctccctc

SEQ ID NO: 296173 - DNA, 18 bp, Homo sapiens
ctgtgccaggactgtgac

SEQ ID NO: 296174 - DNA, 20 bp, Homo sapiens
ctgtgccaggactgtgactc

SEQ ID NO: 296175 - DNA, 21 bp, Homo sapiens
ctgtgccaggactgtgactca

SEQ ID NO: 296176 - DNA, 23 bp, Homo sapiens
ctgtgccaggactgtgactcatt

SEQ ID NO: 296177 - DNA, 22 bp, Homo sapiens
ctgtgccatggatgattctttt

SEQ ID NO: 296178 - DNA, 22 bp, Homo sapiens
ctgtgcccacatcccaggcttc

SEQ ID NO: 296179 - DNA, 15 bp, Homo sapiens
ctgtgcccacccagg

SEQ ID NO: 296180 - DNA, 20 bp, Homo sapiens
ctgtgcccacccagggcccg

SEQ ID NO: 296181 - DNA, 20 bp, Homo sapiens
ctgtgccccatcagcagctt

SEQ ID NO: 296182 - DNA, 17 bp, Homo sapiens
ctgtgccccatgcctgt

SEQ ID NO: 296183 - DNA, 21 bp, Homo sapiens
ctgtgccccatgcctgtccag

SEQ ID NO: 296184 - DNA, 16 bp, Homo sapiens
ctgtgcccttgctggg

SEQ ID NO: 296185 - DNA, 13 bp, Homo sapiens
ctgtgcctaataa

SEQ ID NO: 296186 - DNA, 20 bp, Homo sapiens
ctgtgcctcccaagctcaga

SEQ ID NO: 296187 - DNA, 17 bp, Homo sapiens
ctgtgcctgagaattta

SEQ ID NO: 296188 - DNA, 12 bp, Homo sapiens
ctgtgcctgcta

SEQ ID NO: 296189 - DNA, 14 bp, Homo sapiens
ctgtgcctgctaga

SEQ ID NO: 296190 - DNA, 11 bp, Homo sapiens
ctgtgcctttg

SEQ ID NO: 296191 - DNA, 18 bp, Homo sapiens
ctgtgcctttgggaggca

SEQ ID NO: 296192 - DNA, 14 bp, Homo sapiens
ctgtgcgttccctt

SEQ ID NO: 296193 - DNA, 18 bp, Homo sapiens
ctgtgcgttcccttcagt

SEQ ID NO: 296194 - DNA, 14 bp, Homo sapiens
ctgtgcgttttaga

SEQ ID NO: 296195 - DNA, 18 bp, Homo sapiens
ctgtgctaagttgtctta

SEQ ID NO: 296196 - DNA, 13 bp, Homo sapiens
ctgtgctacctct

SEQ ID NO: 296197 - DNA, 16 bp, Homo sapiens
ctgtgctatgaatttt

SEQ ID NO: 296198 - DNA, 21 bp, Homo sapiens
ctgtgctccagcagtgctggg

SEQ ID NO: 296199 - DNA, 22 bp, Homo sapiens
ctgtgctccagcagtgctgggc

SEQ ID NO: 296200 - DNA, 15 bp, Homo sapiens
ctgtgctccctcggt

SEQ ID NO: 296201 - DNA, 12 bp, Homo sapiens
ctgtgctctgaa

SEQ ID NO: 296202 - DNA, 18 bp, Homo sapiens
ctgtgctctggggatttc

SEQ ID NO: 296203 - DNA, 22 bp, Homo sapiens
ctgtgctctggggatttctggg

SEQ ID NO: 296204 - DNA, 23 bp, Homo sapiens
ctgtgctctggggatttctggga

SEQ ID NO: 296205 - DNA, 18 bp, Homo sapiens
ctgtgctctttgaagaga

SEQ ID NO: 296206 - DNA, 21 bp, Homo sapiens
ctgtgctcttttggtggggag

SEQ ID NO: 296207 - DNA, 15 bp, Homo sapiens
ctgtgctgaggactc

SEQ ID NO: 296208 - DNA, 19 bp, Homo sapiens
ctgtgctgcatgcgacagc

SEQ ID NO: 296209 - DNA, 13 bp, Homo sapiens
ctgtgctgctgca

SEQ ID NO: 296210 - DNA, 19 bp, Homo sapiens
ctgtgctgctgttactgtt

SEQ ID NO: 296211 - DNA, 19 bp, Homo sapiens
ctgtgctgggccagtggct

SEQ ID NO: 296212 - DNA, 22 bp, Homo sapiens
ctgtgctgggccagtggctggg

SEQ ID NO: 296213 - DNA, 15 bp, Homo sapiens
ctgtgctgtgcctgc

SEQ ID NO: 296214 - DNA, 17 bp, Homo sapiens
ctgtgctgtgcctgcta

SEQ ID NO: 296215 - DNA, 18 bp, Homo sapiens
ctgtgctgtgcctgctag

SEQ ID NO: 296216 - DNA, 21 bp, Homo sapiens
ctgtgctgtgcctgctagagc

SEQ ID NO: 296217 - DNA, 18 bp, Homo sapiens
ctgtgcttcaattaataa

SEQ ID NO: 296218 - DNA, 14 bp, Homo sapiens
ctgtgctttctgca

SEQ ID NO: 296219 - DNA, 15 bp, Homo sapiens
ctgtgctttctgcat

SEQ ID NO: 296220 - DNA, 15 bp, Homo sapiens
ctgtggaacactaaa

SEQ ID NO: 296221 - DNA, 13 bp, Homo sapiens
ctgtggaagggac

SEQ ID NO: 296222 - DNA, 14 bp, Homo sapiens
ctgtggaagggact

SEQ ID NO: 296223 - DNA, 16 bp, Homo sapiens
ctgtggaagggactag

SEQ ID NO: 296224 - DNA, 13 bp, Homo sapiens
ctgtggacactgt

SEQ ID NO: 296225 - DNA, 19 bp, Homo sapiens
ctgtggacactgtggaaag

SEQ ID NO: 296226 - DNA, 16 bp, Homo sapiens
ctgtggagagtgagaa

SEQ ID NO: 296227 - DNA, 15 bp, Homo sapiens
ctgtggagcaaaagg

SEQ ID NO: 296228 - DNA, 22 bp, Homo sapiens
ctgtggagcaaaaggcagctca

SEQ ID NO: 296229 - DNA, 22 bp, Homo sapiens
ctgtggagcccgcacccccacc

SEQ ID NO: 296230 - DNA, 23 bp, Homo sapiens
ctgtggagcccgcacccccaccc

SEQ ID NO: 296231 - DNA, 12 bp, Homo sapiens
ctgtggaggcct

SEQ ID NO: 296232 - DNA, 16 bp, Homo sapiens
ctgtggaggcctgatg

SEQ ID NO: 296233 - DNA, 17 bp, Homo sapiens
ctgtggaggcctgatgc

SEQ ID NO: 296234 - DNA, 17 bp, Homo sapiens
ctgtggataaaacatta

SEQ ID NO: 296235 - DNA, 21 bp, Homo sapiens
ctgtggataaaacattagaag

SEQ ID NO: 296236 - DNA, 21 bp, Homo sapiens
ctgtggattcagcttctgttg

SEQ ID NO: 296237 - DNA, 23 bp, Homo sapiens
ctgtggcacagacttctggaagg

SEQ ID NO: 296238 - DNA, 19 bp, Homo sapiens
ctgtggcagaaaagaggag

SEQ ID NO: 296239 - DNA, 17 bp, Homo sapiens
ctgtggcatctttgcct

SEQ ID NO: 296240 - DNA, 14 bp, Homo sapiens
ctgtggccagagca

SEQ ID NO: 296241 - DNA, 17 bp, Homo sapiens
ctgtggccagagcacct

SEQ ID NO: 296242 - DNA, 21 bp, Homo sapiens
ctgtggccagagcacctcagg

SEQ ID NO: 296243 - DNA, 22 bp, Homo sapiens
ctgtggccagagcacctcagga

SEQ ID NO: 296244 - DNA, 22 bp, Homo sapiens
ctgtggccagcttgttatttat

SEQ ID NO: 296245 - DNA, 23 bp, Homo sapiens
ctgtggccagcttgttatttata

SEQ ID NO: 296246 - DNA, 16 bp, Homo sapiens
ctgtggcccctccttc

SEQ ID NO: 296247 - DNA, 19 bp, Homo sapiens
ctgtggccgtctcctccct

SEQ ID NO: 296248 - DNA, 12 bp, Homo sapiens
ctgtggcctcag

SEQ ID NO: 296249 - DNA, 13 bp, Homo sapiens
ctgtggcctcagg

SEQ ID NO: 296250 - DNA, 14 bp, Homo sapiens
ctgtggcctcagga

SEQ ID NO: 296251 - DNA, 17 bp, Homo sapiens
ctgtggccttgcccgcc

SEQ ID NO: 296252 - DNA, 13 bp, Homo sapiens
ctgtggccttgtt

SEQ ID NO: 296253 - DNA, 21 bp, Homo sapiens
ctgtggcgatatgagagggat

SEQ ID NO: 296254 - DNA, 11 bp, Homo sapiens
ctgtggctggg

SEQ ID NO: 296255 - DNA, 18 bp, Homo sapiens
ctgtggctgggtggtcag

SEQ ID NO: 296256 - DNA, 15 bp, Homo sapiens
ctgtggcttctccgt

SEQ ID NO: 296257 - DNA, 23 bp, Homo sapiens
ctgtgggactggcccacccctct

SEQ ID NO: 296258 - DNA, 14 bp, Homo sapiens
ctgtgggagagcaa

SEQ ID NO: 296259 - DNA, 17 bp, Homo sapiens
ctgtgggagagcaactg

SEQ ID NO: 296260 - DNA, 20 bp, Homo sapiens
ctgtgggagtccactttcct

SEQ ID NO: 296261 - DNA, 22 bp, Homo sapiens
ctgtgggagtccactttcctct

SEQ ID NO: 296262 - DNA, 19 bp, Homo sapiens
ctgtgggcctcaaggactt

SEQ ID NO: 296263 - DNA, 17 bp, Homo sapiens
ctgtgggcttggccttg

SEQ ID NO: 296264 - DNA, 19 bp, Homo sapiens
ctgtggggatttctcccag

SEQ ID NO: 296265 - DNA, 21 bp, Homo sapiens
ctgtggggatttctcccagct

SEQ ID NO: 296266 - DNA, 16 bp, Homo sapiens
ctgtggggcccccaca

SEQ ID NO: 296267 - DNA, 23 bp, Homo sapiens
ctgtggggtgtgcacatctctgc

SEQ ID NO: 296268 - DNA, 21 bp, Homo sapiens
ctgtgggtggggaaggaaggc

SEQ ID NO: 296269 - DNA, 12 bp, Homo sapiens
ctgtggtaccct

SEQ ID NO: 296270 - DNA, 15 bp, Homo sapiens
ctgtggtaccctggc

SEQ ID NO: 296271 - DNA, 22 bp, Homo sapiens
ctgtggtaccctggcagagaag

SEQ ID NO: 296272 - DNA, 24 bp, Homo sapiens
ctgtggtaccctggcagagaagag

SEQ ID NO: 296273 - DNA, 13 bp, Homo sapiens
ctgtggtgacagg

SEQ ID NO: 296274 - DNA, 19 bp, Homo sapiens
ctgtggtgatgtgcctgta

SEQ ID NO: 296275 - DNA, 20 bp, Homo sapiens
ctgtggtgggaacattcgag

SEQ ID NO: 296276 - DNA, 18 bp, Homo sapiens
ctgtggtgtctcgtggcc

SEQ ID NO: 296277 - DNA, 17 bp, Homo sapiens
ctgtggttacagtgcag

SEQ ID NO: 296278 - DNA, 21 bp, Homo sapiens
ctgtggttcctggggtgccct

SEQ ID NO: 296279 - DNA, 15 bp, Homo sapiens
ctgtggttgcagcct

SEQ ID NO: 296280 - DNA, 21 bp, Homo sapiens
ctgtggttttcccctccctgg

SEQ ID NO: 296281 - DNA, 12 bp, Homo sapiens
ctgtgtaaccag

SEQ ID NO: 296282 - DNA, 11 bp, Homo sapiens
ctgtgtaactg

SEQ ID NO: 296283 - DNA, 18 bp, Homo sapiens
ctgtgtagagcctgcatc

SEQ ID NO: 296284 - DNA, 19 bp, Homo sapiens
ctgtgtatttctgtagaat

SEQ ID NO: 296285 - DNA, 12 bp, Homo sapiens
ctgtgtcatctg

SEQ ID NO: 296286 - DNA, 16 bp, Homo sapiens
ctgtgtcatctgtcag

SEQ ID NO: 296287 - DNA, 19 bp, Homo sapiens
ctgtgtcatggtgatgcaa

SEQ ID NO: 296288 - DNA, 14 bp, Homo sapiens
ctgtgtccagagac

SEQ ID NO: 296289 - DNA, 19 bp, Homo sapiens
ctgtgtccagagacatggg

SEQ ID NO: 296290 - DNA, 12 bp, Homo sapiens
cttactttgtgc

SEQ ID NO: 296291 - DNA, 19 bp, Homo sapiens
cttagaaatcattgtagaa

SEQ ID NO: 296292 - DNA, 18 bp, Homo sapiens
cttagaacagatggctgt

SEQ ID NO: 296293 - DNA, 15 bp, Homo sapiens
cttagaacctttctt

SEQ ID NO: 296294 - DNA, 16 bp, Homo sapiens
cttagactccttctcc

SEQ ID NO: 296295 - DNA, 19 bp, Homo sapiens
cttagactccttctcccca

SEQ ID NO: 296296 - DNA, 16 bp, Homo sapiens
cttagagagagagaga

SEQ ID NO: 296297 - DNA, 17 bp, Homo sapiens
cttagagagagagagag

SEQ ID NO: 296298 - DNA, 20 bp, Homo sapiens
cttagagattgccccagagc

SEQ ID NO: 296299 - DNA, 20 bp, Homo sapiens
cttagatctgagccctccct

SEQ ID NO: 296300 - DNA, 18 bp, Homo sapiens
cttagcaaggggctcaga

SEQ ID NO: 296301 - DNA, 16 bp, Homo sapiens
cttagcagctcaggcg

SEQ ID NO: 296302 - DNA, 17 bp, Homo sapiens
cttagccgtccatggca

SEQ ID NO: 296303 - DNA, 18 bp, Homo sapiens
cttagccgtccatggcac

SEQ ID NO: 296304 - DNA, 12 bp, Homo sapiens
cttagcctctcc

SEQ ID NO: 296305 - DNA, 15 bp, Homo sapiens
cttagcctctcccac

SEQ ID NO: 296306 - DNA, 14 bp, Homo sapiens
cttagccttgctgt

SEQ ID NO: 296307 - DNA, 17 bp, Homo sapiens
cttagccttgtgccctg

SEQ ID NO: 296308 - DNA, 14 bp, Homo sapiens
cttagctgccaagt

SEQ ID NO: 296309 - DNA, 13 bp, Homo sapiens
cttagcttttctg

SEQ ID NO: 296310 - DNA, 15 bp, Homo sapiens
cttagcttttctgca

SEQ ID NO: 296311 - DNA, 14 bp, Homo sapiens
cttaggagatgtca

SEQ ID NO: 296312 - DNA, 18 bp, Homo sapiens
cttaggtgccaggctgta

SEQ ID NO: 296313 - DNA, 16 bp, Homo sapiens
cttagtcctccctgct

SEQ ID NO: 296314 - DNA, 21 bp, Homo sapiens
cttagtcctccctgctcagct

SEQ ID NO: 296315 - DNA, 23 bp, Homo sapiens
cttagtcgaatgttagattcctc

SEQ ID NO: 296316 - DNA, 15 bp, Homo sapiens
cttagtcttctcata

SEQ ID NO: 296317 - DNA, 20 bp, Homo sapiens
cttagtcttctcatagcatt

SEQ ID NO: 296318 - DNA, 21 bp, Homo sapiens
cttagtcttctcatagcatta

SEQ ID NO: 296319 - DNA, 15 bp, Homo sapiens
cttagtggtatgtct

SEQ ID NO: 296320 - DNA, 20 bp, Homo sapiens
cttagtgtcacctttcttct

SEQ ID NO: 296321 - DNA, 19 bp, Homo sapiens
cttagtgtttagcattaaa

SEQ ID NO: 296322 - DNA, 15 bp, Homo sapiens
cttagttctcactgt

SEQ ID NO: 296323 - DNA, 16 bp, Homo sapiens
cttagttctcactgtt

SEQ ID NO: 296324 - DNA, 14 bp, Homo sapiens
cttagtttttaaaa

SEQ ID NO: 296325 - DNA, 16 bp, Homo sapiens
cttagtttttaaaaag

SEQ ID NO: 296326 - DNA, 20 bp, Homo sapiens
cttataaacacattgaatgc

SEQ ID NO: 296327 - DNA, 18 bp, Homo sapiens
cttataaatcatattgat

SEQ ID NO: 296328 - DNA, 14 bp, Homo sapiens
cttataagaaaaca

SEQ ID NO: 296329 - DNA, 15 bp, Homo sapiens
cttataagcaacatg

SEQ ID NO: 296330 - DNA, 15 bp, Homo sapiens
cttatacatttgata

SEQ ID NO: 296331 - DNA, 13 bp, Homo sapiens
cttataccaaagg

SEQ ID NO: 296332 - DNA, 23 bp, Homo sapiens
cttatattcatctattttctcag

SEQ ID NO: 296333 - DNA, 13 bp, Homo sapiens
cttatcaaatcat

SEQ ID NO: 296334 - DNA, 15 bp, Homo sapiens
cttatcaaatcattc

SEQ ID NO: 296335 - DNA, 16 bp, Homo sapiens
cttatcaagtgtcttc

SEQ ID NO: 296336 - DNA, 18 bp, Homo sapiens
cttatctccctgcttcat

SEQ ID NO: 296337 - DNA, 16 bp, Homo sapiens
cttatctgaaacttcc

SEQ ID NO: 296338 - DNA, 20 bp, Homo sapiens
cttatctgaaacttcccaac

SEQ ID NO: 296339 - DNA, 19 bp, Homo sapiens
cttatctgtgcgtgaaaca

SEQ ID NO: 296340 - DNA, 12 bp, Homo sapiens
cttatgaaatgg

SEQ ID NO: 296341 - DNA, 15 bp, Homo sapiens
cttatgagaacatgg

SEQ ID NO: 296342 - DNA, 22 bp, Homo sapiens
cttatgatacttgaggtaccag

SEQ ID NO: 296343 - DNA, 23 bp, Homo sapiens
cttatgatattctcattatttca

SEQ ID NO: 296344 - DNA, 15 bp, Homo sapiens
cttatgattgcagat

SEQ ID NO: 296345 - DNA, 14 bp, Homo sapiens
cttatgctgctgtg

SEQ ID NO: 296346 - DNA, 18 bp, Homo sapiens
cttatgggatccttgtct

SEQ ID NO: 296347 - DNA, 21 bp, Homo sapiens
cttatgttgatcgatgttaaa

SEQ ID NO: 296348 - DNA, 19 bp, Homo sapiens
cttattaatgctaagggca

SEQ ID NO: 296349 - DNA, 15 bp, Homo sapiens
cttattactattatt

SEQ ID NO: 296350 - DNA, 23 bp, Homo sapiens
cttattcatgctttctccttttt

SEQ ID NO: 296351 - DNA, 13 bp, Homo sapiens
cttattctttaca

SEQ ID NO: 296352 - DNA, 20 bp, Homo sapiens
cttattgattaagtatatct

SEQ ID NO: 296353 - DNA, 13 bp, Homo sapiens
cttattggccact

SEQ ID NO: 296354 - DNA, 16 bp, Homo sapiens
cttattgggagtagga

SEQ ID NO: 296355 - DNA, 15 bp, Homo sapiens
cttattgtacctctc

SEQ ID NO: 296356 - DNA, 14 bp, Homo sapiens
cttattgttccaag

SEQ ID NO: 296357 - DNA, 18 bp, Homo sapiens
cttatttagtattctgcc

SEQ ID NO: 296358 - DNA, 13 bp, Homo sapiens
cttatttatatat

SEQ ID NO: 296359 - DNA, 14 bp, Homo sapiens
cttatttatatatg

SEQ ID NO: 296360 - DNA, 20 bp, Homo sapiens
cttatttcccctttccaatt

SEQ ID NO: 296361 - DNA, 16 bp, Homo sapiens
cttatttctaactatt

SEQ ID NO: 296362 - DNA, 23 bp, Homo sapiens
cttatttgtcggggaagatgaaa

SEQ ID NO: 296363 - DNA, 22 bp, Homo sapiens
cttatttttatttatttttgta

SEQ ID NO: 296364 - DNA, 15 bp, Homo sapiens
cttcaaaacagaacg

SEQ ID NO: 296365 - DNA, 14 bp, Homo sapiens
cttcaaaatcagtg

SEQ ID NO: 296366 - DNA, 22 bp, Homo sapiens
cttcaaacagaactgcagtcag

SEQ ID NO: 296367 - DNA, 16 bp, Homo sapiens
cttcaaacgaaatggc

SEQ ID NO: 296368 - DNA, 18 bp, Homo sapiens
cttcaaatccttccaaaa

SEQ ID NO: 296369 - DNA, 22 bp, Homo sapiens
cttcaacatcaatgttcattgt

SEQ ID NO: 296370 - DNA, 20 bp, Homo sapiens
cttcaaccattccccatggg

SEQ ID NO: 296371 - DNA, 15 bp, Homo sapiens
cttcaaccctgccct

SEQ ID NO: 296372 - DNA, 19 bp, Homo sapiens
cttcaaccctgccctgcac

SEQ ID NO: 296373 - DNA, 22 bp, Homo sapiens
cttcaaccctgccctgcacctt

SEQ ID NO: 296374 - DNA, 17 bp, Homo sapiens
cttcaaccttgagacag

SEQ ID NO: 296375 - DNA, 17 bp, Homo sapiens
cttcaactgaccagcct

SEQ ID NO: 296376 - DNA, 23 bp, Homo sapiens
cttcaactgaccagcctccatgc

SEQ ID NO: 296377 - DNA, 13 bp, Homo sapiens
cttcaaggccaag

SEQ ID NO: 296378 - DNA, 15 bp, Homo sapiens
cttcaagtctgtgcc

SEQ ID NO: 296379 - DNA, 16 bp, Homo sapiens
cttcaagtctgtgcct

SEQ ID NO: 296380 - DNA, 17 bp, Homo sapiens
cttcaagtctgtgcctg

SEQ ID NO: 296381 - DNA, 18 bp, Homo sapiens
cttcaagtgagtggcatg

SEQ ID NO: 296382 - DNA, 20 bp, Homo sapiens
cttcaagtgttgctcttgga

SEQ ID NO: 296383 - DNA, 18 bp, Homo sapiens
cttcaatcctgtcaatgt

SEQ ID NO: 296384 - DNA, 16 bp, Homo sapiens
cttcaatctacgatgt

SEQ ID NO: 296385 - DNA, 12 bp, Homo sapiens
cttcaatctctg

SEQ ID NO: 296386 - DNA, 21 bp, Homo sapiens
cttcaatctctggaaaaataa

SEQ ID NO: 296387 - DNA, 17 bp, Homo sapiens
cttcaatctctgttctg

SEQ ID NO: 296388 - DNA, 15 bp, Homo sapiens
cttcaattaataaaa

SEQ ID NO: 296389 - DNA, 15 bp, Homo sapiens
cttcacacccctcag

SEQ ID NO: 296390 - DNA, 15 bp, Homo sapiens
cttcacaggcagtgc

SEQ ID NO: 296391 - DNA, 18 bp, Homo sapiens
cttcacaggcagtgcatg

SEQ ID NO: 296392 - DNA, 19 bp, Homo sapiens
cttcacagggacagatctg

SEQ ID NO: 296393 - DNA, 17 bp, Homo sapiens
cttcacatccaccccgg

SEQ ID NO: 296394 - DNA, 14 bp, Homo sapiens
cttcaccaccccct

SEQ ID NO: 296395 - DNA, 19 bp, Homo sapiens
cttcaccaccccctgtccc

SEQ ID NO: 296396 - DNA, 20 bp, Homo sapiens
cttcaccaccccctgtccca

SEQ ID NO: 296397 - DNA, 23 bp, Homo sapiens
cttcaccacctcatgtcatttct

SEQ ID NO: 296398 - DNA, 14 bp, Homo sapiens
cttcaccagtctgt

SEQ ID NO: 296399 - DNA, 20 bp, Homo sapiens
cttcaccagtctgtctactg

SEQ ID NO: 296400 - DNA, 14 bp, Homo sapiens
cttcacccccaact

SEQ ID NO: 296401 - DNA, 20 bp, Homo sapiens
cttcaccccggcaggccctg

SEQ ID NO: 296402 - DNA, 22 bp, Homo sapiens
cttcaccccggcaggccctgca

SEQ ID NO: 296403 - DNA, 23 bp, Homo sapiens
cttcaccccggcaggccctgcag

SEQ ID NO: 296404 - DNA, 11 bp, Homo sapiens
cttcacctcta

SEQ ID NO: 296405 - DNA, 15 bp, Homo sapiens
cttcacctctatcca

SEQ ID NO: 296406 - DNA, 14 bp, Homo sapiens
cttcacgctggctt

SEQ ID NO: 296407 - DNA, 17 bp, Homo sapiens
cttcactcgcccccggg

SEQ ID NO: 296408 - DNA, 14 bp, Homo sapiens
cttcactgccatga

SEQ ID NO: 296409 - DNA, 15 bp, Homo sapiens
cttcactgttgaaaa

SEQ ID NO: 296410 - DNA, 16 bp, Homo sapiens
cttcactgttgaaaat

SEQ ID NO: 296411 - DNA, 16 bp, Homo sapiens
cttcagaaaagacact

SEQ ID NO: 296412 - DNA, 17 bp, Homo sapiens
cttcagaaaagacactt

SEQ ID NO: 296413 - DNA, 23 bp, Homo sapiens
cttcagaattgtttttagaaatt

SEQ ID NO: 296414 - DNA, 20 bp, Homo sapiens
cttcagactctctcctctct

SEQ ID NO: 296415 - DNA, 14 bp, Homo sapiens
cttcagactttgct

SEQ ID NO: 296416 - DNA, 19 bp, Homo sapiens
cttcagactttgcttccca

SEQ ID NO: 296417 - DNA, 15 bp, Homo sapiens
cttcagagagctggt

SEQ ID NO: 296418 - DNA, 16 bp, Homo sapiens
cttcagagagctggta

SEQ ID NO: 296419 - DNA, 21 bp, Homo sapiens
cttcagagctcttcaagctgt

SEQ ID NO: 296420 - DNA, 16 bp, Homo sapiens
cttcagatcctgctgc

SEQ ID NO: 296421 - DNA, 23 bp, Homo sapiens
cttcctgttctgtgtctgctgta

SEQ ID NO: 296422 - DNA, 13 bp, Homo sapiens
cttcctgtttcta

SEQ ID NO: 296423 - DNA, 22 bp, Homo sapiens
cttccttccattgctcccagtg

SEQ ID NO: 296424 - DNA, 17 bp, Homo sapiens
cttccttgaccttcctc

SEQ ID NO: 296425 - DNA, 15 bp, Homo sapiens
cttccttgctctccc

SEQ ID NO: 296426 - DNA, 21 bp, Homo sapiens
cttccttttagcctagttcat

SEQ ID NO: 296427 - DNA, 18 bp, Homo sapiens
cttccttttttctttctt

SEQ ID NO: 296428 - DNA, 21 bp, Homo sapiens
cttccttttttctttctttac

SEQ ID NO: 296429 - DNA, 21 bp, Homo sapiens
cttcgaaaacagatgagaaga

SEQ ID NO: 296430 - DNA, 18 bp, Homo sapiens
cttcgaccctttctctga

SEQ ID NO: 296431 - DNA, 14 bp, Homo sapiens
cttcgactcaggat

SEQ ID NO: 296432 - DNA, 15 bp, Homo sapiens
cttcgactcaggatc

SEQ ID NO: 296433 - DNA, 16 bp, Homo sapiens
cttcgactcaggatcc

SEQ ID NO: 296434 - DNA, 17 bp, Homo sapiens
cttcgagggttccaggc

SEQ ID NO: 296435 - DNA, 21 bp, Homo sapiens
cttcgatacaccgggcctgga

SEQ ID NO: 296436 - DNA, 15 bp, Homo sapiens
cttcgcgctggaatc

SEQ ID NO: 296437 - DNA, 18 bp, Homo sapiens
cttcgctattcccaggca

SEQ ID NO: 296438 - DNA, 13 bp, Homo sapiens
cttcgctgctcta

SEQ ID NO: 296439 - DNA, 22 bp, Homo sapiens
cttcggaatccagtgcttccac

SEQ ID NO: 296440 - DNA, 23 bp, Homo sapiens
cttcggaatccagtgcttccaca

SEQ ID NO: 296441 - DNA, 17 bp, Homo sapiens
cttcgggaagagaggag

SEQ ID NO: 296442 - DNA, 18 bp, Homo sapiens
cttcgggaagagaggagt

SEQ ID NO: 296443 - DNA, 14 bp, Homo sapiens
cttcgtacagttct

SEQ ID NO: 296444 - DNA, 15 bp, Homo sapiens
cttcgtgctggagga

SEQ ID NO: 296445 - DNA, 19 bp, Homo sapiens
cttctaaaaaaaaacaaaa

SEQ ID NO: 296446 - DNA, 17 bp, Homo sapiens
cttctaaagaggaagcc

SEQ ID NO: 296447 - DNA, 19 bp, Homo sapiens
cttctaaatcataatcatc

SEQ ID NO: 296448 - DNA, 11 bp, Homo sapiens
cttctaatata

SEQ ID NO: 296449 - DNA, 18 bp, Homo sapiens
cttctaatatatttttat

SEQ ID NO: 296450 - DNA, 16 bp, Homo sapiens
cttctaattgccatgt

SEQ ID NO: 296451 - DNA, 16 bp, Homo sapiens
cttctaattttgtgct

SEQ ID NO: 296452 - DNA, 17 bp, Homo sapiens
cttctaattttgtgctc

SEQ ID NO: 296453 - DNA, 20 bp, Homo sapiens
cttctaattttgtgctcttt

SEQ ID NO: 296454 - DNA, 21 bp, Homo sapiens
cttctaattttgtgctctttc

SEQ ID NO: 296455 - DNA, 18 bp, Homo sapiens
cttctacaaccagagccc

SEQ ID NO: 296456 - DNA, 19 bp, Homo sapiens
cttctacaaccagagcccc

SEQ ID NO: 296457 - DNA, 17 bp, Homo sapiens
cttctacactctcctgg

SEQ ID NO: 296458 - DNA, 18 bp, Homo sapiens
cttctacactctcctggg

SEQ ID NO: 296459 - DNA, 18 bp, Homo sapiens
cttctaccaaatgtgtaa

SEQ ID NO: 296460 - DNA, 15 bp, Homo sapiens
cttctacctgcagga

SEQ ID NO: 296461 - DNA, 18 bp, Homo sapiens
cttctactttttccttcc

SEQ ID NO: 296462 - DNA, 20 bp, Homo sapiens
cttctactttttccttcctg

SEQ ID NO: 296463 - DNA, 15 bp, Homo sapiens
cttctagaattataa

SEQ ID NO: 296464 - DNA, 16 bp, Homo sapiens
cttctagattcactgt

SEQ ID NO: 296465 - DNA, 22 bp, Homo sapiens
cttctaggcatctcctctcccc

SEQ ID NO: 296466 - DNA, 18 bp, Homo sapiens
cttctaggtgtggtccca

SEQ ID NO: 296467 - DNA, 15 bp, Homo sapiens
cttctagttgctctt

SEQ ID NO: 296468 - DNA, 17 bp, Homo sapiens
cttctatattaaggcag

SEQ ID NO: 296469 - DNA, 13 bp, Homo sapiens
cttctatcctgca

SEQ ID NO: 296470 - DNA, 14 bp, Homo sapiens
cttctatcctgcaa

SEQ ID NO: 296471 - DNA, 15 bp, Homo sapiens
cttctatcctgttaa

SEQ ID NO: 296472 - DNA, 15 bp, Homo sapiens
cttctatgtccaaca

SEQ ID NO: 296473 - DNA, 13 bp, Homo sapiens
cttctattttcaa

SEQ ID NO: 296474 - DNA, 21 bp, Homo sapiens
cttctcaaatgctactcagta

SEQ ID NO: 296475 - DNA, 14 bp, Homo sapiens
cttctcaactaaag

SEQ ID NO: 296476 - DNA, 12 bp, Homo sapiens
cttctcaagtgc

SEQ ID NO: 296477 - DNA, 14 bp, Homo sapiens
cttctcaagtgcct

SEQ ID NO: 296478 - DNA, 15 bp, Homo sapiens
cttctcaagtgcctt

SEQ ID NO: 296479 - DNA, 18 bp, Homo sapiens
cttctcaagtgccttaat

SEQ ID NO: 296480 - DNA, 18 bp, Homo sapiens
cttctcacagcacatgct

SEQ ID NO: 296481 - DNA, 19 bp, Homo sapiens
cttctcacagcacatgctg

SEQ ID NO: 296482 - DNA, 15 bp, Homo sapiens
cttctcagctccact

SEQ ID NO: 296483 - DNA, 19 bp, Homo sapiens
cttctcagctccactctga

SEQ ID NO: 296484 - DNA, 17 bp, Homo sapiens
cttctcagctctccacc

SEQ ID NO: 296485 - DNA, 13 bp, Homo sapiens
cttctcatagcat

SEQ ID NO: 296486 - DNA, 14 bp, Homo sapiens
cttctccacctccc

SEQ ID NO: 296487 - DNA, 16 bp, Homo sapiens
cttctccacctccccc

SEQ ID NO: 296488 - DNA, 17 bp, Homo sapiens
cttctccatggccctgc

SEQ ID NO: 296489 - DNA, 13 bp, Homo sapiens
cttctcccacact

SEQ ID NO: 296490 - DNA, 15 bp, Homo sapiens
cttctcccctccaga

SEQ ID NO: 296491 - DNA, 19 bp, Homo sapiens
cttctcccctccagacccc

SEQ ID NO: 296492 - DNA, 16 bp, Homo sapiens
cttctcccctgcactg

SEQ ID NO: 296493 - DNA, 18 bp, Homo sapiens
cttctcccctgcactgta

SEQ ID NO: 296494 - DNA, 23 bp, Homo sapiens
cttctccctcccctcacccgctg

SEQ ID NO: 296495 - DNA, 16 bp, Homo sapiens
cttctcctctctgggc

SEQ ID NO: 296496 - DNA, 14 bp, Homo sapiens
cttctcctttcaca

SEQ ID NO: 296497 - DNA, 17 bp, Homo sapiens
cttctcctttcacaacc

SEQ ID NO: 296498 - DNA, 14 bp, Homo sapiens
cttctcggaggcca

SEQ ID NO: 296499 - DNA, 18 bp, Homo sapiens
cttctcggaggccaggcc

SEQ ID NO: 296500 - DNA, 20 bp, Homo sapiens
cttctctaaatgaggggcct

SEQ ID NO: 296501 - DNA, 17 bp, Homo sapiens
cttctctactcatgcca

SEQ ID NO: 296502 - DNA, 14 bp, Homo sapiens
cttctctcttcaat

SEQ ID NO: 296503 - DNA, 21 bp, Homo sapiens
cttctctcttcaatctctgga

SEQ ID NO: 296504 - DNA, 20 bp, Homo sapiens
cttctctcttgattgatttt

SEQ ID NO: 296505 - DNA, 12 bp, Homo sapiens
cttctctgctcc

SEQ ID NO: 296506 - DNA, 14 bp, Homo sapiens
cttctctgctccac

SEQ ID NO: 296507 - DNA, 15 bp, Homo sapiens
cttctctgctccacc

SEQ ID NO: 296508 - DNA, 16 bp, Homo sapiens
cttctctgctccacca

SEQ ID NO: 296509 - DNA, 17 bp, Homo sapiens
cttctcttgctacctgt

SEQ ID NO: 296510 - DNA, 17 bp, Homo sapiens
cttctcttttcctcgca

SEQ ID NO: 296511 - DNA, 21 bp, Homo sapiens
cttctctttttccagaatttg

SEQ ID NO: 296512 - DNA, 15 bp, Homo sapiens
cttctgaatatttta

SEQ ID NO: 296513 - DNA, 19 bp, Homo sapiens
cttctgaatgctgctactt

SEQ ID NO: 296514 - DNA, 20 bp, Homo sapiens
cttctgaattattctggata

SEQ ID NO: 296515 - DNA, 14 bp, Homo sapiens
cttctgaccacact

SEQ ID NO: 296516 - DNA, 14 bp, Homo sapiens
cttctgaccccact

SEQ ID NO: 296517 - DNA, 14 bp, Homo sapiens
cttctgacctcccc

SEQ ID NO: 296518 - DNA, 14 bp, Homo sapiens
cttctgagtggtgt

SEQ ID NO: 296519 - DNA, 18 bp, Homo sapiens
cttctgcattactattaa

SEQ ID NO: 296520 - DNA, 13 bp, Homo sapiens
cttctgcccaaat

SEQ ID NO: 296521 - DNA, 20 bp, Homo sapiens
cttctgcccaaatcccctcc

SEQ ID NO: 296522 - DNA, 22 bp, Homo sapiens
cttctgcccatcctgtctgttc

SEQ ID NO: 296523 - DNA, 21 bp, Homo sapiens
cttctgcccccgttccagctg

SEQ ID NO: 296524 - DNA, 13 bp, Homo sapiens
cttctgccttttc

SEQ ID NO: 296525 - DNA, 17 bp, Homo sapiens
cttctgcgtttgtccct

SEQ ID NO: 296526 - DNA, 17 bp, Homo sapiens
cttctgctaggtagagg

SEQ ID NO: 296527 - DNA, 10 bp, Homo sapiens
cttctgctcc

SEQ ID NO: 296528 - DNA, 14 bp, Homo sapiens
cttctgctccaccc

SEQ ID NO: 296529 - DNA, 17 bp, Homo sapiens
cttctgctccacccttg

SEQ ID NO: 296530 - DNA, 17 bp, Homo sapiens
cttctgctggataaaat

SEQ ID NO: 296531 - DNA, 19 bp, Homo sapiens
cttctgctggataaaatga

SEQ ID NO: 296532 - DNA, 13 bp, Homo sapiens
cttctgctgtaca

SEQ ID NO: 296533 - DNA, 16 bp, Homo sapiens
cttctgctgtacagat

SEQ ID NO: 296534 - DNA, 18 bp, Homo sapiens
cttctgcttaggagagac

SEQ ID NO: 296535 - DNA, 14 bp, Homo sapiens
cttctggaaggctg

SEQ ID NO: 296536 - DNA, 17 bp, Homo sapiens
cttctggcacttggaga

SEQ ID NO: 296537 - DNA, 22 bp, Homo sapiens
cttctggctttgttcttgtcat

SEQ ID NO: 296538 - DNA, 15 bp, Homo sapiens
cttctgggcagagcc

SEQ ID NO: 296539 - DNA, 19 bp, Homo sapiens
cttctgggcagagcctgtc

SEQ ID NO: 296540 - DNA, 14 bp, Homo sapiens
cttctgggcctgat

SEQ ID NO: 296541 - DNA, 15 bp, Homo sapiens
cttctggtactctcc

SEQ ID NO: 296542 - DNA, 17 bp, Homo sapiens
cttctggtactctccta

SEQ ID NO: 296543 - DNA, 19 bp, Homo sapiens
cttctggtactctcctaga

SEQ ID NO: 296544 - DNA, 20 bp, Homo sapiens
cttctggtactctcctagag

SEQ ID NO: 296545 - DNA, 15 bp, Homo sapiens
cttctggtcccctgt

SEQ ID NO: 296546 - DNA, 17 bp, Homo sapiens
cttctggtcccctgtgg

SEQ ID NO: 296547 - DNA, 18 bp, Homo sapiens
cttctggtcccctgtggt

SEQ ID NO: 296548 - DNA, 15 bp, Homo sapiens
cttctggtgcatgtt

SEQ ID NO: 296549 - DNA, 21 bp, Homo sapiens
cttctgtaacgggtcgtgctc

SEQ ID NO: 296550 - DNA, 18 bp, Homo sapiens
cttctgtagctattcttt

SEQ ID NO: 296551 - DNA, 15 bp, Homo sapiens
cttctgtagtactcc

SEQ ID NO: 296552 - DNA, 12 bp, Homo sapiens
cttgcactgtgc

SEQ ID NO: 296553 - DNA, 15 bp, Homo sapiens
cttgcactgtgcttg

SEQ ID NO: 296554 - DNA, 14 bp, Homo sapiens
cttgcactttgtga

SEQ ID NO: 296555 - DNA, 15 bp, Homo sapiens
cttgcagagaagcct

SEQ ID NO: 296556 - DNA, 20 bp, Homo sapiens
cttgcagagaagccttggta

SEQ ID NO: 296557 - DNA, 19 bp, Homo sapiens
cttgcaggggtcccccctc

SEQ ID NO: 296558 - DNA, 22 bp, Homo sapiens
cttgcagttcagcaccacccta

SEQ ID NO: 296559 - DNA, 22 bp, Homo sapiens
cttgcataataagctaaagagg

SEQ ID NO: 296560 - DNA, 16 bp, Homo sapiens
cttgcatctgggccag

SEQ ID NO: 296561 - DNA, 11 bp, Homo sapiens
cttgcattaga

SEQ ID NO: 296562 - DNA, 15 bp, Homo sapiens
cttgcatttctttat

SEQ ID NO: 296563 - DNA, 16 bp, Homo sapiens
cttgcatttctttatt

SEQ ID NO: 296564 - DNA, 21 bp, Homo sapiens
cttgcatttctttatttctgt

SEQ ID NO: 296565 - DNA, 20 bp, Homo sapiens
cttgcattttagctaattta

SEQ ID NO: 296566 - DNA, 20 bp, Homo sapiens
cttgccaagctttcttctac

SEQ ID NO: 296567 - DNA, 23 bp, Homo sapiens
cttgccaatgaggtctgaaatgg

SEQ ID NO: 296568 - DNA, 23 bp, Homo sapiens
cttgccaccaccagatgagaagt

SEQ ID NO: 296569 - DNA, 17 bp, Homo sapiens
cttgcccagcaaggacc

SEQ ID NO: 296570 - DNA, 21 bp, Homo sapiens
cttgcccagggtgcagtgtga

SEQ ID NO: 296571 - DNA, 14 bp, Homo sapiens
cttgccccagtcct

SEQ ID NO: 296572 - DNA, 15 bp, Homo sapiens
cttgccccagtcctg

SEQ ID NO: 296573 - DNA, 16 bp, Homo sapiens
cttgccccagtcctgg

SEQ ID NO: 296574 - DNA, 14 bp, Homo sapiens
cttgcccccatccc

SEQ ID NO: 296575 - DNA, 15 bp, Homo sapiens
cttgcccccatccct

SEQ ID NO: 296576 - DNA, 18 bp, Homo sapiens
cttgcccccatccctcgg

SEQ ID NO: 296577 - DNA, 16 bp, Homo sapiens
cttgccccccacccca

SEQ ID NO: 296578 - DNA, 19 bp, Homo sapiens
cttgccccccaccccagcc

SEQ ID NO: 296579 - DNA, 14 bp, Homo sapiens
cttgcccgccagcc

SEQ ID NO: 296580 - DNA, 15 bp, Homo sapiens
cttgcccgccagcca

SEQ ID NO: 296581 - DNA, 18 bp, Homo sapiens
cttgcccgccagcctcag

SEQ ID NO: 296582 - DNA, 23 bp, Homo sapiens
cttgcccgccagcctcagtgcca

SEQ ID NO: 296583 - DNA, 14 bp, Homo sapiens
cttgcccgctccca

SEQ ID NO: 296584 - DNA, 19 bp, Homo sapiens
cttgcccgctcccacagct

SEQ ID NO: 296585 - DNA, 13 bp, Homo sapiens
cttgccgagagag

SEQ ID NO: 296586 - DNA, 23 bp, Homo sapiens
cttgccgagcctaatgaaaggga

SEQ ID NO: 296587 - DNA, 18 bp, Homo sapiens
cttgccgaggagccaggc

SEQ ID NO: 296588 - DNA, 15 bp, Homo sapiens
cttgccgctgggaga

SEQ ID NO: 296589 - DNA, 18 bp, Homo sapiens
cttgcctagggcctggtc

SEQ ID NO: 296590 - DNA, 15 bp, Homo sapiens
cttgcctcctgtgta

SEQ ID NO: 296591 - DNA, 14 bp, Homo sapiens
cttgcctctctcag

SEQ ID NO: 296592 - DNA, 20 bp, Homo sapiens
cttgccttcttcacccagct

SEQ ID NO: 296593 - DNA, 22 bp, Homo sapiens
cttgcgccgagaccgcagaggg

SEQ ID NO: 296594 - DNA, 19 bp, Homo sapiens
cttgcgcttttgctggtca

SEQ ID NO: 296595 - DNA, 17 bp, Homo sapiens
cttgcggcaccgcccac

SEQ ID NO: 296596 - DNA, 16 bp, Homo sapiens
cttgcgtcctgcagag

SEQ ID NO: 296597 - DNA, 24 bp, Homo sapiens
cttgcgtcctgcagaggaccacag

SEQ ID NO: 296598 - DNA, 12 bp, Homo sapiens
cttgctaagctc

SEQ ID NO: 296599 - DNA, 14 bp, Homo sapiens
cttgctaagttttc

SEQ ID NO: 296600 - DNA, 17 bp, Homo sapiens
cttgctaattttctcaa

SEQ ID NO: 296601 - DNA, 16 bp, Homo sapiens
cttgctacctcaaggg

SEQ ID NO: 296602 - DNA, 17 bp, Homo sapiens
cttgctacctgtgagca

SEQ ID NO: 296603 - DNA, 22 bp, Homo sapiens
cttgctagacaaggttgctgtt

SEQ ID NO: 296604 - DNA, 20 bp, Homo sapiens
cttgctagctatgtgacctt

SEQ ID NO: 296605 - DNA, 23 bp, Homo sapiens
cttgctagctatgtgaccttgag

SEQ ID NO: 296606 - DNA, 19 bp, Homo sapiens
cttgctcaataaaggtcat

SEQ ID NO: 296607 - DNA, 14 bp, Homo sapiens
cttgctcagtgcct

SEQ ID NO: 296608 - DNA, 15 bp, Homo sapiens
cttgctcagtgcctc

SEQ ID NO: 296609 - DNA, 17 bp, Homo sapiens
cttgctcagtgcctcct

SEQ ID NO: 296610 - DNA, 19 bp, Homo sapiens
cttgctcagtgcctcctgg

SEQ ID NO: 296611 - DNA, 12 bp, Homo sapiens
cttgctccaggg

SEQ ID NO: 296612 - DNA, 15 bp, Homo sapiens
cttgctccagggtct

SEQ ID NO: 296613 - DNA, 20 bp, Homo sapiens
cttgctccagggtcttgggc

SEQ ID NO: 296614 - DNA, 13 bp, Homo sapiens
cttgctcccttca

SEQ ID NO: 296615 - DNA, 20 bp, Homo sapiens
cttgctctcccctgccctgc

SEQ ID NO: 296616 - DNA, 14 bp, Homo sapiens
cttgctctccctct

SEQ ID NO: 296617 - DNA, 17 bp, Homo sapiens
cttgctctccctcttct

SEQ ID NO: 296618 - DNA, 20 bp, Homo sapiens
cttgctcttagattgggcca

SEQ ID NO: 296619 - DNA, 13 bp, Homo sapiens
cttgctgccaagt

SEQ ID NO: 296620 - DNA, 15 bp, Homo sapiens
cttgctgccaagtcc

SEQ ID NO: 296621 - DNA, 20 bp, Homo sapiens
cttgctgccaagtcctgcct

SEQ ID NO: 296622 - DNA, 22 bp, Homo sapiens
cttgctgccaagtcctgccttt

SEQ ID NO: 296623 - DNA, 14 bp, Homo sapiens
cttgctgctgtgcc

SEQ ID NO: 296624 - DNA, 15 bp, Homo sapiens
cttgctgctgtgcct

SEQ ID NO: 296625 - DNA, 16 bp, Homo sapiens
cttgctgctgtgcctg

SEQ ID NO: 296626 - DNA, 17 bp, Homo sapiens
cttgctggtgcacatga

SEQ ID NO: 296627 - DNA, 13 bp, Homo sapiens
cttgctgtgaaac

SEQ ID NO: 296628 - DNA, 17 bp, Homo sapiens
cttgctgtgaaacagtg

SEQ ID NO: 296629 - DNA, 15 bp, Homo sapiens
cttgctgtgacttat

SEQ ID NO: 296630 - DNA, 13 bp, Homo sapiens
cttgctgtggtct

SEQ ID NO: 296631 - DNA, 11 bp, Homo sapiens
cttgctgtgtg

SEQ ID NO: 296632 - DNA, 16 bp, Homo sapiens
cttgctgtgtgacctt

SEQ ID NO: 296633 - DNA, 21 bp, Homo sapiens
cttgctgttcccatccctgaa

SEQ ID NO: 296634 - DNA, 18 bp, Homo sapiens
cttgctgttttgttctgt

SEQ ID NO: 296635 - DNA, 14 bp, Homo sapiens
cttgcttctcaact

SEQ ID NO: 296636 - DNA, 17 bp, Homo sapiens
cttgcttcttgtgtttg

SEQ ID NO: 296637 - DNA, 20 bp, Homo sapiens
cttgcttcttgtgtttgaaa

SEQ ID NO: 296638 - DNA, 18 bp, Homo sapiens
cttgctttcacaaatata

SEQ ID NO: 296639 - DNA, 13 bp, Homo sapiens
cttgctttgggct

SEQ ID NO: 296640 - DNA, 21 bp, Homo sapiens
cttggaaacctgccctgcctg

SEQ ID NO: 296641 - DNA, 24 bp, Homo sapiens
cttggaaagctgatgatgtctctt

SEQ ID NO: 296642 - DNA, 18 bp, Homo sapiens
cttggaatatctgctgta

SEQ ID NO: 296643 - DNA, 22 bp, Homo sapiens
cttggaatgaattctctctaaa

SEQ ID NO: 296644 - DNA, 14 bp, Homo sapiens
cttggacggggaca

SEQ ID NO: 296645 - DNA, 19 bp, Homo sapiens
cttggacggggacacggcc

SEQ ID NO: 296646 - DNA, 16 bp, Homo sapiens
cttggacttcctgggg

SEQ ID NO: 296647 - DNA, 19 bp, Homo sapiens
cttggacttcctggggccc

SEQ ID NO: 296648 - DNA, 13 bp, Homo sapiens
cttggagagcagc

SEQ ID NO: 296649 - DNA, 20 bp, Homo sapiens
cttggagagcagctggctct

SEQ ID NO: 296650 - DNA, 12 bp, Homo sapiens
cttggagaggag

SEQ ID NO: 296651 - DNA, 22 bp, Homo sapiens
cttggagagggacgaagaaagg

SEQ ID NO: 296652 - DNA, 23 bp, Homo sapiens
cttggagcagagacggcagcccc

SEQ ID NO: 296653 - DNA, 13 bp, Homo sapiens
cttggagctgaga

SEQ ID NO: 296654 - DNA, 14 bp, Homo sapiens
cttggagctgagat

SEQ ID NO: 296655 - DNA, 14 bp, Homo sapiens
cttggagctgtcct

SEQ ID NO: 296656 - DNA, 18 bp, Homo sapiens
cttggagctgtcctccag

SEQ ID NO: 296657 - DNA, 19 bp, Homo sapiens
cttggaggatcgtggccaa

SEQ ID NO: 296658 - DNA, 13 bp, Homo sapiens
cttggaggcaacc

SEQ ID NO: 296659 - DNA, 21 bp, Homo sapiens
cttggaggcaacctcccattt

SEQ ID NO: 296660 - DNA, 15 bp, Homo sapiens
cttggagggataagc

SEQ ID NO: 296661 - DNA, 15 bp, Homo sapiens
cttggataggagctt

SEQ ID NO: 296662 - DNA, 21 bp, Homo sapiens
cttggataggagcttccagat

SEQ ID NO: 296663 - DNA, 13 bp, Homo sapiens
cttggatttgcat

SEQ ID NO: 296664 - DNA, 15 bp, Homo sapiens
cttggcaacagaagc

SEQ ID NO: 296665 - DNA, 16 bp, Homo sapiens
cttggcaccaaagatg

SEQ ID NO: 296666 - DNA, 17 bp, Homo sapiens
cttggcacccccatgct

SEQ ID NO: 296667 - DNA, 18 bp, Homo sapiens
cttggcacccccatgctg

SEQ ID NO: 296668 - DNA, 16 bp, Homo sapiens
cttggccacggcctgg

SEQ ID NO: 296669 - DNA, 18 bp, Homo sapiens
cttggccacggcctggga

SEQ ID NO: 296670 - DNA, 12 bp, Homo sapiens
cttggcccagca

SEQ ID NO: 296671 - DNA, 22 bp, Homo sapiens
cttggcccagcagcggcccaga

SEQ ID NO: 296672 - DNA, 12 bp, Homo sapiens
cttggcccctct

SEQ ID NO: 296673 - DNA, 22 bp, Homo sapiens
cttggccgcacctaaagcagcc

SEQ ID NO: 296674 - DNA, 15 bp, Homo sapiens
cttggccgtggcatt

SEQ ID NO: 296675 - DNA, 20 bp, Homo sapiens
cttggcctagcccaccctgc

SEQ ID NO: 296676 - DNA, 21 bp, Homo sapiens
cttggcctagcccaccctgct

SEQ ID NO: 296677 - DNA, 12 bp, Homo sapiens
cttggcctcaga

SEQ ID NO: 296678 - DNA, 15 bp, Homo sapiens
cttggctagtcacat

SEQ ID NO: 296679 - DNA, 14 bp, Homo sapiens
cttggctgactggg

SEQ ID NO: 296680 - DNA, 21 bp, Homo sapiens
cttggctgagccccctctcct

SEQ ID NO: 296681 - DNA, 22 bp, Homo sapiens
cttggctgagccccctctcctg

SEQ ID NO: 296682 - DNA, 23 bp, Homo sapiens
cttggctgtcccctccatctggg

SEQ ID NO: 296683 - DNA, 18 bp, Homo sapiens
ctttccatgacagtagca

SEQ ID NO: 296684 - DNA, 19 bp, Homo sapiens
ctttccatgacagtagcat

SEQ ID NO: 296685 - DNA, 14 bp, Homo sapiens
ctttcccaaaccct

SEQ ID NO: 296686 - DNA, 19 bp, Homo sapiens
ctttcccaacacttcagac

SEQ ID NO: 296687 - DNA, 21 bp, Homo sapiens
ctttcccacccactagccctc

SEQ ID NO: 296688 - DNA, 20 bp, Homo sapiens
ctttcccatcaccccttccc

SEQ ID NO: 296689 - DNA, 22 bp, Homo sapiens
ctttcccatcaccccttcccca

SEQ ID NO: 296690 - DNA, 19 bp, Homo sapiens
ctttcccattggtctgcat

SEQ ID NO: 296691 - DNA, 21 bp, Homo sapiens
ctttcccattggtctgcatgt

SEQ ID NO: 296692 - DNA, 20 bp, Homo sapiens
ctttccccagaggctcccaa

SEQ ID NO: 296693 - DNA, 22 bp, Homo sapiens
ctttccccagaggctcccaatc

SEQ ID NO: 296694 - DNA, 14 bp, Homo sapiens
ctttccctagaaag

SEQ ID NO: 296695 - DNA, 21 bp, Homo sapiens
ctttccctagaaagccatatt

SEQ ID NO: 296696 - DNA, 14 bp, Homo sapiens
ctttccctgcatcc

SEQ ID NO: 296697 - DNA, 14 bp, Homo sapiens
ctttccctggctca

SEQ ID NO: 296698 - DNA, 13 bp, Homo sapiens
ctttcccttcccc

SEQ ID NO: 296699 - DNA, 18 bp, Homo sapiens
ctttcctcccttctttgc

SEQ ID NO: 296700 - DNA, 19 bp, Homo sapiens
ctttcctcccttctttgct

SEQ ID NO: 296701 - DNA, 13 bp, Homo sapiens
ctttcctccttcc

SEQ ID NO: 296702 - DNA, 16 bp, Homo sapiens
ctttcctccttccatg

SEQ ID NO: 296703 - DNA, 13 bp, Homo sapiens
ctttcctcgcctg

SEQ ID NO: 296704 - DNA, 17 bp, Homo sapiens
ctttcctctaactcatt

SEQ ID NO: 296705 - DNA, 12 bp, Homo sapiens
ctttcctctctc

SEQ ID NO: 296706 - DNA, 15 bp, Homo sapiens
ctttcctgcatcttt

SEQ ID NO: 296707 - DNA, 22 bp, Homo sapiens
ctttcctggataaaaaagaaaa

SEQ ID NO: 296708 - DNA, 13 bp, Homo sapiens
ctttcctgggtga

SEQ ID NO: 296709 - DNA, 17 bp, Homo sapiens
ctttcctgtgccaggac

SEQ ID NO: 296710 - DNA, 18 bp, Homo sapiens
ctttcctttcatcctcag

SEQ ID NO: 296711 - DNA, 22 bp, Homo sapiens
ctttcggggagaggctgaggac

SEQ ID NO: 296712 - DNA, 21 bp, Homo sapiens
ctttcgttggttgtttctctg

SEQ ID NO: 296713 - DNA, 20 bp, Homo sapiens
ctttctaacccactaagtaa

SEQ ID NO: 296714 - DNA, 18 bp, Homo sapiens
ctttctaagctttcttac

SEQ ID NO: 296715 - DNA, 19 bp, Homo sapiens
ctttctaaggatagccttt

SEQ ID NO: 296716 - DNA, 22 bp, Homo sapiens
ctttctaaggatagcctttgta

SEQ ID NO: 296717 - DNA, 23 bp, Homo sapiens
ctttctaaggatagcctttgtag

SEQ ID NO: 296718 - DNA, 20 bp, Homo sapiens
ctttctaattaaaaaaataa

SEQ ID NO: 296719 - DNA, 21 bp, Homo sapiens
ctttctacacctgttgcacct

SEQ ID NO: 296720 - DNA, 14 bp, Homo sapiens
ctttctagctgttg

SEQ ID NO: 296721 - DNA, 20 bp, Homo sapiens
ctttctagtcctattctatt

SEQ ID NO: 296722 - DNA, 21 bp, Homo sapiens
ctttctagtcctattctattg

SEQ ID NO: 296723 - DNA, 17 bp, Homo sapiens
ctttctagttcaatgcc

SEQ ID NO: 296724 - DNA, 20 bp, Homo sapiens
ctttctagttcaatgcctca

SEQ ID NO: 296725 - DNA, 23 bp, Homo sapiens
ctttctatataaaatgtattcaa

SEQ ID NO: 296726 - DNA, 24 bp, Homo sapiens
ctttctcagggggtcagcagagtt

SEQ ID NO: 296727 - DNA, 21 bp, Homo sapiens
ctttctccaaaggcactgacc

SEQ ID NO: 296728 - DNA, 13 bp, Homo sapiens
ctttctccagcca

SEQ ID NO: 296729 - DNA, 16 bp, Homo sapiens
ctttctccagccagca

SEQ ID NO: 296730 - DNA, 19 bp, Homo sapiens
ctttctccagccagcaatg

SEQ ID NO: 296731 - DNA, 21 bp, Homo sapiens
ctttctcccccgacactgctg

SEQ ID NO: 296732 - DNA, 18 bp, Homo sapiens
ctttctccctaaccacta

SEQ ID NO: 296733 - DNA, 21 bp, Homo sapiens
ctttctccggggtctgtgctg

SEQ ID NO: 296734 - DNA, 17 bp, Homo sapiens
ctttctccgtatttatt

SEQ ID NO: 296735 - DNA, 23 bp, Homo sapiens
ctttctcctgatagtcacctgct

SEQ ID NO: 296736 - DNA, 23 bp, Homo sapiens
ctttctccttagtcttctcatag

SEQ ID NO: 296737 - DNA, 15 bp, Homo sapiens
ctttctctcctttct

SEQ ID NO: 296738 - DNA, 14 bp, Homo sapiens
ctttctctctgtgt

SEQ ID NO: 296739 - DNA, 17 bp, Homo sapiens
ctttctctgcttcagct

SEQ ID NO: 296740 - DNA, 21 bp, Homo sapiens
ctttctctgcttcagcttgct

SEQ ID NO: 296741 - DNA, 15 bp, Homo sapiens
ctttctgacaataaa

SEQ ID NO: 296742 - DNA, 14 bp, Homo sapiens
ctttctgactgcaa

SEQ ID NO: 296743 - DNA, 19 bp, Homo sapiens
ctttctgcagtttttcagg

SEQ ID NO: 296744 - DNA, 20 bp, Homo sapiens
ctttctgcagtttttcagga

SEQ ID NO: 296745 - DNA, 22 bp, Homo sapiens
ctttctggaaattcttccctgg

SEQ ID NO: 296746 - DNA, 14 bp, Homo sapiens
ctttctgtatcaag

SEQ ID NO: 296747 - DNA, 23 bp, Homo sapiens
ctttctgttttttttttttgtat

SEQ ID NO: 296748 - DNA, 16 bp, Homo sapiens
ctttcttcactgcaga

SEQ ID NO: 296749 - DNA, 15 bp, Homo sapiens
ctttcttcctctgct

SEQ ID NO: 296750 - DNA, 20 bp, Homo sapiens
ctttcttctacaaccagagc

SEQ ID NO: 296751 - DNA, 16 bp, Homo sapiens
ctttcttcttccacac

SEQ ID NO: 296752 - DNA, 22 bp, Homo sapiens
ctttcttgacaaaacctaactt

SEQ ID NO: 296753 - DNA, 21 bp, Homo sapiens
ctttcttgctggttgtcattt

SEQ ID NO: 296754 - DNA, 12 bp, Homo sapiens
ctttctttactc

SEQ ID NO: 296755 - DNA, 17 bp, Homo sapiens
ctttctttcagatgttt

SEQ ID NO: 296756 - DNA, 14 bp, Homo sapiens
ctttctttccaaag

SEQ ID NO: 296757 - DNA, 19 bp, Homo sapiens
ctttctttccaaaggttgt

SEQ ID NO: 296758 - DNA, 16 bp, Homo sapiens
ctttctttgctgctgt

SEQ ID NO: 296759 - DNA, 22 bp, Homo sapiens
ctttcttttctggaatgtaatc

SEQ ID NO: 296760 - DNA, 23 bp, Homo sapiens
ctttcttttgaatcaatctggct

SEQ ID NO: 296761 - DNA, 15 bp, Homo sapiens
ctttctttttcttct

SEQ ID NO: 296762 - DNA, 15 bp, Homo sapiens
ctttgaaaatatttc

SEQ ID NO: 296763 - DNA, 15 bp, Homo sapiens
ctttgaaactagact

SEQ ID NO: 296764 - DNA, 21 bp, Homo sapiens
ctttgaaatagtctgtgtgaa

SEQ ID NO: 296765 - DNA, 18 bp, Homo sapiens
ctttgaaatatgcatgta

SEQ ID NO: 296766 - DNA, 22 bp, Homo sapiens
ctttgaaatatgcatgtacttt

SEQ ID NO: 296767 - DNA, 15 bp, Homo sapiens
ctttgacatgaaaag

SEQ ID NO: 296768 - DNA, 18 bp, Homo sapiens
ctttgacctcaacctgtg

SEQ ID NO: 296769 - DNA, 20 bp, Homo sapiens
ctttgactataacaaaatct

SEQ ID NO: 296770 - DNA, 16 bp, Homo sapiens
ctttgactgagcagac

SEQ ID NO: 296771 - DNA, 14 bp, Homo sapiens
ctttgacttcagct

SEQ ID NO: 296772 - DNA, 15 bp, Homo sapiens
ctttgacttcagctg

SEQ ID NO: 296773 - DNA, 20 bp, Homo sapiens
ctttgacttcagctgcctga

SEQ ID NO: 296774 - DNA, 15 bp, Homo sapiens
ctttgagaaagaaat

SEQ ID NO: 296775 - DNA, 19 bp, Homo sapiens
ctttgagaaaggattaaga

SEQ ID NO: 296776 - DNA, 17 bp, Homo sapiens
ctttgagaatattataa

SEQ ID NO: 296777 - DNA, 16 bp, Homo sapiens
ctttgaggaggaagca

SEQ ID NO: 296778 - DNA, 22 bp, Homo sapiens
ctttgatattttcaacgcagcc

SEQ ID NO: 296779 - DNA, 15 bp, Homo sapiens
ctttgatcttcagga

SEQ ID NO: 296780 - DNA, 22 bp, Homo sapiens
ctttgatgtgtttttgtatgaa

SEQ ID NO: 296781 - DNA, 11 bp, Homo sapiens
ctttgattgag

SEQ ID NO: 296782 - DNA, 14 bp, Homo sapiens
ctttgattgcacat

SEQ ID NO: 296783 - DNA, 17 bp, Homo sapiens
ctttgattgtgaaacag

SEQ ID NO: 296784 - DNA, 16 bp, Homo sapiens
ctttgatttacagtgc

SEQ ID NO: 296785 - DNA, 21 bp, Homo sapiens
ctttgatttacagtgcctgta

SEQ ID NO: 296786 - DNA, 14 bp, Homo sapiens
ctttgcacacttca

SEQ ID NO: 296787 - DNA, 20 bp, Homo sapiens
ctttgcacacttcaaatcag

SEQ ID NO: 296788 - DNA, 21 bp, Homo sapiens
ctttgcacaggaaagagtcac

SEQ ID NO: 296789 - DNA, 16 bp, Homo sapiens
ctttgcactgagggcc

SEQ ID NO: 296790 - DNA, 15 bp, Homo sapiens
ctttgcagacctggg

SEQ ID NO: 296791 - DNA, 18 bp, Homo sapiens
ctttgcagacctgggact

SEQ ID NO: 296792 - DNA, 20 bp, Homo sapiens
ctttgcagacctgggacttt

SEQ ID NO: 296793 - DNA, 18 bp, Homo sapiens
ctttgcagccaaggtgct

SEQ ID NO: 296794 - DNA, 23 bp, Homo sapiens
ctttgcagccaaggtgctaaaag

SEQ ID NO: 296795 - DNA, 13 bp, Homo sapiens
ctttgcaggctct

SEQ ID NO: 296796 - DNA, 17 bp, Homo sapiens
ctttgcagggagaccag

SEQ ID NO: 296797 - DNA, 15 bp, Homo sapiens
ctttgcatgatctgt

SEQ ID NO: 296798 - DNA, 22 bp, Homo sapiens
ctttgccaaggctctcccctct

SEQ ID NO: 296799 - DNA, 18 bp, Homo sapiens
ctttgccatgggcctgct

SEQ ID NO: 296800 - DNA, 18 bp, Homo sapiens
ctttgcccaacctcagca

SEQ ID NO: 296801 - DNA, 21 bp, Homo sapiens
ctttgcccaacctcagcaacc

SEQ ID NO: 296802 - DNA, 18 bp, Homo sapiens
ctttgcccagggtcctgt

SEQ ID NO: 296803 - DNA, 20 bp, Homo sapiens
ctttgcccagggtcctgtgc

SEQ ID NO: 296804 - DNA, 15 bp, Homo sapiens
ctttgcccttcactg

SEQ ID NO: 296805 - DNA, 13 bp, Homo sapiens
ctttgccttgggc

SEQ ID NO: 296806 - DNA, 19 bp, Homo sapiens
ctttgccttgggctgctcc

SEQ ID NO: 296807 - DNA, 22 bp, Homo sapiens
ctttgccttgggctgctcctca

SEQ ID NO: 296808 - DNA, 23 bp, Homo sapiens
ctttgccttgggctgctcctcat

SEQ ID NO: 296809 - DNA, 22 bp, Homo sapiens
ctttgcctttatctctgaggct

SEQ ID NO: 296810 - DNA, 15 bp, Homo sapiens
ctttgcggacgggct

SEQ ID NO: 296811 - DNA, 15 bp, Homo sapiens
ctttgctacgaagaa

SEQ ID NO: 296812 - DNA, 15 bp, Homo sapiens
cttttcctcccttgg

SEQ ID NO: 296813 - DNA, 21 bp, Homo sapiens
cttttcctgggccttctcagc

SEQ ID NO: 296814 - DNA, 11 bp, Homo sapiens
cttttcgttaa

SEQ ID NO: 296815 - DNA, 20 bp, Homo sapiens
cttttcgttaacattgacca

SEQ ID NO: 296816 - DNA, 21 bp, Homo sapiens
cttttctattccttctggcct

SEQ ID NO: 296817 - DNA, 13 bp, Homo sapiens
cttttctcatggt

SEQ ID NO: 296818 - DNA, 13 bp, Homo sapiens
cttttctctttct

SEQ ID NO: 296819 - DNA, 19 bp, Homo sapiens
cttttctggaatgtaatca

SEQ ID NO: 296820 - DNA, 18 bp, Homo sapiens
cttttctggctcctgtgt

SEQ ID NO: 296821 - DNA, 22 bp, Homo sapiens
cttttctggtaggttctgtctg

SEQ ID NO: 296822 - DNA, 14 bp, Homo sapiens
cttttctgtcacca

SEQ ID NO: 296823 - DNA, 23 bp, Homo sapiens
cttttctgtgaagccctttgcct

SEQ ID NO: 296824 - DNA, 21 bp, Homo sapiens
cttttcttagtttcagaagta

SEQ ID NO: 296825 - DNA, 14 bp, Homo sapiens
cttttcttgccagc

SEQ ID NO: 296826 - DNA, 15 bp, Homo sapiens
cttttcttgccagct

SEQ ID NO: 296827 - DNA, 17 bp, Homo sapiens
cttttcttgccagctca

SEQ ID NO: 296828 - DNA, 11 bp, Homo sapiens
cttttcttgga

SEQ ID NO: 296829 - DNA, 19 bp, Homo sapiens
cttttcttggcgttcctgc

SEQ ID NO: 296830 - DNA, 19 bp, Homo sapiens
cttttctttttcccttgaa

SEQ ID NO: 296831 - DNA, 23 bp, Homo sapiens
cttttgaactcacgagccttgcg

SEQ ID NO: 296832 - DNA, 22 bp, Homo sapiens
cttttgaagtagtttgtataac

SEQ ID NO: 296833 - DNA, 18 bp, Homo sapiens
cttttgaataatgtagtg

SEQ ID NO: 296834 - DNA, 21 bp, Homo sapiens
cttttgaatcaatctggcttc

SEQ ID NO: 296835 - DNA, 13 bp, Homo sapiens
cttttgacatgtg

SEQ ID NO: 296836 - DNA, 14 bp, Homo sapiens
cttttgacatgtgg

SEQ ID NO: 296837 - DNA, 14 bp, Homo sapiens
cttttgagaggggt

SEQ ID NO: 296838 - DNA, 16 bp, Homo sapiens
cttttgagcatttaga

SEQ ID NO: 296839 - DNA, 16 bp, Homo sapiens
cttttgataaaatgtt

SEQ ID NO: 296840 - DNA, 12 bp, Homo sapiens
cttttgatacat

SEQ ID NO: 296841 - DNA, 14 bp, Homo sapiens
cttttgatacattt

SEQ ID NO: 296842 - DNA, 16 bp, Homo sapiens
cttttgatacatttat

SEQ ID NO: 296843 - DNA, 19 bp, Homo sapiens
cttttgatacatttatctt

SEQ ID NO: 296844 - DNA, 21 bp, Homo sapiens
cttttgatatgattgtaacat

SEQ ID NO: 296845 - DNA, 13 bp, Homo sapiens
cttttgatggcta

SEQ ID NO: 296846 - DNA, 18 bp, Homo sapiens
cttttgcaaaagaagttg

SEQ ID NO: 296847 - DNA, 22 bp, Homo sapiens
cttttgcaaacagaacactgta

SEQ ID NO: 296848 - DNA, 15 bp, Homo sapiens
cttttgcacatatat

SEQ ID NO: 296849 - DNA, 18 bp, Homo sapiens
cttttgcacatatatttt

SEQ ID NO: 296850 - DNA, 21 bp, Homo sapiens
cttttgcagcttccttccaag

SEQ ID NO: 296851 - DNA, 14 bp, Homo sapiens
cttttgccccagaa

SEQ ID NO: 296852 - DNA, 13 bp, Homo sapiens
cttttgcctggct

SEQ ID NO: 296853 - DNA, 14 bp, Homo sapiens
cttttgcctggctg

SEQ ID NO: 296854 - DNA, 22 bp, Homo sapiens
cttttggccgggcatggtagct

SEQ ID NO: 296855 - DNA, 13 bp, Homo sapiens
cttttggccttgt

SEQ ID NO: 296856 - DNA, 14 bp, Homo sapiens
cttttggccttgtg

SEQ ID NO: 296857 - DNA, 16 bp, Homo sapiens
cttttgggaagccagg

SEQ ID NO: 296858 - DNA, 19 bp, Homo sapiens
cttttgggcctccttccca

SEQ ID NO: 296859 - DNA, 23 bp, Homo sapiens
cttttgggtttgccttaattctt

SEQ ID NO: 296860 - DNA, 12 bp, Homo sapiens
cttttggtttaa

SEQ ID NO: 296861 - DNA, 11 bp, Homo sapiens
cttttgtaaat

SEQ ID NO: 296862 - DNA, 14 bp, Homo sapiens
cttttgtaaatatt

SEQ ID NO: 296863 - DNA, 17 bp, Homo sapiens
cttttgtacccaatact

SEQ ID NO: 296864 - DNA, 16 bp, Homo sapiens
cttttgtccccagggc

SEQ ID NO: 296865 - DNA, 17 bp, Homo sapiens
cttttgtccccagggcc

SEQ ID NO: 296866 - DNA, 16 bp, Homo sapiens
cttttgtctaattaaa

SEQ ID NO: 296867 - DNA, 22 bp, Homo sapiens
cttttgtgagacggctggaaat

SEQ ID NO: 296868 - DNA, 19 bp, Homo sapiens
cttttgtgggtttctctgt

SEQ ID NO: 296869 - DNA, 17 bp, Homo sapiens
cttttgttaagttcacc

SEQ ID NO: 296870 - DNA, 13 bp, Homo sapiens
cttttgttctaga

SEQ ID NO: 296871 - DNA, 16 bp, Homo sapiens
cttttgttctctcttg

SEQ ID NO: 296872 - DNA, 19 bp, Homo sapiens
cttttgttttcctgctggt

SEQ ID NO: 296873 - DNA, 21 bp, Homo sapiens
ctttttaaaaagttgcacatt

SEQ ID NO: 296874 - DNA, 22 bp, Homo sapiens
ctttttaatattgatatgctta

SEQ ID NO: 296875 - DNA, 15 bp, Homo sapiens
ctttttactcccctt

SEQ ID NO: 296876 - DNA, 22 bp, Homo sapiens
ctttttacttggaaataataaa

SEQ ID NO: 296877 - DNA, 21 bp, Homo sapiens
ctttttagtgttttgcaaggg

SEQ ID NO: 296878 - DNA, 11 bp, Homo sapiens
ctttttcaatg

SEQ ID NO: 296879 - DNA, 21 bp, Homo sapiens
ctttttcaatggttgggacaa

SEQ ID NO: 296880 - DNA, 17 bp, Homo sapiens
ctttttcatatgttgct

SEQ ID NO: 296881 - DNA, 12 bp, Homo sapiens
ctttttccacaa

SEQ ID NO: 296882 - DNA, 20 bp, Homo sapiens
ctttttccatttcttcagag

SEQ ID NO: 296883 - DNA, 22 bp, Homo sapiens
ctttttccatttcttcagaggg

SEQ ID NO: 296884 - DNA, 20 bp, Homo sapiens
ctttttcccaactttggaaa

SEQ ID NO: 296885 - DNA, 22 bp, Homo sapiens
ctttttcccctatcctgttctt

SEQ ID NO: 296886 - DNA, 17 bp, Homo sapiens
ctttttccttatttcaa

SEQ ID NO: 296887 - DNA, 20 bp, Homo sapiens
ctttttctaaagtgttggtc

SEQ ID NO: 296888 - DNA, 14 bp, Homo sapiens
ctttttctaccttt

SEQ ID NO: 296889 - DNA, 21 bp, Homo sapiens
ctttttcttaccctctctttc

SEQ ID NO: 296890 - DNA, 18 bp, Homo sapiens
ctttttcttcctctcggc

SEQ ID NO: 296891 - DNA, 11 bp, Homo sapiens
ctttttgagta

SEQ ID NO: 296892 - DNA, 21 bp, Homo sapiens
ctttttggaggtgcttaagca

SEQ ID NO: 296893 - DNA, 19 bp, Homo sapiens
ctttttgggagagacttgt

SEQ ID NO: 296894 - DNA, 17 bp, Homo sapiens
ctttttgtaaatactgc

SEQ ID NO: 296895 - DNA, 12 bp, Homo sapiens
ctttttgtcaaa

SEQ ID NO: 296896 - DNA, 13 bp, Homo sapiens
cttttttaaatga

SEQ ID NO: 296897 - DNA, 19 bp, Homo sapiens
cttttttaaattaatcaga

SEQ ID NO: 296898 - DNA, 15 bp, Homo sapiens
cttttttatagctta

SEQ ID NO: 296899 - DNA, 18 bp, Homo sapiens
cttttttatgtgccgtgt

SEQ ID NO: 296900 - DNA, 12 bp, Homo sapiens
cttttttcaaaa

SEQ ID NO: 296901 - DNA, 16 bp, Homo sapiens
cttttttcctgtcaat

SEQ ID NO: 296902 - DNA, 15 bp, Homo sapiens
cttttttctcttctg

SEQ ID NO: 296903 - DNA, 16 bp, Homo sapiens
cttttttctcttctgt

SEQ ID NO: 296904 - DNA, 16 bp, Homo sapiens
cttttttctttaagat

SEQ ID NO: 296905 - DNA, 18 bp, Homo sapiens
cttttttctttctttact

SEQ ID NO: 296906 - DNA, 11 bp, Homo sapiens
cttttttgtcc

SEQ ID NO: 296907 - DNA, 22 bp, Homo sapiens
cttttttgtcccccaacttgag

SEQ ID NO: 296908 - DNA, 11 bp, Homo sapiens
ctttttttact

SEQ ID NO: 296909 - DNA, 14 bp, Homo sapiens
ctttttttctctcc

SEQ ID NO: 296910 - DNA, 15 bp, Homo sapiens
ctttttttggcccag

SEQ ID NO: 296911 - DNA, 15 bp, Homo sapiens
ctttttttttgaaac

SEQ ID NO: 296912 - DNA, 20 bp, Homo sapiens
ctttttttttgaaacagcag

SEQ ID NO: 296913 - DNA, 23 bp, Homo sapiens
cttttttttttcgtcttccctgc

SEQ ID NO: 296914 - DNA, 14 bp, Homo sapiens
cttttttttttgag

SEQ ID NO: 296915 - DNA, 19 bp, Homo sapiens
ctttttttttttttttgaa

SEQ ID NO: 296916 - DNA, 20 bp, Homo sapiens
ctttttttttttttttgaaa

SEQ ID NO: 296917 - DNA, 21 bp, Homo sapiens
ctttttttttttttttgaaag

SEQ ID NO: 296918 - DNA, 14 bp, Homo sapiens
gaaaaaaaaaacaa

SEQ ID NO: 296919 - DNA, 13 bp, Homo sapiens
gaaaaaaacagca

SEQ ID NO: 296920 - DNA, 23 bp, Homo sapiens
gaaaaaaacttttataaattaaa

SEQ ID NO: 296921 - DNA, 23 bp, Homo sapiens
gaaaaaaaggttaacagtaaaaa

SEQ ID NO: 296922 - DNA, 16 bp, Homo sapiens
gaaaaaaatatatttt

SEQ ID NO: 296923 - DNA, 21 bp, Homo sapiens
gaaaaaagaagtgtccgagaa

SEQ ID NO: 296924 - DNA, 17 bp, Homo sapiens
gaaaaaataacacacat

SEQ ID NO: 296925 - DNA, 12 bp, Homo sapiens
gaaaaaatattt

SEQ ID NO: 296926 - DNA, 15 bp, Homo sapiens
gaaaaaatattttaa

SEQ ID NO: 296927 - DNA, 12 bp, Homo sapiens
gaaaaacaaaat

SEQ ID NO: 296928 - DNA, 17 bp, Homo sapiens
gaaaaacacggcagctg

SEQ ID NO: 296929 - DNA, 18 bp, Homo sapiens
gaaaaacagaacatttct

SEQ ID NO: 296930 - DNA, 20 bp, Homo sapiens
gaaaaacagaacatttctca

SEQ ID NO: 296931 - DNA, 16 bp, Homo sapiens
gaaaaacatgtcatgt

SEQ ID NO: 296932 - DNA, 23 bp, Homo sapiens
gaaaaaccaatgattcataacaa

SEQ ID NO: 296933 - DNA, 14 bp, Homo sapiens
gaaaaacctgtggg

SEQ ID NO: 296934 - DNA, 16 bp, Homo sapiens
gaaaaactggcttttt

SEQ ID NO: 296935 - DNA, 22 bp, Homo sapiens
gaaaaactggctttttcccagc

SEQ ID NO: 296936 - DNA, 14 bp, Homo sapiens
gaaaaagaaacaca

SEQ ID NO: 296937 - DNA, 14 bp, Homo sapiens
gaaaaagagagagc

SEQ ID NO: 296938 - DNA, 15 bp, Homo sapiens
gaaaaagagagagca

SEQ ID NO: 296939 - DNA, 16 bp, Homo sapiens
gaaaaagagagagcag

SEQ ID NO: 296940 - DNA, 14 bp, Homo sapiens
gaaaaagcacagct

SEQ ID NO: 296941 - DNA, 16 bp, Homo sapiens
gaaaaagcacagctct

SEQ ID NO: 296942 - DNA, 17 bp, Homo sapiens
gaaaaagcctaagaaaa

SEQ ID NO: 296943 - DNA, 14 bp, Homo sapiens
gaaattaaataatt

SEQ ID NO: 296944 - DNA, 15 bp, Homo sapiens
gaaattaaataattt

SEQ ID NO: 296945 - DNA, 19 bp, Homo sapiens
gaaattaaataattttaca

SEQ ID NO: 296946 - DNA, 14 bp, Homo sapiens
gaaattacaagttt

SEQ ID NO: 296947 - DNA, 19 bp, Homo sapiens
gaaattacaagtttcagta

SEQ ID NO: 296948 - DNA, 21 bp, Homo sapiens
gaaattacaagtttcagtaat

SEQ ID NO: 296949 - DNA, 19 bp, Homo sapiens
gaaattactacaaaatttg

SEQ ID NO: 296950 - DNA, 23 bp, Homo sapiens
gaaattactggagccatgtctac

SEQ ID NO: 296951 - DNA, 24 bp, Homo sapiens
gaaattactggagccatgtctaca

SEQ ID NO: 296952 - DNA, 13 bp, Homo sapiens
gaaattatgtcaa

SEQ ID NO: 296953 - DNA, 13 bp, Homo sapiens
gaaattatttaat

SEQ ID NO: 296954 - DNA, 17 bp, Homo sapiens
gaaattatttaataaaa

SEQ ID NO: 296955 - DNA, 16 bp, Homo sapiens
gaaattcacactgtgc

SEQ ID NO: 296956 - DNA, 18 bp, Homo sapiens
gaaattccctggaccaga

SEQ ID NO: 296957 - DNA, 22 bp, Homo sapiens
gaaattccctggaccagatgct

SEQ ID NO: 296958 - DNA, 23 bp, Homo sapiens
gaaattccctggaccagatgctg

SEQ ID NO: 296959 - DNA, 16 bp, Homo sapiens
gaaattctgctgcttg

SEQ ID NO: 296960 - DNA, 19 bp, Homo sapiens
gaaattcttccctgggggt

SEQ ID NO: 296961 - DNA, 17 bp, Homo sapiens
gaaattcttgcactgta

SEQ ID NO: 296962 - DNA, 13 bp, Homo sapiens
gaaattgcaaaga

SEQ ID NO: 296963 - DNA, 18 bp, Homo sapiens
gaaattgcaaagaaaatt

SEQ ID NO: 296964 - DNA, 22 bp, Homo sapiens
gaaattgcctccttatttatca

SEQ ID NO: 296965 - DNA, 18 bp, Homo sapiens
gaaattgtgaactcattg

SEQ ID NO: 296966 - DNA, 15 bp, Homo sapiens
gaaattgttcctgat

SEQ ID NO: 296967 - DNA, 19 bp, Homo sapiens
gaaatttattagttaatat

SEQ ID NO: 296968 - DNA, 11 bp, Homo sapiens
gaaatttattc

SEQ ID NO: 296969 - DNA, 15 bp, Homo sapiens
gaaatttgatttcta

SEQ ID NO: 296970 - DNA, 17 bp, Homo sapiens
gaaatttttaaatcatt

SEQ ID NO: 296971 - DNA, 20 bp, Homo sapiens
gaaatttttaaatcatttca

SEQ ID NO: 296972 - DNA, 16 bp, Homo sapiens
gaaatttttttccaga

SEQ ID NO: 296973 - DNA, 12 bp, Homo sapiens
gaacaaagacaa

SEQ ID NO: 296974 - DNA, 24 bp, Homo sapiens
gaacaaatatgattctcctctccc

SEQ ID NO: 296975 - DNA, 23 bp, Homo sapiens
gaacaacaacaaagcatgctcag

SEQ ID NO: 296976 - DNA, 18 bp, Homo sapiens
gaacaactatttataaac

SEQ ID NO: 296977 - DNA, 23 bp, Homo sapiens
gaacaactatttataaactagat

SEQ ID NO: 296978 - DNA, 22 bp, Homo sapiens
gaacaagaaagagtaacactga

SEQ ID NO: 296979 - DNA, 15 bp, Homo sapiens
gaacaaggcaaggct

SEQ ID NO: 296980 - DNA, 18 bp, Homo sapiens
gaacaaggcaaggctgtc

SEQ ID NO: 296981 - DNA, 14 bp, Homo sapiens
gaacaagtcacagc

SEQ ID NO: 296982 - DNA, 19 bp, Homo sapiens
gaacaagtcacagctgcag

SEQ ID NO: 296983 - DNA, 17 bp, Homo sapiens
gaacaagtgaacacatt

SEQ ID NO: 296984 - DNA, 14 bp, Homo sapiens
gaacaatcacaaaa

SEQ ID NO: 296985 - DNA, 18 bp, Homo sapiens
gaacaattacctgccaaa

SEQ ID NO: 296986 - DNA, 21 bp, Homo sapiens
gaacacaagcaaaccttctca

SEQ ID NO: 296987 - DNA, 14 bp, Homo sapiens
gaacacacacacac

SEQ ID NO: 296988 - DNA, 14 bp, Homo sapiens
gaacacactcagca

SEQ ID NO: 296989 - DNA, 17 bp, Homo sapiens
gaacacactcagcagcc

SEQ ID NO: 296990 - DNA, 16 bp, Homo sapiens
gaacacagcatgtgcc

SEQ ID NO: 296991 - DNA, 17 bp, Homo sapiens
gaacacagcatgtgcca

SEQ ID NO: 296992 - DNA, 18 bp, Homo sapiens
gaacaccaagacttgaag

SEQ ID NO: 296993 - DNA, 13 bp, Homo sapiens
gaacacccagccc

SEQ ID NO: 296994 - DNA, 17 bp, Homo sapiens
gaacacccagccccagc

SEQ ID NO: 296995 - DNA, 16 bp, Homo sapiens
gaacacccggaaagac

SEQ ID NO: 296996 - DNA, 18 bp, Homo sapiens
gaacacccggaaagactg

SEQ ID NO: 296997 - DNA, 16 bp, Homo sapiens
gaacactaaagagcta

SEQ ID NO: 296998 - DNA, 22 bp, Homo sapiens
gaacactcatgcggcccagcca

SEQ ID NO: 296999 - DNA, 23 bp, Homo sapiens
gaacactcatgcggcccagccat

SEQ ID NO: 297000 - DNA, 11 bp, Homo sapiens
gaacagaaaac

SEQ ID NO: 297001 - DNA, 17 bp, Homo sapiens
gaacagaaaacaacaaa

SEQ ID NO: 297002 - DNA, 14 bp, Homo sapiens
gaacagagtatata

SEQ ID NO: 297003 - DNA, 21 bp, Homo sapiens
gaacagagtatatatgtacag

SEQ ID NO: 297004 - DNA, 19 bp, Homo sapiens
gaacagatctccaaagctt

SEQ ID NO: 297005 - DNA, 16 bp, Homo sapiens
gaacagatggctgtga

SEQ ID NO: 297006 - DNA, 21 bp, Homo sapiens
gaacagatggctgtgaaaatt

SEQ ID NO: 297007 - DNA, 20 bp, Homo sapiens
gaacagattgctacacacac

SEQ ID NO: 297008 - DNA, 20 bp, Homo sapiens
gaacagcaggcccacctacc

SEQ ID NO: 297009 - DNA, 21 bp, Homo sapiens
gaacagcaggcccacctacct

SEQ ID NO: 297010 - DNA, 24 bp, Homo sapiens
gaacagccctcggcctccgaggct

SEQ ID NO: 297011 - DNA, 19 bp, Homo sapiens
gaacagcgggagacctgtg

SEQ ID NO: 297012 - DNA, 15 bp, Homo sapiens
gaacaggaaaagaaa

SEQ ID NO: 297013 - DNA, 20 bp, Homo sapiens
gaacaggaggaactggtcca

SEQ ID NO: 297014 - DNA, 18 bp, Homo sapiens
gaacagtcacccttctgg

SEQ ID NO: 297015 - DNA, 21 bp, Homo sapiens
gaacagtcacccttctgggca

SEQ ID NO: 297016 - DNA, 22 bp, Homo sapiens
gaacagtccctcacacctgggc

SEQ ID NO: 297017 - DNA, 21 bp, Homo sapiens
gaacagtgatttttttttaga

SEQ ID NO: 297018 - DNA, 16 bp, Homo sapiens
gaacagtggctgggtg

SEQ ID NO: 297019 - DNA, 23 bp, Homo sapiens
gaacagtggctgggtgggcccag

SEQ ID NO: 297020 - DNA, 20 bp, Homo sapiens
gaacagttaagcagccgcca

SEQ ID NO: 297021 - DNA, 18 bp, Homo sapiens
gaacatatgcacagggga

SEQ ID NO: 297022 - DNA, 23 bp, Homo sapiens
gaacatgaaaacagaaaacggtt

SEQ ID NO: 297023 - DNA, 16 bp, Homo sapiens
gaacatgaaatgccct

SEQ ID NO: 297024 - DNA, 16 bp, Homo sapiens
gaacatgcagttcatt

SEQ ID NO: 297025 - DNA, 17 bp, Homo sapiens
gaacatggaattttata

SEQ ID NO: 297026 - DNA, 14 bp, Homo sapiens
gaacatggccaata

SEQ ID NO: 297027 - DNA, 18 bp, Homo sapiens
gaacatggtgtgtgtctc

SEQ ID NO: 297028 - DNA, 19 bp, Homo sapiens
gaacatggtgtgtgtctct

SEQ ID NO: 297029 - DNA, 21 bp, Homo sapiens
gaacatggtgtgtgtctctga

SEQ ID NO: 297030 - DNA, 19 bp, Homo sapiens
gaacattcgaggtgtcacc

SEQ ID NO: 297031 - DNA, 23 bp, Homo sapiens
gaacattcgaggtgtcaccctgc

SEQ ID NO: 297032 - DNA, 23 bp, Homo sapiens
gaacatttctaactaaggacagg

SEQ ID NO: 297033 - DNA, 15 bp, Homo sapiens
gaacatttctcatgt

SEQ ID NO: 297034 - DNA, 16 bp, Homo sapiens
gaacatttctcatgtg

SEQ ID NO: 297035 - DNA, 18 bp, Homo sapiens
gaacatttctcatgtgct

SEQ ID NO: 297036 - DNA, 18 bp, Homo sapiens
gaaccaacgggtctgtgg

SEQ ID NO: 297037 - DNA, 21 bp, Homo sapiens
gaaccaaggcagcctccagag

SEQ ID NO: 297038 - DNA, 17 bp, Homo sapiens
gaaccagcaagtcccag

SEQ ID NO: 297039 - DNA, 14 bp, Homo sapiens
gaaccagcactccc

SEQ ID NO: 297040 - DNA, 16 bp, Homo sapiens
gaaccagcactcccag

SEQ ID NO: 297041 - DNA, 12 bp, Homo sapiens
gaaccagccctc

SEQ ID NO: 297042 - DNA, 14 bp, Homo sapiens
gaaccagccctcca

SEQ ID NO: 297043 - DNA, 17 bp, Homo sapiens
gaaccagctcatctcca

SEQ ID NO: 297044 - DNA, 15 bp, Homo sapiens
gaaccagtgtctgaa

SEQ ID NO: 297045 - DNA, 13 bp, Homo sapiens
gaacccacactgc

SEQ ID NO: 297046 - DNA, 19 bp, Homo sapiens
gaacccaggacgcttctga

SEQ ID NO: 297047 - DNA, 15 bp, Homo sapiens
gaaccccaactccca

SEQ ID NO: 297048 - DNA, 16 bp, Homo sapiens
gaaccccaactcccag

SEQ ID NO: 297049 - DNA, 13 bp, Homo sapiens
gaaccccccactc

SEQ ID NO: 297050 - DNA, 19 bp, Homo sapiens
gaaccccccactccctgcc

SEQ ID NO: 297051 - DNA, 20 bp, Homo sapiens
gaaccccccactccctgcca

SEQ ID NO: 297052 - DNA, 18 bp, Homo sapiens
gaaccccccccccccgcc

SEQ ID NO: 297053 - DNA, 15 bp, Homo sapiens
gaacccccctcccca

SEQ ID NO: 297054 - DNA, 21 bp, Homo sapiens
gaacccccctccccaaggaag

SEQ ID NO: 297055 - DNA, 16 bp, Homo sapiens
gaaccccgcagcccgt

SEQ ID NO: 297056 - DNA, 17 bp, Homo sapiens
gaaccccttcatcctct

SEQ ID NO: 297057 - DNA, 16 bp, Homo sapiens
gaacccttctgctttc

SEQ ID NO: 297058 - DNA, 17 bp, Homo sapiens
gaacccttgtgcttggt

SEQ ID NO: 297059 - DNA, 19 bp, Homo sapiens
gaacccttttggcccccga

SEQ ID NO: 297060 - DNA, 23 bp, Homo sapiens
gaacccttttggcccccgagctg

SEQ ID NO: 297061 - DNA, 15 bp, Homo sapiens
gaacctaccttcatt

SEQ ID NO: 297062 - DNA, 21 bp, Homo sapiens
gaacctccctgggcctgtctc

SEQ ID NO: 297063 - DNA, 13 bp, Homo sapiens
gaacctgctcttc

SEQ ID NO: 297064 - DNA, 12 bp, Homo sapiens
gaacctggacca

SEQ ID NO: 297065 - DNA, 17 bp, Homo sapiens
gaacctggaccaaagct

SEQ ID NO: 297066 - DNA, 21 bp, Homo sapiens
gaacctggctgcgaactgtgc

SEQ ID NO: 297067 - DNA, 16 bp, Homo sapiens
gaacctggtggctgga

SEQ ID NO: 297068 - DNA, 22 bp, Homo sapiens
gaaccttgttgatgccagctgt

SEQ ID NO: 297069 - DNA, 12 bp, Homo sapiens
gaacctttgtca

SEQ ID NO: 297070 - DNA, 21 bp, Homo sapiens
gaaccttttgagtgccttaca

SEQ ID NO: 297071 - DNA, 23 bp, Homo sapiens
gaacctttttttttgaaacagca

SEQ ID NO: 297072 - DNA, 18 bp, Homo sapiens
gaaggtcggaggcttggg

SEQ ID NO: 297073 - DNA, 24 bp, Homo sapiens
gaaggtgaccgcccagctctccca

SEQ ID NO: 297074 - DNA, 14 bp, Homo sapiens
gaaggtgatggggg

SEQ ID NO: 297075 - DNA, 23 bp, Homo sapiens
gaaggtgggggttggctgggtac

SEQ ID NO: 297076 - DNA, 15 bp, Homo sapiens
gaaggtgtgctacag

SEQ ID NO: 297077 - DNA, 20 bp, Homo sapiens
gaaggttggaactgctgcca

SEQ ID NO: 297078 - DNA, 15 bp, Homo sapiens
gaaggttgtgatgaa

SEQ ID NO: 297079 - DNA, 21 bp, Homo sapiens
gaaggtttttatgtgcctttt

SEQ ID NO: 297080 - DNA, 23 bp, Homo sapiens
gaagtaaccaactgaacgacaaa

SEQ ID NO: 297081 - DNA, 16 bp, Homo sapiens
gaagtaacttttacaa

SEQ ID NO: 297082 - DNA, 17 bp, Homo sapiens
gaagtaagtggggttgc

SEQ ID NO: 297083 - DNA, 21 bp, Homo sapiens
gaagtacgttattgttgactt

SEQ ID NO: 297084 - DNA, 18 bp, Homo sapiens
gaagtactataatttacc

SEQ ID NO: 297085 - DNA, 15 bp, Homo sapiens
gaagtactggagaaa

SEQ ID NO: 297086 - DNA, 15 bp, Homo sapiens
gaagtactttgtgct

SEQ ID NO: 297087 - DNA, 19 bp, Homo sapiens
gaagtagtttgtataactt

SEQ ID NO: 297088 - DNA, 22 bp, Homo sapiens
gaagtatccaattatgtgacaa

SEQ ID NO: 297089 - DNA, 12 bp, Homo sapiens
gaagtcaaacta

SEQ ID NO: 297090 - DNA, 18 bp, Homo sapiens
gaagtcactcaattgttt

SEQ ID NO: 297091 - DNA, 15 bp, Homo sapiens
gaagtcactgcacag

SEQ ID NO: 297092 - DNA, 20 bp, Homo sapiens
gaagtcagagaaaacacttt

SEQ ID NO: 297093 - DNA, 22 bp, Homo sapiens
gaagtcagcccgaatgcctgtc

SEQ ID NO: 297094 - DNA, 13 bp, Homo sapiens
gaagtcaggagcc

SEQ ID NO: 297095 - DNA, 20 bp, Homo sapiens
gaagtcaggagccagcaggg

SEQ ID NO: 297096 - DNA, 16 bp, Homo sapiens
gaagtcattgtcgctc

SEQ ID NO: 297097 - DNA, 13 bp, Homo sapiens
gaagtccagaacg

SEQ ID NO: 297098 - DNA, 23 bp, Homo sapiens
gaagtcccaatttaagagtcctg

SEQ ID NO: 297099 - DNA, 15 bp, Homo sapiens
gaagtcccttcctgt

SEQ ID NO: 297100 - DNA, 17 bp, Homo sapiens
gaagtctctttttcttc

SEQ ID NO: 297101 - DNA, 23 bp, Homo sapiens
gaagtctctttttttggcccagg

SEQ ID NO: 297102 - DNA, 11 bp, Homo sapiens
gaagtctgata

SEQ ID NO: 297103 - DNA, 16 bp, Homo sapiens
gaagtcttccatcagc

SEQ ID NO: 297104 - DNA, 19 bp, Homo sapiens
gaagtcttccatcagcagt

SEQ ID NO: 297105 - DNA, 21 bp, Homo sapiens
gaagtcttccatcagcagtga

SEQ ID NO: 297106 - DNA, 18 bp, Homo sapiens
gaagtctttgccttctct

SEQ ID NO: 297107 - DNA, 16 bp, Homo sapiens
gaagtcttttctgtca

SEQ ID NO: 297108 - DNA, 24 bp, Homo sapiens
gaagtgacaaggccccagagactc

SEQ ID NO: 297109 - DNA, 14 bp, Homo sapiens
gaagtgacttgaat

SEQ ID NO: 297110 - DNA, 23 bp, Homo sapiens
gaagtgacttgaatgtacaaaga

SEQ ID NO: 297111 - DNA, 15 bp, Homo sapiens
gaagtgaggcctggg

SEQ ID NO: 297112 - DNA, 11 bp, Homo sapiens
gaagtggcccc

SEQ ID NO: 297113 - DNA, 15 bp, Homo sapiens
gaagtggcctgagaa

SEQ ID NO: 297114 - DNA, 17 bp, Homo sapiens
gaagtgggagtgggaga

SEQ ID NO: 297115 - DNA, 23 bp, Homo sapiens
gaagtgggagtgggagaggaagc

SEQ ID NO: 297116 - DNA, 15 bp, Homo sapiens
gaagtgtaacagctg

SEQ ID NO: 297117 - DNA, 16 bp, Homo sapiens
gaagtgtaacagctga

SEQ ID NO: 297118 - DNA, 18 bp, Homo sapiens
gaagtgtaacagctgagg

SEQ ID NO: 297119 - DNA, 20 bp, Homo sapiens
gaagtgtattggtttctgtt

SEQ ID NO: 297120 - DNA, 20 bp, Homo sapiens
gaagtgtccgagaactaaag

SEQ ID NO: 297121 - DNA, 16 bp, Homo sapiens
gaagtgtggggcgggg

SEQ ID NO: 297122 - DNA, 17 bp, Homo sapiens
gaagtgttcaagaaata

SEQ ID NO: 297123 - DNA, 18 bp, Homo sapiens
gaagttccacttaacaca

SEQ ID NO: 297124 - DNA, 13 bp, Homo sapiens
gaagttggacagc

SEQ ID NO: 297125 - DNA, 16 bp, Homo sapiens
gaagttggacagcaaa

SEQ ID NO: 297126 - DNA, 21 bp, Homo sapiens
gaagtttcatttatgatacaa

SEQ ID NO: 297127 - DNA, 19 bp, Homo sapiens
gaagtttgggctaacattt

SEQ ID NO: 297128 - DNA, 17 bp, Homo sapiens
gaagttttgcatttatg

SEQ ID NO: 297129 - DNA, 16 bp, Homo sapiens
gaataaaaaacatttg

SEQ ID NO: 297130 - DNA, 17 bp, Homo sapiens
gaataaaaaacatttgt

SEQ ID NO: 297131 - DNA, 20 bp, Homo sapiens
gaataaaaaacatttgtaca

SEQ ID NO: 297132 - DNA, 20 bp, Homo sapiens
gaataaactccccagcgtat

SEQ ID NO: 297133 - DNA, 16 bp, Homo sapiens
gaataaataaagaaga

SEQ ID NO: 297134 - DNA, 22 bp, Homo sapiens
gaataaataaatgtatcttatt

SEQ ID NO: 297135 - DNA, 16 bp, Homo sapiens
gaataacaacaattta

SEQ ID NO: 297136 - DNA, 12 bp, Homo sapiens
gaataaggcctt

SEQ ID NO: 297137 - DNA, 13 bp, Homo sapiens
gaataagttgatt

SEQ ID NO: 297138 - DNA, 21 bp, Homo sapiens
gaataatgtgggaagaaacaa

SEQ ID NO: 297139 - DNA, 21 bp, Homo sapiens
gaataatttcccaattaggaa

SEQ ID NO: 297140 - DNA, 23 bp, Homo sapiens
gaataatttcccaattaggaagt

SEQ ID NO: 297141 - DNA, 23 bp, Homo sapiens
gaatacagggcatgcattttgca

SEQ ID NO: 297142 - DNA, 22 bp, Homo sapiens
gaataccattaaaactgctttt

SEQ ID NO: 297143 - DNA, 19 bp, Homo sapiens
gaatacctctttgaaagaa

SEQ ID NO: 297144 - DNA, 15 bp, Homo sapiens
gaatacgaacttaaa

SEQ ID NO: 297145 - DNA, 21 bp, Homo sapiens
gaatactcttggtcacctcaa

SEQ ID NO: 297146 - DNA, 19 bp, Homo sapiens
gaatacttaatatgtggga

SEQ ID NO: 297147 - DNA, 15 bp, Homo sapiens
gaatacttcctgaaa

SEQ ID NO: 297148 - DNA, 19 bp, Homo sapiens
gaatacttcctgaaataaa

SEQ ID NO: 297149 - DNA, 13 bp, Homo sapiens
gaatacttgaagt

SEQ ID NO: 297150 - DNA, 20 bp, Homo sapiens
gaatagatcagtatttcact

SEQ ID NO: 297151 - DNA, 15 bp, Homo sapiens
gaatagatgctgact

SEQ ID NO: 297152 - DNA, 19 bp, Homo sapiens
gaatagatgtgatcactga

SEQ ID NO: 297153 - DNA, 18 bp, Homo sapiens
gaatagcatgttgtagat

SEQ ID NO: 297154 - DNA, 15 bp, Homo sapiens
gaatagccagagagg

SEQ ID NO: 297155 - DNA, 18 bp, Homo sapiens
gaatagccagagaggagc

SEQ ID NO: 297156 - DNA, 21 bp, Homo sapiens
gaataggagaaaatgaaaggt

SEQ ID NO: 297157 - DNA, 15 bp, Homo sapiens
gaatagtgcctcagc

SEQ ID NO: 297158 - DNA, 20 bp, Homo sapiens
gaatataaatgtactacatt

SEQ ID NO: 297159 - DNA, 18 bp, Homo sapiens
gaatataagcttaaaata

SEQ ID NO: 297160 - DNA, 13 bp, Homo sapiens
gaatataattatc

SEQ ID NO: 297161 - DNA, 21 bp, Homo sapiens
gaatatacatagtctttgttt

SEQ ID NO: 297162 - DNA, 16 bp, Homo sapiens
gaatatacttagaaaa

SEQ ID NO: 297163 - DNA, 14 bp, Homo sapiens
gaatatctgggatt

SEQ ID NO: 297164 - DNA, 19 bp, Homo sapiens
gaatattataaaaatatca

SEQ ID NO: 297165 - DNA, 22 bp, Homo sapiens
gaatattgctttggtcatatga

SEQ ID NO: 297166 - DNA, 13 bp, Homo sapiens
gaatatttattac

SEQ ID NO: 297167 - DNA, 19 bp, Homo sapiens
gaatatttattacctctga

SEQ ID NO: 297168 - DNA, 14 bp, Homo sapiens
gaatattttatctt

SEQ ID NO: 297169 - DNA, 16 bp, Homo sapiens
gaatcagacctgggtg

SEQ ID NO: 297170 - DNA, 21 bp, Homo sapiens
gaatcagcttttaataaaatt

SEQ ID NO: 297171 - DNA, 22 bp, Homo sapiens
gaatcatggggtggaataaagg

SEQ ID NO: 297172 - DNA, 19 bp, Homo sapiens
gaatcatgtgaacccggga

SEQ ID NO: 297173 - DNA, 13 bp, Homo sapiens
gaatcattattta

SEQ ID NO: 297174 - DNA, 21 bp, Homo sapiens
gaatcattatttattaaattt

SEQ ID NO: 297175 - DNA, 12 bp, Homo sapiens
gaatcattgctt

SEQ ID NO: 297176 - DNA, 14 bp, Homo sapiens
gaatcattgcttat

SEQ ID NO: 297177 - DNA, 13 bp, Homo sapiens
gaatccagctccc

SEQ ID NO: 297178 - DNA, 18 bp, Homo sapiens
gaatccagctccctagac

SEQ ID NO: 297179 - DNA, 18 bp, Homo sapiens
gaatccagtgcttccaca

SEQ ID NO: 297180 - DNA, 14 bp, Homo sapiens
gaatccctgttcat

SEQ ID NO: 297181 - DNA, 18 bp, Homo sapiens
gaatccctgttcattgta

SEQ ID NO: 297182 - DNA, 19 bp, Homo sapiens
gaatcctcagttggaatca

SEQ ID NO: 297183 - DNA, 13 bp, Homo sapiens
gaatcctttgtac

SEQ ID NO: 297184 - DNA, 18 bp, Homo sapiens
gaatcgaggaaccagagc

SEQ ID NO: 297185 - DNA, 16 bp, Homo sapiens
gaatcgcaaggcctgt

SEQ ID NO: 297186 - DNA, 20 bp, Homo sapiens
gaatctcccagacttgtttc

SEQ ID NO: 297187 - DNA, 19 bp, Homo sapiens
gaatctctcaaaatgtgcc

SEQ ID NO: 297188 - DNA, 21 bp, Homo sapiens
gaatctgatcccataaagaaa

SEQ ID NO: 297189 - DNA, 22 bp, Homo sapiens
gaatctgatcccataaagaaag

SEQ ID NO: 297190 - DNA, 12 bp, Homo sapiens
gaatctgcaggg

SEQ ID NO: 297191 - DNA, 19 bp, Homo sapiens
gaatctgcagggagcaact

SEQ ID NO: 297192 - DNA, 19 bp, Homo sapiens
gaatctgtgcagtcatcaa

SEQ ID NO: 297193 - DNA, 20 bp, Homo sapiens
gaatctttccaataaaccag

SEQ ID NO: 297194 - DNA, 12 bp, Homo sapiens
gaatctttgcaa

SEQ ID NO: 297195 - DNA, 23 bp, Homo sapiens
gaatgaaaaatttaagcattgtt

SEQ ID NO: 297196 - DNA, 21 bp, Homo sapiens
gaatgaaagtcttgtgactag

SEQ ID NO: 297197 - DNA, 23 bp, Homo sapiens
gaatgaaagtcttgtgactagtg

SEQ ID NO: 297198 - DNA, 13 bp, Homo sapiens
gaatgaaatataa

SEQ ID NO: 297199 - DNA, 19 bp, Homo sapiens
gaatgaaatataaactgtg

SEQ ID NO: 297200 - DNA, 20 bp, Homo sapiens
gaatgaaatataaactgtga

SEQ ID NO: 297201 - DNA, 23 bp, Homo sapiens
gacagggttttttcatttttgtg

SEQ ID NO: 297202 - DNA, 14 bp, Homo sapiens
gacaggtaaattaa

SEQ ID NO: 297203 - DNA, 16 bp, Homo sapiens
gacagtattctcagtg

SEQ ID NO: 297204 - DNA, 16 bp, Homo sapiens
gacagtcaaggagtgg

SEQ ID NO: 297205 - DNA, 19 bp, Homo sapiens
gacagtcaaggagtggctt

SEQ ID NO: 297206 - DNA, 14 bp, Homo sapiens
gacagtcaggaagc

SEQ ID NO: 297207 - DNA, 19 bp, Homo sapiens
gacagtcaggaagcctcct

SEQ ID NO: 297208 - DNA, 23 bp, Homo sapiens
gacagtctcaagcactaaaaagt

SEQ ID NO: 297209 - DNA, 16 bp, Homo sapiens
gacagtgatctccata

SEQ ID NO: 297210 - DNA, 17 bp, Homo sapiens
gacagtgcctgggaatg

SEQ ID NO: 297211 - DNA, 21 bp, Homo sapiens
gacagtgcctgggaatgtatt

SEQ ID NO: 297212 - DNA, 15 bp, Homo sapiens
gacagtgctgacccc

SEQ ID NO: 297213 - DNA, 14 bp, Homo sapiens
gacagtggcagcaa

SEQ ID NO: 297214 - DNA, 14 bp, Homo sapiens
gacagttaagagaa

SEQ ID NO: 297215 - DNA, 17 bp, Homo sapiens
gacagttactcttcagt

SEQ ID NO: 297216 - DNA, 18 bp, Homo sapiens
gacagttggcagagaagg

SEQ ID NO: 297217 - DNA, 19 bp, Homo sapiens
gacataactgacttagttc

SEQ ID NO: 297218 - DNA, 12 bp, Homo sapiens
gacataatgtag

SEQ ID NO: 297219 - DNA, 22 bp, Homo sapiens
gacataatgtagtgagtgtaga

SEQ ID NO: 297220 - DNA, 22 bp, Homo sapiens
gacatactccttccatcaaata

SEQ ID NO: 297221 - DNA, 18 bp, Homo sapiens
gacatcatgaattttaca

SEQ ID NO: 297222 - DNA, 14 bp, Homo sapiens
gacatccaaatcta

SEQ ID NO: 297223 - DNA, 16 bp, Homo sapiens
gacatccaagcttcct

SEQ ID NO: 297224 - DNA, 22 bp, Homo sapiens
gacatccatgtttgtaaaacta

SEQ ID NO: 297225 - DNA, 23 bp, Homo sapiens
gacatcccaggaggggcctctga

SEQ ID NO: 297226 - DNA, 18 bp, Homo sapiens
gacatccccctccttgcc

SEQ ID NO: 297227 - DNA, 21 bp, Homo sapiens
gacatctgtttctaaatgttt

SEQ ID NO: 297228 - DNA, 22 bp, Homo sapiens
gacatgattccttcctgttctg

SEQ ID NO: 297229 - DNA, 21 bp, Homo sapiens
gacatgatttagggaagcagg

SEQ ID NO: 297230 - DNA, 23 bp, Homo sapiens
gacatgatttagggaagcaggga

SEQ ID NO: 297231 - DNA, 19 bp, Homo sapiens
gacatgccaactcgggagc

SEQ ID NO: 297232 - DNA, 23 bp, Homo sapiens
gacatgcggctgcccacgctcct

SEQ ID NO: 297233 - DNA, 15 bp, Homo sapiens
gacatgctcacctct

SEQ ID NO: 297234 - DNA, 20 bp, Homo sapiens
gacatgctcacctctagcct

SEQ ID NO: 297235 - DNA, 16 bp, Homo sapiens
gacatggacccggagc

SEQ ID NO: 297236 - DNA, 20 bp, Homo sapiens
gacatggagactcctgccct

SEQ ID NO: 297237 - DNA, 16 bp, Homo sapiens
gacatggcaacaaagg

SEQ ID NO: 297238 - DNA, 22 bp, Homo sapiens
gacatgtgcaattgtgagggac

SEQ ID NO: 297239 - DNA, 18 bp, Homo sapiens
gacattaacagttttcca

SEQ ID NO: 297240 - DNA, 23 bp, Homo sapiens
gacattaacagttttccatgaaa

SEQ ID NO: 297241 - DNA, 20 bp, Homo sapiens
gacattccttgtcaccagca

SEQ ID NO: 297242 - DNA, 19 bp, Homo sapiens
gacattgtagagcttctgg

SEQ ID NO: 297243 - DNA, 12 bp, Homo sapiens
gacattgtcaat

SEQ ID NO: 297244 - DNA, 15 bp, Homo sapiens
gacattgtcaataaa

SEQ ID NO: 297245 - DNA, 18 bp, Homo sapiens
gacatttgtcctgcagag

SEQ ID NO: 297246 - DNA, 20 bp, Homo sapiens
gacatttgtcctgcagagct

SEQ ID NO: 297247 - DNA, 18 bp, Homo sapiens
gacattttgtagctagtt

SEQ ID NO: 297248 - DNA, 17 bp, Homo sapiens
gaccaaaatgacaatga

SEQ ID NO: 297249 - DNA, 19 bp, Homo sapiens
gaccaacattcaaaagcac

SEQ ID NO: 297250 - DNA, 18 bp, Homo sapiens
gaccaacccatgccctgc

SEQ ID NO: 297251 - DNA, 13 bp, Homo sapiens
gaccaactgggcc

SEQ ID NO: 297252 - DNA, 13 bp, Homo sapiens
gaccaagaactgc

SEQ ID NO: 297253 - DNA, 23 bp, Homo sapiens
gaccaagcttaaggagaggagag

SEQ ID NO: 297254 - DNA, 17 bp, Homo sapiens
gaccaaggacccctcac

SEQ ID NO: 297255 - DNA, 20 bp, Homo sapiens
gaccaatattatactaagaa

SEQ ID NO: 297256 - DNA, 20 bp, Homo sapiens
gaccacaaggctgaaaagtg

SEQ ID NO: 297257 - DNA, 22 bp, Homo sapiens
gaccacacttcctgtccagaga

SEQ ID NO: 297258 - DNA, 13 bp, Homo sapiens
gaccacagctgct

SEQ ID NO: 297259 - DNA, 21 bp, Homo sapiens
gaccacagggttcaaaatgtc

SEQ ID NO: 297260 - DNA, 19 bp, Homo sapiens
gaccacagtgggtggcacc

SEQ ID NO: 297261 - DNA, 17 bp, Homo sapiens
gaccaccagccccagca

SEQ ID NO: 297262 - DNA, 14 bp, Homo sapiens
gaccacgctttcta

SEQ ID NO: 297263 - DNA, 21 bp, Homo sapiens
gaccacgctttctagctgttg

SEQ ID NO: 297264 - DNA, 21 bp, Homo sapiens
gaccacggacgtttccatcag

SEQ ID NO: 297265 - DNA, 21 bp, Homo sapiens
gaccagaagtgaatgggaaag

SEQ ID NO: 297266 - DNA, 11 bp, Homo sapiens
gaccagagctc

SEQ ID NO: 297267 - DNA, 15 bp, Homo sapiens
gaccagagctgtctg

SEQ ID NO: 297268 - DNA, 20 bp, Homo sapiens
gaccagcaacttgtcttttt

SEQ ID NO: 297269 - DNA, 21 bp, Homo sapiens
gaccagcaccatctctcctcc

SEQ ID NO: 297270 - DNA, 22 bp, Homo sapiens
gaccagcctccatgctgcctcc

SEQ ID NO: 297271 - DNA, 14 bp, Homo sapiens
gaccaggactccct

SEQ ID NO: 297272 - DNA, 15 bp, Homo sapiens
gaccaggagccaggt

SEQ ID NO: 297273 - DNA, 22 bp, Homo sapiens
gaccaggagctagcccagtccc

SEQ ID NO: 297274 - DNA, 12 bp, Homo sapiens
gaccatcctggc

SEQ ID NO: 297275 - DNA, 20 bp, Homo sapiens
gaccatgtgattatggacat

SEQ ID NO: 297276 - DNA, 14 bp, Homo sapiens
gaccattgacctca

SEQ ID NO: 297277 - DNA, 18 bp, Homo sapiens
gaccattgacctcagctg

SEQ ID NO: 297278 - DNA, 22 bp, Homo sapiens
gacccaagtggggcctccttgt

SEQ ID NO: 297279 - DNA, 15 bp, Homo sapiens
gacccaccagtgcct

SEQ ID NO: 297280 - DNA, 15 bp, Homo sapiens
gacccagctactctg

SEQ ID NO: 297281 - DNA, 16 bp, Homo sapiens
gacccagctactctgt

SEQ ID NO: 297282 - DNA, 11 bp, Homo sapiens
gacccaggccc

SEQ ID NO: 297283 - DNA, 13 bp, Homo sapiens
gacccaggccctc

SEQ ID NO: 297284 - DNA, 15 bp, Homo sapiens
gacccaggccctcca

SEQ ID NO: 297285 - DNA, 12 bp, Homo sapiens
gacccagggcag

SEQ ID NO: 297286 - DNA, 23 bp, Homo sapiens
gacccagggcagtgtggtgggag

SEQ ID NO: 297287 - DNA, 20 bp, Homo sapiens
gaccccacccaagcttggca

SEQ ID NO: 297288 - DNA, 18 bp, Homo sapiens
gaccccacttatgctgct

SEQ ID NO: 297289 - DNA, 23 bp, Homo sapiens
gaccccacttatgctgctgtgaa

SEQ ID NO: 297290 - DNA, 13 bp, Homo sapiens
gaccccagaggga

SEQ ID NO: 297291 - DNA, 15 bp, Homo sapiens
gaccccagagtgact

SEQ ID NO: 297292 - DNA, 16 bp, Homo sapiens
gaccccatccagccag

SEQ ID NO: 297293 - DNA, 17 bp, Homo sapiens
gaccccatccagccagg

SEQ ID NO: 297294 - DNA, 20 bp, Homo sapiens
gaccccatccagccaggggt

SEQ ID NO: 297295 - DNA, 21 bp, Homo sapiens
gaccccatccagccaggggtg

SEQ ID NO: 297296 - DNA, 15 bp, Homo sapiens
gaccccatctgctga

SEQ ID NO: 297297 - DNA, 17 bp, Homo sapiens
gaccccatctgctgagc

SEQ ID NO: 297298 - DNA, 21 bp, Homo sapiens
gacccccaaccaagtggctcc

SEQ ID NO: 297299 - DNA, 19 bp, Homo sapiens
gacccccaagcttccacct

SEQ ID NO: 297300 - DNA, 15 bp, Homo sapiens
gacccccacacctca

SEQ ID NO: 297301 - DNA, 16 bp, Homo sapiens
gacccccaccccttcc

SEQ ID NO: 297302 - DNA, 21 bp, Homo sapiens
gacccccggcctccaggctgg

SEQ ID NO: 297303 - DNA, 22 bp, Homo sapiens
gaccccgacgccacagcccagc

SEQ ID NO: 297304 - DNA, 18 bp, Homo sapiens
gacccctaccctttccca

SEQ ID NO: 297305 - DNA, 20 bp, Homo sapiens
gacccctgctcccagcctgc

SEQ ID NO: 297306 - DNA, 21 bp, Homo sapiens
gacccctgctcccagcctgct

SEQ ID NO: 297307 - DNA, 21 bp, Homo sapiens
gacccctggcttttcactgct

SEQ ID NO: 297308 - DNA, 22 bp, Homo sapiens
gacccctggcttttcactgctg

SEQ ID NO: 297309 - DNA, 13 bp, Homo sapiens
gaccccttcctgt

SEQ ID NO: 297310 - DNA, 16 bp, Homo sapiens
gaccccttcctgtctg

SEQ ID NO: 297311 - DNA, 19 bp, Homo sapiens
gaccccttttagtcaggag

SEQ ID NO: 297312 - DNA, 13 bp, Homo sapiens
gacccggaggcca

SEQ ID NO: 297313 - DNA, 15 bp, Homo sapiens
gacccggaggccaca

SEQ ID NO: 297314 - DNA, 17 bp, Homo sapiens
gacccggaggccacatg

SEQ ID NO: 297315 - DNA, 17 bp, Homo sapiens
gacccggaggggcctgg

SEQ ID NO: 297316 - DNA, 22 bp, Homo sapiens
gacccggctgggtcggccctgc

SEQ ID NO: 297317 - DNA, 20 bp, Homo sapiens
gacccgggaccacagctgct

SEQ ID NO: 297318 - DNA, 22 bp, Homo sapiens
gacccgggaccacagctgctgg

SEQ ID NO: 297319 - DNA, 15 bp, Homo sapiens
gacccggggcagctg

SEQ ID NO: 297320 - DNA, 18 bp, Homo sapiens
gaccctcctccactccac

SEQ ID NO: 297321 - DNA, 23 bp, Homo sapiens
gaccctcctccactccacctcca

SEQ ID NO: 297322 - DNA, 16 bp, Homo sapiens
gaccctcggggcagga

SEQ ID NO: 297323 - DNA, 12 bp, Homo sapiens
gaccctctcact

SEQ ID NO: 297324 - DNA, 15 bp, Homo sapiens
gaccctctccacccc

SEQ ID NO: 297325 - DNA, 14 bp, Homo sapiens
gaccctcttctctg

SEQ ID NO: 297326 - DNA, 17 bp, Homo sapiens
gaccctcttctctgggc

SEQ ID NO: 297327 - DNA, 18 bp, Homo sapiens
gaccctcttctctgggcc

SEQ ID NO: 297328 - DNA, 19 bp, Homo sapiens
gaccctgagtccccacctg

SEQ ID NO: 297329 - DNA, 19 bp, Homo sapiens
gaccctgatgcttaataaa

SEQ ID NO: 297330 - DNA, 17 bp, Homo sapiens
gactacaggtattttca

SEQ ID NO: 297331 - DNA, 19 bp, Homo sapiens
gactacctataaatggact

SEQ ID NO: 297332 - DNA, 15 bp, Homo sapiens
gactagaagggccag

SEQ ID NO: 297333 - DNA, 18 bp, Homo sapiens
gactagactactcaatat

SEQ ID NO: 297334 - DNA, 17 bp, Homo sapiens
gactagcctggcttggg

SEQ ID NO: 297335 - DNA, 17 bp, Homo sapiens
gactaggagaccagaag

SEQ ID NO: 297336 - DNA, 14 bp, Homo sapiens
gactaggagcactg

SEQ ID NO: 297337 - DNA, 21 bp, Homo sapiens
gactagggattcaggctgctt

SEQ ID NO: 297338 - DNA, 13 bp, Homo sapiens
gactagtacaaat

SEQ ID NO: 297339 - DNA, 18 bp, Homo sapiens
gactagtgctgaagctta

SEQ ID NO: 297340 - DNA, 23 bp, Homo sapiens
gactagtgctgaagcttattaat

SEQ ID NO: 297341 - DNA, 16 bp, Homo sapiens
gactatagcagggctg

SEQ ID NO: 297342 - DNA, 19 bp, Homo sapiens
gactatatagagatgtttt

SEQ ID NO: 297343 - DNA, 20 bp, Homo sapiens
gactatatagagatgttttt

SEQ ID NO: 297344 - DNA, 23 bp, Homo sapiens
gactatatagagatgtttttaaa

SEQ ID NO: 297345 - DNA, 23 bp, Homo sapiens
gactatttaaacttataaatcat

SEQ ID NO: 297346 - DNA, 19 bp, Homo sapiens
gactcaaatctccagtatt

SEQ ID NO: 297347 - DNA, 17 bp, Homo sapiens
gactcaagtccttacct

SEQ ID NO: 297348 - DNA, 16 bp, Homo sapiens
gactcaagtgtctcag

SEQ ID NO: 297349 - DNA, 10 bp, Homo sapiens
gactcagcca

SEQ ID NO: 297350 - DNA, 11 bp, Homo sapiens
gactcagccct

SEQ ID NO: 297351 - DNA, 17 bp, Homo sapiens
gactcaggatccagtcc

SEQ ID NO: 297352 - DNA, 13 bp, Homo sapiens
gactcaggcccac

SEQ ID NO: 297353 - DNA, 15 bp, Homo sapiens
gactcaggcctgcca

SEQ ID NO: 297354 - DNA, 19 bp, Homo sapiens
gactcagggccatgcctgc

SEQ ID NO: 297355 - DNA, 19 bp, Homo sapiens
gactcaggtggtgtccttc

SEQ ID NO: 297356 - DNA, 20 bp, Homo sapiens
gactcaggtggtgtccttct

SEQ ID NO: 297357 - DNA, 21 bp, Homo sapiens
gactcaggtggtgtccttctt

SEQ ID NO: 297358 - DNA, 20 bp, Homo sapiens
gactcaggttccagaacagc

SEQ ID NO: 297359 - DNA, 15 bp, Homo sapiens
gactcaggttgtctg

SEQ ID NO: 297360 - DNA, 14 bp, Homo sapiens
gactcagtgtattt

SEQ ID NO: 297361 - DNA, 15 bp, Homo sapiens
gactcagtgtatttt

SEQ ID NO: 297362 - DNA, 12 bp, Homo sapiens
gactcagtgttg

SEQ ID NO: 297363 - DNA, 17 bp, Homo sapiens
gactccagaatctgctg

SEQ ID NO: 297364 - DNA, 18 bp, Homo sapiens
gactccagaatctgctgt

SEQ ID NO: 297365 - DNA, 17 bp, Homo sapiens
gactccagagtctgagc

SEQ ID NO: 297366 - DNA, 20 bp, Homo sapiens
gactccaggatcctcctgga

SEQ ID NO: 297367 - DNA, 17 bp, Homo sapiens
gactccaggccagctcc

SEQ ID NO: 297368 - DNA, 15 bp, Homo sapiens
gactccatggccctt

SEQ ID NO: 297369 - DNA, 18 bp, Homo sapiens
gactcccaaagagctgcc

SEQ ID NO: 297370 - DNA, 23 bp, Homo sapiens
gactccccgcccgccctcctctg

SEQ ID NO: 297371 - DNA, 17 bp, Homo sapiens
gactcccgggccacgcc

SEQ ID NO: 297372 - DNA, 10 bp, Homo sapiens
gactccctcc

SEQ ID NO: 297373 - DNA, 19 bp, Homo sapiens
gactccctccatgtggccc

SEQ ID NO: 297374 - DNA, 15 bp, Homo sapiens
gactccctccccacc

SEQ ID NO: 297375 - DNA, 24 bp, Homo sapiens
gactccctcctcacctctggactg

SEQ ID NO: 297376 - DNA, 18 bp, Homo sapiens
gactccgagaagctctcg

SEQ ID NO: 297377 - DNA, 14 bp, Homo sapiens
gactcctcccttcc

SEQ ID NO: 297378 - DNA, 14 bp, Homo sapiens
gactcctgccctgt

SEQ ID NO: 297379 - DNA, 12 bp, Homo sapiens
gactccttctcc

SEQ ID NO: 297380 - DNA, 17 bp, Homo sapiens
gactcgagagggctgag

SEQ ID NO: 297381 - DNA, 24 bp, Homo sapiens
gactcgagagggctgagcccctcc

SEQ ID NO: 297382 - DNA, 19 bp, Homo sapiens
gactcgcagcacccacagc

SEQ ID NO: 297383 - DNA, 20 bp, Homo sapiens
gactcgtctgactgtgtgtg

SEQ ID NO: 297384 - DNA, 14 bp, Homo sapiens
gactctctcctctc

SEQ ID NO: 297385 - DNA, 15 bp, Homo sapiens
gactctctcctctct

SEQ ID NO: 297386 - DNA, 23 bp, Homo sapiens
gactctctttcttccactaccct

SEQ ID NO: 297387 - DNA, 18 bp, Homo sapiens
gactctgagtccactgct

SEQ ID NO: 297388 - DNA, 23 bp, Homo sapiens
gactctgccccttctgtttccat

SEQ ID NO: 297389 - DNA, 22 bp, Homo sapiens
gactctgtaaccacctctctgt

SEQ ID NO: 297390 - DNA, 12 bp, Homo sapiens
gactctgtgctc

SEQ ID NO: 297391 - DNA, 13 bp, Homo sapiens
gactctgtgctca

SEQ ID NO: 297392 - DNA, 14 bp, Homo sapiens
gactctgtgctcac

SEQ ID NO: 297393 - DNA, 17 bp, Homo sapiens
gactctgtgtgagcgtg

SEQ ID NO: 297394 - DNA, 21 bp, Homo sapiens
gactcttactaaccaccattt

SEQ ID NO: 297395 - DNA, 20 bp, Homo sapiens
gactcttccctctcgctccc

SEQ ID NO: 297396 - DNA, 16 bp, Homo sapiens
gactcttgctctttct

SEQ ID NO: 297397 - DNA, 13 bp, Homo sapiens
gactctttgctgt

SEQ ID NO: 297398 - DNA, 14 bp, Homo sapiens
gactgaaagaagaa

SEQ ID NO: 297399 - DNA, 17 bp, Homo sapiens
gactgaaagaagaacag

SEQ ID NO: 297400 - DNA, 20 bp, Homo sapiens
gactgaaagaagaacagctg

SEQ ID NO: 297401 - DNA, 18 bp, Homo sapiens
gactgaaagcagcagcta

SEQ ID NO: 297402 - DNA, 21 bp, Homo sapiens
gactgaaagcagcagctagga

SEQ ID NO: 297403 - DNA, 18 bp, Homo sapiens
gactgaagcgaacatctt

SEQ ID NO: 297404 - DNA, 19 bp, Homo sapiens
gactgaagcgaacatcttc

SEQ ID NO: 297405 - DNA, 21 bp, Homo sapiens
gactgaagcgaacatcttcat

SEQ ID NO: 297406 - DNA, 16 bp, Homo sapiens
gactgaaggggcacac

SEQ ID NO: 297407 - DNA, 24 bp, Homo sapiens
gactgaaggggcacaccactgccc

SEQ ID NO: 297408 - DNA, 15 bp, Homo sapiens
gactgaatttaacta

SEQ ID NO: 297409 - DNA, 17 bp, Homo sapiens
gactgaatttgggcctc

SEQ ID NO: 297410 - DNA, 13 bp, Homo sapiens
gactgacgagaga

SEQ ID NO: 297411 - DNA, 15 bp, Homo sapiens
gactgagaggcagaa

SEQ ID NO: 297412 - DNA, 16 bp, Homo sapiens
gactgaggacaggccc

SEQ ID NO: 297413 - DNA, 22 bp, Homo sapiens
gactgatcctgaacaagaaaga

SEQ ID NO: 297414 - DNA, 17 bp, Homo sapiens
gactgcaacttctgtcc

SEQ ID NO: 297415 - DNA, 21 bp, Homo sapiens
gactgcaacttctgtcccttg

SEQ ID NO: 297416 - DNA, 17 bp, Homo sapiens
gactgcaagtgagcaaa

SEQ ID NO: 297417 - DNA, 21 bp, Homo sapiens
gactgcaagtgagcaaacctg

SEQ ID NO: 297418 - DNA, 12 bp, Homo sapiens
gactgcagagga

SEQ ID NO: 297419 - DNA, 16 bp, Homo sapiens
gactgcagaggagcca

SEQ ID NO: 297420 - DNA, 21 bp, Homo sapiens
gactgcagggacacgggcagc

SEQ ID NO: 297421 - DNA, 22 bp, Homo sapiens
gactgcaggttggaccccagag

SEQ ID NO: 297422 - DNA, 18 bp, Homo sapiens
gactgcccaccctgggcc

SEQ ID NO: 297423 - DNA, 23 bp, Homo sapiens
gactgcccaccctgggcctcccg

SEQ ID NO: 297424 - DNA, 21 bp, Homo sapiens
gactgccccacggccctgtca

SEQ ID NO: 297425 - DNA, 20 bp, Homo sapiens
gactgccgaccgaggctgga

SEQ ID NO: 297426 - DNA, 15 bp, Homo sapiens
gactgcctctgccac

SEQ ID NO: 297427 - DNA, 15 bp, Homo sapiens
gactgctgctcccca

SEQ ID NO: 297428 - DNA, 21 bp, Homo sapiens
gactggagaccgcttcacccc

SEQ ID NO: 297429 - DNA, 23 bp, Homo sapiens
gactggagaccgcttcacccctg

SEQ ID NO: 297430 - DNA, 16 bp, Homo sapiens
gactggagtcagatga

SEQ ID NO: 297431 - DNA, 22 bp, Homo sapiens
gactggagtgaggcttccaggc

SEQ ID NO: 297432 - DNA, 13 bp, Homo sapiens
gactggcagccag

SEQ ID NO: 297433 - DNA, 15 bp, Homo sapiens
gactggcagccaggg

SEQ ID NO: 297434 - DNA, 16 bp, Homo sapiens
gactggcagccaggga

SEQ ID NO: 297435 - DNA, 14 bp, Homo sapiens
gactggcccacccc

SEQ ID NO: 297436 - DNA, 20 bp, Homo sapiens
gactggctagagtcctcact

SEQ ID NO: 297437 - DNA, 21 bp, Homo sapiens
gactggctagagtcctcactc

SEQ ID NO: 297438 - DNA, 16 bp, Homo sapiens
gactggctgcacagcc

SEQ ID NO: 297439 - DNA, 18 bp, Homo sapiens
gactggctgcacagccca

SEQ ID NO: 297440 - DNA, 15 bp, Homo sapiens
gactggctttcctct

SEQ ID NO: 297441 - DNA, 19 bp, Homo sapiens
gactggctttgtcccacag

SEQ ID NO: 297442 - DNA, 20 bp, Homo sapiens
gactggctttgtcccacagc

SEQ ID NO: 297443 - DNA, 21 bp, Homo sapiens
gactggctttgtcccacagct

SEQ ID NO: 297444 - DNA, 23 bp, Homo sapiens
gactgggagtcagagccctggct

SEQ ID NO: 297445 - DNA, 20 bp, Homo sapiens
gactgggatgggaacactgg

SEQ ID NO: 297446 - DNA, 17 bp, Homo sapiens
gactgggcctcccttgg

SEQ ID NO: 297447 - DNA, 16 bp, Homo sapiens
gactgggggcctctgc

SEQ ID NO: 297448 - DNA, 20 bp, Homo sapiens
gactgggggcctctgcctcc

SEQ ID NO: 297449 - DNA, 21 bp, Homo sapiens
gactgtacctgtaggaaacag

SEQ ID NO: 297450 - DNA, 14 bp, Homo sapiens
gactgtataaacaa

SEQ ID NO: 297451 - DNA, 22 bp, Homo sapiens
gactgtattatacatgggtagc

SEQ ID NO: 297452 - DNA, 22 bp, Homo sapiens
gactgtcagataatcggtgcag

SEQ ID NO: 297453 - DNA, 23 bp, Homo sapiens
gactgtctcaagagggcactggt

SEQ ID NO: 297454 - DNA, 20 bp, Homo sapiens
gactgtcttcaaccctgccc

SEQ ID NO: 297455 - DNA, 21 bp, Homo sapiens
gactgtcttcaaccctgccct

SEQ ID NO: 297456 - DNA, 15 bp, Homo sapiens
gactgtcttgagaaa

SEQ ID NO: 297457 - DNA, 13 bp, Homo sapiens
gactgtctttcag

SEQ ID NO: 297458 - DNA, 15 bp, Homo sapiens
gactgtgaattttgg

SEQ ID NO: 297459 - DNA, 13 bp, Homo sapiens
gagaattaaaata

SEQ ID NO: 297460 - DNA, 16 bp, Homo sapiens
gagaattcagctgccc

SEQ ID NO: 297461 - DNA, 18 bp, Homo sapiens
gagaatttaatttttaaa

SEQ ID NO: 297462 - DNA, 23 bp, Homo sapiens
gagaatttaatttttaaaagact

SEQ ID NO: 297463 - DNA, 15 bp, Homo sapiens
gagacaaaaattatc

SEQ ID NO: 297464 - DNA, 13 bp, Homo sapiens
gagacaaatcttt

SEQ ID NO: 297465 - DNA, 15 bp, Homo sapiens
gagacaaatctttaa

SEQ ID NO: 297466 - DNA, 14 bp, Homo sapiens
gagacaacacacac

SEQ ID NO: 297467 - DNA, 22 bp, Homo sapiens
gagacaacacacacacacacaa

SEQ ID NO: 297468 - DNA, 13 bp, Homo sapiens
gagacaagccctg

SEQ ID NO: 297469 - DNA, 19 bp, Homo sapiens
gagacaagccctggcaaca

SEQ ID NO: 297470 - DNA, 18 bp, Homo sapiens
gagacaaggagggcacag

SEQ ID NO: 297471 - DNA, 14 bp, Homo sapiens
gagacaataaaaca

SEQ ID NO: 297472 - DNA, 17 bp, Homo sapiens
gagacaatgcagatgcc

SEQ ID NO: 297473 - DNA, 13 bp, Homo sapiens
gagacaattacaa

SEQ ID NO: 297474 - DNA, 21 bp, Homo sapiens
gagacaccctaactcttgctc

SEQ ID NO: 297475 - DNA, 15 bp, Homo sapiens
gagacagaagcaggc

SEQ ID NO: 297476 - DNA, 20 bp, Homo sapiens
gagacagacagagaaggcag

SEQ ID NO: 297477 - DNA, 17 bp, Homo sapiens
gagacagagtctcgctc

SEQ ID NO: 297478 - DNA, 12 bp, Homo sapiens
gagacagcaagt

SEQ ID NO: 297479 - DNA, 21 bp, Homo sapiens
gagacagcgcgagtagcaccc

SEQ ID NO: 297480 - DNA, 15 bp, Homo sapiens
gagacagtcaggaag

SEQ ID NO: 297481 - DNA, 16 bp, Homo sapiens
gagacagtcaggaagc

SEQ ID NO: 297482 - DNA, 23 bp, Homo sapiens
gagacagttgggtgagaacaacc

SEQ ID NO: 297483 - DNA, 18 bp, Homo sapiens
gagacattccaaaacgaa

SEQ ID NO: 297484 - DNA, 15 bp, Homo sapiens
gagaccaggactctg

SEQ ID NO: 297485 - DNA, 19 bp, Homo sapiens
gagaccaggactctgcctt

SEQ ID NO: 297486 - DNA, 23 bp, Homo sapiens
gagaccagttgaataaaagtgca

SEQ ID NO: 297487 - DNA, 20 bp, Homo sapiens
gagaccagttgggagcactg

SEQ ID NO: 297488 - DNA, 23 bp, Homo sapiens
gagaccagttgggagcactggag

SEQ ID NO: 297489 - DNA, 13 bp, Homo sapiens
gagacccccacac

SEQ ID NO: 297490 - DNA, 20 bp, Homo sapiens
gagaccctgccaactttcca

SEQ ID NO: 297491 - DNA, 18 bp, Homo sapiens
gagaccctggaattcagc

SEQ ID NO: 297492 - DNA, 19 bp, Homo sapiens
gagacccttgcattagaaa

SEQ ID NO: 297493 - DNA, 23 bp, Homo sapiens
gagaccgagtgtggagctgcttc

SEQ ID NO: 297494 - DNA, 20 bp, Homo sapiens
gagaccgcttcacccctgca

SEQ ID NO: 297495 - DNA, 17 bp, Homo sapiens
gagaccggaattgagag

SEQ ID NO: 297496 - DNA, 18 bp, Homo sapiens
gagacctcagatgtgttg

SEQ ID NO: 297497 - DNA, 11 bp, Homo sapiens
gagacctcatc

SEQ ID NO: 297498 - DNA, 16 bp, Homo sapiens
gagacctgaggcagat

SEQ ID NO: 297499 - DNA, 17 bp, Homo sapiens
gagacgaggcaggggct

SEQ ID NO: 297500 - DNA, 17 bp, Homo sapiens
gagacggatggaaggag

SEQ ID NO: 297501 - DNA, 19 bp, Homo sapiens
gagacggatggaaggagag

SEQ ID NO: 297502 - DNA, 14 bp, Homo sapiens
gagacggcagcccc

SEQ ID NO: 297503 - DNA, 16 bp, Homo sapiens
gagacggtcatgcaag

SEQ ID NO: 297504 - DNA, 15 bp, Homo sapiens
gagacgtccaccctg

SEQ ID NO: 297505 - DNA, 22 bp, Homo sapiens
gagactaagccctgtcgagaca

SEQ ID NO: 297506 - DNA, 22 bp, Homo sapiens
gagactatttaaacttataaat

SEQ ID NO: 297507 - DNA, 14 bp, Homo sapiens
gagactcagacagg

SEQ ID NO: 297508 - DNA, 12 bp, Homo sapiens
gagactcaggcc

SEQ ID NO: 297509 - DNA, 13 bp, Homo sapiens
gagactcaggccc

SEQ ID NO: 297510 - DNA, 19 bp, Homo sapiens
gagactccagaatctgctg

SEQ ID NO: 297511 - DNA, 13 bp, Homo sapiens
gagactccatctt

SEQ ID NO: 297512 - DNA, 16 bp, Homo sapiens
gagactccatgagaag

SEQ ID NO: 297513 - DNA, 15 bp, Homo sapiens
gagactcccaggagt

SEQ ID NO: 297514 - DNA, 15 bp, Homo sapiens
gagactctgaggtgt

SEQ ID NO: 297515 - DNA, 17 bp, Homo sapiens
gagactgaaagcagcag

SEQ ID NO: 297516 - DNA, 22 bp, Homo sapiens
gagactgataacttggggaggc

SEQ ID NO: 297517 - DNA, 11 bp, Homo sapiens
gagactgccca

SEQ ID NO: 297518 - DNA, 14 bp, Homo sapiens
gagactgcccaccc

SEQ ID NO: 297519 - DNA, 22 bp, Homo sapiens
gagactgccccacggccctgtc

SEQ ID NO: 297520 - DNA, 15 bp, Homo sapiens
gagactggcagccag

SEQ ID NO: 297521 - DNA, 17 bp, Homo sapiens
gagactggcagccaggg

SEQ ID NO: 297522 - DNA, 19 bp, Homo sapiens
gagactggcagccagggag

SEQ ID NO: 297523 - DNA, 19 bp, Homo sapiens
gagactgtccacttctagc

SEQ ID NO: 297524 - DNA, 17 bp, Homo sapiens
gagactgtcggagaggc

SEQ ID NO: 297525 - DNA, 17 bp, Homo sapiens
gagactgtgaggcggca

SEQ ID NO: 297526 - DNA, 15 bp, Homo sapiens
gagacttccgtcacc

SEQ ID NO: 297527 - DNA, 23 bp, Homo sapiens
gagacttgtacagttgactggct

SEQ ID NO: 297528 - DNA, 11 bp, Homo sapiens
gagacttgttt

SEQ ID NO: 297529 - DNA, 16 bp, Homo sapiens
gagactttctgatgca

SEQ ID NO: 297530 - DNA, 14 bp, Homo sapiens
gagactttgcccag

SEQ ID NO: 297531 - DNA, 20 bp, Homo sapiens
gagagaaaaagagagagcag

SEQ ID NO: 297532 - DNA, 18 bp, Homo sapiens
gagagaaaacagacctaa

SEQ ID NO: 297533 - DNA, 15 bp, Homo sapiens
gagagaagcacccca

SEQ ID NO: 297534 - DNA, 18 bp, Homo sapiens
gagagaagtgcccctgct

SEQ ID NO: 297535 - DNA, 17 bp, Homo sapiens
gagagaatcagacctgg

SEQ ID NO: 297536 - DNA, 14 bp, Homo sapiens
gagagaatctgcct

SEQ ID NO: 297537 - DNA, 16 bp, Homo sapiens
gagagaccagcctttc

SEQ ID NO: 297538 - DNA, 14 bp, Homo sapiens
gagagaccctcact

SEQ ID NO: 297539 - DNA, 15 bp, Homo sapiens
gagagaccctgccaa

SEQ ID NO: 297540 - DNA, 17 bp, Homo sapiens
gagagacctcatcagga

SEQ ID NO: 297541 - DNA, 16 bp, Homo sapiens
gagagactgaaagcag

SEQ ID NO: 297542 - DNA, 17 bp, Homo sapiens
gagagactgaaagcagc

SEQ ID NO: 297543 - DNA, 19 bp, Homo sapiens
gagagactgaaagcagcag

SEQ ID NO: 297544 - DNA, 14 bp, Homo sapiens
gagagagaaagaat

SEQ ID NO: 297545 - DNA, 14 bp, Homo sapiens
gagagagaatcaga

SEQ ID NO: 297546 - DNA, 13 bp, Homo sapiens
gagagagagagcg

SEQ ID NO: 297547 - DNA, 12 bp, Homo sapiens
gagagagagcct

SEQ ID NO: 297548 - DNA, 17 bp, Homo sapiens
gagagagatgctgctcc

SEQ ID NO: 297549 - DNA, 14 bp, Homo sapiens
gagagagcaatctt

SEQ ID NO: 297550 - DNA, 11 bp, Homo sapiens
gagagagcctt

SEQ ID NO: 297551 - DNA, 20 bp, Homo sapiens
gagagagcgcgggagagagt

SEQ ID NO: 297552 - DNA, 16 bp, Homo sapiens
gagagagtgagagaga

SEQ ID NO: 297553 - DNA, 18 bp, Homo sapiens
gagagcacaaagataacg

SEQ ID NO: 297554 - DNA, 13 bp, Homo sapiens
gagagcagctggc

SEQ ID NO: 297555 - DNA, 14 bp, Homo sapiens
gagagcagctggct

SEQ ID NO: 297556 - DNA, 19 bp, Homo sapiens
gagagcagctggctctcca

SEQ ID NO: 297557 - DNA, 21 bp, Homo sapiens
gagagcaggctggcagctctc

SEQ ID NO: 297558 - DNA, 15 bp, Homo sapiens
gagagcatctgctct

SEQ ID NO: 297559 - DNA, 18 bp, Homo sapiens
gagagcatctgctctgag

SEQ ID NO: 297560 - DNA, 19 bp, Homo sapiens
gagagcatgtgggggaagg

SEQ ID NO: 297561 - DNA, 14 bp, Homo sapiens
gagagccccagctg

SEQ ID NO: 297562 - DNA, 14 bp, Homo sapiens
gagagcccccacca

SEQ ID NO: 297563 - DNA, 18 bp, Homo sapiens
gagagcccccaccagcag

SEQ ID NO: 297564 - DNA, 15 bp, Homo sapiens
gagagcccctggggc

SEQ ID NO: 297565 - DNA, 14 bp, Homo sapiens
gagagcctcttagt

SEQ ID NO: 297566 - DNA, 11 bp, Homo sapiens
gagagcctgcc

SEQ ID NO: 297567 - DNA, 13 bp, Homo sapiens
gagagcctgctgc

SEQ ID NO: 297568 - DNA, 18 bp, Homo sapiens
gagagccttaatggatgc

SEQ ID NO: 297569 - DNA, 20 bp, Homo sapiens
gagagcctttggtgaataac

SEQ ID NO: 297570 - DNA, 15 bp, Homo sapiens
gagagctgaagtact

SEQ ID NO: 297571 - DNA, 12 bp, Homo sapiens
gagagctgctga

SEQ ID NO: 297572 - DNA, 19 bp, Homo sapiens
gagagctgctgagggacct

SEQ ID NO: 297573 - DNA, 22 bp, Homo sapiens
gagaggaactccttggcctagc

SEQ ID NO: 297574 - DNA, 22 bp, Homo sapiens
gagaggagcgggacctgtggct

SEQ ID NO: 297575 - DNA, 13 bp, Homo sapiens
gagaggaggcagc

SEQ ID NO: 297576 - DNA, 13 bp, Homo sapiens
gagaggagggttc

SEQ ID NO: 297577 - DNA, 22 bp, Homo sapiens
gagaggaggtgtggagtggagg

SEQ ID NO: 297578 - DNA, 17 bp, Homo sapiens
gagaggagttcaatgat

SEQ ID NO: 297579 - DNA, 19 bp, Homo sapiens
gagaggagttcaatgatct

SEQ ID NO: 297580 - DNA, 21 bp, Homo sapiens
gagaggatgaatgtatgtgca

SEQ ID NO: 297581 - DNA, 16 bp, Homo sapiens
gagaggcacctgctgg

SEQ ID NO: 297582 - DNA, 17 bp, Homo sapiens
gagaggcatgacagctg

SEQ ID NO: 297583 - DNA, 16 bp, Homo sapiens
gagaggcgcgtctgcc

SEQ ID NO: 297584 - DNA, 19 bp, Homo sapiens
gagaggcgtcctggtgagg

SEQ ID NO: 297585 - DNA, 21 bp, Homo sapiens
gagaggctctgaaagctgctt

SEQ ID NO: 297586 - DNA, 19 bp, Homo sapiens
gagagggacagcccactga

SEQ ID NO: 297587 - DNA, 21 bp, Homo sapiens
gagagggagtacaaagacagg

SEQ ID NO: 297588 - DNA, 22 bp, Homo sapiens
gagagggagtacaaagacaggg

SEQ ID NO: 297589 - DNA, 17 bp, Homo sapiens
gagagggcccagctgta

SEQ ID NO: 297590 - DNA, 20 bp, Homo sapiens
gagccggtttgggagagacc

SEQ ID NO: 297591 - DNA, 13 bp, Homo sapiens
gagccgttcctgg

SEQ ID NO: 297592 - DNA, 15 bp, Homo sapiens
gagcctactgtctcc

SEQ ID NO: 297593 - DNA, 21 bp, Homo sapiens
gagcctactgtctccttccca

SEQ ID NO: 297594 - DNA, 23 bp, Homo sapiens
gagcctatggaaagggtgtggct

SEQ ID NO: 297595 - DNA, 12 bp, Homo sapiens
gagcctcagact

SEQ ID NO: 297596 - DNA, 21 bp, Homo sapiens
gagcctcgcccctccagtgtt

SEQ ID NO: 297597 - DNA, 13 bp, Homo sapiens
gagcctgaggcag

SEQ ID NO: 297598 - DNA, 16 bp, Homo sapiens
gagcctgaggcaggag

SEQ ID NO: 297599 - DNA, 17 bp, Homo sapiens
gagcctgaggcaggaga

SEQ ID NO: 297600 - DNA, 17 bp, Homo sapiens
gagcctgagtcagggcc

SEQ ID NO: 297601 - DNA, 21 bp, Homo sapiens
gagcctgcaaactcactgctc

SEQ ID NO: 297602 - DNA, 18 bp, Homo sapiens
gagcctgcccggccggag

SEQ ID NO: 297603 - DNA, 16 bp, Homo sapiens
gagcctgcggctgctg

SEQ ID NO: 297604 - DNA, 14 bp, Homo sapiens
gagcctggagcccc

SEQ ID NO: 297605 - DNA, 22 bp, Homo sapiens
gagcctggagtcggatctagcc

SEQ ID NO: 297606 - DNA, 17 bp, Homo sapiens
gagcctggtgctgctgc

SEQ ID NO: 297607 - DNA, 16 bp, Homo sapiens
gagcctgtccccgcct

SEQ ID NO: 297608 - DNA, 15 bp, Homo sapiens
gagcctgtctctccc

SEQ ID NO: 297609 - DNA, 16 bp, Homo sapiens
gagcctgtctctccct

SEQ ID NO: 297610 - DNA, 20 bp, Homo sapiens
gagcctgtgttagtgtctgt

SEQ ID NO: 297611 - DNA, 18 bp, Homo sapiens
gagccttaatggatgctc

SEQ ID NO: 297612 - DNA, 16 bp, Homo sapiens
gagccttttattaaca

SEQ ID NO: 297613 - DNA, 14 bp, Homo sapiens
gagcgacggctcct

SEQ ID NO: 297614 - DNA, 17 bp, Homo sapiens
gagcgacggctcctccc

SEQ ID NO: 297615 - DNA, 22 bp, Homo sapiens
gagcgacggctcctccccgatc

SEQ ID NO: 297616 - DNA, 12 bp, Homo sapiens
gagcgcaagata

SEQ ID NO: 297617 - DNA, 16 bp, Homo sapiens
gagcgccacccgcccg

SEQ ID NO: 297618 - DNA, 23 bp, Homo sapiens
gagcgccacccgcccgcccccgc

SEQ ID NO: 297619 - DNA, 21 bp, Homo sapiens
gagcgccccgcccccacccct

SEQ ID NO: 297620 - DNA, 17 bp, Homo sapiens
gagcgcgtgccttcccc

SEQ ID NO: 297621 - DNA, 16 bp, Homo sapiens
gagcggcgatgcactc

SEQ ID NO: 297622 - DNA, 13 bp, Homo sapiens
gagcggctgagga

SEQ ID NO: 297623 - DNA, 15 bp, Homo sapiens
gagcggctgaggacg

SEQ ID NO: 297624 - DNA, 16 bp, Homo sapiens
gagcgggacctgtggc

SEQ ID NO: 297625 - DNA, 15 bp, Homo sapiens
gagcgggcagggccg

SEQ ID NO: 297626 - DNA, 20 bp, Homo sapiens
gagcgggggctaactggccc

SEQ ID NO: 297627 - DNA, 14 bp, Homo sapiens
gagcgtgattctgt

SEQ ID NO: 297628 - DNA, 14 bp, Homo sapiens
gagcgtgtccacag

SEQ ID NO: 297629 - DNA, 17 bp, Homo sapiens
gagcgtgtccacagagt

SEQ ID NO: 297630 - DNA, 14 bp, Homo sapiens
gagctaacactggc

SEQ ID NO: 297631 - DNA, 14 bp, Homo sapiens
gagctaataaatct

SEQ ID NO: 297632 - DNA, 15 bp, Homo sapiens
gagctactctcttgc

SEQ ID NO: 297633 - DNA, 19 bp, Homo sapiens
gagctactctcttgccagc

SEQ ID NO: 297634 - DNA, 20 bp, Homo sapiens
gagctactctcttgccagca

SEQ ID NO: 297635 - DNA, 18 bp, Homo sapiens
gagctagagaggggcctc

SEQ ID NO: 297636 - DNA, 19 bp, Homo sapiens
gagctagagaggggcctct

SEQ ID NO: 297637 - DNA, 23 bp, Homo sapiens
gagctagagaggggcctctggct

SEQ ID NO: 297638 - DNA, 17 bp, Homo sapiens
gagctatgcacaccaaa

SEQ ID NO: 297639 - DNA, 18 bp, Homo sapiens
gagctatttccattccag

SEQ ID NO: 297640 - DNA, 20 bp, Homo sapiens
gagctatttccattccagaa

SEQ ID NO: 297641 - DNA, 14 bp, Homo sapiens
gagctcagcacagc

SEQ ID NO: 297642 - DNA, 18 bp, Homo sapiens
gagctcaggagaaggcct

SEQ ID NO: 297643 - DNA, 15 bp, Homo sapiens
gagctcaggatggct

SEQ ID NO: 297644 - DNA, 13 bp, Homo sapiens
gagctccaccctc

SEQ ID NO: 297645 - DNA, 15 bp, Homo sapiens
gagctccagaccccc

SEQ ID NO: 297646 - DNA, 20 bp, Homo sapiens
gagctccagacccccagcaa

SEQ ID NO: 297647 - DNA, 23 bp, Homo sapiens
gagctccccaatccaacccatgc

SEQ ID NO: 297648 - DNA, 19 bp, Homo sapiens
gagctccccaccaccccag

SEQ ID NO: 297649 - DNA, 22 bp, Homo sapiens
gagctccccaccaccccagctg

SEQ ID NO: 297650 - DNA, 15 bp, Homo sapiens
gagctccgatgcccg

SEQ ID NO: 297651 - DNA, 14 bp, Homo sapiens
gagctcctctgggc

SEQ ID NO: 297652 - DNA, 16 bp, Homo sapiens
gagctcgccattcact

SEQ ID NO: 297653 - DNA, 18 bp, Homo sapiens
gagctcgtgtatcctggg

SEQ ID NO: 297654 - DNA, 16 bp, Homo sapiens
gagctctcctgggcca

SEQ ID NO: 297655 - DNA, 22 bp, Homo sapiens
gagctctcctgggccagggtct

SEQ ID NO: 297656 - DNA, 13 bp, Homo sapiens
gagctctggagcc

SEQ ID NO: 297657 - DNA, 20 bp, Homo sapiens
gagctctggagccacctgtc

SEQ ID NO: 297658 - DNA, 15 bp, Homo sapiens
gagctctgtcctctg

SEQ ID NO: 297659 - DNA, 20 bp, Homo sapiens
gagctcttcaagctgtcccc

SEQ ID NO: 297660 - DNA, 17 bp, Homo sapiens
gagctcttcaggcctcc

SEQ ID NO: 297661 - DNA, 18 bp, Homo sapiens
gagctcttcttgtgaaat

SEQ ID NO: 297662 - DNA, 23 bp, Homo sapiens
gagctctttgtctcaccagctca

SEQ ID NO: 297663 - DNA, 18 bp, Homo sapiens
gagctgaaagggagcccc

SEQ ID NO: 297664 - DNA, 19 bp, Homo sapiens
gagctgaaagggagcccct

SEQ ID NO: 297665 - DNA, 13 bp, Homo sapiens
gagctgacaaaat

SEQ ID NO: 297666 - DNA, 16 bp, Homo sapiens
gagctgacaaaatttt

SEQ ID NO: 297667 - DNA, 10 bp, Homo sapiens
gagctgagat

SEQ ID NO: 297668 - DNA, 13 bp, Homo sapiens
gagctgagatgga

SEQ ID NO: 297669 - DNA, 22 bp, Homo sapiens
gagctgagtactcaggccactc

SEQ ID NO: 297670 - DNA, 17 bp, Homo sapiens
gagctgagtcggctggg

SEQ ID NO: 297671 - DNA, 13 bp, Homo sapiens
gagctgatccaga

SEQ ID NO: 297672 - DNA, 20 bp, Homo sapiens
gagctgatccagagcacaga

SEQ ID NO: 297673 - DNA, 21 bp, Homo sapiens
gagctgatgaaactcacaaat

SEQ ID NO: 297674 - DNA, 17 bp, Homo sapiens
gagctgatttccaggcc

SEQ ID NO: 297675 - DNA, 19 bp, Homo sapiens
gagctgatttccaggcccc

SEQ ID NO: 297676 - DNA, 16 bp, Homo sapiens
gagctgcagcccccca

SEQ ID NO: 297677 - DNA, 17 bp, Homo sapiens
gagctgcagttgtgaaa

SEQ ID NO: 297678 - DNA, 17 bp, Homo sapiens
gagctgcatggacgcct

SEQ ID NO: 297679 - DNA, 23 bp, Homo sapiens
gagctgcatggacgcctggctcc

SEQ ID NO: 297680 - DNA, 17 bp, Homo sapiens
gagctgcctaagaggca

SEQ ID NO: 297681 - DNA, 19 bp, Homo sapiens
gagctgcctaagaggcaat

SEQ ID NO: 297682 - DNA, 23 bp, Homo sapiens
gagctgcctgctctgcagcccac

SEQ ID NO: 297683 - DNA, 14 bp, Homo sapiens
gagctgctcagaat

SEQ ID NO: 297684 - DNA, 13 bp, Homo sapiens
gagctgctctgct

SEQ ID NO: 297685 - DNA, 22 bp, Homo sapiens
gagctggaaaggatgcttctgc

SEQ ID NO: 297686 - DNA, 16 bp, Homo sapiens
gagctggcgtctgtct

SEQ ID NO: 297687 - DNA, 18 bp, Homo sapiens
gagctggctggcaggtgt

SEQ ID NO: 297688 - DNA, 19 bp, Homo sapiens
gagctgggaagctgtactc

SEQ ID NO: 297689 - DNA, 14 bp, Homo sapiens
gagctgggcatggt

SEQ ID NO: 297690 - DNA, 22 bp, Homo sapiens
gagctggggaatcccctcgctt

SEQ ID NO: 297691 - DNA, 21 bp, Homo sapiens
gagctggggagggagagatct

SEQ ID NO: 297692 - DNA, 24 bp, Homo sapiens
gagctgggggccatgagctccaga

SEQ ID NO: 297693 - DNA, 11 bp, Homo sapiens
gagctggtgca

SEQ ID NO: 297694 - DNA, 18 bp, Homo sapiens
gagctggtgcattacaga

SEQ ID NO: 297695 - DNA, 17 bp, Homo sapiens
gagctggtgcccggaga

SEQ ID NO: 297696 - DNA, 22 bp, Homo sapiens
gagctgtataactgtgcagaga

SEQ ID NO: 297697 - DNA, 18 bp, Homo sapiens
gagctgtttatggcctca

SEQ ID NO: 297698 - DNA, 19 bp, Homo sapiens
gagctgtttatggcctcag

SEQ ID NO: 297699 - DNA, 16 bp, Homo sapiens
gagcttacctcccacc

SEQ ID NO: 297700 - DNA, 17 bp, Homo sapiens
gagcttagccaatgtgg

SEQ ID NO: 297701 - DNA, 14 bp, Homo sapiens
gagcttagccttgt

SEQ ID NO: 297702 - DNA, 17 bp, Homo sapiens
gagcttagccttgtgcc

SEQ ID NO: 297703 - DNA, 19 bp, Homo sapiens
gagcttagccttgtgccct

SEQ ID NO: 297704 - DNA, 20 bp, Homo sapiens
gagcttctacagattttaga

SEQ ID NO: 297705 - DNA, 14 bp, Homo sapiens
gagcttctctgtga

SEQ ID NO: 297706 - DNA, 14 bp, Homo sapiens
gagcttctggcact

SEQ ID NO: 297707 - DNA, 18 bp, Homo sapiens
gagcttgattctaaaggg

SEQ ID NO: 297708 - DNA, 22 bp, Homo sapiens
gagcttgattctaaaggggaca

SEQ ID NO: 297709 - DNA, 16 bp, Homo sapiens
gagctttagcttctct

SEQ ID NO: 297710 - DNA, 23 bp, Homo sapiens
gagctttccggggaggagccttg

SEQ ID NO: 297711 - DNA, 21 bp, Homo sapiens
gagctttctgtccttttggca

SEQ ID NO: 297712 - DNA, 18 bp, Homo sapiens
gagcttttttctttaaga

SEQ ID NO: 297713 - DNA, 21 bp, Homo sapiens
gaggaaaaccaagccgtggct

SEQ ID NO: 297714 - DNA, 21 bp, Homo sapiens
gaggaaaagtaaggtgcagtt

SEQ ID NO: 297715 - DNA, 17 bp, Homo sapiens
gaggaaactcacctgct

SEQ ID NO: 297716 - DNA, 16 bp, Homo sapiens
gaggaacaaggcaagg

SEQ ID NO: 297717 - DNA, 18 bp, Homo sapiens
gaggaaccagagccatgg

SEQ ID NO: 297718 - DNA, 23 bp, Homo sapiens
gaggaactggtccaggccaggcc

SEQ ID NO: 297719 - DNA, 23 bp, Homo sapiens
gaggaacttgctgctgtgcctgc

SEQ ID NO: 297720 - DNA, 17 bp, Homo sapiens
gaggtggtagctctgag

SEQ ID NO: 297721 - DNA, 21 bp, Homo sapiens
gaggtggtagctctgagccct

SEQ ID NO: 297722 - DNA, 19 bp, Homo sapiens
gaggtggtctgaatgttct

SEQ ID NO: 297723 - DNA, 18 bp, Homo sapiens
gaggtgtcaccctgcaga

SEQ ID NO: 297724 - DNA, 19 bp, Homo sapiens
gaggtgtggagtggagggg

SEQ ID NO: 297725 - DNA, 21 bp, Homo sapiens
gaggttaaaatataaattaag

SEQ ID NO: 297726 - DNA, 21 bp, Homo sapiens
gaggttaaggtgggtccagga

SEQ ID NO: 297727 - DNA, 22 bp, Homo sapiens
gaggttagttctgtgtgtctgg

SEQ ID NO: 297728 - DNA, 13 bp, Homo sapiens
gaggttataggtc

SEQ ID NO: 297729 - DNA, 14 bp, Homo sapiens
gaggttatctgcct

SEQ ID NO: 297730 - DNA, 23 bp, Homo sapiens
gaggttatctgcctggcctggct

SEQ ID NO: 297731 - DNA, 15 bp, Homo sapiens
gaggttcagcaaggt

SEQ ID NO: 297732 - DNA, 14 bp, Homo sapiens
gaggttcatttttc

SEQ ID NO: 297733 - DNA, 14 bp, Homo sapiens
gaggttcccagggc

SEQ ID NO: 297734 - DNA, 16 bp, Homo sapiens
gaggttctcagagcca

SEQ ID NO: 297735 - DNA, 15 bp, Homo sapiens
gaggttctcagcaag

SEQ ID NO: 297736 - DNA, 16 bp, Homo sapiens
gaggttctcagcaagt

SEQ ID NO: 297737 - DNA, 17 bp, Homo sapiens
gaggttctcagcaagtg

SEQ ID NO: 297738 - DNA, 20 bp, Homo sapiens
gaggttctcagcaagtgtac

SEQ ID NO: 297739 - DNA, 23 bp, Homo sapiens
gaggttctcagcaagtgtacagt

SEQ ID NO: 297740 - DNA, 14 bp, Homo sapiens
gaggttgagtgagc

SEQ ID NO: 297741 - DNA, 20 bp, Homo sapiens
gaggttgccgtgagccaaga

SEQ ID NO: 297742 - DNA, 13 bp, Homo sapiens
gagtaacactgag

SEQ ID NO: 297743 - DNA, 14 bp, Homo sapiens
gagtactatattta

SEQ ID NO: 297744 - DNA, 19 bp, Homo sapiens
gagtactcacttttcactt

SEQ ID NO: 297745 - DNA, 15 bp, Homo sapiens
gagtagacctgagat

SEQ ID NO: 297746 - DNA, 15 bp, Homo sapiens
gagtaggtgggtctt

SEQ ID NO: 297747 - DNA, 17 bp, Homo sapiens
gagtatcaaaggcagaa

SEQ ID NO: 297748 - DNA, 23 bp, Homo sapiens
gagtatctcggacctttcagctg

SEQ ID NO: 297749 - DNA, 18 bp, Homo sapiens
gagtatctttaaatataa

SEQ ID NO: 297750 - DNA, 14 bp, Homo sapiens
gagtatttgctgtt

SEQ ID NO: 297751 - DNA, 15 bp, Homo sapiens
gagtcaatgtgcagt

SEQ ID NO: 297752 - DNA, 19 bp, Homo sapiens
gagtcacagctttcccagg

SEQ ID NO: 297753 - DNA, 12 bp, Homo sapiens
gagtcacctcct

SEQ ID NO: 297754 - DNA, 12 bp, Homo sapiens
gagtcacctgca

SEQ ID NO: 297755 - DNA, 22 bp, Homo sapiens
gagtcacctgcaagccccaggg

SEQ ID NO: 297756 - DNA, 23 bp, Homo sapiens
gagtcacctgcaagccccagggc

SEQ ID NO: 297757 - DNA, 18 bp, Homo sapiens
gagtcaccttccaggacc

SEQ ID NO: 297758 - DNA, 23 bp, Homo sapiens
gagtcaccttccaggacccctgg

SEQ ID NO: 297759 - DNA, 12 bp, Homo sapiens
gagtcagagccc

SEQ ID NO: 297760 - DNA, 17 bp, Homo sapiens
gagtcagagccctggct

SEQ ID NO: 297761 - DNA, 19 bp, Homo sapiens
gagtcagatgagcaaggac

SEQ ID NO: 297762 - DNA, 20 bp, Homo sapiens
gagtccactttcctctctct

SEQ ID NO: 297763 - DNA, 13 bp, Homo sapiens
gagtccagacctg

SEQ ID NO: 297764 - DNA, 21 bp, Homo sapiens
gagtccagctccccccaagat

SEQ ID NO: 297765 - DNA, 21 bp, Homo sapiens
gagtcccagagcaggaggccc

SEQ ID NO: 297766 - DNA, 18 bp, Homo sapiens
gagtcccagtgggaggcg

SEQ ID NO: 297767 - DNA, 22 bp, Homo sapiens
gagtcccccctcccacctccag

SEQ ID NO: 297768 - DNA, 18 bp, Homo sapiens
gagtcccctccccggccc

SEQ ID NO: 297769 - DNA, 17 bp, Homo sapiens
gagtcctgttctcagag

SEQ ID NO: 297770 - DNA, 14 bp, Homo sapiens
gagtcggctgggca

SEQ ID NO: 297771 - DNA, 15 bp, Homo sapiens
gagtcggctgggcag

SEQ ID NO: 297772 - DNA, 16 bp, Homo sapiens
gagtcggctgggcagg

SEQ ID NO: 297773 - DNA, 17 bp, Homo sapiens
gagtcggctgggcaggg

SEQ ID NO: 297774 - DNA, 18 bp, Homo sapiens
gagtcggctgggcagggc

SEQ ID NO: 297775 - DNA, 20 bp, Homo sapiens
gagtcggctgggcagggccg

SEQ ID NO: 297776 - DNA, 17 bp, Homo sapiens
gagtctcattcctctgt

SEQ ID NO: 297777 - DNA, 21 bp, Homo sapiens
gagtctccctccgactccaga

SEQ ID NO: 297778 - DNA, 20 bp, Homo sapiens
gagtctcgctctgtcgccca

SEQ ID NO: 297779 - DNA, 17 bp, Homo sapiens
gagtctctgccacccac

SEQ ID NO: 297780 - DNA, 18 bp, Homo sapiens
gagtctctgccacccact

SEQ ID NO: 297781 - DNA, 19 bp, Homo sapiens
gagtctctgccacccactc

SEQ ID NO: 297782 - DNA, 16 bp, Homo sapiens
gagtctcttctccact

SEQ ID NO: 297783 - DNA, 22 bp, Homo sapiens
gagtctgcttgtcttagatgtt

SEQ ID NO: 297784 - DNA, 15 bp, Homo sapiens
gagtctggagaccag

SEQ ID NO: 297785 - DNA, 18 bp, Homo sapiens
gagtctggagaccaggac

SEQ ID NO: 297786 - DNA, 18 bp, Homo sapiens
gagtctgggcctctgact

SEQ ID NO: 297787 - DNA, 12 bp, Homo sapiens
gagtctgtcctt

SEQ ID NO: 297788 - DNA, 14 bp, Homo sapiens
gagtctgtgctctt

SEQ ID NO: 297789 - DNA, 18 bp, Homo sapiens
gagtctgtgtgtagccag

SEQ ID NO: 297790 - DNA, 19 bp, Homo sapiens
gagtcttaattttctaaaa

SEQ ID NO: 297791 - DNA, 15 bp, Homo sapiens
gagtctttttagtgt

SEQ ID NO: 297792 - DNA, 22 bp, Homo sapiens
gagtgaaaccatgactgtgacc

SEQ ID NO: 297793 - DNA, 19 bp, Homo sapiens
gagtgaaagggctatggca

SEQ ID NO: 297794 - DNA, 19 bp, Homo sapiens
gagtgaacaactatttata

SEQ ID NO: 297795 - DNA, 15 bp, Homo sapiens
gagtgaacatttcta

SEQ ID NO: 297796 - DNA, 15 bp, Homo sapiens
gagtgaaccatcatt

SEQ ID NO: 297797 - DNA, 16 bp, Homo sapiens
gagtgaacctaccttc

SEQ ID NO: 297798 - DNA, 17 bp, Homo sapiens
gagtgaagctgggagaa

SEQ ID NO: 297799 - DNA, 22 bp, Homo sapiens
gagtgaagtaattgacagggaa

SEQ ID NO: 297800 - DNA, 19 bp, Homo sapiens
gagtgacatcggttcagga

SEQ ID NO: 297801 - DNA, 21 bp, Homo sapiens
gagtgagaataattgtgtaca

SEQ ID NO: 297802 - DNA, 14 bp, Homo sapiens
gagtgagagagagt

SEQ ID NO: 297803 - DNA, 15 bp, Homo sapiens
gagtgagagcacaaa

SEQ ID NO: 297804 - DNA, 18 bp, Homo sapiens
gagtgagagcacaaagat

SEQ ID NO: 297805 - DNA, 20 bp, Homo sapiens
gagtgaggcttccaggctct

SEQ ID NO: 297806 - DNA, 19 bp, Homo sapiens
gagtgagtgtggctcccct

SEQ ID NO: 297807 - DNA, 14 bp, Homo sapiens
gagtgatgatttgg

SEQ ID NO: 297808 - DNA, 19 bp, Homo sapiens
gagtgatgatttgggggag

SEQ ID NO: 297809 - DNA, 24 bp, Homo sapiens
gagtgattgaaccagctcatctcc

SEQ ID NO: 297810 - DNA, 18 bp, Homo sapiens
gagtgcagaacacctggc

SEQ ID NO: 297811 - DNA, 17 bp, Homo sapiens
gagtgcagatctgtgct

SEQ ID NO: 297812 - DNA, 14 bp, Homo sapiens
gagtgcatggccac

SEQ ID NO: 297813 - DNA, 15 bp, Homo sapiens
gagtgcatggccaca

SEQ ID NO: 297814 - DNA, 19 bp, Homo sapiens
gagtgcatggccacagcca

SEQ ID NO: 297815 - DNA, 19 bp, Homo sapiens
gagtgccccacctgccact

SEQ ID NO: 297816 - DNA, 16 bp, Homo sapiens
gagtgcccctgcaggg

SEQ ID NO: 297817 - DNA, 20 bp, Homo sapiens
gagtgctgcttgtgcctccc

SEQ ID NO: 297818 - DNA, 24 bp, Homo sapiens
gagtgctgcttgtgcctcccttcc

SEQ ID NO: 297819 - DNA, 22 bp, Homo sapiens
gagtgctggaatggggacctgg

SEQ ID NO: 297820 - DNA, 11 bp, Homo sapiens
gagtgctggct

SEQ ID NO: 297821 - DNA, 22 bp, Homo sapiens
gagtgctggctccacgccctgg

SEQ ID NO: 297822 - DNA, 13 bp, Homo sapiens
gagtggaggcatt

SEQ ID NO: 297823 - DNA, 12 bp, Homo sapiens
gagtggcagcca

SEQ ID NO: 297824 - DNA, 19 bp, Homo sapiens
gagtggcagccatgcctca

SEQ ID NO: 297825 - DNA, 24 bp, Homo sapiens
gagtggcagccatgcctcatgcca

SEQ ID NO: 297826 - DNA, 21 bp, Homo sapiens
gagtggcccctcacctgggcc

SEQ ID NO: 297827 - DNA, 12 bp, Homo sapiens
gagtggcctggc

SEQ ID NO: 297828 - DNA, 19 bp, Homo sapiens
gagtggcctggccaggagc

SEQ ID NO: 297829 - DNA, 15 bp, Homo sapiens
gagtggctcctcccg

SEQ ID NO: 297830 - DNA, 17 bp, Homo sapiens
gagtgggaaggacttgg

SEQ ID NO: 297831 - DNA, 11 bp, Homo sapiens
gagtgggagag

SEQ ID NO: 297832 - DNA, 21 bp, Homo sapiens
gagtgggaggcgtgcccccct

SEQ ID NO: 297833 - DNA, 15 bp, Homo sapiens
gagtgggcacctcag

SEQ ID NO: 297834 - DNA, 15 bp, Homo sapiens
gagtgggctctgagc

SEQ ID NO: 297835 - DNA, 14 bp, Homo sapiens
gagtggggcagtag

SEQ ID NO: 297836 - DNA, 17 bp, Homo sapiens
gagtgggtgggacacag

SEQ ID NO: 297837 - DNA, 17 bp, Homo sapiens
gagtgtaagtgtgagta

SEQ ID NO: 297838 - DNA, 13 bp, Homo sapiens
gagtgtcaggctc

SEQ ID NO: 297839 - DNA, 13 bp, Homo sapiens
gagtgtctgcagt

SEQ ID NO: 297840 - DNA, 22 bp, Homo sapiens
gagtgtgacgggggttggggtg

SEQ ID NO: 297841 - DNA, 17 bp, Homo sapiens
gagtgtggaagccggag

SEQ ID NO: 297842 - DNA, 17 bp, Homo sapiens
gagtgtggctcccctct

SEQ ID NO: 297843 - DNA, 12 bp, Homo sapiens
gagtgtgtgggg

SEQ ID NO: 297844 - DNA, 22 bp, Homo sapiens
gagtgtgtgggggtctgggagg

SEQ ID NO: 297845 - DNA, 23 bp, Homo sapiens
gagtgttctgtgggcttggcctt

SEQ ID NO: 297846 - DNA, 17 bp, Homo sapiens
gagttaaaaagggcagg

SEQ ID NO: 297847 - DNA, 15 bp, Homo sapiens
gagttaggtcctcac

SEQ ID NO: 297848 - DNA, 21 bp, Homo sapiens
gagttattgaatcttaatttt

SEQ ID NO: 297849 - DNA, 12 bp, Homo sapiens
gagttcaatgat

SEQ ID NO: 297850 - DNA, 16 bp, Homo sapiens
gatcacttaagcccag

SEQ ID NO: 297851 - DNA, 19 bp, Homo sapiens
gatcacttgagcccaggaa

SEQ ID NO: 297852 - DNA, 21 bp, Homo sapiens
gatcacttgagcccaggaagt

SEQ ID NO: 297853 - DNA, 15 bp, Homo sapiens
gatcactttgctctg

SEQ ID NO: 297854 - DNA, 14 bp, Homo sapiens
gatcagagagcaag

SEQ ID NO: 297855 - DNA, 22 bp, Homo sapiens
gatcagagtctggcctgccagg

SEQ ID NO: 297856 - DNA, 17 bp, Homo sapiens
gatcagcattcaaaata

SEQ ID NO: 297857 - DNA, 21 bp, Homo sapiens
gatcagcctccgccattccaa

SEQ ID NO: 297858 - DNA, 17 bp, Homo sapiens
gatcagggaatccagct

SEQ ID NO: 297859 - DNA, 14 bp, Homo sapiens
gatcagtctttgtc

SEQ ID NO: 297860 - DNA, 11 bp, Homo sapiens
gatcagttttc

SEQ ID NO: 297861 - DNA, 14 bp, Homo sapiens
gatcagttttccta

SEQ ID NO: 297862 - DNA, 21 bp, Homo sapiens
gatcagttttcctagtctttg

SEQ ID NO: 297863 - DNA, 19 bp, Homo sapiens
gatcatctttgctgaatgt

SEQ ID NO: 297864 - DNA, 14 bp, Homo sapiens
gatcatgcaggaac

SEQ ID NO: 297865 - DNA, 13 bp, Homo sapiens
gatcatgcattgt

SEQ ID NO: 297866 - DNA, 14 bp, Homo sapiens
gatcatgcattgtt

SEQ ID NO: 297867 - DNA, 23 bp, Homo sapiens
gatcattttccccccactctccc

SEQ ID NO: 297868 - DNA, 21 bp, Homo sapiens
gatcatttttaactgattctt

SEQ ID NO: 297869 - DNA, 21 bp, Homo sapiens
gatccagactgtaagatgttg

SEQ ID NO: 297870 - DNA, 15 bp, Homo sapiens
gatccatccatctcc

SEQ ID NO: 297871 - DNA, 16 bp, Homo sapiens
gatccatccatctcca

SEQ ID NO: 297872 - DNA, 18 bp, Homo sapiens
gatcccatccatcagctc

SEQ ID NO: 297873 - DNA, 21 bp, Homo sapiens
gatccccgacagtggctctcc

SEQ ID NO: 297874 - DNA, 18 bp, Homo sapiens
gatccctgtgttgtctct

SEQ ID NO: 297875 - DNA, 19 bp, Homo sapiens
gatccctgtgttgtctcta

SEQ ID NO: 297876 - DNA, 17 bp, Homo sapiens
gatccgcatgtgtctgt

SEQ ID NO: 297877 - DNA, 13 bp, Homo sapiens
gatccgccctggg

SEQ ID NO: 297878 - DNA, 17 bp, Homo sapiens
gatccgccctgggctct

SEQ ID NO: 297879 - DNA, 23 bp, Homo sapiens
gatcctcatatggcccagtgtca

SEQ ID NO: 297880 - DNA, 11 bp, Homo sapiens
gatcctcctgg

SEQ ID NO: 297881 - DNA, 23 bp, Homo sapiens
gatcctcctggagcagcagctga

SEQ ID NO: 297882 - DNA, 15 bp, Homo sapiens
gatcctctattttgt

SEQ ID NO: 297883 - DNA, 19 bp, Homo sapiens
gatcctctattttgtgatg

SEQ ID NO: 297884 - DNA, 19 bp, Homo sapiens
gatcctctccactccatgt

SEQ ID NO: 297885 - DNA, 17 bp, Homo sapiens
gatcctctgatatacaa

SEQ ID NO: 297886 - DNA, 15 bp, Homo sapiens
gatcctgcaccccag

SEQ ID NO: 297887 - DNA, 17 bp, Homo sapiens
gatcctgcaccccagca

SEQ ID NO: 297888 - DNA, 11 bp, Homo sapiens
gatcctgcagg

SEQ ID NO: 297889 - DNA, 12 bp, Homo sapiens
gatcctgcagga

SEQ ID NO: 297890 - DNA, 21 bp, Homo sapiens
gatcctgcaggaacgagcact

SEQ ID NO: 297891 - DNA, 23 bp, Homo sapiens
gatcctgcaggaacgagcactgg

SEQ ID NO: 297892 - DNA, 16 bp, Homo sapiens
gatcctggagcccctg

SEQ ID NO: 297893 - DNA, 15 bp, Homo sapiens
gatccttcacaggca

SEQ ID NO: 297894 - DNA, 16 bp, Homo sapiens
gatccttcacaggcag

SEQ ID NO: 297895 - DNA, 22 bp, Homo sapiens
gatccttgtctttactgacaag

SEQ ID NO: 297896 - DNA, 15 bp, Homo sapiens
gatcgcatcattgca

SEQ ID NO: 297897 - DNA, 16 bp, Homo sapiens
gatcgcttgagcccag

SEQ ID NO: 297898 - DNA, 15 bp, Homo sapiens
gatcgtgctaaattt

SEQ ID NO: 297899 - DNA, 18 bp, Homo sapiens
gatcgtgctaaattttca

SEQ ID NO: 297900 - DNA, 18 bp, Homo sapiens
gatctaaaaggaggacag

SEQ ID NO: 297901 - DNA, 18 bp, Homo sapiens
gatctaagcctttccata

SEQ ID NO: 297902 - DNA, 16 bp, Homo sapiens
gatctaggtttaactc

SEQ ID NO: 297903 - DNA, 18 bp, Homo sapiens
gatctatcacctgtcatc

SEQ ID NO: 297904 - DNA, 19 bp, Homo sapiens
gatctatcacctgtcatca

SEQ ID NO: 297905 - DNA, 14 bp, Homo sapiens
gatctcagctcact

SEQ ID NO: 297906 - DNA, 15 bp, Homo sapiens
gatctcattcagtat

SEQ ID NO: 297907 - DNA, 20 bp, Homo sapiens
gatctcattcagtattaaag

SEQ ID NO: 297908 - DNA, 17 bp, Homo sapiens
gatctccaggcccagcc

SEQ ID NO: 297909 - DNA, 22 bp, Homo sapiens
gatctccaggcccagcctggcc

SEQ ID NO: 297910 - DNA, 23 bp, Homo sapiens
gatctccaggcccagcctggccc

SEQ ID NO: 297911 - DNA, 16 bp, Homo sapiens
gatctctcaggagcac

SEQ ID NO: 297912 - DNA, 18 bp, Homo sapiens
gatctctcaggagcacag

SEQ ID NO: 297913 - DNA, 22 bp, Homo sapiens
gatctctcaggagcacaggcag

SEQ ID NO: 297914 - DNA, 24 bp, Homo sapiens
gatctctcaggagcacaggcagct

SEQ ID NO: 297915 - DNA, 11 bp, Homo sapiens
gatctctgctt

SEQ ID NO: 297916 - DNA, 12 bp, Homo sapiens
gatctctgctta

SEQ ID NO: 297917 - DNA, 20 bp, Homo sapiens
gatctgaactttgtttccag

SEQ ID NO: 297918 - DNA, 23 bp, Homo sapiens
gatctgaactttgtttccagaaa

SEQ ID NO: 297919 - DNA, 17 bp, Homo sapiens
gatctgacatgattcct

SEQ ID NO: 297920 - DNA, 12 bp, Homo sapiens
gatctgagccct

SEQ ID NO: 297921 - DNA, 21 bp, Homo sapiens
gatctgagccctccctcttcc

SEQ ID NO: 297922 - DNA, 12 bp, Homo sapiens
gatctgcctggg

SEQ ID NO: 297923 - DNA, 14 bp, Homo sapiens
gatctgcctgggcc

SEQ ID NO: 297924 - DNA, 23 bp, Homo sapiens
gatctgcctgggcctgtgcagca

SEQ ID NO: 297925 - DNA, 24 bp, Homo sapiens
gatctggcttacaggggggtcgga

SEQ ID NO: 297926 - DNA, 15 bp, Homo sapiens
gatctggggaaggac

SEQ ID NO: 297927 - DNA, 18 bp, Homo sapiens
gatctggggaaggaccaa

SEQ ID NO: 297928 - DNA, 18 bp, Homo sapiens
gatctggtgcgtgtggcc

SEQ ID NO: 297929 - DNA, 17 bp, Homo sapiens
gatctgtcaaagtgaga

SEQ ID NO: 297930 - DNA, 16 bp, Homo sapiens
gatctgtgcccagaga

SEQ ID NO: 297931 - DNA, 20 bp, Homo sapiens
gatctgttgtgtacgtggag

SEQ ID NO: 297932 - DNA, 12 bp, Homo sapiens
gatcttaaattt

SEQ ID NO: 297933 - DNA, 15 bp, Homo sapiens
gatcttcaatggctt

SEQ ID NO: 297934 - DNA, 12 bp, Homo sapiens
gatcttctgaaa

SEQ ID NO: 297935 - DNA, 16 bp, Homo sapiens
gatcttctgaaatgaa

SEQ ID NO: 297936 - DNA, 13 bp, Homo sapiens
gatcttggagaca

SEQ ID NO: 297937 - DNA, 16 bp, Homo sapiens
gatcttggagacaatt

SEQ ID NO: 297938 - DNA, 18 bp, Homo sapiens
gatcttggctcactacaa

SEQ ID NO: 297939 - DNA, 13 bp, Homo sapiens
gatcttgtgctca

SEQ ID NO: 297940 - DNA, 15 bp, Homo sapiens
gatcttgtgctcagc

SEQ ID NO: 297941 - DNA, 23 bp, Homo sapiens
gatgaaattttctagactttctg

SEQ ID NO: 297942 - DNA, 13 bp, Homo sapiens
gatgaacccagga

SEQ ID NO: 297943 - DNA, 22 bp, Homo sapiens
gatgaacccaggacgcttctga

SEQ ID NO: 297944 - DNA, 23 bp, Homo sapiens
gatgaacccaggacgcttctgaa

SEQ ID NO: 297945 - DNA, 19 bp, Homo sapiens
gatgaactctttctggcct

SEQ ID NO: 297946 - DNA, 17 bp, Homo sapiens
gatgaagaacacagcat

SEQ ID NO: 297947 - DNA, 20 bp, Homo sapiens
gatgaagaacacagcatgtg

SEQ ID NO: 297948 - DNA, 17 bp, Homo sapiens
gatgaataaacactttt

SEQ ID NO: 297949 - DNA, 15 bp, Homo sapiens
gatgaatagatgtga

SEQ ID NO: 297950 - DNA, 14 bp, Homo sapiens
gatgaatgtatgtg

SEQ ID NO: 297951 - DNA, 19 bp, Homo sapiens
gatgacagggagctgggga

SEQ ID NO: 297952 - DNA, 20 bp, Homo sapiens
gatgacctccttagaaaaga

SEQ ID NO: 297953 - DNA, 12 bp, Homo sapiens
gatgagaaaaaa

SEQ ID NO: 297954 - DNA, 13 bp, Homo sapiens
gatgagaagacta

SEQ ID NO: 297955 - DNA, 12 bp, Homo sapiens
gatgagaagtta

SEQ ID NO: 297956 - DNA, 14 bp, Homo sapiens
gatgagacaacaca

SEQ ID NO: 297957 - DNA, 16 bp, Homo sapiens
gatgagacaacacaca

SEQ ID NO: 297958 - DNA, 20 bp, Homo sapiens
gatgagatttgccagcacag

SEQ ID NO: 297959 - DNA, 17 bp, Homo sapiens
gatgagcactcctgatt

SEQ ID NO: 297960 - DNA, 20 bp, Homo sapiens
gatgagcccagccctgttct

SEQ ID NO: 297961 - DNA, 22 bp, Homo sapiens
gatgagcctctccttgccccag

SEQ ID NO: 297962 - DNA, 20 bp, Homo sapiens
gatgagctggaaggagtgag

SEQ ID NO: 297963 - DNA, 20 bp, Homo sapiens
gatgagctggtttgactcat

SEQ ID NO: 297964 - DNA, 21 bp, Homo sapiens
gatgagtgggaggcgtgcccc

SEQ ID NO: 297965 - DNA, 23 bp, Homo sapiens
gatgataaaaggaatctggcatt

SEQ ID NO: 297966 - DNA, 19 bp, Homo sapiens
gatgataatgatgatgacg

SEQ ID NO: 297967 - DNA, 20 bp, Homo sapiens
gatgatagacttcgaaaaca

SEQ ID NO: 297968 - DNA, 22 bp, Homo sapiens
gatgatccatgagtttgccctg

SEQ ID NO: 297969 - DNA, 23 bp, Homo sapiens
gatgatccatgagtttgccctgg

SEQ ID NO: 297970 - DNA, 21 bp, Homo sapiens
gatgatctactcagaaatttt

SEQ ID NO: 297971 - DNA, 23 bp, Homo sapiens
gatgatgacgacgacaacgatga

SEQ ID NO: 297972 - DNA, 14 bp, Homo sapiens
gatgatgctgccag

SEQ ID NO: 297973 - DNA, 19 bp, Homo sapiens
gatgatgggaattgtgtga

SEQ ID NO: 297974 - DNA, 18 bp, Homo sapiens
gatgatttgggggaggct

SEQ ID NO: 297975 - DNA, 20 bp, Homo sapiens
gatgatttttaagtacaaaa

SEQ ID NO: 297976 - DNA, 14 bp, Homo sapiens
gatgcaaagaaaat

SEQ ID NO: 297977 - DNA, 17 bp, Homo sapiens
gatgcaaggaccaggac

SEQ ID NO: 297978 - DNA, 19 bp, Homo sapiens
gatgcaaggaccaggactc

SEQ ID NO: 297979 - DNA, 13 bp, Homo sapiens
gatgcaataaaca

SEQ ID NO: 297980 - DNA, 22 bp, Homo sapiens
gattttagatttctttgattgt

SEQ ID NO: 297981 - DNA, 18 bp, Homo sapiens
gattttcatcaatttaaa

SEQ ID NO: 297982 - DNA, 12 bp, Homo sapiens
gattttctattg

SEQ ID NO: 297983 - DNA, 18 bp, Homo sapiens
gattttctattgttactc

SEQ ID NO: 297984 - DNA, 13 bp, Homo sapiens
gattttctttcta

SEQ ID NO: 297985 - DNA, 15 bp, Homo sapiens
gattttctttctatg

SEQ ID NO: 297986 - DNA, 17 bp, Homo sapiens
gattttctttctatgta

SEQ ID NO: 297987 - DNA, 14 bp, Homo sapiens
gattttgagtatct

SEQ ID NO: 297988 - DNA, 23 bp, Homo sapiens
gatttttaaagtttaaataccag

SEQ ID NO: 297989 - DNA, 14 bp, Homo sapiens
gatttttaaattat

SEQ ID NO: 297990 - DNA, 17 bp, Homo sapiens
gatttttaagtacaaaa

SEQ ID NO: 297991 - DNA, 18 bp, Homo sapiens
gatttttgttaagctcag

SEQ ID NO: 297992 - DNA, 20 bp, Homo sapiens
gatttttgttaagctcagga

SEQ ID NO: 297993 - DNA, 14 bp, Homo sapiens
gatttttttctgag

SEQ ID NO: 297994 - DNA, 15 bp, Homo sapiens
gcaaaaaaataagaa

SEQ ID NO: 297995 - DNA, 18 bp, Homo sapiens
gcaaaacacgcaagggca

SEQ ID NO: 297996 - DNA, 17 bp, Homo sapiens
gcaaaaccattgcttca

SEQ ID NO: 297997 - DNA, 18 bp, Homo sapiens
gcaaaaccattgcttcac

SEQ ID NO: 297998 - DNA, 20 bp, Homo sapiens
gcaaaaccggcaacctgtaa

SEQ ID NO: 297999 - DNA, 13 bp, Homo sapiens
gcaaaactgcaaa

SEQ ID NO: 298000 - DNA, 18 bp, Homo sapiens
gcaaaagaagttgatctg

SEQ ID NO: 298001 - DNA, 21 bp, Homo sapiens
gcaaaataaagaatagcaatt

SEQ ID NO: 298002 - DNA, 18 bp, Homo sapiens
gcaaaataaatgttttta

SEQ ID NO: 298003 - DNA, 21 bp, Homo sapiens
gcaaaatacatgatgatttca

SEQ ID NO: 298004 - DNA, 17 bp, Homo sapiens
gcaaaattacctacccc

SEQ ID NO: 298005 - DNA, 12 bp, Homo sapiens
gcaaacaataaa

SEQ ID NO: 298006 - DNA, 19 bp, Homo sapiens
gcaaacacacagactctgt

SEQ ID NO: 298007 - DNA, 10 bp, Homo sapiens
gcaaacattt

SEQ ID NO: 298008 - DNA, 11 bp, Homo sapiens
gcaaacattta

SEQ ID NO: 298009 - DNA, 20 bp, Homo sapiens
gcaaacatttctttttcctt

SEQ ID NO: 298010 - DNA, 17 bp, Homo sapiens
gcaaactcactgctcaa

SEQ ID NO: 298011 - DNA, 19 bp, Homo sapiens
gcaaactcactgctcaaga

SEQ ID NO: 298012 - DNA, 12 bp, Homo sapiens
gcaaactttaac

SEQ ID NO: 298013 - DNA, 11 bp, Homo sapiens
gcaaagaaaac

SEQ ID NO: 298014 - DNA, 14 bp, Homo sapiens
gcaaagaaaacaca

SEQ ID NO: 298015 - DNA, 21 bp, Homo sapiens
gcaaagaaaacacacaaaaga

SEQ ID NO: 298016 - DNA, 18 bp, Homo sapiens
gcaaagaaaattctcaag

SEQ ID NO: 298017 - DNA, 17 bp, Homo sapiens
gcaaagaactgccccat

SEQ ID NO: 298018 - DNA, 15 bp, Homo sapiens
gcaaagaggtgctgc

SEQ ID NO: 298019 - DNA, 12 bp, Homo sapiens
gcaaagatcaaa

SEQ ID NO: 298020 - DNA, 15 bp, Homo sapiens
gcaaagatcaaaata

SEQ ID NO: 298021 - DNA, 16 bp, Homo sapiens
gcaaagatcaaaataa

SEQ ID NO: 298022 - DNA, 19 bp, Homo sapiens
gcaaagcatttgagctgtg

SEQ ID NO: 298023 - DNA, 15 bp, Homo sapiens
gcaaagcctttaaat

SEQ ID NO: 298024 - DNA, 21 bp, Homo sapiens
gcaaagctgatgacaacttcc

SEQ ID NO: 298025 - DNA, 20 bp, Homo sapiens
gcaaaggactgttttttcct

SEQ ID NO: 298026 - DNA, 21 bp, Homo sapiens
gcaaaggagacaaagcaggag

SEQ ID NO: 298027 - DNA, 19 bp, Homo sapiens
gcaaaggagggcctcagag

SEQ ID NO: 298028 - DNA, 22 bp, Homo sapiens
gcaaaggagggcctcagagaca

SEQ ID NO: 298029 - DNA, 16 bp, Homo sapiens
gcaaagggccaggaag

SEQ ID NO: 298030 - DNA, 16 bp, Homo sapiens
gcaaagtgctgtaccc

SEQ ID NO: 298031 - DNA, 17 bp, Homo sapiens
gcaaataccaaagcagt

SEQ ID NO: 298032 - DNA, 17 bp, Homo sapiens
gcaaatataagctggga

SEQ ID NO: 298033 - DNA, 20 bp, Homo sapiens
gcaaatcagaaacttgtgaa

SEQ ID NO: 298034 - DNA, 22 bp, Homo sapiens
gcaaatcagaaacttgtgaagt

SEQ ID NO: 298035 - DNA, 20 bp, Homo sapiens
gcaaatgccaggacagctgc

SEQ ID NO: 298036 - DNA, 13 bp, Homo sapiens
gcaaattaaaggg

SEQ ID NO: 298037 - DNA, 14 bp, Homo sapiens
gcaaattattctag

SEQ ID NO: 298038 - DNA, 15 bp, Homo sapiens
gcaaattattctagt

SEQ ID NO: 298039 - DNA, 17 bp, Homo sapiens
gcaaattccacccctcc

SEQ ID NO: 298040 - DNA, 22 bp, Homo sapiens
gcaaattccacccctccttccc

SEQ ID NO: 298041 - DNA, 17 bp, Homo sapiens
gcaaattcttgaataaa

SEQ ID NO: 298042 - DNA, 22 bp, Homo sapiens
gcaaatttctagatatgagaaa

SEQ ID NO: 298043 - DNA, 18 bp, Homo sapiens
gcaacaacttactaaatc

SEQ ID NO: 298044 - DNA, 16 bp, Homo sapiens
gcaacaataataaatg

SEQ ID NO: 298045 - DNA, 18 bp, Homo sapiens
gcaacacccaagtccacc

SEQ ID NO: 298046 - DNA, 20 bp, Homo sapiens
gcaacagcactggctctctc

SEQ ID NO: 298047 - DNA, 17 bp, Homo sapiens
gcaacaggaccaggagc

SEQ ID NO: 298048 - DNA, 19 bp, Homo sapiens
gcaacaggaccaggagcca

SEQ ID NO: 298049 - DNA, 23 bp, Homo sapiens
gcaacaggttgaggctaaaacaa

SEQ ID NO: 298050 - DNA, 18 bp, Homo sapiens
gcaacatgaagaatgcat

SEQ ID NO: 298051 - DNA, 23 bp, Homo sapiens
gcaacatgcttcatgaaaatcct

SEQ ID NO: 298052 - DNA, 13 bp, Homo sapiens
gcaaccacacacc

SEQ ID NO: 298053 - DNA, 15 bp, Homo sapiens
gcaaccacacacctc

SEQ ID NO: 298054 - DNA, 13 bp, Homo sapiens
gcaacccctgtac

SEQ ID NO: 298055 - DNA, 14 bp, Homo sapiens
gcaacccctgtacc

SEQ ID NO: 298056 - DNA, 13 bp, Homo sapiens
gcaacctctgcct

SEQ ID NO: 298057 - DNA, 23 bp, Homo sapiens
gcaacgaagaaaaaaaataacac

SEQ ID NO: 298058 - DNA, 21 bp, Homo sapiens
gcaacgcctgccttctgggca

SEQ ID NO: 298059 - DNA, 12 bp, Homo sapiens
gcaactcagaat

SEQ ID NO: 298060 - DNA, 18 bp, Homo sapiens
gcaactcagaatgctcta

SEQ ID NO: 298061 - DNA, 23 bp, Homo sapiens
gcaactccatgcctatttactgg

SEQ ID NO: 298062 - DNA, 13 bp, Homo sapiens
gcaactcttgtat

SEQ ID NO: 298063 - DNA, 15 bp, Homo sapiens
gcaactgaacaaaaa

SEQ ID NO: 298064 - DNA, 14 bp, Homo sapiens
gcaactgtgcagca

SEQ ID NO: 298065 - DNA, 16 bp, Homo sapiens
gcaactgtgcagcacc

SEQ ID NO: 298066 - DNA, 21 bp, Homo sapiens
gcaagaaaaaagtacagaaca

SEQ ID NO: 298067 - DNA, 20 bp, Homo sapiens
gcaagaaattcattaaagaa

SEQ ID NO: 298068 - DNA, 18 bp, Homo sapiens
gcaagaagattctaaaac

SEQ ID NO: 298069 - DNA, 21 bp, Homo sapiens
gcaagaagattctaaaacatt

SEQ ID NO: 298070 - DNA, 17 bp, Homo sapiens
gcaagaataaaaaagaa

SEQ ID NO: 298071 - DNA, 16 bp, Homo sapiens
gcaagacgtcctggaa

SEQ ID NO: 298072 - DNA, 19 bp, Homo sapiens
gcaagagaaatgaggaaga

SEQ ID NO: 298073 - DNA, 13 bp, Homo sapiens
gcaagagaattat

SEQ ID NO: 298074 - DNA, 14 bp, Homo sapiens
gcaagagaattatt

SEQ ID NO: 298075 - DNA, 16 bp, Homo sapiens
gcaagagagaaagaaa

SEQ ID NO: 298076 - DNA, 17 bp, Homo sapiens
gcaagagatgagaaaca

SEQ ID NO: 298077 - DNA, 20 bp, Homo sapiens
gcaagagtgggctttccagg

SEQ ID NO: 298078 - DNA, 22 bp, Homo sapiens
gcaagatagctccttcatgctt

SEQ ID NO: 298079 - DNA, 24 bp, Homo sapiens
gcaagatgatttttaagtacaaaa

SEQ ID NO: 298080 - DNA, 15 bp, Homo sapiens
gcaagattgaagtct

SEQ ID NO: 298081 - DNA, 22 bp, Homo sapiens
gcaagattggaaagacaggaag

SEQ ID NO: 298082 - DNA, 14 bp, Homo sapiens
gcaagcacatctgc

SEQ ID NO: 298083 - DNA, 11 bp, Homo sapiens
gcaagccaacc

SEQ ID NO: 298084 - DNA, 14 bp, Homo sapiens
gcaagccccagggc

SEQ ID NO: 298085 - DNA, 23 bp, Homo sapiens
gcaagcctgagtggtgaggggcc

SEQ ID NO: 298086 - DNA, 15 bp, Homo sapiens
gcaagcgagcacagt

SEQ ID NO: 298087 - DNA, 17 bp, Homo sapiens
gcaaggaagcagagcac

SEQ ID NO: 298088 - DNA, 21 bp, Homo sapiens
gcaaggacaacctgcccctcc

SEQ ID NO: 298089 - DNA, 18 bp, Homo sapiens
gcaaggacattgccccaa

SEQ ID NO: 298090 - DNA, 19 bp, Homo sapiens
gcaaggacattgccccaag

SEQ ID NO: 298091 - DNA, 20 bp, Homo sapiens
gcaaggaccaggactccctc

SEQ ID NO: 298092 - DNA, 21 bp, Homo sapiens
gcaaggaccaggactccctcc

SEQ ID NO: 298093 - DNA, 17 bp, Homo sapiens
gcaaggaccagtgagac

SEQ ID NO: 298094 - DNA, 16 bp, Homo sapiens
gcaaggatgaaagaca

SEQ ID NO: 298095 - DNA, 22 bp, Homo sapiens
gcaaggatgaaagacaaagaag

SEQ ID NO: 298096 - DNA, 17 bp, Homo sapiens
gcaaggcaagaagtggg

SEQ ID NO: 298097 - DNA, 19 bp, Homo sapiens
gcaaggcaagaagtgggat

SEQ ID NO: 298098 - DNA, 20 bp, Homo sapiens
gcaaggcacaggctcctgta

SEQ ID NO: 298099 - DNA, 16 bp, Homo sapiens
gcaaggcagctcccag

SEQ ID NO: 298100 - DNA, 16 bp, Homo sapiens
gcaaggcccacaggag

SEQ ID NO: 298101 - DNA, 16 bp, Homo sapiens
gcaaggctgccggctg

SEQ ID NO: 298102 - DNA, 11 bp, Homo sapiens
gcaaggctgtc

SEQ ID NO: 298103 - DNA, 14 bp, Homo sapiens
gcaaggctgtcaat

SEQ ID NO: 298104 - DNA, 17 bp, Homo sapiens
gcaagggctccagcatc

SEQ ID NO: 298105 - DNA, 10 bp, Homo sapiens
gcaagggctt

SEQ ID NO: 298106 - DNA, 14 bp, Homo sapiens
gcaaggggctctgc

SEQ ID NO: 298107 - DNA, 21 bp, Homo sapiens
gcaagggggtgtcatctgagg

SEQ ID NO: 298108 - DNA, 16 bp, Homo sapiens
gcaaggggtgcctggg

SEQ ID NO: 298109 - DNA, 19 bp, Homo sapiens
gcaaggggtgcctgggaac

SEQ ID NO: 298110 - DNA, 14 bp, Homo sapiens
gcacccccatgctg

SEQ ID NO: 298111 - DNA, 23 bp, Homo sapiens
gcaccccgatgtggacctctact

SEQ ID NO: 298112 - DNA, 21 bp, Homo sapiens
gcacccctccgtgtggagcac

SEQ ID NO: 298113 - DNA, 12 bp, Homo sapiens
gcacccctggaa

SEQ ID NO: 298114 - DNA, 15 bp, Homo sapiens
gcacccgccctttcc

SEQ ID NO: 298115 - DNA, 15 bp, Homo sapiens
gcacccggcagcccc

SEQ ID NO: 298116 - DNA, 22 bp, Homo sapiens
gcacccggcagccccccagtgt

SEQ ID NO: 298117 - DNA, 20 bp, Homo sapiens
gcaccctctgctatgtctgt

SEQ ID NO: 298118 - DNA, 18 bp, Homo sapiens
gcaccctggaaaggggag

SEQ ID NO: 298119 - DNA, 17 bp, Homo sapiens
gcaccctggggcctgga

SEQ ID NO: 298120 - DNA, 12 bp, Homo sapiens
gcaccctgggtg

SEQ ID NO: 298121 - DNA, 22 bp, Homo sapiens
gcaccctgggtgccattcccag

SEQ ID NO: 298122 - DNA, 17 bp, Homo sapiens
gcaccctgtatggagct

SEQ ID NO: 298123 - DNA, 14 bp, Homo sapiens
gcacccttaaaact

SEQ ID NO: 298124 - DNA, 15 bp, Homo sapiens
gcaccgcccaacccc

SEQ ID NO: 298125 - DNA, 13 bp, Homo sapiens
gcaccgccttctc

SEQ ID NO: 298126 - DNA, 14 bp, Homo sapiens
gcaccgccttctct

SEQ ID NO: 298127 - DNA, 17 bp, Homo sapiens
gcaccgtcatggcttaa

SEQ ID NO: 298128 - DNA, 18 bp, Homo sapiens
gcaccgtggtgtgaggcc

SEQ ID NO: 298129 - DNA, 21 bp, Homo sapiens
gcaccgtggtgtgaggccccc

SEQ ID NO: 298130 - DNA, 14 bp, Homo sapiens
gcacctacgggggc

SEQ ID NO: 298131 - DNA, 23 bp, Homo sapiens
gcacctactacatcgccctccac

SEQ ID NO: 298132 - DNA, 23 bp, Homo sapiens
gcacctataaatactaaatatga

SEQ ID NO: 298133 - DNA, 16 bp, Homo sapiens
gcacctatgaaagcaa

SEQ ID NO: 298134 - DNA, 23 bp, Homo sapiens
gcacctatgagatggccatgctc

SEQ ID NO: 298135 - DNA, 11 bp, Homo sapiens
gcacctcagaa

SEQ ID NO: 298136 - DNA, 15 bp, Homo sapiens
gcacctcctctctgc

SEQ ID NO: 298137 - DNA, 16 bp, Homo sapiens
gcacctcctctctgct

SEQ ID NO: 298138 - DNA, 15 bp, Homo sapiens
gcacctcctgagaag

SEQ ID NO: 298139 - DNA, 17 bp, Homo sapiens
gcacctccttgtcactt

SEQ ID NO: 298140 - DNA, 18 bp, Homo sapiens
gcacctgaaccccatggg

SEQ ID NO: 298141 - DNA, 15 bp, Homo sapiens
gcacctgctggaaac

SEQ ID NO: 298142 - DNA, 19 bp, Homo sapiens
gcacctggagcccacagag

SEQ ID NO: 298143 - DNA, 16 bp, Homo sapiens
gcacctggcacaccag

SEQ ID NO: 298144 - DNA, 21 bp, Homo sapiens
gcacctgggctgaggaggcag

SEQ ID NO: 298145 - DNA, 20 bp, Homo sapiens
gcacctgggctttctggaat

SEQ ID NO: 298146 - DNA, 17 bp, Homo sapiens
gcacctggggagtggga

SEQ ID NO: 298147 - DNA, 16 bp, Homo sapiens
gcacctgtagtcccag

SEQ ID NO: 298148 - DNA, 18 bp, Homo sapiens
gcaccttaccaactttct

SEQ ID NO: 298149 - DNA, 20 bp, Homo sapiens
gcaccttaccaactttctgt

SEQ ID NO: 298150 - DNA, 21 bp, Homo sapiens
gcaccttgggcacgggagagc

SEQ ID NO: 298151 - DNA, 20 bp, Homo sapiens
gcaccttttataccagagac

SEQ ID NO: 298152 - DNA, 16 bp, Homo sapiens
gcacgatctcagctca

SEQ ID NO: 298153 - DNA, 10 bp, Homo sapiens
gcacgcacac

SEQ ID NO: 298154 - DNA, 11 bp, Homo sapiens
gcacgcacaca

SEQ ID NO: 298155 - DNA, 14 bp, Homo sapiens
gcacgcacctgtag

SEQ ID NO: 298156 - DNA, 20 bp, Homo sapiens
gcacgcacctgtagtcccag

SEQ ID NO: 298157 - DNA, 22 bp, Homo sapiens
gcacgcccatgtgtgagtgtgt

SEQ ID NO: 298158 - DNA, 15 bp, Homo sapiens
gcacgcctgccttct

SEQ ID NO: 298159 - DNA, 12 bp, Homo sapiens
gcacgctgtggg

SEQ ID NO: 298160 - DNA, 20 bp, Homo sapiens
gcacgctgtgggcaggtggg

SEQ ID NO: 298161 - DNA, 19 bp, Homo sapiens
gcacgcttgcgtatgtctg

SEQ ID NO: 298162 - DNA, 21 bp, Homo sapiens
gcacgcttgcgtatgtctgtt

SEQ ID NO: 298163 - DNA, 14 bp, Homo sapiens
gcacggctccgagg

SEQ ID NO: 298164 - DNA, 13 bp, Homo sapiens
gcacggggccagc

SEQ ID NO: 298165 - DNA, 14 bp, Homo sapiens
gcacggtttctgtt

SEQ ID NO: 298166 - DNA, 17 bp, Homo sapiens
gcacggtttctgttctg

SEQ ID NO: 298167 - DNA, 22 bp, Homo sapiens
gcacgtagctgaggccggatgc

SEQ ID NO: 298168 - DNA, 12 bp, Homo sapiens
gcacgtgcctgt

SEQ ID NO: 298169 - DNA, 21 bp, Homo sapiens
gcacgtggagatagtgccagg

SEQ ID NO: 298170 - DNA, 15 bp, Homo sapiens
gcacgtggcctcttg

SEQ ID NO: 298171 - DNA, 19 bp, Homo sapiens
gcacgtggcctcttgagca

SEQ ID NO: 298172 - DNA, 13 bp, Homo sapiens
gcactacatgtgg

SEQ ID NO: 298173 - DNA, 21 bp, Homo sapiens
gcactacatgtggtttataga

SEQ ID NO: 298174 - DNA, 17 bp, Homo sapiens
gcactactcctctgcag

SEQ ID NO: 298175 - DNA, 15 bp, Homo sapiens
gcactactctgtgcc

SEQ ID NO: 298176 - DNA, 17 bp, Homo sapiens
gcactactctgtgccag

SEQ ID NO: 298177 - DNA, 22 bp, Homo sapiens
gcactatgaggaataattattt

SEQ ID NO: 298178 - DNA, 16 bp, Homo sapiens
gcactattggactttg

SEQ ID NO: 298179 - DNA, 13 bp, Homo sapiens
gcactcacatgct

SEQ ID NO: 298180 - DNA, 15 bp, Homo sapiens
gcactccatggccac

SEQ ID NO: 298181 - DNA, 12 bp, Homo sapiens
gcactcctgatt

SEQ ID NO: 298182 - DNA, 16 bp, Homo sapiens
gcactcgagaccatcc

SEQ ID NO: 298183 - DNA, 17 bp, Homo sapiens
gcactcgagaccatcct

SEQ ID NO: 298184 - DNA, 14 bp, Homo sapiens
gcactcgcactgca

SEQ ID NO: 298185 - DNA, 14 bp, Homo sapiens
gcactctctgccag

SEQ ID NO: 298186 - DNA, 13 bp, Homo sapiens
gcactctgctggc

SEQ ID NO: 298187 - DNA, 14 bp, Homo sapiens
gcactctgctggcg

SEQ ID NO: 298188 - DNA, 15 bp, Homo sapiens
gcactcttaaagcaa

SEQ ID NO: 298189 - DNA, 22 bp, Homo sapiens
gcactgaccctcggcctctact

SEQ ID NO: 298190 - DNA, 16 bp, Homo sapiens
gcactgactgggcata

SEQ ID NO: 298191 - DNA, 21 bp, Homo sapiens
gcactgagatatttattgttt

SEQ ID NO: 298192 - DNA, 17 bp, Homo sapiens
gcactgaggaccagcca

SEQ ID NO: 298193 - DNA, 11 bp, Homo sapiens
gcactgagggc

SEQ ID NO: 298194 - DNA, 14 bp, Homo sapiens
gcactgccttctcc

SEQ ID NO: 298195 - DNA, 18 bp, Homo sapiens
gcactgccttctcctctc

SEQ ID NO: 298196 - DNA, 22 bp, Homo sapiens
gcactgccttctcctctctggg

SEQ ID NO: 298197 - DNA, 23 bp, Homo sapiens
gcactgccttctcctctctgggc

SEQ ID NO: 298198 - DNA, 14 bp, Homo sapiens
gcactgctgcccag

SEQ ID NO: 298199 - DNA, 15 bp, Homo sapiens
gcactgctgcccagc

SEQ ID NO: 298200 - DNA, 11 bp, Homo sapiens
gcactgctgtt

SEQ ID NO: 298201 - DNA, 22 bp, Homo sapiens
gcactgctgttcctgctccatg

SEQ ID NO: 298202 - DNA, 16 bp, Homo sapiens
gcactggagtgcaggg

SEQ ID NO: 298203 - DNA, 20 bp, Homo sapiens
gcactggcattgtccctgtg

SEQ ID NO: 298204 - DNA, 15 bp, Homo sapiens
gcactggccagagag

SEQ ID NO: 298205 - DNA, 21 bp, Homo sapiens
gcactggccagagagggccca

SEQ ID NO: 298206 - DNA, 14 bp, Homo sapiens
gcactggccccacc

SEQ ID NO: 298207 - DNA, 15 bp, Homo sapiens
gcactggctctctcc

SEQ ID NO: 298208 - DNA, 17 bp, Homo sapiens
gcactggctctctccag

SEQ ID NO: 298209 - DNA, 18 bp, Homo sapiens
gcactggctctctccagg

SEQ ID NO: 298210 - DNA, 12 bp, Homo sapiens
gcactggctgct

SEQ ID NO: 298211 - DNA, 15 bp, Homo sapiens
gcactggctgctctg

SEQ ID NO: 298212 - DNA, 16 bp, Homo sapiens
gcactgggaagctgga

SEQ ID NO: 298213 - DNA, 23 bp, Homo sapiens
gcactgggaagctggagtgctgc

SEQ ID NO: 298214 - DNA, 19 bp, Homo sapiens
gcactgggccggcagcctg

SEQ ID NO: 298215 - DNA, 21 bp, Homo sapiens
gcactgggctaatttgtatgt

SEQ ID NO: 298216 - DNA, 18 bp, Homo sapiens
gcactgggttgcagggga

SEQ ID NO: 298217 - DNA, 21 bp, Homo sapiens
gcactgggttgcaggggattg

SEQ ID NO: 298218 - DNA, 14 bp, Homo sapiens
gcactggtggcccg

SEQ ID NO: 298219 - DNA, 22 bp, Homo sapiens
gcactggtggcccgacagcctg

SEQ ID NO: 298220 - DNA, 23 bp, Homo sapiens
gcactggtggcccgacagcctgg

SEQ ID NO: 298221 - DNA, 16 bp, Homo sapiens
gcactgtaaaatgtgg

SEQ ID NO: 298222 - DNA, 18 bp, Homo sapiens
gcactgtcactttgctct

SEQ ID NO: 298223 - DNA, 21 bp, Homo sapiens
gcactgtcactttgctctggg

SEQ ID NO: 298224 - DNA, 18 bp, Homo sapiens
gcactgtcccttgcctca

SEQ ID NO: 298225 - DNA, 23 bp, Homo sapiens
gcactgtcccttgcctcaatgcc

SEQ ID NO: 298226 - DNA, 12 bp, Homo sapiens
gcactgtgcttg

SEQ ID NO: 298227 - DNA, 13 bp, Homo sapiens
gcactgtggcctt

SEQ ID NO: 298228 - DNA, 19 bp, Homo sapiens
gcactgttttattttaatt

SEQ ID NO: 298229 - DNA, 17 bp, Homo sapiens
gcacttagctatcagaa

SEQ ID NO: 298230 - DNA, 16 bp, Homo sapiens
gcacttattttttaat

SEQ ID NO: 298231 - DNA, 21 bp, Homo sapiens
gcacttattttttaatgtgag

SEQ ID NO: 298232 - DNA, 22 bp, Homo sapiens
gcacttattttttaatgtgaga

SEQ ID NO: 298233 - DNA, 13 bp, Homo sapiens
gcacttcatatct

SEQ ID NO: 298234 - DNA, 18 bp, Homo sapiens
gcacttggtgctgctttg

SEQ ID NO: 298235 - DNA, 19 bp, Homo sapiens
gcactttagtgtattttct

SEQ ID NO: 298236 - DNA, 19 bp, Homo sapiens
gcactttgaaaatatttct

SEQ ID NO: 298237 - DNA, 22 bp, Homo sapiens
gcactttgaaaatatttctatg

SEQ ID NO: 298238 - DNA, 17 bp, Homo sapiens
gcactttgggaggccaa

SEQ ID NO: 298239 - DNA, 19 bp, Homo sapiens
gcactttgggaggccaagg

SEQ ID NO: 298240 - DNA, 18 bp, Homo sapiens
gcagccgtgccttcagct

SEQ ID NO: 298241 - DNA, 22 bp, Homo sapiens
gcagcctatgggggctctcgga

SEQ ID NO: 298242 - DNA, 14 bp, Homo sapiens
gcagcctcagggct

SEQ ID NO: 298243 - DNA, 18 bp, Homo sapiens
gcagcctcagggcttcct

SEQ ID NO: 298244 - DNA, 16 bp, Homo sapiens
gcagcctccagagcca

SEQ ID NO: 298245 - DNA, 17 bp, Homo sapiens
gcagcctccagagccag

SEQ ID NO: 298246 - DNA, 20 bp, Homo sapiens
gcagcctccagagccagcct

SEQ ID NO: 298247 - DNA, 23 bp, Homo sapiens
gcagcctccagagccagcctggg

SEQ ID NO: 298248 - DNA, 23 bp, Homo sapiens
gcagcctccctgtcactcagctg

SEQ ID NO: 298249 - DNA, 15 bp, Homo sapiens
gcagcctcctcctga

SEQ ID NO: 298250 - DNA, 15 bp, Homo sapiens
gcagcctctgccagg

SEQ ID NO: 298251 - DNA, 17 bp, Homo sapiens
gcagcctgagctccacc

SEQ ID NO: 298252 - DNA, 18 bp, Homo sapiens
gcagcctgagctccaccc

SEQ ID NO: 298253 - DNA, 19 bp, Homo sapiens
gcagcctgagctccaccct

SEQ ID NO: 298254 - DNA, 22 bp, Homo sapiens
gcagcctgagctccaccctccc

SEQ ID NO: 298255 - DNA, 13 bp, Homo sapiens
gcagcctgatggc

SEQ ID NO: 298256 - DNA, 17 bp, Homo sapiens
gcagcctgatggccaag

SEQ ID NO: 298257 - DNA, 19 bp, Homo sapiens
gcagcctgatggccaaggg

SEQ ID NO: 298258 - DNA, 20 bp, Homo sapiens
gcagcctgatggccaagggg

SEQ ID NO: 298259 - DNA, 23 bp, Homo sapiens
gcagcctgatggccaagggggtg

SEQ ID NO: 298260 - DNA, 22 bp, Homo sapiens
gcagcctgcttcccacctccct

SEQ ID NO: 298261 - DNA, 12 bp, Homo sapiens
gcagcctggagg

SEQ ID NO: 298262 - DNA, 13 bp, Homo sapiens
gcagcctggctcc

SEQ ID NO: 298263 - DNA, 23 bp, Homo sapiens
gcagcctggttccctctttcctg

SEQ ID NO: 298264 - DNA, 13 bp, Homo sapiens
gcagcctgtgagg

SEQ ID NO: 298265 - DNA, 14 bp, Homo sapiens
gcagcctgtggcat

SEQ ID NO: 298266 - DNA, 16 bp, Homo sapiens
gcagcctgtggcatct

SEQ ID NO: 298267 - DNA, 17 bp, Homo sapiens
gcagcctgtgggagaag

SEQ ID NO: 298268 - DNA, 18 bp, Homo sapiens
gcagcctgtgggagaagg

SEQ ID NO: 298269 - DNA, 19 bp, Homo sapiens
gcagcctgtgggagaaggg

SEQ ID NO: 298270 - DNA, 19 bp, Homo sapiens
gcagccttgaccacggctg

SEQ ID NO: 298271 - DNA, 13 bp, Homo sapiens
gcagcgcctcccg

SEQ ID NO: 298272 - DNA, 15 bp, Homo sapiens
gcagcgcctcccgcc

SEQ ID NO: 298273 - DNA, 22 bp, Homo sapiens
gcagcggtggaaggagcctgcg

SEQ ID NO: 298274 - DNA, 22 bp, Homo sapiens
gcagctaaaagcatccctgtga

SEQ ID NO: 298275 - DNA, 22 bp, Homo sapiens
gcagctagactggagtgaggct

SEQ ID NO: 298276 - DNA, 17 bp, Homo sapiens
gcagctattcacacaca

SEQ ID NO: 298277 - DNA, 18 bp, Homo sapiens
gcagctcacccctgggca

SEQ ID NO: 298278 - DNA, 12 bp, Homo sapiens
gcagctcaggcg

SEQ ID NO: 298279 - DNA, 14 bp, Homo sapiens
gcagctcaggcgca

SEQ ID NO: 298280 - DNA, 20 bp, Homo sapiens
gcagctcaggcgcagcccta

SEQ ID NO: 298281 - DNA, 15 bp, Homo sapiens
gcagctccccaggag

SEQ ID NO: 298282 - DNA, 18 bp, Homo sapiens
gcagctccgcctggcacc

SEQ ID NO: 298283 - DNA, 17 bp, Homo sapiens
gcagctcctctccttgg

SEQ ID NO: 298284 - DNA, 21 bp, Homo sapiens
gcagctctccagtcaggaggc

SEQ ID NO: 298285 - DNA, 13 bp, Homo sapiens
gcagctcttctgg

SEQ ID NO: 298286 - DNA, 20 bp, Homo sapiens
gcagctcttctgggcagagc

SEQ ID NO: 298287 - DNA, 22 bp, Homo sapiens
gcagctcttctgggcagagcct

SEQ ID NO: 298288 - DNA, 24 bp, Homo sapiens
gcagctcttctgggcagagcctgt

SEQ ID NO: 298289 - DNA, 15 bp, Homo sapiens
gcagctgaaaagtaa

SEQ ID NO: 298290 - DNA, 21 bp, Homo sapiens
gcagctgaggacacaccccac

SEQ ID NO: 298291 - DNA, 13 bp, Homo sapiens
gcagctgaggccc

SEQ ID NO: 298292 - DNA, 19 bp, Homo sapiens
gcagctgaggccccagggc

SEQ ID NO: 298293 - DNA, 18 bp, Homo sapiens
gcagctgattttaacaat

SEQ ID NO: 298294 - DNA, 15 bp, Homo sapiens
gcagctgccagagaa

SEQ ID NO: 298295 - DNA, 13 bp, Homo sapiens
gcagctgctctta

SEQ ID NO: 298296 - DNA, 13 bp, Homo sapiens
gcagctgctggtt

SEQ ID NO: 298297 - DNA, 20 bp, Homo sapiens
gcagctgggacccctcccaa

SEQ ID NO: 298298 - DNA, 22 bp, Homo sapiens
gcagctgggacccctcccaacc

SEQ ID NO: 298299 - DNA, 12 bp, Homo sapiens
gcagctgggctg

SEQ ID NO: 298300 - DNA, 18 bp, Homo sapiens
gcagctggggagcagctg

SEQ ID NO: 298301 - DNA, 17 bp, Homo sapiens
gcagctgtcccctctcc

SEQ ID NO: 298302 - DNA, 20 bp, Homo sapiens
gcagctgtcccctctccctg

SEQ ID NO: 298303 - DNA, 13 bp, Homo sapiens
gcagcttcaaaac

SEQ ID NO: 298304 - DNA, 21 bp, Homo sapiens
gcagcttgcgttagaatgagg

SEQ ID NO: 298305 - DNA, 15 bp, Homo sapiens
gcagcttgctgcacc

SEQ ID NO: 298306 - DNA, 17 bp, Homo sapiens
gcagcttggctgagccc

SEQ ID NO: 298307 - DNA, 18 bp, Homo sapiens
gcaggaaagatcccaagt

SEQ ID NO: 298308 - DNA, 21 bp, Homo sapiens
gcaggaaatgagagatagagg

SEQ ID NO: 298309 - DNA, 14 bp, Homo sapiens
gcaggaacgagcac

SEQ ID NO: 298310 - DNA, 19 bp, Homo sapiens
gcaggaacgagcactggcc

SEQ ID NO: 298311 - DNA, 12 bp, Homo sapiens
gcaggaaggaga

SEQ ID NO: 298312 - DNA, 23 bp, Homo sapiens
gcaggaaggagagcctgctgcat

SEQ ID NO: 298313 - DNA, 23 bp, Homo sapiens
gcaggaagtcaggagccagcagg

SEQ ID NO: 298314 - DNA, 13 bp, Homo sapiens
gcaggaagtccct

SEQ ID NO: 298315 - DNA, 14 bp, Homo sapiens
gcaggaagtccctg

SEQ ID NO: 298316 - DNA, 17 bp, Homo sapiens
gcaggaagtccctgaga

SEQ ID NO: 298317 - DNA, 17 bp, Homo sapiens
gcaggaatcaaggagcc

SEQ ID NO: 298318 - DNA, 18 bp, Homo sapiens
gcaggaatcaaggagcct

SEQ ID NO: 298319 - DNA, 18 bp, Homo sapiens
gcaggaattggtggcaga

SEQ ID NO: 298320 - DNA, 20 bp, Homo sapiens
gcaggacacatcccggcctc

SEQ ID NO: 298321 - DNA, 15 bp, Homo sapiens
gcaggacctcagagt

SEQ ID NO: 298322 - DNA, 17 bp, Homo sapiens
gcaggagaatcagcctg

SEQ ID NO: 298323 - DNA, 18 bp, Homo sapiens
gcaggagacactggtctc

SEQ ID NO: 298324 - DNA, 22 bp, Homo sapiens
gcaggagacactggtctcagag

SEQ ID NO: 298325 - DNA, 23 bp, Homo sapiens
gcaggagacactggtctcagagg

SEQ ID NO: 298326 - DNA, 15 bp, Homo sapiens
gcaggagagagagag

SEQ ID NO: 298327 - DNA, 20 bp, Homo sapiens
gcaggagagagagagagaaa

SEQ ID NO: 298328 - DNA, 21 bp, Homo sapiens
gcaggagagagagagagaaag

SEQ ID NO: 298329 - DNA, 22 bp, Homo sapiens
gcaggagagagagagagaaaga

SEQ ID NO: 298330 - DNA, 15 bp, Homo sapiens
gcaggagcagctgtg

SEQ ID NO: 298331 - DNA, 17 bp, Homo sapiens
gcaggagcagctgtgct

SEQ ID NO: 298332 - DNA, 16 bp, Homo sapiens
gcaggagctcagatga

SEQ ID NO: 298333 - DNA, 16 bp, Homo sapiens
gcaggaggcctgggag

SEQ ID NO: 298334 - DNA, 23 bp, Homo sapiens
gcaggaggcctgggagggcaagg

SEQ ID NO: 298335 - DNA, 13 bp, Homo sapiens
gcaggagggtggc

SEQ ID NO: 298336 - DNA, 17 bp, Homo sapiens
gcaggagggtggcactt

SEQ ID NO: 298337 - DNA, 18 bp, Homo sapiens
gcaggagtctctgccacc

SEQ ID NO: 298338 - DNA, 20 bp, Homo sapiens
gcaggagtctctgccaccca

SEQ ID NO: 298339 - DNA, 21 bp, Homo sapiens
gcaggagtctctgccacccac

SEQ ID NO: 298340 - DNA, 17 bp, Homo sapiens
gcaggagtggaaggtga

SEQ ID NO: 298341 - DNA, 21 bp, Homo sapiens
gcaggagtggaaggtgaggcg

SEQ ID NO: 298342 - DNA, 19 bp, Homo sapiens
gcaggcaaaaaagggacag

SEQ ID NO: 298343 - DNA, 22 bp, Homo sapiens
gcaggcagagctcagcacagcc

SEQ ID NO: 298344 - DNA, 14 bp, Homo sapiens
gcaggcagccttga

SEQ ID NO: 298345 - DNA, 16 bp, Homo sapiens
gcaggcagccttgacc

SEQ ID NO: 298346 - DNA, 22 bp, Homo sapiens
gcaggcatatcaacttgaggcc

SEQ ID NO: 298347 - DNA, 21 bp, Homo sapiens
gcaggccaaggccttctcctc

SEQ ID NO: 298348 - DNA, 13 bp, Homo sapiens
gcaggccaccagc

SEQ ID NO: 298349 - DNA, 22 bp, Homo sapiens
gcaggccagctgtggttttctt

SEQ ID NO: 298350 - DNA, 21 bp, Homo sapiens
gcaggccagcttcgtgctgga

SEQ ID NO: 298351 - DNA, 12 bp, Homo sapiens
gcaggcccacct

SEQ ID NO: 298352 - DNA, 14 bp, Homo sapiens
gcaggcccagagga

SEQ ID NO: 298353 - DNA, 15 bp, Homo sapiens
gcaggcccagcagac

SEQ ID NO: 298354 - DNA, 13 bp, Homo sapiens
gcaggccccagcc

SEQ ID NO: 298355 - DNA, 16 bp, Homo sapiens
gcaggccccagccaag

SEQ ID NO: 298356 - DNA, 23 bp, Homo sapiens
gcaggccctccgcgggggacagg

SEQ ID NO: 298357 - DNA, 11 bp, Homo sapiens
gcaggccctgc

SEQ ID NO: 298358 - DNA, 14 bp, Homo sapiens
gcaggccctgcctt

SEQ ID NO: 298359 - DNA, 13 bp, Homo sapiens
gcaggcctttcct

SEQ ID NO: 298360 - DNA, 17 bp, Homo sapiens
gcaggcgcgcaccgccc

SEQ ID NO: 298361 - DNA, 21 bp, Homo sapiens
gcaggcgcgcaccgcccaacc

SEQ ID NO: 298362 - DNA, 22 bp, Homo sapiens
gcaggcggcctttgttgctcag

SEQ ID NO: 298363 - DNA, 15 bp, Homo sapiens
gcaggcggtatccag

SEQ ID NO: 298364 - DNA, 18 bp, Homo sapiens
gcaggcggtatccagagg

SEQ ID NO: 298365 - DNA, 20 bp, Homo sapiens
gcaggcggtccccatcccca

SEQ ID NO: 298366 - DNA, 24 bp, Homo sapiens
gcaggcggtccccatccccaccag

SEQ ID NO: 298367 - DNA, 24 bp, Homo sapiens
gcaggctcctcctctctggacttt

SEQ ID NO: 298368 - DNA, 15 bp, Homo sapiens
gcaggctctgggctc

SEQ ID NO: 298369 - DNA, 16 bp, Homo sapiens
gcagtgttcgcttggc

SEQ ID NO: 298370 - DNA, 22 bp, Homo sapiens
gcagtgttcgcttggctccatg

SEQ ID NO: 298371 - DNA, 20 bp, Homo sapiens
gcagttaacatctgaagtgt

SEQ ID NO: 298372 - DNA, 21 bp, Homo sapiens
gcagttaccgaggagctaaac

SEQ ID NO: 298373 - DNA, 23 bp, Homo sapiens
gcagttcccccaacctcagactt

SEQ ID NO: 298374 - DNA, 19 bp, Homo sapiens
gcagttctgcaaatagaaa

SEQ ID NO: 298375 - DNA, 14 bp, Homo sapiens
gcagttggccagag

SEQ ID NO: 298376 - DNA, 17 bp, Homo sapiens
gcagttgggagtacata

SEQ ID NO: 298377 - DNA, 16 bp, Homo sapiens
gcagttttaagaattg

SEQ ID NO: 298378 - DNA, 15 bp, Homo sapiens
gcagttttccaggaa

SEQ ID NO: 298379 - DNA, 12 bp, Homo sapiens
gcataaaagtta

SEQ ID NO: 298380 - DNA, 14 bp, Homo sapiens
gcataataagctaa

SEQ ID NO: 298381 - DNA, 16 bp, Homo sapiens
gcataatagtcaattt

SEQ ID NO: 298382 - DNA, 23 bp, Homo sapiens
gcataattcggaagggaaaacag

SEQ ID NO: 298383 - DNA, 17 bp, Homo sapiens
gcatacaaaaatatatt

SEQ ID NO: 298384 - DNA, 21 bp, Homo sapiens
gcatacaaaaatatattaaaa

SEQ ID NO: 298385 - DNA, 14 bp, Homo sapiens
gcatacacatgcac

SEQ ID NO: 298386 - DNA, 16 bp, Homo sapiens
gcatactttctctcta

SEQ ID NO: 298387 - DNA, 18 bp, Homo sapiens
gcatagccctcctgagca

SEQ ID NO: 298388 - DNA, 16 bp, Homo sapiens
gcataggcctgggtgc

SEQ ID NO: 298389 - DNA, 17 bp, Homo sapiens
gcataggcctgggtgct

SEQ ID NO: 298390 - DNA, 21 bp, Homo sapiens
gcatagtattccattgtgtga

SEQ ID NO: 298391 - DNA, 14 bp, Homo sapiens
gcatatataaaaca

SEQ ID NO: 298392 - DNA, 16 bp, Homo sapiens
gcatatataaaacaaa

SEQ ID NO: 298393 - DNA, 19 bp, Homo sapiens
gcatatattcatacctgtt

SEQ ID NO: 298394 - DNA, 21 bp, Homo sapiens
gcatatggagtgcctgtacaa

SEQ ID NO: 298395 - DNA, 13 bp, Homo sapiens
gcatatgtgagtg

SEQ ID NO: 298396 - DNA, 22 bp, Homo sapiens
gcatattctattgtattatttg

SEQ ID NO: 298397 - DNA, 16 bp, Homo sapiens
gcatattttctccgaa

SEQ ID NO: 298398 - DNA, 13 bp, Homo sapiens
gcatcaaaataca

SEQ ID NO: 298399 - DNA, 16 bp, Homo sapiens
gcatcaaacatgaaaa

SEQ ID NO: 298400 - DNA, 22 bp, Homo sapiens
gcatcaaacatgaaaacattga

SEQ ID NO: 298401 - DNA, 20 bp, Homo sapiens
gcatcacacgcaggttacct

SEQ ID NO: 298402 - DNA, 22 bp, Homo sapiens
gcatcaccaccacacccctgcc

SEQ ID NO: 298403 - DNA, 14 bp, Homo sapiens
gcatcagcgtggca

SEQ ID NO: 298404 - DNA, 16 bp, Homo sapiens
gcatcagctttccctg

SEQ ID NO: 298405 - DNA, 19 bp, Homo sapiens
gcatcagctttccctggct

SEQ ID NO: 298406 - DNA, 17 bp, Homo sapiens
gcatcaggcactggtgg

SEQ ID NO: 298407 - DNA, 20 bp, Homo sapiens
gcatcatctgtagatactag

SEQ ID NO: 298408 - DNA, 15 bp, Homo sapiens
gcatccacccagtgc

SEQ ID NO: 298409 - DNA, 19 bp, Homo sapiens
gcatccacccagtgctgcc

SEQ ID NO: 298410 - DNA, 20 bp, Homo sapiens
gcatccacccagtgctgcca

SEQ ID NO: 298411 - DNA, 21 bp, Homo sapiens
gcatccacccagtgctgccat

SEQ ID NO: 298412 - DNA, 22 bp, Homo sapiens
gcatccacccagtgctgccatg

SEQ ID NO: 298413 - DNA, 17 bp, Homo sapiens
gcatccaggcctgaggc

SEQ ID NO: 298414 - DNA, 21 bp, Homo sapiens
gcatccatgcggccggcctgg

SEQ ID NO: 298415 - DNA, 22 bp, Homo sapiens
gcatccatgcggccggcctggg

SEQ ID NO: 298416 - DNA, 17 bp, Homo sapiens
gcatcccagtggcctca

SEQ ID NO: 298417 - DNA, 18 bp, Homo sapiens
gcatccccagccccctgg

SEQ ID NO: 298418 - DNA, 19 bp, Homo sapiens
gcatccccagccccctggc

SEQ ID NO: 298419 - DNA, 16 bp, Homo sapiens
gcatcccccaaagttc

SEQ ID NO: 298420 - DNA, 14 bp, Homo sapiens
gcatcccctgtgaa

SEQ ID NO: 298421 - DNA, 18 bp, Homo sapiens
gcatccctgaggagccag

SEQ ID NO: 298422 - DNA, 14 bp, Homo sapiens
gcatccctgtgagc

SEQ ID NO: 298423 - DNA, 20 bp, Homo sapiens
gcatcccttggcccctctct

SEQ ID NO: 298424 - DNA, 17 bp, Homo sapiens
gcatccgcctctgagcc

SEQ ID NO: 298425 - DNA, 21 bp, Homo sapiens
gcatccgcctctgagccagga

SEQ ID NO: 298426 - DNA, 22 bp, Homo sapiens
gcatcctatcgatctggaaaga

SEQ ID NO: 298427 - DNA, 17 bp, Homo sapiens
gcatcctcctcccaact

SEQ ID NO: 298428 - DNA, 16 bp, Homo sapiens
gcatccttcccagcag

SEQ ID NO: 298429 - DNA, 22 bp, Homo sapiens
gcatccttgaggacctccacct

SEQ ID NO: 298430 - DNA, 15 bp, Homo sapiens
gcatcgtagaagaga

SEQ ID NO: 298431 - DNA, 19 bp, Homo sapiens
gcatcgtagaagagatgtg

SEQ ID NO: 298432 - DNA, 22 bp, Homo sapiens
gcatcgtgacccttcagggcca

SEQ ID NO: 298433 - DNA, 21 bp, Homo sapiens
gcatctaagacattcaccaac

SEQ ID NO: 298434 - DNA, 20 bp, Homo sapiens
gcatctatcgagtttgcaat

SEQ ID NO: 298435 - DNA, 13 bp, Homo sapiens
gcatctccaggaa

SEQ ID NO: 298436 - DNA, 16 bp, Homo sapiens
gcatctcctctcccca

SEQ ID NO: 298437 - DNA, 23 bp, Homo sapiens
gcatctctccccatatataaatt

SEQ ID NO: 298438 - DNA, 17 bp, Homo sapiens
gcatctgagtccagctc

SEQ ID NO: 298439 - DNA, 19 bp, Homo sapiens
gcatctgagtccagctccc

SEQ ID NO: 298440 - DNA, 18 bp, Homo sapiens
gcatctgctctgagacgg

SEQ ID NO: 298441 - DNA, 15 bp, Homo sapiens
gcatctgtctgtcct

SEQ ID NO: 298442 - DNA, 23 bp, Homo sapiens
gcatctgttacggttaatgagag

SEQ ID NO: 298443 - DNA, 13 bp, Homo sapiens
gcatcttggaaat

SEQ ID NO: 298444 - DNA, 15 bp, Homo sapiens
gcatctttgccttgg

SEQ ID NO: 298445 - DNA, 23 bp, Homo sapiens
gcatctttgccttgggctgctcc

SEQ ID NO: 298446 - DNA, 11 bp, Homo sapiens
gcatgaccctg

SEQ ID NO: 298447 - DNA, 22 bp, Homo sapiens
gcatgacctgtgaccagcactg

SEQ ID NO: 298448 - DNA, 20 bp, Homo sapiens
gcatgaccttttggcctttg

SEQ ID NO: 298449 - DNA, 22 bp, Homo sapiens
gcatgagaatgtcatttgctaa

SEQ ID NO: 298450 - DNA, 22 bp, Homo sapiens
gcatgagtggccttaataaata

SEQ ID NO: 298451 - DNA, 16 bp, Homo sapiens
gcatgatccagctgtg

SEQ ID NO: 298452 - DNA, 17 bp, Homo sapiens
gcatgcagcaacaccca

SEQ ID NO: 298453 - DNA, 19 bp, Homo sapiens
gcatgcagcaacacccaag

SEQ ID NO: 298454 - DNA, 12 bp, Homo sapiens
gcatgcagcagc

SEQ ID NO: 298455 - DNA, 18 bp, Homo sapiens
gcatgccaccctcacaca

SEQ ID NO: 298456 - DNA, 22 bp, Homo sapiens
gcatgccacgccccgtgtctgg

SEQ ID NO: 298457 - DNA, 17 bp, Homo sapiens
gcatgccaggctgggca

SEQ ID NO: 298458 - DNA, 18 bp, Homo sapiens
gcatgccaggctgggcac

SEQ ID NO: 298459 - DNA, 15 bp, Homo sapiens
gcatgccccacccac

SEQ ID NO: 298460 - DNA, 17 bp, Homo sapiens
gcatgccccacccaccc

SEQ ID NO: 298461 - DNA, 18 bp, Homo sapiens
gcatgccccacccacccc

SEQ ID NO: 298462 - DNA, 19 bp, Homo sapiens
gcatgccccacccacccct

SEQ ID NO: 298463 - DNA, 21 bp, Homo sapiens
gcatgccccacccacccctcc

SEQ ID NO: 298464 - DNA, 13 bp, Homo sapiens
gcatgccccttgg

SEQ ID NO: 298465 - DNA, 19 bp, Homo sapiens
gcatgccgagtgccccaga

SEQ ID NO: 298466 - DNA, 13 bp, Homo sapiens
gcatgcctgtgtg

SEQ ID NO: 298467 - DNA, 14 bp, Homo sapiens
gcatgctcagtatt

SEQ ID NO: 298468 - DNA, 15 bp, Homo sapiens
gcatgctcagtattg

SEQ ID NO: 298469 - DNA, 14 bp, Homo sapiens
gcatgctcccagca

SEQ ID NO: 298470 - DNA, 12 bp, Homo sapiens
gcatgctgcctg

SEQ ID NO: 298471 - DNA, 21 bp, Homo sapiens
gcatgctgcctgcctccggcc

SEQ ID NO: 298472 - DNA, 16 bp, Homo sapiens
gcatgctgctggacag

SEQ ID NO: 298473 - DNA, 13 bp, Homo sapiens
gcatgctgcttta

SEQ ID NO: 298474 - DNA, 14 bp, Homo sapiens
gcatgctttgctgc

SEQ ID NO: 298475 - DNA, 15 bp, Homo sapiens
gcatgctttgctgct

SEQ ID NO: 298476 - DNA, 22 bp, Homo sapiens
gcatgctttggaaatttggaag

SEQ ID NO: 298477 - DNA, 17 bp, Homo sapiens
gcatggacagggccagg

SEQ ID NO: 298478 - DNA, 15 bp, Homo sapiens
gcatggactctgggt

SEQ ID NO: 298479 - DNA, 17 bp, Homo sapiens
gcatggagtgtgtattg

SEQ ID NO: 298480 - DNA, 22 bp, Homo sapiens
gcatggagtgtgtattgttccc

SEQ ID NO: 298481 - DNA, 20 bp, Homo sapiens
gcatggcagcaggcctgttg

SEQ ID NO: 298482 - DNA, 13 bp, Homo sapiens
gcatggccaggtg

SEQ ID NO: 298483 - DNA, 14 bp, Homo sapiens
gcatggccaggtgg

SEQ ID NO: 298484 - DNA, 16 bp, Homo sapiens
gcatggcccagcctgg

SEQ ID NO: 298485 - DNA, 19 bp, Homo sapiens
gcatggcctcccagccacc

SEQ ID NO: 298486 - DNA, 15 bp, Homo sapiens
gcatggctccagtct

SEQ ID NO: 298487 - DNA, 19 bp, Homo sapiens
gcatgggaaagccacctct

SEQ ID NO: 298488 - DNA, 20 bp, Homo sapiens
gcatgggaaagccacctctc

SEQ ID NO: 298489 - DNA, 19 bp, Homo sapiens
gcatgggaatgaatgtcag

SEQ ID NO: 298490 - DNA, 16 bp, Homo sapiens
gcatgggggaggctct

SEQ ID NO: 298491 - DNA, 15 bp, Homo sapiens
gcatggggtgggcct

SEQ ID NO: 298492 - DNA, 19 bp, Homo sapiens
gcatggggtgggcctctgg

SEQ ID NO: 298493 - DNA, 19 bp, Homo sapiens
gcatggtggggcatgcctg

SEQ ID NO: 298494 - DNA, 19 bp, Homo sapiens
gcatggttccttccctggg

SEQ ID NO: 298495 - DNA, 22 bp, Homo sapiens
gcatggttccttccctgggaag

SEQ ID NO: 298496 - DNA, 17 bp, Homo sapiens
gcatgtaaaatcttcag

SEQ ID NO: 298497 - DNA, 19 bp, Homo sapiens
gcatgtaaaatcttcagct

SEQ ID NO: 298498 - DNA, 22 bp, Homo sapiens
gccaggcagggagtgtctgcag

SEQ ID NO: 298499 - DNA, 21 bp, Homo sapiens
gccaggcatggcccagcctgg

SEQ ID NO: 298500 - DNA, 15 bp, Homo sapiens
gccaggccatggcca

SEQ ID NO: 298501 - DNA, 16 bp, Homo sapiens
gccaggccctcctgct

SEQ ID NO: 298502 - DNA, 22 bp, Homo sapiens
gccaggccctcctgctggctga

SEQ ID NO: 298503 - DNA, 15 bp, Homo sapiens
gccaggcctgccagc

SEQ ID NO: 298504 - DNA, 16 bp, Homo sapiens
gccaggcctgccagcc

SEQ ID NO: 298505 - DNA, 14 bp, Homo sapiens
gccaggcctgggtc

SEQ ID NO: 298506 - DNA, 21 bp, Homo sapiens
gccaggcctgggtctgtgtct

SEQ ID NO: 298507 - DNA, 23 bp, Homo sapiens
gccaggcgggagatggacccctc

SEQ ID NO: 298508 - DNA, 15 bp, Homo sapiens
gccaggcgttggtgc

SEQ ID NO: 298509 - DNA, 17 bp, Homo sapiens
gccaggcgttggtgcca

SEQ ID NO: 298510 - DNA, 21 bp, Homo sapiens
gccaggcgttggtgccacttc

SEQ ID NO: 298511 - DNA, 14 bp, Homo sapiens
gccaggctctccct

SEQ ID NO: 298512 - DNA, 14 bp, Homo sapiens
gccaggctgccaag

SEQ ID NO: 298513 - DNA, 21 bp, Homo sapiens
gccaggctgcggtgggcagcc

SEQ ID NO: 298514 - DNA, 11 bp, Homo sapiens
gccagggagct

SEQ ID NO: 298515 - DNA, 20 bp, Homo sapiens
gccagggatggggccacagc

SEQ ID NO: 298516 - DNA, 23 bp, Homo sapiens
gccagggctccacgggggcctag

SEQ ID NO: 298517 - DNA, 13 bp, Homo sapiens
gccaggggatctg

SEQ ID NO: 298518 - DNA, 20 bp, Homo sapiens
gccaggggatctgggtgtgt

SEQ ID NO: 298519 - DNA, 16 bp, Homo sapiens
gccaggggcttttgct

SEQ ID NO: 298520 - DNA, 23 bp, Homo sapiens
gccagggtagacttggagctgtc

SEQ ID NO: 298521 - DNA, 22 bp, Homo sapiens
gccagggtagagcaaaggagac

SEQ ID NO: 298522 - DNA, 12 bp, Homo sapiens
gccagggtctcg

SEQ ID NO: 298523 - DNA, 14 bp, Homo sapiens
gccaggtccctgga

SEQ ID NO: 298524 - DNA, 17 bp, Homo sapiens
gccaggtccctggacca

SEQ ID NO: 298525 - DNA, 20 bp, Homo sapiens
gccaggtccctggaccagcc

SEQ ID NO: 298526 - DNA, 21 bp, Homo sapiens
gccaggtccctggaccagcct

SEQ ID NO: 298527 - DNA, 18 bp, Homo sapiens
gccaggtggccactccag

SEQ ID NO: 298528 - DNA, 17 bp, Homo sapiens
gccaggtgtcctgactg

SEQ ID NO: 298529 - DNA, 15 bp, Homo sapiens
gccaggttgcagctg

SEQ ID NO: 298530 - DNA, 20 bp, Homo sapiens
gccaggttgcagctgctctt

SEQ ID NO: 298531 - DNA, 13 bp, Homo sapiens
gccaggtttgtta

SEQ ID NO: 298532 - DNA, 20 bp, Homo sapiens
gccagtaacgcgtcttcctg

SEQ ID NO: 298533 - DNA, 21 bp, Homo sapiens
gccagtaacgcgtcttcctga

SEQ ID NO: 298534 - DNA, 15 bp, Homo sapiens
gccagtatataagct

SEQ ID NO: 298535 - DNA, 13 bp, Homo sapiens
gccagtcccaggg

SEQ ID NO: 298536 - DNA, 16 bp, Homo sapiens
gccagtcccaggggca

SEQ ID NO: 298537 - DNA, 13 bp, Homo sapiens
gccagtcctgcaa

SEQ ID NO: 298538 - DNA, 14 bp, Homo sapiens
gccagtcctgcctg

SEQ ID NO: 298539 - DNA, 18 bp, Homo sapiens
gccagtcctgcctggcca

SEQ ID NO: 298540 - DNA, 14 bp, Homo sapiens
gccagtctcccagg

SEQ ID NO: 298541 - DNA, 15 bp, Homo sapiens
gccagtctcccaggc

SEQ ID NO: 298542 - DNA, 16 bp, Homo sapiens
gccagtctgggctgcc

SEQ ID NO: 298543 - DNA, 20 bp, Homo sapiens
gccagtcttgcctaggccaa

SEQ ID NO: 298544 - DNA, 13 bp, Homo sapiens
gccagtgacagac

SEQ ID NO: 298545 - DNA, 14 bp, Homo sapiens
gccagtgacagaca

SEQ ID NO: 298546 - DNA, 15 bp, Homo sapiens
gccagtgactccagg

SEQ ID NO: 298547 - DNA, 21 bp, Homo sapiens
gccagtgactccaggagagga

SEQ ID NO: 298548 - DNA, 13 bp, Homo sapiens
gccagtgactttt

SEQ ID NO: 298549 - DNA, 13 bp, Homo sapiens
gccagtggacaga

SEQ ID NO: 298550 - DNA, 24 bp, Homo sapiens
gccagtggacagagggagaaggga

SEQ ID NO: 298551 - DNA, 14 bp, Homo sapiens
gccagtggctgggg

SEQ ID NO: 298552 - DNA, 13 bp, Homo sapiens
gccataacttgaa

SEQ ID NO: 298553 - DNA, 22 bp, Homo sapiens
gccataattctaagttatttac

SEQ ID NO: 298554 - DNA, 21 bp, Homo sapiens
gccatacatgttattgttttc

SEQ ID NO: 298555 - DNA, 16 bp, Homo sapiens
gccataccttgagacc

SEQ ID NO: 298556 - DNA, 13 bp, Homo sapiens
gccatagccccat

SEQ ID NO: 298557 - DNA, 19 bp, Homo sapiens
gccatatattttctgagta

SEQ ID NO: 298558 - DNA, 16 bp, Homo sapiens
gccatcacttctcccc

SEQ ID NO: 298559 - DNA, 17 bp, Homo sapiens
gccatcacttctccccg

SEQ ID NO: 298560 - DNA, 17 bp, Homo sapiens
gccatcagcccctgctg

SEQ ID NO: 298561 - DNA, 18 bp, Homo sapiens
gccatcagcccctgctgc

SEQ ID NO: 298562 - DNA, 19 bp, Homo sapiens
gccatcagcccctgctgct

SEQ ID NO: 298563 - DNA, 20 bp, Homo sapiens
gccatcatgcctgactaatt

SEQ ID NO: 298564 - DNA, 15 bp, Homo sapiens
gccatccacatttta

SEQ ID NO: 298565 - DNA, 18 bp, Homo sapiens
gccatccacattttaaca

SEQ ID NO: 298566 - DNA, 19 bp, Homo sapiens
gccatcctaaaagccaccc

SEQ ID NO: 298567 - DNA, 18 bp, Homo sapiens
gccatctaatgcttgttt

SEQ ID NO: 298568 - DNA, 17 bp, Homo sapiens
gccatctgtgggcacgc

SEQ ID NO: 298569 - DNA, 19 bp, Homo sapiens
gccatgacaacttctaatt

SEQ ID NO: 298570 - DNA, 17 bp, Homo sapiens
gccatgagctccagacc

SEQ ID NO: 298571 - DNA, 18 bp, Homo sapiens
gccatgaggaacaaggca

SEQ ID NO: 298572 - DNA, 20 bp, Homo sapiens
gccatgaggaacaaggcaag

SEQ ID NO: 298573 - DNA, 17 bp, Homo sapiens
gccatgatgtggagtgg

SEQ ID NO: 298574 - DNA, 18 bp, Homo sapiens
gccatgcaactccatgcc

SEQ ID NO: 298575 - DNA, 20 bp, Homo sapiens
gccatgcaactccatgccta

SEQ ID NO: 298576 - DNA, 14 bp, Homo sapiens
gccatgccactgcc

SEQ ID NO: 298577 - DNA, 18 bp, Homo sapiens
gccatgccactgccaggc

SEQ ID NO: 298578 - DNA, 22 bp, Homo sapiens
gccatgccactgccaggcacct

SEQ ID NO: 298579 - DNA, 23 bp, Homo sapiens
gccatgccactgccaggcacctg

SEQ ID NO: 298580 - DNA, 21 bp, Homo sapiens
gccatgctcaacccccctccc

SEQ ID NO: 298581 - DNA, 22 bp, Homo sapiens
gccatgctcaacccccctccca

SEQ ID NO: 298582 - DNA, 12 bp, Homo sapiens
gccatgctgcta

SEQ ID NO: 298583 - DNA, 23 bp, Homo sapiens
gccatggaagctggcaggagaca

SEQ ID NO: 298584 - DNA, 20 bp, Homo sapiens
gccatggactctacactgtg

SEQ ID NO: 298585 - DNA, 22 bp, Homo sapiens
gccatggactctacactgtgaa

SEQ ID NO: 298586 - DNA, 23 bp, Homo sapiens
gccatggactctacactgtgaac

SEQ ID NO: 298587 - DNA, 16 bp, Homo sapiens
gccatggaggcacaca

SEQ ID NO: 298588 - DNA, 18 bp, Homo sapiens
gccatggaggcacacagc

SEQ ID NO: 298589 - DNA, 21 bp, Homo sapiens
gccatggaggcacacagctgc

SEQ ID NO: 298590 - DNA, 14 bp, Homo sapiens
gccatggccaaggg

SEQ ID NO: 298591 - DNA, 17 bp, Homo sapiens
gccatggctttcatcct

SEQ ID NO: 298592 - DNA, 19 bp, Homo sapiens
gccatggctttcatcctgt

SEQ ID NO: 298593 - DNA, 20 bp, Homo sapiens
gccatggctttcatcctgtg

SEQ ID NO: 298594 - DNA, 23 bp, Homo sapiens
gccatggctttcatcctgtgtcc

SEQ ID NO: 298595 - DNA, 13 bp, Homo sapiens
gccatgggcctgc

SEQ ID NO: 298596 - DNA, 16 bp, Homo sapiens
gccatgggcctgctgc

SEQ ID NO: 298597 - DNA, 17 bp, Homo sapiens
gccatgggcctgggcct

SEQ ID NO: 298598 - DNA, 19 bp, Homo sapiens
gccatgggcctgggcctgc

SEQ ID NO: 298599 - DNA, 15 bp, Homo sapiens
gccatgtgaagaggg

SEQ ID NO: 298600 - DNA, 14 bp, Homo sapiens
gccatgtgagccac

SEQ ID NO: 298601 - DNA, 17 bp, Homo sapiens
gccatgtgtttatccta

SEQ ID NO: 298602 - DNA, 22 bp, Homo sapiens
gccattcatctgggctggcaga

SEQ ID NO: 298603 - DNA, 12 bp, Homo sapiens
gccattccctgt

SEQ ID NO: 298604 - DNA, 21 bp, Homo sapiens
gccattcctgttctctttgcc

SEQ ID NO: 298605 - DNA, 18 bp, Homo sapiens
gccattctcctgcctcag

SEQ ID NO: 298606 - DNA, 21 bp, Homo sapiens
gccattctcctgcctcagcct

SEQ ID NO: 298607 - DNA, 18 bp, Homo sapiens
gccattgtactccagcct

SEQ ID NO: 298608 - DNA, 18 bp, Homo sapiens
gccattgtcgtttcattc

SEQ ID NO: 298609 - DNA, 16 bp, Homo sapiens
gccatttgtgtttata

SEQ ID NO: 298610 - DNA, 15 bp, Homo sapiens
gccattttgtaactg

SEQ ID NO: 298611 - DNA, 20 bp, Homo sapiens
gccattttgtaactgcctac

SEQ ID NO: 298612 - DNA, 17 bp, Homo sapiens
gccattttttgaggaga

SEQ ID NO: 298613 - DNA, 16 bp, Homo sapiens
gcccaaagctggagcc

SEQ ID NO: 298614 - DNA, 17 bp, Homo sapiens
gcccaaagtctgtgtga

SEQ ID NO: 298615 - DNA, 22 bp, Homo sapiens
gcccaaattatcaagctaataa

SEQ ID NO: 298616 - DNA, 14 bp, Homo sapiens
gcccaaccaggagg

SEQ ID NO: 298617 - DNA, 20 bp, Homo sapiens
gcccaaccaggaggggtctg

SEQ ID NO: 298618 - DNA, 19 bp, Homo sapiens
gcccaacccccacctcccg

SEQ ID NO: 298619 - DNA, 22 bp, Homo sapiens
gcccaaccgggaaaggcatcta

SEQ ID NO: 298620 - DNA, 13 bp, Homo sapiens
gcccaacctcagc

SEQ ID NO: 298621 - DNA, 24 bp, Homo sapiens
gcccaacctgctctcctcttgcca

SEQ ID NO: 298622 - DNA, 23 bp, Homo sapiens
gcccaagagcagagtctgggcct

SEQ ID NO: 298623 - DNA, 14 bp, Homo sapiens
gcccaagcatgccc

SEQ ID NO: 298624 - DNA, 15 bp, Homo sapiens
gcccaagcatgcccc

SEQ ID NO: 298625 - DNA, 19 bp, Homo sapiens
gcccaagcatgccccaccc

SEQ ID NO: 298626 - DNA, 15 bp, Homo sapiens
gcccaaggtcccctc

SEQ ID NO: 298627 - DNA, 22 bp, Homo sapiens
gcccgagagctcttagttttta

SEQ ID NO: 298628 - DNA, 23 bp, Homo sapiens
gcccgagcgcgtgccttccccgt

SEQ ID NO: 298629 - DNA, 14 bp, Homo sapiens
gcccgagctggtgc

SEQ ID NO: 298630 - DNA, 15 bp, Homo sapiens
gcccgagctggtgca

SEQ ID NO: 298631 - DNA, 15 bp, Homo sapiens
gcccgatattctccc

SEQ ID NO: 298632 - DNA, 21 bp, Homo sapiens
gcccgatattctccctgacct

SEQ ID NO: 298633 - DNA, 23 bp, Homo sapiens
gcccgcacaccctcactctgcca

SEQ ID NO: 298634 - DNA, 14 bp, Homo sapiens
gcccgcacagcagc

SEQ ID NO: 298635 - DNA, 15 bp, Homo sapiens
gcccgcacccccacc

SEQ ID NO: 298636 - DNA, 19 bp, Homo sapiens
gcccgcacccccacccttt

SEQ ID NO: 298637 - DNA, 21 bp, Homo sapiens
gcccgcacccccaccctttgg

SEQ ID NO: 298638 - DNA, 13 bp, Homo sapiens
gcccgcagagccc

SEQ ID NO: 298639 - DNA, 14 bp, Homo sapiens
gcccgcatgcagca

SEQ ID NO: 298640 - DNA, 19 bp, Homo sapiens
gcccgcatgcagcagcttg

SEQ ID NO: 298641 - DNA, 12 bp, Homo sapiens
gcccgccacctt

SEQ ID NO: 298642 - DNA, 18 bp, Homo sapiens
gcccgccagccagtggcc

SEQ ID NO: 298643 - DNA, 14 bp, Homo sapiens
gcccgccagcctca

SEQ ID NO: 298644 - DNA, 17 bp, Homo sapiens
gcccgccagcctcagtg

SEQ ID NO: 298645 - DNA, 12 bp, Homo sapiens
gcccgcccaccc

SEQ ID NO: 298646 - DNA, 15 bp, Homo sapiens
gcccgcccaccccgc

SEQ ID NO: 298647 - DNA, 22 bp, Homo sapiens
gcccgcccacctctgctgccca

SEQ ID NO: 298648 - DNA, 16 bp, Homo sapiens
gcccgcccacctgggc

SEQ ID NO: 298649 - DNA, 17 bp, Homo sapiens
gcccgcccactgtcctg

SEQ ID NO: 298650 - DNA, 17 bp, Homo sapiens
gcccgcccccgccctcg

SEQ ID NO: 298651 - DNA, 14 bp, Homo sapiens
gcccgcccgccggt

SEQ ID NO: 298652 - DNA, 13 bp, Homo sapiens
gcccgccctcctc

SEQ ID NO: 298653 - DNA, 18 bp, Homo sapiens
gcccgccctcctctgccc

SEQ ID NO: 298654 - DNA, 20 bp, Homo sapiens
gcccgccggttggccggctg

SEQ ID NO: 298655 - DNA, 17 bp, Homo sapiens
gcccgccgtgcctgcat

SEQ ID NO: 298656 - DNA, 19 bp, Homo sapiens
gcccgcctgccgtgcatgg

SEQ ID NO: 298657 - DNA, 18 bp, Homo sapiens
gcccgcctggcagaactg

SEQ ID NO: 298658 - DNA, 19 bp, Homo sapiens
gcccgcgtccaaccccggg

SEQ ID NO: 298659 - DNA, 17 bp, Homo sapiens
gcccgcgtctgtgccgc

SEQ ID NO: 298660 - DNA, 23 bp, Homo sapiens
gcccgctcaacctctcagatccc

SEQ ID NO: 298661 - DNA, 12 bp, Homo sapiens
gcccgctcccac

SEQ ID NO: 298662 - DNA, 14 bp, Homo sapiens
gcccgctcccacag

SEQ ID NO: 298663 - DNA, 14 bp, Homo sapiens
gcccgctgggctga

SEQ ID NO: 298664 - DNA, 16 bp, Homo sapiens
gcccgctgggctgagc

SEQ ID NO: 298665 - DNA, 15 bp, Homo sapiens
gcccgcttttgttct

SEQ ID NO: 298666 - DNA, 23 bp, Homo sapiens
gcccgcttttgttcttccccaca

SEQ ID NO: 298667 - DNA, 19 bp, Homo sapiens
gcccggagattggacggcc

SEQ ID NO: 298668 - DNA, 14 bp, Homo sapiens
gcccggccaaggac

SEQ ID NO: 298669 - DNA, 19 bp, Homo sapiens
gcccggcccacgcagagcc

SEQ ID NO: 298670 - DNA, 22 bp, Homo sapiens
gcccggccgccccgccccagag

SEQ ID NO: 298671 - DNA, 22 bp, Homo sapiens
gcccggcctgctcccagcagcc

SEQ ID NO: 298672 - DNA, 22 bp, Homo sapiens
gcccgggagatccgccctgggc

SEQ ID NO: 298673 - DNA, 21 bp, Homo sapiens
gcccgggaggaggatccgggc

SEQ ID NO: 298674 - DNA, 14 bp, Homo sapiens
gcccgggcccagag

SEQ ID NO: 298675 - DNA, 19 bp, Homo sapiens
gcccggggcagagctcaga

SEQ ID NO: 298676 - DNA, 20 bp, Homo sapiens
gcccggggcagagctcagag

SEQ ID NO: 298677 - DNA, 14 bp, Homo sapiens
gcccggggcagctg

SEQ ID NO: 298678 - DNA, 14 bp, Homo sapiens
gcccgtgaagcagt

SEQ ID NO: 298679 - DNA, 21 bp, Homo sapiens
gcccgtgaagcagtgcctcga

SEQ ID NO: 298680 - DNA, 16 bp, Homo sapiens
gcccgtgcgcagccgc

SEQ ID NO: 298681 - DNA, 23 bp, Homo sapiens
gcccgtgcgcagccgcgctctgc

SEQ ID NO: 298682 - DNA, 19 bp, Homo sapiens
gcccgtggatctgggcaca

SEQ ID NO: 298683 - DNA, 15 bp, Homo sapiens
gcccgtgtggcccct

SEQ ID NO: 298684 - DNA, 16 bp, Homo sapiens
gcccgtgtggcccctt

SEQ ID NO: 298685 - DNA, 23 bp, Homo sapiens
gccctaaggccttggtgccctga

SEQ ID NO: 298686 - DNA, 14 bp, Homo sapiens
gccctaagggactt

SEQ ID NO: 298687 - DNA, 20 bp, Homo sapiens
gccctacagaggtctctgcc

SEQ ID NO: 298688 - DNA, 13 bp, Homo sapiens
gccctagaccctc

SEQ ID NO: 298689 - DNA, 15 bp, Homo sapiens
gccctagaggcgagc

SEQ ID NO: 298690 - DNA, 23 bp, Homo sapiens
gccctaggattcctcccccagag

SEQ ID NO: 298691 - DNA, 15 bp, Homo sapiens
gccctaggctaccct

SEQ ID NO: 298692 - DNA, 20 bp, Homo sapiens
gccctaggctacccttgcca

SEQ ID NO: 298693 - DNA, 17 bp, Homo sapiens
gccctaggctccgtcag

SEQ ID NO: 298694 - DNA, 19 bp, Homo sapiens
gccctagtgggagcccagc

SEQ ID NO: 298695 - DNA, 21 bp, Homo sapiens
gccctagtgggagcccagcac

SEQ ID NO: 298696 - DNA, 22 bp, Homo sapiens
gccctagtgggagcccagcaca

SEQ ID NO: 298697 - DNA, 19 bp, Homo sapiens
gccctataacccctgcctg

SEQ ID NO: 298698 - DNA, 15 bp, Homo sapiens
gccctatttttgcaa

SEQ ID NO: 298699 - DNA, 18 bp, Homo sapiens
gccctcaataagccagca

SEQ ID NO: 298700 - DNA, 18 bp, Homo sapiens
gccctcactccactcccc

SEQ ID NO: 298701 - DNA, 19 bp, Homo sapiens
gccctcactccactcccct

SEQ ID NO: 298702 - DNA, 21 bp, Homo sapiens
gccctcactccactcccctca

SEQ ID NO: 298703 - DNA, 23 bp, Homo sapiens
gccctcagtcagttcccggagca

SEQ ID NO: 298704 - DNA, 15 bp, Homo sapiens
gccctccaaaagcac

SEQ ID NO: 298705 - DNA, 18 bp, Homo sapiens
gccctccactgccctctg

SEQ ID NO: 298706 - DNA, 12 bp, Homo sapiens
gccctccagagc

SEQ ID NO: 298707 - DNA, 16 bp, Homo sapiens
gccctccagagcagga

SEQ ID NO: 298708 - DNA, 17 bp, Homo sapiens
gccctccagctctttcc

SEQ ID NO: 298709 - DNA, 16 bp, Homo sapiens
gccctccatgggctag

SEQ ID NO: 298710 - DNA, 15 bp, Homo sapiens
gccctccccagagca

SEQ ID NO: 298711 - DNA, 20 bp, Homo sapiens
gccctccctccctccacacc

SEQ ID NO: 298712 - DNA, 23 bp, Homo sapiens
gccctccctcggccccacccacc

SEQ ID NO: 298713 - DNA, 18 bp, Homo sapiens
gccctccctcttcccagc

SEQ ID NO: 298714 - DNA, 20 bp, Homo sapiens
gccctccctgtctccagggc

SEQ ID NO: 298715 - DNA, 19 bp, Homo sapiens
gccctcccttggaaacctg

SEQ ID NO: 298716 - DNA, 21 bp, Homo sapiens
gccctcccttggaaacctgcc

SEQ ID NO: 298717 - DNA, 15 bp, Homo sapiens
gccctccgtcctggc

SEQ ID NO: 298718 - DNA, 19 bp, Homo sapiens
gccctccgtcctggcaggg

SEQ ID NO: 298719 - DNA, 21 bp, Homo sapiens
gccctccgtcctggcagggca

SEQ ID NO: 298720 - DNA, 14 bp, Homo sapiens
gccctcctcgctgt

SEQ ID NO: 298721 - DNA, 18 bp, Homo sapiens
gccctcctcgctgtgcca

SEQ ID NO: 298722 - DNA, 12 bp, Homo sapiens
gccctcctctgc

SEQ ID NO: 298723 - DNA, 14 bp, Homo sapiens
gccctcctctgccc

SEQ ID NO: 298724 - DNA, 15 bp, Homo sapiens
gccctcctctgcccc

SEQ ID NO: 298725 - DNA, 18 bp, Homo sapiens
gccctcctctgccccctc

SEQ ID NO: 298726 - DNA, 21 bp, Homo sapiens
gccctcctctgccccctcccc

SEQ ID NO: 298727 - DNA, 17 bp, Homo sapiens
gccctcctgctggctga

SEQ ID NO: 298728 - DNA, 20 bp, Homo sapiens
gccctcctgctggctgaggc

SEQ ID NO: 298729 - DNA, 17 bp, Homo sapiens
gccctccttcttgccct

SEQ ID NO: 298730 - DNA, 19 bp, Homo sapiens
gccctccttcttgccctga

SEQ ID NO: 298731 - DNA, 22 bp, Homo sapiens
gccctccttcttgccctgagct

SEQ ID NO: 298732 - DNA, 17 bp, Homo sapiens
gccctccttgccacccc

SEQ ID NO: 298733 - DNA, 17 bp, Homo sapiens
gccctcgaaccaaggca

SEQ ID NO: 298734 - DNA, 15 bp, Homo sapiens
gccctctccacaccc

SEQ ID NO: 298735 - DNA, 14 bp, Homo sapiens
gccctctctctggg

SEQ ID NO: 298736 - DNA, 15 bp, Homo sapiens
gccctctctctgggc

SEQ ID NO: 298737 - DNA, 21 bp, Homo sapiens
gccctctgcccccagctgctc

SEQ ID NO: 298738 - DNA, 23 bp, Homo sapiens
gccctctgcccccagctgctcct

SEQ ID NO: 298739 - DNA, 15 bp, Homo sapiens
gccctctgctgcttt

SEQ ID NO: 298740 - DNA, 23 bp, Homo sapiens
gccctctgtagctccctcctccc

SEQ ID NO: 298741 - DNA, 18 bp, Homo sapiens
gccctctgtgcctaataa

SEQ ID NO: 298742 - DNA, 21 bp, Homo sapiens
gccctcttcccctctaatgct

SEQ ID NO: 298743 - DNA, 23 bp, Homo sapiens
gccctctttctctctgtgtggca

SEQ ID NO: 298744 - DNA, 22 bp, Homo sapiens
gccctgaccttggctgactggg

SEQ ID NO: 298745 - DNA, 20 bp, Homo sapiens
gccctgagctttccggggag

SEQ ID NO: 298746 - DNA, 19 bp, Homo sapiens
gccctgatgcgtctaccca

SEQ ID NO: 298747 - DNA, 15 bp, Homo sapiens
gccctgcaagggcgt

SEQ ID NO: 298748 - DNA, 16 bp, Homo sapiens
gccctgcacctgtgca

SEQ ID NO: 298749 - DNA, 13 bp, Homo sapiens
gccctgcaggagg

SEQ ID NO: 298750 - DNA, 16 bp, Homo sapiens
gccctgcaggaggcct

SEQ ID NO: 298751 - DNA, 17 bp, Homo sapiens
gccctgcaggaggcctg

SEQ ID NO: 298752 - DNA, 22 bp, Homo sapiens
gccctgcaggaggcctgggagg

SEQ ID NO: 298753 - DNA, 14 bp, Homo sapiens
gccctgccaagcct

SEQ ID NO: 298754 - DNA, 16 bp, Homo sapiens
gccctgccaagcctgg

SEQ ID NO: 298755 - DNA, 17 bp, Homo sapiens
gccctgccaagcctgga

SEQ ID NO: 298756 - DNA, 20 bp, Homo sapiens
gcctccaccgagccagcttg

SEQ ID NO: 298757 - DNA, 15 bp, Homo sapiens
gcctccactccccca

SEQ ID NO: 298758 - DNA, 20 bp, Homo sapiens
gcctccactcccccacctga

SEQ ID NO: 298759 - DNA, 21 bp, Homo sapiens
gcctccactcccccacctgac

SEQ ID NO: 298760 - DNA, 22 bp, Homo sapiens
gcctccactcccccacctgaca

SEQ ID NO: 298761 - DNA, 15 bp, Homo sapiens
gcctccactctagtt

SEQ ID NO: 298762 - DNA, 23 bp, Homo sapiens
gcctccagagccagcctgggact

SEQ ID NO: 298763 - DNA, 13 bp, Homo sapiens
gcctccagcctct

SEQ ID NO: 298764 - DNA, 18 bp, Homo sapiens
gcctccagcctctcccgg

SEQ ID NO: 298765 - DNA, 12 bp, Homo sapiens
gcctccaggagg

SEQ ID NO: 298766 - DNA, 20 bp, Homo sapiens
gcctccaggcaggacgagac

SEQ ID NO: 298767 - DNA, 23 bp, Homo sapiens
gcctccaggcaggacgagactcc

SEQ ID NO: 298768 - DNA, 24 bp, Homo sapiens
gcctccaggcaggacgagactcct

SEQ ID NO: 298769 - DNA, 12 bp, Homo sapiens
gcctccaggctg

SEQ ID NO: 298770 - DNA, 13 bp, Homo sapiens
gcctccaggctgg

SEQ ID NO: 298771 - DNA, 18 bp, Homo sapiens
gcctccaggctggggcct

SEQ ID NO: 298772 - DNA, 20 bp, Homo sapiens
gcctccaggctggggcctgg

SEQ ID NO: 298773 - DNA, 12 bp, Homo sapiens
gcctccagggcc

SEQ ID NO: 298774 - DNA, 18 bp, Homo sapiens
gcctccagttgtagcagg

SEQ ID NO: 298775 - DNA, 17 bp, Homo sapiens
gcctccatttagttctt

SEQ ID NO: 298776 - DNA, 17 bp, Homo sapiens
gcctcccaaagtgctgg

SEQ ID NO: 298777 - DNA, 19 bp, Homo sapiens
gcctcccaaagtgctggga

SEQ ID NO: 298778 - DNA, 19 bp, Homo sapiens
gcctcccaaggtcctctca

SEQ ID NO: 298779 - DNA, 21 bp, Homo sapiens
gcctcccaaggtcctctcagt

SEQ ID NO: 298780 - DNA, 16 bp, Homo sapiens
gcctcccaataaagct

SEQ ID NO: 298781 - DNA, 20 bp, Homo sapiens
gcctcccaataaagctggac

SEQ ID NO: 298782 - DNA, 21 bp, Homo sapiens
gcctcccacacttgctggggc

SEQ ID NO: 298783 - DNA, 13 bp, Homo sapiens
gcctcccaccaga

SEQ ID NO: 298784 - DNA, 10 bp, Homo sapiens
gcctcccagc

SEQ ID NO: 298785 - DNA, 12 bp, Homo sapiens
gcctcccagcca

SEQ ID NO: 298786 - DNA, 12 bp, Homo sapiens
gcctcccaggtt

SEQ ID NO: 298787 - DNA, 16 bp, Homo sapiens
gcctcccccaggctgc

SEQ ID NO: 298788 - DNA, 19 bp, Homo sapiens
gcctcccccaggctgcgcc

SEQ ID NO: 298789 - DNA, 14 bp, Homo sapiens
gcctccccccagac

SEQ ID NO: 298790 - DNA, 14 bp, Homo sapiens
gcctcccccgcagg

SEQ ID NO: 298791 - DNA, 21 bp, Homo sapiens
gcctcccccgccacctgtgtg

SEQ ID NO: 298792 - DNA, 18 bp, Homo sapiens
gcctccccgggggtcccc

SEQ ID NO: 298793 - DNA, 12 bp, Homo sapiens
gcctcccctccc

SEQ ID NO: 298794 - DNA, 16 bp, Homo sapiens
gcctcccctcccctgg

SEQ ID NO: 298795 - DNA, 20 bp, Homo sapiens
gcctcccctcccctggggac

SEQ ID NO: 298796 - DNA, 16 bp, Homo sapiens
gcctcccctcctctcc

SEQ ID NO: 298797 - DNA, 15 bp, Homo sapiens
gcctcccctgcggag

SEQ ID NO: 298798 - DNA, 20 bp, Homo sapiens
gcctcccctgctgaaggtgg

SEQ ID NO: 298799 - DNA, 20 bp, Homo sapiens
gcctcccgcatgctgcctgc

SEQ ID NO: 298800 - DNA, 15 bp, Homo sapiens
gcctcccgccgcctc

SEQ ID NO: 298801 - DNA, 21 bp, Homo sapiens
gcctccctctctcttctgctc

SEQ ID NO: 298802 - DNA, 22 bp, Homo sapiens
gcctccctctctcttctgctcc

SEQ ID NO: 298803 - DNA, 20 bp, Homo sapiens
gcctccctctcttccgggag

SEQ ID NO: 298804 - DNA, 20 bp, Homo sapiens
gcctccctggggaccaggag

SEQ ID NO: 298805 - DNA, 22 bp, Homo sapiens
gcctccctggggaccaggagct

SEQ ID NO: 298806 - DNA, 16 bp, Homo sapiens
gcctccctggtccctt

SEQ ID NO: 298807 - DNA, 19 bp, Homo sapiens
gcctccctgtcactcagct

SEQ ID NO: 298808 - DNA, 21 bp, Homo sapiens
gcctccctgtcactcagctga

SEQ ID NO: 298809 - DNA, 13 bp, Homo sapiens
gcctccctgtcca

SEQ ID NO: 298810 - DNA, 14 bp, Homo sapiens
gcctccctgtccac

SEQ ID NO: 298811 - DNA, 22 bp, Homo sapiens
gcctcccttcccagtgggctgt

SEQ ID NO: 298812 - DNA, 12 bp, Homo sapiens
gcctcccttcct

SEQ ID NO: 298813 - DNA, 15 bp, Homo sapiens
gcctcccttcctccg

SEQ ID NO: 298814 - DNA, 18 bp, Homo sapiens
gcctcccttcctccgctc

SEQ ID NO: 298815 - DNA, 16 bp, Homo sapiens
gcctccgaggctcccc

SEQ ID NO: 298816 - DNA, 19 bp, Homo sapiens
gcctccgaggctccccgcc

SEQ ID NO: 298817 - DNA, 21 bp, Homo sapiens
gcctccgaggctccccgcctc

SEQ ID NO: 298818 - DNA, 13 bp, Homo sapiens
gcctccgagggac

SEQ ID NO: 298819 - DNA, 15 bp, Homo sapiens
gcctccggccctgcc

SEQ ID NO: 298820 - DNA, 20 bp, Homo sapiens
gcctccggccctgccccaca

SEQ ID NO: 298821 - DNA, 16 bp, Homo sapiens
gcctccggcctcccct

SEQ ID NO: 298822 - DNA, 15 bp, Homo sapiens
gcctccgttcccacc

SEQ ID NO: 298823 - DNA, 16 bp, Homo sapiens
gcctcctccagactcg

SEQ ID NO: 298824 - DNA, 12 bp, Homo sapiens
gcctcctcccat

SEQ ID NO: 298825 - DNA, 17 bp, Homo sapiens
gcctcctcccatccagc

SEQ ID NO: 298826 - DNA, 15 bp, Homo sapiens
gcctcctcctgacca

SEQ ID NO: 298827 - DNA, 16 bp, Homo sapiens
gcctcctctaacaggg

SEQ ID NO: 298828 - DNA, 15 bp, Homo sapiens
gcctcctctctccct

SEQ ID NO: 298829 - DNA, 17 bp, Homo sapiens
gcctcctctctccctgc

SEQ ID NO: 298830 - DNA, 23 bp, Homo sapiens
gcctcctctctccctgcctcaca

SEQ ID NO: 298831 - DNA, 13 bp, Homo sapiens
gcctcctcttcac

SEQ ID NO: 298832 - DNA, 17 bp, Homo sapiens
gcctcctcttcaccccg

SEQ ID NO: 298833 - DNA, 21 bp, Homo sapiens
gcctcctcttcaccccggcag

SEQ ID NO: 298834 - DNA, 16 bp, Homo sapiens
gcctcctgccccctgc

SEQ ID NO: 298835 - DNA, 17 bp, Homo sapiens
gcctcctgcctgcccct

SEQ ID NO: 298836 - DNA, 18 bp, Homo sapiens
gcctcctgtgtagctggg

SEQ ID NO: 298837 - DNA, 18 bp, Homo sapiens
gcctccttcccatgcctg

SEQ ID NO: 298838 - DNA, 20 bp, Homo sapiens
gcctccttcccatgcctgtc

SEQ ID NO: 298839 - DNA, 15 bp, Homo sapiens
gcctccttgtccagg

SEQ ID NO: 298840 - DNA, 12 bp, Homo sapiens
gcctcgcccctc

SEQ ID NO: 298841 - DNA, 13 bp, Homo sapiens
gcctcgcccctcc

SEQ ID NO: 298842 - DNA, 19 bp, Homo sapiens
gcctcgcccctccagtgtt

SEQ ID NO: 298843 - DNA, 21 bp, Homo sapiens
gcctcgcccctccagtgttgc

SEQ ID NO: 298844 - DNA, 20 bp, Homo sapiens
gcctcggcagaactctctgt

SEQ ID NO: 298845 - DNA, 22 bp, Homo sapiens
gcctcggcctcccaaagtgctg

SEQ ID NO: 298846 - DNA, 15 bp, Homo sapiens
gcctcgggccgcctc

SEQ ID NO: 298847 - DNA, 15 bp, Homo sapiens
gcctcggggcagggc

SEQ ID NO: 298848 - DNA, 18 bp, Homo sapiens
gcctcgtgggttcttcct

SEQ ID NO: 298849 - DNA, 19 bp, Homo sapiens
gcctctaaggccaaggcct

SEQ ID NO: 298850 - DNA, 21 bp, Homo sapiens
gcctctaaggccaaggcctca

SEQ ID NO: 298851 - DNA, 22 bp, Homo sapiens
gcctctaaggccaaggcctcag

SEQ ID NO: 298852 - DNA, 19 bp, Homo sapiens
gcctctactttgtcccctc

SEQ ID NO: 298853 - DNA, 19 bp, Homo sapiens
gcctctcagagggttttct

SEQ ID NO: 298854 - DNA, 12 bp, Homo sapiens
gcctctcatccc

SEQ ID NO: 298855 - DNA, 10 bp, Homo sapiens
gcctctccca

SEQ ID NO: 298856 - DNA, 20 bp, Homo sapiens
gcctctcccggctgcctgcc

SEQ ID NO: 298857 - DNA, 15 bp, Homo sapiens
gcctctccttgcccc

SEQ ID NO: 298858 - DNA, 22 bp, Homo sapiens
gcctctccttgccccagtcctg

SEQ ID NO: 298859 - DNA, 23 bp, Homo sapiens
gcctctccttgccccagtcctgg

SEQ ID NO: 298860 - DNA, 13 bp, Homo sapiens
gcctctgaaaata

SEQ ID NO: 298861 - DNA, 15 bp, Homo sapiens
gcctctgaaaatatt

SEQ ID NO: 298862 - DNA, 16 bp, Homo sapiens
gcctctgaaatttccc

SEQ ID NO: 298863 - DNA, 18 bp, Homo sapiens
gcctctgaactgctgctg

SEQ ID NO: 298864 - DNA, 18 bp, Homo sapiens
gcctctgacagcagcctg

SEQ ID NO: 298865 - DNA, 22 bp, Homo sapiens
gcctctgacagcagcctgtgag

SEQ ID NO: 298866 - DNA, 12 bp, Homo sapiens
gcctctgcattc

SEQ ID NO: 298867 - DNA, 16 bp, Homo sapiens
gcctctgccaggcctg

SEQ ID NO: 298868 - DNA, 16 bp, Homo sapiens
gcctctgccccgtctc

SEQ ID NO: 298869 - DNA, 12 bp, Homo sapiens
gcctctgcctcc

SEQ ID NO: 298870 - DNA, 19 bp, Homo sapiens
gcctctgcctccaggaggg

SEQ ID NO: 298871 - DNA, 15 bp, Homo sapiens
gcctctgcctcccag

SEQ ID NO: 298872 - DNA, 12 bp, Homo sapiens
gcctctgccttg

SEQ ID NO: 298873 - DNA, 17 bp, Homo sapiens
gcctctggaggcctctg

SEQ ID NO: 298874 - DNA, 13 bp, Homo sapiens
gcctctggccaga

SEQ ID NO: 298875 - DNA, 13 bp, Homo sapiens
gcctctggctaga

SEQ ID NO: 298876 - DNA, 21 bp, Homo sapiens
gcctctggctagaggccagcc

SEQ ID NO: 298877 - DNA, 16 bp, Homo sapiens
gcctctggctgcctgg

SEQ ID NO: 298878 - DNA, 17 bp, Homo sapiens
gcctctggctgcctggc

SEQ ID NO: 298879 - DNA, 22 bp, Homo sapiens
gcctctggctgcctggcccagg

SEQ ID NO: 298880 - DNA, 12 bp, Homo sapiens
gcctctggggag

SEQ ID NO: 298881 - DNA, 20 bp, Homo sapiens
gcctctgggtgagtggctga

SEQ ID NO: 298882 - DNA, 21 bp, Homo sapiens
gcctctgggtgagtggctgac

SEQ ID NO: 298883 - DNA, 14 bp, Homo sapiens
gcctctggttccac

SEQ ID NO: 298884 - DNA, 21 bp, Homo sapiens
gcctctggttccactcagctt

SEQ ID NO: 298885 - DNA, 21 bp, Homo sapiens
gcctctgtcctggctgtgcac

SEQ ID NO: 298886 - DNA, 13 bp, Homo sapiens
gcgcgggagagag

SEQ ID NO: 298887 - DNA, 22 bp, Homo sapiens
gcgcgggaggcaccagctctgt

SEQ ID NO: 298888 - DNA, 20 bp, Homo sapiens
gcgcggtggctcacgcctgt

SEQ ID NO: 298889 - DNA, 16 bp, Homo sapiens
gcgcgtgcccccagcg

SEQ ID NO: 298890 - DNA, 16 bp, Homo sapiens
gcgctcacctgcagcc

SEQ ID NO: 298891 - DNA, 14 bp, Homo sapiens
gcgctcaggaccca

SEQ ID NO: 298892 - DNA, 19 bp, Homo sapiens
gcgctcaggacccaggccc

SEQ ID NO: 298893 - DNA, 21 bp, Homo sapiens
gcgctcaggacccaggccctc

SEQ ID NO: 298894 - DNA, 18 bp, Homo sapiens
gcgctccctgtcgcctgc

SEQ ID NO: 298895 - DNA, 13 bp, Homo sapiens
gcgctcctctgca

SEQ ID NO: 298896 - DNA, 18 bp, Homo sapiens
gcgctcctctgcagcctg

SEQ ID NO: 298897 - DNA, 15 bp, Homo sapiens
gcgctctcttccaga

SEQ ID NO: 298898 - DNA, 19 bp, Homo sapiens
gcgctgacaaccaccgctc

SEQ ID NO: 298899 - DNA, 14 bp, Homo sapiens
gcgctgagggcagg

SEQ ID NO: 298900 - DNA, 21 bp, Homo sapiens
gcgctgcccacaccaccgccc

SEQ ID NO: 298901 - DNA, 17 bp, Homo sapiens
gcgctggaatccagaag

SEQ ID NO: 298902 - DNA, 18 bp, Homo sapiens
gcgctggcagcgctcctg

SEQ ID NO: 298903 - DNA, 19 bp, Homo sapiens
gcgctggcagcgctcctgg

SEQ ID NO: 298904 - DNA, 24 bp, Homo sapiens
gcgctgtgctccagcagtgctggg

SEQ ID NO: 298905 - DNA, 18 bp, Homo sapiens
gcgctttctcctgtgccc

SEQ ID NO: 298906 - DNA, 17 bp, Homo sapiens
gcgcttttgctggtcac

SEQ ID NO: 298907 - DNA, 16 bp, Homo sapiens
gcggaacctggctgcg

SEQ ID NO: 298908 - DNA, 16 bp, Homo sapiens
gcggagaaaggaaggg

SEQ ID NO: 298909 - DNA, 21 bp, Homo sapiens
gcggagctgcatggacgcctg

SEQ ID NO: 298910 - DNA, 16 bp, Homo sapiens
gcggaggggcttggag

SEQ ID NO: 298911 - DNA, 13 bp, Homo sapiens
gcggatgtagcat

SEQ ID NO: 298912 - DNA, 16 bp, Homo sapiens
gcggcaccgcccaccc

SEQ ID NO: 298913 - DNA, 14 bp, Homo sapiens
gcggcaggagggag

SEQ ID NO: 298914 - DNA, 22 bp, Homo sapiens
gcggcaggagggaggtttgtga

SEQ ID NO: 298915 - DNA, 12 bp, Homo sapiens
gcggccagggac

SEQ ID NO: 298916 - DNA, 15 bp, Homo sapiens
gcggccagggacaga

SEQ ID NO: 298917 - DNA, 22 bp, Homo sapiens
gcggcccaagcccgacttgctg

SEQ ID NO: 298918 - DNA, 15 bp, Homo sapiens
gcggcccgtgcgcag

SEQ ID NO: 298919 - DNA, 16 bp, Homo sapiens
gcggcccgtgcgcagc

SEQ ID NO: 298920 - DNA, 22 bp, Homo sapiens
gcggcccgtgcgcagccgcgct

SEQ ID NO: 298921 - DNA, 17 bp, Homo sapiens
gcggcccttcctgcagc

SEQ ID NO: 298922 - DNA, 14 bp, Homo sapiens
gcggccggcctggg

SEQ ID NO: 298923 - DNA, 19 bp, Homo sapiens
gcggctaggccggccagct

SEQ ID NO: 298924 - DNA, 23 bp, Homo sapiens
gcggctaggccggccagctcccc

SEQ ID NO: 298925 - DNA, 15 bp, Homo sapiens
gcggctcccggggca

SEQ ID NO: 298926 - DNA, 22 bp, Homo sapiens
gcggctcccggggcagggcagc

SEQ ID NO: 298927 - DNA, 12 bp, Homo sapiens
gcggctgaggac

SEQ ID NO: 298928 - DNA, 23 bp, Homo sapiens
gcggctgaggacggggcagagct

SEQ ID NO: 298929 - DNA, 14 bp, Homo sapiens
gcggctggaaagag

SEQ ID NO: 298930 - DNA, 19 bp, Homo sapiens
gcggctgggagcctcgccc

SEQ ID NO: 298931 - DNA, 15 bp, Homo sapiens
gcggcttcctgtcca

SEQ ID NO: 298932 - DNA, 22 bp, Homo sapiens
gcgggacaaagccttaaaatgc

SEQ ID NO: 298933 - DNA, 15 bp, Homo sapiens
gcgggacctgtggct

SEQ ID NO: 298934 - DNA, 20 bp, Homo sapiens
gcgggagagagtgagagaga

SEQ ID NO: 298935 - DNA, 21 bp, Homo sapiens
gcgggagagagtgagagagag

SEQ ID NO: 298936 - DNA, 23 bp, Homo sapiens
gcgggagagagtgagagagagtg

SEQ ID NO: 298937 - DNA, 15 bp, Homo sapiens
gcgggaggcaccagc

SEQ ID NO: 298938 - DNA, 12 bp, Homo sapiens
gcgggaggccac

SEQ ID NO: 298939 - DNA, 10 bp, Homo sapiens
gcgggcagcc

SEQ ID NO: 298940 - DNA, 12 bp, Homo sapiens
gcgggcagcccc

SEQ ID NO: 298941 - DNA, 14 bp, Homo sapiens
gcgggcagggccgc

SEQ ID NO: 298942 - DNA, 13 bp, Homo sapiens
gcgggccaaggac

SEQ ID NO: 298943 - DNA, 15 bp, Homo sapiens
gcgggccaaggactg

SEQ ID NO: 298944 - DNA, 17 bp, Homo sapiens
gcgggccaaggactgcc

SEQ ID NO: 298945 - DNA, 21 bp, Homo sapiens
gcgggcgctgctgggagcaga

SEQ ID NO: 298946 - DNA, 16 bp, Homo sapiens
gcgggctgggcagctg

SEQ ID NO: 298947 - DNA, 15 bp, Homo sapiens
gcggggcagcaggag

SEQ ID NO: 298948 - DNA, 11 bp, Homo sapiens
gcgggggagcc

SEQ ID NO: 298949 - DNA, 23 bp, Homo sapiens
gcgggggctaactggccccaggc

SEQ ID NO: 298950 - DNA, 17 bp, Homo sapiens
gcgggtaaaaagagaag

SEQ ID NO: 298951 - DNA, 23 bp, Homo sapiens
gcgggttctagacgcccctccca

SEQ ID NO: 298952 - DNA, 15 bp, Homo sapiens
gcggtaggtgctggc

SEQ ID NO: 298953 - DNA, 13 bp, Homo sapiens
gcggtatccagag

SEQ ID NO: 298954 - DNA, 14 bp, Homo sapiens
gcggtatccagagg

SEQ ID NO: 298955 - DNA, 20 bp, Homo sapiens
gcggtccccatccccaccag

SEQ ID NO: 298956 - DNA, 16 bp, Homo sapiens
gcggtgatcagcagag

SEQ ID NO: 298957 - DNA, 12 bp, Homo sapiens
gcggtgctctgg

SEQ ID NO: 298958 - DNA, 21 bp, Homo sapiens
gcggtgctctggcggcttcct

SEQ ID NO: 298959 - DNA, 16 bp, Homo sapiens
gcggtggggagagatg

SEQ ID NO: 298960 - DNA, 22 bp, Homo sapiens
gcggtgtgagatggtgccccct

SEQ ID NO: 298961 - DNA, 12 bp, Homo sapiens
gcgtaggagaga

SEQ ID NO: 298962 - DNA, 14 bp, Homo sapiens
gcgtagttccctgg

SEQ ID NO: 298963 - DNA, 13 bp, Homo sapiens
gcgtatgtctgtt

SEQ ID NO: 298964 - DNA, 18 bp, Homo sapiens
gcgtccactttcccttcc

SEQ ID NO: 298965 - DNA, 20 bp, Homo sapiens
gcgtccgcgcgccagcacag

SEQ ID NO: 298966 - DNA, 17 bp, Homo sapiens
gcgtcctgacggcgccc

SEQ ID NO: 298967 - DNA, 12 bp, Homo sapiens
gcgtcctgagga

SEQ ID NO: 298968 - DNA, 18 bp, Homo sapiens
gcgtcctgcagaggacca

SEQ ID NO: 298969 - DNA, 20 bp, Homo sapiens
gcgtcctgcagaggaccaca

SEQ ID NO: 298970 - DNA, 17 bp, Homo sapiens
gcgtccttccccctgta

SEQ ID NO: 298971 - DNA, 14 bp, Homo sapiens
gcgtctcccttggc

SEQ ID NO: 298972 - DNA, 15 bp, Homo sapiens
gcgtctcccttggcc

SEQ ID NO: 298973 - DNA, 21 bp, Homo sapiens
gcgtctgagcggccgcctgtc

SEQ ID NO: 298974 - DNA, 22 bp, Homo sapiens
gcgtctgagcggccgcctgtcc

SEQ ID NO: 298975 - DNA, 13 bp, Homo sapiens
gcgtctgccccac

SEQ ID NO: 298976 - DNA, 18 bp, Homo sapiens
gcgtctgcctaggagctg

SEQ ID NO: 298977 - DNA, 16 bp, Homo sapiens
gcgtctgcgcggatgt

SEQ ID NO: 298978 - DNA, 18 bp, Homo sapiens
gcgtctgtcttcaagggc

SEQ ID NO: 298979 - DNA, 12 bp, Homo sapiens
gcgtcttcctga

SEQ ID NO: 298980 - DNA, 11 bp, Homo sapiens
gcgtgaaacac

SEQ ID NO: 298981 - DNA, 19 bp, Homo sapiens
gcgtgaaacacaccaggct

SEQ ID NO: 298982 - DNA, 20 bp, Homo sapiens
gcgtgaaacacaccaggctg

SEQ ID NO: 298983 - DNA, 15 bp, Homo sapiens
gcgtgaccggcccgc

SEQ ID NO: 298984 - DNA, 18 bp, Homo sapiens
gcgtgaccggcccgccac

SEQ ID NO: 298985 - DNA, 21 bp, Homo sapiens
gcgtgacttcagactctctcc

SEQ ID NO: 298986 - DNA, 15 bp, Homo sapiens
gcgtgagccactgcg

SEQ ID NO: 298987 - DNA, 13 bp, Homo sapiens
gcgtgattctgtt

SEQ ID NO: 298988 - DNA, 15 bp, Homo sapiens
gcgtgcgaccagagg

SEQ ID NO: 298989 - DNA, 16 bp, Homo sapiens
gcgtgctgggacagct

SEQ ID NO: 298990 - DNA, 20 bp, Homo sapiens
gcgtgcttgcatgtgctgca

SEQ ID NO: 298991 - DNA, 12 bp, Homo sapiens
gcgtggctgtgg

SEQ ID NO: 298992 - DNA, 14 bp, Homo sapiens
gcgtggctgtggca

SEQ ID NO: 298993 - DNA, 16 bp, Homo sapiens
gcgtggtcccgaggaa

SEQ ID NO: 298994 - DNA, 16 bp, Homo sapiens
gcgtgtctgtttcctt

SEQ ID NO: 298995 - DNA, 15 bp, Homo sapiens
gcgtgtggccctgtg

SEQ ID NO: 298996 - DNA, 11 bp, Homo sapiens
gcgttcctgcc

SEQ ID NO: 298997 - DNA, 11 bp, Homo sapiens
gcgttcctggc

SEQ ID NO: 298998 - DNA, 12 bp, Homo sapiens
gcgttcttcagg

SEQ ID NO: 298999 - DNA, 17 bp, Homo sapiens
gcgttggaattaaaaca

SEQ ID NO: 299000 - DNA, 14 bp, Homo sapiens
gcgttggagccact

SEQ ID NO: 299001 - DNA, 14 bp, Homo sapiens
gcgttggtgccact

SEQ ID NO: 299002 - DNA, 14 bp, Homo sapiens
gcgttgtgggcagg

SEQ ID NO: 299003 - DNA, 16 bp, Homo sapiens
gcgttgtgggcaggct

SEQ ID NO: 299004 - DNA, 22 bp, Homo sapiens
gcgtttagtttctagaggcctc

SEQ ID NO: 299005 - DNA, 20 bp, Homo sapiens
gcgtttgctgtgccaggagg

SEQ ID NO: 299006 - DNA, 21 bp, Homo sapiens
gcgtttgctgtgccaggaggc

SEQ ID NO: 299007 - DNA, 22 bp, Homo sapiens
gctaaagaggtggggtgaagct

SEQ ID NO: 299008 - DNA, 18 bp, Homo sapiens
gctaaatggcaacaaaca

SEQ ID NO: 299009 - DNA, 17 bp, Homo sapiens
gctaaatgttagcaaga

SEQ ID NO: 299010 - DNA, 18 bp, Homo sapiens
gctaaattacaattgtca

SEQ ID NO: 299011 - DNA, 18 bp, Homo sapiens
gctaacaaactgaaaaat

SEQ ID NO: 299012 - DNA, 14 bp, Homo sapiens
gctaacatggaagt

SEQ ID NO: 299013 - DNA, 18 bp, Homo sapiens
gctaacatttaggagaag

SEQ ID NO: 299014 - DNA, 18 bp, Homo sapiens
gctaaccagttctctttg

SEQ ID NO: 299015 - DNA, 15 bp, Homo sapiens
gctaactggccccag

SEQ ID NO: 299016 - DNA, 21 bp, Homo sapiens
gctaactttgcccttcactgt

SEQ ID NO: 299017 - DNA, 17 bp, Homo sapiens
gctctctacccagccca

SEQ ID NO: 299018 - DNA, 21 bp, Homo sapiens
gctctctacccagcccatctt

SEQ ID NO: 299019 - DNA, 12 bp, Homo sapiens
gctctctcatgt

SEQ ID NO: 299020 - DNA, 13 bp, Homo sapiens
gctctctcatgtg

SEQ ID NO: 299021 - DNA, 11 bp, Homo sapiens
gctctctggga

SEQ ID NO: 299022 - DNA, 23 bp, Homo sapiens
gctctcttaaatgaagtgcccac

SEQ ID NO: 299023 - DNA, 22 bp, Homo sapiens
gctctcttccagaagatgccct

SEQ ID NO: 299024 - DNA, 16 bp, Homo sapiens
gctctgaaagctgctt

SEQ ID NO: 299025 - DNA, 22 bp, Homo sapiens
gctctgaatctctcaaaatgtg

SEQ ID NO: 299026 - DNA, 17 bp, Homo sapiens
gctctgacccaagtggg

SEQ ID NO: 299027 - DNA, 23 bp, Homo sapiens
gctctgacccaagtggggcctcc

SEQ ID NO: 299028 - DNA, 22 bp, Homo sapiens
gctctgaccctgatgcttaata

SEQ ID NO: 299029 - DNA, 22 bp, Homo sapiens
gctctgagaagaggagccctca

SEQ ID NO: 299030 - DNA, 20 bp, Homo sapiens
gctctgagcaaatgtggctc

SEQ ID NO: 299031 - DNA, 21 bp, Homo sapiens
gctctgagcaaatgtggctcc

SEQ ID NO: 299032 - DNA, 18 bp, Homo sapiens
gctctgagcagttgttat

SEQ ID NO: 299033 - DNA, 23 bp, Homo sapiens
gctctgaggcaaccccctcggag

SEQ ID NO: 299034 - DNA, 21 bp, Homo sapiens
gctctgatattccatgaatgt

SEQ ID NO: 299035 - DNA, 15 bp, Homo sapiens
gctctgcacagatgg

SEQ ID NO: 299036 - DNA, 18 bp, Homo sapiens
gctctgcagcccacagag

SEQ ID NO: 299037 - DNA, 14 bp, Homo sapiens
gctctgcatgtgtg

SEQ ID NO: 299038 - DNA, 17 bp, Homo sapiens
gctctgccatcagcccc

SEQ ID NO: 299039 - DNA, 14 bp, Homo sapiens
gctctgcccagagc

SEQ ID NO: 299040 - DNA, 15 bp, Homo sapiens
gctctgcccagagct

SEQ ID NO: 299041 - DNA, 15 bp, Homo sapiens
gctctgccccaagcc

SEQ ID NO: 299042 - DNA, 12 bp, Homo sapiens
gctctgcccctc

SEQ ID NO: 299043 - DNA, 18 bp, Homo sapiens
gctctgcccctccgtccc

SEQ ID NO: 299044 - DNA, 15 bp, Homo sapiens
gctctggaagcctgc

SEQ ID NO: 299045 - DNA, 17 bp, Homo sapiens
gctctggaagcctgctg

SEQ ID NO: 299046 - DNA, 16 bp, Homo sapiens
gctctggagccacctg

SEQ ID NO: 299047 - DNA, 20 bp, Homo sapiens
gctctggagccacctgtccc

SEQ ID NO: 299048 - DNA, 14 bp, Homo sapiens
gctctggcacagtg

SEQ ID NO: 299049 - DNA, 11 bp, Homo sapiens
gctctggcagg

SEQ ID NO: 299050 - DNA, 14 bp, Homo sapiens
gctctggcaggtgg

SEQ ID NO: 299051 - DNA, 19 bp, Homo sapiens
gctctggcagtaggtgtcc

SEQ ID NO: 299052 - DNA, 15 bp, Homo sapiens
gctctggccacaatc

SEQ ID NO: 299053 - DNA, 20 bp, Homo sapiens
gctctggcggcttcctgtcc

SEQ ID NO: 299054 - DNA, 13 bp, Homo sapiens
gctctggctccct

SEQ ID NO: 299055 - DNA, 19 bp, Homo sapiens
gctctggctccctgggacc

SEQ ID NO: 299056 - DNA, 17 bp, Homo sapiens
gctctggctggagagga

SEQ ID NO: 299057 - DNA, 15 bp, Homo sapiens
gctctgggagaggat

SEQ ID NO: 299058 - DNA, 11 bp, Homo sapiens
gctctgggctc

SEQ ID NO: 299059 - DNA, 18 bp, Homo sapiens
gctctgggctcagggctg

SEQ ID NO: 299060 - DNA, 19 bp, Homo sapiens
gctctgggctcagggctgg

SEQ ID NO: 299061 - DNA, 14 bp, Homo sapiens
gctctgggttcggg

SEQ ID NO: 299062 - DNA, 15 bp, Homo sapiens
gctctggtgggaaaa

SEQ ID NO: 299063 - DNA, 16 bp, Homo sapiens
gctctggtgggaaaat

SEQ ID NO: 299064 - DNA, 23 bp, Homo sapiens
gctctgtccaattccagagctgt

SEQ ID NO: 299065 - DNA, 14 bp, Homo sapiens
gctctgtcttcctg

SEQ ID NO: 299066 - DNA, 15 bp, Homo sapiens
gctctgtcttcctgg

SEQ ID NO: 299067 - DNA, 14 bp, Homo sapiens
gctctgtgcctggg

SEQ ID NO: 299068 - DNA, 17 bp, Homo sapiens
gctctgtgcctgggatc

SEQ ID NO: 299069 - DNA, 18 bp, Homo sapiens
gctctgtgcctgggatca

SEQ ID NO: 299070 - DNA, 14 bp, Homo sapiens
gctctgtggcctgt

SEQ ID NO: 299071 - DNA, 16 bp, Homo sapiens
gctctgttgcaggtgt

SEQ ID NO: 299072 - DNA, 20 bp, Homo sapiens
gctctgttgcaggtgtccgg

SEQ ID NO: 299073 - DNA, 19 bp, Homo sapiens
gctcttagcagcttccaga

SEQ ID NO: 299074 - DNA, 19 bp, Homo sapiens
gctcttagtcctccctgct

SEQ ID NO: 299075 - DNA, 22 bp, Homo sapiens
gctcttagtcctccctgctcag

SEQ ID NO: 299076 - DNA, 16 bp, Homo sapiens
gctcttagtgcccgcc

SEQ ID NO: 299077 - DNA, 24 bp, Homo sapiens
gctcttcaagctgtcccctctgtc

SEQ ID NO: 299078 - DNA, 16 bp, Homo sapiens
gctcttcaccaggaag

SEQ ID NO: 299079 - DNA, 20 bp, Homo sapiens
gctcttcccccatgtgcctg

SEQ ID NO: 299080 - DNA, 16 bp, Homo sapiens
gctcttcctggacctg

SEQ ID NO: 299081 - DNA, 17 bp, Homo sapiens
gctcttctcctttcaca

SEQ ID NO: 299082 - DNA, 23 bp, Homo sapiens
gctcttctcctttcacaaccttc

SEQ ID NO: 299083 - DNA, 18 bp, Homo sapiens
gctcttgcagagaagcct

SEQ ID NO: 299084 - DNA, 19 bp, Homo sapiens
gctcttggcaggtactcag

SEQ ID NO: 299085 - DNA, 22 bp, Homo sapiens
gctcttggcattttcctcgcct

SEQ ID NO: 299086 - DNA, 14 bp, Homo sapiens
gctcttggtccctg

SEQ ID NO: 299087 - DNA, 16 bp, Homo sapiens
gctcttggtccctggt

SEQ ID NO: 299088 - DNA, 15 bp, Homo sapiens
gctctttccttgctc

SEQ ID NO: 299089 - DNA, 20 bp, Homo sapiens
gctctttctacatgactggg

SEQ ID NO: 299090 - DNA, 17 bp, Homo sapiens
gctctttctactctgaa

SEQ ID NO: 299091 - DNA, 17 bp, Homo sapiens
gctctttctctgccagt

SEQ ID NO: 299092 - DNA, 18 bp, Homo sapiens
gctctttctctgccagtg

SEQ ID NO: 299093 - DNA, 17 bp, Homo sapiens
gctctttgaaacaactt

SEQ ID NO: 299094 - DNA, 23 bp, Homo sapiens
gctctttgaaatagtctgtgtga

SEQ ID NO: 299095 - DNA, 14 bp, Homo sapiens
gctctttgtctcac

SEQ ID NO: 299096 - DNA, 18 bp, Homo sapiens
gctctttgtctcaccagc

SEQ ID NO: 299097 - DNA, 22 bp, Homo sapiens
gctctttgtctcaccagctcag

SEQ ID NO: 299098 - DNA, 21 bp, Homo sapiens
gctgaaaaccatctggcctgg

SEQ ID NO: 299099 - DNA, 14 bp, Homo sapiens
gctgaaaagtaaat

SEQ ID NO: 299100 - DNA, 16 bp, Homo sapiens
gctgaaaagtaaattg

SEQ ID NO: 299101 - DNA, 15 bp, Homo sapiens
gctgaaaagtgcttt

SEQ ID NO: 299102 - DNA, 14 bp, Homo sapiens
gctgaaaatcacta

SEQ ID NO: 299103 - DNA, 16 bp, Homo sapiens
gctgaaacagaatact

SEQ ID NO: 299104 - DNA, 16 bp, Homo sapiens
gctgaaacaggagaga

SEQ ID NO: 299105 - DNA, 20 bp, Homo sapiens
gctgaaacattccgaagagg

SEQ ID NO: 299106 - DNA, 17 bp, Homo sapiens
gctgaaattatgtcaaa

SEQ ID NO: 299107 - DNA, 22 bp, Homo sapiens
gctgaacagtggaggaagaggg

SEQ ID NO: 299108 - DNA, 23 bp, Homo sapiens
gctgaacctgttcaaaatgttaa

SEQ ID NO: 299109 - DNA, 17 bp, Homo sapiens
gctgaactaagttttgt

SEQ ID NO: 299110 - DNA, 23 bp, Homo sapiens
gctgaactgtgcatcaaccagga

SEQ ID NO: 299111 - DNA, 18 bp, Homo sapiens
gctgaagaattatttttt

SEQ ID NO: 299112 - DNA, 19 bp, Homo sapiens
gctgaagccgccaggaccg

SEQ ID NO: 299113 - DNA, 22 bp, Homo sapiens
gctgaagcttattaatgctaag

SEQ ID NO: 299114 - DNA, 15 bp, Homo sapiens
gctgaataacaacaa

SEQ ID NO: 299115 - DNA, 14 bp, Homo sapiens
gctgaatatctgtt

SEQ ID NO: 299116 - DNA, 16 bp, Homo sapiens
gctgaatatgcaattt

SEQ ID NO: 299117 - DNA, 19 bp, Homo sapiens
gctgacaaccaccgctccc

SEQ ID NO: 299118 - DNA, 19 bp, Homo sapiens
gctgacacctaccatgctg

SEQ ID NO: 299119 - DNA, 19 bp, Homo sapiens
gctgacacgtccaccccag

SEQ ID NO: 299120 - DNA, 16 bp, Homo sapiens
gctgacatcttgcacg

SEQ ID NO: 299121 - DNA, 13 bp, Homo sapiens
gctgaccccagga

SEQ ID NO: 299122 - DNA, 20 bp, Homo sapiens
gctgaccttgaactcctggg

SEQ ID NO: 299123 - DNA, 23 bp, Homo sapiens
gctgaccttgaactcctgggctc

SEQ ID NO: 299124 - DNA, 22 bp, Homo sapiens
gctgaccttggaggaatgacaa

SEQ ID NO: 299125 - DNA, 21 bp, Homo sapiens
gctgactggccccagggactc

SEQ ID NO: 299126 - DNA, 13 bp, Homo sapiens
gctgactggggct

SEQ ID NO: 299127 - DNA, 23 bp, Homo sapiens
gctgactgggggcctctgcctcc

SEQ ID NO: 299128 - DNA, 21 bp, Homo sapiens
gctgactgtactcctcccagg

SEQ ID NO: 299129 - DNA, 13 bp, Homo sapiens
gctgactgtggcc

SEQ ID NO: 299130 - DNA, 23 bp, Homo sapiens
gctgagaaatggggtggaatagg

SEQ ID NO: 299131 - DNA, 19 bp, Homo sapiens
gctgagactgcagaggagc

SEQ ID NO: 299132 - DNA, 20 bp, Homo sapiens
gctgagactgcagaggagcc

SEQ ID NO: 299133 - DNA, 14 bp, Homo sapiens
gctgagagccccag

SEQ ID NO: 299134 - DNA, 17 bp, Homo sapiens
gctgagagcccccacct

SEQ ID NO: 299135 - DNA, 14 bp, Homo sapiens
gctgagaggatgaa

SEQ ID NO: 299136 - DNA, 23 bp, Homo sapiens
gctgagatgggaggatcacttga

SEQ ID NO: 299137 - DNA, 18 bp, Homo sapiens
gctgagatgtttagtagc

SEQ ID NO: 299138 - DNA, 16 bp, Homo sapiens
gctgagcaccctctcc

SEQ ID NO: 299139 - DNA, 13 bp, Homo sapiens
gctgagccactcg

SEQ ID NO: 299140 - DNA, 15 bp, Homo sapiens
gctgagccactcgca

SEQ ID NO: 299141 - DNA, 16 bp, Homo sapiens
gctgagccactcgcag

SEQ ID NO: 299142 - DNA, 15 bp, Homo sapiens
gctgagccccctctc

SEQ ID NO: 299143 - DNA, 14 bp, Homo sapiens
gctgagcccctacc

SEQ ID NO: 299144 - DNA, 18 bp, Homo sapiens
gctgagcctactgtctcc

SEQ ID NO: 299145 - DNA, 22 bp, Homo sapiens
gctgagcctactgtctccttcc

SEQ ID NO: 299146 - DNA, 16 bp, Homo sapiens
gctgagcctgaggcct

SEQ ID NO: 299147 - DNA, 23 bp, Homo sapiens
gctgtggttttcttttgccatga

SEQ ID NO: 299148 - DNA, 14 bp, Homo sapiens
gctgtgtatttctg

SEQ ID NO: 299149 - DNA, 17 bp, Homo sapiens
gctgtgtatttctgtag

SEQ ID NO: 299150 - DNA, 19 bp, Homo sapiens
gctgtgtgttttcaatcct

SEQ ID NO: 299151 - DNA, 19 bp, Homo sapiens
gctgtgttgactgctgctc

SEQ ID NO: 299152 - DNA, 19 bp, Homo sapiens
gctgtgttttgtctgagcc

SEQ ID NO: 299153 - DNA, 18 bp, Homo sapiens
gctgttactgttaaccat

SEQ ID NO: 299154 - DNA, 13 bp, Homo sapiens
gctgttatctgtc

SEQ ID NO: 299155 - DNA, 17 bp, Homo sapiens
gctgttatctgtcttta

SEQ ID NO: 299156 - DNA, 13 bp, Homo sapiens
gctgttatcttgt

SEQ ID NO: 299157 - DNA, 16 bp, Homo sapiens
gctgttcattgatgac

SEQ ID NO: 299158 - DNA, 17 bp, Homo sapiens
gctgttccacaggggct

SEQ ID NO: 299159 - DNA, 12 bp, Homo sapiens
gctgttccagac

SEQ ID NO: 299160 - DNA, 13 bp, Homo sapiens
gctgttccagact

SEQ ID NO: 299161 - DNA, 14 bp, Homo sapiens
gctgttccagactc

SEQ ID NO: 299162 - DNA, 16 bp, Homo sapiens
gctgttcctgctccat

SEQ ID NO: 299163 - DNA, 14 bp, Homo sapiens
gctgttcctgtgtt

SEQ ID NO: 299164 - DNA, 16 bp, Homo sapiens
gctgttgagctgtttt

SEQ ID NO: 299165 - DNA, 18 bp, Homo sapiens
gctgttgagctgttttcc

SEQ ID NO: 299166 - DNA, 14 bp, Homo sapiens
gctgttgccatagc

SEQ ID NO: 299167 - DNA, 15 bp, Homo sapiens
gctgttgccatagcc

SEQ ID NO: 299168 - DNA, 18 bp, Homo sapiens
gctgttggctgggggcat

SEQ ID NO: 299169 - DNA, 20 bp, Homo sapiens
gctgtttagtttgttaattg

SEQ ID NO: 299170 - DNA, 16 bp, Homo sapiens
gctgtttatggcctca

SEQ ID NO: 299171 - DNA, 12 bp, Homo sapiens
gctgtttgtcat

SEQ ID NO: 299172 - DNA, 18 bp, Homo sapiens
gctgttttagtgccaggc

SEQ ID NO: 299173 - DNA, 18 bp, Homo sapiens
gctgttttgttctgtggt

SEQ ID NO: 299174 - DNA, 19 bp, Homo sapiens
gcttaatctagagctatgc

SEQ ID NO: 299175 - DNA, 12 bp, Homo sapiens
gcttaatttcta

SEQ ID NO: 299176 - DNA, 13 bp, Homo sapiens
gcttaatttctaa

SEQ ID NO: 299177 - DNA, 14 bp, Homo sapiens
gcttacaatgtgca

SEQ ID NO: 299178 - DNA, 13 bp, Homo sapiens
gcttacaggaagc

SEQ ID NO: 299179 - DNA, 14 bp, Homo sapiens
gcttacatttttac

SEQ ID NO: 299180 - DNA, 18 bp, Homo sapiens
gcttacatttttacaata

SEQ ID NO: 299181 - DNA, 19 bp, Homo sapiens
gcttacatttttacaataa

SEQ ID NO: 299182 - DNA, 15 bp, Homo sapiens
gcttacctcccacct

SEQ ID NO: 299183 - DNA, 21 bp, Homo sapiens
gcttactacatgtgggagctt

SEQ ID NO: 299184 - DNA, 13 bp, Homo sapiens
gcttactcttgct

SEQ ID NO: 299185 - DNA, 17 bp, Homo sapiens
gcttagaacccttctgc

SEQ ID NO: 299186 - DNA, 18 bp, Homo sapiens
gcttagaacccttctgct

SEQ ID NO: 299187 - DNA, 13 bp, Homo sapiens
gcttagaagccac

SEQ ID NO: 299188 - DNA, 13 bp, Homo sapiens
gcttagagagagg

SEQ ID NO: 299189 - DNA, 23 bp, Homo sapiens
gcttagagagaggaggcagcccc

SEQ ID NO: 299190 - DNA, 15 bp, Homo sapiens
gcttagaggagctct

SEQ ID NO: 299191 - DNA, 20 bp, Homo sapiens
gcttagatgagggtgactgt

SEQ ID NO: 299192 - DNA, 12 bp, Homo sapiens
gcttagccttgt

SEQ ID NO: 299193 - DNA, 13 bp, Homo sapiens
gcttagccttgtg

SEQ ID NO: 299194 - DNA, 18 bp, Homo sapiens
gcttagccttgtgccctg

SEQ ID NO: 299195 - DNA, 19 bp, Homo sapiens
gcttagccttgtgccctgc

SEQ ID NO: 299196 - DNA, 13 bp, Homo sapiens
gcttagctgaaac

SEQ ID NO: 299197 - DNA, 17 bp, Homo sapiens
gcttagctgaaacctaa

SEQ ID NO: 299198 - DNA, 16 bp, Homo sapiens
gcttaggccagtcagt

SEQ ID NO: 299199 - DNA, 15 bp, Homo sapiens
gcttatctccctgct

SEQ ID NO: 299200 - DNA, 14 bp, Homo sapiens
gcttatctgaaact

SEQ ID NO: 299201 - DNA, 17 bp, Homo sapiens
gcttatgaatatattta

SEQ ID NO: 299202 - DNA, 19 bp, Homo sapiens
gcttattaatgctaagggc

SEQ ID NO: 299203 - DNA, 14 bp, Homo sapiens
gcttattgtgtgaa

SEQ ID NO: 299204 - DNA, 14 bp, Homo sapiens
gcttatttatattc

SEQ ID NO: 299205 - DNA, 11 bp, Homo sapiens
gcttatttcta

SEQ ID NO: 299206 - DNA, 19 bp, Homo sapiens
gcttcaagtgttgctcttg

SEQ ID NO: 299207 - DNA, 16 bp, Homo sapiens
gcttcaataaatcttt

SEQ ID NO: 299208 - DNA, 15 bp, Homo sapiens
gcttcaattaataaa

SEQ ID NO: 299209 - DNA, 16 bp, Homo sapiens
gcttcacacccctcag

SEQ ID NO: 299210 - DNA, 15 bp, Homo sapiens
gcttcaccagagcat

SEQ ID NO: 299211 - DNA, 16 bp, Homo sapiens
gcttcacccctgcact

SEQ ID NO: 299212 - DNA, 21 bp, Homo sapiens
gcttcacccctgcacttcaga

SEQ ID NO: 299213 - DNA, 22 bp, Homo sapiens
gcttcaccctgaatggttccat

SEQ ID NO: 299214 - DNA, 20 bp, Homo sapiens
gcttcacggacaggaagcac

SEQ ID NO: 299215 - DNA, 16 bp, Homo sapiens
gcttcacggactcttt

SEQ ID NO: 299216 - DNA, 18 bp, Homo sapiens
gcttcacggactctttgc

SEQ ID NO: 299217 - DNA, 21 bp, Homo sapiens
gcttcacggactctttgctgt

SEQ ID NO: 299218 - DNA, 13 bp, Homo sapiens
gcttcagaattgt

SEQ ID NO: 299219 - DNA, 17 bp, Homo sapiens
gcttcagcccctggggt

SEQ ID NO: 299220 - DNA, 13 bp, Homo sapiens
gcttcagggctgg

SEQ ID NO: 299221 - DNA, 16 bp, Homo sapiens
gcttcagggctgggca

SEQ ID NO: 299222 - DNA, 18 bp, Homo sapiens
gcttcataggcagagccc

SEQ ID NO: 299223 - DNA, 12 bp, Homo sapiens
gcttcatatctc

SEQ ID NO: 299224 - DNA, 20 bp, Homo sapiens
gcttcatcttgagcctgagc

SEQ ID NO: 299225 - DNA, 15 bp, Homo sapiens
gcttcatgcctttgt

SEQ ID NO: 299226 - DNA, 20 bp, Homo sapiens
gcttccaaatttgaatggat

SEQ ID NO: 299227 - DNA, 23 bp, Homo sapiens
gcttccagattgacgacaagtgc

SEQ ID NO: 299228 - DNA, 16 bp, Homo sapiens
gcttccagcgggccct

SEQ ID NO: 299229 - DNA, 20 bp, Homo sapiens
gcttccagcgggccctctgc

SEQ ID NO: 299230 - DNA, 15 bp, Homo sapiens
gcttccatggcttcc

SEQ ID NO: 299231 - DNA, 19 bp, Homo sapiens
gcttccatggcttcctgag

SEQ ID NO: 299232 - DNA, 20 bp, Homo sapiens
gcttccatggcttcctgaga

SEQ ID NO: 299233 - DNA, 21 bp, Homo sapiens
gcttccatggtggtttcagaa

SEQ ID NO: 299234 - DNA, 23 bp, Homo sapiens
gcttccatggtggtttcagaaag

SEQ ID NO: 299235 - DNA, 14 bp, Homo sapiens
gcttcccaacaata

SEQ ID NO: 299236 - DNA, 13 bp, Homo sapiens
gcttcccacctcc

SEQ ID NO: 299237 - DNA, 18 bp, Homo sapiens
gcttcccaggaccctggg

SEQ ID NO: 299238 - DNA, 18 bp, Homo sapiens
gcttccccttttgccaat

SEQ ID NO: 299239 - DNA, 23 bp, Homo sapiens
gcttcccgctcagccctccctgc

SEQ ID NO: 299240 - DNA, 15 bp, Homo sapiens
gcttccctagatggt

SEQ ID NO: 299241 - DNA, 12 bp, Homo sapiens
gcttccctctgc

SEQ ID NO: 299242 - DNA, 17 bp, Homo sapiens
gcttccctctgcctgtc

SEQ ID NO: 299243 - DNA, 23 bp, Homo sapiens
gcttccctctgcctgtccctctc

SEQ ID NO: 299244 - DNA, 16 bp, Homo sapiens
gcttccctctgctcca

SEQ ID NO: 299245 - DNA, 17 bp, Homo sapiens
gcttccctgacttgctt

SEQ ID NO: 299246 - DNA, 15 bp, Homo sapiens
gcttccgctgtcacc

SEQ ID NO: 299247 - DNA, 17 bp, Homo sapiens
gcttccgtgagacacaa

SEQ ID NO: 299248 - DNA, 13 bp, Homo sapiens
gcttcctaactta

SEQ ID NO: 299249 - DNA, 18 bp, Homo sapiens
gcttcctccgtccaccca

SEQ ID NO: 299250 - DNA, 21 bp, Homo sapiens
gcttcctccgtccacccaggc

SEQ ID NO: 299251 - DNA, 22 bp, Homo sapiens
gcttcctccgtccacccaggct

SEQ ID NO: 299252 - DNA, 18 bp, Homo sapiens
gcttcctgacaatcaact

SEQ ID NO: 299253 - DNA, 23 bp, Homo sapiens
gcttcctgagaaagcccacctgg

SEQ ID NO: 299254 - DNA, 17 bp, Homo sapiens
gcttcctgtccactctc

SEQ ID NO: 299255 - DNA, 19 bp, Homo sapiens
gcttcctgtccactctcgg

SEQ ID NO: 299256 - DNA, 22 bp, Homo sapiens
gcttccttctgtgaaagtacat

SEQ ID NO: 299257 - DNA, 14 bp, Homo sapiens
gcttcggcctgctt

SEQ ID NO: 299258 - DNA, 15 bp, Homo sapiens
gcttctaattttgtg

SEQ ID NO: 299259 - DNA, 19 bp, Homo sapiens
gcttctcaactaaagaata

SEQ ID NO: 299260 - DNA, 23 bp, Homo sapiens
gcttctccacaacctcctcctcc

SEQ ID NO: 299261 - DNA, 14 bp, Homo sapiens
gcttctccacctcc

SEQ ID NO: 299262 - DNA, 15 bp, Homo sapiens
gcttctccacctccc

SEQ ID NO: 299263 - DNA, 20 bp, Homo sapiens
gcttctccctggactctgtg

SEQ ID NO: 299264 - DNA, 12 bp, Homo sapiens
gcttctcctgac

SEQ ID NO: 299265 - DNA, 20 bp, Homo sapiens
gcttctcggaggccaggccc

SEQ ID NO: 299266 - DNA, 21 bp, Homo sapiens
gcttctcggaggccaggccct

SEQ ID NO: 299267 - DNA, 22 bp, Homo sapiens
gcttctctgtgaacgatttaga

SEQ ID NO: 299268 - DNA, 19 bp, Homo sapiens
gcttctgaatgctgctact

SEQ ID NO: 299269 - DNA, 22 bp, Homo sapiens
gcttctgaattattctggatat

SEQ ID NO: 299270 - DNA, 18 bp, Homo sapiens
gcttctgcggtgaggcag

SEQ ID NO: 299271 - DNA, 12 bp, Homo sapiens
gcttctgctcac

SEQ ID NO: 299272 - DNA, 23 bp, Homo sapiens
gcttctgctttttctttcttttt

SEQ ID NO: 299273 - DNA, 18 bp, Homo sapiens
gcttctggctttgttctt

SEQ ID NO: 299274 - DNA, 18 bp, Homo sapiens
gcttctggtactctccta

SEQ ID NO: 299275 - DNA, 19 bp, Homo sapiens
gcttctggtactctcctag

SEQ ID NO: 299276 - DNA, 19 bp, Homo sapiens
gcttcttaatataactgcc

SEQ ID NO: 299277 - DNA, 13 bp, Homo sapiens
gcttcttccccag

SEQ ID NO: 299278 - DNA, 14 bp, Homo sapiens
ggacagacacagag

SEQ ID NO: 299279 - DNA, 13 bp, Homo sapiens
ggacagagggaga

SEQ ID NO: 299280 - DNA, 20 bp, Homo sapiens
ggacagagggagaagggaga

SEQ ID NO: 299281 - DNA, 22 bp, Homo sapiens
ggacagagggttttgattttaa

SEQ ID NO: 299282 - DNA, 23 bp, Homo sapiens
ggacagagttcagggaggggctg

SEQ ID NO: 299283 - DNA, 15 bp, Homo sapiens
ggacagatcaatggc

SEQ ID NO: 299284 - DNA, 23 bp, Homo sapiens
ggacagatcaatggcgcagtgcc

SEQ ID NO: 299285 - DNA, 23 bp, Homo sapiens
ggacagatccagggactgaagcc

SEQ ID NO: 299286 - DNA, 21 bp, Homo sapiens
ggacagcatgccccttggctg

SEQ ID NO: 299287 - DNA, 19 bp, Homo sapiens
ggacagcggcccggcccac

SEQ ID NO: 299288 - DNA, 20 bp, Homo sapiens
ggacagctgcaggtgcccat

SEQ ID NO: 299289 - DNA, 23 bp, Homo sapiens
ggacaggaacacccagccccagc

SEQ ID NO: 299290 - DNA, 15 bp, Homo sapiens
ggacaggaagcacag

SEQ ID NO: 299291 - DNA, 19 bp, Homo sapiens
ggacaggaagcacagcagg

SEQ ID NO: 299292 - DNA, 18 bp, Homo sapiens
ggacagttggcagagaag

SEQ ID NO: 299293 - DNA, 21 bp, Homo sapiens
ggacatgctcacctctagcct

SEQ ID NO: 299294 - DNA, 16 bp, Homo sapiens
ggacatgttcccttct

SEQ ID NO: 299295 - DNA, 21 bp, Homo sapiens
ggacatgtttttgttttcttt

SEQ ID NO: 299296 - DNA, 17 bp, Homo sapiens
ggacattgccccaagat

SEQ ID NO: 299297 - DNA, 22 bp, Homo sapiens
ggaccaaggtgcggaccggagc

SEQ ID NO: 299298 - DNA, 14 bp, Homo sapiens
ggaccacagctgct

SEQ ID NO: 299299 - DNA, 15 bp, Homo sapiens
ggaccacagctgctg

SEQ ID NO: 299300 - DNA, 20 bp, Homo sapiens
ggaccacagtgggtggcacc

SEQ ID NO: 299301 - DNA, 18 bp, Homo sapiens
ggaccaccagccccagca

SEQ ID NO: 299302 - DNA, 20 bp, Homo sapiens
ggaccaccagccccagcaag

SEQ ID NO: 299303 - DNA, 19 bp, Homo sapiens
ggaccagaagccaaagact

SEQ ID NO: 299304 - DNA, 12 bp, Homo sapiens
ggaccagatgct

SEQ ID NO: 299305 - DNA, 14 bp, Homo sapiens
ggaccagctggggg

SEQ ID NO: 299306 - DNA, 15 bp, Homo sapiens
ggaccaggactccct

SEQ ID NO: 299307 - DNA, 11 bp, Homo sapiens
ggaccaggagc

SEQ ID NO: 299308 - DNA, 14 bp, Homo sapiens
ggaccaggagccag

SEQ ID NO: 299309 - DNA, 15 bp, Homo sapiens
ggaccagttttgtat

SEQ ID NO: 299310 - DNA, 21 bp, Homo sapiens
ggaccattgacctcagctgca

SEQ ID NO: 299311 - DNA, 24 bp, Homo sapiens
ggaccattgacctcagctgcacat

SEQ ID NO: 299312 - DNA, 12 bp, Homo sapiens
ggacccaccaaa

SEQ ID NO: 299313 - DNA, 21 bp, Homo sapiens
ggacccaccccaactctcccc

SEQ ID NO: 299314 - DNA, 13 bp, Homo sapiens
ggacccagcaggg

SEQ ID NO: 299315 - DNA, 15 bp, Homo sapiens
ggacccagcaggggc

SEQ ID NO: 299316 - DNA, 12 bp, Homo sapiens
ggaccccagagg

SEQ ID NO: 299317 - DNA, 17 bp, Homo sapiens
ggaccccatctgctgag

SEQ ID NO: 299318 - DNA, 23 bp, Homo sapiens
ggaccccatctgctgagctctga

SEQ ID NO: 299319 - DNA, 21 bp, Homo sapiens
ggaccccccccccccccgccc

SEQ ID NO: 299320 - DNA, 18 bp, Homo sapiens
ggacccccggcctccagg

SEQ ID NO: 299321 - DNA, 20 bp, Homo sapiens
ggacccccggcctccaggct

SEQ ID NO: 299322 - DNA, 22 bp, Homo sapiens
ggacccccggcctccaggctgg

SEQ ID NO: 299323 - DNA, 23 bp, Homo sapiens
ggacccccggcctccaggctggg

SEQ ID NO: 299324 - DNA, 15 bp, Homo sapiens
ggacccctcccaacc

SEQ ID NO: 299325 - DNA, 17 bp, Homo sapiens
ggacccctcccttgctc

SEQ ID NO: 299326 - DNA, 23 bp, Homo sapiens
ggacccctcccttgctcagtgcc

SEQ ID NO: 299327 - DNA, 20 bp, Homo sapiens
ggacccctgctcccagcctg

SEQ ID NO: 299328 - DNA, 19 bp, Homo sapiens
ggaccctcggggcaggaag

SEQ ID NO: 299329 - DNA, 13 bp, Homo sapiens
ggaccctgagggt

SEQ ID NO: 299330 - DNA, 23 bp, Homo sapiens
ggaccctgagggtttccaccttg

SEQ ID NO: 299331 - DNA, 15 bp, Homo sapiens
ggaccgccagatggg

SEQ ID NO: 299332 - DNA, 22 bp, Homo sapiens
ggaccgccagatggggcctctg

SEQ ID NO: 299333 - DNA, 23 bp, Homo sapiens
ggaccgccagatggggcctctgt

SEQ ID NO: 299334 - DNA, 16 bp, Homo sapiens
ggaccggagcggctga

SEQ ID NO: 299335 - DNA, 22 bp, Homo sapiens
ggaccggagcggctgaggacgg

SEQ ID NO: 299336 - DNA, 23 bp, Homo sapiens
ggaccgggccgctagatgggcat

SEQ ID NO: 299337 - DNA, 15 bp, Homo sapiens
ggaccgggtgggcct

SEQ ID NO: 299338 - DNA, 22 bp, Homo sapiens
ggaccgggtgggcctggcctga

SEQ ID NO: 299339 - DNA, 17 bp, Homo sapiens
ggacctatgtcctaagg

SEQ ID NO: 299340 - DNA, 13 bp, Homo sapiens
ggacctccacctg

SEQ ID NO: 299341 - DNA, 18 bp, Homo sapiens
ggacctccacctgggaga

SEQ ID NO: 299342 - DNA, 14 bp, Homo sapiens
ggacctgaaggacg

SEQ ID NO: 299343 - DNA, 23 bp, Homo sapiens
ggacctgcctcctgcctgcccct

SEQ ID NO: 299344 - DNA, 17 bp, Homo sapiens
ggacctgctgctccatg

SEQ ID NO: 299345 - DNA, 22 bp, Homo sapiens
ggaccttatctgtgcgtgaaac

SEQ ID NO: 299346 - DNA, 18 bp, Homo sapiens
ggaccttggagagctcag

SEQ ID NO: 299347 - DNA, 15 bp, Homo sapiens
ggacctttcagctgt

SEQ ID NO: 299348 - DNA, 13 bp, Homo sapiens
ggacgcctggctc

SEQ ID NO: 299349 - DNA, 22 bp, Homo sapiens
ggacgcctggctccaggctcca

SEQ ID NO: 299350 - DNA, 12 bp, Homo sapiens
ggacgctggctc

SEQ ID NO: 299351 - DNA, 13 bp, Homo sapiens
ggacgctggctcc

SEQ ID NO: 299352 - DNA, 23 bp, Homo sapiens
ggacgggacagcggcccggccca

SEQ ID NO: 299353 - DNA, 13 bp, Homo sapiens
ggacgggggctgc

SEQ ID NO: 299354 - DNA, 15 bp, Homo sapiens
ggacggttgtaagca

SEQ ID NO: 299355 - DNA, 18 bp, Homo sapiens
ggacgtggtcagggcagg

SEQ ID NO: 299356 - DNA, 18 bp, Homo sapiens
ggactaacataaaatctg

SEQ ID NO: 299357 - DNA, 14 bp, Homo sapiens
ggactcagccctga

SEQ ID NO: 299358 - DNA, 18 bp, Homo sapiens
ggactcaggcctgccaat

SEQ ID NO: 299359 - DNA, 20 bp, Homo sapiens
ggactcagggccatgcctgc

SEQ ID NO: 299360 - DNA, 17 bp, Homo sapiens
ggactccaggccagctc

SEQ ID NO: 299361 - DNA, 21 bp, Homo sapiens
ggactccaggccagctccttt

SEQ ID NO: 299362 - DNA, 19 bp, Homo sapiens
ggactcccgggccacgccc

SEQ ID NO: 299363 - DNA, 20 bp, Homo sapiens
ggactcccgggccacgcccc

SEQ ID NO: 299364 - DNA, 15 bp, Homo sapiens
ggactccctccccac

SEQ ID NO: 299365 - DNA, 22 bp, Homo sapiens
ggactccctcctcacctctgga

SEQ ID NO: 299366 - DNA, 12 bp, Homo sapiens
ggactcctctgt

SEQ ID NO: 299367 - DNA, 15 bp, Homo sapiens
ggactcctctgtcca

SEQ ID NO: 299368 - DNA, 13 bp, Homo sapiens
ggactctgcccca

SEQ ID NO: 299369 - DNA, 13 bp, Homo sapiens
ggactctgtgctc

SEQ ID NO: 299370 - DNA, 14 bp, Homo sapiens
ggactctgtgctca

SEQ ID NO: 299371 - DNA, 19 bp, Homo sapiens
ggactctgtggggccacac

SEQ ID NO: 299372 - DNA, 21 bp, Homo sapiens
ggactcttgagccctcctgga

SEQ ID NO: 299373 - DNA, 14 bp, Homo sapiens
ggactgaagcctgc

SEQ ID NO: 299374 - DNA, 17 bp, Homo sapiens
ggactgagccagtccca

SEQ ID NO: 299375 - DNA, 14 bp, Homo sapiens
ggactgaggagtgg

SEQ ID NO: 299376 - DNA, 19 bp, Homo sapiens
ggactgatgtcatcttgag

SEQ ID NO: 299377 - DNA, 11 bp, Homo sapiens
ggactgccccc

SEQ ID NO: 299378 - DNA, 15 bp, Homo sapiens
ggactgcccccagaa

SEQ ID NO: 299379 - DNA, 22 bp, Homo sapiens
ggactgcccccagaaagcctcc

SEQ ID NO: 299380 - DNA, 15 bp, Homo sapiens
ggactgcctctgcca

SEQ ID NO: 299381 - DNA, 23 bp, Homo sapiens
ggactggagtcagatgagcaagg

SEQ ID NO: 299382 - DNA, 20 bp, Homo sapiens
ggactggctagagtcctcac

SEQ ID NO: 299383 - DNA, 20 bp, Homo sapiens
ggactgtacctgtaggaaac

SEQ ID NO: 299384 - DNA, 14 bp, Homo sapiens
ggactgtcagctga

SEQ ID NO: 299385 - DNA, 20 bp, Homo sapiens
ggactgttttttcctgagct

SEQ ID NO: 299386 - DNA, 21 bp, Homo sapiens
ggactgttttttcctgagctt

SEQ ID NO: 299387 - DNA, 15 bp, Homo sapiens
ggacttaacggctcc

SEQ ID NO: 299388 - DNA, 20 bp, Homo sapiens
ggacttaacggctccaggat

SEQ ID NO: 299389 - DNA, 17 bp, Homo sapiens
ggacttaagacaaatgg

SEQ ID NO: 299390 - DNA, 18 bp, Homo sapiens
ggactttatttaatttca

SEQ ID NO: 299391 - DNA, 20 bp, Homo sapiens
ggactttatttaatttcata

SEQ ID NO: 299392 - DNA, 21 bp, Homo sapiens
ggactttccaccccctccctg

SEQ ID NO: 299393 - DNA, 12 bp, Homo sapiens
ggactttgttac

SEQ ID NO: 299394 - DNA, 15 bp, Homo sapiens
ggacttttattttgg

SEQ ID NO: 299395 - DNA, 22 bp, Homo sapiens
ggacttttcgttaacattgacc

SEQ ID NO: 299396 - DNA, 11 bp, Homo sapiens
ggagaaacaca

SEQ ID NO: 299397 - DNA, 14 bp, Homo sapiens
ggagaaaccagctt

SEQ ID NO: 299398 - DNA, 18 bp, Homo sapiens
ggagaaactgaaagtgtt

SEQ ID NO: 299399 - DNA, 13 bp, Homo sapiens
ggagaaaggatgg

SEQ ID NO: 299400 - DNA, 21 bp, Homo sapiens
ggagaaaggatggcagcctca

SEQ ID NO: 299401 - DNA, 21 bp, Homo sapiens
ggagaacctcgttgacatgca

SEQ ID NO: 299402 - DNA, 13 bp, Homo sapiens
ggagaactagaga

SEQ ID NO: 299403 - DNA, 13 bp, Homo sapiens
ggagaaggaaaag

SEQ ID NO: 299404 - DNA, 13 bp, Homo sapiens
ggagaaggagagg

SEQ ID NO: 299405 - DNA, 14 bp, Homo sapiens
ggagaaggagaggc

SEQ ID NO: 299406 - DNA, 18 bp, Homo sapiens
ggagaaggagaggctctg

SEQ ID NO: 299407 - DNA, 22 bp, Homo sapiens
ggagaaggcctgccccccttcc

SEQ ID NO: 299408 - DNA, 19 bp, Homo sapiens
ggattacaggtgcccacca

SEQ ID NO: 299409 - DNA, 16 bp, Homo sapiens
ggattcaaatgcatga

SEQ ID NO: 299410 - DNA, 17 bp, Homo sapiens
ggattcacttctattta

SEQ ID NO: 299411 - DNA, 15 bp, Homo sapiens
ggattcatgtccaga

SEQ ID NO: 299412 - DNA, 16 bp, Homo sapiens
ggattcattacagctt

SEQ ID NO: 299413 - DNA, 16 bp, Homo sapiens
ggattccaaagcattt

SEQ ID NO: 299414 - DNA, 16 bp, Homo sapiens
ggattcccctggacat

SEQ ID NO: 299415 - DNA, 16 bp, Homo sapiens
ggattccggccctggc

SEQ ID NO: 299416 - DNA, 23 bp, Homo sapiens
ggattctactttaagcactacat

SEQ ID NO: 299417 - DNA, 10 bp, Homo sapiens
ggattctggg

SEQ ID NO: 299418 - DNA, 18 bp, Homo sapiens
ggattctttccattatga

SEQ ID NO: 299419 - DNA, 13 bp, Homo sapiens
ggattgaacacag

SEQ ID NO: 299420 - DNA, 18 bp, Homo sapiens
ggattgcacgtggcctct

SEQ ID NO: 299421 - DNA, 17 bp, Homo sapiens
ggattgtacgtgggaga

SEQ ID NO: 299422 - DNA, 20 bp, Homo sapiens
ggattgtacgtgggagaggc

SEQ ID NO: 299423 - DNA, 20 bp, Homo sapiens
ggattgtccacaaatgtcct

SEQ ID NO: 299424 - DNA, 17 bp, Homo sapiens
ggatttaaaaactggaa

SEQ ID NO: 299425 - DNA, 18 bp, Homo sapiens
ggatttaaaaactggaac

SEQ ID NO: 299426 - DNA, 21 bp, Homo sapiens
ggatttaacagtcatttaaaa

SEQ ID NO: 299427 - DNA, 20 bp, Homo sapiens
ggatttcatgatttcatttc

SEQ ID NO: 299428 - DNA, 13 bp, Homo sapiens
ggatttctcccag

SEQ ID NO: 299429 - DNA, 13 bp, Homo sapiens
ggatttcttccta

SEQ ID NO: 299430 - DNA, 21 bp, Homo sapiens
ggatttgaggagcagcttcag

SEQ ID NO: 299431 - DNA, 13 bp, Homo sapiens
ggattttgtggct

SEQ ID NO: 299432 - DNA, 18 bp, Homo sapiens
ggcaaaagacatcctcaa

SEQ ID NO: 299433 - DNA, 18 bp, Homo sapiens
ggcaaagaactgccccat

SEQ ID NO: 299434 - DNA, 15 bp, Homo sapiens
ggcaaagaggtgctg

SEQ ID NO: 299435 - DNA, 21 bp, Homo sapiens
ggcaaagtgctgtacccttcc

SEQ ID NO: 299436 - DNA, 11 bp, Homo sapiens
ggcaaatctgc

SEQ ID NO: 299437 - DNA, 22 bp, Homo sapiens
ggcaaatgccaggacagctgca

SEQ ID NO: 299438 - DNA, 17 bp, Homo sapiens
ggcaaatgtccaagcat

SEQ ID NO: 299439 - DNA, 16 bp, Homo sapiens
ggcaaattaacttgag

SEQ ID NO: 299440 - DNA, 17 bp, Homo sapiens
ggcaacattacaaacaa

SEQ ID NO: 299441 - DNA, 12 bp, Homo sapiens
ggcaacctgtaa

SEQ ID NO: 299442 - DNA, 15 bp, Homo sapiens
ggcaacgaagaaaaa

SEQ ID NO: 299443 - DNA, 17 bp, Homo sapiens
ggcaacgacggtttcaa

SEQ ID NO: 299444 - DNA, 16 bp, Homo sapiens
ggcaactgaacaaaaa

SEQ ID NO: 299445 - DNA, 19 bp, Homo sapiens
ggcaagagaaatgaggaag

SEQ ID NO: 299446 - DNA, 21 bp, Homo sapiens
ggcaagagaaatgaggaagaa

SEQ ID NO: 299447 - DNA, 17 bp, Homo sapiens
ggcaagagactgggagc

SEQ ID NO: 299448 - DNA, 16 bp, Homo sapiens
ggcaagagggaaggtg

SEQ ID NO: 299449 - DNA, 19 bp, Homo sapiens
ggcaagattggaaagacag

SEQ ID NO: 299450 - DNA, 12 bp, Homo sapiens
ggcaagcaggga

SEQ ID NO: 299451 - DNA, 14 bp, Homo sapiens
ggcaagccacagaa

SEQ ID NO: 299452 - DNA, 15 bp, Homo sapiens
ggcaagcccctcagc

SEQ ID NO: 299453 - DNA, 16 bp, Homo sapiens
ggcaagcccctcagcc

SEQ ID NO: 299454 - DNA, 19 bp, Homo sapiens
ggcaagcccctcagccctt

SEQ ID NO: 299455 - DNA, 20 bp, Homo sapiens
ggcaagcccctcagcccttg

SEQ ID NO: 299456 - DNA, 14 bp, Homo sapiens
ggcaagcctgagtg

SEQ ID NO: 299457 - DNA, 18 bp, Homo sapiens
ggcaagcctgagtggtga

SEQ ID NO: 299458 - DNA, 14 bp, Homo sapiens
ggcaagctggcagg

SEQ ID NO: 299459 - DNA, 15 bp, Homo sapiens
ggcaaggatgatcca

SEQ ID NO: 299460 - DNA, 17 bp, Homo sapiens
ggcaaggggtgcctggg

SEQ ID NO: 299461 - DNA, 23 bp, Homo sapiens
ggcaaggtgggttccagggactg

SEQ ID NO: 299462 - DNA, 13 bp, Homo sapiens
ggcaatgactgtg

SEQ ID NO: 299463 - DNA, 16 bp, Homo sapiens
ggcaattcttcttctc

SEQ ID NO: 299464 - DNA, 15 bp, Homo sapiens
ggcacaaaaccagaa

SEQ ID NO: 299465 - DNA, 19 bp, Homo sapiens
ggcacaccactgccctgcc

SEQ ID NO: 299466 - DNA, 20 bp, Homo sapiens
ggcacaccactgccctgcct

SEQ ID NO: 299467 - DNA, 17 bp, Homo sapiens
ggcacactacagagcag

SEQ ID NO: 299468 - DNA, 14 bp, Homo sapiens
ggcacactgagcaa

SEQ ID NO: 299469 - DNA, 18 bp, Homo sapiens
ggcacagacttctggaag

SEQ ID NO: 299470 - DNA, 13 bp, Homo sapiens
ggcacagccagaa

SEQ ID NO: 299471 - DNA, 12 bp, Homo sapiens
ggcacagctgtg

SEQ ID NO: 299472 - DNA, 19 bp, Homo sapiens
ggcacagggtctgctcttt

SEQ ID NO: 299473 - DNA, 14 bp, Homo sapiens
ggcacatgtgttca

SEQ ID NO: 299474 - DNA, 16 bp, Homo sapiens
ggcaccaaagatgcag

SEQ ID NO: 299475 - DNA, 24 bp, Homo sapiens
ggcaccactagggtcctggccctc

SEQ ID NO: 299476 - DNA, 15 bp, Homo sapiens
ggcaccagccccctg

SEQ ID NO: 299477 - DNA, 19 bp, Homo sapiens
ggcaccagccccctggatg

SEQ ID NO: 299478 - DNA, 13 bp, Homo sapiens
ggcaccagctctg

SEQ ID NO: 299479 - DNA, 19 bp, Homo sapiens
ggcaccagctctgtggcct

SEQ ID NO: 299480 - DNA, 23 bp, Homo sapiens
ggcaccatagaagaacagcagat

SEQ ID NO: 299481 - DNA, 14 bp, Homo sapiens
ggcaccgagaatgt

SEQ ID NO: 299482 - DNA, 15 bp, Homo sapiens
ggcaccgagaatgtt

SEQ ID NO: 299483 - DNA, 21 bp, Homo sapiens
ggcaccgcccacccacacccc

SEQ ID NO: 299484 - DNA, 22 bp, Homo sapiens
ggcaccgcccacccacaccccg

SEQ ID NO: 299485 - DNA, 13 bp, Homo sapiens
ggcaccggcgctg

SEQ ID NO: 299486 - DNA, 14 bp, Homo sapiens
ggcaccggcgctgc

SEQ ID NO: 299487 - DNA, 13 bp, Homo sapiens
ggcacctgctgga

SEQ ID NO: 299488 - DNA, 18 bp, Homo sapiens
ggcacgctgtgggcaggt

SEQ ID NO: 299489 - DNA, 16 bp, Homo sapiens
ggcacgggagagcgcc

SEQ ID NO: 299490 - DNA, 18 bp, Homo sapiens
ggcacgggagagcgccac

SEQ ID NO: 299491 - DNA, 21 bp, Homo sapiens
ggcacgggtgtcgaggcagga

SEQ ID NO: 299492 - DNA, 22 bp, Homo sapiens
ggcactagcattataccaagag

SEQ ID NO: 299493 - DNA, 16 bp, Homo sapiens
ggcactctctgccagc

SEQ ID NO: 299494 - DNA, 17 bp, Homo sapiens
ggcactctctgccagct

SEQ ID NO: 299495 - DNA, 24 bp, Homo sapiens
ggcactctctgccagctccacagg

SEQ ID NO: 299496 - DNA, 17 bp, Homo sapiens
ggcactgagatatttat

SEQ ID NO: 299497 - DNA, 21 bp, Homo sapiens
ggcactgccttctcctctctg

SEQ ID NO: 299498 - DNA, 23 bp, Homo sapiens
ggcactgccttctcctctctggg

SEQ ID NO: 299499 - DNA, 16 bp, Homo sapiens
ggcactggaaaacata

SEQ ID NO: 299500 - DNA, 20 bp, Homo sapiens
ggcactggcattgtccctgt

SEQ ID NO: 299501 - DNA, 15 bp, Homo sapiens
ggcactggctgctct

SEQ ID NO: 299502 - DNA, 16 bp, Homo sapiens
ggcactggctgctctg

SEQ ID NO: 299503 - DNA, 20 bp, Homo sapiens
ggcactgggccggcagcctg

SEQ ID NO: 299504 - DNA, 16 bp, Homo sapiens
ggcactggtggcatcg

SEQ ID NO: 299505 - DNA, 21 bp, Homo sapiens
ggcactttagtgattgctttt

SEQ ID NO: 299506 - DNA, 17 bp, Homo sapiens
ggcagaaaagaggagac

SEQ ID NO: 299507 - DNA, 21 bp, Homo sapiens
ggcagaaaagaggagaccctg

SEQ ID NO: 299508 - DNA, 17 bp, Homo sapiens
ggcagaaagcagaggct

SEQ ID NO: 299509 - DNA, 19 bp, Homo sapiens
ggcagaaagcagaggctgg

SEQ ID NO: 299510 - DNA, 20 bp, Homo sapiens
ggcagaaaggagatcattta

SEQ ID NO: 299511 - DNA, 19 bp, Homo sapiens
ggcagaaatcccagttcat

SEQ ID NO: 299512 - DNA, 14 bp, Homo sapiens
ggcagaaccctggt

SEQ ID NO: 299513 - DNA, 15 bp, Homo sapiens
ggcagaaccctggtg

SEQ ID NO: 299514 - DNA, 14 bp, Homo sapiens
ggcagaacctggtg

SEQ ID NO: 299515 - DNA, 15 bp, Homo sapiens
ggcagaactgagctc

SEQ ID NO: 299516 - DNA, 15 bp, Homo sapiens
ggcagaagatagaga

SEQ ID NO: 299517 - DNA, 20 bp, Homo sapiens
ggcagaagcgtctcccttgg

SEQ ID NO: 299518 - DNA, 15 bp, Homo sapiens
ggcagaagtcagccc

SEQ ID NO: 299519 - DNA, 15 bp, Homo sapiens
ggcagaatggtgggc

SEQ ID NO: 299520 - DNA, 14 bp, Homo sapiens
ggcagacacatgct

SEQ ID NO: 299521 - DNA, 13 bp, Homo sapiens
ggcagactcgagg

SEQ ID NO: 299522 - DNA, 22 bp, Homo sapiens
ggcagagaaaacacacgctcct

SEQ ID NO: 299523 - DNA, 14 bp, Homo sapiens
ggcagagccatggg

SEQ ID NO: 299524 - DNA, 19 bp, Homo sapiens
ggcagagccatgggcctgg

SEQ ID NO: 299525 - DNA, 13 bp, Homo sapiens
ggcagagcctgtc

SEQ ID NO: 299526 - DNA, 15 bp, Homo sapiens
ggcagagcctgtccc

SEQ ID NO: 299527 - DNA, 13 bp, Homo sapiens
ggcagagctcaga

SEQ ID NO: 299528 - DNA, 20 bp, Homo sapiens
ggcagagctcagcacagcct

SEQ ID NO: 299529 - DNA, 16 bp, Homo sapiens
ggcagaggatgttctg

SEQ ID NO: 299530 - DNA, 13 bp, Homo sapiens
ggcagaggcaggg

SEQ ID NO: 299531 - DNA, 17 bp, Homo sapiens
ggcagaggcagggccct

SEQ ID NO: 299532 - DNA, 20 bp, Homo sapiens
ggcagagggaatgttccctg

SEQ ID NO: 299533 - DNA, 22 bp, Homo sapiens
ggcagagggaatgttccctgca

SEQ ID NO: 299534 - DNA, 23 bp, Homo sapiens
ggcagagggaatgttccctgcac

SEQ ID NO: 299535 - DNA, 13 bp, Homo sapiens
ggcagaggggaga

SEQ ID NO: 299536 - DNA, 16 bp, Homo sapiens
ggcagaggggagagga

SEQ ID NO: 299537 - DNA, 17 bp, Homo sapiens
ggcagaggggcagccgc

SEQ ID NO: 299538 - DNA, 18 bp, Homo sapiens
ggcagaggtcccctgagg

SEQ ID NO: 299539 - DNA, 13 bp, Homo sapiens
ggcctgagctggg

SEQ ID NO: 299540 - DNA, 22 bp, Homo sapiens
ggcctgaggatgagctggaagg

SEQ ID NO: 299541 - DNA, 16 bp, Homo sapiens
ggcctgaggctgctga

SEQ ID NO: 299542 - DNA, 16 bp, Homo sapiens
ggcctgagggaagccc

SEQ ID NO: 299543 - DNA, 19 bp, Homo sapiens
ggcctgagggaagcccacc

SEQ ID NO: 299544 - DNA, 22 bp, Homo sapiens
ggcctgagggaagcccacccgc

SEQ ID NO: 299545 - DNA, 15 bp, Homo sapiens
ggcctgatggagagg

SEQ ID NO: 299546 - DNA, 20 bp, Homo sapiens
ggcctgatggagaggagaac

SEQ ID NO: 299547 - DNA, 12 bp, Homo sapiens
ggcctgcagccc

SEQ ID NO: 299548 - DNA, 15 bp, Homo sapiens
ggcctgcagcccaga

SEQ ID NO: 299549 - DNA, 17 bp, Homo sapiens
ggcctgcagcccagaac

SEQ ID NO: 299550 - DNA, 13 bp, Homo sapiens
ggcctgcaggccc

SEQ ID NO: 299551 - DNA, 14 bp, Homo sapiens
ggcctgcaggcccc

SEQ ID NO: 299552 - DNA, 17 bp, Homo sapiens
ggcctgcaggccccagc

SEQ ID NO: 299553 - DNA, 18 bp, Homo sapiens
ggcctgcaggccccagcc

SEQ ID NO: 299554 - DNA, 22 bp, Homo sapiens
ggcctgcaggccccagccaagt

SEQ ID NO: 299555 - DNA, 14 bp, Homo sapiens
ggcctgcaggggcc

SEQ ID NO: 299556 - DNA, 17 bp, Homo sapiens
ggcctgccccccttccc

SEQ ID NO: 299557 - DNA, 22 bp, Homo sapiens
ggcctgcccgttgccgggcctg

SEQ ID NO: 299558 - DNA, 18 bp, Homo sapiens
ggcctgctaaggctcctc

SEQ ID NO: 299559 - DNA, 18 bp, Homo sapiens
ggcctgctgcgtcagacc

SEQ ID NO: 299560 - DNA, 19 bp, Homo sapiens
ggcctgctgcgtcagacca

SEQ ID NO: 299561 - DNA, 23 bp, Homo sapiens
ggcctgctgggaaccccgcagcc

SEQ ID NO: 299562 - DNA, 15 bp, Homo sapiens
ggcctgctgtgggtc

SEQ ID NO: 299563 - DNA, 19 bp, Homo sapiens
ggcctgcttttccaggatc

SEQ ID NO: 299564 - DNA, 15 bp, Homo sapiens
ggcctggacctgcct

SEQ ID NO: 299565 - DNA, 15 bp, Homo sapiens
ggcctggcagccgtg

SEQ ID NO: 299566 - DNA, 16 bp, Homo sapiens
ggcctggccacctctc

SEQ ID NO: 299567 - DNA, 14 bp, Homo sapiens
ggcctggccaggag

SEQ ID NO: 299568 - DNA, 15 bp, Homo sapiens
ggcctggccaggagc

SEQ ID NO: 299569 - DNA, 17 bp, Homo sapiens
ggcctggccaggagctc

SEQ ID NO: 299570 - DNA, 10 bp, Homo sapiens
ggcctggccc

SEQ ID NO: 299571 - DNA, 12 bp, Homo sapiens
ggcctggcccag

SEQ ID NO: 299572 - DNA, 12 bp, Homo sapiens
ggcctggccctg

SEQ ID NO: 299573 - DNA, 13 bp, Homo sapiens
ggcctggccctgc

SEQ ID NO: 299574 - DNA, 19 bp, Homo sapiens
ggcctggccctgccctgag

SEQ ID NO: 299575 - DNA, 18 bp, Homo sapiens
ggcctggcctatttaagc

SEQ ID NO: 299576 - DNA, 11 bp, Homo sapiens
ggcctggcctg

SEQ ID NO: 299577 - DNA, 16 bp, Homo sapiens
ggcctggcctgagctg

SEQ ID NO: 299578 - DNA, 16 bp, Homo sapiens
ggcctggcctggccct

SEQ ID NO: 299579 - DNA, 13 bp, Homo sapiens
ggcctggcctggg

SEQ ID NO: 299580 - DNA, 14 bp, Homo sapiens
ggcctggcctgggt

SEQ ID NO: 299581 - DNA, 15 bp, Homo sapiens
ggcctggcctgggtg

SEQ ID NO: 299582 - DNA, 13 bp, Homo sapiens
ggcctggcctggt

SEQ ID NO: 299583 - DNA, 23 bp, Homo sapiens
ggcctggctccccacgagtcacc

SEQ ID NO: 299584 - DNA, 16 bp, Homo sapiens
ggcctggcttgctcca

SEQ ID NO: 299585 - DNA, 19 bp, Homo sapiens
ggcctggcttgctccaggg

SEQ ID NO: 299586 - DNA, 21 bp, Homo sapiens
ggcctggcttgctccagggtc

SEQ ID NO: 299587 - DNA, 22 bp, Homo sapiens
ggcctgggacccagctactctg

SEQ ID NO: 299588 - DNA, 12 bp, Homo sapiens
ggcctgggaggg

SEQ ID NO: 299589 - DNA, 14 bp, Homo sapiens
ggcctgggcctgct

SEQ ID NO: 299590 - DNA, 14 bp, Homo sapiens
ggcctgggtctgtg

SEQ ID NO: 299591 - DNA, 21 bp, Homo sapiens
ggcctgggtggggcagggcct

SEQ ID NO: 299592 - DNA, 17 bp, Homo sapiens
ggcctggtcagcagagc

SEQ ID NO: 299593 - DNA, 22 bp, Homo sapiens
ggcctggtcagcagagccgccc

SEQ ID NO: 299594 - DNA, 15 bp, Homo sapiens
ggcctgtatgaggct

SEQ ID NO: 299595 - DNA, 23 bp, Homo sapiens
ggcctgtccacctgtgctgctgc

SEQ ID NO: 299596 - DNA, 21 bp, Homo sapiens
ggcctgtccctggccatctct

SEQ ID NO: 299597 - DNA, 19 bp, Homo sapiens
ggcctgtgcagcagcccag

SEQ ID NO: 299598 - DNA, 17 bp, Homo sapiens
ggcctgtgctgcatgcg

SEQ ID NO: 299599 - DNA, 17 bp, Homo sapiens
ggcctgtgctgggccag

SEQ ID NO: 299600 - DNA, 21 bp, Homo sapiens
ggcctgtgctgggccagtggc

SEQ ID NO: 299601 - DNA, 22 bp, Homo sapiens
ggcctgtgtgtaagctgactgg

SEQ ID NO: 299602 - DNA, 19 bp, Homo sapiens
ggcctgttctgtaggagag

SEQ ID NO: 299603 - DNA, 11 bp, Homo sapiens
ggcctgttgcc

SEQ ID NO: 299604 - DNA, 14 bp, Homo sapiens
ggccttaataaata

SEQ ID NO: 299605 - DNA, 21 bp, Homo sapiens
ggccttccccttttgcctggc

SEQ ID NO: 299606 - DNA, 22 bp, Homo sapiens
ggccttgcccgccagcctcagt

SEQ ID NO: 299607 - DNA, 15 bp, Homo sapiens
ggccttgctgtcatg

SEQ ID NO: 299608 - DNA, 20 bp, Homo sapiens
ggccttggacggggacacgg

SEQ ID NO: 299609 - DNA, 15 bp, Homo sapiens
ggccttggccttggg

SEQ ID NO: 299610 - DNA, 24 bp, Homo sapiens
ggccttggggccagactggctgca

SEQ ID NO: 299611 - DNA, 17 bp, Homo sapiens
ggccttgggggtctgct

SEQ ID NO: 299612 - DNA, 19 bp, Homo sapiens
ggccttgtgacattcactc

SEQ ID NO: 299613 - DNA, 17 bp, Homo sapiens
ggccttgtgtgctggct

SEQ ID NO: 299614 - DNA, 15 bp, Homo sapiens
ggccttgttctctct

SEQ ID NO: 299615 - DNA, 13 bp, Homo sapiens
ggcctttcctgtg

SEQ ID NO: 299616 - DNA, 23 bp, Homo sapiens
ggcctttgtaagacacacagcct

SEQ ID NO: 299617 - DNA, 12 bp, Homo sapiens
ggccttttccta

SEQ ID NO: 299618 - DNA, 16 bp, Homo sapiens
ggcgaagctgagcggg

SEQ ID NO: 299619 - DNA, 17 bp, Homo sapiens
ggcgactgtcatgtggc

SEQ ID NO: 299620 - DNA, 12 bp, Homo sapiens
ggcgaggcagag

SEQ ID NO: 299621 - DNA, 13 bp, Homo sapiens
ggcgaggcagagg

SEQ ID NO: 299622 - DNA, 21 bp, Homo sapiens
ggcgaggcgaagctgagcggg

SEQ ID NO: 299623 - DNA, 17 bp, Homo sapiens
ggcgaggcgggggagcc

SEQ ID NO: 299624 - DNA, 18 bp, Homo sapiens
ggcgaggcgggggagcct

SEQ ID NO: 299625 - DNA, 19 bp, Homo sapiens
ggcgaggcgggggagcctg

SEQ ID NO: 299626 - DNA, 18 bp, Homo sapiens
ggcgaggcgggggatcct

SEQ ID NO: 299627 - DNA, 17 bp, Homo sapiens
ggcgaggctgcctctgg

SEQ ID NO: 299628 - DNA, 12 bp, Homo sapiens
ggcgagggaggg

SEQ ID NO: 299629 - DNA, 19 bp, Homo sapiens
ggcgagggaggggaggtgg

SEQ ID NO: 299630 - DNA, 22 bp, Homo sapiens
ggcgatccacctgtctcagcct

SEQ ID NO: 299631 - DNA, 13 bp, Homo sapiens
ggcgcagcccctg

SEQ ID NO: 299632 - DNA, 16 bp, Homo sapiens
ggcgcagccctagtgg

SEQ ID NO: 299633 - DNA, 13 bp, Homo sapiens
ggcgcccacctgc

SEQ ID NO: 299634 - DNA, 15 bp, Homo sapiens
ggcgcccctgccacc

SEQ ID NO: 299635 - DNA, 23 bp, Homo sapiens
ggcgcctgcgctcctctgcagcc

SEQ ID NO: 299636 - DNA, 19 bp, Homo sapiens
ggcgccttctacctgcagg

SEQ ID NO: 299637 - DNA, 16 bp, Homo sapiens
ggcgcgggaggcacca

SEQ ID NO: 299638 - DNA, 19 bp, Homo sapiens
ggcgcgggaggcaccagct

SEQ ID NO: 299639 - DNA, 21 bp, Homo sapiens
ggcgcggttcaggtcagggct

SEQ ID NO: 299640 - DNA, 14 bp, Homo sapiens
ggcgctcaggaccc

SEQ ID NO: 299641 - DNA, 19 bp, Homo sapiens
ggcgctccggcagaggcag

SEQ ID NO: 299642 - DNA, 21 bp, Homo sapiens
ggcgctccggcagaggcaggg

SEQ ID NO: 299643 - DNA, 18 bp, Homo sapiens
ggcgctgctgggagcaga

SEQ ID NO: 299644 - DNA, 14 bp, Homo sapiens
ggcgctgcttccag

SEQ ID NO: 299645 - DNA, 15 bp, Homo sapiens
ggcgctgcttccagg

SEQ ID NO: 299646 - DNA, 17 bp, Homo sapiens
ggcgctttctcctgtgc

SEQ ID NO: 299647 - DNA, 15 bp, Homo sapiens
ggcggaacctggctg

SEQ ID NO: 299648 - DNA, 19 bp, Homo sapiens
ggcggaacctggctgcgaa

SEQ ID NO: 299649 - DNA, 16 bp, Homo sapiens
ggcggaggggcttgga

SEQ ID NO: 299650 - DNA, 19 bp, Homo sapiens
ggcggaggggcttggagca

SEQ ID NO: 299651 - DNA, 20 bp, Homo sapiens
ggcggaggggcttggagcag

SEQ ID NO: 299652 - DNA, 21 bp, Homo sapiens
ggcggaggggcttggagcaga

SEQ ID NO: 299653 - DNA, 13 bp, Homo sapiens
ggcggcagctggg

SEQ ID NO: 299654 - DNA, 18 bp, Homo sapiens
ggcggcccctctgttctg

SEQ ID NO: 299655 - DNA, 14 bp, Homo sapiens
ggcggctaggccgg

SEQ ID NO: 299656 - DNA, 14 bp, Homo sapiens
ggcggctgagagcc

SEQ ID NO: 299657 - DNA, 23 bp, Homo sapiens
ggcggctgagagccccagctgac

SEQ ID NO: 299658 - DNA, 21 bp, Homo sapiens
ggcggcttcctgtccactctc

SEQ ID NO: 299659 - DNA, 11 bp, Homo sapiens
ggcgggcagcc

SEQ ID NO: 299660 - DNA, 12 bp, Homo sapiens
ggcgggcagccc

SEQ ID NO: 299661 - DNA, 16 bp, Homo sapiens
ggcgggcagcccctgc

SEQ ID NO: 299662 - DNA, 17 bp, Homo sapiens
ggcggggcagcaggagc

SEQ ID NO: 299663 - DNA, 17 bp, Homo sapiens
ggcgggggatcctggag

SEQ ID NO: 299664 - DNA, 21 bp, Homo sapiens
ggcggtccccatccccaccag

SEQ ID NO: 299665 - DNA, 19 bp, Homo sapiens
ggcgtaatgggcctgccca

SEQ ID NO: 299666 - DNA, 19 bp, Homo sapiens
ggcgtagggccagggctct

SEQ ID NO: 299667 - DNA, 20 bp, Homo sapiens
ggcgtagggccagggctctg

SEQ ID NO: 299668 - DNA, 16 bp, Homo sapiens
ggcgtcctggtgagga

SEQ ID NO: 299669 - DNA, 23 bp, Homo sapiens
ggcgtctgcctaggagctggctg

SEQ ID NO: 299670 - DNA, 22 bp, Homo sapiens
ggcttgctccagggtcttgggc

SEQ ID NO: 299671 - DNA, 17 bp, Homo sapiens
ggcttgcttgccgagcc

SEQ ID NO: 299672 - DNA, 17 bp, Homo sapiens
ggcttggacttcctggg

SEQ ID NO: 299673 - DNA, 15 bp, Homo sapiens
ggcttggggtagaga

SEQ ID NO: 299674 - DNA, 17 bp, Homo sapiens
ggcttggggtagagagg

SEQ ID NO: 299675 - DNA, 21 bp, Homo sapiens
ggcttggggtagagaggacag

SEQ ID NO: 299676 - DNA, 16 bp, Homo sapiens
ggcttggggtgtgggg

SEQ ID NO: 299677 - DNA, 13 bp, Homo sapiens
ggcttggtggtgg

SEQ ID NO: 299678 - DNA, 16 bp, Homo sapiens
ggcttgtcagagctgg

SEQ ID NO: 299679 - DNA, 16 bp, Homo sapiens
ggctttaagctccagc

SEQ ID NO: 299680 - DNA, 18 bp, Homo sapiens
ggctttaagctccagctt

SEQ ID NO: 299681 - DNA, 22 bp, Homo sapiens
ggctttatgcaggattctcttt

SEQ ID NO: 299682 - DNA, 23 bp, Homo sapiens
ggctttcatcctgtgtcccctga

SEQ ID NO: 299683 - DNA, 20 bp, Homo sapiens
ggctttcatgaggaggcaga

SEQ ID NO: 299684 - DNA, 21 bp, Homo sapiens
ggctttccagaaggccacagg

SEQ ID NO: 299685 - DNA, 13 bp, Homo sapiens
ggctttctggaat

SEQ ID NO: 299686 - DNA, 13 bp, Homo sapiens
ggctttgcaggct

SEQ ID NO: 299687 - DNA, 15 bp, Homo sapiens
ggctttgcaggctct

SEQ ID NO: 299688 - DNA, 20 bp, Homo sapiens
ggctttgcaggctctgggct

SEQ ID NO: 299689 - DNA, 13 bp, Homo sapiens
ggctttgcaggga

SEQ ID NO: 299690 - DNA, 16 bp, Homo sapiens
ggctttgcagggagac

SEQ ID NO: 299691 - DNA, 20 bp, Homo sapiens
ggctttgcccaacctcagca

SEQ ID NO: 299692 - DNA, 21 bp, Homo sapiens
ggctttgggaacactggcctg

SEQ ID NO: 299693 - DNA, 15 bp, Homo sapiens
ggctttgtgcttggg

SEQ ID NO: 299694 - DNA, 15 bp, Homo sapiens
ggctttgttcttgtc

SEQ ID NO: 299695 - DNA, 24 bp, Homo sapiens
ggctttgttcttgtcatcagtaag

SEQ ID NO: 299696 - DNA, 22 bp, Homo sapiens
ggcttttattttttaagttcaa

SEQ ID NO: 299697 - DNA, 19 bp, Homo sapiens
ggcttttcactgctggctg

SEQ ID NO: 299698 - DNA, 22 bp, Homo sapiens
ggcttttcactgctggctgcct

SEQ ID NO: 299699 - DNA, 20 bp, Homo sapiens
ggcttttcccaccagctccc

SEQ ID NO: 299700 - DNA, 21 bp, Homo sapiens
ggcttttcccaccagctccca

SEQ ID NO: 299701 - DNA, 16 bp, Homo sapiens
ggctttttttttctct

SEQ ID NO: 299702 - DNA, 15 bp, Homo sapiens
gggaaaactcttcat

SEQ ID NO: 299703 - DNA, 22 bp, Homo sapiens
gggaaaatatagacctatgata

SEQ ID NO: 299704 - DNA, 21 bp, Homo sapiens
gggaaaatgtcccccacctct

SEQ ID NO: 299705 - DNA, 16 bp, Homo sapiens
gggaaagcgggcagcc

SEQ ID NO: 299706 - DNA, 13 bp, Homo sapiens
gggaaagctccac

SEQ ID NO: 299707 - DNA, 16 bp, Homo sapiens
gggaaaggacccaccc

SEQ ID NO: 299708 - DNA, 18 bp, Homo sapiens
gggaaatccaactccagg

SEQ ID NO: 299709 - DNA, 14 bp, Homo sapiens
gggaaattcttgca

SEQ ID NO: 299710 - DNA, 17 bp, Homo sapiens
gggaacaagtgtacaga

SEQ ID NO: 299711 - DNA, 16 bp, Homo sapiens
gggaaccccgcagccc

SEQ ID NO: 299712 - DNA, 15 bp, Homo sapiens
gggaacgcagcctcc

SEQ ID NO: 299713 - DNA, 19 bp, Homo sapiens
gggaacgcagcctccagtt

SEQ ID NO: 299714 - DNA, 14 bp, Homo sapiens
gggaactccactct

SEQ ID NO: 299715 - DNA, 22 bp, Homo sapiens
gggaactgcttgcccagggtgc

SEQ ID NO: 299716 - DNA, 13 bp, Homo sapiens
gggaagagagcct

SEQ ID NO: 299717 - DNA, 16 bp, Homo sapiens
gggaagagagcctgcc

SEQ ID NO: 299718 - DNA, 21 bp, Homo sapiens
gggaagagaggagttcaatga

SEQ ID NO: 299719 - DNA, 22 bp, Homo sapiens
gggaagagaggagttcaatgat

SEQ ID NO: 299720 - DNA, 22 bp, Homo sapiens
gggaagagctgggttttcctag

SEQ ID NO: 299721 - DNA, 22 bp, Homo sapiens
gggaagataggctctgcacaga

SEQ ID NO: 299722 - DNA, 12 bp, Homo sapiens
gggaagatgctg

SEQ ID NO: 299723 - DNA, 12 bp, Homo sapiens
gggaagcaggga

SEQ ID NO: 299724 - DNA, 13 bp, Homo sapiens
gggaagcccaccc

SEQ ID NO: 299725 - DNA, 18 bp, Homo sapiens
gggaagcccacccgcccc

SEQ ID NO: 299726 - DNA, 21 bp, Homo sapiens
gggaagctgaggcgggagaat

SEQ ID NO: 299727 - DNA, 16 bp, Homo sapiens
gggaagctgcagcttg

SEQ ID NO: 299728 - DNA, 19 bp, Homo sapiens
gggaagctgcagcttggga

SEQ ID NO: 299729 - DNA, 18 bp, Homo sapiens
gggaagctgtactcagag

SEQ ID NO: 299730 - DNA, 22 bp, Homo sapiens
gggaagcttgagcctcccccaa

SEQ ID NO: 299731 - DNA, 18 bp, Homo sapiens
gggaaggacttggcgcgc

SEQ ID NO: 299732 - DNA, 15 bp, Homo sapiens
gggaaggccacctgc

SEQ ID NO: 299733 - DNA, 17 bp, Homo sapiens
gggaagggaaccagccc

SEQ ID NO: 299734 - DNA, 23 bp, Homo sapiens
gggaagggaaccagccctccaga

SEQ ID NO: 299735 - DNA, 13 bp, Homo sapiens
gggaagggccagt

SEQ ID NO: 299736 - DNA, 16 bp, Homo sapiens
gggaagggccagtctg

SEQ ID NO: 299737 - DNA, 19 bp, Homo sapiens
gggaaggggtgggagccaa

SEQ ID NO: 299738 - DNA, 12 bp, Homo sapiens
gggaaggtcacc

SEQ ID NO: 299739 - DNA, 20 bp, Homo sapiens
gggaatggatggggagaatg

SEQ ID NO: 299740 - DNA, 21 bp, Homo sapiens
gggaatgtattattctgcagc

SEQ ID NO: 299741 - DNA, 22 bp, Homo sapiens
gggaatgtcagtagtgccagaa

SEQ ID NO: 299742 - DNA, 11 bp, Homo sapiens
gggaatgtgaa

SEQ ID NO: 299743 - DNA, 14 bp, Homo sapiens
gggaattgtgtgat

SEQ ID NO: 299744 - DNA, 12 bp, Homo sapiens
gggaatttcctc

SEQ ID NO: 299745 - DNA, 19 bp, Homo sapiens
gggacaaatttaaaacaaa

SEQ ID NO: 299746 - DNA, 18 bp, Homo sapiens
gggacaagggattctggg

SEQ ID NO: 299747 - DNA, 21 bp, Homo sapiens
gggacacagaccggccgcatg

SEQ ID NO: 299748 - DNA, 14 bp, Homo sapiens
gggacacagagacc

SEQ ID NO: 299749 - DNA, 21 bp, Homo sapiens
gggacagacgcttgcgccgag

SEQ ID NO: 299750 - DNA, 22 bp, Homo sapiens
gggacagcatgccccttggctg

SEQ ID NO: 299751 - DNA, 13 bp, Homo sapiens
gggacagcggccc

SEQ ID NO: 299752 - DNA, 15 bp, Homo sapiens
gggacagcggcccgg

SEQ ID NO: 299753 - DNA, 18 bp, Homo sapiens
gggacagcggcccggccc

SEQ ID NO: 299754 - DNA, 22 bp, Homo sapiens
gggacagctaggctgagatgca

SEQ ID NO: 299755 - DNA, 16 bp, Homo sapiens
gggacagctttcctgg

SEQ ID NO: 299756 - DNA, 15 bp, Homo sapiens
gggacagttggcaga

SEQ ID NO: 299757 - DNA, 17 bp, Homo sapiens
gggacatgctcacctct

SEQ ID NO: 299758 - DNA, 21 bp, Homo sapiens
gggacatggtgtgccacaggc

SEQ ID NO: 299759 - DNA, 15 bp, Homo sapiens
gggaccacagctgct

SEQ ID NO: 299760 - DNA, 21 bp, Homo sapiens
gggacccagctactctgtcca

SEQ ID NO: 299761 - DNA, 20 bp, Homo sapiens
gggacccatagatcttctga

SEQ ID NO: 299762 - DNA, 20 bp, Homo sapiens
gggacccctgctcccagcct

SEQ ID NO: 299763 - DNA, 13 bp, Homo sapiens
gggacctgctgct

SEQ ID NO: 299764 - DNA, 21 bp, Homo sapiens
gggactcgcagcacccacagc

SEQ ID NO: 299765 - DNA, 15 bp, Homo sapiens
gggactgaagccaaa

SEQ ID NO: 299766 - DNA, 14 bp, Homo sapiens
gggactgagccagt

SEQ ID NO: 299767 - DNA, 17 bp, Homo sapiens
gggactgagccagtccc

SEQ ID NO: 299768 - DNA, 11 bp, Homo sapiens
gggactgatgt

SEQ ID NO: 299769 - DNA, 16 bp, Homo sapiens
gggactgcatgcaagc

SEQ ID NO: 299770 - DNA, 23 bp, Homo sapiens
gggactgccagtccccctgcccc

SEQ ID NO: 299771 - DNA, 14 bp, Homo sapiens
gggactgcctctgc

SEQ ID NO: 299772 - DNA, 17 bp, Homo sapiens
gggactgcctctgccac

SEQ ID NO: 299773 - DNA, 22 bp, Homo sapiens
gggactggcccacccctcttcc

SEQ ID NO: 299774 - DNA, 13 bp, Homo sapiens
gggactgggaggg

SEQ ID NO: 299775 - DNA, 17 bp, Homo sapiens
gggactgggagtcagag

SEQ ID NO: 299776 - DNA, 19 bp, Homo sapiens
gggactgtatttctgtgga

SEQ ID NO: 299777 - DNA, 14 bp, Homo sapiens
gggactgtcagata

SEQ ID NO: 299778 - DNA, 15 bp, Homo sapiens
gggacttcaaaatca

SEQ ID NO: 299779 - DNA, 15 bp, Homo sapiens
gggacttccttgctc

SEQ ID NO: 299780 - DNA, 16 bp, Homo sapiens
gggagaaaagccagat

SEQ ID NO: 299781 - DNA, 20 bp, Homo sapiens
gggagaacctcgttgacatg

SEQ ID NO: 299782 - DNA, 23 bp, Homo sapiens
gggagaacctcgttgacatgcac

SEQ ID NO: 299783 - DNA, 16 bp, Homo sapiens
gggagaagtggcccct

SEQ ID NO: 299784 - DNA, 18 bp, Homo sapiens
gggagaatggctctggct

SEQ ID NO: 299785 - DNA, 15 bp, Homo sapiens
gggagacacctcaga

SEQ ID NO: 299786 - DNA, 11 bp, Homo sapiens
gggagacccaa

SEQ ID NO: 299787 - DNA, 17 bp, Homo sapiens
gggagaccctgggagag

SEQ ID NO: 299788 - DNA, 19 bp, Homo sapiens
gggagaccgagtgtggagc

SEQ ID NO: 299789 - DNA, 22 bp, Homo sapiens
gggagagacctcatcaggatga

SEQ ID NO: 299790 - DNA, 19 bp, Homo sapiens
gggagagagtgagagagag

SEQ ID NO: 299791 - DNA, 18 bp, Homo sapiens
gggagagcgccacccgcc

SEQ ID NO: 299792 - DNA, 13 bp, Homo sapiens
gggagaggaagca

SEQ ID NO: 299793 - DNA, 12 bp, Homo sapiens
gggagaggaggg

SEQ ID NO: 299794 - DNA, 12 bp, Homo sapiens
gggagaggcaga

SEQ ID NO: 299795 - DNA, 13 bp, Homo sapiens
gggagaggcagaa

SEQ ID NO: 299796 - DNA, 18 bp, Homo sapiens
gggagagtgaggtcatcc

SEQ ID NO: 299797 - DNA, 22 bp, Homo sapiens
gggagatccgccctgggctctg

SEQ ID NO: 299798 - DNA, 15 bp, Homo sapiens
gggagatggtcagtg

SEQ ID NO: 299799 - DNA, 16 bp, Homo sapiens
gggagcactggagtgc

SEQ ID NO: 299800 - DNA, 13 bp, Homo sapiens
gggcctggctccc

SEQ ID NO: 299801 - DNA, 22 bp, Homo sapiens
gggcctgggggcagtgactggc

SEQ ID NO: 299802 - DNA, 12 bp, Homo sapiens
gggcctgtgcag

SEQ ID NO: 299803 - DNA, 17 bp, Homo sapiens
gggcctgtgcagcagcc

SEQ ID NO: 299804 - DNA, 21 bp, Homo sapiens
gggcctgtgcagcagcccagc

SEQ ID NO: 299805 - DNA, 16 bp, Homo sapiens
gggccttctcagctct

SEQ ID NO: 299806 - DNA, 19 bp, Homo sapiens
gggccttctcagctctcca

SEQ ID NO: 299807 - DNA, 12 bp, Homo sapiens
gggcgaggcaga

SEQ ID NO: 299808 - DNA, 22 bp, Homo sapiens
gggcgcccattcgtctgtccca

SEQ ID NO: 299809 - DNA, 19 bp, Homo sapiens
gggcgcctgcgctcctctg

SEQ ID NO: 299810 - DNA, 15 bp, Homo sapiens
gggcgctcaggaccc

SEQ ID NO: 299811 - DNA, 22 bp, Homo sapiens
gggcgctcaggacccaggccct

SEQ ID NO: 299812 - DNA, 16 bp, Homo sapiens
gggcgctccggcagag

SEQ ID NO: 299813 - DNA, 23 bp, Homo sapiens
gggcgctccggcagaggcagggc

SEQ ID NO: 299814 - DNA, 16 bp, Homo sapiens
gggcgctgcctgctct

SEQ ID NO: 299815 - DNA, 19 bp, Homo sapiens
gggcgctgctgggagcaga

SEQ ID NO: 299816 - DNA, 15 bp, Homo sapiens
gggcggccaggcaac

SEQ ID NO: 299817 - DNA, 12 bp, Homo sapiens
gggcggccaggg

SEQ ID NO: 299818 - DNA, 13 bp, Homo sapiens
gggcggccaggga

SEQ ID NO: 299819 - DNA, 21 bp, Homo sapiens
gggcggctggaaagaggagaa

SEQ ID NO: 299820 - DNA, 15 bp, Homo sapiens
gggcgggccaggaga

SEQ ID NO: 299821 - DNA, 14 bp, Homo sapiens
gggcggggagaaga

SEQ ID NO: 299822 - DNA, 18 bp, Homo sapiens
gggcgggggtctatacat

SEQ ID NO: 299823 - DNA, 16 bp, Homo sapiens
gggctaacgggcgcct

SEQ ID NO: 299824 - DNA, 14 bp, Homo sapiens
gggctaactggccc

SEQ ID NO: 299825 - DNA, 17 bp, Homo sapiens
gggctaactggccccag

SEQ ID NO: 299826 - DNA, 21 bp, Homo sapiens
gggctaactggccccaggcgg

SEQ ID NO: 299827 - DNA, 22 bp, Homo sapiens
gggctaaggcctcttgctggtg

SEQ ID NO: 299828 - DNA, 16 bp, Homo sapiens
gggctactggcagctc

SEQ ID NO: 299829 - DNA, 22 bp, Homo sapiens
gggctactggcagctcctctcc

SEQ ID NO: 299830 - DNA, 17 bp, Homo sapiens
gggctagtgtgagtggc

SEQ ID NO: 299831 - DNA, 22 bp, Homo sapiens
gggctatttctctccccactga

SEQ ID NO: 299832 - DNA, 15 bp, Homo sapiens
gggctcacggggcct

SEQ ID NO: 299833 - DNA, 18 bp, Homo sapiens
gggctcagctctggctca

SEQ ID NO: 299834 - DNA, 23 bp, Homo sapiens
gggctcagctctggctcacagac

SEQ ID NO: 299835 - DNA, 12 bp, Homo sapiens
gggctcagggct

SEQ ID NO: 299836 - DNA, 13 bp, Homo sapiens
gggctcagggctg

SEQ ID NO: 299837 - DNA, 20 bp, Homo sapiens
gggctccagagtaggtgggt

SEQ ID NO: 299838 - DNA, 20 bp, Homo sapiens
gggctccagcatccagcctg

SEQ ID NO: 299839 - DNA, 22 bp, Homo sapiens
gggctccagcatccagcctgtg

SEQ ID NO: 299840 - DNA, 23 bp, Homo sapiens
gggctccagcatccagcctgtgt

SEQ ID NO: 299841 - DNA, 22 bp, Homo sapiens
gggctcccggagagggagtcag

SEQ ID NO: 299842 - DNA, 14 bp, Homo sapiens
gggctcctggaacc

SEQ ID NO: 299843 - DNA, 17 bp, Homo sapiens
gggctcctggctgccag

SEQ ID NO: 299844 - DNA, 17 bp, Homo sapiens
gggctcgtggccttccc

SEQ ID NO: 299845 - DNA, 13 bp, Homo sapiens
gggctctccaaag

SEQ ID NO: 299846 - DNA, 13 bp, Homo sapiens
gggctctggccac

SEQ ID NO: 299847 - DNA, 14 bp, Homo sapiens
gggctctggccacc

SEQ ID NO: 299848 - DNA, 16 bp, Homo sapiens
gggctctgtcttcctg

SEQ ID NO: 299849 - DNA, 15 bp, Homo sapiens
gggctgacacctacc

SEQ ID NO: 299850 - DNA, 22 bp, Homo sapiens
gggctgacacctaccatgctgc

SEQ ID NO: 299851 - DNA, 10 bp, Homo sapiens
gggctgagac

SEQ ID NO: 299852 - DNA, 12 bp, Homo sapiens
gggctgagcccc

SEQ ID NO: 299853 - DNA, 14 bp, Homo sapiens
gggctgagccccta

SEQ ID NO: 299854 - DNA, 23 bp, Homo sapiens
gggctgagcccctaccccacacc

SEQ ID NO: 299855 - DNA, 18 bp, Homo sapiens
gggctgagcccctcctct

SEQ ID NO: 299856 - DNA, 19 bp, Homo sapiens
gggctgagcccctcctctc

SEQ ID NO: 299857 - DNA, 15 bp, Homo sapiens
gggctgagtctggct

SEQ ID NO: 299858 - DNA, 13 bp, Homo sapiens
gggctgcatcctc

SEQ ID NO: 299859 - DNA, 16 bp, Homo sapiens
gggctgcatcctcagc

SEQ ID NO: 299860 - DNA, 22 bp, Homo sapiens
gggctgcccctgtaggttgctt

SEQ ID NO: 299861 - DNA, 13 bp, Homo sapiens
gggctgccctggt

SEQ ID NO: 299862 - DNA, 16 bp, Homo sapiens
gggctgcgaccgccag

SEQ ID NO: 299863 - DNA, 16 bp, Homo sapiens
gggctgctggggcatg

SEQ ID NO: 299864 - DNA, 14 bp, Homo sapiens
gggctgcttctcca

SEQ ID NO: 299865 - DNA, 17 bp, Homo sapiens
gggctgcttctccacct

SEQ ID NO: 299866 - DNA, 16 bp, Homo sapiens
gggctggactggctgt

SEQ ID NO: 299867 - DNA, 17 bp, Homo sapiens
gggctggagtgcgctct

SEQ ID NO: 299868 - DNA, 23 bp, Homo sapiens
gggctggagtgcgctcttggtcc

SEQ ID NO: 299869 - DNA, 15 bp, Homo sapiens
gggctggcaagcagg

SEQ ID NO: 299870 - DNA, 11 bp, Homo sapiens
gggctggcaga

SEQ ID NO: 299871 - DNA, 17 bp, Homo sapiens
gggctggccagttggaa

SEQ ID NO: 299872 - DNA, 16 bp, Homo sapiens
gggctggcccggggag

SEQ ID NO: 299873 - DNA, 15 bp, Homo sapiens
gggctggccttcctg

SEQ ID NO: 299874 - DNA, 16 bp, Homo sapiens
gggctgggagctctgc

SEQ ID NO: 299875 - DNA, 14 bp, Homo sapiens
gggctgggcagctg

SEQ ID NO: 299876 - DNA, 20 bp, Homo sapiens
gggctgggggtgaggggcca

SEQ ID NO: 299877 - DNA, 18 bp, Homo sapiens
gggctggggtgagagagg

SEQ ID NO: 299878 - DNA, 21 bp, Homo sapiens
gggctgtggctgggtggtcag

SEQ ID NO: 299879 - DNA, 20 bp, Homo sapiens
gggctgttttagtgccaggc

SEQ ID NO: 299880 - DNA, 15 bp, Homo sapiens
gggcttagaatgggg

SEQ ID NO: 299881 - DNA, 20 bp, Homo sapiens
gggcttccctagatggttcc

SEQ ID NO: 299882 - DNA, 15 bp, Homo sapiens
gggcttccctctgct

SEQ ID NO: 299883 - DNA, 19 bp, Homo sapiens
gggcttccctctgctccac

SEQ ID NO: 299884 - DNA, 11 bp, Homo sapiens
gggcttcctta

SEQ ID NO: 299885 - DNA, 21 bp, Homo sapiens
gggcttggacttcctggggcc

SEQ ID NO: 299886 - DNA, 14 bp, Homo sapiens
gggcttggagcaga

SEQ ID NO: 299887 - DNA, 13 bp, Homo sapiens
gggcttggccttg

SEQ ID NO: 299888 - DNA, 13 bp, Homo sapiens
gggcttggggtag

SEQ ID NO: 299889 - DNA, 18 bp, Homo sapiens
gggcttggggtagagagg

SEQ ID NO: 299890 - DNA, 22 bp, Homo sapiens
gggcttggggtagagaggacag

SEQ ID NO: 299891 - DNA, 20 bp, Homo sapiens
gggctttgattccatctcct

SEQ ID NO: 299892 - DNA, 17 bp, Homo sapiens
gggctttgcaggctctg

SEQ ID NO: 299893 - DNA, 19 bp, Homo sapiens
gggctttgcaggctctggg

SEQ ID NO: 299894 - DNA, 14 bp, Homo sapiens
gggcttttattttt

SEQ ID NO: 299895 - DNA, 11 bp, Homo sapiens
ggggaacagat

SEQ ID NO: 299896 - DNA, 14 bp, Homo sapiens
ggggaagagagcct

SEQ ID NO: 299897 - DNA, 19 bp, Homo sapiens
ggggaagaggccttggggg

SEQ ID NO: 299898 - DNA, 12 bp, Homo sapiens
ggggaagatgaa

SEQ ID NO: 299899 - DNA, 17 bp, Homo sapiens
ggggaaggccttgctgt

SEQ ID NO: 299900 - DNA, 13 bp, Homo sapiens
ggggaagggccag

SEQ ID NO: 299901 - DNA, 19 bp, Homo sapiens
ggggacagatcttgagcaa

SEQ ID NO: 299902 - DNA, 13 bp, Homo sapiens
ggggacagctttc

SEQ ID NO: 299903 - DNA, 20 bp, Homo sapiens
ggggacagttggcagagaag

SEQ ID NO: 299904 - DNA, 13 bp, Homo sapiens
ggggaccaggagc

SEQ ID NO: 299905 - DNA, 16 bp, Homo sapiens
ggggagacacctcaga

SEQ ID NO: 299906 - DNA, 18 bp, Homo sapiens
ggggagagcaggctggca

SEQ ID NO: 299907 - DNA, 19 bp, Homo sapiens
ggggagatcggggccagag

SEQ ID NO: 299908 - DNA, 19 bp, Homo sapiens
ggggagcacttgcgtcctg

SEQ ID NO: 299909 - DNA, 13 bp, Homo sapiens
ggggagcctggag

SEQ ID NO: 299910 - DNA, 14 bp, Homo sapiens
ggggagcctggagc

SEQ ID NO: 299911 - DNA, 16 bp, Homo sapiens
ggggagcctggagccc

SEQ ID NO: 299912 - DNA, 16 bp, Homo sapiens
ggggaggacctctggg

SEQ ID NO: 299913 - DNA, 23 bp, Homo sapiens
ggggaggacggagttcagagggt

SEQ ID NO: 299914 - DNA, 18 bp, Homo sapiens
ggggaggccgaggcaggg

SEQ ID NO: 299915 - DNA, 19 bp, Homo sapiens
ggggaggccgaggcagggg

SEQ ID NO: 299916 - DNA, 13 bp, Homo sapiens
ggggaggctctga

SEQ ID NO: 299917 - DNA, 21 bp, Homo sapiens
ggggaggggcctagggagccg

SEQ ID NO: 299918 - DNA, 16 bp, Homo sapiens
ggggaggggcctggcc

SEQ ID NO: 299919 - DNA, 19 bp, Homo sapiens
ggggagtgggacagagtct

SEQ ID NO: 299920 - DNA, 21 bp, Homo sapiens
ggggagttgagtcacaagagg

SEQ ID NO: 299921 - DNA, 22 bp, Homo sapiens
ggggagtttccgcggcggcttc

SEQ ID NO: 299922 - DNA, 14 bp, Homo sapiens
ggggatcctggagc

SEQ ID NO: 299923 - DNA, 23 bp, Homo sapiens
ggggatctaaaaggaggacaggg

SEQ ID NO: 299924 - DNA, 13 bp, Homo sapiens
ggggattcaaatg

SEQ ID NO: 299925 - DNA, 14 bp, Homo sapiens
ggggatttctggga

SEQ ID NO: 299926 - DNA, 16 bp, Homo sapiens
ggggcaaccctggtga

SEQ ID NO: 299927 - DNA, 13 bp, Homo sapiens
ggggcaagagctc

SEQ ID NO: 299928 - DNA, 18 bp, Homo sapiens
ggggcaaggtctccttac

SEQ ID NO: 299929 - DNA, 22 bp, Homo sapiens
ggggcaaggtgggggagcctgg

SEQ ID NO: 299930 - DNA, 18 bp, Homo sapiens
ggggcacaccactgccct

SEQ ID NO: 299931 - DNA, 17 bp, Homo sapiens
ggtacaggaaggcttgc

SEQ ID NO: 299932 - DNA, 14 bp, Homo sapiens
ggtacattcacagc

SEQ ID NO: 299933 - DNA, 16 bp, Homo sapiens
ggtaccacatggtcca

SEQ ID NO: 299934 - DNA, 22 bp, Homo sapiens
ggtaccacccttcagaccccag

SEQ ID NO: 299935 - DNA, 18 bp, Homo sapiens
ggtaccagccctggggct

SEQ ID NO: 299936 - DNA, 13 bp, Homo sapiens
ggtaccaggccac

SEQ ID NO: 299937 - DNA, 14 bp, Homo sapiens
ggtaccaggccacc

SEQ ID NO: 299938 - DNA, 16 bp, Homo sapiens
ggtaccaggccaccca

SEQ ID NO: 299939 - DNA, 13 bp, Homo sapiens
ggtaccctggcag

SEQ ID NO: 299940 - DNA, 23 bp, Homo sapiens
ggtaccctggcagagaagagacc

SEQ ID NO: 299941 - DNA, 15 bp, Homo sapiens
ggtactcttgttgag

SEQ ID NO: 299942 - DNA, 15 bp, Homo sapiens
ggtagacttggagct

SEQ ID NO: 299943 - DNA, 17 bp, Homo sapiens
ggtagagatggaggagg

SEQ ID NO: 299944 - DNA, 17 bp, Homo sapiens
ggtagagctgatccaga

SEQ ID NO: 299945 - DNA, 12 bp, Homo sapiens
ggtagagtttat

SEQ ID NO: 299946 - DNA, 19 bp, Homo sapiens
ggtagatcgcttgagccca

SEQ ID NO: 299947 - DNA, 21 bp, Homo sapiens
ggtagatcgcttgagcccagg

SEQ ID NO: 299948 - DNA, 22 bp, Homo sapiens
ggtagatcgcttgagcccagga

SEQ ID NO: 299949 - DNA, 16 bp, Homo sapiens
ggtagcgagctgctct

SEQ ID NO: 299950 - DNA, 20 bp, Homo sapiens
ggtagcgagctgctctgcta

SEQ ID NO: 299951 - DNA, 17 bp, Homo sapiens
ggtagctctgagccctc

SEQ ID NO: 299952 - DNA, 19 bp, Homo sapiens
ggtagcttctgacctcagc

SEQ ID NO: 299953 - DNA, 13 bp, Homo sapiens
ggtaggaaagcac

SEQ ID NO: 299954 - DNA, 23 bp, Homo sapiens
ggtaggcaaggctgccggctgca

SEQ ID NO: 299955 - DNA, 12 bp, Homo sapiens
ggtaggcccttg

SEQ ID NO: 299956 - DNA, 20 bp, Homo sapiens
ggtagggtaagtgagagagg

SEQ ID NO: 299957 - DNA, 13 bp, Homo sapiens
ggtagtactggga

SEQ ID NO: 299958 - DNA, 19 bp, Homo sapiens
ggtagtagaatctcagcac

SEQ ID NO: 299959 - DNA, 18 bp, Homo sapiens
ggtatcaaacagctcagg

SEQ ID NO: 299960 - DNA, 13 bp, Homo sapiens
ggtatcacacact

SEQ ID NO: 299961 - DNA, 21 bp, Homo sapiens
ggtatcacacactttctgact

SEQ ID NO: 299962 - DNA, 15 bp, Homo sapiens
ggtatcccacctcca

SEQ ID NO: 299963 - DNA, 17 bp, Homo sapiens
ggtatcccacctccagc

SEQ ID NO: 299964 - DNA, 21 bp, Homo sapiens
ggtatcctacatacttctttc

SEQ ID NO: 299965 - DNA, 12 bp, Homo sapiens
ggtatcctgccc

SEQ ID NO: 299966 - DNA, 17 bp, Homo sapiens
ggtatctttaattgtat

SEQ ID NO: 299967 - DNA, 19 bp, Homo sapiens
ggtatgaacttgaggacac

SEQ ID NO: 299968 - DNA, 22 bp, Homo sapiens
ggtatgaacttgaggacacatg

SEQ ID NO: 299969 - DNA, 23 bp, Homo sapiens
ggtatgaacttgaggacacatgt

SEQ ID NO: 299970 - DNA, 18 bp, Homo sapiens
ggtatggtggggatattt

SEQ ID NO: 299971 - DNA, 12 bp, Homo sapiens
ggtatgtgcctg

SEQ ID NO: 299972 - DNA, 17 bp, Homo sapiens
ggtatgtgttgccaaag

SEQ ID NO: 299973 - DNA, 15 bp, Homo sapiens
ggtattagcacctct

SEQ ID NO: 299974 - DNA, 18 bp, Homo sapiens
ggtattttcgtgcatttg

SEQ ID NO: 299975 - DNA, 13 bp, Homo sapiens
ggtcaacccgctg

SEQ ID NO: 299976 - DNA, 14 bp, Homo sapiens
ggtcaacccgctgc

SEQ ID NO: 299977 - DNA, 14 bp, Homo sapiens
ggtcaactccaagg

SEQ ID NO: 299978 - DNA, 13 bp, Homo sapiens
ggtcaagcccagg

SEQ ID NO: 299979 - DNA, 15 bp, Homo sapiens
ggtcaagcccaggag

SEQ ID NO: 299980 - DNA, 17 bp, Homo sapiens
ggtcaagcccaggagga

SEQ ID NO: 299981 - DNA, 20 bp, Homo sapiens
ggtcaagtaagaagacatga

SEQ ID NO: 299982 - DNA, 18 bp, Homo sapiens
ggtcaataattgtggaga

SEQ ID NO: 299983 - DNA, 22 bp, Homo sapiens
ggtcaataattgtggagaggag

SEQ ID NO: 299984 - DNA, 23 bp, Homo sapiens
ggtcaccttcctgggcagcccag

SEQ ID NO: 299985 - DNA, 17 bp, Homo sapiens
ggtcactaaccaacaag

SEQ ID NO: 299986 - DNA, 20 bp, Homo sapiens
ggtcagagggactgtcagct

SEQ ID NO: 299987 - DNA, 19 bp, Homo sapiens
ggtcagagtaagctgcttt

SEQ ID NO: 299988 - DNA, 22 bp, Homo sapiens
ggtcagcagaaacccccaggag

SEQ ID NO: 299989 - DNA, 13 bp, Homo sapiens
ggtcagctctggc

SEQ ID NO: 299990 - DNA, 15 bp, Homo sapiens
ggtcagctctggcca

SEQ ID NO: 299991 - DNA, 16 bp, Homo sapiens
ggtcagctctggccac

SEQ ID NO: 299992 - DNA, 18 bp, Homo sapiens
ggtcagctgttactttct

SEQ ID NO: 299993 - DNA, 15 bp, Homo sapiens
ggtcaggaggcaggg

SEQ ID NO: 299994 - DNA, 16 bp, Homo sapiens
ggtcaggccctggaac

SEQ ID NO: 299995 - DNA, 14 bp, Homo sapiens
ggtcagggctatgg

SEQ ID NO: 299996 - DNA, 20 bp, Homo sapiens
ggtcagtacccacctgagct

SEQ ID NO: 299997 - DNA, 19 bp, Homo sapiens
ggtcagtgaggcccaggga

SEQ ID NO: 299998 - DNA, 14 bp, Homo sapiens
ggtcagtgtgcaaa

SEQ ID NO: 299999 - DNA, 15 bp, Homo sapiens
ggtcagtgtgccacc

SEQ ID NO: 300000 - DNA, 14 bp, Homo sapiens
ggtcagtgtggaga

SEQ ID NO: 300001 - DNA, 22 bp, Homo sapiens
ggtcatactatctactctcctc

SEQ ID NO: 300002 - DNA, 15 bp, Homo sapiens
ggtcatccaacctct

SEQ ID NO: 300003 - DNA, 16 bp, Homo sapiens
ggtcatcccggggcca

SEQ ID NO: 300004 - DNA, 17 bp, Homo sapiens
ggtcatttggtggctct

SEQ ID NO: 300005 - DNA, 14 bp, Homo sapiens
ggtcattttccttt

SEQ ID NO: 300006 - DNA, 13 bp, Homo sapiens
ggtccaacagttt

SEQ ID NO: 300007 - DNA, 14 bp, Homo sapiens
ggtccaagggccat

SEQ ID NO: 300008 - DNA, 19 bp, Homo sapiens
ggtccacacaccacagaag

SEQ ID NO: 300009 - DNA, 17 bp, Homo sapiens
ggtccacattctgctgc

SEQ ID NO: 300010 - DNA, 14 bp, Homo sapiens
ggtccaccccgtcc

SEQ ID NO: 300011 - DNA, 23 bp, Homo sapiens
ggtccaccccgtcccggccccgc

SEQ ID NO: 300012 - DNA, 18 bp, Homo sapiens
ggtccagagaccacacca

SEQ ID NO: 300013 - DNA, 15 bp, Homo sapiens
ggtccaggaaggcag

SEQ ID NO: 300014 - DNA, 18 bp, Homo sapiens
ggtccaggaaggcagctg

SEQ ID NO: 300015 - DNA, 19 bp, Homo sapiens
ggtccaggaaggcagctgc

SEQ ID NO: 300016 - DNA, 21 bp, Homo sapiens
ggtccaggaaggcagctgctc

SEQ ID NO: 300017 - DNA, 13 bp, Homo sapiens
ggtccaggccagg

SEQ ID NO: 300018 - DNA, 15 bp, Homo sapiens
ggtccaggccaggcc

SEQ ID NO: 300019 - DNA, 11 bp, Homo sapiens
ggtccagggaa

SEQ ID NO: 300020 - DNA, 21 bp, Homo sapiens
ggtccagggaagctggccgag

SEQ ID NO: 300021 - DNA, 16 bp, Homo sapiens
ggtccatttcatgtga

SEQ ID NO: 300022 - DNA, 20 bp, Homo sapiens
ggtcccaaacagctgcctct

SEQ ID NO: 300023 - DNA, 23 bp, Homo sapiens
ggtcccaaggcaaggggtgcctg

SEQ ID NO: 300024 - DNA, 20 bp, Homo sapiens
ggtcccaggaagcagggaga

SEQ ID NO: 300025 - DNA, 17 bp, Homo sapiens
ggtcccaggatcccctg

SEQ ID NO: 300026 - DNA, 18 bp, Homo sapiens
ggtcccaggatcccctgc

SEQ ID NO: 300027 - DNA, 19 bp, Homo sapiens
ggtcccaggatcccctgct

SEQ ID NO: 300028 - DNA, 14 bp, Homo sapiens
ggtcccaggccgca

SEQ ID NO: 300029 - DNA, 16 bp, Homo sapiens
ggtcccaggccgcatg

SEQ ID NO: 300030 - DNA, 17 bp, Homo sapiens
ggtcccatttctcactg

SEQ ID NO: 300031 - DNA, 13 bp, Homo sapiens
ggtccccactccc

SEQ ID NO: 300032 - DNA, 23 bp, Homo sapiens
ggtccccatccccaccagctcgt

SEQ ID NO: 300033 - DNA, 13 bp, Homo sapiens
ggtcccccctgag

SEQ ID NO: 300034 - DNA, 14 bp, Homo sapiens
ggtcccccctgagt

SEQ ID NO: 300035 - DNA, 12 bp, Homo sapiens
ggtcccctgagg

SEQ ID NO: 300036 - DNA, 23 bp, Homo sapiens
ggtcccggctgacacctcccttc

SEQ ID NO: 300037 - DNA, 24 bp, Homo sapiens
ggtccctaattctcttcgctgtga

SEQ ID NO: 300038 - DNA, 22 bp, Homo sapiens
ggtccctcgtccacaggggcag

SEQ ID NO: 300039 - DNA, 17 bp, Homo sapiens
ggtccctggaccagcct

SEQ ID NO: 300040 - DNA, 19 bp, Homo sapiens
ggtccctggtccctcgtcc

SEQ ID NO: 300041 - DNA, 21 bp, Homo sapiens
ggtcccttcttactcacacac

SEQ ID NO: 300042 - DNA, 23 bp, Homo sapiens
ggtcccttgcagctagttttcta

SEQ ID NO: 300043 - DNA, 16 bp, Homo sapiens
ggtccgagctctgtcc

SEQ ID NO: 300044 - DNA, 19 bp, Homo sapiens
ggtccgcaccagctgctct

SEQ ID NO: 300045 - DNA, 20 bp, Homo sapiens
ggtccgcaccagctgctctg

SEQ ID NO: 300046 - DNA, 19 bp, Homo sapiens
ggtcctaagtccctgcccc

SEQ ID NO: 300047 - DNA, 19 bp, Homo sapiens
ggtcctagtgtctattccc

SEQ ID NO: 300048 - DNA, 12 bp, Homo sapiens
ggtcctctcagt

SEQ ID NO: 300049 - DNA, 21 bp, Homo sapiens
ggtcctctcagttctctccct

SEQ ID NO: 300050 - DNA, 17 bp, Homo sapiens
ggtcctcttaggtcccg

SEQ ID NO: 300051 - DNA, 14 bp, Homo sapiens
ggtcctgaggctgg

SEQ ID NO: 300052 - DNA, 18 bp, Homo sapiens
ggtcctgaggctggggct

SEQ ID NO: 300053 - DNA, 17 bp, Homo sapiens
ggtcctgattctccctg

SEQ ID NO: 300054 - DNA, 18 bp, Homo sapiens
ggtcctgcaatctccagg

SEQ ID NO: 300055 - DNA, 13 bp, Homo sapiens
ggtcctgctgctc

SEQ ID NO: 300056 - DNA, 20 bp, Homo sapiens
ggtcctgctgctcgggaagg

SEQ ID NO: 300057 - DNA, 12 bp, Homo sapiens
ggtcctggctcc

SEQ ID NO: 300058 - DNA, 15 bp, Homo sapiens
ggtcctggggaggct

SEQ ID NO: 300059 - DNA, 13 bp, Homo sapiens
ggtcctgtctccc

SEQ ID NO: 300060 - DNA, 21 bp, Homo sapiens
ggtcctgtctcccctctgctg

SEQ ID NO: 300061 - DNA, 14 bp, Homo sapiens
ggttgcaaccactg

SEQ ID NO: 300062 - DNA, 14 bp, Homo sapiens
ggttgcagctgctc

SEQ ID NO: 300063 - DNA, 19 bp, Homo sapiens
ggttgcttaaaagggacag

SEQ ID NO: 300064 - DNA, 11 bp, Homo sapiens
ggttgcttctg

SEQ ID NO: 300065 - DNA, 18 bp, Homo sapiens
ggttggaactgctgccat

SEQ ID NO: 300066 - DNA, 22 bp, Homo sapiens
ggttggaactttagggggtggg

SEQ ID NO: 300067 - DNA, 14 bp, Homo sapiens
ggttggaccccaga

SEQ ID NO: 300068 - DNA, 14 bp, Homo sapiens
ggttggaggcctgg

SEQ ID NO: 300069 - DNA, 14 bp, Homo sapiens
ggttggccggctgg

SEQ ID NO: 300070 - DNA, 17 bp, Homo sapiens
ggttgggacaatggcaa

SEQ ID NO: 300071 - DNA, 23 bp, Homo sapiens
ggttgggattgggggctggtgcc

SEQ ID NO: 300072 - DNA, 17 bp, Homo sapiens
ggttgggcccagatctg

SEQ ID NO: 300073 - DNA, 16 bp, Homo sapiens
ggttgtatttctatat

SEQ ID NO: 300074 - DNA, 10 bp, Homo sapiens
ggttgtcaat

SEQ ID NO: 300075 - DNA, 15 bp, Homo sapiens
ggttgtcactcaaca

SEQ ID NO: 300076 - DNA, 12 bp, Homo sapiens
ggttgtgatatt

SEQ ID NO: 300077 - DNA, 22 bp, Homo sapiens
ggttgttgccaggttgcagctg

SEQ ID NO: 300078 - DNA, 23 bp, Homo sapiens
ggttgttgccaggttgcagctgc

SEQ ID NO: 300079 - DNA, 14 bp, Homo sapiens
ggtttaactcagat

SEQ ID NO: 300080 - DNA, 12 bp, Homo sapiens
ggtttactctgt

SEQ ID NO: 300081 - DNA, 18 bp, Homo sapiens
ggtttactgctgtcattg

SEQ ID NO: 300082 - DNA, 17 bp, Homo sapiens
ggtttcactattcctat

SEQ ID NO: 300083 - DNA, 12 bp, Homo sapiens
ggtttcagaagc

SEQ ID NO: 300084 - DNA, 20 bp, Homo sapiens
ggtttccacacaggcccatg

SEQ ID NO: 300085 - DNA, 22 bp, Homo sapiens
ggtttctagggtgggccccagc

SEQ ID NO: 300086 - DNA, 21 bp, Homo sapiens
ggtttctctgtgctctgaatg

SEQ ID NO: 300087 - DNA, 14 bp, Homo sapiens
ggtttctgattctt

SEQ ID NO: 300088 - DNA, 14 bp, Homo sapiens
ggtttctgccctgc

SEQ ID NO: 300089 - DNA, 14 bp, Homo sapiens
ggtttgcttgctct

SEQ ID NO: 300090 - DNA, 15 bp, Homo sapiens
ggtttgggagagacc

SEQ ID NO: 300091 - DNA, 20 bp, Homo sapiens
ggtttgggcagtggagaggg

SEQ ID NO: 300092 - DNA, 19 bp, Homo sapiens
ggtttggggagcagagaca

SEQ ID NO: 300093 - DNA, 15 bp, Homo sapiens
ggtttggtctgggac

SEQ ID NO: 300094 - DNA, 19 bp, Homo sapiens
ggtttgtgagccttgctgc

SEQ ID NO: 300095 - DNA, 19 bp, Homo sapiens
ggtttgttatcagtacaat

SEQ ID NO: 300096 - DNA, 14 bp, Homo sapiens
ggtttgtttgctgc

SEQ ID NO: 300097 - DNA, 13 bp, Homo sapiens
ggttttatcagtg

SEQ ID NO: 300098 - DNA, 15 bp, Homo sapiens
ggttttcaggggctt

SEQ ID NO: 300099 - DNA, 15 bp, Homo sapiens
ggttttctgctctgt

SEQ ID NO: 300100 - DNA, 17 bp, Homo sapiens
ggttttgcatgtctgca

SEQ ID NO: 300101 - DNA, 15 bp, Homo sapiens
ggttttggagtcagt

SEQ ID NO: 300102 - DNA, 14 bp, Homo sapiens
ggttttggcctgcc

SEQ ID NO: 300103 - DNA, 12 bp, Homo sapiens
ggtttttctctt

SEQ ID NO: 300104 - DNA, 12 bp, Homo sapiens
ggtttttgctct

SEQ ID NO: 300105 - DNA, 15 bp, Homo sapiens
ggtttttggctcttt

SEQ ID NO: 300106 - DNA, 11 bp, Homo sapiens
gtaaaaaagaa

SEQ ID NO: 300107 - DNA, 18 bp, Homo sapiens
gtaaaaacacaaatgtgt

SEQ ID NO: 300108 - DNA, 18 bp, Homo sapiens
gtaaaaataaactgttat

SEQ ID NO: 300109 - DNA, 19 bp, Homo sapiens
gtaaaactgtgacattcca

SEQ ID NO: 300110 - DNA, 17 bp, Homo sapiens
gtaaaagcaacatcagc

SEQ ID NO: 300111 - DNA, 12 bp, Homo sapiens
gtaaaagtgaca

SEQ ID NO: 300112 - DNA, 18 bp, Homo sapiens
gtaaaatactattggaca

SEQ ID NO: 300113 - DNA, 18 bp, Homo sapiens
gtaaaatcttgtcatgtg

SEQ ID NO: 300114 - DNA, 16 bp, Homo sapiens
gtaaaattagaaaaaa

SEQ ID NO: 300115 - DNA, 19 bp, Homo sapiens
gtaaaattagaaaaaaaca

SEQ ID NO: 300116 - DNA, 22 bp, Homo sapiens
gtaaaattattccctgaattgt

SEQ ID NO: 300117 - DNA, 14 bp, Homo sapiens
gtaaacatgtgttt

SEQ ID NO: 300118 - DNA, 22 bp, Homo sapiens
gtaaacattcctccagcctccc

SEQ ID NO: 300119 - DNA, 16 bp, Homo sapiens
gtaaacgtttcagtaa

SEQ ID NO: 300120 - DNA, 21 bp, Homo sapiens
gtaaacgtttcagtaataaaa

SEQ ID NO: 300121 - DNA, 23 bp, Homo sapiens
gtaaacgtttcagtaataaaaca

SEQ ID NO: 300122 - DNA, 20 bp, Homo sapiens
gtaaactgtatcaaatctgt

SEQ ID NO: 300123 - DNA, 17 bp, Homo sapiens
gtaaactttttcaatgg

SEQ ID NO: 300124 - DNA, 17 bp, Homo sapiens
gtaaagataaaaggata

SEQ ID NO: 300125 - DNA, 14 bp, Homo sapiens
gtaaagatattatt

SEQ ID NO: 300126 - DNA, 16 bp, Homo sapiens
gtaaagttaattcatt

SEQ ID NO: 300127 - DNA, 15 bp, Homo sapiens
gtaaataaactcttc

SEQ ID NO: 300128 - DNA, 14 bp, Homo sapiens
gtaaataaattgtt

SEQ ID NO: 300129 - DNA, 15 bp, Homo sapiens
gtaaatacaaaataa

SEQ ID NO: 300130 - DNA, 22 bp, Homo sapiens
gtaaatacaaaataaaattatg

SEQ ID NO: 300131 - DNA, 18 bp, Homo sapiens
gtaaatacaagttctatt

SEQ ID NO: 300132 - DNA, 20 bp, Homo sapiens
gtaaatacaagttctattta

SEQ ID NO: 300133 - DNA, 14 bp, Homo sapiens
gtaaatacatgtgt

SEQ ID NO: 300134 - DNA, 22 bp, Homo sapiens
gtaaatacatgtgtggatgtgt

SEQ ID NO: 300135 - DNA, 15 bp, Homo sapiens
gtaaatagtatttga

SEQ ID NO: 300136 - DNA, 16 bp, Homo sapiens
gtaaatagtatttgag

SEQ ID NO: 300137 - DNA, 21 bp, Homo sapiens
gtaaatatatgttttgagaaa

SEQ ID NO: 300138 - DNA, 23 bp, Homo sapiens
gtaaatatatgttttgagaaaaa

SEQ ID NO: 300139 - DNA, 15 bp, Homo sapiens
gtaaatatcccagag

SEQ ID NO: 300140 - DNA, 12 bp, Homo sapiens
gtaaatattaaa

SEQ ID NO: 300141 - DNA, 13 bp, Homo sapiens
gtaaatattatga

SEQ ID NO: 300142 - DNA, 14 bp, Homo sapiens
gtaaatattcttgt

SEQ ID NO: 300143 - DNA, 15 bp, Homo sapiens
gtaaatatttttccc

SEQ ID NO: 300144 - DNA, 17 bp, Homo sapiens
gtaaatatttttccctc

SEQ ID NO: 300145 - DNA, 17 bp, Homo sapiens
gtaaatggagcttgtac

SEQ ID NO: 300146 - DNA, 22 bp, Homo sapiens
gtaaatggagcttgtacatatt

SEQ ID NO: 300147 - DNA, 14 bp, Homo sapiens
gtaaattattgtaa

SEQ ID NO: 300148 - DNA, 15 bp, Homo sapiens
gtaaattattgtaaa

SEQ ID NO: 300149 - DNA, 17 bp, Homo sapiens
gtaaattattttaaatt

SEQ ID NO: 300150 - DNA, 14 bp, Homo sapiens
gtaaatttaactgc

SEQ ID NO: 300151 - DNA, 13 bp, Homo sapiens
gtaaatttgtact

SEQ ID NO: 300152 - DNA, 15 bp, Homo sapiens
gtaaatttgtactat

SEQ ID NO: 300153 - DNA, 20 bp, Homo sapiens
gtaaatttgtactatttaac

SEQ ID NO: 300154 - DNA, 14 bp, Homo sapiens
gtaacaagaaaaca

SEQ ID NO: 300155 - DNA, 19 bp, Homo sapiens
gtaacaatgcatgctttgg

SEQ ID NO: 300156 - DNA, 22 bp, Homo sapiens
gtaacacagctgagagactttt

SEQ ID NO: 300157 - DNA, 22 bp, Homo sapiens
gtaacacataaagtaaatgcta

SEQ ID NO: 300158 - DNA, 16 bp, Homo sapiens
gtaacagctgaggtct

SEQ ID NO: 300159 - DNA, 21 bp, Homo sapiens
gtaacatataaattaatacat

SEQ ID NO: 300160 - DNA, 12 bp, Homo sapiens
gtaacctcagct

SEQ ID NO: 300161 - DNA, 15 bp, Homo sapiens
gtaacctcagctctg

SEQ ID NO: 300162 - DNA, 17 bp, Homo sapiens
gtaacgcgtcttcctga

SEQ ID NO: 300163 - DNA, 23 bp, Homo sapiens
gtaactctaattcccattttgca

SEQ ID NO: 300164 - DNA, 16 bp, Homo sapiens
gtaactgcctaccagt

SEQ ID NO: 300165 - DNA, 18 bp, Homo sapiens
gtaactgctgagccactc

SEQ ID NO: 300166 - DNA, 21 bp, Homo sapiens
gtaacttgctgtgaaatgact

SEQ ID NO: 300167 - DNA, 14 bp, Homo sapiens
gtaactttgcatgt

SEQ ID NO: 300168 - DNA, 18 bp, Homo sapiens
gtaagaaaccgaggcgat

SEQ ID NO: 300169 - DNA, 15 bp, Homo sapiens
gtaagaagacatgaa

SEQ ID NO: 300170 - DNA, 16 bp, Homo sapiens
gtaagacacacagcct

SEQ ID NO: 300171 - DNA, 19 bp, Homo sapiens
gtaagaccggaagctcctg

SEQ ID NO: 300172 - DNA, 21 bp, Homo sapiens
gtaagaccggaagctcctggt

SEQ ID NO: 300173 - DNA, 16 bp, Homo sapiens
gtaaggacttgtgcct

SEQ ID NO: 300174 - DNA, 16 bp, Homo sapiens
gtaaggcagctctgtc

SEQ ID NO: 300175 - DNA, 17 bp, Homo sapiens
gtaaggcagctctgtcg

SEQ ID NO: 300176 - DNA, 15 bp, Homo sapiens
gtaagtaaatgtctg

SEQ ID NO: 300177 - DNA, 23 bp, Homo sapiens
gtaagtaattatcgggaacagtg

SEQ ID NO: 300178 - DNA, 13 bp, Homo sapiens
gtaagtggagcat

SEQ ID NO: 300179 - DNA, 21 bp, Homo sapiens
gtaagtggggttgcaaccact

SEQ ID NO: 300180 - DNA, 15 bp, Homo sapiens
gtaatagaaaactga

SEQ ID NO: 300181 - DNA, 12 bp, Homo sapiens
gtaatagctgaa

SEQ ID NO: 300182 - DNA, 13 bp, Homo sapiens
gtaatagctgaac

SEQ ID NO: 300183 - DNA, 16 bp, Homo sapiens
gtaatatcatttcata

SEQ ID NO: 300184 - DNA, 23 bp, Homo sapiens
gtaatattaaattcctcctgtct

SEQ ID NO: 300185 - DNA, 18 bp, Homo sapiens
gtaatcaatgaatattga

SEQ ID NO: 300186 - DNA, 18 bp, Homo sapiens
gtaatcacaactcagcat

SEQ ID NO: 300187 - DNA, 20 bp, Homo sapiens
gtaatcacactctcttctta

SEQ ID NO: 300188 - DNA, 24 bp, Homo sapiens
gtaatcatttatcttatctagcaa

SEQ ID NO: 300189 - DNA, 16 bp, Homo sapiens
gtaatcccagctactt

SEQ ID NO: 300190 - DNA, 20 bp, Homo sapiens
gtaatctcacttaatacaga

SEQ ID NO: 300191 - DNA, 18 bp, Homo sapiens
gtaatctgctttgttaat

SEQ ID NO: 300192 - DNA, 14 bp, Homo sapiens
gtcaagtctctgct

SEQ ID NO: 300193 - DNA, 16 bp, Homo sapiens
gtcaagtgtgcctgct

SEQ ID NO: 300194 - DNA, 17 bp, Homo sapiens
gtcaagtgtgcctgcta

SEQ ID NO: 300195 - DNA, 17 bp, Homo sapiens
gtcaagttaacaaggaa

SEQ ID NO: 300196 - DNA, 11 bp, Homo sapiens
gtcaagttatt

SEQ ID NO: 300197 - DNA, 18 bp, Homo sapiens
gtcaagttattaatttct

SEQ ID NO: 300198 - DNA, 16 bp, Homo sapiens
gtcaagttgtgcttgt

SEQ ID NO: 300199 - DNA, 17 bp, Homo sapiens
gtcaagttgtgcttgtt

SEQ ID NO: 300200 - DNA, 18 bp, Homo sapiens
gtcaataattgtggagag

SEQ ID NO: 300201 - DNA, 20 bp, Homo sapiens
gtcaataattgtggagagga

SEQ ID NO: 300202 - DNA, 23 bp, Homo sapiens
gtcaatattaaatacagacacta

SEQ ID NO: 300203 - DNA, 15 bp, Homo sapiens
gtcaatcatttctca

SEQ ID NO: 300204 - DNA, 16 bp, Homo sapiens
gtcaatcatttctcac

SEQ ID NO: 300205 - DNA, 16 bp, Homo sapiens
gtcaatcctgtgggtg

SEQ ID NO: 300206 - DNA, 18 bp, Homo sapiens
gtcaatgtgcagtgtagc

SEQ ID NO: 300207 - DNA, 16 bp, Homo sapiens
gtcaattacaggaagt

SEQ ID NO: 300208 - DNA, 22 bp, Homo sapiens
gtcaattacaggaagtactgga

SEQ ID NO: 300209 - DNA, 13 bp, Homo sapiens
gtcaattcatcta

SEQ ID NO: 300210 - DNA, 13 bp, Homo sapiens
gtcacactctgtg

SEQ ID NO: 300211 - DNA, 19 bp, Homo sapiens
gtcacagaaatcagaggag

SEQ ID NO: 300212 - DNA, 12 bp, Homo sapiens
gtcacagagaac

SEQ ID NO: 300213 - DNA, 19 bp, Homo sapiens
gtcacagagaactagtggt

SEQ ID NO: 300214 - DNA, 11 bp, Homo sapiens
gtcacagccat

SEQ ID NO: 300215 - DNA, 16 bp, Homo sapiens
gtcacagccatttcaa

SEQ ID NO: 300216 - DNA, 15 bp, Homo sapiens
gtcacagctcttgtt

SEQ ID NO: 300217 - DNA, 16 bp, Homo sapiens
gtcacagctgcagctg

SEQ ID NO: 300218 - DNA, 17 bp, Homo sapiens
gtcacagctttcccagg

SEQ ID NO: 300219 - DNA, 15 bp, Homo sapiens
gtcacaggaaaaagt

SEQ ID NO: 300220 - DNA, 17 bp, Homo sapiens
gtcacaggactctgcct

SEQ ID NO: 300221 - DNA, 18 bp, Homo sapiens
gtcacaggactctgcctc

SEQ ID NO: 300222 - DNA, 19 bp, Homo sapiens
gtcacaggactctgcctcc

SEQ ID NO: 300223 - DNA, 18 bp, Homo sapiens
gtcacagggcctggggag

SEQ ID NO: 300224 - DNA, 16 bp, Homo sapiens
gtcacatcagataaga

SEQ ID NO: 300225 - DNA, 20 bp, Homo sapiens
gtcacatggggcctggccca

SEQ ID NO: 300226 - DNA, 14 bp, Homo sapiens
gtcaccaagaaggg

SEQ ID NO: 300227 - DNA, 14 bp, Homo sapiens
gtcaccagaattag

SEQ ID NO: 300228 - DNA, 15 bp, Homo sapiens
gtcaccagcaacatc

SEQ ID NO: 300229 - DNA, 13 bp, Homo sapiens
gtcaccaggactt

SEQ ID NO: 300230 - DNA, 15 bp, Homo sapiens
gtcaccatctcaggc

SEQ ID NO: 300231 - DNA, 20 bp, Homo sapiens
gtcaccatctcaggccacct

SEQ ID NO: 300232 - DNA, 17 bp, Homo sapiens
gtcacccagcaaggcac

SEQ ID NO: 300233 - DNA, 22 bp, Homo sapiens
gtcacccccacccccgggtgcc

SEQ ID NO: 300234 - DNA, 20 bp, Homo sapiens
gtcaccctgtgaccctctca

SEQ ID NO: 300235 - DNA, 17 bp, Homo sapiens
gtcacccttctgggcaa

SEQ ID NO: 300236 - DNA, 19 bp, Homo sapiens
gtcacccttggtagagttt

SEQ ID NO: 300237 - DNA, 15 bp, Homo sapiens
gtcaccgccatgcaa

SEQ ID NO: 300238 - DNA, 22 bp, Homo sapiens
gtcacctcctccaagaagccct

SEQ ID NO: 300239 - DNA, 15 bp, Homo sapiens
gtcacctcctccact

SEQ ID NO: 300240 - DNA, 16 bp, Homo sapiens
gtcacctcctccactc

SEQ ID NO: 300241 - DNA, 18 bp, Homo sapiens
gtcacctgcaagccccag

SEQ ID NO: 300242 - DNA, 13 bp, Homo sapiens
gtcacctgtgcta

SEQ ID NO: 300243 - DNA, 13 bp, Homo sapiens
gtcaccttcctgg

SEQ ID NO: 300244 - DNA, 15 bp, Homo sapiens
gtcaccttcctgggc

SEQ ID NO: 300245 - DNA, 21 bp, Homo sapiens
gtcaccttcctgggcagccca

SEQ ID NO: 300246 - DNA, 23 bp, Homo sapiens
gtcaccttcctgggcagcccaga

SEQ ID NO: 300247 - DNA, 24 bp, Homo sapiens
gtcaccttcctgggcagcccagag

SEQ ID NO: 300248 - DNA, 14 bp, Homo sapiens
gtcacgtgtaggag

SEQ ID NO: 300249 - DNA, 18 bp, Homo sapiens
gtcactaaatttctcagt

SEQ ID NO: 300250 - DNA, 15 bp, Homo sapiens
gtcactactggtctg

SEQ ID NO: 300251 - DNA, 23 bp, Homo sapiens
gtcactcaacaaaagtgctttgg

SEQ ID NO: 300252 - DNA, 16 bp, Homo sapiens
gtcactcagctgagaa

SEQ ID NO: 300253 - DNA, 21 bp, Homo sapiens
gtcactcctggggcctcttgg

SEQ ID NO: 300254 - DNA, 23 bp, Homo sapiens
gtcactgcacagtgcatctcagc

SEQ ID NO: 300255 - DNA, 18 bp, Homo sapiens
gtcactggaacctccctg

SEQ ID NO: 300256 - DNA, 19 bp, Homo sapiens
gtcactggaacctccctgg

SEQ ID NO: 300257 - DNA, 20 bp, Homo sapiens
gtcactggaacctccctggg

SEQ ID NO: 300258 - DNA, 20 bp, Homo sapiens
gtcacttacctagatttaca

SEQ ID NO: 300259 - DNA, 24 bp, Homo sapiens
gtcacttcgcgtgccctcgctgct

SEQ ID NO: 300260 - DNA, 17 bp, Homo sapiens
gtcacttgactcttgaa

SEQ ID NO: 300261 - DNA, 20 bp, Homo sapiens
gtcacttttttcctgtcaat

SEQ ID NO: 300262 - DNA, 18 bp, Homo sapiens
gtcagacatccatgtttg

SEQ ID NO: 300263 - DNA, 14 bp, Homo sapiens
gtcagagaaaacac

SEQ ID NO: 300264 - DNA, 16 bp, Homo sapiens
gtcagagaaaacactt

SEQ ID NO: 300265 - DNA, 18 bp, Homo sapiens
gtcagagccctggctggg

SEQ ID NO: 300266 - DNA, 22 bp, Homo sapiens
gtcagagccctggctgggttca

SEQ ID NO: 300267 - DNA, 22 bp, Homo sapiens
gtcagagcttgattagaagcca

SEQ ID NO: 300268 - DNA, 19 bp, Homo sapiens
gtcagaggctaagatgaga

SEQ ID NO: 300269 - DNA, 15 bp, Homo sapiens
gtcagagggactgtc

SEQ ID NO: 300270 - DNA, 20 bp, Homo sapiens
gtcagagggactgtcagctg

SEQ ID NO: 300271 - DNA, 19 bp, Homo sapiens
gtcagagtaagctgctttt

SEQ ID NO: 300272 - DNA, 13 bp, Homo sapiens
gtcagagtgttgt

SEQ ID NO: 300273 - DNA, 18 bp, Homo sapiens
gtcagatgagcaaggaca

SEQ ID NO: 300274 - DNA, 16 bp, Homo sapiens
gtcagatggatgtaga

SEQ ID NO: 300275 - DNA, 17 bp, Homo sapiens
gtcagatggatgtagat

SEQ ID NO: 300276 - DNA, 14 bp, Homo sapiens
gtcagatttccagt

SEQ ID NO: 300277 - DNA, 13 bp, Homo sapiens
gtcagcagggggg

SEQ ID NO: 300278 - DNA, 23 bp, Homo sapiens
gtcagccaaatgacttcatttct

SEQ ID NO: 300279 - DNA, 15 bp, Homo sapiens
gtcagccaaatgtaa

SEQ ID NO: 300280 - DNA, 15 bp, Homo sapiens
gtcagccagcttggt

SEQ ID NO: 300281 - DNA, 15 bp, Homo sapiens
gtcagccctgctgtc

SEQ ID NO: 300282 - DNA, 16 bp, Homo sapiens
gtcagccgagccgggc

SEQ ID NO: 300283 - DNA, 22 bp, Homo sapiens
gtcagccttgcatcaagggctt

SEQ ID NO: 300284 - DNA, 20 bp, Homo sapiens
gtcagcgggcgctgctggga

SEQ ID NO: 300285 - DNA, 17 bp, Homo sapiens
gtcagctactaatgatg

SEQ ID NO: 300286 - DNA, 21 bp, Homo sapiens
gtcagctgagcttgagctccc

SEQ ID NO: 300287 - DNA, 18 bp, Homo sapiens
gtcagcttcccaacaata

SEQ ID NO: 300288 - DNA, 14 bp, Homo sapiens
gtcagcttgaatgt

SEQ ID NO: 300289 - DNA, 13 bp, Homo sapiens
gtcagctttcaga

SEQ ID NO: 300290 - DNA, 17 bp, Homo sapiens
gtcagctttcagagcca

SEQ ID NO: 300291 - DNA, 18 bp, Homo sapiens
gtcagctttgccttccac

SEQ ID NO: 300292 - DNA, 23 bp, Homo sapiens
gtcagctttgccttccacgctgt

SEQ ID NO: 300293 - DNA, 15 bp, Homo sapiens
gtcaggagccagcag

SEQ ID NO: 300294 - DNA, 20 bp, Homo sapiens
gtcaggaggtgcctgagagc

SEQ ID NO: 300295 - DNA, 12 bp, Homo sapiens
gtcaggccacgg

SEQ ID NO: 300296 - DNA, 14 bp, Homo sapiens
gtcaggccacggca

SEQ ID NO: 300297 - DNA, 15 bp, Homo sapiens
gtcaggccacggcag

SEQ ID NO: 300298 - DNA, 16 bp, Homo sapiens
gtcaggccacggcagc

SEQ ID NO: 300299 - DNA, 18 bp, Homo sapiens
gtcaggccacggcagcct

SEQ ID NO: 300300 - DNA, 11 bp, Homo sapiens
gtcaggccctg

SEQ ID NO: 300301 - DNA, 15 bp, Homo sapiens
gtcaggccctggaac

SEQ ID NO: 300302 - DNA, 12 bp, Homo sapiens
gtcaggctccat

SEQ ID NO: 300303 - DNA, 12 bp, Homo sapiens
gtcaggcttctc

SEQ ID NO: 300304 - DNA, 13 bp, Homo sapiens
gtcagggacagca

SEQ ID NO: 300305 - DNA, 16 bp, Homo sapiens
gtcagggacagcagcc

SEQ ID NO: 300306 - DNA, 18 bp, Homo sapiens
gtcagggacagcagcctc

SEQ ID NO: 300307 - DNA, 21 bp, Homo sapiens
gtcagggacagcagcctccct

SEQ ID NO: 300308 - DNA, 13 bp, Homo sapiens
gtcagggaccaag

SEQ ID NO: 300309 - DNA, 13 bp, Homo sapiens
gtcagggagccct

SEQ ID NO: 300310 - DNA, 16 bp, Homo sapiens
gtcagggagccctggg

SEQ ID NO: 300311 - DNA, 14 bp, Homo sapiens
gtcagggcagggct

SEQ ID NO: 300312 - DNA, 16 bp, Homo sapiens
gtcagggcccagaggc

SEQ ID NO: 300313 - DNA, 20 bp, Homo sapiens
gtcagggcccagaggctgag

SEQ ID NO: 300314 - DNA, 15 bp, Homo sapiens
gtcaggtgggaaagc

SEQ ID NO: 300315 - DNA, 20 bp, Homo sapiens
gtcagtacccacctgagctt

SEQ ID NO: 300316 - DNA, 17 bp, Homo sapiens
gtcagtaggtccaaggg

SEQ ID NO: 300317 - DNA, 19 bp, Homo sapiens
gtcagtaggtccaagggcc

SEQ ID NO: 300318 - DNA, 23 bp, Homo sapiens
gtcagtatcaggcctgccagacg

SEQ ID NO: 300319 - DNA, 20 bp, Homo sapiens
gtcagtatctgtatctctct

SEQ ID NO: 300320 - DNA, 21 bp, Homo sapiens
gtcagtatctgtatctctctc

SEQ ID NO: 300321 - DNA, 14 bp, Homo sapiens
gtcagtatgacatt

SEQ ID NO: 300322 - DNA, 16 bp, Homo sapiens
gtcagtctacaggcct

SEQ ID NO: 300323 - DNA, 15 bp, Homo sapiens
gtctcatatttttac

SEQ ID NO: 300324 - DNA, 17 bp, Homo sapiens
gtctcatatttttacaa

SEQ ID NO: 300325 - DNA, 14 bp, Homo sapiens
gtctcatccccagg

SEQ ID NO: 300326 - DNA, 16 bp, Homo sapiens
gtctcatccccagggg

SEQ ID NO: 300327 - DNA, 14 bp, Homo sapiens
gtctcatgccagca

SEQ ID NO: 300328 - DNA, 16 bp, Homo sapiens
gtctcatgccagcagc

SEQ ID NO: 300329 - DNA, 15 bp, Homo sapiens
gtctcattgccagtg

SEQ ID NO: 300330 - DNA, 16 bp, Homo sapiens
gtctcattgccagtgg

SEQ ID NO: 300331 - DNA, 17 bp, Homo sapiens
gtctcattgccagtggt

SEQ ID NO: 300332 - DNA, 19 bp, Homo sapiens
gtctcattttgtatgtatg

SEQ ID NO: 300333 - DNA, 20 bp, Homo sapiens
gtctcattttgtatgtatgt

SEQ ID NO: 300334 - DNA, 22 bp, Homo sapiens
gtctcattttgtatgtatgtgt

SEQ ID NO: 300335 - DNA, 16 bp, Homo sapiens
gtctccacccctcaag

SEQ ID NO: 300336 - DNA, 13 bp, Homo sapiens
gtctccagctgat

SEQ ID NO: 300337 - DNA, 17 bp, Homo sapiens
gtctcccaggccccctg

SEQ ID NO: 300338 - DNA, 18 bp, Homo sapiens
gtctccccatgtgcctgc

SEQ ID NO: 300339 - DNA, 18 bp, Homo sapiens
gtctcccctaccaggctg

SEQ ID NO: 300340 - DNA, 16 bp, Homo sapiens
gtctcccctctgctgg

SEQ ID NO: 300341 - DNA, 19 bp, Homo sapiens
gtctcccctctgctggccg

SEQ ID NO: 300342 - DNA, 14 bp, Homo sapiens
gtctccctccgact

SEQ ID NO: 300343 - DNA, 12 bp, Homo sapiens
gtctccctgagc

SEQ ID NO: 300344 - DNA, 14 bp, Homo sapiens
gtctccctgagcct

SEQ ID NO: 300345 - DNA, 21 bp, Homo sapiens
gtctccctggccacccttggc

SEQ ID NO: 300346 - DNA, 23 bp, Homo sapiens
gtctccctggtggggtgtgcatg

SEQ ID NO: 300347 - DNA, 15 bp, Homo sapiens
gtctcctactctgtg

SEQ ID NO: 300348 - DNA, 13 bp, Homo sapiens
gtctcctcagggt

SEQ ID NO: 300349 - DNA, 19 bp, Homo sapiens
gtctcctcagggtgggggg

SEQ ID NO: 300350 - DNA, 19 bp, Homo sapiens
gtctcctccctcagctctc

SEQ ID NO: 300351 - DNA, 14 bp, Homo sapiens
gtctcctgcatgca

SEQ ID NO: 300352 - DNA, 15 bp, Homo sapiens
gtctcctgtatcatt

SEQ ID NO: 300353 - DNA, 13 bp, Homo sapiens
gtctccttcccac

SEQ ID NO: 300354 - DNA, 17 bp, Homo sapiens
gtctccttcccactgtc

SEQ ID NO: 300355 - DNA, 17 bp, Homo sapiens
gtctcgctttgttgccc

SEQ ID NO: 300356 - DNA, 13 bp, Homo sapiens
gtctcgtcaggag

SEQ ID NO: 300357 - DNA, 15 bp, Homo sapiens
gtctcgtcaggaggt

SEQ ID NO: 300358 - DNA, 13 bp, Homo sapiens
gtctctcccaccc

SEQ ID NO: 300359 - DNA, 20 bp, Homo sapiens
gtctctcccaccccggcctc

SEQ ID NO: 300360 - DNA, 22 bp, Homo sapiens
gtctctcccaccccggcctcca

SEQ ID NO: 300361 - DNA, 15 bp, Homo sapiens
gtctctccctggggt

SEQ ID NO: 300362 - DNA, 12 bp, Homo sapiens
gtctctctgtga

SEQ ID NO: 300363 - DNA, 14 bp, Homo sapiens
gtctctctgtgaat

SEQ ID NO: 300364 - DNA, 18 bp, Homo sapiens
gtctctctgtgaatacaa

SEQ ID NO: 300365 - DNA, 20 bp, Homo sapiens
gtctctgagccccctgtgcc

SEQ ID NO: 300366 - DNA, 15 bp, Homo sapiens
gtctctgccatgtgg

SEQ ID NO: 300367 - DNA, 15 bp, Homo sapiens
gtctctgctggccca

SEQ ID NO: 300368 - DNA, 16 bp, Homo sapiens
gtctctgctggcccag

SEQ ID NO: 300369 - DNA, 14 bp, Homo sapiens
gtctctgcttccat

SEQ ID NO: 300370 - DNA, 23 bp, Homo sapiens
gtctctgtcccggttcaccttgc

SEQ ID NO: 300371 - DNA, 17 bp, Homo sapiens
gtctctgtcgtggacac

SEQ ID NO: 300372 - DNA, 21 bp, Homo sapiens
gtctctgttcagatgtgcatt

SEQ ID NO: 300373 - DNA, 16 bp, Homo sapiens
gtctcttcctctgcag

SEQ ID NO: 300374 - DNA, 13 bp, Homo sapiens
gtctctttaagtt

SEQ ID NO: 300375 - DNA, 17 bp, Homo sapiens
gtctctttaatcttcag

SEQ ID NO: 300376 - DNA, 13 bp, Homo sapiens
gtctctttccact

SEQ ID NO: 300377 - DNA, 17 bp, Homo sapiens
gtctctttctttccaaa

SEQ ID NO: 300378 - DNA, 15 bp, Homo sapiens
gtctctttttctcac

SEQ ID NO: 300379 - DNA, 14 bp, Homo sapiens
gtctgaaaatgttg

SEQ ID NO: 300380 - DNA, 15 bp, Homo sapiens
gtctgaaaggaaaag

SEQ ID NO: 300381 - DNA, 11 bp, Homo sapiens
gtctgaaatgg

SEQ ID NO: 300382 - DNA, 13 bp, Homo sapiens
gtctgaacccttg

SEQ ID NO: 300383 - DNA, 18 bp, Homo sapiens
gtctgaacccttgtgctt

SEQ ID NO: 300384 - DNA, 19 bp, Homo sapiens
gtctgaaggaatagccaga

SEQ ID NO: 300385 - DNA, 21 bp, Homo sapiens
gtctgaaggaatagccagaga

SEQ ID NO: 300386 - DNA, 22 bp, Homo sapiens
gtctgaaggagaggagtgcgct

SEQ ID NO: 300387 - DNA, 14 bp, Homo sapiens
gtctgaatgttctg

SEQ ID NO: 300388 - DNA, 17 bp, Homo sapiens
gtctgaatgttctgaca

SEQ ID NO: 300389 - DNA, 14 bp, Homo sapiens
gtctgacacatgct

SEQ ID NO: 300390 - DNA, 13 bp, Homo sapiens
gtctgacaggaag

SEQ ID NO: 300391 - DNA, 23 bp, Homo sapiens
gtctgacaggaagactggagact

SEQ ID NO: 300392 - DNA, 14 bp, Homo sapiens
gtctgactccagag

SEQ ID NO: 300393 - DNA, 22 bp, Homo sapiens
gtctgactccagagtctgagcc

SEQ ID NO: 300394 - DNA, 10 bp, Homo sapiens
gtctgagccc

SEQ ID NO: 300395 - DNA, 16 bp, Homo sapiens
gtctgagcccccggct

SEQ ID NO: 300396 - DNA, 15 bp, Homo sapiens
gtctgagccctgccc

SEQ ID NO: 300397 - DNA, 20 bp, Homo sapiens
gtctgagccctgccctcact

SEQ ID NO: 300398 - DNA, 16 bp, Homo sapiens
gtctgagcggccgcct

SEQ ID NO: 300399 - DNA, 17 bp, Homo sapiens
gtctgagcggccgcctg

SEQ ID NO: 300400 - DNA, 19 bp, Homo sapiens
gtctgagcggccgcctgtc

SEQ ID NO: 300401 - DNA, 19 bp, Homo sapiens
gtctgaggccccaggccct

SEQ ID NO: 300402 - DNA, 14 bp, Homo sapiens
gtctgaggcctcat

SEQ ID NO: 300403 - DNA, 22 bp, Homo sapiens
gtctgaggcctcatccctcgga

SEQ ID NO: 300404 - DNA, 14 bp, Homo sapiens
gtctgatagtcctc

SEQ ID NO: 300405 - DNA, 16 bp, Homo sapiens
gtctgatgtgtgccca

SEQ ID NO: 300406 - DNA, 18 bp, Homo sapiens
gtctgatgtgtgcccaga

SEQ ID NO: 300407 - DNA, 22 bp, Homo sapiens
gtctgattctatgcctgtattt

SEQ ID NO: 300408 - DNA, 20 bp, Homo sapiens
gtctgcaaaggagggcctca

SEQ ID NO: 300409 - DNA, 15 bp, Homo sapiens
gtctgcaagaacctg

SEQ ID NO: 300410 - DNA, 19 bp, Homo sapiens
gtctgcagctattcacaca

SEQ ID NO: 300411 - DNA, 21 bp, Homo sapiens
gtctgcagctattcacacaca

SEQ ID NO: 300412 - DNA, 13 bp, Homo sapiens
gtctgcaggccac

SEQ ID NO: 300413 - DNA, 14 bp, Homo sapiens
gtctgcagtcctgg

SEQ ID NO: 300414 - DNA, 17 bp, Homo sapiens
gtctgcagtcctggtgg

SEQ ID NO: 300415 - DNA, 22 bp, Homo sapiens
gtctgcagtcctggtggggctg

SEQ ID NO: 300416 - DNA, 12 bp, Homo sapiens
gtctgccaggcc

SEQ ID NO: 300417 - DNA, 13 bp, Homo sapiens
gtctgccaggccc

SEQ ID NO: 300418 - DNA, 14 bp, Homo sapiens
gtctgccccaccct

SEQ ID NO: 300419 - DNA, 10 bp, Homo sapiens
gtctgcccct

SEQ ID NO: 300420 - DNA, 17 bp, Homo sapiens
gtctgccccttgacccc

SEQ ID NO: 300421 - DNA, 19 bp, Homo sapiens
gtctgcctaggagctggct

SEQ ID NO: 300422 - DNA, 20 bp, Homo sapiens
gtctgcctgcctcatgctct

SEQ ID NO: 300423 - DNA, 23 bp, Homo sapiens
gtctgcctgcctcatgctctcta

SEQ ID NO: 300424 - DNA, 11 bp, Homo sapiens
gtctgcctgta

SEQ ID NO: 300425 - DNA, 17 bp, Homo sapiens
gtctgcgattttatctg

SEQ ID NO: 300426 - DNA, 14 bp, Homo sapiens
gtctgcgccgctgt

SEQ ID NO: 300427 - DNA, 15 bp, Homo sapiens
gtctgctaggcgctg

SEQ ID NO: 300428 - DNA, 13 bp, Homo sapiens
gtctgctgccctc

SEQ ID NO: 300429 - DNA, 15 bp, Homo sapiens
gtctgctgccctcca

SEQ ID NO: 300430 - DNA, 16 bp, Homo sapiens
gtctgctgccctccat

SEQ ID NO: 300431 - DNA, 18 bp, Homo sapiens
gtctgctgccctccatcc

SEQ ID NO: 300432 - DNA, 10 bp, Homo sapiens
gtctgctgct

SEQ ID NO: 300433 - DNA, 16 bp, Homo sapiens
gtctgctgctcccagc

SEQ ID NO: 300434 - DNA, 17 bp, Homo sapiens
gtctgctgctcccagcc

SEQ ID NO: 300435 - DNA, 18 bp, Homo sapiens
gtctggaatcccagctcc

SEQ ID NO: 300436 - DNA, 19 bp, Homo sapiens
gtctggacattcagaacac

SEQ ID NO: 300437 - DNA, 17 bp, Homo sapiens
gtctggagaccaggact

SEQ ID NO: 300438 - DNA, 19 bp, Homo sapiens
gtctggcaaacatgtgcaa

SEQ ID NO: 300439 - DNA, 14 bp, Homo sapiens
gtctggccaggcac

SEQ ID NO: 300440 - DNA, 23 bp, Homo sapiens
gtctggcccaaaggaagtagcag

SEQ ID NO: 300441 - DNA, 15 bp, Homo sapiens
gtctggcctgccagg

SEQ ID NO: 300442 - DNA, 15 bp, Homo sapiens
gtctggcgagccctt

SEQ ID NO: 300443 - DNA, 17 bp, Homo sapiens
gtctggcgagcccttag

SEQ ID NO: 300444 - DNA, 20 bp, Homo sapiens
gtctggcgagcccttagcct

SEQ ID NO: 300445 - DNA, 14 bp, Homo sapiens
gtctggctaggggc

SEQ ID NO: 300446 - DNA, 21 bp, Homo sapiens
gtctggctcggacccacccca

SEQ ID NO: 300447 - DNA, 14 bp, Homo sapiens
gtctggctgtggcc

SEQ ID NO: 300448 - DNA, 17 bp, Homo sapiens
gtctgggagaggcagag

SEQ ID NO: 300449 - DNA, 17 bp, Homo sapiens
gtctgggagtgttctgt

SEQ ID NO: 300450 - DNA, 11 bp, Homo sapiens
gtctgggcctc

SEQ ID NO: 300451 - DNA, 15 bp, Homo sapiens
gtctgggcctctgac

SEQ ID NO: 300452 - DNA, 14 bp, Homo sapiens
gtctggggccgagg

SEQ ID NO: 300453 - DNA, 15 bp, Homo sapiens
gtctggggtgtgggg

SEQ ID NO: 300454 - DNA, 13 bp, Homo sapiens
gtctggtgccaat

SEQ ID NO: 300455 - DNA, 14 bp, Homo sapiens
gtgatggttcccct

SEQ ID NO: 300456 - DNA, 19 bp, Homo sapiens
gtgatgtcctgtaaacact

SEQ ID NO: 300457 - DNA, 15 bp, Homo sapiens
gtgatgtggtggccg

SEQ ID NO: 300458 - DNA, 18 bp, Homo sapiens
gtgatgttgggaagctat

SEQ ID NO: 300459 - DNA, 15 bp, Homo sapiens
gtgatgtttccagct

SEQ ID NO: 300460 - DNA, 16 bp, Homo sapiens
gtgatgtttccagctg

SEQ ID NO: 300461 - DNA, 14 bp, Homo sapiens
gtgatgtttgtcct

SEQ ID NO: 300462 - DNA, 22 bp, Homo sapiens
gtgattaaagcaagagaattat

SEQ ID NO: 300463 - DNA, 15 bp, Homo sapiens
gtgattaaatattta

SEQ ID NO: 300464 - DNA, 15 bp, Homo sapiens
gtgattaactgtgaa

SEQ ID NO: 300465 - DNA, 17 bp, Homo sapiens
gtgattctctcttctct

SEQ ID NO: 300466 - DNA, 23 bp, Homo sapiens
gtgattgacaactgaagagacac

SEQ ID NO: 300467 - DNA, 13 bp, Homo sapiens
gtgattgaccctt

SEQ ID NO: 300468 - DNA, 15 bp, Homo sapiens
gtgatttatgcattt

SEQ ID NO: 300469 - DNA, 22 bp, Homo sapiens
gtgatttatgcatttatgcatg

SEQ ID NO: 300470 - DNA, 17 bp, Homo sapiens
gtgatttccatttctga

SEQ ID NO: 300471 - DNA, 12 bp, Homo sapiens
gtgatttgctat

SEQ ID NO: 300472 - DNA, 17 bp, Homo sapiens
gtgattttcctgtgtcc

SEQ ID NO: 300473 - DNA, 18 bp, Homo sapiens
gtgcaaagattgcctctt

SEQ ID NO: 300474 - DNA, 17 bp, Homo sapiens
gtgcaaatggaagacaa

SEQ ID NO: 300475 - DNA, 18 bp, Homo sapiens
gtgcaacggcatgatttt

SEQ ID NO: 300476 - DNA, 15 bp, Homo sapiens
gtgcaagcaaagaac

SEQ ID NO: 300477 - DNA, 20 bp, Homo sapiens
gtgcaaggtgataggaaaac

SEQ ID NO: 300478 - DNA, 22 bp, Homo sapiens
gtgcaagtgtatgcacgtgtgc

SEQ ID NO: 300479 - DNA, 16 bp, Homo sapiens
gtgcaatatgagggga

SEQ ID NO: 300480 - DNA, 24 bp, Homo sapiens
gtgcaatatgaggggactgcatgc

SEQ ID NO: 300481 - DNA, 17 bp, Homo sapiens
gtgcaattaactctgga

SEQ ID NO: 300482 - DNA, 15 bp, Homo sapiens
gtgcaatttcttctg

SEQ ID NO: 300483 - DNA, 23 bp, Homo sapiens
gtgcaatttcttctgtagctatt

SEQ ID NO: 300484 - DNA, 17 bp, Homo sapiens
gtgcacccactcaccag

SEQ ID NO: 300485 - DNA, 19 bp, Homo sapiens
gtgcacccactcaccaggg

SEQ ID NO: 300486 - DNA, 21 bp, Homo sapiens
gtgcacccactcaccagggtc

SEQ ID NO: 300487 - DNA, 22 bp, Homo sapiens
gtgcacccactcaccagggtcc

SEQ ID NO: 300488 - DNA, 21 bp, Homo sapiens
gtgcaccttaccaactttctg

SEQ ID NO: 300489 - DNA, 18 bp, Homo sapiens
gtgcacgtggagagctgg

SEQ ID NO: 300490 - DNA, 13 bp, Homo sapiens
gtgcactctgcta

SEQ ID NO: 300491 - DNA, 22 bp, Homo sapiens
gtgcactgaatcgtttcatgta

SEQ ID NO: 300492 - DNA, 16 bp, Homo sapiens
gtgcactggccccacc

SEQ ID NO: 300493 - DNA, 18 bp, Homo sapiens
gtgcactggccccaccct

SEQ ID NO: 300494 - DNA, 23 bp, Homo sapiens
gtgcactgtcactttgctctggg

SEQ ID NO: 300495 - DNA, 14 bp, Homo sapiens
gtgcagaacacctg

SEQ ID NO: 300496 - DNA, 16 bp, Homo sapiens
gtgcagaacacctggc

SEQ ID NO: 300497 - DNA, 17 bp, Homo sapiens
gtgcagaacacctggcc

SEQ ID NO: 300498 - DNA, 22 bp, Homo sapiens
gtgcagacaggccatgtgagcc

SEQ ID NO: 300499 - DNA, 14 bp, Homo sapiens
gtgcagactggagg

SEQ ID NO: 300500 - DNA, 23 bp, Homo sapiens
gtgcagactggaggggacgctgg

SEQ ID NO: 300501 - DNA, 18 bp, Homo sapiens
gtgcagaggctgagcagg

SEQ ID NO: 300502 - DNA, 15 bp, Homo sapiens
gtgcagatctgtgct

SEQ ID NO: 300503 - DNA, 21 bp, Homo sapiens
gtgcagcccgtgtggcccctt

SEQ ID NO: 300504 - DNA, 14 bp, Homo sapiens
gtgcagcccttcct

SEQ ID NO: 300505 - DNA, 18 bp, Homo sapiens
gtgcagcccttcctcctg

SEQ ID NO: 300506 - DNA, 13 bp, Homo sapiens
gtgcagccttccc

SEQ ID NO: 300507 - DNA, 15 bp, Homo sapiens
gtgcagcggtggaag

SEQ ID NO: 300508 - DNA, 20 bp, Homo sapiens
gtgcagcggtggaaggagcc

SEQ ID NO: 300509 - DNA, 14 bp, Homo sapiens
gtgcagctgatttt

SEQ ID NO: 300510 - DNA, 16 bp, Homo sapiens
gtgcagctgattttaa

SEQ ID NO: 300511 - DNA, 18 bp, Homo sapiens
gtgcagctgattttaaca

SEQ ID NO: 300512 - DNA, 19 bp, Homo sapiens
gtgcaggcgcgcaccgccc

SEQ ID NO: 300513 - DNA, 20 bp, Homo sapiens
gtgcaggcgcgcaccgccca

SEQ ID NO: 300514 - DNA, 15 bp, Homo sapiens
gtgcaggctggcacc

SEQ ID NO: 300515 - DNA, 14 bp, Homo sapiens
gtgcaggttatgca

SEQ ID NO: 300516 - DNA, 15 bp, Homo sapiens
gtgcagtaaccattt

SEQ ID NO: 300517 - DNA, 15 bp, Homo sapiens
gtgcagtagtgtcac

SEQ ID NO: 300518 - DNA, 23 bp, Homo sapiens
gtgcagtggccccatccagcatg

SEQ ID NO: 300519 - DNA, 15 bp, Homo sapiens
gtgcagttttccagg

SEQ ID NO: 300520 - DNA, 20 bp, Homo sapiens
gtgcatgacgtttaaggcca

SEQ ID NO: 300521 - DNA, 18 bp, Homo sapiens
gtgcatgagaatgtcatt

SEQ ID NO: 300522 - DNA, 20 bp, Homo sapiens
gtgcatggccacagccacct

SEQ ID NO: 300523 - DNA, 16 bp, Homo sapiens
gtgcatggctcctgtc

SEQ ID NO: 300524 - DNA, 13 bp, Homo sapiens
gtgcatgggtgaa

SEQ ID NO: 300525 - DNA, 13 bp, Homo sapiens
gtgcatgtgtgtg

SEQ ID NO: 300526 - DNA, 12 bp, Homo sapiens
gtgcatttaaaa

SEQ ID NO: 300527 - DNA, 14 bp, Homo sapiens
gtgcatttctgaat

SEQ ID NO: 300528 - DNA, 23 bp, Homo sapiens
gtgcatttgtgtctgcctgcctc

SEQ ID NO: 300529 - DNA, 21 bp, Homo sapiens
gtgcatttttatctgtgagtt

SEQ ID NO: 300530 - DNA, 11 bp, Homo sapiens
gtgccaaactt

SEQ ID NO: 300531 - DNA, 16 bp, Homo sapiens
gtgccaaagcaggtca

SEQ ID NO: 300532 - DNA, 23 bp, Homo sapiens
gtgccaaccacctctggccctgt

SEQ ID NO: 300533 - DNA, 20 bp, Homo sapiens
gtgccaatatgtattgtaaa

SEQ ID NO: 300534 - DNA, 14 bp, Homo sapiens
gtgccaccaataaa

SEQ ID NO: 300535 - DNA, 15 bp, Homo sapiens
gtgccaccaataaaa

SEQ ID NO: 300536 - DNA, 17 bp, Homo sapiens
gtgccaccaataaaaat

SEQ ID NO: 300537 - DNA, 21 bp, Homo sapiens
gtgccaccaataaaaatccta

SEQ ID NO: 300538 - DNA, 18 bp, Homo sapiens
gtgccaccacccctccct

SEQ ID NO: 300539 - DNA, 23 bp, Homo sapiens
gtgccaccacccctccctctgct

SEQ ID NO: 300540 - DNA, 15 bp, Homo sapiens
gtgccaccctctgca

SEQ ID NO: 300541 - DNA, 21 bp, Homo sapiens
gtgccacttcttaaaggcctg

SEQ ID NO: 300542 - DNA, 18 bp, Homo sapiens
gtgccacttgacattcct

SEQ ID NO: 300543 - DNA, 13 bp, Homo sapiens
gtgccaggactct

SEQ ID NO: 300544 - DNA, 17 bp, Homo sapiens
gtgccaggactctcttt

SEQ ID NO: 300545 - DNA, 17 bp, Homo sapiens
gtgccaggactgtgact

SEQ ID NO: 300546 - DNA, 12 bp, Homo sapiens
gtgccaggagca

SEQ ID NO: 300547 - DNA, 19 bp, Homo sapiens
gtgccaggagcaatgggac

SEQ ID NO: 300548 - DNA, 22 bp, Homo sapiens
gtgccaggagtgggtgggacac

SEQ ID NO: 300549 - DNA, 17 bp, Homo sapiens
gtgccaggctgtaagca

SEQ ID NO: 300550 - DNA, 22 bp, Homo sapiens
gtgccaggtggctcagtgccac

SEQ ID NO: 300551 - DNA, 20 bp, Homo sapiens
gtgccattgtactccagcct

SEQ ID NO: 300552 - DNA, 21 bp, Homo sapiens
gtgccattgtactccagcctg

SEQ ID NO: 300553 - DNA, 23 bp, Homo sapiens
gtgccattgtactccagcctggg

SEQ ID NO: 300554 - DNA, 15 bp, Homo sapiens
gtgcccaccatgcac

SEQ ID NO: 300555 - DNA, 22 bp, Homo sapiens
gtgcccacccgtgttctcctcc

SEQ ID NO: 300556 - DNA, 15 bp, Homo sapiens
gtgcccagagtagcc

SEQ ID NO: 300557 - DNA, 18 bp, Homo sapiens
gtgcccagtgatggcatt

SEQ ID NO: 300558 - DNA, 20 bp, Homo sapiens
gtgcccatcatctctgcctt

SEQ ID NO: 300559 - DNA, 12 bp, Homo sapiens
gtgccccacagc

SEQ ID NO: 300560 - DNA, 22 bp, Homo sapiens
gtgccccacagctacctgagac

SEQ ID NO: 300561 - DNA, 16 bp, Homo sapiens
gtgccccatgcctgtc

SEQ ID NO: 300562 - DNA, 18 bp, Homo sapiens
gtgccccatgcctgtcca

SEQ ID NO: 300563 - DNA, 12 bp, Homo sapiens
gtgcccccagac

SEQ ID NO: 300564 - DNA, 12 bp, Homo sapiens
gtgcccccagcg

SEQ ID NO: 300565 - DNA, 18 bp, Homo sapiens
gtgcccccagcgtggggc

SEQ ID NO: 300566 - DNA, 14 bp, Homo sapiens
gtgcccccatcttt

SEQ ID NO: 300567 - DNA, 18 bp, Homo sapiens
gtgcccccctcctccagt

SEQ ID NO: 300568 - DNA, 22 bp, Homo sapiens
gtgccccgtggtacattcacag

SEQ ID NO: 300569 - DNA, 16 bp, Homo sapiens
gtgcccctcccatggc

SEQ ID NO: 300570 - DNA, 21 bp, Homo sapiens
gtgcccctcccatggcccagc

SEQ ID NO: 300571 - DNA, 16 bp, Homo sapiens
gtgcccctgcagggga

SEQ ID NO: 300572 - DNA, 17 bp, Homo sapiens
gtgccccttaagggttg

SEQ ID NO: 300573 - DNA, 23 bp, Homo sapiens
gtgccccttaagggttgaaggca

SEQ ID NO: 300574 - DNA, 14 bp, Homo sapiens
gtgcccgcccacct

SEQ ID NO: 300575 - DNA, 19 bp, Homo sapiens
gtgcccgcccacctctgct

SEQ ID NO: 300576 - DNA, 21 bp, Homo sapiens
gtgcccgcccacctctgctgc

SEQ ID NO: 300577 - DNA, 20 bp, Homo sapiens
gtgcccgcctaggagttgag

SEQ ID NO: 300578 - DNA, 17 bp, Homo sapiens
gtgccctcaccacccac

SEQ ID NO: 300579 - DNA, 14 bp, Homo sapiens
gtgccctgccccca

SEQ ID NO: 300580 - DNA, 18 bp, Homo sapiens
gtgccctgcccccatctc

SEQ ID NO: 300581 - DNA, 19 bp, Homo sapiens
gtgccctgcccccatctcc

SEQ ID NO: 300582 - DNA, 13 bp, Homo sapiens
gtgccctggctcc

SEQ ID NO: 300583 - DNA, 15 bp, Homo sapiens
gtgccctgtgggaga

SEQ ID NO: 300584 - DNA, 19 bp, Homo sapiens
gtgccctgtgggagagcaa

SEQ ID NO: 300585 - DNA, 20 bp, Homo sapiens
gtgtattctgtggattctat

SEQ ID NO: 300586 - DNA, 19 bp, Homo sapiens
gtgtatttattttcctccc

SEQ ID NO: 300587 - DNA, 22 bp, Homo sapiens
gtgtatttattttcctccccag

SEQ ID NO: 300588 - DNA, 19 bp, Homo sapiens
gtgtatttccagtgcaatt

SEQ ID NO: 300589 - DNA, 23 bp, Homo sapiens
gtgtatttctattttgcagcagt

SEQ ID NO: 300590 - DNA, 13 bp, Homo sapiens
gtgtatttctgta

SEQ ID NO: 300591 - DNA, 18 bp, Homo sapiens
gtgtcaactttcatttga

SEQ ID NO: 300592 - DNA, 14 bp, Homo sapiens
gtgtcacactctgt

SEQ ID NO: 300593 - DNA, 14 bp, Homo sapiens
gtgtcacagaggca

SEQ ID NO: 300594 - DNA, 16 bp, Homo sapiens
gtgtcacagaggcagt

SEQ ID NO: 300595 - DNA, 18 bp, Homo sapiens
gtgtcaccctgcagagct

SEQ ID NO: 300596 - DNA, 15 bp, Homo sapiens
gtgtcacctttcttc

SEQ ID NO: 300597 - DNA, 14 bp, Homo sapiens
gtgtcactctgcct

SEQ ID NO: 300598 - DNA, 15 bp, Homo sapiens
gtgtcactctgcctc

SEQ ID NO: 300599 - DNA, 14 bp, Homo sapiens
gtgtcactgagctg

SEQ ID NO: 300600 - DNA, 16 bp, Homo sapiens
gtgtcacttttttcct

SEQ ID NO: 300601 - DNA, 19 bp, Homo sapiens
gtgtcaggattgaggatga

SEQ ID NO: 300602 - DNA, 13 bp, Homo sapiens
gtgtcatctgtca

SEQ ID NO: 300603 - DNA, 21 bp, Homo sapiens
gtgtcattttattttttccct

SEQ ID NO: 300604 - DNA, 23 bp, Homo sapiens
gtgtccacagagtttgtagtaaa

SEQ ID NO: 300605 - DNA, 13 bp, Homo sapiens
gtgtccagcagct

SEQ ID NO: 300606 - DNA, 14 bp, Homo sapiens
gtgtccagcagctg

SEQ ID NO: 300607 - DNA, 14 bp, Homo sapiens
gtgtccatgtgtgt

SEQ ID NO: 300608 - DNA, 15 bp, Homo sapiens
gtgtccatgtgtgtg

SEQ ID NO: 300609 - DNA, 18 bp, Homo sapiens
gtgtcccaaggagctgat

SEQ ID NO: 300610 - DNA, 19 bp, Homo sapiens
gtgtcccagcacctggcac

SEQ ID NO: 300611 - DNA, 13 bp, Homo sapiens
gtgtcccagtgaa

SEQ ID NO: 300612 - DNA, 22 bp, Homo sapiens
gtgtccccaacgtcccctccgc

SEQ ID NO: 300613 - DNA, 20 bp, Homo sapiens
gtgtcccctgacctgtccag

SEQ ID NO: 300614 - DNA, 17 bp, Homo sapiens
gtgtccccttcccctgc

SEQ ID NO: 300615 - DNA, 21 bp, Homo sapiens
gtgtccctcctcttcctgtag

SEQ ID NO: 300616 - DNA, 14 bp, Homo sapiens
gtgtccgctctctc

SEQ ID NO: 300617 - DNA, 17 bp, Homo sapiens
gtgtccgctctctcatg

SEQ ID NO: 300618 - DNA, 16 bp, Homo sapiens
gtgtcctgtgctttct

SEQ ID NO: 300619 - DNA, 15 bp, Homo sapiens
gtgtccttcttcctc

SEQ ID NO: 300620 - DNA, 20 bp, Homo sapiens
gtgtcggggggcgagggagg

SEQ ID NO: 300621 - DNA, 15 bp, Homo sapiens
gtgtctaatgcatta

SEQ ID NO: 300622 - DNA, 16 bp, Homo sapiens
gtgtctaatgcattaa

SEQ ID NO: 300623 - DNA, 17 bp, Homo sapiens
gtgtctcatgccagcag

SEQ ID NO: 300624 - DNA, 15 bp, Homo sapiens
gtgtctcctgcatgc

SEQ ID NO: 300625 - DNA, 15 bp, Homo sapiens
gtgtctcgtggcccc

SEQ ID NO: 300626 - DNA, 12 bp, Homo sapiens
gtgtctctccca

SEQ ID NO: 300627 - DNA, 14 bp, Homo sapiens
gtgtctctcccacc

SEQ ID NO: 300628 - DNA, 19 bp, Homo sapiens
gtgtctgaaccaccctgga

SEQ ID NO: 300629 - DNA, 14 bp, Homo sapiens
gtgtctgcaacatg

SEQ ID NO: 300630 - DNA, 15 bp, Homo sapiens
gtgtctgcagtcctg

SEQ ID NO: 300631 - DNA, 14 bp, Homo sapiens
gtgtctgccccctc

SEQ ID NO: 300632 - DNA, 16 bp, Homo sapiens
gtgtctggtccacaca

SEQ ID NO: 300633 - DNA, 12 bp, Homo sapiens
gtgtctggtggg

SEQ ID NO: 300634 - DNA, 12 bp, Homo sapiens
gtgtctgtattc

SEQ ID NO: 300635 - DNA, 23 bp, Homo sapiens
gtgtctgtccatctgtctgtcct

SEQ ID NO: 300636 - DNA, 14 bp, Homo sapiens
gtgtctgtgccatg

SEQ ID NO: 300637 - DNA, 12 bp, Homo sapiens
gtgtcttccata

SEQ ID NO: 300638 - DNA, 13 bp, Homo sapiens
gtgtcttccataa

SEQ ID NO: 300639 - DNA, 15 bp, Homo sapiens
gtgtcttgtgttttt

SEQ ID NO: 300640 - DNA, 13 bp, Homo sapiens
gtgtctttatcag

SEQ ID NO: 300641 - DNA, 15 bp, Homo sapiens
gtgtcttttaatgat

SEQ ID NO: 300642 - DNA, 11 bp, Homo sapiens
gtgtgaagaaa

SEQ ID NO: 300643 - DNA, 19 bp, Homo sapiens
gtgtgaaggtaactaagaa

SEQ ID NO: 300644 - DNA, 12 bp, Homo sapiens
gtgtgaggcccc

SEQ ID NO: 300645 - DNA, 20 bp, Homo sapiens
gtgtgagtggcagccatgcc

SEQ ID NO: 300646 - DNA, 21 bp, Homo sapiens
gtgtgagtggcagccatgcct

SEQ ID NO: 300647 - DNA, 13 bp, Homo sapiens
gtgtgagtgtgac

SEQ ID NO: 300648 - DNA, 14 bp, Homo sapiens
gtgtgagtgtgatg

SEQ ID NO: 300649 - DNA, 17 bp, Homo sapiens
gtgtgatttgtctctga

SEQ ID NO: 300650 - DNA, 16 bp, Homo sapiens
gtgtgcaagtgtgtgc

SEQ ID NO: 300651 - DNA, 22 bp, Homo sapiens
gtgtgcaccttaccaactttct

SEQ ID NO: 300652 - DNA, 13 bp, Homo sapiens
gtgtgcagtgaag

SEQ ID NO: 300653 - DNA, 12 bp, Homo sapiens
gtgtgcatgtgt

SEQ ID NO: 300654 - DNA, 20 bp, Homo sapiens
gtgtgcatgtgtgtgctcag

SEQ ID NO: 300655 - DNA, 15 bp, Homo sapiens
gtgtgccacaggctg

SEQ ID NO: 300656 - DNA, 20 bp, Homo sapiens
gtgtgcccacccgtgttctc

SEQ ID NO: 300657 - DNA, 11 bp, Homo sapiens
gtgtgccctgg

SEQ ID NO: 300658 - DNA, 12 bp, Homo sapiens
gtgtgccctggc

SEQ ID NO: 300659 - DNA, 16 bp, Homo sapiens
gtgtgccctggctccc

SEQ ID NO: 300660 - DNA, 14 bp, Homo sapiens
gtgtgcctgtggca

SEQ ID NO: 300661 - DNA, 18 bp, Homo sapiens
gtgtgcgcccctccccac

SEQ ID NO: 300662 - DNA, 21 bp, Homo sapiens
gtgtgcgcccctccccacccc

SEQ ID NO: 300663 - DNA, 14 bp, Homo sapiens
gtgtgctacagaaa

SEQ ID NO: 300664 - DNA, 11 bp, Homo sapiens
gtgtgctgtaa

SEQ ID NO: 300665 - DNA, 18 bp, Homo sapiens
gtgtgctttatgctgaaa

SEQ ID NO: 300666 - DNA, 18 bp, Homo sapiens
gtgtggactcaagtcctt

SEQ ID NO: 300667 - DNA, 18 bp, Homo sapiens
gtgtggagagggaatgtg

SEQ ID NO: 300668 - DNA, 21 bp, Homo sapiens
gtgtggagagggaatgtgaaa

SEQ ID NO: 300669 - DNA, 10 bp, Homo sapiens
gtgtggagca

SEQ ID NO: 300670 - DNA, 19 bp, Homo sapiens
gtgtggagctgcttccagt

SEQ ID NO: 300671 - DNA, 14 bp, Homo sapiens
gtgtggagtggagg

SEQ ID NO: 300672 - DNA, 14 bp, Homo sapiens
gtgtggcaaacatt

SEQ ID NO: 300673 - DNA, 16 bp, Homo sapiens
gtgtggcaaacattta

SEQ ID NO: 300674 - DNA, 17 bp, Homo sapiens
gtgtggcacgcacctgt

SEQ ID NO: 300675 - DNA, 19 bp, Homo sapiens
gtgtggccgcctggcaggt

SEQ ID NO: 300676 - DNA, 19 bp, Homo sapiens
gtgtggctcacgtgtgtga

SEQ ID NO: 300677 - DNA, 13 bp, Homo sapiens
gtgtggctgctcc

SEQ ID NO: 300678 - DNA, 13 bp, Homo sapiens
gtgtggctggtgt

SEQ ID NO: 300679 - DNA, 17 bp, Homo sapiens
gtgtggcttaaacattt

SEQ ID NO: 300680 - DNA, 15 bp, Homo sapiens
gtgtgggtcagggag

SEQ ID NO: 300681 - DNA, 18 bp, Homo sapiens
gtgtgggtttactctgtg

SEQ ID NO: 300682 - DNA, 14 bp, Homo sapiens
gtgtggtggctcat

SEQ ID NO: 300683 - DNA, 17 bp, Homo sapiens
gtgtgtaagctgactgg

SEQ ID NO: 300684 - DNA, 20 bp, Homo sapiens
gtgtgtatgtgcgtgtgtgc

SEQ ID NO: 300685 - DNA, 12 bp, Homo sapiens
gtgtgtctctga

SEQ ID NO: 300686 - DNA, 14 bp, Homo sapiens
gtgtgtctggtggg

SEQ ID NO: 300687 - DNA, 21 bp, Homo sapiens
gtgtgtgagtgggaggagagg

SEQ ID NO: 300688 - DNA, 20 bp, Homo sapiens
gtgtgtggaaggcacccgcc

SEQ ID NO: 300689 - DNA, 17 bp, Homo sapiens
gtgtgtgtatgtttgca

SEQ ID NO: 300690 - DNA, 16 bp, Homo sapiens
gtgtgtttaaataaag

SEQ ID NO: 300691 - DNA, 17 bp, Homo sapiens
gtgtgttttcataataa

SEQ ID NO: 300692 - DNA, 17 bp, Homo sapiens
gtgttaaatcacagaaa

SEQ ID NO: 300693 - DNA, 13 bp, Homo sapiens
gtgttacacatac

SEQ ID NO: 300694 - DNA, 14 bp, Homo sapiens
gtgttagtgggaag

SEQ ID NO: 300695 - DNA, 13 bp, Homo sapiens
gtgttagtgtctg

SEQ ID NO: 300696 - DNA, 18 bp, Homo sapiens
gtgttcagagttccacag

SEQ ID NO: 300697 - DNA, 18 bp, Homo sapiens
gtgttcccaatgctttgt

SEQ ID NO: 300698 - DNA, 10 bp, Homo sapiens
gtgttcctgg

SEQ ID NO: 300699 - DNA, 16 bp, Homo sapiens
gtgttctatgcaaagt

SEQ ID NO: 300700 - DNA, 17 bp, Homo sapiens
gtgttctcaatgctttt

SEQ ID NO: 300701 - DNA, 21 bp, Homo sapiens
gtgttctgaaggtgcccagga

SEQ ID NO: 300702 - DNA, 17 bp, Homo sapiens
gtgttctgtttgttaaa

SEQ ID NO: 300703 - DNA, 17 bp, Homo sapiens
gtgttcttcgtatatac

SEQ ID NO: 300704 - DNA, 16 bp, Homo sapiens
gtgttcttctcaagga

SEQ ID NO: 300705 - DNA, 16 bp, Homo sapiens
gtgttgactgctgctc

SEQ ID NO: 300706 - DNA, 15 bp, Homo sapiens
gtgttgccaggcagg

SEQ ID NO: 300707 - DNA, 20 bp, Homo sapiens
gtgttgcccaggctggtctc

SEQ ID NO: 300708 - DNA, 17 bp, Homo sapiens
gtgttggcccaagctct

SEQ ID NO: 300709 - DNA, 21 bp, Homo sapiens
gtgttggcttgtgatctggga

SEQ ID NO: 300710 - DNA, 22 bp, Homo sapiens
gtgttggcttgtgatctgggaa

SEQ ID NO: 300711 - DNA, 15 bp, Homo sapiens
gtgttgggacctgct

SEQ ID NO: 300712 - DNA, 16 bp, Homo sapiens
gtgttgggacctgctg

SEQ ID NO: 300713 - DNA, 15 bp, Homo sapiens
gtgttggtctttcta

SEQ ID NO: 300714 - DNA, 18 bp, Homo sapiens
gtgttggtctttctaatg

SEQ ID NO: 300715 - DNA, 20 bp, Homo sapiens
gtgttggtctttctaatgta

SEQ ID NO: 300716 - DNA, 23 bp, Homo sapiens
gtgttgtagctaattaggaagct

SEQ ID NO: 300717 - DNA, 23 bp, Homo sapiens
gttctcatccacagaggccaggc

SEQ ID NO: 300718 - DNA, 18 bp, Homo sapiens
gttctcatgtttgtgcat

SEQ ID NO: 300719 - DNA, 20 bp, Homo sapiens
gttctcatgtttgtgcatgt

SEQ ID NO: 300720 - DNA, 21 bp, Homo sapiens
gttctcatgtttgtgcatgta

SEQ ID NO: 300721 - DNA, 17 bp, Homo sapiens
gttctccacccaccagt

SEQ ID NO: 300722 - DNA, 17 bp, Homo sapiens
gttctccactaatactg

SEQ ID NO: 300723 - DNA, 17 bp, Homo sapiens
gttctccagaatgtaag

SEQ ID NO: 300724 - DNA, 19 bp, Homo sapiens
gttctccagaatgtaagaa

SEQ ID NO: 300725 - DNA, 14 bp, Homo sapiens
gttctccaggtgat

SEQ ID NO: 300726 - DNA, 20 bp, Homo sapiens
gttctccaggtgattctgat

SEQ ID NO: 300727 - DNA, 15 bp, Homo sapiens
gttctcctgcttgta

SEQ ID NO: 300728 - DNA, 15 bp, Homo sapiens
gttctcgtgacccag

SEQ ID NO: 300729 - DNA, 23 bp, Homo sapiens
gttctctctatggtaaagatatt

SEQ ID NO: 300730 - DNA, 19 bp, Homo sapiens
gttctctcttggtctcttt

SEQ ID NO: 300731 - DNA, 15 bp, Homo sapiens
gttctcttctctctt

SEQ ID NO: 300732 - DNA, 22 bp, Homo sapiens
gttctctttgccttgatgttgt

SEQ ID NO: 300733 - DNA, 13 bp, Homo sapiens
gttctgaaatatt

SEQ ID NO: 300734 - DNA, 21 bp, Homo sapiens
gttctgaaggttggaactgct

SEQ ID NO: 300735 - DNA, 15 bp, Homo sapiens
gttctgacattaaca

SEQ ID NO: 300736 - DNA, 23 bp, Homo sapiens
gttctgacattaacagttttcca

SEQ ID NO: 300737 - DNA, 22 bp, Homo sapiens
gttctgagaactgactttctcc

SEQ ID NO: 300738 - DNA, 19 bp, Homo sapiens
gttctgagcccccacctgc

SEQ ID NO: 300739 - DNA, 22 bp, Homo sapiens
gttctgagcccccacctgcctg

SEQ ID NO: 300740 - DNA, 14 bp, Homo sapiens
gttctgcaaataga

SEQ ID NO: 300741 - DNA, 15 bp, Homo sapiens
gttctgcaaatagaa

SEQ ID NO: 300742 - DNA, 15 bp, Homo sapiens
gttctgcagagactt

SEQ ID NO: 300743 - DNA, 19 bp, Homo sapiens
gttctgctggcctggatct

SEQ ID NO: 300744 - DNA, 18 bp, Homo sapiens
gttctggactctgcccca

SEQ ID NO: 300745 - DNA, 22 bp, Homo sapiens
gttctggctgccccaacctgct

SEQ ID NO: 300746 - DNA, 15 bp, Homo sapiens
gttctggggcccctt

SEQ ID NO: 300747 - DNA, 11 bp, Homo sapiens
gttctgggtgg

SEQ ID NO: 300748 - DNA, 20 bp, Homo sapiens
gttctggtaacctgtggtgt

SEQ ID NO: 300749 - DNA, 15 bp, Homo sapiens
gttctggtggcccca

SEQ ID NO: 300750 - DNA, 23 bp, Homo sapiens
gttctggttagctcagccccagc

SEQ ID NO: 300751 - DNA, 20 bp, Homo sapiens
gttctgtgggcttggccttg

SEQ ID NO: 300752 - DNA, 21 bp, Homo sapiens
gttctgtggttttcccctccc

SEQ ID NO: 300753 - DNA, 23 bp, Homo sapiens
gttctgtggttttcccctccctg

SEQ ID NO: 300754 - DNA, 15 bp, Homo sapiens
gttctgtgtctgctg

SEQ ID NO: 300755 - DNA, 17 bp, Homo sapiens
gttctgtgtctgctgta

SEQ ID NO: 300756 - DNA, 15 bp, Homo sapiens
gttctgtgtgtctgg

SEQ ID NO: 300757 - DNA, 13 bp, Homo sapiens
gttctgttaaata

SEQ ID NO: 300758 - DNA, 15 bp, Homo sapiens
gttctgtttgttaaa

SEQ ID NO: 300759 - DNA, 22 bp, Homo sapiens
gttctgtttgttaaaactggca

SEQ ID NO: 300760 - DNA, 12 bp, Homo sapiens
gttctgttttgt

SEQ ID NO: 300761 - DNA, 16 bp, Homo sapiens
gttctgttttgttttg

SEQ ID NO: 300762 - DNA, 17 bp, Homo sapiens
gttcttagttctcactg

SEQ ID NO: 300763 - DNA, 13 bp, Homo sapiens
gttcttcacctct

SEQ ID NO: 300764 - DNA, 16 bp, Homo sapiens
gttcttcgggaagaga

SEQ ID NO: 300765 - DNA, 21 bp, Homo sapiens
gttcttgctgagcaccctctc

SEQ ID NO: 300766 - DNA, 21 bp, Homo sapiens
gttcttgggggaggccacccc

SEQ ID NO: 300767 - DNA, 17 bp, Homo sapiens
gttcttgttacggcagt

SEQ ID NO: 300768 - DNA, 16 bp, Homo sapiens
gttcttgttttatata

SEQ ID NO: 300769 - DNA, 22 bp, Homo sapiens
gttctttcctttcatcctcagc

SEQ ID NO: 300770 - DNA, 23 bp, Homo sapiens
gttctttcctttcatcctcagca

SEQ ID NO: 300771 - DNA, 16 bp, Homo sapiens
gttctttcttcctctg

SEQ ID NO: 300772 - DNA, 22 bp, Homo sapiens
gttctttgagggactgcctctg

SEQ ID NO: 300773 - DNA, 23 bp, Homo sapiens
gttctttgagggactgcctctgc

SEQ ID NO: 300774 - DNA, 15 bp, Homo sapiens
gttctttgttcctgc

SEQ ID NO: 300775 - DNA, 21 bp, Homo sapiens
gttcttttgatacatttatct

SEQ ID NO: 300776 - DNA, 17 bp, Homo sapiens
gttgaaaatgagcctgt

SEQ ID NO: 300777 - DNA, 21 bp, Homo sapiens
gttgaactatatttggagaaa

SEQ ID NO: 300778 - DNA, 22 bp, Homo sapiens
gttgaagctaagatttagagat

SEQ ID NO: 300779 - DNA, 13 bp, Homo sapiens
gttgaaggcagtc

SEQ ID NO: 300780 - DNA, 13 bp, Homo sapiens
gttgaataaaagt

SEQ ID NO: 300781 - DNA, 15 bp, Homo sapiens
gttgaatgacaacag

SEQ ID NO: 300782 - DNA, 19 bp, Homo sapiens
gttgacaaaatatataatg

SEQ ID NO: 300783 - DNA, 15 bp, Homo sapiens
gttgacacggccatg

SEQ ID NO: 300784 - DNA, 18 bp, Homo sapiens
gttgacagttcatatgta

SEQ ID NO: 300785 - DNA, 14 bp, Homo sapiens
gttgacatgcacag

SEQ ID NO: 300786 - DNA, 22 bp, Homo sapiens
gttgaccctactgtggattggt

SEQ ID NO: 300787 - DNA, 19 bp, Homo sapiens
gttgaccgttttcatcctg

SEQ ID NO: 300788 - DNA, 11 bp, Homo sapiens
gttgaccttta

SEQ ID NO: 300789 - DNA, 21 bp, Homo sapiens
gttgacctttatttattaaac

SEQ ID NO: 300790 - DNA, 22 bp, Homo sapiens
gttgacgtgaccaattgccctg

SEQ ID NO: 300791 - DNA, 15 bp, Homo sapiens
gttgactgctgctcc

SEQ ID NO: 300792 - DNA, 23 bp, Homo sapiens
gttgagaacaaaaattgggtttt

SEQ ID NO: 300793 - DNA, 16 bp, Homo sapiens
gttgagaatgcagtga

SEQ ID NO: 300794 - DNA, 13 bp, Homo sapiens
gttgagacgcctt

SEQ ID NO: 300795 - DNA, 23 bp, Homo sapiens
gttgagccaggcctgggtctgtg

SEQ ID NO: 300796 - DNA, 24 bp, Homo sapiens
gttgagctctcggaactgcatgct

SEQ ID NO: 300797 - DNA, 18 bp, Homo sapiens
gttgaggacaggagaggg

SEQ ID NO: 300798 - DNA, 16 bp, Homo sapiens
gttgaggatgcactgg

SEQ ID NO: 300799 - DNA, 14 bp, Homo sapiens
gttgaggggagagg

SEQ ID NO: 300800 - DNA, 13 bp, Homo sapiens
gttgagtatttgc

SEQ ID NO: 300801 - DNA, 15 bp, Homo sapiens
gttgagtatttgctg

SEQ ID NO: 300802 - DNA, 14 bp, Homo sapiens
gttgagtgagccgg

SEQ ID NO: 300803 - DNA, 15 bp, Homo sapiens
gttgagtttcttcta

SEQ ID NO: 300804 - DNA, 23 bp, Homo sapiens
gttgatattggttctatttattt

SEQ ID NO: 300805 - DNA, 14 bp, Homo sapiens
gttgatgaccaatc

SEQ ID NO: 300806 - DNA, 18 bp, Homo sapiens
gttgatgggccttcagat

SEQ ID NO: 300807 - DNA, 21 bp, Homo sapiens
gttgattctcatgcactgcaa

SEQ ID NO: 300808 - DNA, 13 bp, Homo sapiens
gttgattctgtcc

SEQ ID NO: 300809 - DNA, 15 bp, Homo sapiens
gttgattctttcaat

SEQ ID NO: 300810 - DNA, 15 bp, Homo sapiens
gttgcacaacacaga

SEQ ID NO: 300811 - DNA, 18 bp, Homo sapiens
gttgcacagtccctcctg

SEQ ID NO: 300812 - DNA, 23 bp, Homo sapiens
gttgcacctcaggcagaggatgt

SEQ ID NO: 300813 - DNA, 11 bp, Homo sapiens
gttgcagcctg

SEQ ID NO: 300814 - DNA, 17 bp, Homo sapiens
gttgcaggtgtccgggg

SEQ ID NO: 300815 - DNA, 20 bp, Homo sapiens
gttgcataaacaatccaaat

SEQ ID NO: 300816 - DNA, 18 bp, Homo sapiens
gttgccaactaagccctc

SEQ ID NO: 300817 - DNA, 17 bp, Homo sapiens
gttgccaagaactgaaa

SEQ ID NO: 300818 - DNA, 15 bp, Homo sapiens
gttgccagagatgga

SEQ ID NO: 300819 - DNA, 16 bp, Homo sapiens
gttgccattttgtctg

SEQ ID NO: 300820 - DNA, 20 bp, Homo sapiens
gttgcccaggctggagtgca

SEQ ID NO: 300821 - DNA, 16 bp, Homo sapiens
gttgcccgtggatctg

SEQ ID NO: 300822 - DNA, 18 bp, Homo sapiens
gttgccgggcctggactg

SEQ ID NO: 300823 - DNA, 20 bp, Homo sapiens
gttgcctcctcccatccagc

SEQ ID NO: 300824 - DNA, 16 bp, Homo sapiens
gttgcctcctctctcc

SEQ ID NO: 300825 - DNA, 19 bp, Homo sapiens
gttgcctcctctctccctg

SEQ ID NO: 300826 - DNA, 20 bp, Homo sapiens
gttgcctcctctctccctgc

SEQ ID NO: 300827 - DNA, 21 bp, Homo sapiens
gttgcctcctctctccctgcc

SEQ ID NO: 300828 - DNA, 23 bp, Homo sapiens
gttgcctcctctctccctgcctc

SEQ ID NO: 300829 - DNA, 15 bp, Homo sapiens
gttgcctgaaaaatg

SEQ ID NO: 300830 - DNA, 14 bp, Homo sapiens
gttgctatttgttg

SEQ ID NO: 300831 - DNA, 22 bp, Homo sapiens
gttgctcagcaaggggctctgc

SEQ ID NO: 300832 - DNA, 20 bp, Homo sapiens
gttgctcctacccctgtcct

SEQ ID NO: 300833 - DNA, 15 bp, Homo sapiens
gttgctgagaaatgg

SEQ ID NO: 300834 - DNA, 14 bp, Homo sapiens
gttgcttctgagtg

SEQ ID NO: 300835 - DNA, 13 bp, Homo sapiens
gttgcttctggga

SEQ ID NO: 300836 - DNA, 21 bp, Homo sapiens
gttgcttgggccactgccctc

SEQ ID NO: 300837 - DNA, 18 bp, Homo sapiens
gttgcttttgcacctacg

SEQ ID NO: 300838 - DNA, 12 bp, Homo sapiens
gttggaaaagaa

SEQ ID NO: 300839 - DNA, 23 bp, Homo sapiens
gttggaaattgggtgtgccctgg

SEQ ID NO: 300840 - DNA, 15 bp, Homo sapiens
gttggaactgctgcc

SEQ ID NO: 300841 - DNA, 22 bp, Homo sapiens
gttggaactttagggggtggga

SEQ ID NO: 300842 - DNA, 14 bp, Homo sapiens
gttggacacactgt

SEQ ID NO: 300843 - DNA, 19 bp, Homo sapiens
gttggacagcaaaaccatt

SEQ ID NO: 300844 - DNA, 13 bp, Homo sapiens
gttggactgtggc

SEQ ID NO: 300845 - DNA, 15 bp, Homo sapiens
gttggactgtggcct

SEQ ID NO: 300846 - DNA, 20 bp, Homo sapiens
gtttttttttcctgtccttc

SEQ ID NO: 300847 - DNA, 19 bp, Homo sapiens
gttttttttttttgtattt

SEQ ID NO: 300848 - DNA, 23 bp, Homo sapiens
gttttttttttttgtatttcttt

SEQ ID NO: 300849 - DNA, 20 bp, Homo sapiens
gtttttttttttttacatgt

SEQ ID NO: 300850 - DNA, 19 bp, Homo sapiens
gttttttttttttttttgg

SEQ ID NO: 300851 - DNA, 15 bp, Homo sapiens
taaaaaaaaaaacta

SEQ ID NO: 300852 - DNA, 19 bp, Homo sapiens
taaaaaaaaaaggatgaaa

SEQ ID NO: 300853 - DNA, 13 bp, Homo sapiens
taaaaaaaggaaa

SEQ ID NO: 300854 - DNA, 14 bp, Homo sapiens
taaaaaaaggaaaa

SEQ ID NO: 300855 - DNA, 14 bp, Homo sapiens
taaaaaaataacat

SEQ ID NO: 300856 - DNA, 20 bp, Homo sapiens
taaaaaaataataataatgt

SEQ ID NO: 300857 - DNA, 15 bp, Homo sapiens
taaaaaaataatata

SEQ ID NO: 300858 - DNA, 12 bp, Homo sapiens
taaaaaacaaga

SEQ ID NO: 300859 - DNA, 13 bp, Homo sapiens
taaaaaacatttg

SEQ ID NO: 300860 - DNA, 17 bp, Homo sapiens
taaaaaagaaaacattc

SEQ ID NO: 300861 - DNA, 20 bp, Homo sapiens
taaaaaataaagtacgtgtt

SEQ ID NO: 300862 - DNA, 12 bp, Homo sapiens
taaaaaataaca

SEQ ID NO: 300863 - DNA, 14 bp, Homo sapiens
taaaaaataacata

SEQ ID NO: 300864 - DNA, 18 bp, Homo sapiens
taaaaaataacatattct

SEQ ID NO: 300865 - DNA, 15 bp, Homo sapiens
taaaaaatggaaaga

SEQ ID NO: 300866 - DNA, 14 bp, Homo sapiens
taaaaaatttatta

SEQ ID NO: 300867 - DNA, 12 bp, Homo sapiens
taaaaacatttt

SEQ ID NO: 300868 - DNA, 14 bp, Homo sapiens
taaaaacattttaa

SEQ ID NO: 300869 - DNA, 19 bp, Homo sapiens
taaaaacattttaaaatca

SEQ ID NO: 300870 - DNA, 20 bp, Homo sapiens
taaaaacattttaaaatcaa

SEQ ID NO: 300871 - DNA, 23 bp, Homo sapiens
taaaaacattttaaaatcaactt

SEQ ID NO: 300872 - DNA, 23 bp, Homo sapiens
taaaaaccattataaaatctttc

SEQ ID NO: 300873 - DNA, 15 bp, Homo sapiens
taaaaaccctgctaa

SEQ ID NO: 300874 - DNA, 13 bp, Homo sapiens
taaaaaccctgta

SEQ ID NO: 300875 - DNA, 22 bp, Homo sapiens
taaaaacctcttagcttttctg

SEQ ID NO: 300876 - DNA, 19 bp, Homo sapiens
taaaaactgcccattgtaa

SEQ ID NO: 300877 - DNA, 22 bp, Homo sapiens
taaaaagaactcaaaaggagaa

SEQ ID NO: 300878 - DNA, 19 bp, Homo sapiens
taaaaagagagaaaactta

SEQ ID NO: 300879 - DNA, 20 bp, Homo sapiens
taaaaagagagaaaacttat

SEQ ID NO: 300880 - DNA, 20 bp, Homo sapiens
taaaaagggcagggcatctc

SEQ ID NO: 300881 - DNA, 17 bp, Homo sapiens
taaaaagtcaattcatc

SEQ ID NO: 300882 - DNA, 18 bp, Homo sapiens
taaaaagtgacacagcag

SEQ ID NO: 300883 - DNA, 21 bp, Homo sapiens
taaaaagttaaaaaaaataat

SEQ ID NO: 300884 - DNA, 16 bp, Homo sapiens
taaaaataaaaaagat

SEQ ID NO: 300885 - DNA, 21 bp, Homo sapiens
taaaaataaaaaagatcccaa

SEQ ID NO: 300886 - DNA, 17 bp, Homo sapiens
taaaaataaaaatggaa

SEQ ID NO: 300887 - DNA, 14 bp, Homo sapiens
taaaaataaaagtt

SEQ ID NO: 300888 - DNA, 19 bp, Homo sapiens
taaaaataaaatgatgtat

SEQ ID NO: 300889 - DNA, 18 bp, Homo sapiens
taaaaataaaatgcattt

SEQ ID NO: 300890 - DNA, 17 bp, Homo sapiens
taaaaataaatttggtt

SEQ ID NO: 300891 - DNA, 18 bp, Homo sapiens
taaaaataaccaaaaaat

SEQ ID NO: 300892 - DNA, 22 bp, Homo sapiens
taaaaataaccaaaaaatgtga

SEQ ID NO: 300893 - DNA, 19 bp, Homo sapiens
taaaaatataaacaatgtt

SEQ ID NO: 300894 - DNA, 19 bp, Homo sapiens
taaaaatatggaacttcta

SEQ ID NO: 300895 - DNA, 10 bp, Homo sapiens
taaaaatatt

SEQ ID NO: 300896 - DNA, 15 bp, Homo sapiens
taaaaatattctcca

SEQ ID NO: 300897 - DNA, 21 bp, Homo sapiens
taaaaatattgtgttgtgaat

SEQ ID NO: 300898 - DNA, 22 bp, Homo sapiens
taaaaatattgtgttgtgaatg

SEQ ID NO: 300899 - DNA, 21 bp, Homo sapiens
taaaaatccctcttcctccaa

SEQ ID NO: 300900 - DNA, 22 bp, Homo sapiens
taaaaatccctcttcctccaaa

SEQ ID NO: 300901 - DNA, 12 bp, Homo sapiens
taaaaatctttc

SEQ ID NO: 300902 - DNA, 18 bp, Homo sapiens
taaaaatctttcagaata

SEQ ID NO: 300903 - DNA, 19 bp, Homo sapiens
taaaaattaaggcaactga

SEQ ID NO: 300904 - DNA, 18 bp, Homo sapiens
taaaaattatctttaaaa

SEQ ID NO: 300905 - DNA, 14 bp, Homo sapiens
taaaaattctgaat

SEQ ID NO: 300906 - DNA, 22 bp, Homo sapiens
taaaaattgccattggacagtt

SEQ ID NO: 300907 - DNA, 17 bp, Homo sapiens
taaaaattgtgatcaga

SEQ ID NO: 300908 - DNA, 15 bp, Homo sapiens
taaaacaaaaaacaa

SEQ ID NO: 300909 - DNA, 21 bp, Homo sapiens
taaaacaaaaaacaatattta

SEQ ID NO: 300910 - DNA, 22 bp, Homo sapiens
taaaacaaaaaacaatatttat

SEQ ID NO: 300911 - DNA, 21 bp, Homo sapiens
taaaacaaaaccaagccttgg

SEQ ID NO: 300912 - DNA, 12 bp, Homo sapiens
taaaacaaaatc

SEQ ID NO: 300913 - DNA, 14 bp, Homo sapiens
taaaacaaattaaa

SEQ ID NO: 300914 - DNA, 17 bp, Homo sapiens
taaaacaagaaagtttc

SEQ ID NO: 300915 - DNA, 18 bp, Homo sapiens
taaaacaagaaagtttcc

SEQ ID NO: 300916 - DNA, 18 bp, Homo sapiens
taaaacagctgtctctaa

SEQ ID NO: 300917 - DNA, 21 bp, Homo sapiens
taaaacataatagaatttcct

SEQ ID NO: 300918 - DNA, 20 bp, Homo sapiens
taaaacattagaagaaaaca

SEQ ID NO: 300919 - DNA, 21 bp, Homo sapiens
taaaacattagaagaaaacat

SEQ ID NO: 300920 - DNA, 23 bp, Homo sapiens
taaaacattagaagaaaacatat

SEQ ID NO: 300921 - DNA, 15 bp, Homo sapiens
taaaacctaaaatta

SEQ ID NO: 300922 - DNA, 11 bp, Homo sapiens
taaaacctttc

SEQ ID NO: 300923 - DNA, 20 bp, Homo sapiens
taaaactaagctctttgaga

SEQ ID NO: 300924 - DNA, 21 bp, Homo sapiens
taaaactaagctctttgagaa

SEQ ID NO: 300925 - DNA, 23 bp, Homo sapiens
taaaactagataacttaaataat

SEQ ID NO: 300926 - DNA, 21 bp, Homo sapiens
taaaactagggggtgtatatt

SEQ ID NO: 300927 - DNA, 21 bp, Homo sapiens
taaaactatggttcccaataa

SEQ ID NO: 300928 - DNA, 23 bp, Homo sapiens
taaaactatggttcccaataaaa

SEQ ID NO: 300929 - DNA, 17 bp, Homo sapiens
taaaactatttaaaatt

SEQ ID NO: 300930 - DNA, 20 bp, Homo sapiens
taaaactatttaaaattggc

SEQ ID NO: 300931 - DNA, 21 bp, Homo sapiens
taaaactatttaaaattggca

SEQ ID NO: 300932 - DNA, 18 bp, Homo sapiens
taaaactcagttaaaatg

SEQ ID NO: 300933 - DNA, 20 bp, Homo sapiens
taaaactgcacagtgctgtt

SEQ ID NO: 300934 - DNA, 10 bp, Homo sapiens
taaaactgtg

SEQ ID NO: 300935 - DNA, 12 bp, Homo sapiens
taaaactgtgac

SEQ ID NO: 300936 - DNA, 18 bp, Homo sapiens
taaaactgtgacattcca

SEQ ID NO: 300937 - DNA, 20 bp, Homo sapiens
taaaactgtgacattccaca

SEQ ID NO: 300938 - DNA, 18 bp, Homo sapiens
taaaacttatgctagttt

SEQ ID NO: 300939 - DNA, 20 bp, Homo sapiens
taaaacttgatgtgttatct

SEQ ID NO: 300940 - DNA, 13 bp, Homo sapiens
taaaactttattt

SEQ ID NO: 300941 - DNA, 17 bp, Homo sapiens
taaaactttcctcgcct

SEQ ID NO: 300942 - DNA, 20 bp, Homo sapiens
taaaagaaagggttctgtaa

SEQ ID NO: 300943 - DNA, 23 bp, Homo sapiens
taaaagaaagggttctgtaaaat

SEQ ID NO: 300944 - DNA, 16 bp, Homo sapiens
taaaagagccaagttc

SEQ ID NO: 300945 - DNA, 21 bp, Homo sapiens
taaaagagccaagttcaaaga

SEQ ID NO: 300946 - DNA, 22 bp, Homo sapiens
taaaagagccaagttcaaagaa

SEQ ID NO: 300947 - DNA, 21 bp, Homo sapiens
taaaagaggaaattaaataat

SEQ ID NO: 300948 - DNA, 22 bp, Homo sapiens
taaaagaggaaattaaataatt

SEQ ID NO: 300949 - DNA, 13 bp, Homo sapiens
taaaagattcttt

SEQ ID NO: 300950 - DNA, 19 bp, Homo sapiens
taaaagattctttaaacta

SEQ ID NO: 300951 - DNA, 18 bp, Homo sapiens
taaaagcaacatcagctt

SEQ ID NO: 300952 - DNA, 20 bp, Homo sapiens
taaaagcagcatctgctaat

SEQ ID NO: 300953 - DNA, 22 bp, Homo sapiens
taaaagcatactctatgtgatt

SEQ ID NO: 300954 - DNA, 12 bp, Homo sapiens
taaaagcatata

SEQ ID NO: 300955 - DNA, 20 bp, Homo sapiens
taaaagcatatataaaacaa

SEQ ID NO: 300956 - DNA, 21 bp, Homo sapiens
taaaagcattttaatactaag

SEQ ID NO: 300957 - DNA, 20 bp, Homo sapiens
taaaagccactgttacattt

SEQ ID NO: 300958 - DNA, 21 bp, Homo sapiens
taaaaggaggacagggaggga

SEQ ID NO: 300959 - DNA, 12 bp, Homo sapiens
taaaagtattca

SEQ ID NO: 300960 - DNA, 15 bp, Homo sapiens
taaaagtattcatac

SEQ ID NO: 300961 - DNA, 13 bp, Homo sapiens
taaaagtgatcaa

SEQ ID NO: 300962 - DNA, 17 bp, Homo sapiens
taaaagtgcacacctta

SEQ ID NO: 300963 - DNA, 20 bp, Homo sapiens
taaaagttctcaaatattgg

SEQ ID NO: 300964 - DNA, 14 bp, Homo sapiens
taaaagttgtgatt

SEQ ID NO: 300965 - DNA, 15 bp, Homo sapiens
taaaagttgtgattc

SEQ ID NO: 300966 - DNA, 15 bp, Homo sapiens
taaaagtttcaatgt

SEQ ID NO: 300967 - DNA, 18 bp, Homo sapiens
taaaagtttgtcctttaa

SEQ ID NO: 300968 - DNA, 16 bp, Homo sapiens
taaaagttttctccaa

SEQ ID NO: 300969 - DNA, 13 bp, Homo sapiens
taaaataaatata

SEQ ID NO: 300970 - DNA, 20 bp, Homo sapiens
taaaataaatatactaataa

SEQ ID NO: 300971 - DNA, 20 bp, Homo sapiens
taaaataaccccgggcaaga

SEQ ID NO: 300972 - DNA, 14 bp, Homo sapiens
taaaataagtaaca

SEQ ID NO: 300973 - DNA, 17 bp, Homo sapiens
taaaataagtaacatat

SEQ ID NO: 300974 - DNA, 14 bp, Homo sapiens
taaaataagtgaat

SEQ ID NO: 300975 - DNA, 14 bp, Homo sapiens
taaaatacatttaa

SEQ ID NO: 300976 - DNA, 15 bp, Homo sapiens
taaaatacatttaaa

SEQ ID NO: 300977 - DNA, 22 bp, Homo sapiens
taaaatactctagcctgggcca

SEQ ID NO: 300978 - DNA, 20 bp, Homo sapiens
taaaatactgcttttgcaaa

SEQ ID NO: 300979 - DNA, 22 bp, Homo sapiens
taaaatacttctttttacaatg

SEQ ID NO: 300980 - DNA, 14 bp, Homo sapiens
taaaatagcttgta

SEQ ID NO: 300981 - DNA, 14 bp, Homo sapiens
taaaatatcattca

SEQ ID NO: 300982 - DNA, 18 bp, Homo sapiens
taaaatatcattcagcaa

SEQ ID NO: 300983 - DNA, 18 bp, Homo sapiens
taaaatatggctataaat

SEQ ID NO: 300984 - DNA, 13 bp, Homo sapiens
taaaatctgtgaa

SEQ ID NO: 300985 - DNA, 11 bp, Homo sapiens
taaaatcttgt

SEQ ID NO: 300986 - DNA, 20 bp, Homo sapiens
taaaatcttgtcatgtgtat

SEQ ID NO: 300987 - DNA, 23 bp, Homo sapiens
taaaatcttgtcatgtgtataaa

SEQ ID NO: 300988 - DNA, 23 bp, Homo sapiens
taaaatctttccatctcattaca

SEQ ID NO: 300989 - DNA, 17 bp, Homo sapiens
taaaatgacttttatta

SEQ ID NO: 300990 - DNA, 19 bp, Homo sapiens
taaaatgagggacttccct

SEQ ID NO: 300991 - DNA, 14 bp, Homo sapiens
taaaatgattcact

SEQ ID NO: 300992 - DNA, 14 bp, Homo sapiens
taaaatgattttat

SEQ ID NO: 300993 - DNA, 19 bp, Homo sapiens
taaaatgcaaaataaatgt

SEQ ID NO: 300994 - DNA, 13 bp, Homo sapiens
taaaatgcactga

SEQ ID NO: 300995 - DNA, 16 bp, Homo sapiens
taaaatggtgttttca

SEQ ID NO: 300996 - DNA, 23 bp, Homo sapiens
taaaatgtagaagaaagcaaaaa

SEQ ID NO: 300997 - DNA, 14 bp, Homo sapiens
taaaatgtattcaa

SEQ ID NO: 300998 - DNA, 17 bp, Homo sapiens
taaaatgtattcaagca

SEQ ID NO: 300999 - DNA, 18 bp, Homo sapiens
taaaattacagtggattg

SEQ ID NO: 301000 - DNA, 22 bp, Homo sapiens
taaaattagaaaaaaacaaact

SEQ ID NO: 301001 - DNA, 12 bp, Homo sapiens
taaaattagtga

SEQ ID NO: 301002 - DNA, 17 bp, Homo sapiens
taaaattagtgagattt

SEQ ID NO: 301003 - DNA, 21 bp, Homo sapiens
taaaattagtgagatttgtat

SEQ ID NO: 301004 - DNA, 19 bp, Homo sapiens
taaaattattaaaaattat

SEQ ID NO: 301005 - DNA, 21 bp, Homo sapiens
taaaattattaaaaattatag

SEQ ID NO: 301006 - DNA, 15 bp, Homo sapiens
taaaattcaacaaat

SEQ ID NO: 301007 - DNA, 18 bp, Homo sapiens
taaaattcaacaaatgat

SEQ ID NO: 301008 - DNA, 14 bp, Homo sapiens
taaaattcatttct

SEQ ID NO: 301009 - DNA, 12 bp, Homo sapiens
taaaattctagt

SEQ ID NO: 301010 - DNA, 19 bp, Homo sapiens
taaaattctagtctctgat

SEQ ID NO: 301011 - DNA, 20 bp, Homo sapiens
taaaattctagtctctgatt

SEQ ID NO: 301012 - DNA, 22 bp, Homo sapiens
taaaattgtaaaattgtataga

SEQ ID NO: 301013 - DNA, 17 bp, Homo sapiens
taaaatttaagtatctt

SEQ ID NO: 301014 - DNA, 19 bp, Homo sapiens
taaacaaaaactttccatg

SEQ ID NO: 301015 - DNA, 18 bp, Homo sapiens
taaacaaaatagaagctg

SEQ ID NO: 301016 - DNA, 18 bp, Homo sapiens
taaacaaactgtgtaact

SEQ ID NO: 301017 - DNA, 21 bp, Homo sapiens
taaacaacgtgtatagtgcct

SEQ ID NO: 301018 - DNA, 12 bp, Homo sapiens
taaacacacaag

SEQ ID NO: 301019 - DNA, 14 bp, Homo sapiens
taaacacacaagta

SEQ ID NO: 301020 - DNA, 23 bp, Homo sapiens
taaacacagaggttttaaacagt

SEQ ID NO: 301021 - DNA, 12 bp, Homo sapiens
taaacactcagc

SEQ ID NO: 301022 - DNA, 15 bp, Homo sapiens
taaacactcagctgt

SEQ ID NO: 301023 - DNA, 13 bp, Homo sapiens
taaacactgtaat

SEQ ID NO: 301024 - DNA, 23 bp, Homo sapiens
taaacagactatttaacttgagg

SEQ ID NO: 301025 - DNA, 22 bp, Homo sapiens
taaacagataatgcttttacta

SEQ ID NO: 301026 - DNA, 18 bp, Homo sapiens
taaacagcttcatgcctt

SEQ ID NO: 301027 - DNA, 16 bp, Homo sapiens
taaacatcacacacac

SEQ ID NO: 301028 - DNA, 17 bp, Homo sapiens
taaacatgaatttaatg

SEQ ID NO: 301029 - DNA, 18 bp, Homo sapiens
taaacatgaatttaatgt

SEQ ID NO: 301030 - DNA, 17 bp, Homo sapiens
taaacattaaacactgt

SEQ ID NO: 301031 - DNA, 19 bp, Homo sapiens
taaacattaaacactgtaa

SEQ ID NO: 301032 - DNA, 20 bp, Homo sapiens
taaacattcctccagcctcc

SEQ ID NO: 301033 - DNA, 15 bp, Homo sapiens
taaaccaataaaaca

SEQ ID NO: 301034 - DNA, 16 bp, Homo sapiens
taaaccaataaaacaa

SEQ ID NO: 301035 - DNA, 20 bp, Homo sapiens
taaaccataaaataaataat

SEQ ID NO: 301036 - DNA, 18 bp, Homo sapiens
taaacccacaagctgcct

SEQ ID NO: 301037 - DNA, 20 bp, Homo sapiens
taaacccacaagctgcctct

SEQ ID NO: 301038 - DNA, 15 bp, Homo sapiens
taaacccatctgtaa

SEQ ID NO: 301039 - DNA, 12 bp, Homo sapiens
taaacctggagg

SEQ ID NO: 301040 - DNA, 17 bp, Homo sapiens
taaaccttgtttctttc

SEQ ID NO: 301041 - DNA, 19 bp, Homo sapiens
taaaccttgtttctttctg

SEQ ID NO: 301042 - DNA, 17 bp, Homo sapiens
taaacgtgatgatcagc

SEQ ID NO: 301043 - DNA, 22 bp, Homo sapiens
taaactagatctcctatttttc

SEQ ID NO: 301044 - DNA, 15 bp, Homo sapiens
taaactataggtaat

SEQ ID NO: 301045 - DNA, 13 bp, Homo sapiens
taaactatcagtt

SEQ ID NO: 301046 - DNA, 17 bp, Homo sapiens
taaactattggaaagta

SEQ ID NO: 301047 - DNA, 24 bp, Homo sapiens
taaactcctactgcttcctctgaa

SEQ ID NO: 301048 - DNA, 15 bp, Homo sapiens
taaactctaaacatt

SEQ ID NO: 301049 - DNA, 20 bp, Homo sapiens
taaactctaagtgtaaaaaa

SEQ ID NO: 301050 - DNA, 14 bp, Homo sapiens
taaactgactttat

SEQ ID NO: 301051 - DNA, 16 bp, Homo sapiens
taaactgactttatcc

SEQ ID NO: 301052 - DNA, 13 bp, Homo sapiens
taaactgccctgt

SEQ ID NO: 301053 - DNA, 22 bp, Homo sapiens
taaactgtatcaaatctgtata

SEQ ID NO: 301054 - DNA, 17 bp, Homo sapiens
taaactgtcctctttca

SEQ ID NO: 301055 - DNA, 18 bp, Homo sapiens
taaactgtcctctttcag

SEQ ID NO: 301056 - DNA, 18 bp, Homo sapiens
taaactgtgagataaata

SEQ ID NO: 301057 - DNA, 12 bp, Homo sapiens
taaactgttttc

SEQ ID NO: 301058 - DNA, 19 bp, Homo sapiens
taaacttagaataaaattg

SEQ ID NO: 301059 - DNA, 18 bp, Homo sapiens
taaacttataaatcatat

SEQ ID NO: 301060 - DNA, 14 bp, Homo sapiens
taaacttcacctac

SEQ ID NO: 301061 - DNA, 20 bp, Homo sapiens
taaacttcagagttctctgt

SEQ ID NO: 301062 - DNA, 14 bp, Homo sapiens
taaacttgcaatga

SEQ ID NO: 301063 - DNA, 23 bp, Homo sapiens
taaacttgcaatgaaaagaaaat

SEQ ID NO: 301064 - DNA, 20 bp, Homo sapiens
taaactttacccaaaaacta

SEQ ID NO: 301065 - DNA, 13 bp, Homo sapiens
taaactttgtcac

SEQ ID NO: 301066 - DNA, 15 bp, Homo sapiens
taaactttttcaatg

SEQ ID NO: 301067 - DNA, 22 bp, Homo sapiens
taaagaaaaaaatagttttaca

SEQ ID NO: 301068 - DNA, 23 bp, Homo sapiens
taaagaaaaaaatagttttacat

SEQ ID NO: 301069 - DNA, 16 bp, Homo sapiens
taaagaaaatgtgtct

SEQ ID NO: 301070 - DNA, 13 bp, Homo sapiens
taaagaaacactt

SEQ ID NO: 301071 - DNA, 14 bp, Homo sapiens
taaagaaacagctt

SEQ ID NO: 301072 - DNA, 13 bp, Homo sapiens
taaagaaaccttt

SEQ ID NO: 301073 - DNA, 16 bp, Homo sapiens
taaagaactaaatcat

SEQ ID NO: 301074 - DNA, 17 bp, Homo sapiens
taaagaactccttattt

SEQ ID NO: 301075 - DNA, 16 bp, Homo sapiens
taaagaagacacacag

SEQ ID NO: 301076 - DNA, 23 bp, Homo sapiens
taaagaatagtgcctcagcgctg

SEQ ID NO: 301077 - DNA, 17 bp, Homo sapiens
taaagaatcattattta

SEQ ID NO: 301078 - DNA, 15 bp, Homo sapiens
taaagacacctactg

SEQ ID NO: 301079 - DNA, 13 bp, Homo sapiens
taaagacttaaga

SEQ ID NO: 301080 - DNA, 14 bp, Homo sapiens
taaagagacaaata

SEQ ID NO: 301081 - DNA, 16 bp, Homo sapiens
taaagagacaaatagt

SEQ ID NO: 301082 - DNA, 18 bp, Homo sapiens
taaagagacaaatagtag

SEQ ID NO: 301083 - DNA, 12 bp, Homo sapiens
taaagagagaat

SEQ ID NO: 301084 - DNA, 19 bp, Homo sapiens
taaagaggcgtcttgtatt

SEQ ID NO: 301085 - DNA, 20 bp, Homo sapiens
taaagaggctgaaagaggcc

SEQ ID NO: 301086 - DNA, 23 bp, Homo sapiens
taaagaggtggggtgaagctggg

SEQ ID NO: 301087 - DNA, 20 bp, Homo sapiens
taaagatatcagagctctta

SEQ ID NO: 301088 - DNA, 11 bp, Homo sapiens
taaagatgatc

SEQ ID NO: 301089 - DNA, 22 bp, Homo sapiens
taaagatgtcaaatatctcaga

SEQ ID NO: 301090 - DNA, 13 bp, Homo sapiens
taaagatgtctgc

SEQ ID NO: 301091 - DNA, 17 bp, Homo sapiens
taaagatttttgttaag

SEQ ID NO: 301092 - DNA, 14 bp, Homo sapiens
taaagcaataagtt

SEQ ID NO: 301093 - DNA, 21 bp, Homo sapiens
taaagcaataagttcattaaa

SEQ ID NO: 301094 - DNA, 23 bp, Homo sapiens
taaagcaataagttcattaaaca

SEQ ID NO: 301095 - DNA, 15 bp, Homo sapiens
taaagcacattttaa

SEQ ID NO: 301096 - DNA, 19 bp, Homo sapiens
taaagcaggccttttgata

SEQ ID NO: 301097 - DNA, 20 bp, Homo sapiens
taaagcaggccttttgatat

SEQ ID NO: 301098 - DNA, 16 bp, Homo sapiens
taaagcagtgttttca

SEQ ID NO: 301099 - DNA, 11 bp, Homo sapiens
taaagccaagg

SEQ ID NO: 301100 - DNA, 23 bp, Homo sapiens
taaagccgccgttttcatgacca

SEQ ID NO: 301101 - DNA, 17 bp, Homo sapiens
taaagcgaatggaccat

SEQ ID NO: 301102 - DNA, 18 bp, Homo sapiens
taaagcgatatacagatg

SEQ ID NO: 301103 - DNA, 19 bp, Homo sapiens
taaagctactgatttcctt

SEQ ID NO: 301104 - DNA, 17 bp, Homo sapiens
taaagctgcctgtagtt

SEQ ID NO: 301105 - DNA, 16 bp, Homo sapiens
tactttttcattcttt

SEQ ID NO: 301106 - DNA, 13 bp, Homo sapiens
tactttttccttc

SEQ ID NO: 301107 - DNA, 18 bp, Homo sapiens
tactttttgtaaaaagct

SEQ ID NO: 301108 - DNA, 14 bp, Homo sapiens
tactttttttcaca

SEQ ID NO: 301109 - DNA, 15 bp, Homo sapiens
tagaaaacaggaaaa

SEQ ID NO: 301110 - DNA, 15 bp, Homo sapiens
tagaaaagcttccta

SEQ ID NO: 301111 - DNA, 15 bp, Homo sapiens
tagaaaccttaatat

SEQ ID NO: 301112 - DNA, 20 bp, Homo sapiens
tagaaagaaaagaccctgag

SEQ ID NO: 301113 - DNA, 21 bp, Homo sapiens
tagaaagaagcccaatattat

SEQ ID NO: 301114 - DNA, 18 bp, Homo sapiens
tagaaagccatattccag

SEQ ID NO: 301115 - DNA, 17 bp, Homo sapiens
tagaaagtcatctttga

SEQ ID NO: 301116 - DNA, 16 bp, Homo sapiens
tagaaataaatagcta

SEQ ID NO: 301117 - DNA, 22 bp, Homo sapiens
tagaaataagtggttatttctc

SEQ ID NO: 301118 - DNA, 15 bp, Homo sapiens
tagaaataatatgca

SEQ ID NO: 301119 - DNA, 11 bp, Homo sapiens
tagaaatactt

SEQ ID NO: 301120 - DNA, 14 bp, Homo sapiens
tagaaatatgattt

SEQ ID NO: 301121 - DNA, 22 bp, Homo sapiens
tagaaatgcataccagtaattg

SEQ ID NO: 301122 - DNA, 12 bp, Homo sapiens
tagaaattacaa

SEQ ID NO: 301123 - DNA, 13 bp, Homo sapiens
tagaaattacaag

SEQ ID NO: 301124 - DNA, 16 bp, Homo sapiens
tagaaattgttcctga

SEQ ID NO: 301125 - DNA, 17 bp, Homo sapiens
tagaaattttacaatag

SEQ ID NO: 301126 - DNA, 22 bp, Homo sapiens
tagaaattttacaataggtgct

SEQ ID NO: 301127 - DNA, 23 bp, Homo sapiens
tagaaattttatctcttcttcct

SEQ ID NO: 301128 - DNA, 15 bp, Homo sapiens
tagaacagaaaacaa

SEQ ID NO: 301129 - DNA, 16 bp, Homo sapiens
tagaacagaaaacaac

SEQ ID NO: 301130 - DNA, 16 bp, Homo sapiens
tagaaccactatgaag

SEQ ID NO: 301131 - DNA, 22 bp, Homo sapiens
tagaacgtgtttaattaaattt

SEQ ID NO: 301132 - DNA, 16 bp, Homo sapiens
tagaactggtcttcca

SEQ ID NO: 301133 - DNA, 23 bp, Homo sapiens
tagaactgtcccacaaaatattt

SEQ ID NO: 301134 - DNA, 21 bp, Homo sapiens
tagaactgttcatttccacca

SEQ ID NO: 301135 - DNA, 23 bp, Homo sapiens
tagaacttagttttgttccaaca

SEQ ID NO: 301136 - DNA, 23 bp, Homo sapiens
tagaacttcaagaagtaagagct

SEQ ID NO: 301137 - DNA, 17 bp, Homo sapiens
tagaagaaaacatatat

SEQ ID NO: 301138 - DNA, 20 bp, Homo sapiens
tagaagaaaagcactgggag

SEQ ID NO: 301139 - DNA, 14 bp, Homo sapiens
tagaagaaagcaaa

SEQ ID NO: 301140 - DNA, 20 bp, Homo sapiens
tagaagaaagcaaaaaataa

SEQ ID NO: 301141 - DNA, 21 bp, Homo sapiens
tagaagaaagcaaaaaataaa

SEQ ID NO: 301142 - DNA, 17 bp, Homo sapiens
tagaagagggagaagga

SEQ ID NO: 301143 - DNA, 18 bp, Homo sapiens
tagaagatgaatcagtat

SEQ ID NO: 301144 - DNA, 21 bp, Homo sapiens
tagaagatgaatcagtatgaa

SEQ ID NO: 301145 - DNA, 10 bp, Homo sapiens
tagaagccag

SEQ ID NO: 301146 - DNA, 16 bp, Homo sapiens
tagaagctgtagtagc

SEQ ID NO: 301147 - DNA, 14 bp, Homo sapiens
tagaaggagagccc

SEQ ID NO: 301148 - DNA, 19 bp, Homo sapiens
tagaagggccagtcctgcc

SEQ ID NO: 301149 - DNA, 21 bp, Homo sapiens
tagaaggtcggaggcttggga

SEQ ID NO: 301150 - DNA, 21 bp, Homo sapiens
tagaagtccaggcagagacaa

SEQ ID NO: 301151 - DNA, 23 bp, Homo sapiens
tagaagtccaggcagagacaata

SEQ ID NO: 301152 - DNA, 18 bp, Homo sapiens
tagaagtccatgagttga

SEQ ID NO: 301153 - DNA, 15 bp, Homo sapiens
tagaagtgcatttct

SEQ ID NO: 301154 - DNA, 16 bp, Homo sapiens
tagaagtgcatttctg

SEQ ID NO: 301155 - DNA, 18 bp, Homo sapiens
tagaagtgcatttctgaa

SEQ ID NO: 301156 - DNA, 14 bp, Homo sapiens
tagaataaaattgt

SEQ ID NO: 301157 - DNA, 22 bp, Homo sapiens
tagaataatgtgggaagaaaca

SEQ ID NO: 301158 - DNA, 12 bp, Homo sapiens
tagaatactttt

SEQ ID NO: 301159 - DNA, 21 bp, Homo sapiens
tagaatacttttttctagttt

SEQ ID NO: 301160 - DNA, 20 bp, Homo sapiens
tagaatagcatgttgtagat

SEQ ID NO: 301161 - DNA, 15 bp, Homo sapiens
tagaatataattatc

SEQ ID NO: 301162 - DNA, 17 bp, Homo sapiens
tagaatcaagtctgtga

SEQ ID NO: 301163 - DNA, 19 bp, Homo sapiens
tagaatccaaattctctga

SEQ ID NO: 301164 - DNA, 19 bp, Homo sapiens
tagaatctgtagaggagcc

SEQ ID NO: 301165 - DNA, 13 bp, Homo sapiens
tagaatggggctt

SEQ ID NO: 301166 - DNA, 17 bp, Homo sapiens
tagaattataagtcaca

SEQ ID NO: 301167 - DNA, 18 bp, Homo sapiens
tagaattccttttataag

SEQ ID NO: 301168 - DNA, 13 bp, Homo sapiens
tagaattgatttc

SEQ ID NO: 301169 - DNA, 21 bp, Homo sapiens
tagaattgatttccaagaatc

SEQ ID NO: 301170 - DNA, 15 bp, Homo sapiens
tagaatttattcaat

SEQ ID NO: 301171 - DNA, 16 bp, Homo sapiens
tagacaaaggcccaga

SEQ ID NO: 301172 - DNA, 13 bp, Homo sapiens
tagacaaaggcct

SEQ ID NO: 301173 - DNA, 18 bp, Homo sapiens
tagacaaaggccttaaca

SEQ ID NO: 301174 - DNA, 13 bp, Homo sapiens
tagacaaccatag

SEQ ID NO: 301175 - DNA, 17 bp, Homo sapiens
tagacaaggttgctgtt

SEQ ID NO: 301176 - DNA, 20 bp, Homo sapiens
tagacaatggctatattaat

SEQ ID NO: 301177 - DNA, 23 bp, Homo sapiens
tagacacccgccctgcccttccc

SEQ ID NO: 301178 - DNA, 15 bp, Homo sapiens
tagacactgaaggca

SEQ ID NO: 301179 - DNA, 15 bp, Homo sapiens
tagacagtattgcca

SEQ ID NO: 301180 - DNA, 19 bp, Homo sapiens
tagacattatcttttggct

SEQ ID NO: 301181 - DNA, 23 bp, Homo sapiens
tagactggagtgaggcttccagg

SEQ ID NO: 301182 - DNA, 13 bp, Homo sapiens
tagacttccccat

SEQ ID NO: 301183 - DNA, 15 bp, Homo sapiens
tagacttccccatcc

SEQ ID NO: 301184 - DNA, 18 bp, Homo sapiens
tagacttcgactcaggat

SEQ ID NO: 301185 - DNA, 13 bp, Homo sapiens
tagacttctggtt

SEQ ID NO: 301186 - DNA, 20 bp, Homo sapiens
tagagaaaatggaacattaa

SEQ ID NO: 301187 - DNA, 21 bp, Homo sapiens
tagagaaaatggaacattaac

SEQ ID NO: 301188 - DNA, 13 bp, Homo sapiens
tagagaacaaagg

SEQ ID NO: 301189 - DNA, 19 bp, Homo sapiens
tagagaacccagatgatct

SEQ ID NO: 301190 - DNA, 22 bp, Homo sapiens
tagagaagccttttccataaag

SEQ ID NO: 301191 - DNA, 13 bp, Homo sapiens
tagagaaggaccc

SEQ ID NO: 301192 - DNA, 16 bp, Homo sapiens
tagagaagtaagcaga

SEQ ID NO: 301193 - DNA, 20 bp, Homo sapiens
tagagaagtatccaattatg

SEQ ID NO: 301194 - DNA, 18 bp, Homo sapiens
tagagacagaagcaggct

SEQ ID NO: 301195 - DNA, 16 bp, Homo sapiens
tagagactagacaaat

SEQ ID NO: 301196 - DNA, 14 bp, Homo sapiens
tagagactgtagat

SEQ ID NO: 301197 - DNA, 15 bp, Homo sapiens
tagagactgtagatt

SEQ ID NO: 301198 - DNA, 21 bp, Homo sapiens
tagagagaggaggcagccccc

SEQ ID NO: 301199 - DNA, 20 bp, Homo sapiens
tagagaggggcctctggctg

SEQ ID NO: 301200 - DNA, 23 bp, Homo sapiens
tagagaggggcctctggctgcct

SEQ ID NO: 301201 - DNA, 13 bp, Homo sapiens
tagagagggggct

SEQ ID NO: 301202 - DNA, 20 bp, Homo sapiens
tagagatatttaaaagacaa

SEQ ID NO: 301203 - DNA, 18 bp, Homo sapiens
tagagatatttttatata

SEQ ID NO: 301204 - DNA, 22 bp, Homo sapiens
tagagatgctactgtcagtgtc

SEQ ID NO: 301205 - DNA, 23 bp, Homo sapiens
tagagatgctactgtcagtgtcc

SEQ ID NO: 301206 - DNA, 19 bp, Homo sapiens
tagagatggaggaggaggc

SEQ ID NO: 301207 - DNA, 17 bp, Homo sapiens
tagagattcccctggac

SEQ ID NO: 301208 - DNA, 15 bp, Homo sapiens
tagagatttcatagc

SEQ ID NO: 301209 - DNA, 21 bp, Homo sapiens
tagagcaaaattgatgtgttt

SEQ ID NO: 301210 - DNA, 15 bp, Homo sapiens
tagagcaaagactta

SEQ ID NO: 301211 - DNA, 19 bp, Homo sapiens
tagagcagatgacccctcc

SEQ ID NO: 301212 - DNA, 21 bp, Homo sapiens
tagagcagttaacatctgaag

SEQ ID NO: 301213 - DNA, 14 bp, Homo sapiens
tagagcatctgtcc

SEQ ID NO: 301214 - DNA, 23 bp, Homo sapiens
tagagcatctgtcccactgggac

SEQ ID NO: 301215 - DNA, 23 bp, Homo sapiens
tagagcattctggggtggggctt

SEQ ID NO: 301216 - DNA, 17 bp, Homo sapiens
tagagccagccttggtt

SEQ ID NO: 301217 - DNA, 13 bp, Homo sapiens
tagagcctttgat

SEQ ID NO: 301218 - DNA, 17 bp, Homo sapiens
tagagctagtctttcac

SEQ ID NO: 301219 - DNA, 12 bp, Homo sapiens
tagaggagcctg

SEQ ID NO: 301220 - DNA, 22 bp, Homo sapiens
tagaggatgggcagctgggggg

SEQ ID NO: 301221 - DNA, 19 bp, Homo sapiens
tagaggcatttgtcttaga

SEQ ID NO: 301222 - DNA, 12 bp, Homo sapiens
tagaggcctgag

SEQ ID NO: 301223 - DNA, 15 bp, Homo sapiens
tagaggcctgaggat

SEQ ID NO: 301224 - DNA, 17 bp, Homo sapiens
tagaggcgagccaggca

SEQ ID NO: 301225 - DNA, 18 bp, Homo sapiens
tagaggcgagccaggcaa

SEQ ID NO: 301226 - DNA, 13 bp, Homo sapiens
tagagggttcctg

SEQ ID NO: 301227 - DNA, 17 bp, Homo sapiens
tagagggttcctgtaga

SEQ ID NO: 301228 - DNA, 16 bp, Homo sapiens
tagaggtgggcagctg

SEQ ID NO: 301229 - DNA, 17 bp, Homo sapiens
tagagtatgcaagaaga

SEQ ID NO: 301230 - DNA, 21 bp, Homo sapiens
tagagtcacagctttcccagg

SEQ ID NO: 301231 - DNA, 22 bp, Homo sapiens
tagagtccaacgtggggcagca

SEQ ID NO: 301232 - DNA, 20 bp, Homo sapiens
tagagtcctcactcccagtc

SEQ ID NO: 301233 - DNA, 22 bp, Homo sapiens
tagagtgcccttaaaataatga

SEQ ID NO: 301234 - DNA, 22 bp, Homo sapiens
tagagtttatttttttgatggc

SEQ ID NO: 301235 - DNA, 17 bp, Homo sapiens
tagctagactaggagac

SEQ ID NO: 301236 - DNA, 18 bp, Homo sapiens
tagctagactaggagacc

SEQ ID NO: 301237 - DNA, 16 bp, Homo sapiens
tagctatcagaagacc

SEQ ID NO: 301238 - DNA, 14 bp, Homo sapiens
tagctattactgtc

SEQ ID NO: 301239 - DNA, 15 bp, Homo sapiens
tagctattactgtct

SEQ ID NO: 301240 - DNA, 12 bp, Homo sapiens
tagctattcttt

SEQ ID NO: 301241 - DNA, 16 bp, Homo sapiens
tagctatttctatgta

SEQ ID NO: 301242 - DNA, 14 bp, Homo sapiens
tagctcaagcctat

SEQ ID NO: 301243 - DNA, 14 bp, Homo sapiens
tagctcagccccag

SEQ ID NO: 301244 - DNA, 21 bp, Homo sapiens
tagctccccgcttctgcctgc

SEQ ID NO: 301245 - DNA, 19 bp, Homo sapiens
tagctccctcctcccatct

SEQ ID NO: 301246 - DNA, 11 bp, Homo sapiens
tagctccttca

SEQ ID NO: 301247 - DNA, 19 bp, Homo sapiens
tagctccttggagcaggca

SEQ ID NO: 301248 - DNA, 17 bp, Homo sapiens
tagctgaaacaaaaatg

SEQ ID NO: 301249 - DNA, 16 bp, Homo sapiens
tagctgggatttgaac

SEQ ID NO: 301250 - DNA, 23 bp, Homo sapiens
tagctgggatttgaactgagccg

SEQ ID NO: 301251 - DNA, 22 bp, Homo sapiens
tagctgtcctctcagaactcct

SEQ ID NO: 301252 - DNA, 18 bp, Homo sapiens
tagcttaaaaaaaggaaa

SEQ ID NO: 301253 - DNA, 20 bp, Homo sapiens
tagcttaaaaaaaggaaaac

SEQ ID NO: 301254 - DNA, 15 bp, Homo sapiens
tagcttaactaattt

SEQ ID NO: 301255 - DNA, 15 bp, Homo sapiens
tagcttacaggaagc

SEQ ID NO: 301256 - DNA, 14 bp, Homo sapiens
tagcttatctccct

SEQ ID NO: 301257 - DNA, 18 bp, Homo sapiens
tagcttcatcttgagcct

SEQ ID NO: 301258 - DNA, 13 bp, Homo sapiens
tagcttcctccag

SEQ ID NO: 301259 - DNA, 17 bp, Homo sapiens
tagcttctgacctcagc

SEQ ID NO: 301260 - DNA, 19 bp, Homo sapiens
tagcttctgacctcagcat

SEQ ID NO: 301261 - DNA, 20 bp, Homo sapiens
tagcttgattgctcagagaa

SEQ ID NO: 301262 - DNA, 18 bp, Homo sapiens
tagcttggcatggtggca

SEQ ID NO: 301263 - DNA, 17 bp, Homo sapiens
tagcttgtatagtgtaa

SEQ ID NO: 301264 - DNA, 15 bp, Homo sapiens
tagctttaccctcag

SEQ ID NO: 301265 - DNA, 18 bp, Homo sapiens
tagctttccacatttgtc

SEQ ID NO: 301266 - DNA, 18 bp, Homo sapiens
tagcttttattgtataaa

SEQ ID NO: 301267 - DNA, 13 bp, Homo sapiens
tagcttttccctt

SEQ ID NO: 301268 - DNA, 19 bp, Homo sapiens
taggaaaagtacatttaat

SEQ ID NO: 301269 - DNA, 18 bp, Homo sapiens
taggaaacagaaaagaga

SEQ ID NO: 301270 - DNA, 22 bp, Homo sapiens
taggaaacagaaaagagaagaa

SEQ ID NO: 301271 - DNA, 23 bp, Homo sapiens
taggaaacagaaaagagaagaaa

SEQ ID NO: 301272 - DNA, 21 bp, Homo sapiens
taggaaagagttgagcacagg

SEQ ID NO: 301273 - DNA, 17 bp, Homo sapiens
taggaaagatttaatgt

SEQ ID NO: 301274 - DNA, 21 bp, Homo sapiens
taggaaagcaccgcagcatgt

SEQ ID NO: 301275 - DNA, 15 bp, Homo sapiens
taggaaaggcagaaa

SEQ ID NO: 301276 - DNA, 17 bp, Homo sapiens
taggaaaggcagaaaca

SEQ ID NO: 301277 - DNA, 17 bp, Homo sapiens
taggaaataaaaccttt

SEQ ID NO: 301278 - DNA, 18 bp, Homo sapiens
taggaacagagtatatat

SEQ ID NO: 301279 - DNA, 16 bp, Homo sapiens
taggaacatatgaaaa

SEQ ID NO: 301280 - DNA, 12 bp, Homo sapiens
taggaacccggc

SEQ ID NO: 301281 - DNA, 15 bp, Homo sapiens
taggaagagaaacca

SEQ ID NO: 301282 - DNA, 19 bp, Homo sapiens
taggaagagaaaccaggga

SEQ ID NO: 301283 - DNA, 18 bp, Homo sapiens
taggaagtgtaacagctg

SEQ ID NO: 301284 - DNA, 12 bp, Homo sapiens
taggaataaata

SEQ ID NO: 301285 - DNA, 15 bp, Homo sapiens
taggaatagcatgtc

SEQ ID NO: 301286 - DNA, 14 bp, Homo sapiens
taggaatcccagag

SEQ ID NO: 301287 - DNA, 21 bp, Homo sapiens
taggaatcccagaggtgggat

SEQ ID NO: 301288 - DNA, 13 bp, Homo sapiens
taggaatgctcaa

SEQ ID NO: 301289 - DNA, 18 bp, Homo sapiens
taggaatgctcaatgtgc

SEQ ID NO: 301290 - DNA, 22 bp, Homo sapiens
taggaatgctcaatgtgctgtt

SEQ ID NO: 301291 - DNA, 23 bp, Homo sapiens
taggacatctctgtaaaaagcag

SEQ ID NO: 301292 - DNA, 15 bp, Homo sapiens
taggaccagttttgt

SEQ ID NO: 301293 - DNA, 15 bp, Homo sapiens
taggactatataaag

SEQ ID NO: 301294 - DNA, 19 bp, Homo sapiens
taggactcaggcctgccaa

SEQ ID NO: 301295 - DNA, 22 bp, Homo sapiens
taggactttagggatctgggga

SEQ ID NO: 301296 - DNA, 19 bp, Homo sapiens
taggagacacatccagcaa

SEQ ID NO: 301297 - DNA, 14 bp, Homo sapiens
taggagagaccgag

SEQ ID NO: 301298 - DNA, 11 bp, Homo sapiens
taggagcagcc

SEQ ID NO: 301299 - DNA, 21 bp, Homo sapiens
taggagctggatttgggagct

SEQ ID NO: 301300 - DNA, 19 bp, Homo sapiens
taggagctggctggcaggt

SEQ ID NO: 301301 - DNA, 19 bp, Homo sapiens
taggagcttccagatgggt

SEQ ID NO: 301302 - DNA, 18 bp, Homo sapiens
taggaggaatgtgctttt

SEQ ID NO: 301303 - DNA, 22 bp, Homo sapiens
taggatttaacagtcatttaaa

SEQ ID NO: 301304 - DNA, 18 bp, Homo sapiens
taggcaactattaataat

SEQ ID NO: 301305 - DNA, 19 bp, Homo sapiens
taggcaaggatgaaagaca

SEQ ID NO: 301306 - DNA, 23 bp, Homo sapiens
taggcaaggatgaaagacaaaga

SEQ ID NO: 301307 - DNA, 12 bp, Homo sapiens
taggcagcctct

SEQ ID NO: 301308 - DNA, 14 bp, Homo sapiens
taggcaggaagtca

SEQ ID NO: 301309 - DNA, 17 bp, Homo sapiens
taggcaggaagtcagga

SEQ ID NO: 301310 - DNA, 18 bp, Homo sapiens
taggcaggaagtcaggag

SEQ ID NO: 301311 - DNA, 20 bp, Homo sapiens
taggcaggaagtcaggagcc

SEQ ID NO: 301312 - DNA, 18 bp, Homo sapiens
taggcagttagagatgcc

SEQ ID NO: 301313 - DNA, 18 bp, Homo sapiens
taggcatactctccagga

SEQ ID NO: 301314 - DNA, 21 bp, Homo sapiens
taggcattctttagtctacat

SEQ ID NO: 301315 - DNA, 14 bp, Homo sapiens
taggcatttgtaaa

SEQ ID NO: 301316 - DNA, 19 bp, Homo sapiens
taggccaccccctatcctc

SEQ ID NO: 301317 - DNA, 15 bp, Homo sapiens
taggccatctgtaaa

SEQ ID NO: 301318 - DNA, 17 bp, Homo sapiens
taggccatctgtaaata

SEQ ID NO: 301319 - DNA, 13 bp, Homo sapiens
taggcccttgtcc

SEQ ID NO: 301320 - DNA, 23 bp, Homo sapiens
taggcccttgtcctgccagctgc

SEQ ID NO: 301321 - DNA, 16 bp, Homo sapiens
taggccggccagctcc

SEQ ID NO: 301322 - DNA, 20 bp, Homo sapiens
taggcctcagtgtcctcatc

SEQ ID NO: 301323 - DNA, 15 bp, Homo sapiens
taggcggcgattttt

SEQ ID NO: 301324 - DNA, 16 bp, Homo sapiens
taggcgtgagaagcat

SEQ ID NO: 301325 - DNA, 17 bp, Homo sapiens
taggctacccttgccaa

SEQ ID NO: 301326 - DNA, 17 bp, Homo sapiens
taggctataagaagtag

SEQ ID NO: 301327 - DNA, 22 bp, Homo sapiens
taggctccgtcagtatcaggcc

SEQ ID NO: 301328 - DNA, 18 bp, Homo sapiens
taggctctgcacagatgg

SEQ ID NO: 301329 - DNA, 20 bp, Homo sapiens
taggctctgcacagatggat

SEQ ID NO: 301330 - DNA, 18 bp, Homo sapiens
taggctgggtgcccacag

SEQ ID NO: 301331 - DNA, 20 bp, Homo sapiens
taggcttctatgtccaacag

SEQ ID NO: 301332 - DNA, 16 bp, Homo sapiens
tagggaaaagttcata

SEQ ID NO: 301333 - DNA, 21 bp, Homo sapiens
tagggaagcagggacaccccc

SEQ ID NO: 301334 - DNA, 11 bp, Homo sapiens
tagggagaagg

SEQ ID NO: 301335 - DNA, 18 bp, Homo sapiens
tagggagacccaataaag

SEQ ID NO: 301336 - DNA, 19 bp, Homo sapiens
tagggatctggggaaggac

SEQ ID NO: 301337 - DNA, 16 bp, Homo sapiens
tagggattcaggctgc

SEQ ID NO: 301338 - DNA, 19 bp, Homo sapiens
tagggccagggctctggca

SEQ ID NO: 301339 - DNA, 17 bp, Homo sapiens
tagggctctaatttcct

SEQ ID NO: 301340 - DNA, 14 bp, Homo sapiens
tagggctggaccta

SEQ ID NO: 301341 - DNA, 21 bp, Homo sapiens
taggggccgagtccaggagcc

SEQ ID NO: 301342 - DNA, 17 bp, Homo sapiens
taggggtcaggctccat

SEQ ID NO: 301343 - DNA, 23 bp, Homo sapiens
taggggtgcgctcacctgcagcc

SEQ ID NO: 301344 - DNA, 11 bp, Homo sapiens
taggggtgggg

SEQ ID NO: 301345 - DNA, 14 bp, Homo sapiens
taggggtgggggag

SEQ ID NO: 301346 - DNA, 14 bp, Homo sapiens
tagggtaaaaattg

SEQ ID NO: 301347 - DNA, 16 bp, Homo sapiens
tagggtccttgaaaca

SEQ ID NO: 301348 - DNA, 15 bp, Homo sapiens
tagggtggacagaag

SEQ ID NO: 301349 - DNA, 17 bp, Homo sapiens
tagggttataataatgt

SEQ ID NO: 301350 - DNA, 18 bp, Homo sapiens
tagggttgctggagcctg

SEQ ID NO: 301351 - DNA, 13 bp, Homo sapiens
taggtaacacatt

SEQ ID NO: 301352 - DNA, 17 bp, Homo sapiens
taggtagaggcatttgt

SEQ ID NO: 301353 - DNA, 18 bp, Homo sapiens
taggtataaaaaataagt

SEQ ID NO: 301354 - DNA, 22 bp, Homo sapiens
taggtataaaaaataagtaaag

SEQ ID NO: 301355 - DNA, 17 bp, Homo sapiens
taggtatacaaaagact

SEQ ID NO: 301356 - DNA, 21 bp, Homo sapiens
taggtcccagaatggaaaaaa

SEQ ID NO: 301357 - DNA, 15 bp, Homo sapiens
taggtctccacccct

SEQ ID NO: 301358 - DNA, 16 bp, Homo sapiens
taggtctccacccctc

SEQ ID NO: 301359 - DNA, 20 bp, Homo sapiens
taggtctcctcagggtgggg

SEQ ID NO: 301360 - DNA, 17 bp, Homo sapiens
taggtctgcattttctc

SEQ ID NO: 301361 - DNA, 19 bp, Homo sapiens
taggtctgcattttctcag

SEQ ID NO: 301362 - DNA, 20 bp, Homo sapiens
taggtctgcattttctcagg

SEQ ID NO: 301363 - DNA, 22 bp, Homo sapiens
taggtgggattacaggtgccca

SEQ ID NO: 301364 - DNA, 23 bp, Homo sapiens
taggtgggccagcccctcccacc

SEQ ID NO: 301365 - DNA, 15 bp, Homo sapiens
tataaaaaaattgta

SEQ ID NO: 301366 - DNA, 14 bp, Homo sapiens
tataaaaaataagt

SEQ ID NO: 301367 - DNA, 15 bp, Homo sapiens
tataaaaaataagta

SEQ ID NO: 301368 - DNA, 21 bp, Homo sapiens
tataaaaagaaaagataaaga

SEQ ID NO: 301369 - DNA, 23 bp, Homo sapiens
tataaaaagaaaagataaagatg

SEQ ID NO: 301370 - DNA, 22 bp, Homo sapiens
tataaaaataaaaaagatccca

SEQ ID NO: 301371 - DNA, 13 bp, Homo sapiens
tataaaactcagt

SEQ ID NO: 301372 - DNA, 13 bp, Homo sapiens
tataaaataaata

SEQ ID NO: 301373 - DNA, 14 bp, Homo sapiens
tataaaataaatat

SEQ ID NO: 301374 - DNA, 15 bp, Homo sapiens
tataaaataaatata

SEQ ID NO: 301375 - DNA, 17 bp, Homo sapiens
tataaaataaatatact

SEQ ID NO: 301376 - DNA, 19 bp, Homo sapiens
tataaaataaatatactaa

SEQ ID NO: 301377 - DNA, 23 bp, Homo sapiens
tataaaataaatatactaataaa

SEQ ID NO: 301378 - DNA, 19 bp, Homo sapiens
tataaaatctagatcaatt

SEQ ID NO: 301379 - DNA, 13 bp, Homo sapiens
tataaaatctttc

SEQ ID NO: 301380 - DNA, 21 bp, Homo sapiens
tataaaatgcaaaataaatgt

SEQ ID NO: 301381 - DNA, 22 bp, Homo sapiens
tataaaatggtgttttcatgta

SEQ ID NO: 301382 - DNA, 18 bp, Homo sapiens
tataaaatgtattcaagc

SEQ ID NO: 301383 - DNA, 19 bp, Homo sapiens
tataaaatgtattcaagca

SEQ ID NO: 301384 - DNA, 15 bp, Homo sapiens
tataaacacattgaa

SEQ ID NO: 301385 - DNA, 18 bp, Homo sapiens
tataaacacattgaatgc

SEQ ID NO: 301386 - DNA, 18 bp, Homo sapiens
tataaacactgtattgta

SEQ ID NO: 301387 - DNA, 17 bp, Homo sapiens
tataaacatcacacaca

SEQ ID NO: 301388 - DNA, 17 bp, Homo sapiens
tataaacattaaaagaa

SEQ ID NO: 301389 - DNA, 15 bp, Homo sapiens
tataaaccataaaat

SEQ ID NO: 301390 - DNA, 17 bp, Homo sapiens
tataaaccttaaatgaa

SEQ ID NO: 301391 - DNA, 21 bp, Homo sapiens
tataaactaattttgtacgta

SEQ ID NO: 301392 - DNA, 13 bp, Homo sapiens
tataaactgtgag

SEQ ID NO: 301393 - DNA, 14 bp, Homo sapiens
tataaactgtgaga

SEQ ID NO: 301394 - DNA, 15 bp, Homo sapiens
tataaactgtgagat

SEQ ID NO: 301395 - DNA, 16 bp, Homo sapiens
tataaactgtgagata

SEQ ID NO: 301396 - DNA, 23 bp, Homo sapiens
tataaacttagtgcggacaagtt

SEQ ID NO: 301397 - DNA, 15 bp, Homo sapiens
tataaagaacaaggt

SEQ ID NO: 301398 - DNA, 15 bp, Homo sapiens
tataaagcagtagac

SEQ ID NO: 301399 - DNA, 21 bp, Homo sapiens
tataaagcgatatacagatga

SEQ ID NO: 301400 - DNA, 23 bp, Homo sapiens
tataaagcgatatacagatgaaa

SEQ ID NO: 301401 - DNA, 23 bp, Homo sapiens
tataaagtgcaattgcacaaata

SEQ ID NO: 301402 - DNA, 15 bp, Homo sapiens
tataaataaagcaaa

SEQ ID NO: 301403 - DNA, 17 bp, Homo sapiens
tataaatatgaaatgat

SEQ ID NO: 301404 - DNA, 15 bp, Homo sapiens
tataaatcaatgtca

SEQ ID NO: 301405 - DNA, 16 bp, Homo sapiens
tataaatcaatgtcac

SEQ ID NO: 301406 - DNA, 18 bp, Homo sapiens
tataaatcatattgatga

SEQ ID NO: 301407 - DNA, 22 bp, Homo sapiens
tataaatcatattgatgaaaag

SEQ ID NO: 301408 - DNA, 24 bp, Homo sapiens
tataaatgaagtttatacagtaca

SEQ ID NO: 301409 - DNA, 20 bp, Homo sapiens
tataaatgaatgaaatataa

SEQ ID NO: 301410 - DNA, 22 bp, Homo sapiens
tataaatggacttgcttcttgt

SEQ ID NO: 301411 - DNA, 18 bp, Homo sapiens
tataaatggtgagaatta

SEQ ID NO: 301412 - DNA, 18 bp, Homo sapiens
tataaatgtaaaaatgaa

SEQ ID NO: 301413 - DNA, 13 bp, Homo sapiens
tataaatgtgtgg

SEQ ID NO: 301414 - DNA, 14 bp, Homo sapiens
tataaatgtgtggt

SEQ ID NO: 301415 - DNA, 19 bp, Homo sapiens
tataaatgtttatattgtt

SEQ ID NO: 301416 - DNA, 11 bp, Homo sapiens
tataaattaaa

SEQ ID NO: 301417 - DNA, 19 bp, Homo sapiens
tataaattaaatatatgta

SEQ ID NO: 301418 - DNA, 16 bp, Homo sapiens
tataaattattacttt

SEQ ID NO: 301419 - DNA, 15 bp, Homo sapiens
tataacaaactatgt

SEQ ID NO: 301420 - DNA, 21 bp, Homo sapiens
tataacaacactaatacacta

SEQ ID NO: 301421 - DNA, 15 bp, Homo sapiens
tataacagctcaaag

SEQ ID NO: 301422 - DNA, 19 bp, Homo sapiens
tataaccaacttttctatt

SEQ ID NO: 301423 - DNA, 15 bp, Homo sapiens
tataaccccagcctg

SEQ ID NO: 301424 - DNA, 16 bp, Homo sapiens
tataaccccagcctga

SEQ ID NO: 301425 - DNA, 16 bp, Homo sapiens
tataactcatcataaa

SEQ ID NO: 301426 - DNA, 17 bp, Homo sapiens
tataactcatcataaaa

SEQ ID NO: 301427 - DNA, 19 bp, Homo sapiens
tataactcatcataaaata

SEQ ID NO: 301428 - DNA, 20 bp, Homo sapiens
tataactcatcataaaataa

SEQ ID NO: 301429 - DNA, 20 bp, Homo sapiens
tataacttaaaaatgtaaat

SEQ ID NO: 301430 - DNA, 17 bp, Homo sapiens
tataagaaaacatgtaa

SEQ ID NO: 301431 - DNA, 12 bp, Homo sapiens
tataagaagtag

SEQ ID NO: 301432 - DNA, 17 bp, Homo sapiens
tataagatttaattgta

SEQ ID NO: 301433 - DNA, 16 bp, Homo sapiens
tataagcatggagaac

SEQ ID NO: 301434 - DNA, 18 bp, Homo sapiens
tataagcattgaaattat

SEQ ID NO: 301435 - DNA, 14 bp, Homo sapiens
tataagctgaataa

SEQ ID NO: 301436 - DNA, 14 bp, Homo sapiens
tataagctgggaaa

SEQ ID NO: 301437 - DNA, 17 bp, Homo sapiens
tataaggaaatccagcc

SEQ ID NO: 301438 - DNA, 20 bp, Homo sapiens
tataaggaaatccagcccca

SEQ ID NO: 301439 - DNA, 12 bp, Homo sapiens
tataaggactgc

SEQ ID NO: 301440 - DNA, 15 bp, Homo sapiens
tataaggactgcatg

SEQ ID NO: 301441 - DNA, 21 bp, Homo sapiens
tataaggactgcatggtaatt

SEQ ID NO: 301442 - DNA, 17 bp, Homo sapiens
tataagtagatttgtag

SEQ ID NO: 301443 - DNA, 14 bp, Homo sapiens
tataagttgacctt

SEQ ID NO: 301444 - DNA, 18 bp, Homo sapiens
tataataaatgggaaatg

SEQ ID NO: 301445 - DNA, 20 bp, Homo sapiens
tataatacttaaaaatatgt

SEQ ID NO: 301446 - DNA, 20 bp, Homo sapiens
tataatatactatatttatg

SEQ ID NO: 301447 - DNA, 13 bp, Homo sapiens
tataatatatgtt

SEQ ID NO: 301448 - DNA, 18 bp, Homo sapiens
tataatgaatgaaacatt

SEQ ID NO: 301449 - DNA, 18 bp, Homo sapiens
tataatggcctcttaaaa

SEQ ID NO: 301450 - DNA, 15 bp, Homo sapiens
tataatggtttactg

SEQ ID NO: 301451 - DNA, 22 bp, Homo sapiens
tataatgtttccctcaagaaca

SEQ ID NO: 301452 - DNA, 22 bp, Homo sapiens
tataattatgttattgaaaaaa

SEQ ID NO: 301453 - DNA, 17 bp, Homo sapiens
tataattctatactgtt

SEQ ID NO: 301454 - DNA, 14 bp, Homo sapiens
tataattctgtaaa

SEQ ID NO: 301455 - DNA, 15 bp, Homo sapiens
tataattctgtaaat

SEQ ID NO: 301456 - DNA, 19 bp, Homo sapiens
tataattttaaaattgcag

SEQ ID NO: 301457 - DNA, 13 bp, Homo sapiens
tataattttcact

SEQ ID NO: 301458 - DNA, 18 bp, Homo sapiens
tataatttttttcaatat

SEQ ID NO: 301459 - DNA, 21 bp, Homo sapiens
tataatttttttcaatattta

SEQ ID NO: 301460 - DNA, 17 bp, Homo sapiens
tatacaaacaggtgcta

SEQ ID NO: 301461 - DNA, 21 bp, Homo sapiens
tatacaactttggaatttgaa

SEQ ID NO: 301462 - DNA, 21 bp, Homo sapiens
tatacacttacactttatgca

SEQ ID NO: 301463 - DNA, 12 bp, Homo sapiens
tatacagaccta

SEQ ID NO: 301464 - DNA, 19 bp, Homo sapiens
tatacagacctaatatcat

SEQ ID NO: 301465 - DNA, 20 bp, Homo sapiens
tatacagacctaatatcatt

SEQ ID NO: 301466 - DNA, 14 bp, Homo sapiens
tatacagatgaaaa

SEQ ID NO: 301467 - DNA, 16 bp, Homo sapiens
tatacagtacagtggt

SEQ ID NO: 301468 - DNA, 16 bp, Homo sapiens
tatacagttttaaaga

SEQ ID NO: 301469 - DNA, 21 bp, Homo sapiens
tatacagtttttgtaaccata

SEQ ID NO: 301470 - DNA, 21 bp, Homo sapiens
tatacataacagggtaaatta

SEQ ID NO: 301471 - DNA, 23 bp, Homo sapiens
tatacataacagggtaaattatt

SEQ ID NO: 301472 - DNA, 18 bp, Homo sapiens
tatacatacctctctcta

SEQ ID NO: 301473 - DNA, 16 bp, Homo sapiens
tatacatagtctttgt

SEQ ID NO: 301474 - DNA, 11 bp, Homo sapiens
tatacattcct

SEQ ID NO: 301475 - DNA, 12 bp, Homo sapiens
tatacattcctg

SEQ ID NO: 301476 - DNA, 13 bp, Homo sapiens
tatacattcctga

SEQ ID NO: 301477 - DNA, 23 bp, Homo sapiens
tatacattcctgagattctggga

SEQ ID NO: 301478 - DNA, 22 bp, Homo sapiens
tatacattctttatcttgacat

SEQ ID NO: 301479 - DNA, 21 bp, Homo sapiens
tatacatttcataaggcctgc

SEQ ID NO: 301480 - DNA, 13 bp, Homo sapiens
tatacatttctgt

SEQ ID NO: 301481 - DNA, 16 bp, Homo sapiens
tataccacctgtacat

SEQ ID NO: 301482 - DNA, 17 bp, Homo sapiens
tataccacctgtacata

SEQ ID NO: 301483 - DNA, 13 bp, Homo sapiens
tataccagagacc

SEQ ID NO: 301484 - DNA, 22 bp, Homo sapiens
tataccccttacttagcatgca

SEQ ID NO: 301485 - DNA, 21 bp, Homo sapiens
tataccctaggtctccacccc

SEQ ID NO: 301486 - DNA, 20 bp, Homo sapiens
tatacctggcttttacttta

SEQ ID NO: 301487 - DNA, 14 bp, Homo sapiens
tatactaataaaaa

SEQ ID NO: 301488 - DNA, 23 bp, Homo sapiens
tatactatttattaaaaccattc

SEQ ID NO: 301489 - DNA, 22 bp, Homo sapiens
tatactcagggattccttctaa

SEQ ID NO: 301490 - DNA, 23 bp, Homo sapiens
tatactcagggattccttctaag

SEQ ID NO: 301491 - DNA, 16 bp, Homo sapiens
tatactgaagtctttt

SEQ ID NO: 301492 - DNA, 11 bp, Homo sapiens
tatactgcata

SEQ ID NO: 301493 - DNA, 22 bp, Homo sapiens
tatactgcatatcctggtgtct

SEQ ID NO: 301494 - DNA, 16 bp, Homo sapiens
tatactgggttcttgt

SEQ ID NO: 301495 - DNA, 20 bp, Homo sapiens
tatcttctgtttttctcaaa

SEQ ID NO: 301496 - DNA, 12 bp, Homo sapiens
tatcttgaagaa

SEQ ID NO: 301497 - DNA, 13 bp, Homo sapiens
tatcttgaagaat

SEQ ID NO: 301498 - DNA, 20 bp, Homo sapiens
tatcttggactgacatttag

SEQ ID NO: 301499 - DNA, 15 bp, Homo sapiens
tatcttgtctctggg

SEQ ID NO: 301500 - DNA, 17 bp, Homo sapiens
tatcttgtctctgggct

SEQ ID NO: 301501 - DNA, 12 bp, Homo sapiens
tatctttcagtt

SEQ ID NO: 301502 - DNA, 23 bp, Homo sapiens
tatcttttattttcctgtcttct

SEQ ID NO: 301503 - DNA, 21 bp, Homo sapiens
tatcttttcatttatcaagca

SEQ ID NO: 301504 - DNA, 20 bp, Homo sapiens
tatcttttggctctgaagaa

SEQ ID NO: 301505 - DNA, 19 bp, Homo sapiens
tatgaaaaaaatatatttt

SEQ ID NO: 301506 - DNA, 19 bp, Homo sapiens
tatgaaaatgagcatcaga

SEQ ID NO: 301507 - DNA, 21 bp, Homo sapiens
tatgaaatgataaagatgtca

SEQ ID NO: 301508 - DNA, 21 bp, Homo sapiens
tatgaacagggcccaggcctg

SEQ ID NO: 301509 - DNA, 14 bp, Homo sapiens
tatgaacatgcagt

SEQ ID NO: 301510 - DNA, 17 bp, Homo sapiens
tatgaacttaacatgct

SEQ ID NO: 301511 - DNA, 19 bp, Homo sapiens
tatgaacttgaggacacat

SEQ ID NO: 301512 - DNA, 22 bp, Homo sapiens
tatgaacttgaggacacatgtc

SEQ ID NO: 301513 - DNA, 17 bp, Homo sapiens
tatgaagacactgtcaa

SEQ ID NO: 301514 - DNA, 21 bp, Homo sapiens
tatgaagacactgtcaatgag

SEQ ID NO: 301515 - DNA, 19 bp, Homo sapiens
tatgaagactacttttaga

SEQ ID NO: 301516 - DNA, 13 bp, Homo sapiens
tatgaagtaagtt

SEQ ID NO: 301517 - DNA, 14 bp, Homo sapiens
tatgaagtgtgggg

SEQ ID NO: 301518 - DNA, 19 bp, Homo sapiens
tatgaataattatgtttac

SEQ ID NO: 301519 - DNA, 22 bp, Homo sapiens
tatgaataattatgtttacctc

SEQ ID NO: 301520 - DNA, 18 bp, Homo sapiens
tatgaattagccaaaaga

SEQ ID NO: 301521 - DNA, 13 bp, Homo sapiens
tatgaattcaaga

SEQ ID NO: 301522 - DNA, 18 bp, Homo sapiens
tatgaattcaagaaagga

SEQ ID NO: 301523 - DNA, 17 bp, Homo sapiens
tatgaatttaaatataa

SEQ ID NO: 301524 - DNA, 19 bp, Homo sapiens
tatgaatttaaatataatt

SEQ ID NO: 301525 - DNA, 15 bp, Homo sapiens
tatgacaatttcaaa

SEQ ID NO: 301526 - DNA, 17 bp, Homo sapiens
tatgacaatttcaaaat

SEQ ID NO: 301527 - DNA, 15 bp, Homo sapiens
tatgacagttatact

SEQ ID NO: 301528 - DNA, 12 bp, Homo sapiens
tatgacatttct

SEQ ID NO: 301529 - DNA, 20 bp, Homo sapiens
tatgacctcaacaaagaaga

SEQ ID NO: 301530 - DNA, 16 bp, Homo sapiens
tatgactaaagagaga

SEQ ID NO: 301531 - DNA, 17 bp, Homo sapiens
tatgactaaagagagaa

SEQ ID NO: 301532 - DNA, 19 bp, Homo sapiens
tatgactaaagagagaatg

SEQ ID NO: 301533 - DNA, 20 bp, Homo sapiens
tatgactaaagagagaatgt

SEQ ID NO: 301534 - DNA, 16 bp, Homo sapiens
tatgactaattcacaa

SEQ ID NO: 301535 - DNA, 13 bp, Homo sapiens
tatgacttcttgt

SEQ ID NO: 301536 - DNA, 19 bp, Homo sapiens
tatgagaaaaaaacagcag

SEQ ID NO: 301537 - DNA, 23 bp, Homo sapiens
tatgagaactggttcttgccttc

SEQ ID NO: 301538 - DNA, 18 bp, Homo sapiens
tatgagaagtactttgtg

SEQ ID NO: 301539 - DNA, 21 bp, Homo sapiens
tatgagaagtactttgtgctg

SEQ ID NO: 301540 - DNA, 16 bp, Homo sapiens
tatgagatggccatgc

SEQ ID NO: 301541 - DNA, 19 bp, Homo sapiens
tatgagatggccatgctca

SEQ ID NO: 301542 - DNA, 21 bp, Homo sapiens
tatgagatggccatgctcaac

SEQ ID NO: 301543 - DNA, 20 bp, Homo sapiens
tatgagattggaaaaaatta

SEQ ID NO: 301544 - DNA, 16 bp, Homo sapiens
tatgagccagacaaat

SEQ ID NO: 301545 - DNA, 17 bp, Homo sapiens
tatgagccagacaaatg

SEQ ID NO: 301546 - DNA, 19 bp, Homo sapiens
tatgagccagacaaatgga

SEQ ID NO: 301547 - DNA, 18 bp, Homo sapiens
tatgagcttccttctgtg

SEQ ID NO: 301548 - DNA, 20 bp, Homo sapiens
tatgaggacaaggtatacac

SEQ ID NO: 301549 - DNA, 22 bp, Homo sapiens
tatgagggcatgtgatattttc

SEQ ID NO: 301550 - DNA, 17 bp, Homo sapiens
tatgaggggactgcatg

SEQ ID NO: 301551 - DNA, 17 bp, Homo sapiens
tatgagtcaatgtgcag

SEQ ID NO: 301552 - DNA, 23 bp, Homo sapiens
tatgagtcaatgtgcagtgtagc

SEQ ID NO: 301553 - DNA, 15 bp, Homo sapiens
tatgataaaacactg

SEQ ID NO: 301554 - DNA, 16 bp, Homo sapiens
tatgataaaaggaagt

SEQ ID NO: 301555 - DNA, 15 bp, Homo sapiens
tatgataggcagcac

SEQ ID NO: 301556 - DNA, 19 bp, Homo sapiens
tatgatataataaatatat

SEQ ID NO: 301557 - DNA, 19 bp, Homo sapiens
tatgatatataaaccttaa

SEQ ID NO: 301558 - DNA, 15 bp, Homo sapiens
tatgatatatatgta

SEQ ID NO: 301559 - DNA, 22 bp, Homo sapiens
tatgatatgcatgtagcatata

SEQ ID NO: 301560 - DNA, 16 bp, Homo sapiens
tatgatctctgctttg

SEQ ID NO: 301561 - DNA, 13 bp, Homo sapiens
tatgatctgtgga

SEQ ID NO: 301562 - DNA, 15 bp, Homo sapiens
tatgatctgtggaga

SEQ ID NO: 301563 - DNA, 22 bp, Homo sapiens
tatgatctgtggagaatgtaca

SEQ ID NO: 301564 - DNA, 19 bp, Homo sapiens
tatgatgtttaaaagcata

SEQ ID NO: 301565 - DNA, 15 bp, Homo sapiens
tatgattctcctctc

SEQ ID NO: 301566 - DNA, 16 bp, Homo sapiens
tatgattctcctctcc

SEQ ID NO: 301567 - DNA, 16 bp, Homo sapiens
tatgattgaaaagaag

SEQ ID NO: 301568 - DNA, 17 bp, Homo sapiens
tatgattgaaaagaaga

SEQ ID NO: 301569 - DNA, 19 bp, Homo sapiens
tatgattgaaaagaagaaa

SEQ ID NO: 301570 - DNA, 18 bp, Homo sapiens
tatgattgtaacatattt

SEQ ID NO: 301571 - DNA, 14 bp, Homo sapiens
tatgatttatagtt

SEQ ID NO: 301572 - DNA, 15 bp, Homo sapiens
tatgatttatagttt

SEQ ID NO: 301573 - DNA, 12 bp, Homo sapiens
tatgatttcatg

SEQ ID NO: 301574 - DNA, 18 bp, Homo sapiens
tatgattttatttaaact

SEQ ID NO: 301575 - DNA, 23 bp, Homo sapiens
tatgcaagtcgccaggcaggagg

SEQ ID NO: 301576 - DNA, 23 bp, Homo sapiens
tatgcaagtgggagatgaaaacc

SEQ ID NO: 301577 - DNA, 22 bp, Homo sapiens
tatgcacaccaaattgctgaga

SEQ ID NO: 301578 - DNA, 21 bp, Homo sapiens
tatgcacacctcccaccccct

SEQ ID NO: 301579 - DNA, 18 bp, Homo sapiens
tatgcacctataaatact

SEQ ID NO: 301580 - DNA, 19 bp, Homo sapiens
tatgcagcatacaaaaata

SEQ ID NO: 301581 - DNA, 20 bp, Homo sapiens
tatgcagcatacaaaaatat

SEQ ID NO: 301582 - DNA, 23 bp, Homo sapiens
tatgcagcatacaaaaatatatt

SEQ ID NO: 301583 - DNA, 19 bp, Homo sapiens
tatgcatctttgagaatat

SEQ ID NO: 301584 - DNA, 21 bp, Homo sapiens
tatgcatgagaactaaataga

SEQ ID NO: 301585 - DNA, 22 bp, Homo sapiens
tatgcatgtagcatataaatgt

SEQ ID NO: 301586 - DNA, 17 bp, Homo sapiens
tatgcatttatgcatga

SEQ ID NO: 301587 - DNA, 18 bp, Homo sapiens
tatgcatttatgcatgag

SEQ ID NO: 301588 - DNA, 19 bp, Homo sapiens
tatgcatttatgcatgaga

SEQ ID NO: 301589 - DNA, 20 bp, Homo sapiens
tatgccacctgcagcgtctg

SEQ ID NO: 301590 - DNA, 14 bp, Homo sapiens
tatgccatgatgga

SEQ ID NO: 301591 - DNA, 17 bp, Homo sapiens
tatgccatgatggaaat

SEQ ID NO: 301592 - DNA, 14 bp, Homo sapiens
tatgccatttgttt

SEQ ID NO: 301593 - DNA, 20 bp, Homo sapiens
tatgccctcagatggagaca

SEQ ID NO: 301594 - DNA, 14 bp, Homo sapiens
tatgcctgtggtga

SEQ ID NO: 301595 - DNA, 14 bp, Homo sapiens
tatgccttcttatt

SEQ ID NO: 301596 - DNA, 22 bp, Homo sapiens
tatgcctttaaatctgtgatga

SEQ ID NO: 301597 - DNA, 16 bp, Homo sapiens
tatgctacttttactt

SEQ ID NO: 301598 - DNA, 21 bp, Homo sapiens
tatgctagtttattggaagtg

SEQ ID NO: 301599 - DNA, 22 bp, Homo sapiens
tatgctgagtatgttaagctct

SEQ ID NO: 301600 - DNA, 15 bp, Homo sapiens
tatgctgctgtgaat

SEQ ID NO: 301601 - DNA, 22 bp, Homo sapiens
tatgcttatacacttacacttt

SEQ ID NO: 301602 - DNA, 13 bp, Homo sapiens
tatggaacttcta

SEQ ID NO: 301603 - DNA, 20 bp, Homo sapiens
tatggaacttctaatatatt

SEQ ID NO: 301604 - DNA, 14 bp, Homo sapiens
tatggaattacatg

SEQ ID NO: 301605 - DNA, 21 bp, Homo sapiens
tatggacatcgatatgaaaaa

SEQ ID NO: 301606 - DNA, 13 bp, Homo sapiens
tatggagcctctg

SEQ ID NO: 301607 - DNA, 18 bp, Homo sapiens
tatggaggattctttccc

SEQ ID NO: 301608 - DNA, 21 bp, Homo sapiens
tatggaggattctttccccag

SEQ ID NO: 301609 - DNA, 14 bp, Homo sapiens
tatggcaaaaatgg

SEQ ID NO: 301610 - DNA, 15 bp, Homo sapiens
tatggcagtgggaga

SEQ ID NO: 301611 - DNA, 13 bp, Homo sapiens
tatggctgtattt

SEQ ID NO: 301612 - DNA, 16 bp, Homo sapiens
tatgggaacaagtgta

SEQ ID NO: 301613 - DNA, 15 bp, Homo sapiens
tatgggaagctctgt

SEQ ID NO: 301614 - DNA, 18 bp, Homo sapiens
tatgggaggaacaaagac

SEQ ID NO: 301615 - DNA, 18 bp, Homo sapiens
tatgggctttctctttgg

SEQ ID NO: 301616 - DNA, 23 bp, Homo sapiens
tatggggggaggggggagggctg

SEQ ID NO: 301617 - DNA, 13 bp, Homo sapiens
tatgggtcacagg

SEQ ID NO: 301618 - DNA, 14 bp, Homo sapiens
tatgggtcacagga

SEQ ID NO: 301619 - DNA, 15 bp, Homo sapiens
tatgggtcacaggaa

SEQ ID NO: 301620 - DNA, 15 bp, Homo sapiens
tatggtataataaag

SEQ ID NO: 301621 - DNA, 14 bp, Homo sapiens
tatggtatatattt

SEQ ID NO: 301622 - DNA, 16 bp, Homo sapiens
tatggtggccctgggg

SEQ ID NO: 301623 - DNA, 17 bp, Homo sapiens
tatggttcccaataaaa

SEQ ID NO: 301624 - DNA, 20 bp, Homo sapiens
tatttaatgatttttgtgta

SEQ ID NO: 301625 - DNA, 23 bp, Homo sapiens
tatttaattattaactacattta

SEQ ID NO: 301626 - DNA, 14 bp, Homo sapiens
tatttaatttcata

SEQ ID NO: 301627 - DNA, 18 bp, Homo sapiens
tatttaatttcataaatt

SEQ ID NO: 301628 - DNA, 21 bp, Homo sapiens
tatttagcatgacaagcccca

SEQ ID NO: 301629 - DNA, 22 bp, Homo sapiens
tatttagttgattttaattact

SEQ ID NO: 301630 - DNA, 21 bp, Homo sapiens
tatttataacattgtaaatga

SEQ ID NO: 301631 - DNA, 20 bp, Homo sapiens
tatttataactcatcataaa

SEQ ID NO: 301632 - DNA, 18 bp, Homo sapiens
tatttatataattatgtt

SEQ ID NO: 301633 - DNA, 13 bp, Homo sapiens
tatttatatatga

SEQ ID NO: 301634 - DNA, 17 bp, Homo sapiens
tatttatatatttataa

SEQ ID NO: 301635 - DNA, 18 bp, Homo sapiens
tatttatatatttataac

SEQ ID NO: 301636 - DNA, 14 bp, Homo sapiens
tatttatatttcac

SEQ ID NO: 301637 - DNA, 13 bp, Homo sapiens
tatttatcacata

SEQ ID NO: 301638 - DNA, 18 bp, Homo sapiens
tatttatcagtgacagag

SEQ ID NO: 301639 - DNA, 17 bp, Homo sapiens
tatttatctgtctgagc

SEQ ID NO: 301640 - DNA, 20 bp, Homo sapiens
tatttatgcctctgtattta

SEQ ID NO: 301641 - DNA, 17 bp, Homo sapiens
tatttatgggatcctgg

SEQ ID NO: 301642 - DNA, 13 bp, Homo sapiens
tatttatgtgcaa

SEQ ID NO: 301643 - DNA, 16 bp, Homo sapiens
tatttattaaacttca

SEQ ID NO: 301644 - DNA, 13 bp, Homo sapiens
tatttattaaatt

SEQ ID NO: 301645 - DNA, 13 bp, Homo sapiens
tatttattaagat

SEQ ID NO: 301646 - DNA, 13 bp, Homo sapiens
tatttattacctc

SEQ ID NO: 301647 - DNA, 16 bp, Homo sapiens
tatttattacctctga

SEQ ID NO: 301648 - DNA, 16 bp, Homo sapiens
tatttattagctgtaa

SEQ ID NO: 301649 - DNA, 13 bp, Homo sapiens
tatttattgtatt

SEQ ID NO: 301650 - DNA, 16 bp, Homo sapiens
tatttattgtttattt

SEQ ID NO: 301651 - DNA, 22 bp, Homo sapiens
tatttattgtttatttatcagt

SEQ ID NO: 301652 - DNA, 21 bp, Homo sapiens
tatttatttaataacaattgt

SEQ ID NO: 301653 - DNA, 13 bp, Homo sapiens
tatttatttactg

SEQ ID NO: 301654 - DNA, 21 bp, Homo sapiens
tatttattttcagtatactgt

SEQ ID NO: 301655 - DNA, 11 bp, Homo sapiens
tatttcactta

SEQ ID NO: 301656 - DNA, 19 bp, Homo sapiens
tatttcacttaaactttgt

SEQ ID NO: 301657 - DNA, 21 bp, Homo sapiens
tatttcacttaaactttgtca

SEQ ID NO: 301658 - DNA, 15 bp, Homo sapiens
tatttcatattgaga

SEQ ID NO: 301659 - DNA, 16 bp, Homo sapiens
tatttcattcatatcc

SEQ ID NO: 301660 - DNA, 13 bp, Homo sapiens
tatttccaacaaa

SEQ ID NO: 301661 - DNA, 22 bp, Homo sapiens
tatttccccaggggaaaatgaa

SEQ ID NO: 301662 - DNA, 16 bp, Homo sapiens
tatttccctaaaatac

SEQ ID NO: 301663 - DNA, 20 bp, Homo sapiens
tatttccctaaaatacattt

SEQ ID NO: 301664 - DNA, 18 bp, Homo sapiens
tatttccctctcattttg

SEQ ID NO: 301665 - DNA, 22 bp, Homo sapiens
tatttcctttgcgcaaacttta

SEQ ID NO: 301666 - DNA, 15 bp, Homo sapiens
tatttcgaaagctgc

SEQ ID NO: 301667 - DNA, 17 bp, Homo sapiens
tatttctaagtatttaa

SEQ ID NO: 301668 - DNA, 19 bp, Homo sapiens
tatttctatgtaaattatt

SEQ ID NO: 301669 - DNA, 12 bp, Homo sapiens
tatttctgtaga

SEQ ID NO: 301670 - DNA, 14 bp, Homo sapiens
tatttctgtagaat

SEQ ID NO: 301671 - DNA, 23 bp, Homo sapiens
tatttctgtggaaaacaatttgc

SEQ ID NO: 301672 - DNA, 13 bp, Homo sapiens
tatttctttgtta

SEQ ID NO: 301673 - DNA, 14 bp, Homo sapiens
tatttcttttatat

SEQ ID NO: 301674 - DNA, 18 bp, Homo sapiens
tatttcttttatatataa

SEQ ID NO: 301675 - DNA, 19 bp, Homo sapiens
tatttcttttatatataaa

SEQ ID NO: 301676 - DNA, 20 bp, Homo sapiens
tatttcttttatatataaaa

SEQ ID NO: 301677 - DNA, 21 bp, Homo sapiens
tatttcttttatatataaaat

SEQ ID NO: 301678 - DNA, 18 bp, Homo sapiens
tatttgaaaattttactt

SEQ ID NO: 301679 - DNA, 21 bp, Homo sapiens
tatttgacattcttcactgtc

SEQ ID NO: 301680 - DNA, 14 bp, Homo sapiens
tatttgagacattc

SEQ ID NO: 301681 - DNA, 15 bp, Homo sapiens
tatttgagagttcta

SEQ ID NO: 301682 - DNA, 18 bp, Homo sapiens
tatttgagtttgacattt

SEQ ID NO: 301683 - DNA, 21 bp, Homo sapiens
tatttgagtttgacatttaat

SEQ ID NO: 301684 - DNA, 13 bp, Homo sapiens
tatttgataacat

SEQ ID NO: 301685 - DNA, 15 bp, Homo sapiens
tatttgataacattt

SEQ ID NO: 301686 - DNA, 19 bp, Homo sapiens
tatttgataacattttgtt

SEQ ID NO: 301687 - DNA, 14 bp, Homo sapiens
tatttgatctggtg

SEQ ID NO: 301688 - DNA, 14 bp, Homo sapiens
tatttgcaacattt

SEQ ID NO: 301689 - DNA, 16 bp, Homo sapiens
tatttgcaacatttac

SEQ ID NO: 301690 - DNA, 15 bp, Homo sapiens
tatttgcatgttacc

SEQ ID NO: 301691 - DNA, 21 bp, Homo sapiens
tatttgccttttaaattcttt

SEQ ID NO: 301692 - DNA, 20 bp, Homo sapiens
tatttgctggagtgctggct

SEQ ID NO: 301693 - DNA, 21 bp, Homo sapiens
tatttgctggagtgctggctc

SEQ ID NO: 301694 - DNA, 18 bp, Homo sapiens
tatttgctttagagacag

SEQ ID NO: 301695 - DNA, 16 bp, Homo sapiens
tatttggatatctgtt

SEQ ID NO: 301696 - DNA, 17 bp, Homo sapiens
tatttgtaactttgcat

SEQ ID NO: 301697 - DNA, 20 bp, Homo sapiens
tatttgtaactttgcatgtt

SEQ ID NO: 301698 - DNA, 17 bp, Homo sapiens
tatttgtagctagaata

SEQ ID NO: 301699 - DNA, 15 bp, Homo sapiens
tatttgtatctctga

SEQ ID NO: 301700 - DNA, 15 bp, Homo sapiens
tatttgtctttcagg

SEQ ID NO: 301701 - DNA, 13 bp, Homo sapiens
tatttgtgttcag

SEQ ID NO: 301702 - DNA, 16 bp, Homo sapiens
tatttgtgttcagttc

SEQ ID NO: 301703 - DNA, 21 bp, Homo sapiens
tatttgttatgataaaaggaa

SEQ ID NO: 301704 - DNA, 14 bp, Homo sapiens
tatttgttcagaga

SEQ ID NO: 301705 - DNA, 14 bp, Homo sapiens
tattttaaactact

SEQ ID NO: 301706 - DNA, 21 bp, Homo sapiens
tattttaaattataaggactg

SEQ ID NO: 301707 - DNA, 18 bp, Homo sapiens
tattttaatacctttaaa

SEQ ID NO: 301708 - DNA, 19 bp, Homo sapiens
tattttaatacctttaaat

SEQ ID NO: 301709 - DNA, 21 bp, Homo sapiens
tattttaatacctttaaatat

SEQ ID NO: 301710 - DNA, 21 bp, Homo sapiens
tattttacacagcaattttgt

SEQ ID NO: 301711 - DNA, 13 bp, Homo sapiens
tattttactttgt

SEQ ID NO: 301712 - DNA, 14 bp, Homo sapiens
tattttactttgtg

SEQ ID NO: 301713 - DNA, 20 bp, Homo sapiens
tattttagacaaccatagaa

SEQ ID NO: 301714 - DNA, 15 bp, Homo sapiens
tattttagagaatgg

SEQ ID NO: 301715 - DNA, 22 bp, Homo sapiens
tattttagcagttctgcaaata

SEQ ID NO: 301716 - DNA, 16 bp, Homo sapiens
tattttaggagacagt

SEQ ID NO: 301717 - DNA, 21 bp, Homo sapiens
tattttaggcagggatttgag

SEQ ID NO: 301718 - DNA, 15 bp, Homo sapiens
tattttatcctctgg

SEQ ID NO: 301719 - DNA, 14 bp, Homo sapiens
tattttattattca

SEQ ID NO: 301720 - DNA, 15 bp, Homo sapiens
tattttattattcag

SEQ ID NO: 301721 - DNA, 17 bp, Homo sapiens
tattttattattcagaa

SEQ ID NO: 301722 - DNA, 21 bp, Homo sapiens
tattttcatgacttttccatg

SEQ ID NO: 301723 - DNA, 13 bp, Homo sapiens
tattttcgggatt

SEQ ID NO: 301724 - DNA, 18 bp, Homo sapiens
tattttcgtgcatttgtg

SEQ ID NO: 301725 - DNA, 19 bp, Homo sapiens
tattttctatatttgtaac

SEQ ID NO: 301726 - DNA, 20 bp, Homo sapiens
tattttctgaattcataaaa

SEQ ID NO: 301727 - DNA, 19 bp, Homo sapiens
tattttcttcccatttgta

SEQ ID NO: 301728 - DNA, 18 bp, Homo sapiens
tattttgaaaacacttat

SEQ ID NO: 301729 - DNA, 13 bp, Homo sapiens
tattttgaatgtc

SEQ ID NO: 301730 - DNA, 16 bp, Homo sapiens
tattttgaatgtgaag

SEQ ID NO: 301731 - DNA, 15 bp, Homo sapiens
tattttgataataaa

SEQ ID NO: 301732 - DNA, 20 bp, Homo sapiens
tattttgataataaattgaa

SEQ ID NO: 301733 - DNA, 17 bp, Homo sapiens
tattttgctccttttct

SEQ ID NO: 301734 - DNA, 19 bp, Homo sapiens
tattttggacgtgtgagga

SEQ ID NO: 301735 - DNA, 19 bp, Homo sapiens
tattttggttcttagttct

SEQ ID NO: 301736 - DNA, 15 bp, Homo sapiens
tattttgtatatatc

SEQ ID NO: 301737 - DNA, 23 bp, Homo sapiens
tattttgtggttctattttactt

SEQ ID NO: 301738 - DNA, 12 bp, Homo sapiens
tattttgttact

SEQ ID NO: 301739 - DNA, 18 bp, Homo sapiens
tatttttaatttatgata

SEQ ID NO: 301740 - DNA, 23 bp, Homo sapiens
tatttttagagattaatttgtgt

SEQ ID NO: 301741 - DNA, 21 bp, Homo sapiens
tatttttatatttagttatag

SEQ ID NO: 301742 - DNA, 13 bp, Homo sapiens
tatttttcagaga

SEQ ID NO: 301743 - DNA, 14 bp, Homo sapiens
tatttttcatattg

SEQ ID NO: 301744 - DNA, 21 bp, Homo sapiens
tatttttccctccgggcaggg

SEQ ID NO: 301745 - DNA, 13 bp, Homo sapiens
tattttttaagta

SEQ ID NO: 301746 - DNA, 13 bp, Homo sapiens
tattttttaagtt

SEQ ID NO: 301747 - DNA, 14 bp, Homo sapiens
tattttttactaca

SEQ ID NO: 301748 - DNA, 17 bp, Homo sapiens
tattttttattgttttc

SEQ ID NO: 301749 - DNA, 19 bp, Homo sapiens
tatttttttaagctgtaaa

SEQ ID NO: 301750 - DNA, 20 bp, Homo sapiens
tatttttttaagctgtaaaa

SEQ ID NO: 301751 - DNA, 16 bp, Homo sapiens
tatttttttattcttc

SEQ ID NO: 301752 - DNA, 15 bp, Homo sapiens
tatttttttctagct

SEQ ID NO: 301753 - DNA, 16 bp, Homo sapiens
tatttttttctagcta

SEQ ID NO: 301754 - DNA, 22 bp, Homo sapiens
tatttttttctagctataacaa

SEQ ID NO: 301755 - DNA, 15 bp, Homo sapiens
tatttttttctctat

SEQ ID NO: 301756 - DNA, 17 bp, Homo sapiens
tatttttttgttgctgt

SEQ ID NO: 301757 - DNA, 18 bp, Homo sapiens
tatttttttgttgctgtt

SEQ ID NO: 301758 - DNA, 14 bp, Homo sapiens
tcaaaaaaacacta

SEQ ID NO: 301759 - DNA, 15 bp, Homo sapiens
tcaaaaatacaaaat

SEQ ID NO: 301760 - DNA, 13 bp, Homo sapiens
tcaaaaatataac

SEQ ID NO: 301761 - DNA, 21 bp, Homo sapiens
tcaaaacctgtgccaggctga

SEQ ID NO: 301762 - DNA, 14 bp, Homo sapiens
tcaaaagaaagaga

SEQ ID NO: 301763 - DNA, 17 bp, Homo sapiens
tcaaaaggaaaccaagt

SEQ ID NO: 301764 - DNA, 19 bp, Homo sapiens
tcaaaaggagaactgtgct

SEQ ID NO: 301765 - DNA, 22 bp, Homo sapiens
tcaaaaggagaactgtgctctc

SEQ ID NO: 301766 - DNA, 20 bp, Homo sapiens
tcaaaaggtgattaaatatt

SEQ ID NO: 301767 - DNA, 15 bp, Homo sapiens
tcaaaagtctatttt

SEQ ID NO: 301768 - DNA, 20 bp, Homo sapiens
tcaaaagtggattttcctga

SEQ ID NO: 301769 - DNA, 23 bp, Homo sapiens
tcaaaataaaaagtgacacagca

SEQ ID NO: 301770 - DNA, 17 bp, Homo sapiens
tcaaaatacaacttcat

SEQ ID NO: 301771 - DNA, 19 bp, Homo sapiens
tcaaaatacttctttttca

SEQ ID NO: 301772 - DNA, 15 bp, Homo sapiens
tcaaaatagttctat

SEQ ID NO: 301773 - DNA, 22 bp, Homo sapiens
tcaaaatagttctatttctatc

SEQ ID NO: 301774 - DNA, 13 bp, Homo sapiens
tcaaaatgcatgt

SEQ ID NO: 301775 - DNA, 18 bp, Homo sapiens
tcaaaatgttaataaagg

SEQ ID NO: 301776 - DNA, 19 bp, Homo sapiens
tcaaaatgttaataaaggt

SEQ ID NO: 301777 - DNA, 14 bp, Homo sapiens
tcaaaattatagga

SEQ ID NO: 301778 - DNA, 18 bp, Homo sapiens
tcaaacagcatcaaaata

SEQ ID NO: 301779 - DNA, 23 bp, Homo sapiens
tcaaacagggacactacaaacat

SEQ ID NO: 301780 - DNA, 23 bp, Homo sapiens
tcaaacagtgtggcttaaacatt

SEQ ID NO: 301781 - DNA, 15 bp, Homo sapiens
tcaaacatgaaaaca

SEQ ID NO: 301782 - DNA, 17 bp, Homo sapiens
tcaaacatgaaaacatt

SEQ ID NO: 301783 - DNA, 14 bp, Homo sapiens
tcaaaccaggattt

SEQ ID NO: 301784 - DNA, 19 bp, Homo sapiens
tcaaaccccgaccacctgc

SEQ ID NO: 301785 - DNA, 19 bp, Homo sapiens
tcaaaccctgtttacggta

SEQ ID NO: 301786 - DNA, 18 bp, Homo sapiens
tcaaacctgcatattgtg

SEQ ID NO: 301787 - DNA, 13 bp, Homo sapiens
tcaaaccttttta

SEQ ID NO: 301788 - DNA, 19 bp, Homo sapiens
tcaaactggggcctccctg

SEQ ID NO: 301789 - DNA, 21 bp, Homo sapiens
tcaaactttactctaagtctc

SEQ ID NO: 301790 - DNA, 12 bp, Homo sapiens
tcaaagaaatgc

SEQ ID NO: 301791 - DNA, 16 bp, Homo sapiens
tcaaagaaatgctgat

SEQ ID NO: 301792 - DNA, 19 bp, Homo sapiens
tcaaagaaatgctgatgga

SEQ ID NO: 301793 - DNA, 22 bp, Homo sapiens
tcaaagaaggatggcacctaaa

SEQ ID NO: 301794 - DNA, 14 bp, Homo sapiens
tcaaagacacacag

SEQ ID NO: 301795 - DNA, 23 bp, Homo sapiens
tcaaagatgtactgagaggaggg

SEQ ID NO: 301796 - DNA, 14 bp, Homo sapiens
tcaaagcaaccacc

SEQ ID NO: 301797 - DNA, 17 bp, Homo sapiens
tcaaagccggttgcaga

SEQ ID NO: 301798 - DNA, 13 bp, Homo sapiens
tcaaagctgaata

SEQ ID NO: 301799 - DNA, 17 bp, Homo sapiens
tcaaagctgaatatttt

SEQ ID NO: 301800 - DNA, 20 bp, Homo sapiens
tcaaagctgaatatttttta

SEQ ID NO: 301801 - DNA, 19 bp, Homo sapiens
tcaaaggattttggaaaag

SEQ ID NO: 301802 - DNA, 21 bp, Homo sapiens
tcaaaggattttggaaaagaa

SEQ ID NO: 301803 - DNA, 20 bp, Homo sapiens
tcaaagtactaaaactagat

SEQ ID NO: 301804 - DNA, 19 bp, Homo sapiens
tcaaagtaggtatacaaaa

SEQ ID NO: 301805 - DNA, 13 bp, Homo sapiens
tcaaagtcaaaaa

SEQ ID NO: 301806 - DNA, 19 bp, Homo sapiens
tcaaagtttttacagtgta

SEQ ID NO: 301807 - DNA, 22 bp, Homo sapiens
tcaaagtttttacagtgtatct

SEQ ID NO: 301808 - DNA, 13 bp, Homo sapiens
tcaaataaacctt

SEQ ID NO: 301809 - DNA, 20 bp, Homo sapiens
tcaaataaaccttgtttctt

SEQ ID NO: 301810 - DNA, 15 bp, Homo sapiens
tcaaatatctcagag

SEQ ID NO: 301811 - DNA, 16 bp, Homo sapiens
tcaaatccttccaaaa

SEQ ID NO: 301812 - DNA, 22 bp, Homo sapiens
tcaaatccttccaaaaattatt

SEQ ID NO: 301813 - DNA, 13 bp, Homo sapiens
tcaaatctattca

SEQ ID NO: 301814 - DNA, 14 bp, Homo sapiens
tcaaatctattcag

SEQ ID NO: 301815 - DNA, 16 bp, Homo sapiens
tcaaatctgtagcata

SEQ ID NO: 301816 - DNA, 21 bp, Homo sapiens
tcaaatctgtatatgttgtaa

SEQ ID NO: 301817 - DNA, 16 bp, Homo sapiens
tcaaatgatacagtca

SEQ ID NO: 301818 - DNA, 20 bp, Homo sapiens
tcaaatgtcattatgtagaa

SEQ ID NO: 301819 - DNA, 23 bp, Homo sapiens
tcaaattaatctttctttacctg

SEQ ID NO: 301820 - DNA, 20 bp, Homo sapiens
tcaaattcatttttttcact

SEQ ID NO: 301821 - DNA, 16 bp, Homo sapiens
tcaaattcctgcaaaa

SEQ ID NO: 301822 - DNA, 12 bp, Homo sapiens
tcaaattgtatc

SEQ ID NO: 301823 - DNA, 16 bp, Homo sapiens
tcaaattttgcattgt

SEQ ID NO: 301824 - DNA, 20 bp, Homo sapiens
tcaacaaaagggagaacatg

SEQ ID NO: 301825 - DNA, 21 bp, Homo sapiens
tcaacaaagaagaaccatctt

SEQ ID NO: 301826 - DNA, 14 bp, Homo sapiens
tcaacaaagcacag

SEQ ID NO: 301827 - DNA, 17 bp, Homo sapiens
tcaacaagggagagacc

SEQ ID NO: 301828 - DNA, 17 bp, Homo sapiens
tcaacacttattttctg

SEQ ID NO: 301829 - DNA, 16 bp, Homo sapiens
tcaacagcatgtctac

SEQ ID NO: 301830 - DNA, 16 bp, Homo sapiens
tcaacagtgaacagct

SEQ ID NO: 301831 - DNA, 22 bp, Homo sapiens
tcaacataattatgggaacaag

SEQ ID NO: 301832 - DNA, 15 bp, Homo sapiens
tcaacatcaatgttc

SEQ ID NO: 301833 - DNA, 17 bp, Homo sapiens
tcaacatcaatgttcat

SEQ ID NO: 301834 - DNA, 18 bp, Homo sapiens
tcaacatcaatgttcatt

SEQ ID NO: 301835 - DNA, 19 bp, Homo sapiens
tcaacatcaatgttcattg

SEQ ID NO: 301836 - DNA, 21 bp, Homo sapiens
tcaacatcaatgttcattgta

SEQ ID NO: 301837 - DNA, 15 bp, Homo sapiens
tcaacatgttactga

SEQ ID NO: 301838 - DNA, 17 bp, Homo sapiens
tcaacatttgctttttg

SEQ ID NO: 301839 - DNA, 23 bp, Homo sapiens
tcaaccactgtaaaatgaaatta

SEQ ID NO: 301840 - DNA, 13 bp, Homo sapiens
tcaaccaggaaga

SEQ ID NO: 301841 - DNA, 15 bp, Homo sapiens
tcaaccattccccat

SEQ ID NO: 301842 - DNA, 18 bp, Homo sapiens
tcaacccccatttctatt

SEQ ID NO: 301843 - DNA, 17 bp, Homo sapiens
tcaaccctccctcagcc

SEQ ID NO: 301844 - DNA, 19 bp, Homo sapiens
tcaaccctccctcagcccc

SEQ ID NO: 301845 - DNA, 23 bp, Homo sapiens
tcaaccctccctcagcccctctt

SEQ ID NO: 301846 - DNA, 23 bp, Homo sapiens
tcaacctaaaacaatctgtaatt

SEQ ID NO: 301847 - DNA, 19 bp, Homo sapiens
tcaacctgcacttcatatc

SEQ ID NO: 301848 - DNA, 18 bp, Homo sapiens
tcaaccttgagacagctt

SEQ ID NO: 301849 - DNA, 14 bp, Homo sapiens
tcaacgcagccctg

SEQ ID NO: 301850 - DNA, 15 bp, Homo sapiens
tcaacgcagccctgc

SEQ ID NO: 301851 - DNA, 21 bp, Homo sapiens
tcaactaaagaatagtgcctc

SEQ ID NO: 301852 - DNA, 16 bp, Homo sapiens
tcaactcacctaatgt

SEQ ID NO: 301853 - DNA, 19 bp, Homo sapiens
tcaactcacctaatgttta

SEQ ID NO: 301854 - DNA, 16 bp, Homo sapiens
tcaactctacccctgc

SEQ ID NO: 301855 - DNA, 23 bp, Homo sapiens
tcaactctacccctgctcccatt

SEQ ID NO: 301856 - DNA, 19 bp, Homo sapiens
tcaactctgtgtcccagca

SEQ ID NO: 301857 - DNA, 18 bp, Homo sapiens
tcaactgaccagcctcca

SEQ ID NO: 301858 - DNA, 16 bp, Homo sapiens
tcaacttaaatcactg

SEQ ID NO: 301859 - DNA, 20 bp, Homo sapiens
tcaacttcagttgaaaagag

SEQ ID NO: 301860 - DNA, 18 bp, Homo sapiens
tcaacttctggctcctca

SEQ ID NO: 301861 - DNA, 19 bp, Homo sapiens
tcaacttctggctcctcaa

SEQ ID NO: 301862 - DNA, 16 bp, Homo sapiens
tcaacttgagcatgtt

SEQ ID NO: 301863 - DNA, 17 bp, Homo sapiens
tcaactttcatttgaaa

SEQ ID NO: 301864 - DNA, 12 bp, Homo sapiens
tcaagaagacat

SEQ ID NO: 301865 - DNA, 19 bp, Homo sapiens
tcaagaccagtctggccaa

SEQ ID NO: 301866 - DNA, 22 bp, Homo sapiens
tcaagacccttttgggtttctg

SEQ ID NO: 301867 - DNA, 21 bp, Homo sapiens
tcaagagggcactggtggccc

SEQ ID NO: 301868 - DNA, 21 bp, Homo sapiens
tcaagaggttctcgactggag

SEQ ID NO: 301869 - DNA, 15 bp, Homo sapiens
tcaagatacctttgc

SEQ ID NO: 301870 - DNA, 21 bp, Homo sapiens
tcaagatacctttgcgtggat

SEQ ID NO: 301871 - DNA, 13 bp, Homo sapiens
tcaagatccaaat

SEQ ID NO: 301872 - DNA, 22 bp, Homo sapiens
tcaagatccaaatgctgtgcaa

SEQ ID NO: 301873 - DNA, 23 bp, Homo sapiens
tcaagatccaaatgctgtgcaaa

SEQ ID NO: 301874 - DNA, 13 bp, Homo sapiens
tcaagattttgaa

SEQ ID NO: 301875 - DNA, 21 bp, Homo sapiens
tcaagcaaacatcaaataaat

SEQ ID NO: 301876 - DNA, 11 bp, Homo sapiens
tcaagcaaata

SEQ ID NO: 301877 - DNA, 13 bp, Homo sapiens
tcaagcactgaca

SEQ ID NO: 301878 - DNA, 22 bp, Homo sapiens
tcaagcaggtttcttgcttctg

SEQ ID NO: 301879 - DNA, 13 bp, Homo sapiens
tcaagccaggaga

SEQ ID NO: 301880 - DNA, 14 bp, Homo sapiens
tcaagccaggagac

SEQ ID NO: 301881 - DNA, 15 bp, Homo sapiens
tcaagccaggagacc

SEQ ID NO: 301882 - DNA, 18 bp, Homo sapiens
tcaagccaggagaccctg

SEQ ID NO: 301883 - DNA, 16 bp, Homo sapiens
tcaagccatcttcccg

SEQ ID NO: 301884 - DNA, 12 bp, Homo sapiens
tcacctgtgcta

SEQ ID NO: 301885 - DNA, 19 bp, Homo sapiens
tcacctgtttttaagctgt

SEQ ID NO: 301886 - DNA, 22 bp, Homo sapiens
tcacctgtttttaagctgtttc

SEQ ID NO: 301887 - DNA, 21 bp, Homo sapiens
tcaccttccaggacccctggg

SEQ ID NO: 301888 - DNA, 21 bp, Homo sapiens
tcaccttcctgggcagcccag

SEQ ID NO: 301889 - DNA, 19 bp, Homo sapiens
tcaccttgccgagagaggc

SEQ ID NO: 301890 - DNA, 14 bp, Homo sapiens
tcaccttttctaaa

SEQ ID NO: 301891 - DNA, 21 bp, Homo sapiens
tcaccttttctaaaaagtcaa

SEQ ID NO: 301892 - DNA, 20 bp, Homo sapiens
tcacctttttgacttttcca

SEQ ID NO: 301893 - DNA, 16 bp, Homo sapiens
tcacgagatttgccag

SEQ ID NO: 301894 - DNA, 19 bp, Homo sapiens
tcacgccattctcctgcct

SEQ ID NO: 301895 - DNA, 22 bp, Homo sapiens
tcacgcctgtaatcccagcact

SEQ ID NO: 301896 - DNA, 23 bp, Homo sapiens
tcacgctcccaacacaaggtggg

SEQ ID NO: 301897 - DNA, 15 bp, Homo sapiens
tcacggactctttgc

SEQ ID NO: 301898 - DNA, 17 bp, Homo sapiens
tcacggactctttgctg

SEQ ID NO: 301899 - DNA, 14 bp, Homo sapiens
tcacgggcccgctc

SEQ ID NO: 301900 - DNA, 22 bp, Homo sapiens
tcacggggttggctgttccaga

SEQ ID NO: 301901 - DNA, 16 bp, Homo sapiens
tcacgtcactgccaga

SEQ ID NO: 301902 - DNA, 12 bp, Homo sapiens
tcacgtgtgtga

SEQ ID NO: 301903 - DNA, 15 bp, Homo sapiens
tcactaaccaacaag

SEQ ID NO: 301904 - DNA, 20 bp, Homo sapiens
tcactaataaagtctgtctg

SEQ ID NO: 301905 - DNA, 13 bp, Homo sapiens
tcactacaacctc

SEQ ID NO: 301906 - DNA, 17 bp, Homo sapiens
tcactataaatggtgtt

SEQ ID NO: 301907 - DNA, 19 bp, Homo sapiens
tcactataaccatcagtta

SEQ ID NO: 301908 - DNA, 22 bp, Homo sapiens
tcactataaccatcagttactg

SEQ ID NO: 301909 - DNA, 14 bp, Homo sapiens
tcactatgtttctc

SEQ ID NO: 301910 - DNA, 13 bp, Homo sapiens
tcactattcctat

SEQ ID NO: 301911 - DNA, 12 bp, Homo sapiens
tcactattctta

SEQ ID NO: 301912 - DNA, 21 bp, Homo sapiens
tcactattcttaagcactttg

SEQ ID NO: 301913 - DNA, 21 bp, Homo sapiens
tcactatttttttgttgctgt

SEQ ID NO: 301914 - DNA, 14 bp, Homo sapiens
tcactcagaattat

SEQ ID NO: 301915 - DNA, 13 bp, Homo sapiens
tcactcatactgt

SEQ ID NO: 301916 - DNA, 18 bp, Homo sapiens
tcactccattctcagccc

SEQ ID NO: 301917 - DNA, 20 bp, Homo sapiens
tcactccctaaagccctctt

SEQ ID NO: 301918 - DNA, 23 bp, Homo sapiens
tcactccctaaagccctcttcag

SEQ ID NO: 301919 - DNA, 15 bp, Homo sapiens
tcactccctgtcata

SEQ ID NO: 301920 - DNA, 22 bp, Homo sapiens
tcactccctttgtggactttat

SEQ ID NO: 301921 - DNA, 16 bp, Homo sapiens
tcactcggctgtggag

SEQ ID NO: 301922 - DNA, 19 bp, Homo sapiens
tcactcggctgtggagaac

SEQ ID NO: 301923 - DNA, 20 bp, Homo sapiens
tcactctacccccaacacca

SEQ ID NO: 301924 - DNA, 12 bp, Homo sapiens
tcactctgacag

SEQ ID NO: 301925 - DNA, 20 bp, Homo sapiens
tcactctgacagtattaaca

SEQ ID NO: 301926 - DNA, 11 bp, Homo sapiens
tcactctgcca

SEQ ID NO: 301927 - DNA, 12 bp, Homo sapiens
tcactctgccag

SEQ ID NO: 301928 - DNA, 13 bp, Homo sapiens
tcactctgccagg

SEQ ID NO: 301929 - DNA, 14 bp, Homo sapiens
tcactcttcctcat

SEQ ID NO: 301930 - DNA, 18 bp, Homo sapiens
tcactgaatatcatatgt

SEQ ID NO: 301931 - DNA, 23 bp, Homo sapiens
tcactgagggggagctgtcttgt

SEQ ID NO: 301932 - DNA, 18 bp, Homo sapiens
tcactgcaacttctgcct

SEQ ID NO: 301933 - DNA, 22 bp, Homo sapiens
tcactgcacagtgcatctcagc

SEQ ID NO: 301934 - DNA, 24 bp, Homo sapiens
tcactgcacagtgcatctcagccc

SEQ ID NO: 301935 - DNA, 14 bp, Homo sapiens
tcactgccagagct

SEQ ID NO: 301936 - DNA, 15 bp, Homo sapiens
tcactgccagagcta

SEQ ID NO: 301937 - DNA, 19 bp, Homo sapiens
tcactgcccgcacaccctc

SEQ ID NO: 301938 - DNA, 22 bp, Homo sapiens
tcactgcccgcacaccctcact

SEQ ID NO: 301939 - DNA, 14 bp, Homo sapiens
tcactgctgctcct

SEQ ID NO: 301940 - DNA, 15 bp, Homo sapiens
tcactgctggctgcc

SEQ ID NO: 301941 - DNA, 11 bp, Homo sapiens
tcactgctttg

SEQ ID NO: 301942 - DNA, 19 bp, Homo sapiens
tcactgctttgcaccgtgg

SEQ ID NO: 301943 - DNA, 14 bp, Homo sapiens
tcactgctttgtag

SEQ ID NO: 301944 - DNA, 16 bp, Homo sapiens
tcactggaacctccct

SEQ ID NO: 301945 - DNA, 19 bp, Homo sapiens
tcactggaacctccctggg

SEQ ID NO: 301946 - DNA, 19 bp, Homo sapiens
tcactggatgaagattctc

SEQ ID NO: 301947 - DNA, 21 bp, Homo sapiens
tcactggccagtagctgccaa

SEQ ID NO: 301948 - DNA, 11 bp, Homo sapiens
tcactggctgg

SEQ ID NO: 301949 - DNA, 19 bp, Homo sapiens
tcactggctggggcagagg

SEQ ID NO: 301950 - DNA, 17 bp, Homo sapiens
tcactggggagtctgct

SEQ ID NO: 301951 - DNA, 18 bp, Homo sapiens
tcactggtgcatttaaaa

SEQ ID NO: 301952 - DNA, 23 bp, Homo sapiens
tcactggtgcatttaaaatggac

SEQ ID NO: 301953 - DNA, 19 bp, Homo sapiens
tcactgtaggtatagaaga

SEQ ID NO: 301954 - DNA, 19 bp, Homo sapiens
tcactgtcctggcttttat

SEQ ID NO: 301955 - DNA, 17 bp, Homo sapiens
tcactgtctttcctaga

SEQ ID NO: 301956 - DNA, 11 bp, Homo sapiens
tcactgtgctc

SEQ ID NO: 301957 - DNA, 12 bp, Homo sapiens
tcactgtgctcc

SEQ ID NO: 301958 - DNA, 16 bp, Homo sapiens
tcactgtgtacataat

SEQ ID NO: 301959 - DNA, 22 bp, Homo sapiens
tcactgttagctttttaaaaca

SEQ ID NO: 301960 - DNA, 23 bp, Homo sapiens
tcactgttagctttttaaaacat

SEQ ID NO: 301961 - DNA, 15 bp, Homo sapiens
tcactgttccctctg

SEQ ID NO: 301962 - DNA, 18 bp, Homo sapiens
tcactgttccctctgctc

SEQ ID NO: 301963 - DNA, 18 bp, Homo sapiens
tcactgttgaaaattatt

SEQ ID NO: 301964 - DNA, 20 bp, Homo sapiens
tcactgttgaaaattatttt

SEQ ID NO: 301965 - DNA, 22 bp, Homo sapiens
tcactgtttcctattaatcttc

SEQ ID NO: 301966 - DNA, 18 bp, Homo sapiens
tcactgtttctctgctgt

SEQ ID NO: 301967 - DNA, 20 bp, Homo sapiens
tcactgtttctctgctgttg

SEQ ID NO: 301968 - DNA, 18 bp, Homo sapiens
tcacttaaactttgtcac

SEQ ID NO: 301969 - DNA, 17 bp, Homo sapiens
tcacttacctagattta

SEQ ID NO: 301970 - DNA, 12 bp, Homo sapiens
tcacttatacca

SEQ ID NO: 301971 - DNA, 18 bp, Homo sapiens
tcacttccatacagctct

SEQ ID NO: 301972 - DNA, 19 bp, Homo sapiens
tcacttccatacagctcta

SEQ ID NO: 301973 - DNA, 22 bp, Homo sapiens
tcacttccatacagctctacgt

SEQ ID NO: 301974 - DNA, 17 bp, Homo sapiens
tcacttccccttccaac

SEQ ID NO: 301975 - DNA, 16 bp, Homo sapiens
tcacttctaaatgcat

SEQ ID NO: 301976 - DNA, 18 bp, Homo sapiens
tcacttctgaccacactt

SEQ ID NO: 301977 - DNA, 14 bp, Homo sapiens
tcacttctgctgta

SEQ ID NO: 301978 - DNA, 22 bp, Homo sapiens
tcacttgaggtcaggagttcct

SEQ ID NO: 301979 - DNA, 16 bp, Homo sapiens
tcacttgtgtttgtat

SEQ ID NO: 301980 - DNA, 23 bp, Homo sapiens
tcacttgtgtttgtatataaatg

SEQ ID NO: 301981 - DNA, 18 bp, Homo sapiens
tcactttcacatagatgt

SEQ ID NO: 301982 - DNA, 19 bp, Homo sapiens
tcactttcacatagatgtc

SEQ ID NO: 301983 - DNA, 15 bp, Homo sapiens
tcactttgctctggg

SEQ ID NO: 301984 - DNA, 16 bp, Homo sapiens
tcactttgctctgggt

SEQ ID NO: 301985 - DNA, 16 bp, Homo sapiens
tcacttttattgtata

SEQ ID NO: 301986 - DNA, 13 bp, Homo sapiens
tcacttttcactt

SEQ ID NO: 301987 - DNA, 19 bp, Homo sapiens
tcacttttttcctgtcaat

SEQ ID NO: 301988 - DNA, 11 bp, Homo sapiens
tcagaaaacag

SEQ ID NO: 301989 - DNA, 20 bp, Homo sapiens
tcagaaaacttctcttctga

SEQ ID NO: 301990 - DNA, 13 bp, Homo sapiens
tcagaaaagacac

SEQ ID NO: 301991 - DNA, 16 bp, Homo sapiens
tcagaaacaatttctg

SEQ ID NO: 301992 - DNA, 18 bp, Homo sapiens
tcagaaaccccacttcca

SEQ ID NO: 301993 - DNA, 16 bp, Homo sapiens
tcagaaacttgtgaag

SEQ ID NO: 301994 - DNA, 23 bp, Homo sapiens
tcagaaagggcagcccctcccca

SEQ ID NO: 301995 - DNA, 16 bp, Homo sapiens
tcagaaatgctgcctg

SEQ ID NO: 301996 - DNA, 15 bp, Homo sapiens
tcagaacacattctt

SEQ ID NO: 301997 - DNA, 20 bp, Homo sapiens
tcagaactcctgtgtgtgga

SEQ ID NO: 301998 - DNA, 14 bp, Homo sapiens
tcagaactctcaga

SEQ ID NO: 301999 - DNA, 18 bp, Homo sapiens
tcagaactgctaccatga

SEQ ID NO: 302000 - DNA, 15 bp, Homo sapiens
tcagaactgttggct

SEQ ID NO: 302001 - DNA, 20 bp, Homo sapiens
tcagaagaaatttaatcagt

SEQ ID NO: 302002 - DNA, 19 bp, Homo sapiens
tcagaagacctccctgtga

SEQ ID NO: 302003 - DNA, 22 bp, Homo sapiens
tcagaagatgggtgttgttttc

SEQ ID NO: 302004 - DNA, 20 bp, Homo sapiens
tcagaagccccatttgcaca

SEQ ID NO: 302005 - DNA, 15 bp, Homo sapiens
tcagaagcctccaag

SEQ ID NO: 302006 - DNA, 23 bp, Homo sapiens
tcagaagcctccaagcctgcctc

SEQ ID NO: 302007 - DNA, 15 bp, Homo sapiens
tcagaaggggacctg

SEQ ID NO: 302008 - DNA, 14 bp, Homo sapiens
tcagaagtgaaaaa

SEQ ID NO: 302009 - DNA, 19 bp, Homo sapiens
tcagaagttgttagtgatt

SEQ ID NO: 302010 - DNA, 19 bp, Homo sapiens
tcagaagtttctcagctcc

SEQ ID NO: 302011 - DNA, 12 bp, Homo sapiens
tcagaataaatg

SEQ ID NO: 302012 - DNA, 16 bp, Homo sapiens
tcagaatcaaaccttt

SEQ ID NO: 302013 - DNA, 22 bp, Homo sapiens
tcagaatcaaacctttttatat

SEQ ID NO: 302014 - DNA, 22 bp, Homo sapiens
tcagggccagaaggagggcaga

SEQ ID NO: 302015 - DNA, 14 bp, Homo sapiens
tcagggccatgcct

SEQ ID NO: 302016 - DNA, 19 bp, Homo sapiens
tcagggcccacctcctcca

SEQ ID NO: 302017 - DNA, 18 bp, Homo sapiens
tcagggcccagaggctga

SEQ ID NO: 302018 - DNA, 19 bp, Homo sapiens
tcagggcccagaggctgag

SEQ ID NO: 302019 - DNA, 12 bp, Homo sapiens
tcagggctgggc

SEQ ID NO: 302020 - DNA, 15 bp, Homo sapiens
tcagggctgggcagg

SEQ ID NO: 302021 - DNA, 18 bp, Homo sapiens
tcaggggactcagccctg

SEQ ID NO: 302022 - DNA, 13 bp, Homo sapiens
tcaggtaggccct

SEQ ID NO: 302023 - DNA, 17 bp, Homo sapiens
tcaggtaggcccttgtc

SEQ ID NO: 302024 - DNA, 21 bp, Homo sapiens
tcaggtaggcccttgtcctgc

SEQ ID NO: 302025 - DNA, 14 bp, Homo sapiens
tcaggtcagggcta

SEQ ID NO: 302026 - DNA, 23 bp, Homo sapiens
tcaggtcagggctatggatgggg

SEQ ID NO: 302027 - DNA, 23 bp, Homo sapiens
tcaggtcccacgtctggccaggc

SEQ ID NO: 302028 - DNA, 21 bp, Homo sapiens
tcaggtgaaaaaggcaagcca

SEQ ID NO: 302029 - DNA, 12 bp, Homo sapiens
tcaggtgatcca

SEQ ID NO: 302030 - DNA, 16 bp, Homo sapiens
tcaggtgatccacctg

SEQ ID NO: 302031 - DNA, 13 bp, Homo sapiens
tcaggtgccactc

SEQ ID NO: 302032 - DNA, 23 bp, Homo sapiens
tcaggtgcctcaagagaaggcaa

SEQ ID NO: 302033 - DNA, 13 bp, Homo sapiens
tcaggtggaacag

SEQ ID NO: 302034 - DNA, 18 bp, Homo sapiens
tcaggtggaacaggagga

SEQ ID NO: 302035 - DNA, 23 bp, Homo sapiens
tcaggtggaacaggaggaactgg

SEQ ID NO: 302036 - DNA, 20 bp, Homo sapiens
tcaggtggtgtccttcttcc

SEQ ID NO: 302037 - DNA, 15 bp, Homo sapiens
tcaggttatactcct

SEQ ID NO: 302038 - DNA, 18 bp, Homo sapiens
tcaggttcttagtgtcac

SEQ ID NO: 302039 - DNA, 22 bp, Homo sapiens
tcaggttgtctgaagtcactgc

SEQ ID NO: 302040 - DNA, 17 bp, Homo sapiens
tcaggtttgcctgaggg

SEQ ID NO: 302041 - DNA, 15 bp, Homo sapiens
tcagtaataaaacat

SEQ ID NO: 302042 - DNA, 13 bp, Homo sapiens
tcagtaatagctg

SEQ ID NO: 302043 - DNA, 15 bp, Homo sapiens
tcagtaatagctgaa

SEQ ID NO: 302044 - DNA, 13 bp, Homo sapiens
tcagtaccaaaga

SEQ ID NO: 302045 - DNA, 13 bp, Homo sapiens
tcagtacccacct

SEQ ID NO: 302046 - DNA, 14 bp, Homo sapiens
tcagtactgcagcg

SEQ ID NO: 302047 - DNA, 23 bp, Homo sapiens
tcagtagaaactctacataattt

SEQ ID NO: 302048 - DNA, 22 bp, Homo sapiens
tcagtagacctgattttcaaaa

SEQ ID NO: 302049 - DNA, 16 bp, Homo sapiens
tcagtatcaaggctgc

SEQ ID NO: 302050 - DNA, 19 bp, Homo sapiens
tcagtatgaagacactgtc

SEQ ID NO: 302051 - DNA, 15 bp, Homo sapiens
tcagtatgtattctt

SEQ ID NO: 302052 - DNA, 17 bp, Homo sapiens
tcagtattaaactctcc

SEQ ID NO: 302053 - DNA, 22 bp, Homo sapiens
tcagtattaaactctcctttga

SEQ ID NO: 302054 - DNA, 12 bp, Homo sapiens
tcagtattgtgt

SEQ ID NO: 302055 - DNA, 17 bp, Homo sapiens
tcagtattgtgtaaagg

SEQ ID NO: 302056 - DNA, 20 bp, Homo sapiens
tcagtattgtgtaaaggaac

SEQ ID NO: 302057 - DNA, 21 bp, Homo sapiens
tcagtattgtgtaaaggaaca

SEQ ID NO: 302058 - DNA, 22 bp, Homo sapiens
tcagtcatgcgtccactttccc

SEQ ID NO: 302059 - DNA, 21 bp, Homo sapiens
tcagtcccccaccacactgaa

SEQ ID NO: 302060 - DNA, 18 bp, Homo sapiens
tcagtccccgtgaaggag

SEQ ID NO: 302061 - DNA, 17 bp, Homo sapiens
tcagtccctccctcctg

SEQ ID NO: 302062 - DNA, 18 bp, Homo sapiens
tcagtccctccctcctgg

SEQ ID NO: 302063 - DNA, 19 bp, Homo sapiens
tcagtcctcaaagcttttt

SEQ ID NO: 302064 - DNA, 15 bp, Homo sapiens
tcagtctacaggcct

SEQ ID NO: 302065 - DNA, 19 bp, Homo sapiens
tcagtctacaggcctttca

SEQ ID NO: 302066 - DNA, 17 bp, Homo sapiens
tcagtctccctttccct

SEQ ID NO: 302067 - DNA, 20 bp, Homo sapiens
tcagtctccctttcccttct

SEQ ID NO: 302068 - DNA, 12 bp, Homo sapiens
tcagtcttggag

SEQ ID NO: 302069 - DNA, 21 bp, Homo sapiens
tcagtctttgggggattcaaa

SEQ ID NO: 302070 - DNA, 21 bp, Homo sapiens
tcagtctttgtcaatgctcta

SEQ ID NO: 302071 - DNA, 23 bp, Homo sapiens
tcagtgaagcccaggaggacctg

SEQ ID NO: 302072 - DNA, 17 bp, Homo sapiens
tcagtgaatataaatgt

SEQ ID NO: 302073 - DNA, 19 bp, Homo sapiens
tcagtgacagagttcacta

SEQ ID NO: 302074 - DNA, 15 bp, Homo sapiens
tcagtgagcccctcc

SEQ ID NO: 302075 - DNA, 20 bp, Homo sapiens
tcagtgagcccctccccagc

SEQ ID NO: 302076 - DNA, 23 bp, Homo sapiens
tcagtgagcccctccccagccag

SEQ ID NO: 302077 - DNA, 20 bp, Homo sapiens
tcagtgcacctgtggcctct

SEQ ID NO: 302078 - DNA, 15 bp, Homo sapiens
tcagtgcagcccgtg

SEQ ID NO: 302079 - DNA, 21 bp, Homo sapiens
tcagtggactttccaccccct

SEQ ID NO: 302080 - DNA, 22 bp, Homo sapiens
tcagtgggaatgcagtgggtgg

SEQ ID NO: 302081 - DNA, 12 bp, Homo sapiens
tcagtgtatttt

SEQ ID NO: 302082 - DNA, 17 bp, Homo sapiens
tcagtgtcccgggcccg

SEQ ID NO: 302083 - DNA, 13 bp, Homo sapiens
tcagtgtcctcag

SEQ ID NO: 302084 - DNA, 19 bp, Homo sapiens
tcagtgtcctcttgctcaa

SEQ ID NO: 302085 - DNA, 15 bp, Homo sapiens
tcagtgtgcaaagaa

SEQ ID NO: 302086 - DNA, 13 bp, Homo sapiens
tcagtgtgccacc

SEQ ID NO: 302087 - DNA, 20 bp, Homo sapiens
tcagtgtgccaccctctgca

SEQ ID NO: 302088 - DNA, 22 bp, Homo sapiens
tcagtgtgccaccctctgcagg

SEQ ID NO: 302089 - DNA, 15 bp, Homo sapiens
tcagtgttaaaaaat

SEQ ID NO: 302090 - DNA, 16 bp, Homo sapiens
tcagttaagaaaaaaa

SEQ ID NO: 302091 - DNA, 19 bp, Homo sapiens
tcagttaagaaaaaaataa

SEQ ID NO: 302092 - DNA, 16 bp, Homo sapiens
tcagttactggtttca

SEQ ID NO: 302093 - DNA, 21 bp, Homo sapiens
tcagttcatatttcatttcca

SEQ ID NO: 302094 - DNA, 12 bp, Homo sapiens
tcagttccagct

SEQ ID NO: 302095 - DNA, 15 bp, Homo sapiens
tcagttccagctttt

SEQ ID NO: 302096 - DNA, 18 bp, Homo sapiens
tcagttccagcttttgta

SEQ ID NO: 302097 - DNA, 23 bp, Homo sapiens
tcagttcccggagcacagccctg

SEQ ID NO: 302098 - DNA, 18 bp, Homo sapiens
tcagttcccttggcctca

SEQ ID NO: 302099 - DNA, 22 bp, Homo sapiens
tcagttcccttggcctcagaat

SEQ ID NO: 302100 - DNA, 16 bp, Homo sapiens
tcagttcctctttgca

SEQ ID NO: 302101 - DNA, 18 bp, Homo sapiens
tcagttcctctttgcatg

SEQ ID NO: 302102 - DNA, 19 bp, Homo sapiens
tcagttcctctttgcatgg

SEQ ID NO: 302103 - DNA, 20 bp, Homo sapiens
tcagttcctgcagcagagcc

SEQ ID NO: 302104 - DNA, 13 bp, Homo sapiens
tcagttgaaaaga

SEQ ID NO: 302105 - DNA, 23 bp, Homo sapiens
tcagttgagcttcatataccagc

SEQ ID NO: 302106 - DNA, 19 bp, Homo sapiens
tcagtttcacatatttgta

SEQ ID NO: 302107 - DNA, 18 bp, Homo sapiens
tcagtttctccatcagct

SEQ ID NO: 302108 - DNA, 21 bp, Homo sapiens
tcagtttgaaaatattttgtt

SEQ ID NO: 302109 - DNA, 13 bp, Homo sapiens
tcagtttgtgaag

SEQ ID NO: 302110 - DNA, 14 bp, Homo sapiens
tcagtttgtgaagt

SEQ ID NO: 302111 - DNA, 13 bp, Homo sapiens
tcagttttaacta

SEQ ID NO: 302112 - DNA, 21 bp, Homo sapiens
tcagttttagtttcaaaatgt

SEQ ID NO: 302113 - DNA, 16 bp, Homo sapiens
tcagttttatcatttt

SEQ ID NO: 302114 - DNA, 19 bp, Homo sapiens
tcagttttatcattttcaa

SEQ ID NO: 302115 - DNA, 14 bp, Homo sapiens
tcagttttatcttt

SEQ ID NO: 302116 - DNA, 21 bp, Homo sapiens
tcataaaaggtgacccttctg

SEQ ID NO: 302117 - DNA, 22 bp, Homo sapiens
tcataaaaggtgacccttctgt

SEQ ID NO: 302118 - DNA, 17 bp, Homo sapiens
tcataaattatttctaa

SEQ ID NO: 302119 - DNA, 24 bp, Homo sapiens
tcataaattcaaacctaagttgct

SEQ ID NO: 302120 - DNA, 12 bp, Homo sapiens
tcataaattggc

SEQ ID NO: 302121 - DNA, 21 bp, Homo sapiens
tcataaattggctcctttccc

SEQ ID NO: 302122 - DNA, 19 bp, Homo sapiens
tcataaatttgttgtcatg

SEQ ID NO: 302123 - DNA, 13 bp, Homo sapiens
tcataacaatgta

SEQ ID NO: 302124 - DNA, 15 bp, Homo sapiens
tcataagatattctt

SEQ ID NO: 302125 - DNA, 13 bp, Homo sapiens
tcataattgtcaa

SEQ ID NO: 302126 - DNA, 21 bp, Homo sapiens
tcatacaaaggacagtacaca

SEQ ID NO: 302127 - DNA, 22 bp, Homo sapiens
tcataccaggccgccccagcct

SEQ ID NO: 302128 - DNA, 23 bp, Homo sapiens
tcatacgtgtgtgtgtgtgtatg

SEQ ID NO: 302129 - DNA, 20 bp, Homo sapiens
tcatactcacgggaggaatc

SEQ ID NO: 302130 - DNA, 16 bp, Homo sapiens
tcatactctgtgtaat

SEQ ID NO: 302131 - DNA, 13 bp, Homo sapiens
tcatactctgttg

SEQ ID NO: 302132 - DNA, 15 bp, Homo sapiens
tcatactctgttgcc

SEQ ID NO: 302133 - DNA, 20 bp, Homo sapiens
tcatagaaggagagcccagg

SEQ ID NO: 302134 - DNA, 14 bp, Homo sapiens
tcatagataccatt

SEQ ID NO: 302135 - DNA, 22 bp, Homo sapiens
tcatagataccattttgaaata

SEQ ID NO: 302136 - DNA, 14 bp, Homo sapiens
tcatagcattaact

SEQ ID NO: 302137 - DNA, 17 bp, Homo sapiens
tcatagctccttggagc

SEQ ID NO: 302138 - DNA, 14 bp, Homo sapiens
tcatagctgtatat

SEQ ID NO: 302139 - DNA, 17 bp, Homo sapiens
tcatagggtctcttcag

SEQ ID NO: 302140 - DNA, 15 bp, Homo sapiens
tcatagtcaatcaaa

SEQ ID NO: 302141 - DNA, 11 bp, Homo sapiens
tcatagtgcct

SEQ ID NO: 302142 - DNA, 16 bp, Homo sapiens
tcatagtgcctttttc

SEQ ID NO: 302143 - DNA, 15 bp, Homo sapiens
tcatagttctgttaa

SEQ ID NO: 302144 - DNA, 16 bp, Homo sapiens
tccaaggatcctctcc

SEQ ID NO: 302145 - DNA, 15 bp, Homo sapiens
tccaaggcaaatgtc

SEQ ID NO: 302146 - DNA, 14 bp, Homo sapiens
tccaagggcccaga

SEQ ID NO: 302147 - DNA, 16 bp, Homo sapiens
tccaagggcccagagg

SEQ ID NO: 302148 - DNA, 17 bp, Homo sapiens
tccaagggcccagaggg

SEQ ID NO: 302149 - DNA, 21 bp, Homo sapiens
tccaagggtatgggaagccat

SEQ ID NO: 302150 - DNA, 13 bp, Homo sapiens
tccaaggtgcaca

SEQ ID NO: 302151 - DNA, 14 bp, Homo sapiens
tccaagtaccaatg

SEQ ID NO: 302152 - DNA, 19 bp, Homo sapiens
tccaagtaccaatgctgtt

SEQ ID NO: 302153 - DNA, 22 bp, Homo sapiens
tccaagtcaacactcttcttga

SEQ ID NO: 302154 - DNA, 18 bp, Homo sapiens
tccaagtccaacctgcct

SEQ ID NO: 302155 - DNA, 22 bp, Homo sapiens
tccaagtccaacctgcctgtgc

SEQ ID NO: 302156 - DNA, 17 bp, Homo sapiens
tccaagtctctctgtga

SEQ ID NO: 302157 - DNA, 12 bp, Homo sapiens
tccaagtgtgtg

SEQ ID NO: 302158 - DNA, 13 bp, Homo sapiens
tccaagtgtgtgt

SEQ ID NO: 302159 - DNA, 13 bp, Homo sapiens
tccaagtgtttct

SEQ ID NO: 302160 - DNA, 14 bp, Homo sapiens
tccaagtgtttctt

SEQ ID NO: 302161 - DNA, 21 bp, Homo sapiens
tccaagttatttgatctggtg

SEQ ID NO: 302162 - DNA, 16 bp, Homo sapiens
tccaagttcttcacct

SEQ ID NO: 302163 - DNA, 21 bp, Homo sapiens
tccaagttcttcacctctatc

SEQ ID NO: 302164 - DNA, 14 bp, Homo sapiens
tccaataaaccagg

SEQ ID NO: 302165 - DNA, 15 bp, Homo sapiens
tccaataattgactg

SEQ ID NO: 302166 - DNA, 15 bp, Homo sapiens
tccaatcctcactgg

SEQ ID NO: 302167 - DNA, 16 bp, Homo sapiens
tccaatcctcactggg

SEQ ID NO: 302168 - DNA, 23 bp, Homo sapiens
tccaatctccggtgtgagcccac

SEQ ID NO: 302169 - DNA, 19 bp, Homo sapiens
tccaatgtgcccagtcatg

SEQ ID NO: 302170 - DNA, 20 bp, Homo sapiens
tccaatgtggtggcaataaa

SEQ ID NO: 302171 - DNA, 23 bp, Homo sapiens
tccaattatgtgacaacctttgt

SEQ ID NO: 302172 - DNA, 17 bp, Homo sapiens
tccaattccagagctgt

SEQ ID NO: 302173 - DNA, 13 bp, Homo sapiens
tccaattgatgta

SEQ ID NO: 302174 - DNA, 12 bp, Homo sapiens
tccaatttaagg

SEQ ID NO: 302175 - DNA, 13 bp, Homo sapiens
tccaatttaagga

SEQ ID NO: 302176 - DNA, 18 bp, Homo sapiens
tccaatttacatactctg

SEQ ID NO: 302177 - DNA, 17 bp, Homo sapiens
tccacaaatgtcctcag

SEQ ID NO: 302178 - DNA, 20 bp, Homo sapiens
tccacaaatgtcctcagagg

SEQ ID NO: 302179 - DNA, 17 bp, Homo sapiens
tccacaaggaataaatg

SEQ ID NO: 302180 - DNA, 17 bp, Homo sapiens
tccacacaacaccagga

SEQ ID NO: 302181 - DNA, 12 bp, Homo sapiens
tccacacaggcc

SEQ ID NO: 302182 - DNA, 13 bp, Homo sapiens
tccacacaggccc

SEQ ID NO: 302183 - DNA, 22 bp, Homo sapiens
tccacacaggcccatgccctcc

SEQ ID NO: 302184 - DNA, 16 bp, Homo sapiens
tccacaccagtggcct

SEQ ID NO: 302185 - DNA, 18 bp, Homo sapiens
tccacaccagtggcctcg

SEQ ID NO: 302186 - DNA, 19 bp, Homo sapiens
tccacagaaaccctgtttt

SEQ ID NO: 302187 - DNA, 18 bp, Homo sapiens
tccacagaacctttgtca

SEQ ID NO: 302188 - DNA, 13 bp, Homo sapiens
tccacaggattcc

SEQ ID NO: 302189 - DNA, 16 bp, Homo sapiens
tccacaggggcaggcc

SEQ ID NO: 302190 - DNA, 17 bp, Homo sapiens
tccacaggggcaggcct

SEQ ID NO: 302191 - DNA, 18 bp, Homo sapiens
tccacaggggcaggcctg

SEQ ID NO: 302192 - DNA, 22 bp, Homo sapiens
tccacagggtgggatgagcctc

SEQ ID NO: 302193 - DNA, 21 bp, Homo sapiens
tccacagtattgttcttgtaa

SEQ ID NO: 302194 - DNA, 15 bp, Homo sapiens
tccacagtgctgctt

SEQ ID NO: 302195 - DNA, 15 bp, Homo sapiens
tccacagttgattag

SEQ ID NO: 302196 - DNA, 17 bp, Homo sapiens
tccacatcccagcagcc

SEQ ID NO: 302197 - DNA, 21 bp, Homo sapiens
tccacatccccaccctcccct

SEQ ID NO: 302198 - DNA, 12 bp, Homo sapiens
tccacatgctct

SEQ ID NO: 302199 - DNA, 13 bp, Homo sapiens
tccacatgctctg

SEQ ID NO: 302200 - DNA, 18 bp, Homo sapiens
tccacattctgctgcccc

SEQ ID NO: 302201 - DNA, 18 bp, Homo sapiens
tccaccacaagagctcct

SEQ ID NO: 302202 - DNA, 14 bp, Homo sapiens
tccaccaccttgcc

SEQ ID NO: 302203 - DNA, 15 bp, Homo sapiens
tccaccaccttgcca

SEQ ID NO: 302204 - DNA, 15 bp, Homo sapiens
tccaccaggaacctc

SEQ ID NO: 302205 - DNA, 17 bp, Homo sapiens
tccacccaccagtcagg

SEQ ID NO: 302206 - DNA, 20 bp, Homo sapiens
tccacccacctcagcctccc

SEQ ID NO: 302207 - DNA, 19 bp, Homo sapiens
tccacccacttagtccact

SEQ ID NO: 302208 - DNA, 14 bp, Homo sapiens
tccacccagcccct

SEQ ID NO: 302209 - DNA, 16 bp, Homo sapiens
tccacccagcccctgg

SEQ ID NO: 302210 - DNA, 17 bp, Homo sapiens
tccacccagcccctggc

SEQ ID NO: 302211 - DNA, 12 bp, Homo sapiens
tccacccagtgc

SEQ ID NO: 302212 - DNA, 21 bp, Homo sapiens
tccacccagtgctgccatgcc

SEQ ID NO: 302213 - DNA, 22 bp, Homo sapiens
tccacccatcctaccaatgcat

SEQ ID NO: 302214 - DNA, 12 bp, Homo sapiens
tccaccccactc

SEQ ID NO: 302215 - DNA, 14 bp, Homo sapiens
tccacccccaagaa

SEQ ID NO: 302216 - DNA, 16 bp, Homo sapiens
tccacccccaagaaac

SEQ ID NO: 302217 - DNA, 17 bp, Homo sapiens
tccacccccaagaaacc

SEQ ID NO: 302218 - DNA, 20 bp, Homo sapiens
tccacccccgccacggccac

SEQ ID NO: 302219 - DNA, 22 bp, Homo sapiens
tccacccccgccacggccaccc

SEQ ID NO: 302220 - DNA, 13 bp, Homo sapiens
tccaccccctccc

SEQ ID NO: 302221 - DNA, 19 bp, Homo sapiens
tccaccccctccctggcct

SEQ ID NO: 302222 - DNA, 21 bp, Homo sapiens
tccacccctcaagccaggaga

SEQ ID NO: 302223 - DNA, 17 bp, Homo sapiens
tccacccctccttccct

SEQ ID NO: 302224 - DNA, 22 bp, Homo sapiens
tccaccctcatttctgccagcg

SEQ ID NO: 302225 - DNA, 15 bp, Homo sapiens
tccacccttggcctg

SEQ ID NO: 302226 - DNA, 17 bp, Homo sapiens
tccacccttggcctgtc

SEQ ID NO: 302227 - DNA, 21 bp, Homo sapiens
tccaccggtgcctcctctggg

SEQ ID NO: 302228 - DNA, 22 bp, Homo sapiens
tccaccggtgcctcctctgggg

SEQ ID NO: 302229 - DNA, 20 bp, Homo sapiens
tccacctcctagaggtgggc

SEQ ID NO: 302230 - DNA, 20 bp, Homo sapiens
tccacctcctctcttggact

SEQ ID NO: 302231 - DNA, 23 bp, Homo sapiens
tccacctcctctcttggactccc

SEQ ID NO: 302232 - DNA, 17 bp, Homo sapiens
tccacctgagctgccat

SEQ ID NO: 302233 - DNA, 13 bp, Homo sapiens
tccacctgcttgt

SEQ ID NO: 302234 - DNA, 17 bp, Homo sapiens
tccacctgggagatgct

SEQ ID NO: 302235 - DNA, 23 bp, Homo sapiens
tccacctgggagatgctgggacc

SEQ ID NO: 302236 - DNA, 16 bp, Homo sapiens
tccacctgtctcagcc

SEQ ID NO: 302237 - DNA, 17 bp, Homo sapiens
tccacctgtgctgctgc

SEQ ID NO: 302238 - DNA, 14 bp, Homo sapiens
tccaccttaaatta

SEQ ID NO: 302239 - DNA, 22 bp, Homo sapiens
tccaccttaaattaaacaattt

SEQ ID NO: 302240 - DNA, 16 bp, Homo sapiens
tccaccttcccatgcc

SEQ ID NO: 302241 - DNA, 19 bp, Homo sapiens
tccaccttcccatgccctg

SEQ ID NO: 302242 - DNA, 14 bp, Homo sapiens
tccacgccctgggg

SEQ ID NO: 302243 - DNA, 17 bp, Homo sapiens
tccacgctgtctccaga

SEQ ID NO: 302244 - DNA, 16 bp, Homo sapiens
tccacggaaacagaac

SEQ ID NO: 302245 - DNA, 14 bp, Homo sapiens
tccacggctctagg

SEQ ID NO: 302246 - DNA, 13 bp, Homo sapiens
tccacggtgcgtg

SEQ ID NO: 302247 - DNA, 16 bp, Homo sapiens
tccacggtgcgtggct

SEQ ID NO: 302248 - DNA, 23 bp, Homo sapiens
tccacggtgcgtggctgtggcac

SEQ ID NO: 302249 - DNA, 17 bp, Homo sapiens
tccacgtccccctgggg

SEQ ID NO: 302250 - DNA, 18 bp, Homo sapiens
tccacgtgtatgcaagtg

SEQ ID NO: 302251 - DNA, 20 bp, Homo sapiens
tccactatgggaagctctgt

SEQ ID NO: 302252 - DNA, 22 bp, Homo sapiens
tccactatgggaagctctgtgt

SEQ ID NO: 302253 - DNA, 15 bp, Homo sapiens
tccactcactccagc

SEQ ID NO: 302254 - DNA, 17 bp, Homo sapiens
tccactcactccagccc

SEQ ID NO: 302255 - DNA, 15 bp, Homo sapiens
tccactcactgcatt

SEQ ID NO: 302256 - DNA, 12 bp, Homo sapiens
tccactcagctt

SEQ ID NO: 302257 - DNA, 23 bp, Homo sapiens
tccactccatatttatttaaaca

SEQ ID NO: 302258 - DNA, 21 bp, Homo sapiens
tccactccatgtttgcaatgc

SEQ ID NO: 302259 - DNA, 17 bp, Homo sapiens
tccactcccccacctga

SEQ ID NO: 302260 - DNA, 19 bp, Homo sapiens
tccactcccccacctgaca

SEQ ID NO: 302261 - DNA, 18 bp, Homo sapiens
tccactcctcccaactct

SEQ ID NO: 302262 - DNA, 23 bp, Homo sapiens
tccactcctcccaactctggcct

SEQ ID NO: 302263 - DNA, 13 bp, Homo sapiens
tccactccttcct

SEQ ID NO: 302264 - DNA, 20 bp, Homo sapiens
tccactctaccctcccaccc

SEQ ID NO: 302265 - DNA, 16 bp, Homo sapiens
tccactgacctggaag

SEQ ID NO: 302266 - DNA, 12 bp, Homo sapiens
tccactgccctc

SEQ ID NO: 302267 - DNA, 13 bp, Homo sapiens
tccactgcctctg

SEQ ID NO: 302268 - DNA, 16 bp, Homo sapiens
tccactgcctctgcct

SEQ ID NO: 302269 - DNA, 19 bp, Homo sapiens
tccactgcctctgccttag

SEQ ID NO: 302270 - DNA, 17 bp, Homo sapiens
tccactggcctgcccgt

SEQ ID NO: 302271 - DNA, 19 bp, Homo sapiens
tccactggggagtgctgga

SEQ ID NO: 302272 - DNA, 12 bp, Homo sapiens
tccacttctggt

SEQ ID NO: 302273 - DNA, 15 bp, Homo sapiens
tccacttctggtccc

SEQ ID NO: 302274 - DNA, 17 bp, Homo sapiens
tccactttcccttcccc

SEQ ID NO: 302275 - DNA, 14 bp, Homo sapiens
tccattttggaaaa

SEQ ID NO: 302276 - DNA, 19 bp, Homo sapiens
tccatttttactaaagcag

SEQ ID NO: 302277 - DNA, 16 bp, Homo sapiens
tccatttttcccagga

SEQ ID NO: 302278 - DNA, 21 bp, Homo sapiens
tcccaaaagagggacaacgaa

SEQ ID NO: 302279 - DNA, 18 bp, Homo sapiens
tcccaaacccttcagtgc

SEQ ID NO: 302280 - DNA, 16 bp, Homo sapiens
tcccaaagcagtgcat

SEQ ID NO: 302281 - DNA, 19 bp, Homo sapiens
tcccaacaatactttgtgt

SEQ ID NO: 302282 - DNA, 21 bp, Homo sapiens
tcccaacacaaggtgggcagg

SEQ ID NO: 302283 - DNA, 17 bp, Homo sapiens
tcccaacagaggcctcc

SEQ ID NO: 302284 - DNA, 22 bp, Homo sapiens
tcccaacctcaatgccctgcca

SEQ ID NO: 302285 - DNA, 14 bp, Homo sapiens
tcccaacgtactcc

SEQ ID NO: 302286 - DNA, 16 bp, Homo sapiens
tcccaactcactgtgc

SEQ ID NO: 302287 - DNA, 20 bp, Homo sapiens
tcccaactctggccttggtt

SEQ ID NO: 302288 - DNA, 15 bp, Homo sapiens
tcccaactttggaaa

SEQ ID NO: 302289 - DNA, 16 bp, Homo sapiens
tcccaactttggaaaa

SEQ ID NO: 302290 - DNA, 19 bp, Homo sapiens
tcccaactttggaaaacat

SEQ ID NO: 302291 - DNA, 17 bp, Homo sapiens
tcccaagaacagcaggc

SEQ ID NO: 302292 - DNA, 20 bp, Homo sapiens
tcccaagagtggtggcagct

SEQ ID NO: 302293 - DNA, 18 bp, Homo sapiens
tcccaagctagtgagcaa

SEQ ID NO: 302294 - DNA, 20 bp, Homo sapiens
tcccaagctggagtgcagtg

SEQ ID NO: 302295 - DNA, 22 bp, Homo sapiens
tcccaaggagctgatttccagg

SEQ ID NO: 302296 - DNA, 23 bp, Homo sapiens
tcccaaggcaaggggtgcctggg

SEQ ID NO: 302297 - DNA, 20 bp, Homo sapiens
tcccaagggaggcccatgtg

SEQ ID NO: 302298 - DNA, 20 bp, Homo sapiens
tcccaagtcaaacagtgtgg

SEQ ID NO: 302299 - DNA, 21 bp, Homo sapiens
tcccaagtcaaacagtgtggc

SEQ ID NO: 302300 - DNA, 22 bp, Homo sapiens
tcccaagtcaaacagtgtggct

SEQ ID NO: 302301 - DNA, 15 bp, Homo sapiens
tcccaataaagctgg

SEQ ID NO: 302302 - DNA, 16 bp, Homo sapiens
tcccaataaagctgga

SEQ ID NO: 302303 - DNA, 17 bp, Homo sapiens
tcccaataaagctggac

SEQ ID NO: 302304 - DNA, 19 bp, Homo sapiens
tcccaataaagtcctcttc

SEQ ID NO: 302305 - DNA, 22 bp, Homo sapiens
tcccaatcagcttttgttctag

SEQ ID NO: 302306 - DNA, 20 bp, Homo sapiens
tcccaatccttatcccaagc

SEQ ID NO: 302307 - DNA, 15 bp, Homo sapiens
tcccaatcttaccag

SEQ ID NO: 302308 - DNA, 21 bp, Homo sapiens
tcccaatcttaccagatgcta

SEQ ID NO: 302309 - DNA, 14 bp, Homo sapiens
tcccaatctttcta

SEQ ID NO: 302310 - DNA, 15 bp, Homo sapiens
tcccaatctttctat

SEQ ID NO: 302311 - DNA, 20 bp, Homo sapiens
tcccaattaggaagtgtaac

SEQ ID NO: 302312 - DNA, 18 bp, Homo sapiens
tcccacaaaatatttcta

SEQ ID NO: 302313 - DNA, 19 bp, Homo sapiens
tcccacaaaatatttctaa

SEQ ID NO: 302314 - DNA, 16 bp, Homo sapiens
tcccacaatggctggg

SEQ ID NO: 302315 - DNA, 18 bp, Homo sapiens
tcccacacatattcaaat

SEQ ID NO: 302316 - DNA, 17 bp, Homo sapiens
tcccacacttgctgggg

SEQ ID NO: 302317 - DNA, 15 bp, Homo sapiens
tcccacaggcccttc

SEQ ID NO: 302318 - DNA, 21 bp, Homo sapiens
tcccacaggcccttcctctcc

SEQ ID NO: 302319 - DNA, 15 bp, Homo sapiens
tcccacatcccactg

SEQ ID NO: 302320 - DNA, 16 bp, Homo sapiens
tcccacatcccactgg

SEQ ID NO: 302321 - DNA, 15 bp, Homo sapiens
tcccacatcccccgt

SEQ ID NO: 302322 - DNA, 14 bp, Homo sapiens
tcccaccaactctg

SEQ ID NO: 302323 - DNA, 17 bp, Homo sapiens
tcccaccaactctgcac

SEQ ID NO: 302324 - DNA, 18 bp, Homo sapiens
tcccaccaactctgcact

SEQ ID NO: 302325 - DNA, 21 bp, Homo sapiens
tcccaccaactctgcactcca

SEQ ID NO: 302326 - DNA, 22 bp, Homo sapiens
tcccaccaactctgcactccat

SEQ ID NO: 302327 - DNA, 15 bp, Homo sapiens
tcccaccacagcagg

SEQ ID NO: 302328 - DNA, 19 bp, Homo sapiens
tcccaccagaacgcacccc

SEQ ID NO: 302329 - DNA, 21 bp, Homo sapiens
tcccaccagaacgcaccccac

SEQ ID NO: 302330 - DNA, 15 bp, Homo sapiens
tcccaccagctccca

SEQ ID NO: 302331 - DNA, 22 bp, Homo sapiens
tcccacccccttctctgctcca

SEQ ID NO: 302332 - DNA, 14 bp, Homo sapiens
tcccacccggccac

SEQ ID NO: 302333 - DNA, 16 bp, Homo sapiens
tcccacccggccacag

SEQ ID NO: 302334 - DNA, 20 bp, Homo sapiens
tcccacccggccacagctgc

SEQ ID NO: 302335 - DNA, 19 bp, Homo sapiens
tcccaccggttgcttctgg

SEQ ID NO: 302336 - DNA, 22 bp, Homo sapiens
tcccacctcaaatgggtctggg

SEQ ID NO: 302337 - DNA, 13 bp, Homo sapiens
tcccacctccagc

SEQ ID NO: 302338 - DNA, 20 bp, Homo sapiens
tcccacctccagcccacagt

SEQ ID NO: 302339 - DNA, 17 bp, Homo sapiens
tcccacctccagtcccc

SEQ ID NO: 302340 - DNA, 18 bp, Homo sapiens
tcccacctccctgcccag

SEQ ID NO: 302341 - DNA, 20 bp, Homo sapiens
tcccacctctccttttgagg

SEQ ID NO: 302342 - DNA, 23 bp, Homo sapiens
tcccacctctccttttgaggctt

SEQ ID NO: 302343 - DNA, 14 bp, Homo sapiens
tcccacctctgagg

SEQ ID NO: 302344 - DNA, 23 bp, Homo sapiens
tcccacggaaaatgccaatctct

SEQ ID NO: 302345 - DNA, 19 bp, Homo sapiens
tcccacggccactgcagtc

SEQ ID NO: 302346 - DNA, 14 bp, Homo sapiens
tcccacgtctggcc

SEQ ID NO: 302347 - DNA, 17 bp, Homo sapiens
tcccacgtctggccagg

SEQ ID NO: 302348 - DNA, 22 bp, Homo sapiens
tcccacgttgacaccaagaaac

SEQ ID NO: 302349 - DNA, 20 bp, Homo sapiens
tcccactaagctttctcctt

SEQ ID NO: 302350 - DNA, 23 bp, Homo sapiens
tcccactgccaggattttgtatt

SEQ ID NO: 302351 - DNA, 14 bp, Homo sapiens
tcccactgccctgg

SEQ ID NO: 302352 - DNA, 12 bp, Homo sapiens
tcccactgtcct

SEQ ID NO: 302353 - DNA, 16 bp, Homo sapiens
tcccactgtcctttct

SEQ ID NO: 302354 - DNA, 15 bp, Homo sapiens
tcccacttgcccctg

SEQ ID NO: 302355 - DNA, 17 bp, Homo sapiens
tcccagacaggccctcc

SEQ ID NO: 302356 - DNA, 18 bp, Homo sapiens
tcccagacccagggcagt

SEQ ID NO: 302357 - DNA, 15 bp, Homo sapiens
tcccagacttgtttc

SEQ ID NO: 302358 - DNA, 16 bp, Homo sapiens
tcccagacttgtttcc

SEQ ID NO: 302359 - DNA, 18 bp, Homo sapiens
tcccagacttgtttcctg

SEQ ID NO: 302360 - DNA, 20 bp, Homo sapiens
tcccagacttgtttcctgtg

SEQ ID NO: 302361 - DNA, 13 bp, Homo sapiens
tcccagagaacaa

SEQ ID NO: 302362 - DNA, 24 bp, Homo sapiens
tcccagagaacaatcactattctt

SEQ ID NO: 302363 - DNA, 17 bp, Homo sapiens
tcccagagcaggaggcc

SEQ ID NO: 302364 - DNA, 18 bp, Homo sapiens
tcccagagcaggaggccc

SEQ ID NO: 302365 - DNA, 11 bp, Homo sapiens
tcccagaggct

SEQ ID NO: 302366 - DNA, 16 bp, Homo sapiens
tcccagaggctcctgg

SEQ ID NO: 302367 - DNA, 21 bp, Homo sapiens
tcccagaggctcctggagcca

SEQ ID NO: 302368 - DNA, 13 bp, Homo sapiens
tcccagaggtggg

SEQ ID NO: 302369 - DNA, 22 bp, Homo sapiens
tcccagaggtgggatcctccct

SEQ ID NO: 302370 - DNA, 23 bp, Homo sapiens
tcccagaggtgggatcctccctc

SEQ ID NO: 302371 - DNA, 16 bp, Homo sapiens
tcccagatagtcccag

SEQ ID NO: 302372 - DNA, 18 bp, Homo sapiens
tcccagatagtcccagca

SEQ ID NO: 302373 - DNA, 11 bp, Homo sapiens
tcccagatgcc

SEQ ID NO: 302374 - DNA, 23 bp, Homo sapiens
tcccagatgccttctagattcac

SEQ ID NO: 302375 - DNA, 17 bp, Homo sapiens
tcccagcacctgccagg

SEQ ID NO: 302376 - DNA, 20 bp, Homo sapiens
tcccagcacctgccagggcc

SEQ ID NO: 302377 - DNA, 21 bp, Homo sapiens
tcccagcactttgggaggcct

SEQ ID NO: 302378 - DNA, 14 bp, Homo sapiens
tcccagcagcccaa

SEQ ID NO: 302379 - DNA, 13 bp, Homo sapiens
tcccagcagccct

SEQ ID NO: 302380 - DNA, 19 bp, Homo sapiens
tcccagccaccaccactgt

SEQ ID NO: 302381 - DNA, 20 bp, Homo sapiens
tcccagccaccccgggctct

SEQ ID NO: 302382 - DNA, 23 bp, Homo sapiens
tcccagccacccggatctccagg

SEQ ID NO: 302383 - DNA, 16 bp, Homo sapiens
tcccagcccctacctt

SEQ ID NO: 302384 - DNA, 14 bp, Homo sapiens
tcccagcccctggt

SEQ ID NO: 302385 - DNA, 15 bp, Homo sapiens
tcccagcccctggta

SEQ ID NO: 302386 - DNA, 22 bp, Homo sapiens
tcccagcccctggtactccccc

SEQ ID NO: 302387 - DNA, 22 bp, Homo sapiens
tcccagcctcttgctcagagct

SEQ ID NO: 302388 - DNA, 22 bp, Homo sapiens
tcccagcctgctgagagccccc

SEQ ID NO: 302389 - DNA, 19 bp, Homo sapiens
tcccagctaaagaggtggg

SEQ ID NO: 302390 - DNA, 14 bp, Homo sapiens
tcccagctacaggg

SEQ ID NO: 302391 - DNA, 16 bp, Homo sapiens
tcccagctacttggga

SEQ ID NO: 302392 - DNA, 22 bp, Homo sapiens
tcccagctacttgggagcctga

SEQ ID NO: 302393 - DNA, 19 bp, Homo sapiens
tcccagctacttgggaggc

SEQ ID NO: 302394 - DNA, 20 bp, Homo sapiens
tcccagctctagacaaccct

SEQ ID NO: 302395 - DNA, 18 bp, Homo sapiens
tcccagctggcagcgcct

SEQ ID NO: 302396 - DNA, 14 bp, Homo sapiens
tcccaggacaggaa

SEQ ID NO: 302397 - DNA, 19 bp, Homo sapiens
tcccaggacaggaaatatg

SEQ ID NO: 302398 - DNA, 20 bp, Homo sapiens
tcccaggaccctgggtcacc

SEQ ID NO: 302399 - DNA, 21 bp, Homo sapiens
tcccaggacctggagacagga

SEQ ID NO: 302400 - DNA, 18 bp, Homo sapiens
tcccaggacgcagggaga

SEQ ID NO: 302401 - DNA, 14 bp, Homo sapiens
tcccaggcagggag

SEQ ID NO: 302402 - DNA, 17 bp, Homo sapiens
tcccaggccccctgcat

SEQ ID NO: 302403 - DNA, 19 bp, Homo sapiens
tcccaggccccctgcatct

SEQ ID NO: 302404 - DNA, 18 bp, Homo sapiens
tccccctgtagactagtg

SEQ ID NO: 302405 - DNA, 18 bp, Homo sapiens
tccccgcagcccgcctgc

SEQ ID NO: 302406 - DNA, 16 bp, Homo sapiens
tccccgcccgccctcc

SEQ ID NO: 302407 - DNA, 20 bp, Homo sapiens
tccccgcccgccctcctctg

SEQ ID NO: 302408 - DNA, 21 bp, Homo sapiens
tccccgcccgccctcctctgc

SEQ ID NO: 302409 - DNA, 15 bp, Homo sapiens
tccccgcccttcttt

SEQ ID NO: 302410 - DNA, 14 bp, Homo sapiens
tccccgcctccact

SEQ ID NO: 302411 - DNA, 15 bp, Homo sapiens
tccccgcctccactc

SEQ ID NO: 302412 - DNA, 14 bp, Homo sapiens
tccccgccttccct

SEQ ID NO: 302413 - DNA, 16 bp, Homo sapiens
tccccggacgctggct

SEQ ID NO: 302414 - DNA, 18 bp, Homo sapiens
tccccggacgctggctcg

SEQ ID NO: 302415 - DNA, 20 bp, Homo sapiens
tccccgtgccccgcctcccc

SEQ ID NO: 302416 - DNA, 17 bp, Homo sapiens
tccccgtgggccatggc

SEQ ID NO: 302417 - DNA, 14 bp, Homo sapiens
tcccctcacctcca

SEQ ID NO: 302418 - DNA, 23 bp, Homo sapiens
tcccctccatctggggatggaga

SEQ ID NO: 302419 - DNA, 19 bp, Homo sapiens
tcccctcccacctctcctt

SEQ ID NO: 302420 - DNA, 13 bp, Homo sapiens
tcccctcccagtc

SEQ ID NO: 302421 - DNA, 18 bp, Homo sapiens
tcccctccccggccctac

SEQ ID NO: 302422 - DNA, 18 bp, Homo sapiens
tcccctccctgcctgctc

SEQ ID NO: 302423 - DNA, 19 bp, Homo sapiens
tcccctccctgcctgctcc

SEQ ID NO: 302424 - DNA, 13 bp, Homo sapiens
tcccctccctggc

SEQ ID NO: 302425 - DNA, 15 bp, Homo sapiens
tcccctccctggctc

SEQ ID NO: 302426 - DNA, 13 bp, Homo sapiens
tcccctccctgta

SEQ ID NO: 302427 - DNA, 14 bp, Homo sapiens
tcccctcctcttcc

SEQ ID NO: 302428 - DNA, 21 bp, Homo sapiens
tcccctccttgcctcctgtgt

SEQ ID NO: 302429 - DNA, 16 bp, Homo sapiens
tcccctcctttgtctt

SEQ ID NO: 302430 - DNA, 23 bp, Homo sapiens
tcccctcgtcctgtcccagaggt

SEQ ID NO: 302431 - DNA, 18 bp, Homo sapiens
tcccctctcctgcatccc

SEQ ID NO: 302432 - DNA, 19 bp, Homo sapiens
tcccctctcgccccatccc

SEQ ID NO: 302433 - DNA, 16 bp, Homo sapiens
tcccctgacctgtcca

SEQ ID NO: 302434 - DNA, 19 bp, Homo sapiens
tcccctgaggacctttctg

SEQ ID NO: 302435 - DNA, 14 bp, Homo sapiens
tcccctgcactgta

SEQ ID NO: 302436 - DNA, 17 bp, Homo sapiens
tcccctgcactgtaaaa

SEQ ID NO: 302437 - DNA, 14 bp, Homo sapiens
tcccctgccccgtc

SEQ ID NO: 302438 - DNA, 13 bp, Homo sapiens
tcccctgcccggt

SEQ ID NO: 302439 - DNA, 17 bp, Homo sapiens
tcccctgccctggtcca

SEQ ID NO: 302440 - DNA, 17 bp, Homo sapiens
tcccctgcctgtgagtg

SEQ ID NO: 302441 - DNA, 16 bp, Homo sapiens
tcccctgcgcaggccc

SEQ ID NO: 302442 - DNA, 20 bp, Homo sapiens
tcccctgcgcaggccctccg

SEQ ID NO: 302443 - DNA, 22 bp, Homo sapiens
tcccctggagccagcagggctg

SEQ ID NO: 302444 - DNA, 20 bp, Homo sapiens
tcccctgtcccaccaactct

SEQ ID NO: 302445 - DNA, 21 bp, Homo sapiens
tcccctgtgactcctcccttc

SEQ ID NO: 302446 - DNA, 18 bp, Homo sapiens
tcccctgtggtttgttat

SEQ ID NO: 302447 - DNA, 18 bp, Homo sapiens
tcccctgtgtagagcctg

SEQ ID NO: 302448 - DNA, 13 bp, Homo sapiens
tccccttccctgc

SEQ ID NO: 302449 - DNA, 20 bp, Homo sapiens
tccccttctcccctgcactg

SEQ ID NO: 302450 - DNA, 14 bp, Homo sapiens
tccccttgcactgg

SEQ ID NO: 302451 - DNA, 18 bp, Homo sapiens
tccccttgggatgtacct

SEQ ID NO: 302452 - DNA, 14 bp, Homo sapiens
tccccttgggcggc

SEQ ID NO: 302453 - DNA, 16 bp, Homo sapiens
tcccctttccaattcc

SEQ ID NO: 302454 - DNA, 20 bp, Homo sapiens
tcccctttccaattccaaaa

SEQ ID NO: 302455 - DNA, 15 bp, Homo sapiens
tcccctttcccatca

SEQ ID NO: 302456 - DNA, 22 bp, Homo sapiens
tcccctttcccatcaccccttc

SEQ ID NO: 302457 - DNA, 19 bp, Homo sapiens
tccccttttccttcagagt

SEQ ID NO: 302458 - DNA, 16 bp, Homo sapiens
tccccttttgcctggc

SEQ ID NO: 302459 - DNA, 18 bp, Homo sapiens
tccccttttgcctggctg

SEQ ID NO: 302460 - DNA, 19 bp, Homo sapiens
tccccttttgcctggctgt

SEQ ID NO: 302461 - DNA, 17 bp, Homo sapiens
tcccgagccccctgtcc

SEQ ID NO: 302462 - DNA, 18 bp, Homo sapiens
tcccgagccccctgtcct

SEQ ID NO: 302463 - DNA, 21 bp, Homo sapiens
tcccgagctactctcttgcca

SEQ ID NO: 302464 - DNA, 22 bp, Homo sapiens
tcccgaggaagggccagagcct

SEQ ID NO: 302465 - DNA, 13 bp, Homo sapiens
tcccgaggcagca

SEQ ID NO: 302466 - DNA, 23 bp, Homo sapiens
tcccgcagcaccagcctgagcca

SEQ ID NO: 302467 - DNA, 14 bp, Homo sapiens
tcccgcatgctgcc

SEQ ID NO: 302468 - DNA, 23 bp, Homo sapiens
tcccgccgagtactatgtattac

SEQ ID NO: 302469 - DNA, 16 bp, Homo sapiens
tcccgccgcccgaccc

SEQ ID NO: 302470 - DNA, 13 bp, Homo sapiens
tcccgccgcctcg

SEQ ID NO: 302471 - DNA, 23 bp, Homo sapiens
tcccgccgcctcgggccgcctcc

SEQ ID NO: 302472 - DNA, 15 bp, Homo sapiens
tcccgcctcagcctc

SEQ ID NO: 302473 - DNA, 15 bp, Homo sapiens
tcccgcgttcaagac

SEQ ID NO: 302474 - DNA, 13 bp, Homo sapiens
tcccgctgctgct

SEQ ID NO: 302475 - DNA, 14 bp, Homo sapiens
tcccgctgctgtgc

SEQ ID NO: 302476 - DNA, 15 bp, Homo sapiens
tcccggagcacagcc

SEQ ID NO: 302477 - DNA, 19 bp, Homo sapiens
tcccggagcacagccctgg

SEQ ID NO: 302478 - DNA, 20 bp, Homo sapiens
tcccggcaaccagatttcag

SEQ ID NO: 302479 - DNA, 18 bp, Homo sapiens
tcccggccaggcgggaga

SEQ ID NO: 302480 - DNA, 14 bp, Homo sapiens
tcccggccccgcgc

SEQ ID NO: 302481 - DNA, 15 bp, Homo sapiens
tcccggccccgcgcg

SEQ ID NO: 302482 - DNA, 23 bp, Homo sapiens
tcccggccccgcgcgtgccccca

SEQ ID NO: 302483 - DNA, 13 bp, Homo sapiens
tcccggctgcctg

SEQ ID NO: 302484 - DNA, 14 bp, Homo sapiens
tcccggctgcctgc

SEQ ID NO: 302485 - DNA, 18 bp, Homo sapiens
tcccggctgcctgccgcc

SEQ ID NO: 302486 - DNA, 14 bp, Homo sapiens
tcccggctggactt

SEQ ID NO: 302487 - DNA, 20 bp, Homo sapiens
tcccggctttgcagggagac

SEQ ID NO: 302488 - DNA, 14 bp, Homo sapiens
tcccgggccacgcc

SEQ ID NO: 302489 - DNA, 17 bp, Homo sapiens
tcccgggccacgcccca

SEQ ID NO: 302490 - DNA, 19 bp, Homo sapiens
tcccgggccacgccccagc

SEQ ID NO: 302491 - DNA, 20 bp, Homo sapiens
tcccgggccacgccccagcc

SEQ ID NO: 302492 - DNA, 21 bp, Homo sapiens
tcccgggccacgccccagccc

SEQ ID NO: 302493 - DNA, 22 bp, Homo sapiens
tcccgggccacgccccagcccg

SEQ ID NO: 302494 - DNA, 14 bp, Homo sapiens
tcccgggccctccc

SEQ ID NO: 302495 - DNA, 18 bp, Homo sapiens
tcccgggccctcccttgg

SEQ ID NO: 302496 - DNA, 13 bp, Homo sapiens
tcccggggccatg

SEQ ID NO: 302497 - DNA, 15 bp, Homo sapiens
tcccgggttagcctg

SEQ ID NO: 302498 - DNA, 17 bp, Homo sapiens
tcccgggttagcctggt

SEQ ID NO: 302499 - DNA, 17 bp, Homo sapiens
tcccggtttcagaagct

SEQ ID NO: 302500 - DNA, 14 bp, Homo sapiens
tcccgtacctcttc

SEQ ID NO: 302501 - DNA, 23 bp, Homo sapiens
tcccgtgaaagaattatttttgt

SEQ ID NO: 302502 - DNA, 16 bp, Homo sapiens
tccctaaaatacattt

SEQ ID NO: 302503 - DNA, 16 bp, Homo sapiens
tccctaaagccctctt

SEQ ID NO: 302504 - DNA, 13 bp, Homo sapiens
tccctaaccacta

SEQ ID NO: 302505 - DNA, 14 bp, Homo sapiens
tccctaactctcgg

SEQ ID NO: 302506 - DNA, 16 bp, Homo sapiens
tccctaactctcggga

SEQ ID NO: 302507 - DNA, 15 bp, Homo sapiens
tccctaagaattccc

SEQ ID NO: 302508 - DNA, 15 bp, Homo sapiens
tccctaattctcttc

SEQ ID NO: 302509 - DNA, 19 bp, Homo sapiens
tccctaattctcttcgctg

SEQ ID NO: 302510 - DNA, 21 bp, Homo sapiens
tccctaccactgagcccttgc

SEQ ID NO: 302511 - DNA, 13 bp, Homo sapiens
tccctacccacag

SEQ ID NO: 302512 - DNA, 17 bp, Homo sapiens
tccctacccacagggcc

SEQ ID NO: 302513 - DNA, 20 bp, Homo sapiens
tccctaccccctaagagcca

SEQ ID NO: 302514 - DNA, 23 bp, Homo sapiens
tccctaccgagtctcttctccac

SEQ ID NO: 302515 - DNA, 15 bp, Homo sapiens
tccctacctcaacct

SEQ ID NO: 302516 - DNA, 20 bp, Homo sapiens
tccctacctcaacctgtaaa

SEQ ID NO: 302517 - DNA, 22 bp, Homo sapiens
tccctacctcaacctgtaaatt

SEQ ID NO: 302518 - DNA, 14 bp, Homo sapiens
tccctagactctgt

SEQ ID NO: 302519 - DNA, 19 bp, Homo sapiens
tccctagagggttcctgta

SEQ ID NO: 302520 - DNA, 21 bp, Homo sapiens
tccctagatggttccctttgt

SEQ ID NO: 302521 - DNA, 14 bp, Homo sapiens
tccctagggctggg

SEQ ID NO: 302522 - DNA, 15 bp, Homo sapiens
tccctagttacccac

SEQ ID NO: 302523 - DNA, 13 bp, Homo sapiens
tccctagttcttt

SEQ ID NO: 302524 - DNA, 16 bp, Homo sapiens
tccctataatgctgga

SEQ ID NO: 302525 - DNA, 16 bp, Homo sapiens
tccctatgtcccagcc

SEQ ID NO: 302526 - DNA, 23 bp, Homo sapiens
tccctcaacaagggagagacctc

SEQ ID NO: 302527 - DNA, 15 bp, Homo sapiens
tccctcagcccctct

SEQ ID NO: 302528 - DNA, 16 bp, Homo sapiens
tccctcagcccctctt

SEQ ID NO: 302529 - DNA, 17 bp, Homo sapiens
tccctcagctctctggg

SEQ ID NO: 302530 - DNA, 19 bp, Homo sapiens
tccctcagtgtgaagcctg

SEQ ID NO: 302531 - DNA, 23 bp, Homo sapiens
tccctcattccaccttcccatgc

SEQ ID NO: 302532 - DNA, 9 bp, Homo sapiens
tccctccac

SEQ ID NO: 302533 - DNA, 18 bp, Homo sapiens
tccctccacacctccacc

SEQ ID NO: 302534 - DNA, 21 bp, Homo sapiens
tcctaggggtgcgctcacctg

SEQ ID NO: 302535 - DNA, 19 bp, Homo sapiens
tcctaggtgaccccatctc

SEQ ID NO: 302536 - DNA, 20 bp, Homo sapiens
tcctagtatacccactgcat

SEQ ID NO: 302537 - DNA, 22 bp, Homo sapiens
tcctagttcttaagcatttgcg

SEQ ID NO: 302538 - DNA, 20 bp, Homo sapiens
tcctataatataataaatat

SEQ ID NO: 302539 - DNA, 20 bp, Homo sapiens
tcctataattccctatcttt

SEQ ID NO: 302540 - DNA, 16 bp, Homo sapiens
tcctatacatttctgt

SEQ ID NO: 302541 - DNA, 16 bp, Homo sapiens
tcctatcacctcccct

SEQ ID NO: 302542 - DNA, 19 bp, Homo sapiens
tcctatcacctcccctcct

SEQ ID NO: 302543 - DNA, 17 bp, Homo sapiens
tcctatcagaagtttct

SEQ ID NO: 302544 - DNA, 20 bp, Homo sapiens
tcctatccccaggccaggtc

SEQ ID NO: 302545 - DNA, 22 bp, Homo sapiens
tcctatccttggagagcagctg

SEQ ID NO: 302546 - DNA, 22 bp, Homo sapiens
tcctatctgtatgtctgcctaa

SEQ ID NO: 302547 - DNA, 13 bp, Homo sapiens
tcctatctgtgtt

SEQ ID NO: 302548 - DNA, 18 bp, Homo sapiens
tcctatcttttatttcat

SEQ ID NO: 302549 - DNA, 18 bp, Homo sapiens
tcctatgtggcagctggg

SEQ ID NO: 302550 - DNA, 23 bp, Homo sapiens
tcctattaggctataagaagtag

SEQ ID NO: 302551 - DNA, 17 bp, Homo sapiens
tcctcaagcttctcaga

SEQ ID NO: 302552 - DNA, 20 bp, Homo sapiens
tcctcacaagcctcttctga

SEQ ID NO: 302553 - DNA, 12 bp, Homo sapiens
tcctcacagcct

SEQ ID NO: 302554 - DNA, 15 bp, Homo sapiens
tcctcacagcctctc

SEQ ID NO: 302555 - DNA, 16 bp, Homo sapiens
tcctcacagcctctcc

SEQ ID NO: 302556 - DNA, 19 bp, Homo sapiens
tcctcacagcctctccctt

SEQ ID NO: 302557 - DNA, 18 bp, Homo sapiens
tcctcaccaataacttca

SEQ ID NO: 302558 - DNA, 15 bp, Homo sapiens
tcctcaccccagtgc

SEQ ID NO: 302559 - DNA, 17 bp, Homo sapiens
tcctcaccccagtgcct

SEQ ID NO: 302560 - DNA, 16 bp, Homo sapiens
tcctcacccccacccc

SEQ ID NO: 302561 - DNA, 17 bp, Homo sapiens
tcctcaccccttccttt

SEQ ID NO: 302562 - DNA, 13 bp, Homo sapiens
tcctcacctctgg

SEQ ID NO: 302563 - DNA, 15 bp, Homo sapiens
tcctcacctctggac

SEQ ID NO: 302564 - DNA, 16 bp, Homo sapiens
tcctcacctctggact

SEQ ID NO: 302565 - DNA, 20 bp, Homo sapiens
tcctcacctctggactggct

SEQ ID NO: 302566 - DNA, 23 bp, Homo sapiens
tcctcacctctggactggctaga

SEQ ID NO: 302567 - DNA, 17 bp, Homo sapiens
tcctcacctgtctaggt

SEQ ID NO: 302568 - DNA, 12 bp, Homo sapiens
tcctcactccca

SEQ ID NO: 302569 - DNA, 13 bp, Homo sapiens
tcctcactcccag

SEQ ID NO: 302570 - DNA, 14 bp, Homo sapiens
tcctcactgggtgg

SEQ ID NO: 302571 - DNA, 22 bp, Homo sapiens
tcctcacttccatacagctcta

SEQ ID NO: 302572 - DNA, 15 bp, Homo sapiens
tcctcacttggggga

SEQ ID NO: 302573 - DNA, 19 bp, Homo sapiens
tcctcagcaagtgctgagt

SEQ ID NO: 302574 - DNA, 12 bp, Homo sapiens
tcctcagcccca

SEQ ID NO: 302575 - DNA, 23 bp, Homo sapiens
tcctcagccccagggccctgctc

SEQ ID NO: 302576 - DNA, 15 bp, Homo sapiens
tcctcagctgccaag

SEQ ID NO: 302577 - DNA, 17 bp, Homo sapiens
tcctcaggtagtactgg

SEQ ID NO: 302578 - DNA, 16 bp, Homo sapiens
tcctcaggtgaataac

SEQ ID NO: 302579 - DNA, 18 bp, Homo sapiens
tcctcagttcctgcagca

SEQ ID NO: 302580 - DNA, 16 bp, Homo sapiens
tcctcagttggaatca

SEQ ID NO: 302581 - DNA, 21 bp, Homo sapiens
tcctcatatggcccagtgtca

SEQ ID NO: 302582 - DNA, 15 bp, Homo sapiens
tcctcatcccctcgt

SEQ ID NO: 302583 - DNA, 23 bp, Homo sapiens
tcctcatcccctcgtcctgtccc

SEQ ID NO: 302584 - DNA, 16 bp, Homo sapiens
tcctcatcctgcttct

SEQ ID NO: 302585 - DNA, 12 bp, Homo sapiens
tcctcatctcta

SEQ ID NO: 302586 - DNA, 14 bp, Homo sapiens
tcctcatgaatgta

SEQ ID NO: 302587 - DNA, 20 bp, Homo sapiens
tcctcatgaatgtaaatttg

SEQ ID NO: 302588 - DNA, 21 bp, Homo sapiens
tcctcattcttctctcccaca

SEQ ID NO: 302589 - DNA, 12 bp, Homo sapiens
tcctcatttgtt

SEQ ID NO: 302590 - DNA, 23 bp, Homo sapiens
tcctccaaaacacaagggaggat

SEQ ID NO: 302591 - DNA, 14 bp, Homo sapiens
tcctccaaatgctg

SEQ ID NO: 302592 - DNA, 18 bp, Homo sapiens
tcctccaagaagccctcc

SEQ ID NO: 302593 - DNA, 19 bp, Homo sapiens
tcctccacagtgctgcttc

SEQ ID NO: 302594 - DNA, 16 bp, Homo sapiens
tcctccactccacctc

SEQ ID NO: 302595 - DNA, 17 bp, Homo sapiens
tcctccactccacctcc

SEQ ID NO: 302596 - DNA, 14 bp, Homo sapiens
tcctccagaagcct

SEQ ID NO: 302597 - DNA, 16 bp, Homo sapiens
tcctccagaagcctct

SEQ ID NO: 302598 - DNA, 13 bp, Homo sapiens
tcctccagcctcc

SEQ ID NO: 302599 - DNA, 19 bp, Homo sapiens
tcctccagcctcccctccc

SEQ ID NO: 302600 - DNA, 22 bp, Homo sapiens
tcctccagcgagtaccccagcc

SEQ ID NO: 302601 - DNA, 11 bp, Homo sapiens
tcctccagggg

SEQ ID NO: 302602 - DNA, 20 bp, Homo sapiens
tcctccagggggcctgcagg

SEQ ID NO: 302603 - DNA, 21 bp, Homo sapiens
tcctccagtacgtcccgctgc

SEQ ID NO: 302604 - DNA, 18 bp, Homo sapiens
tcctccagtctgttctca

SEQ ID NO: 302605 - DNA, 21 bp, Homo sapiens
tcctccatctttctacagaga

SEQ ID NO: 302606 - DNA, 16 bp, Homo sapiens
tcctccatggcccatc

SEQ ID NO: 302607 - DNA, 22 bp, Homo sapiens
tcctcccaactctggccttggt

SEQ ID NO: 302608 - DNA, 13 bp, Homo sapiens
tcctcccaggcgc

SEQ ID NO: 302609 - DNA, 16 bp, Homo sapiens
tcctcccatctccttc

SEQ ID NO: 302610 - DNA, 14 bp, Homo sapiens
tcctcccatggcct

SEQ ID NO: 302611 - DNA, 22 bp, Homo sapiens
tcctccccaccagtctcaccca

SEQ ID NO: 302612 - DNA, 10 bp, Homo sapiens
tcctccccag

SEQ ID NO: 302613 - DNA, 23 bp, Homo sapiens
tcctccccgatccccgacagtgg

SEQ ID NO: 302614 - DNA, 13 bp, Homo sapiens
tcctcccctcctc

SEQ ID NO: 302615 - DNA, 18 bp, Homo sapiens
tcctcccctcctcttccc

SEQ ID NO: 302616 - DNA, 13 bp, Homo sapiens
tcctccccttccc

SEQ ID NO: 302617 - DNA, 18 bp, Homo sapiens
tcctccccttccctgcaa

SEQ ID NO: 302618 - DNA, 16 bp, Homo sapiens
tcctcccgggccctcc

SEQ ID NO: 302619 - DNA, 19 bp, Homo sapiens
tcctcccgggccctccctt

SEQ ID NO: 302620 - DNA, 16 bp, Homo sapiens
tcctccctacttccaa

SEQ ID NO: 302621 - DNA, 17 bp, Homo sapiens
tcctccctccctgcagg

SEQ ID NO: 302622 - DNA, 18 bp, Homo sapiens
tcctccctccctgcaggg

SEQ ID NO: 302623 - DNA, 17 bp, Homo sapiens
tcctccctcctgcaggc

SEQ ID NO: 302624 - DNA, 18 bp, Homo sapiens
tcctccctcctgcaggct

SEQ ID NO: 302625 - DNA, 19 bp, Homo sapiens
tcctccctgctcagctggc

SEQ ID NO: 302626 - DNA, 20 bp, Homo sapiens
tcctccctgttatctgctag

SEQ ID NO: 302627 - DNA, 14 bp, Homo sapiens
tcctcccttcccca

SEQ ID NO: 302628 - DNA, 19 bp, Homo sapiens
tcctcccttgggttctgat

SEQ ID NO: 302629 - DNA, 17 bp, Homo sapiens
tcctccgtccacccagg

SEQ ID NO: 302630 - DNA, 23 bp, Homo sapiens
tcctccgtccacccaggctgcac

SEQ ID NO: 302631 - DNA, 11 bp, Homo sapiens
tcctcctccag

SEQ ID NO: 302632 - DNA, 13 bp, Homo sapiens
tcctcctcccctc

SEQ ID NO: 302633 - DNA, 16 bp, Homo sapiens
tcctcctcctcctcct

SEQ ID NO: 302634 - DNA, 15 bp, Homo sapiens
tcctcctcctcctgt

SEQ ID NO: 302635 - DNA, 22 bp, Homo sapiens
tcctcctgaagcctctgccctg

SEQ ID NO: 302636 - DNA, 12 bp, Homo sapiens
tcctcctgatgg

SEQ ID NO: 302637 - DNA, 16 bp, Homo sapiens
tcctcctgtctcctct

SEQ ID NO: 302638 - DNA, 19 bp, Homo sapiens
tcctcctgtctcctctgtc

SEQ ID NO: 302639 - DNA, 17 bp, Homo sapiens
tcctcctgttcctgcct

SEQ ID NO: 302640 - DNA, 20 bp, Homo sapiens
tcctcctgttcctgccttct

SEQ ID NO: 302641 - DNA, 13 bp, Homo sapiens
tcctccttccatg

SEQ ID NO: 302642 - DNA, 15 bp, Homo sapiens
tcctccttccatgga

SEQ ID NO: 302643 - DNA, 21 bp, Homo sapiens
tcctccttttcacagttctct

SEQ ID NO: 302644 - DNA, 16 bp, Homo sapiens
tcctcgctgtgccacc

SEQ ID NO: 302645 - DNA, 18 bp, Homo sapiens
tcctcggccagagctccc

SEQ ID NO: 302646 - DNA, 15 bp, Homo sapiens
tcctcggccccctcc

SEQ ID NO: 302647 - DNA, 19 bp, Homo sapiens
tcctcggccccctccatcg

SEQ ID NO: 302648 - DNA, 21 bp, Homo sapiens
tcctcggtggcatttgctgaa

SEQ ID NO: 302649 - DNA, 22 bp, Homo sapiens
tcctcggtggcatttgctgaat

SEQ ID NO: 302650 - DNA, 16 bp, Homo sapiens
tcctcgtcccctgcct

SEQ ID NO: 302651 - DNA, 16 bp, Homo sapiens
tcctcgtccggcctgc

SEQ ID NO: 302652 - DNA, 21 bp, Homo sapiens
tcctcgtccggcctgcagccc

SEQ ID NO: 302653 - DNA, 22 bp, Homo sapiens
tcctcgtccggcctgcagccca

SEQ ID NO: 302654 - DNA, 23 bp, Homo sapiens
tcctcgtccggcctgcagcccag

SEQ ID NO: 302655 - DNA, 21 bp, Homo sapiens
tcctcgtggcggggcagcagg

SEQ ID NO: 302656 - DNA, 21 bp, Homo sapiens
tcctctaacaggggctggtgg

SEQ ID NO: 302657 - DNA, 13 bp, Homo sapiens
tcctctaactcat

SEQ ID NO: 302658 - DNA, 14 bp, Homo sapiens
tcctctaactcatt

SEQ ID NO: 302659 - DNA, 16 bp, Homo sapiens
tcctctataggagatg

SEQ ID NO: 302660 - DNA, 19 bp, Homo sapiens
tcctctattgatgtacagt

SEQ ID NO: 302661 - DNA, 13 bp, Homo sapiens
tcctctcagcttc

SEQ ID NO: 302662 - DNA, 14 bp, Homo sapiens
tcctctcagcttct

SEQ ID NO: 302663 - DNA, 18 bp, Homo sapiens
tcctctcagcttctaatt

SEQ ID NO: 302664 - DNA, 22 bp, Homo sapiens
tccttagcagctcaggcgcagc

SEQ ID NO: 302665 - DNA, 14 bp, Homo sapiens
tccttaggcttaca

SEQ ID NO: 302666 - DNA, 15 bp, Homo sapiens
tccttagtcttctca

SEQ ID NO: 302667 - DNA, 18 bp, Homo sapiens
tccttatagacacttgct

SEQ ID NO: 302668 - DNA, 14 bp, Homo sapiens
tccttatttcaagg

SEQ ID NO: 302669 - DNA, 20 bp, Homo sapiens
tccttcaaaatccttccaaa

SEQ ID NO: 302670 - DNA, 18 bp, Homo sapiens
tccttcacatctcccatg

SEQ ID NO: 302671 - DNA, 19 bp, Homo sapiens
tccttcactctgacagtat

SEQ ID NO: 302672 - DNA, 18 bp, Homo sapiens
tccttcatgcctgggcct

SEQ ID NO: 302673 - DNA, 17 bp, Homo sapiens
tccttcatgcttttctc

SEQ ID NO: 302674 - DNA, 15 bp, Homo sapiens
tccttccaaagaatt

SEQ ID NO: 302675 - DNA, 19 bp, Homo sapiens
tccttccaaagaattctta

SEQ ID NO: 302676 - DNA, 14 bp, Homo sapiens
tccttccaactgct

SEQ ID NO: 302677 - DNA, 14 bp, Homo sapiens
tccttccacctccc

SEQ ID NO: 302678 - DNA, 12 bp, Homo sapiens
tccttccagcct

SEQ ID NO: 302679 - DNA, 21 bp, Homo sapiens
tccttccattgctcccagtgc

SEQ ID NO: 302680 - DNA, 14 bp, Homo sapiens
tccttcccactgtc

SEQ ID NO: 302681 - DNA, 18 bp, Homo sapiens
tccttcccactgtccttt

SEQ ID NO: 302682 - DNA, 21 bp, Homo sapiens
tccttcccatgcctgtctctg

SEQ ID NO: 302683 - DNA, 13 bp, Homo sapiens
tccttcccccagc

SEQ ID NO: 302684 - DNA, 15 bp, Homo sapiens
tccttcccccagccc

SEQ ID NO: 302685 - DNA, 19 bp, Homo sapiens
tccttcccccagcccaata

SEQ ID NO: 302686 - DNA, 12 bp, Homo sapiens
tccttccctctc

SEQ ID NO: 302687 - DNA, 16 bp, Homo sapiens
tccttccctggtccag

SEQ ID NO: 302688 - DNA, 20 bp, Homo sapiens
tccttccctggtccagattg

SEQ ID NO: 302689 - DNA, 22 bp, Homo sapiens
tccttcctacacccttggactt

SEQ ID NO: 302690 - DNA, 12 bp, Homo sapiens
tccttcctgccc

SEQ ID NO: 302691 - DNA, 14 bp, Homo sapiens
tccttcctgccctg

SEQ ID NO: 302692 - DNA, 15 bp, Homo sapiens
tccttcctgccctgt

SEQ ID NO: 302693 - DNA, 11 bp, Homo sapiens
tccttcctgcg

SEQ ID NO: 302694 - DNA, 18 bp, Homo sapiens
tccttcctgttctgtgtc

SEQ ID NO: 302695 - DNA, 21 bp, Homo sapiens
tccttcggaatccagtgcttc

SEQ ID NO: 302696 - DNA, 18 bp, Homo sapiens
tccttcgtgtctctccca

SEQ ID NO: 302697 - DNA, 18 bp, Homo sapiens
tccttctcccctccagac

SEQ ID NO: 302698 - DNA, 19 bp, Homo sapiens
tccttctcccctccagacc

SEQ ID NO: 302699 - DNA, 12 bp, Homo sapiens
tccttctccttc

SEQ ID NO: 302700 - DNA, 17 bp, Homo sapiens
tccttctcgtcttcctc

SEQ ID NO: 302701 - DNA, 21 bp, Homo sapiens
tccttctctactcatgccaga

SEQ ID NO: 302702 - DNA, 13 bp, Homo sapiens
tccttctggcctt

SEQ ID NO: 302703 - DNA, 17 bp, Homo sapiens
tccttcttgccctgagc

SEQ ID NO: 302704 - DNA, 20 bp, Homo sapiens
tccttgaagacatatcatgt

SEQ ID NO: 302705 - DNA, 23 bp, Homo sapiens
tccttgaagacatatcatgtgtg

SEQ ID NO: 302706 - DNA, 20 bp, Homo sapiens
tccttgactgaagcgaacat

SEQ ID NO: 302707 - DNA, 22 bp, Homo sapiens
tccttgactgaagcgaacatct

SEQ ID NO: 302708 - DNA, 19 bp, Homo sapiens
tccttgaggacctccacct

SEQ ID NO: 302709 - DNA, 21 bp, Homo sapiens
tccttgaggacctccacctgg

SEQ ID NO: 302710 - DNA, 22 bp, Homo sapiens
tccttgataatgttgtggtttg

SEQ ID NO: 302711 - DNA, 16 bp, Homo sapiens
tccttgccaccccccg

SEQ ID NO: 302712 - DNA, 15 bp, Homo sapiens
tccttgccccagtcc

SEQ ID NO: 302713 - DNA, 14 bp, Homo sapiens
tccttgccctgggc

SEQ ID NO: 302714 - DNA, 16 bp, Homo sapiens
tccttgccctgggcca

SEQ ID NO: 302715 - DNA, 13 bp, Homo sapiens
tccttgccttctt

SEQ ID NO: 302716 - DNA, 14 bp, Homo sapiens
tccttgccttcttt

SEQ ID NO: 302717 - DNA, 21 bp, Homo sapiens
tccttgctagccctggggtgg

SEQ ID NO: 302718 - DNA, 19 bp, Homo sapiens
tccttgctctccctcttct

SEQ ID NO: 302719 - DNA, 14 bp, Homo sapiens
tccttgcttttatg

SEQ ID NO: 302720 - DNA, 14 bp, Homo sapiens
tccttggagagcag

SEQ ID NO: 302721 - DNA, 14 bp, Homo sapiens
tccttggcaccaaa

SEQ ID NO: 302722 - DNA, 18 bp, Homo sapiens
tccttggcacccccatgc

SEQ ID NO: 302723 - DNA, 23 bp, Homo sapiens
tccttggcacccccatgctgcct

SEQ ID NO: 302724 - DNA, 13 bp, Homo sapiens
tccttggcccagc

SEQ ID NO: 302725 - DNA, 14 bp, Homo sapiens
tccttggcccagca

SEQ ID NO: 302726 - DNA, 15 bp, Homo sapiens
tccttggcccagcag

SEQ ID NO: 302727 - DNA, 10 bp, Homo sapiens
tccttggcct

SEQ ID NO: 302728 - DNA, 23 bp, Homo sapiens
tccttgggctcctggctgccagg

SEQ ID NO: 302729 - DNA, 22 bp, Homo sapiens
tccttggggaggggtcagctct

SEQ ID NO: 302730 - DNA, 23 bp, Homo sapiens
tccttggggaggggtcagctctg

SEQ ID NO: 302731 - DNA, 21 bp, Homo sapiens
tccttggtggccgggggtggg

SEQ ID NO: 302732 - DNA, 12 bp, Homo sapiens
tcctttaaccca

SEQ ID NO: 302733 - DNA, 23 bp, Homo sapiens
tcctttaactatcagagggatct

SEQ ID NO: 302734 - DNA, 23 bp, Homo sapiens
tcctttacaactaaataacacag

SEQ ID NO: 302735 - DNA, 20 bp, Homo sapiens
tcctttcacaaccttctgtg

SEQ ID NO: 302736 - DNA, 18 bp, Homo sapiens
tcctttcatcctcagcaa

SEQ ID NO: 302737 - DNA, 20 bp, Homo sapiens
tcctttcatcctcagcaagt

SEQ ID NO: 302738 - DNA, 12 bp, Homo sapiens
tcctttcccaca

SEQ ID NO: 302739 - DNA, 14 bp, Homo sapiens
tcctttcccacagt

SEQ ID NO: 302740 - DNA, 15 bp, Homo sapiens
tcctttcccacagtc

SEQ ID NO: 302741 - DNA, 13 bp, Homo sapiens
tcctttccttctc

SEQ ID NO: 302742 - DNA, 15 bp, Homo sapiens
tcctttccttctcgt

SEQ ID NO: 302743 - DNA, 11 bp, Homo sapiens
tcctttctatc

SEQ ID NO: 302744 - DNA, 15 bp, Homo sapiens
tcctttctcatccca

SEQ ID NO: 302745 - DNA, 16 bp, Homo sapiens
tcctttctccagccag

SEQ ID NO: 302746 - DNA, 17 bp, Homo sapiens
tcctttctccagccagc

SEQ ID NO: 302747 - DNA, 16 bp, Homo sapiens
tcctttctttttcttc

SEQ ID NO: 302748 - DNA, 20 bp, Homo sapiens
tcctttctttttcttcttcc

SEQ ID NO: 302749 - DNA, 17 bp, Homo sapiens
tcctttgagaaagaaat

SEQ ID NO: 302750 - DNA, 22 bp, Homo sapiens
tcctttgatattatgtggcttt

SEQ ID NO: 302751 - DNA, 13 bp, Homo sapiens
tcctttgctctgg

SEQ ID NO: 302752 - DNA, 22 bp, Homo sapiens
tcctttggagcttttttcttta

SEQ ID NO: 302753 - DNA, 19 bp, Homo sapiens
tcctttgtttttttttcct

SEQ ID NO: 302754 - DNA, 23 bp, Homo sapiens
tccttttcacagttctctccttc

SEQ ID NO: 302755 - DNA, 21 bp, Homo sapiens
tccttttctgtgaagcccttt

SEQ ID NO: 302756 - DNA, 14 bp, Homo sapiens
tccttttgaggctt

SEQ ID NO: 302757 - DNA, 18 bp, Homo sapiens
tcctttttctttttttaa

SEQ ID NO: 302758 - DNA, 17 bp, Homo sapiens
tccttttttctcttctg

SEQ ID NO: 302759 - DNA, 12 bp, Homo sapiens
tcgaaccaaggc

SEQ ID NO: 302760 - DNA, 13 bp, Homo sapiens
tcgaacccacact

SEQ ID NO: 302761 - DNA, 19 bp, Homo sapiens
tcgaacccacactgcaaca

SEQ ID NO: 302762 - DNA, 12 bp, Homo sapiens
tcgaactcctga

SEQ ID NO: 302763 - DNA, 16 bp, Homo sapiens
tcgaactcctgggctc

SEQ ID NO: 302764 - DNA, 14 bp, Homo sapiens
tcgaagctcagccc

SEQ ID NO: 302765 - DNA, 15 bp, Homo sapiens
tcgaagctcagccca

SEQ ID NO: 302766 - DNA, 19 bp, Homo sapiens
tcgaagctcagcccacccc

SEQ ID NO: 302767 - DNA, 16 bp, Homo sapiens
tcgaagtcttccatca

SEQ ID NO: 302768 - DNA, 15 bp, Homo sapiens
tcgaattaatagctt

SEQ ID NO: 302769 - DNA, 16 bp, Homo sapiens
tcgaattctcagacga

SEQ ID NO: 302770 - DNA, 22 bp, Homo sapiens
tcgacatagtatggaagtattt

SEQ ID NO: 302771 - DNA, 19 bp, Homo sapiens
tcgaccccaaagccccttg

SEQ ID NO: 302772 - DNA, 15 bp, Homo sapiens
tcgaccctttctctg

SEQ ID NO: 302773 - DNA, 16 bp, Homo sapiens
tcgactgtgacctgtg

SEQ ID NO: 302774 - DNA, 17 bp, Homo sapiens
tcgactgtgacctgtgg

SEQ ID NO: 302775 - DNA, 13 bp, Homo sapiens
tcgagagggctga

SEQ ID NO: 302776 - DNA, 14 bp, Homo sapiens
tcgagagggctgag

SEQ ID NO: 302777 - DNA, 15 bp, Homo sapiens
tcgagagggctgagc

SEQ ID NO: 302778 - DNA, 22 bp, Homo sapiens
tcgagagggctgagcccctcct

SEQ ID NO: 302779 - DNA, 22 bp, Homo sapiens
tcgagccccctggatgtcccct

SEQ ID NO: 302780 - DNA, 20 bp, Homo sapiens
tcgaggtgtcaccctgcaga

SEQ ID NO: 302781 - DNA, 13 bp, Homo sapiens
tcgagtccaaaat

SEQ ID NO: 302782 - DNA, 21 bp, Homo sapiens
tcgagtgatatggcttgtagg

SEQ ID NO: 302783 - DNA, 22 bp, Homo sapiens
tcgagtgcccctgcaggggagg

SEQ ID NO: 302784 - DNA, 15 bp, Homo sapiens
tcgagttacagacaa

SEQ ID NO: 302785 - DNA, 17 bp, Homo sapiens
tcgagttacagacaaag

SEQ ID NO: 302786 - DNA, 19 bp, Homo sapiens
tcgatgcaagtgtttctgt

SEQ ID NO: 302787 - DNA, 21 bp, Homo sapiens
tcgatgcaagtgtttctgttc

SEQ ID NO: 302788 - DNA, 13 bp, Homo sapiens
tcgatgcactgac

SEQ ID NO: 302789 - DNA, 14 bp, Homo sapiens
tcgatgcactgacc

SEQ ID NO: 302790 - DNA, 16 bp, Homo sapiens
tcgatgctcactgctt

SEQ ID NO: 302791 - DNA, 19 bp, Homo sapiens
tcgatgggggatgcttcat

SEQ ID NO: 302792 - DNA, 22 bp, Homo sapiens
tcgatggtggcgctttctcctg

SEQ ID NO: 302793 - DNA, 18 bp, Homo sapiens
tcgattaacctgcatgca

SEQ ID NO: 302794 - DNA, 13 bp, Homo sapiens
tcgcaaggcctgt

SEQ ID NO: 302795 - DNA, 19 bp, Homo sapiens
tcgcaaggcctgtgctgca

SEQ ID NO: 302796 - DNA, 16 bp, Homo sapiens
tcgcaccttttatacc

SEQ ID NO: 302797 - DNA, 13 bp, Homo sapiens
tcgcactgcaaat

SEQ ID NO: 302798 - DNA, 14 bp, Homo sapiens
tcgcagaccagagc

SEQ ID NO: 302799 - DNA, 19 bp, Homo sapiens
tcgcagaccagagctgtct

SEQ ID NO: 302800 - DNA, 16 bp, Homo sapiens
tcgcagcagctccgcc

SEQ ID NO: 302801 - DNA, 19 bp, Homo sapiens
tcgcaggagtctctgccac

SEQ ID NO: 302802 - DNA, 21 bp, Homo sapiens
tcgcaggagtctctgccaccc

SEQ ID NO: 302803 - DNA, 22 bp, Homo sapiens
tcgcaggagtctctgccaccca

SEQ ID NO: 302804 - DNA, 19 bp, Homo sapiens
tcgcaggatccgctgccac

SEQ ID NO: 302805 - DNA, 21 bp, Homo sapiens
tcgcaggatccgctgccacca

SEQ ID NO: 302806 - DNA, 14 bp, Homo sapiens
tcgcagtgcccagt

SEQ ID NO: 302807 - DNA, 13 bp, Homo sapiens
tcgcatttgtcaa

SEQ ID NO: 302808 - DNA, 16 bp, Homo sapiens
tcgccaagccatcaca

SEQ ID NO: 302809 - DNA, 18 bp, Homo sapiens
tcgccaagccatcacagg

SEQ ID NO: 302810 - DNA, 23 bp, Homo sapiens
tcgccatccgtcaccagaattag

SEQ ID NO: 302811 - DNA, 17 bp, Homo sapiens
tcgcccaaagccagaca

SEQ ID NO: 302812 - DNA, 18 bp, Homo sapiens
tcgcccaaagccagacag

SEQ ID NO: 302813 - DNA, 22 bp, Homo sapiens
tcgccccagatcaccagcccgg

SEQ ID NO: 302814 - DNA, 12 bp, Homo sapiens
tcgcccctccag

SEQ ID NO: 302815 - DNA, 13 bp, Homo sapiens
tcgcccctcctcg

SEQ ID NO: 302816 - DNA, 20 bp, Homo sapiens
tcgcccgcccactgtcctgg

SEQ ID NO: 302817 - DNA, 16 bp, Homo sapiens
tcgccctctgtgccta

SEQ ID NO: 302818 - DNA, 20 bp, Homo sapiens
tcgccctctgtgcctaataa

SEQ ID NO: 302819 - DNA, 14 bp, Homo sapiens
tcgccgtccctctg

SEQ ID NO: 302820 - DNA, 19 bp, Homo sapiens
tcgccgtccctctgccttg

SEQ ID NO: 302821 - DNA, 22 bp, Homo sapiens
tcgcctgacaaccactggtctg

SEQ ID NO: 302822 - DNA, 15 bp, Homo sapiens
tcgcgctggaatcca

SEQ ID NO: 302823 - DNA, 15 bp, Homo sapiens
tcgcggcgcagcccc

SEQ ID NO: 302824 - DNA, 21 bp, Homo sapiens
tcgcggctgggagcctcgccc

SEQ ID NO: 302825 - DNA, 16 bp, Homo sapiens
tcgcgtgccctcgctg

SEQ ID NO: 302826 - DNA, 20 bp, Homo sapiens
tcgcgtgccctcgctgcttc

SEQ ID NO: 302827 - DNA, 14 bp, Homo sapiens
tcgctattcccagg

SEQ ID NO: 302828 - DNA, 18 bp, Homo sapiens
tcgctattcccaggcagg

SEQ ID NO: 302829 - DNA, 15 bp, Homo sapiens
tcgctcccctctgcc

SEQ ID NO: 302830 - DNA, 18 bp, Homo sapiens
tcgctgctctagctggca

SEQ ID NO: 302831 - DNA, 19 bp, Homo sapiens
tcgctgctctagctggcag

SEQ ID NO: 302832 - DNA, 14 bp, Homo sapiens
tcgctgctgctact

SEQ ID NO: 302833 - DNA, 22 bp, Homo sapiens
tcgctgtgatgcatgagctccc

SEQ ID NO: 302834 - DNA, 12 bp, Homo sapiens
tcgctgtgccac

SEQ ID NO: 302835 - DNA, 13 bp, Homo sapiens
tcgctgtgccacc

SEQ ID NO: 302836 - DNA, 19 bp, Homo sapiens
tcgctgtgccaccacccct

SEQ ID NO: 302837 - DNA, 20 bp, Homo sapiens
tcgcttcataggcagagccc

SEQ ID NO: 302838 - DNA, 23 bp, Homo sapiens
tcgcttcataggcagagcccgcc

SEQ ID NO: 302839 - DNA, 14 bp, Homo sapiens
tcgcttctctgtga

SEQ ID NO: 302840 - DNA, 17 bp, Homo sapiens
tcgcttgaacctgggaa

SEQ ID NO: 302841 - DNA, 13 bp, Homo sapiens
tcgcttgagccca

SEQ ID NO: 302842 - DNA, 15 bp, Homo sapiens
tcgcttgagcccagg

SEQ ID NO: 302843 - DNA, 17 bp, Homo sapiens
tcgcttgagcccaggag

SEQ ID NO: 302844 - DNA, 22 bp, Homo sapiens
tcgcttgccgggcctgggcctc

SEQ ID NO: 302845 - DNA, 15 bp, Homo sapiens
tcggaagcagtgcct

SEQ ID NO: 302846 - DNA, 22 bp, Homo sapiens
tcggaagcagtgccttccataa

SEQ ID NO: 302847 - DNA, 23 bp, Homo sapiens
tcggaagcagtgccttccataat

SEQ ID NO: 302848 - DNA, 20 bp, Homo sapiens
tcggaagccgtctgactcca

SEQ ID NO: 302849 - DNA, 18 bp, Homo sapiens
tcggaatggtaaccgagc

SEQ ID NO: 302850 - DNA, 18 bp, Homo sapiens
tcggacccaccccaactc

SEQ ID NO: 302851 - DNA, 17 bp, Homo sapiens
tcggacctttcagctgt

SEQ ID NO: 302852 - DNA, 23 bp, Homo sapiens
tcggagacagtgatctccatatg

SEQ ID NO: 302853 - DNA, 20 bp, Homo sapiens
tcggagaggctgtctggggc

SEQ ID NO: 302854 - DNA, 23 bp, Homo sapiens
tcggagcctgtgttagtgtctgt

SEQ ID NO: 302855 - DNA, 12 bp, Homo sapiens
tcggaggccagg

SEQ ID NO: 302856 - DNA, 15 bp, Homo sapiens
tcggaggccaggccc

SEQ ID NO: 302857 - DNA, 17 bp, Homo sapiens
tcggaggccaggccctc

SEQ ID NO: 302858 - DNA, 22 bp, Homo sapiens
tcggagtagaaattgttcctga

SEQ ID NO: 302859 - DNA, 17 bp, Homo sapiens
tcggagtatctgggaac

SEQ ID NO: 302860 - DNA, 20 bp, Homo sapiens
tcggatctggggctctggga

SEQ ID NO: 302861 - DNA, 14 bp, Homo sapiens
tcggcaccttcccc

SEQ ID NO: 302862 - DNA, 16 bp, Homo sapiens
tcggcattcacacaca

SEQ ID NO: 302863 - DNA, 21 bp, Homo sapiens
tcggcattcacacacagcctg

SEQ ID NO: 302864 - DNA, 12 bp, Homo sapiens
tcggccagagct

SEQ ID NO: 302865 - DNA, 17 bp, Homo sapiens
tcggccccacccaccct

SEQ ID NO: 302866 - DNA, 19 bp, Homo sapiens
tcggcctccgaggctcccc

SEQ ID NO: 302867 - DNA, 17 bp, Homo sapiens
tcggctgggcagggccg

SEQ ID NO: 302868 - DNA, 21 bp, Homo sapiens
tcggctgggcagggccgcagg

SEQ ID NO: 302869 - DNA, 13 bp, Homo sapiens
tcggctgtggaga

SEQ ID NO: 302870 - DNA, 15 bp, Homo sapiens
tcgggaacagtgttt

SEQ ID NO: 302871 - DNA, 23 bp, Homo sapiens
tcgggaagaaggacttcctgcta

SEQ ID NO: 302872 - DNA, 24 bp, Homo sapiens
tcgggaagagaggagttcaatgat

SEQ ID NO: 302873 - DNA, 15 bp, Homo sapiens
tcgggaaggcctgag

SEQ ID NO: 302874 - DNA, 16 bp, Homo sapiens
tcgggaaggcctgagg

SEQ ID NO: 302875 - DNA, 23 bp, Homo sapiens
tcgggagcagtgtcttccataat

SEQ ID NO: 302876 - DNA, 17 bp, Homo sapiens
tcgggccgcctcctcca

SEQ ID NO: 302877 - DNA, 12 bp, Homo sapiens
tcgggctcagct

SEQ ID NO: 302878 - DNA, 17 bp, Homo sapiens
tcgggctcagctctggc

SEQ ID NO: 302879 - DNA, 22 bp, Homo sapiens
tcggggcaggaagtccctgaga

SEQ ID NO: 302880 - DNA, 12 bp, Homo sapiens
tcggggcagggc

SEQ ID NO: 302881 - DNA, 15 bp, Homo sapiens
tcggggcagggcagg

SEQ ID NO: 302882 - DNA, 22 bp, Homo sapiens
tcgggggaggagcacccccagc

SEQ ID NO: 302883 - DNA, 18 bp, Homo sapiens
tcggggggcgagggaggg

SEQ ID NO: 302884 - DNA, 13 bp, Homo sapiens
tcgggtccagaga

SEQ ID NO: 302885 - DNA, 15 bp, Homo sapiens
tcgggtccagagacc

SEQ ID NO: 302886 - DNA, 13 bp, Homo sapiens
tcggtcagcaccg

SEQ ID NO: 302887 - DNA, 18 bp, Homo sapiens
tcggtcctgtctcccctc

SEQ ID NO: 302888 - DNA, 23 bp, Homo sapiens
tcggtgttttgcaaacatttctt

SEQ ID NO: 302889 - DNA, 17 bp, Homo sapiens
tcgtagcccctgctaag

SEQ ID NO: 302890 - DNA, 16 bp, Homo sapiens
tcgtatagaaaaagca

SEQ ID NO: 302891 - DNA, 19 bp, Homo sapiens
tcgtatagaaaaagcacag

SEQ ID NO: 302892 - DNA, 19 bp, Homo sapiens
tcgtccacaggggcaggcc

SEQ ID NO: 302893 - DNA, 21 bp, Homo sapiens
tcgtccacaggggcaggcctg

SEQ ID NO: 302894 - DNA, 23 bp, Homo sapiens
tcgtccacaggggcaggcctggg

SEQ ID NO: 302895 - DNA, 22 bp, Homo sapiens
tcgtccggcctgcagcccagaa

SEQ ID NO: 302896 - DNA, 13 bp, Homo sapiens
tcgtccttttggt

SEQ ID NO: 302897 - DNA, 14 bp, Homo sapiens
tcgtctgatgtttt

SEQ ID NO: 302898 - DNA, 12 bp, Homo sapiens
tcgtctgtccca

SEQ ID NO: 302899 - DNA, 18 bp, Homo sapiens
tcgtgaaaccctgtctct

SEQ ID NO: 302900 - DNA, 20 bp, Homo sapiens
tcgtgcattggaagacccca

SEQ ID NO: 302901 - DNA, 23 bp, Homo sapiens
tcgtgcctccttccacctccctc

SEQ ID NO: 302902 - DNA, 16 bp, Homo sapiens
tcgtggagatgtcttc

SEQ ID NO: 302903 - DNA, 22 bp, Homo sapiens
tcgtggcagataatcagcctct

SEQ ID NO: 302904 - DNA, 15 bp, Homo sapiens
tcgtgggctctggct

SEQ ID NO: 302905 - DNA, 17 bp, Homo sapiens
tcgtgggctctggctcc

SEQ ID NO: 302906 - DNA, 19 bp, Homo sapiens
tcgtgggctctggctccct

SEQ ID NO: 302907 - DNA, 16 bp, Homo sapiens
tcgtggtagaagccag

SEQ ID NO: 302908 - DNA, 22 bp, Homo sapiens
tcgtggtgatcaattaaatgta

SEQ ID NO: 302909 - DNA, 23 bp, Homo sapiens
tcgtggtggagaatctgagggca

SEQ ID NO: 302910 - DNA, 14 bp, Homo sapiens
tcgtgtatcctggg

SEQ ID NO: 302911 - DNA, 16 bp, Homo sapiens
tcgtgtatcctggggc

SEQ ID NO: 302912 - DNA, 14 bp, Homo sapiens
tcgtgtctctccca

SEQ ID NO: 302913 - DNA, 15 bp, Homo sapiens
tcgtgtgcatgagaa

SEQ ID NO: 302914 - DNA, 12 bp, Homo sapiens
tcgttaacattg

SEQ ID NO: 302915 - DNA, 14 bp, Homo sapiens
tcgttaacattgac

SEQ ID NO: 302916 - DNA, 21 bp, Homo sapiens
tcgttaactgtgtatgtacat

SEQ ID NO: 302917 - DNA, 19 bp, Homo sapiens
tcgttctcgtgacccagtg

SEQ ID NO: 302918 - DNA, 13 bp, Homo sapiens
tcgttctctgcct

SEQ ID NO: 302919 - DNA, 12 bp, Homo sapiens
tcgttgcatggt

SEQ ID NO: 302920 - DNA, 15 bp, Homo sapiens
tcgttggttgtttct

SEQ ID NO: 302921 - DNA, 10 bp, Homo sapiens
tcgtttgttt

SEQ ID NO: 302922 - DNA, 14 bp, Homo sapiens
tcgtttgtttgttt

SEQ ID NO: 302923 - DNA, 18 bp, Homo sapiens
tcgttttctttgctgtgc

SEQ ID NO: 302924 - DNA, 19 bp, Homo sapiens
tctaaaaataaaatgatgt

SEQ ID NO: 302925 - DNA, 18 bp, Homo sapiens
tctcactgttccctctgc

SEQ ID NO: 302926 - DNA, 13 bp, Homo sapiens
tctcacttatacc

SEQ ID NO: 302927 - DNA, 21 bp, Homo sapiens
tctcactttaataataaaaat

SEQ ID NO: 302928 - DNA, 15 bp, Homo sapiens
tctcacttttctcca

SEQ ID NO: 302929 - DNA, 22 bp, Homo sapiens
tctcagaaaacttctcttctga

SEQ ID NO: 302930 - DNA, 15 bp, Homo sapiens
tctcagaacagctga

SEQ ID NO: 302931 - DNA, 19 bp, Homo sapiens
tctcagaagtgaaaaagac

SEQ ID NO: 302932 - DNA, 20 bp, Homo sapiens
tctcagaagtgaaaaagact

SEQ ID NO: 302933 - DNA, 20 bp, Homo sapiens
tctcagacccttgaagatgt

SEQ ID NO: 302934 - DNA, 21 bp, Homo sapiens
tctcagactctaaacacacaa

SEQ ID NO: 302935 - DNA, 17 bp, Homo sapiens
tctcagagactcccagg

SEQ ID NO: 302936 - DNA, 16 bp, Homo sapiens
tctcagagggttttct

SEQ ID NO: 302937 - DNA, 20 bp, Homo sapiens
tctcagatatttatattttt

SEQ ID NO: 302938 - DNA, 14 bp, Homo sapiens
tctcagatccctcg

SEQ ID NO: 302939 - DNA, 14 bp, Homo sapiens
tctcagatgggctg

SEQ ID NO: 302940 - DNA, 11 bp, Homo sapiens
tctcagcctcc

SEQ ID NO: 302941 - DNA, 18 bp, Homo sapiens
tctcagcctcctgagcct

SEQ ID NO: 302942 - DNA, 20 bp, Homo sapiens
tctcagccttacatttgtga

SEQ ID NO: 302943 - DNA, 16 bp, Homo sapiens
tctcagctctccaccc

SEQ ID NO: 302944 - DNA, 18 bp, Homo sapiens
tctcaggagcacaggcag

SEQ ID NO: 302945 - DNA, 19 bp, Homo sapiens
tctcaggagcacaggcagc

SEQ ID NO: 302946 - DNA, 20 bp, Homo sapiens
tctcaggagcacaggcagct

SEQ ID NO: 302947 - DNA, 23 bp, Homo sapiens
tctcaggagcacaggcagctgga

SEQ ID NO: 302948 - DNA, 17 bp, Homo sapiens
tctcaggaggtgtctcc

SEQ ID NO: 302949 - DNA, 15 bp, Homo sapiens
tctcaggagtatctt

SEQ ID NO: 302950 - DNA, 18 bp, Homo sapiens
tctcaggtgccactccct

SEQ ID NO: 302951 - DNA, 23 bp, Homo sapiens
tctcagtgcttcttactattaag

SEQ ID NO: 302952 - DNA, 13 bp, Homo sapiens
tctcagtttcact

SEQ ID NO: 302953 - DNA, 13 bp, Homo sapiens
tctcatagcatta

SEQ ID NO: 302954 - DNA, 16 bp, Homo sapiens
tctcataggaaaagta

SEQ ID NO: 302955 - DNA, 22 bp, Homo sapiens
tctcataggaaaagtacattta

SEQ ID NO: 302956 - DNA, 15 bp, Homo sapiens
tctcatatttttaca

SEQ ID NO: 302957 - DNA, 15 bp, Homo sapiens
tctcatcagcccagg

SEQ ID NO: 302958 - DNA, 16 bp, Homo sapiens
tctcatcagcccaggt

SEQ ID NO: 302959 - DNA, 22 bp, Homo sapiens
tctcatcagcccaggtcccagt

SEQ ID NO: 302960 - DNA, 21 bp, Homo sapiens
tctcatcagtgtcctcttgct

SEQ ID NO: 302961 - DNA, 23 bp, Homo sapiens
tctcatccaggtcctttccttct

SEQ ID NO: 302962 - DNA, 15 bp, Homo sapiens
tctcatccccagggg

SEQ ID NO: 302963 - DNA, 15 bp, Homo sapiens
tctcatgccagcagc

SEQ ID NO: 302964 - DNA, 16 bp, Homo sapiens
tctcattacttttgaa

SEQ ID NO: 302965 - DNA, 17 bp, Homo sapiens
tctcattcagtattaaa

SEQ ID NO: 302966 - DNA, 17 bp, Homo sapiens
tctcattccaacagtga

SEQ ID NO: 302967 - DNA, 13 bp, Homo sapiens
tctcattcctctg

SEQ ID NO: 302968 - DNA, 13 bp, Homo sapiens
tctcattgccagt

SEQ ID NO: 302969 - DNA, 15 bp, Homo sapiens
tctcattttgtatgt

SEQ ID NO: 302970 - DNA, 17 bp, Homo sapiens
tctcattttgtatgtat

SEQ ID NO: 302971 - DNA, 18 bp, Homo sapiens
tctcattttgtatgtatg

SEQ ID NO: 302972 - DNA, 14 bp, Homo sapiens
tctccaaaccactt

SEQ ID NO: 302973 - DNA, 11 bp, Homo sapiens
tctccaaagct

SEQ ID NO: 302974 - DNA, 12 bp, Homo sapiens
tctccaaagctt

SEQ ID NO: 302975 - DNA, 15 bp, Homo sapiens
tctccaaaggggctg

SEQ ID NO: 302976 - DNA, 12 bp, Homo sapiens
tctccaaatgag

SEQ ID NO: 302977 - DNA, 24 bp, Homo sapiens
tctccaaatgagatctaagccttt

SEQ ID NO: 302978 - DNA, 17 bp, Homo sapiens
tctccaagtctctctgt

SEQ ID NO: 302979 - DNA, 18 bp, Homo sapiens
tctccaccaggaacctct

SEQ ID NO: 302980 - DNA, 17 bp, Homo sapiens
tctccacccctcaagcc

SEQ ID NO: 302981 - DNA, 20 bp, Homo sapiens
tctccacccctcaagccagg

SEQ ID NO: 302982 - DNA, 23 bp, Homo sapiens
tctccaccctccggccagcgagt

SEQ ID NO: 302983 - DNA, 22 bp, Homo sapiens
tctccacctcccccaaaccctg

SEQ ID NO: 302984 - DNA, 16 bp, Homo sapiens
tctccacctgaagtga

SEQ ID NO: 302985 - DNA, 12 bp, Homo sapiens
tctccactccat

SEQ ID NO: 302986 - DNA, 17 bp, Homo sapiens
tctccacttctggtccc

SEQ ID NO: 302987 - DNA, 21 bp, Homo sapiens
tctccacttctggtcccctgt

SEQ ID NO: 302988 - DNA, 20 bp, Homo sapiens
tctccagaatgtaagaaaac

SEQ ID NO: 302989 - DNA, 12 bp, Homo sapiens
tctccagccagc

SEQ ID NO: 302990 - DNA, 16 bp, Homo sapiens
tctccagccagcaatg

SEQ ID NO: 302991 - DNA, 18 bp, Homo sapiens
tctccaggaaggcggggc

SEQ ID NO: 302992 - DNA, 13 bp, Homo sapiens
tctccaggatcca

SEQ ID NO: 302993 - DNA, 12 bp, Homo sapiens
tctccaggccca

SEQ ID NO: 302994 - DNA, 21 bp, Homo sapiens
tctccagggagtcccctcccc

SEQ ID NO: 302995 - DNA, 17 bp, Homo sapiens
tctccagggcccccacc

SEQ ID NO: 302996 - DNA, 18 bp, Homo sapiens
tctccagggcccccaccg

SEQ ID NO: 302997 - DNA, 14 bp, Homo sapiens
tctccatatgttac

SEQ ID NO: 302998 - DNA, 15 bp, Homo sapiens
tctccatatgttaca

SEQ ID NO: 302999 - DNA, 19 bp, Homo sapiens
tctccatcataggctgaca

SEQ ID NO: 303000 - DNA, 18 bp, Homo sapiens
tctccatcatatgcctga

SEQ ID NO: 303001 - DNA, 14 bp, Homo sapiens
tctccatccccatg

SEQ ID NO: 303002 - DNA, 12 bp, Homo sapiens
tctccatcccct

SEQ ID NO: 303003 - DNA, 13 bp, Homo sapiens
tctccatcccctc

SEQ ID NO: 303004 - DNA, 16 bp, Homo sapiens
tctccatcccctccct

SEQ ID NO: 303005 - DNA, 20 bp, Homo sapiens
tctccatcccctccctgcct

SEQ ID NO: 303006 - DNA, 22 bp, Homo sapiens
tctccatcccctccctgcctgc

SEQ ID NO: 303007 - DNA, 16 bp, Homo sapiens
tctccatgtttgatgt

SEQ ID NO: 303008 - DNA, 18 bp, Homo sapiens
tctccatttttcccagga

SEQ ID NO: 303009 - DNA, 24 bp, Homo sapiens
tctcccacccggccacagctgctg

SEQ ID NO: 303010 - DNA, 20 bp, Homo sapiens
tctcccagacttgtttcctg

SEQ ID NO: 303011 - DNA, 17 bp, Homo sapiens
tctcccagctctagaca

SEQ ID NO: 303012 - DNA, 15 bp, Homo sapiens
tctcccaggccccct

SEQ ID NO: 303013 - DNA, 12 bp, Homo sapiens
tctccccaggcc

SEQ ID NO: 303014 - DNA, 13 bp, Homo sapiens
tctccccaggcct

SEQ ID NO: 303015 - DNA, 16 bp, Homo sapiens
tctccccaggcctcca

SEQ ID NO: 303016 - DNA, 18 bp, Homo sapiens
tctccccaggcctccagc

SEQ ID NO: 303017 - DNA, 18 bp, Homo sapiens
tctccccagtgcctgcca

SEQ ID NO: 303018 - DNA, 19 bp, Homo sapiens
tctccccagtgcctgccac

SEQ ID NO: 303019 - DNA, 19 bp, Homo sapiens
tctccccatccccttccta

SEQ ID NO: 303020 - DNA, 22 bp, Homo sapiens
tctccccatccccttcctaaat

SEQ ID NO: 303021 - DNA, 16 bp, Homo sapiens
tctcccccgacactgc

SEQ ID NO: 303022 - DNA, 19 bp, Homo sapiens
tctcccccgacactgctgc

SEQ ID NO: 303023 - DNA, 21 bp, Homo sapiens
tctcccccgacactgctgcac

SEQ ID NO: 303024 - DNA, 16 bp, Homo sapiens
tctcccctccagaccc

SEQ ID NO: 303025 - DNA, 12 bp, Homo sapiens
tctcccctctcg

SEQ ID NO: 303026 - DNA, 13 bp, Homo sapiens
tctcccctctgct

SEQ ID NO: 303027 - DNA, 16 bp, Homo sapiens
tctcccctctgctggc

SEQ ID NO: 303028 - DNA, 12 bp, Homo sapiens
tctcccctgcac

SEQ ID NO: 303029 - DNA, 16 bp, Homo sapiens
tctcccctgcactgta

SEQ ID NO: 303030 - DNA, 21 bp, Homo sapiens
tctcccctgcactgtaaaatg

SEQ ID NO: 303031 - DNA, 12 bp, Homo sapiens
tctcccctgccc

SEQ ID NO: 303032 - DNA, 13 bp, Homo sapiens
tctcccctgcccc

SEQ ID NO: 303033 - DNA, 15 bp, Homo sapiens
tctcccctgccctgc

SEQ ID NO: 303034 - DNA, 13 bp, Homo sapiens
tctccccttttcc

SEQ ID NO: 303035 - DNA, 17 bp, Homo sapiens
tctcccgaatcctgagg

SEQ ID NO: 303036 - DNA, 13 bp, Homo sapiens
tctcccgctgctg

SEQ ID NO: 303037 - DNA, 14 bp, Homo sapiens
tctcccgctgctgc

SEQ ID NO: 303038 - DNA, 22 bp, Homo sapiens
tctccctaccctcttctcagct

SEQ ID NO: 303039 - DNA, 12 bp, Homo sapiens
tctccctccact

SEQ ID NO: 303040 - DNA, 20 bp, Homo sapiens
tctccctccactcctcccaa

SEQ ID NO: 303041 - DNA, 15 bp, Homo sapiens
tctccctccatggca

SEQ ID NO: 303042 - DNA, 19 bp, Homo sapiens
tctccctccgactccagat

SEQ ID NO: 303043 - DNA, 19 bp, Homo sapiens
tctccctcgaacccacact

SEQ ID NO: 303044 - DNA, 12 bp, Homo sapiens
tctccctgacct

SEQ ID NO: 303045 - DNA, 14 bp, Homo sapiens
tctccctgagcctg

SEQ ID NO: 303046 - DNA, 21 bp, Homo sapiens
tctccctgcctcacatctccc

SEQ ID NO: 303047 - DNA, 23 bp, Homo sapiens
tctccctggactctgtggggcca

SEQ ID NO: 303048 - DNA, 12 bp, Homo sapiens
tctcccttacta

SEQ ID NO: 303049 - DNA, 20 bp, Homo sapiens
tctcccttactattcccact

SEQ ID NO: 303050 - DNA, 16 bp, Homo sapiens
tctcccttcatccttc

SEQ ID NO: 303051 - DNA, 17 bp, Homo sapiens
tctcccttcctctctcc

SEQ ID NO: 303052 - DNA, 18 bp, Homo sapiens
tctcccttctttaccttc

SEQ ID NO: 303053 - DNA, 13 bp, Homo sapiens
tctcccttggcca

SEQ ID NO: 303054 - DNA, 19 bp, Homo sapiens
tctccggggtctgtgctgt

SEQ ID NO: 303055 - DNA, 19 bp, Homo sapiens
tctccggtgtgagcccacc

SEQ ID NO: 303056 - DNA, 13 bp, Homo sapiens
tctgacctcagca

SEQ ID NO: 303057 - DNA, 19 bp, Homo sapiens
tctgacctcatgagtgtca

SEQ ID NO: 303058 - DNA, 13 bp, Homo sapiens
tctgacggccctg

SEQ ID NO: 303059 - DNA, 16 bp, Homo sapiens
tctgacggccctgcaa

SEQ ID NO: 303060 - DNA, 13 bp, Homo sapiens
tctgactccagag

SEQ ID NO: 303061 - DNA, 15 bp, Homo sapiens
tctgactccagagtc

SEQ ID NO: 303062 - DNA, 17 bp, Homo sapiens
tctgactccagagtctg

SEQ ID NO: 303063 - DNA, 12 bp, Homo sapiens
tctgactcccaa

SEQ ID NO: 303064 - DNA, 19 bp, Homo sapiens
tctgactcccaaagagctg

SEQ ID NO: 303065 - DNA, 23 bp, Homo sapiens
tctgactgatcctgaacaagaaa

SEQ ID NO: 303066 - DNA, 18 bp, Homo sapiens
tctgactgcaacttctgt

SEQ ID NO: 303067 - DNA, 22 bp, Homo sapiens
tctgactgcaacttctgtccct

SEQ ID NO: 303068 - DNA, 14 bp, Homo sapiens
tctgactgtgtgtg

SEQ ID NO: 303069 - DNA, 15 bp, Homo sapiens
tctgagaactgactt

SEQ ID NO: 303070 - DNA, 16 bp, Homo sapiens
tctgagaactgacttt

SEQ ID NO: 303071 - DNA, 15 bp, Homo sapiens
tctgagaagaggagc

SEQ ID NO: 303072 - DNA, 23 bp, Homo sapiens
tctgagaagaggagccctcatct

SEQ ID NO: 303073 - DNA, 20 bp, Homo sapiens
tctgagaaggccctgtgccc

SEQ ID NO: 303074 - DNA, 20 bp, Homo sapiens
tctgagacggatggaaggag

SEQ ID NO: 303075 - DNA, 22 bp, Homo sapiens
tctgagacggatggaaggagag

SEQ ID NO: 303076 - DNA, 23 bp, Homo sapiens
tctgagacggatggaaggagaga

SEQ ID NO: 303077 - DNA, 17 bp, Homo sapiens
tctgagcaactgtgcag

SEQ ID NO: 303078 - DNA, 19 bp, Homo sapiens
tctgagcaactgtgcagca

SEQ ID NO: 303079 - DNA, 22 bp, Homo sapiens
tctgagcaactgtgcagcaccc

SEQ ID NO: 303080 - DNA, 21 bp, Homo sapiens
tctgagcacgggcaaagaaaa

SEQ ID NO: 303081 - DNA, 23 bp, Homo sapiens
tctgagcacgggcaaagaaaaca

SEQ ID NO: 303082 - DNA, 21 bp, Homo sapiens
tctgagcagcctctgccaggc

SEQ ID NO: 303083 - DNA, 18 bp, Homo sapiens
tctgagccaaagagaatg

SEQ ID NO: 303084 - DNA, 21 bp, Homo sapiens
tctgagccaccgcgagggcct

SEQ ID NO: 303085 - DNA, 14 bp, Homo sapiens
tctgagccaggagc

SEQ ID NO: 303086 - DNA, 14 bp, Homo sapiens
tctgagcccaggcc

SEQ ID NO: 303087 - DNA, 15 bp, Homo sapiens
tctgagcccaggccg

SEQ ID NO: 303088 - DNA, 16 bp, Homo sapiens
tctgagccccctgtgc

SEQ ID NO: 303089 - DNA, 19 bp, Homo sapiens
tctgagccccctgtgccca

SEQ ID NO: 303090 - DNA, 17 bp, Homo sapiens
tctgagccctgccctca

SEQ ID NO: 303091 - DNA, 17 bp, Homo sapiens
tctgagccttgagagaa

SEQ ID NO: 303092 - DNA, 15 bp, Homo sapiens
tctgagcggccgcct

SEQ ID NO: 303093 - DNA, 12 bp, Homo sapiens
tctgagctgggc

SEQ ID NO: 303094 - DNA, 13 bp, Homo sapiens
tctgagctttgtt

SEQ ID NO: 303095 - DNA, 18 bp, Homo sapiens
tctgagctttgttactga

SEQ ID NO: 303096 - DNA, 18 bp, Homo sapiens
tctgagcttttcatggaa

SEQ ID NO: 303097 - DNA, 21 bp, Homo sapiens
tctgagcttttcatggaagtg

SEQ ID NO: 303098 - DNA, 22 bp, Homo sapiens
tctgagcttttcatggaagtgg

SEQ ID NO: 303099 - DNA, 16 bp, Homo sapiens
tctgaggagtaaaaag

SEQ ID NO: 303100 - DNA, 16 bp, Homo sapiens
tctgaggagtccaaaa

SEQ ID NO: 303101 - DNA, 14 bp, Homo sapiens
tctgaggcctcatc

SEQ ID NO: 303102 - DNA, 20 bp, Homo sapiens
tctgagggcactctctgcca

SEQ ID NO: 303103 - DNA, 21 bp, Homo sapiens
tctgagggcactctctgccag

SEQ ID NO: 303104 - DNA, 22 bp, Homo sapiens
tctgagtttaccatttgtaata

SEQ ID NO: 303105 - DNA, 13 bp, Homo sapiens
tctgataaacaca

SEQ ID NO: 303106 - DNA, 22 bp, Homo sapiens
tctgataactagatggtgctga

SEQ ID NO: 303107 - DNA, 22 bp, Homo sapiens
tctgataagactggaaaatagt

SEQ ID NO: 303108 - DNA, 14 bp, Homo sapiens
tctgataatgtatt

SEQ ID NO: 303109 - DNA, 21 bp, Homo sapiens
tctgatattcaaacacacagt

SEQ ID NO: 303110 - DNA, 18 bp, Homo sapiens
tctgatatttgctggagt

SEQ ID NO: 303111 - DNA, 23 bp, Homo sapiens
tctgatcaaagcaccttgaatgg

SEQ ID NO: 303112 - DNA, 17 bp, Homo sapiens
tctgatcccctttggtt

SEQ ID NO: 303113 - DNA, 15 bp, Homo sapiens
tctgatccctcgccc

SEQ ID NO: 303114 - DNA, 15 bp, Homo sapiens
tctgatcttgtgctc

SEQ ID NO: 303115 - DNA, 19 bp, Homo sapiens
tctgatcttgtgctcagca

SEQ ID NO: 303116 - DNA, 17 bp, Homo sapiens
tctgatggtgagctggg

SEQ ID NO: 303117 - DNA, 20 bp, Homo sapiens
tctgatgtctctaaagcact

SEQ ID NO: 303118 - DNA, 17 bp, Homo sapiens
tctgatgtgtgcccaga

SEQ ID NO: 303119 - DNA, 18 bp, Homo sapiens
tctgattcactattagag

SEQ ID NO: 303120 - DNA, 20 bp, Homo sapiens
tctgattggacattttcttc

SEQ ID NO: 303121 - DNA, 14 bp, Homo sapiens
tctgatttgcaaat

SEQ ID NO: 303122 - DNA, 22 bp, Homo sapiens
tctgattttttactggctgtgt

SEQ ID NO: 303123 - DNA, 13 bp, Homo sapiens
tctgcaaaggagg

SEQ ID NO: 303124 - DNA, 22 bp, Homo sapiens
tctgcaaaggagggcctcagag

SEQ ID NO: 303125 - DNA, 15 bp, Homo sapiens
tctgcaacagcctgt

SEQ ID NO: 303126 - DNA, 15 bp, Homo sapiens
tctgcaactagccaa

SEQ ID NO: 303127 - DNA, 18 bp, Homo sapiens
tctgcaactagccaaggc

SEQ ID NO: 303128 - DNA, 22 bp, Homo sapiens
tctgcaactcatgaacaaaatg

SEQ ID NO: 303129 - DNA, 13 bp, Homo sapiens
tctgcaactgaat

SEQ ID NO: 303130 - DNA, 12 bp, Homo sapiens
tctgcaatttgt

SEQ ID NO: 303131 - DNA, 13 bp, Homo sapiens
tctgcacacataa

SEQ ID NO: 303132 - DNA, 15 bp, Homo sapiens
tctgcacagatggat

SEQ ID NO: 303133 - DNA, 23 bp, Homo sapiens
tctgcaccctggggcctggacct

SEQ ID NO: 303134 - DNA, 20 bp, Homo sapiens
tctgcactactgacatgtgg

SEQ ID NO: 303135 - DNA, 21 bp, Homo sapiens
tctgcactactgacatgtggg

SEQ ID NO: 303136 - DNA, 15 bp, Homo sapiens
tctgcactccatggc

SEQ ID NO: 303137 - DNA, 13 bp, Homo sapiens
tctgcagagactt

SEQ ID NO: 303138 - DNA, 15 bp, Homo sapiens
tctgcagaggcagca

SEQ ID NO: 303139 - DNA, 21 bp, Homo sapiens
tctgcagaggcagcaggagcc

SEQ ID NO: 303140 - DNA, 20 bp, Homo sapiens
tctgcagcatgacctgtgac

SEQ ID NO: 303141 - DNA, 13 bp, Homo sapiens
tctgcagcccaca

SEQ ID NO: 303142 - DNA, 22 bp, Homo sapiens
tctgcagcccacagaggacagt

SEQ ID NO: 303143 - DNA, 21 bp, Homo sapiens
tctgcagcccttgggcagttc

SEQ ID NO: 303144 - DNA, 19 bp, Homo sapiens
tctgcagcctgagctccac

SEQ ID NO: 303145 - DNA, 20 bp, Homo sapiens
tctgcagctattcacacaca

SEQ ID NO: 303146 - DNA, 21 bp, Homo sapiens
tctgcagctattcacacacac

SEQ ID NO: 303147 - DNA, 20 bp, Homo sapiens
tctgcagctgacctctgttg

SEQ ID NO: 303148 - DNA, 19 bp, Homo sapiens
tctgcaggatgattgtaca

SEQ ID NO: 303149 - DNA, 15 bp, Homo sapiens
tctgcaggccaccag

SEQ ID NO: 303150 - DNA, 15 bp, Homo sapiens
tctgcagggcagcct

SEQ ID NO: 303151 - DNA, 16 bp, Homo sapiens
tctgcagggcagcctg

SEQ ID NO: 303152 - DNA, 16 bp, Homo sapiens
tctgcatagacaaagg

SEQ ID NO: 303153 - DNA, 18 bp, Homo sapiens
tctgcatcatctgtagat

SEQ ID NO: 303154 - DNA, 16 bp, Homo sapiens
tctgcatgcttagagc

SEQ ID NO: 303155 - DNA, 15 bp, Homo sapiens
tctgcatggcagaag

SEQ ID NO: 303156 - DNA, 23 bp, Homo sapiens
tctgcattactattaactctgca

SEQ ID NO: 303157 - DNA, 23 bp, Homo sapiens
tctgcattgttattgtggaagat

SEQ ID NO: 303158 - DNA, 10 bp, Homo sapiens
tctgcattta

SEQ ID NO: 303159 - DNA, 19 bp, Homo sapiens
tctgcatttataaatgtgt

SEQ ID NO: 303160 - DNA, 17 bp, Homo sapiens
tctgcattttcacccca

SEQ ID NO: 303161 - DNA, 14 bp, Homo sapiens
tctgcattttctca

SEQ ID NO: 303162 - DNA, 15 bp, Homo sapiens
tctgcattttctcag

SEQ ID NO: 303163 - DNA, 15 bp, Homo sapiens
tctgccacactctga

SEQ ID NO: 303164 - DNA, 14 bp, Homo sapiens
tctgccacccactc

SEQ ID NO: 303165 - DNA, 16 bp, Homo sapiens
tctgccacccactcag

SEQ ID NO: 303166 - DNA, 21 bp, Homo sapiens
tctgccaccctacctgttcag

SEQ ID NO: 303167 - DNA, 19 bp, Homo sapiens
tctgccacttgcactgtgc

SEQ ID NO: 303168 - DNA, 20 bp, Homo sapiens
tctgccacttgcactgtgct

SEQ ID NO: 303169 - DNA, 21 bp, Homo sapiens
tctgccacttgcactgtgctt

SEQ ID NO: 303170 - DNA, 12 bp, Homo sapiens
tctgccaggccc

SEQ ID NO: 303171 - DNA, 14 bp, Homo sapiens
tctgccaggcctgt

SEQ ID NO: 303172 - DNA, 14 bp, Homo sapiens
tctgccagggagct

SEQ ID NO: 303173 - DNA, 13 bp, Homo sapiens
tctgccagtgaca

SEQ ID NO: 303174 - DNA, 17 bp, Homo sapiens
tctgccatcagcccctg

SEQ ID NO: 303175 - DNA, 21 bp, Homo sapiens
tctgccatttcaaatttctat

SEQ ID NO: 303176 - DNA, 17 bp, Homo sapiens
tctgcccaaatcccctc

SEQ ID NO: 303177 - DNA, 17 bp, Homo sapiens
tctgcccaactttcatt

SEQ ID NO: 303178 - DNA, 20 bp, Homo sapiens
tctgcccaactttcattggt

SEQ ID NO: 303179 - DNA, 22 bp, Homo sapiens
tctgcccaccgaccccctttct

SEQ ID NO: 303180 - DNA, 19 bp, Homo sapiens
tctgcccacttccccttcc

SEQ ID NO: 303181 - DNA, 13 bp, Homo sapiens
tctgcccagagct

SEQ ID NO: 303182 - DNA, 19 bp, Homo sapiens
tctgcccagagctgggtga

SEQ ID NO: 303183 - DNA, 17 bp, Homo sapiens
tctgccccaagcagcca

SEQ ID NO: 303184 - DNA, 20 bp, Homo sapiens
tctgccccaagcagccagcc

SEQ ID NO: 303185 - DNA, 14 bp, Homo sapiens
tctgccccaagccc

SEQ ID NO: 303186 - DNA, 15 bp, Homo sapiens
tctgccccaagcccc

SEQ ID NO: 303187 - DNA, 23 bp, Homo sapiens
tctgccccaatcgggtccagaga

SEQ ID NO: 303188 - DNA, 15 bp, Homo sapiens
tctgccccaccctca

SEQ ID NO: 303189 - DNA, 9 bp, Homo sapiens
tctgccccc

SEQ ID NO: 303190 - DNA, 14 bp, Homo sapiens
tctgcccccagctg

SEQ ID NO: 303191 - DNA, 23 bp, Homo sapiens
tctgcccccgcgggttctagacg

SEQ ID NO: 303192 - DNA, 13 bp, Homo sapiens
tctgccccctccc

SEQ ID NO: 303193 - DNA, 16 bp, Homo sapiens
tctgccccctcccccg

SEQ ID NO: 303194 - DNA, 19 bp, Homo sapiens
tctgccccctcccccgcag

SEQ ID NO: 303195 - DNA, 22 bp, Homo sapiens
tctgccccctcccccgcagaca

SEQ ID NO: 303196 - DNA, 16 bp, Homo sapiens
tctgcccctcccccaa

SEQ ID NO: 303197 - DNA, 16 bp, Homo sapiens
tctgcccctccgtccc

SEQ ID NO: 303198 - DNA, 22 bp, Homo sapiens
tctgcccctccgtccccagggt

SEQ ID NO: 303199 - DNA, 15 bp, Homo sapiens
tctgccccttgggca

SEQ ID NO: 303200 - DNA, 13 bp, Homo sapiens
tctgcccgcagag

SEQ ID NO: 303201 - DNA, 22 bp, Homo sapiens
tctgccctcagatgaaaataaa

SEQ ID NO: 303202 - DNA, 18 bp, Homo sapiens
tctgccctccctccttcc

SEQ ID NO: 303203 - DNA, 14 bp, Homo sapiens
tctgccctgcctcc

SEQ ID NO: 303204 - DNA, 15 bp, Homo sapiens
tctgccctgcctccc

SEQ ID NO: 303205 - DNA, 19 bp, Homo sapiens
tctgccgaccgcctgcttc

SEQ ID NO: 303206 - DNA, 23 bp, Homo sapiens
tctgccggtcccccatgccacca

SEQ ID NO: 303207 - DNA, 13 bp, Homo sapiens
tctgcctccagga

SEQ ID NO: 303208 - DNA, 21 bp, Homo sapiens
tctgcctcccacgctgggaca

SEQ ID NO: 303209 - DNA, 18 bp, Homo sapiens
tctgcctctaaggccaag

SEQ ID NO: 303210 - DNA, 21 bp, Homo sapiens
tctgcctgcctcatgctctct

SEQ ID NO: 303211 - DNA, 10 bp, Homo sapiens
tctgcctggg

SEQ ID NO: 303212 - DNA, 20 bp, Homo sapiens
tctgcctgggcctgtgcagc

SEQ ID NO: 303213 - DNA, 12 bp, Homo sapiens
tctgcctgtccc

SEQ ID NO: 303214 - DNA, 18 bp, Homo sapiens
tctgcctgtccctctcag

SEQ ID NO: 303215 - DNA, 16 bp, Homo sapiens
tctgcctgtggaactg

SEQ ID NO: 303216 - DNA, 19 bp, Homo sapiens
tctgcctgttataactctg

SEQ ID NO: 303217 - DNA, 13 bp, Homo sapiens
tctgccttagagg

SEQ ID NO: 303218 - DNA, 11 bp, Homo sapiens
tctgccttcca

SEQ ID NO: 303219 - DNA, 21 bp, Homo sapiens
tctgccttgcacaaaaagcac

SEQ ID NO: 303220 - DNA, 13 bp, Homo sapiens
tctgccttgctgc

SEQ ID NO: 303221 - DNA, 22 bp, Homo sapiens
tctgccttgctgcacctgaggc

SEQ ID NO: 303222 - DNA, 14 bp, Homo sapiens
tctgccttggacac

SEQ ID NO: 303223 - DNA, 19 bp, Homo sapiens
tctgcgagcaacagtgccc

SEQ ID NO: 303224 - DNA, 14 bp, Homo sapiens
tctgcgattttatc

SEQ ID NO: 303225 - DNA, 18 bp, Homo sapiens
tctgcgattttatctgtt

SEQ ID NO: 303226 - DNA, 18 bp, Homo sapiens
tctgcgcccttgtgccct

SEQ ID NO: 303227 - DNA, 19 bp, Homo sapiens
tctgcgcccttgtgccctg

SEQ ID NO: 303228 - DNA, 16 bp, Homo sapiens
tctgcgccgctgtgct

SEQ ID NO: 303229 - DNA, 18 bp, Homo sapiens
tctgcgccgctgtgctgt

SEQ ID NO: 303230 - DNA, 22 bp, Homo sapiens
tctgcgccgctgtgctgttgtc

SEQ ID NO: 303231 - DNA, 13 bp, Homo sapiens
tctgctatgtctg

SEQ ID NO: 303232 - DNA, 19 bp, Homo sapiens
tctgctcaatgaaaccttc

SEQ ID NO: 303233 - DNA, 21 bp, Homo sapiens
tctgctcaatgaaaccttcct

SEQ ID NO: 303234 - DNA, 21 bp, Homo sapiens
tctgctcacattccctctcat

SEQ ID NO: 303235 - DNA, 22 bp, Homo sapiens
tctgctcacattccctctcatc

SEQ ID NO: 303236 - DNA, 21 bp, Homo sapiens
tctgctccacagaaaccctgt

SEQ ID NO: 303237 - DNA, 16 bp, Homo sapiens
tctgctccacccttgg

SEQ ID NO: 303238 - DNA, 21 bp, Homo sapiens
tctgctccacccttggcctgt

SEQ ID NO: 303239 - DNA, 20 bp, Homo sapiens
tctgctcccagcccctacct

SEQ ID NO: 303240 - DNA, 13 bp, Homo sapiens
tctgctcctcacc

SEQ ID NO: 303241 - DNA, 15 bp, Homo sapiens
tctgctcctcacccc

SEQ ID NO: 303242 - DNA, 21 bp, Homo sapiens
tctgctctgttttgcatggag

SEQ ID NO: 303243 - DNA, 14 bp, Homo sapiens
tctgctctttctct

SEQ ID NO: 303244 - DNA, 20 bp, Homo sapiens
tctgctctttctctgccagt

SEQ ID NO: 303245 - DNA, 12 bp, Homo sapiens
tctgctgaacat

SEQ ID NO: 303246 - DNA, 19 bp, Homo sapiens
tctgctgacagatgttcca

SEQ ID NO: 303247 - DNA, 18 bp, Homo sapiens
tctgctgacttctgagca

SEQ ID NO: 303248 - DNA, 19 bp, Homo sapiens
tctgctgacttctgagcag

SEQ ID NO: 303249 - DNA, 13 bp, Homo sapiens
tctgctgcccacg

SEQ ID NO: 303250 - DNA, 17 bp, Homo sapiens
tctgctgcccacggcca

SEQ ID NO: 303251 - DNA, 21 bp, Homo sapiens
tctgctgcccacggccaccca

SEQ ID NO: 303252 - DNA, 13 bp, Homo sapiens
tctgctgccctcc

SEQ ID NO: 303253 - DNA, 23 bp, Homo sapiens
tctgctgcctgcccgcacagcag

SEQ ID NO: 303254 - DNA, 11 bp, Homo sapiens
tctgctgcttg

SEQ ID NO: 303255 - DNA, 12 bp, Homo sapiens
tctgctgcttga

SEQ ID NO: 303256 - DNA, 16 bp, Homo sapiens
tctgctggataaaatg

SEQ ID NO: 303257 - DNA, 21 bp, Homo sapiens
tctgctggccgggcacagctg

SEQ ID NO: 303258 - DNA, 13 bp, Homo sapiens
tctgctgttgcca

SEQ ID NO: 303259 - DNA, 15 bp, Homo sapiens
tctgcttaccaaaac

SEQ ID NO: 303260 - DNA, 18 bp, Homo sapiens
tctgcttaccaaaacata

SEQ ID NO: 303261 - DNA, 21 bp, Homo sapiens
tctgcttccatggcttcctga

SEQ ID NO: 303262 - DNA, 22 bp, Homo sapiens
tctgcttccatggcttcctgag

SEQ ID NO: 303263 - DNA, 21 bp, Homo sapiens
tctgctttcttgccacacagt

SEQ ID NO: 303264 - DNA, 19 bp, Homo sapiens
tctggaaaactcaggattc

SEQ ID NO: 303265 - DNA, 20 bp, Homo sapiens
tctggaaaactcaggattct

SEQ ID NO: 303266 - DNA, 15 bp, Homo sapiens
tctggaaaggaggaa

SEQ ID NO: 303267 - DNA, 16 bp, Homo sapiens
tctggaaaggaggaag

SEQ ID NO: 303268 - DNA, 17 bp, Homo sapiens
tctggaaattcttccct

SEQ ID NO: 303269 - DNA, 18 bp, Homo sapiens
tctggaaattcttccctg

SEQ ID NO: 303270 - DNA, 17 bp, Homo sapiens
tctggaagacgtggctc

SEQ ID NO: 303271 - DNA, 20 bp, Homo sapiens
tctggaaggcccctcccagc

SEQ ID NO: 303272 - DNA, 15 bp, Homo sapiens
tctggaaggctggct

SEQ ID NO: 303273 - DNA, 16 bp, Homo sapiens
tctggaaggctggctg

SEQ ID NO: 303274 - DNA, 17 bp, Homo sapiens
tctggaaggctggctga

SEQ ID NO: 303275 - DNA, 19 bp, Homo sapiens
tctggaaggctggctgagt

SEQ ID NO: 303276 - DNA, 17 bp, Homo sapiens
tctggaatcccagctcc

SEQ ID NO: 303277 - DNA, 15 bp, Homo sapiens
tctggaatgtaatca

SEQ ID NO: 303278 - DNA, 22 bp, Homo sapiens
tctggaatgtaatcaatgtttc

SEQ ID NO: 303279 - DNA, 17 bp, Homo sapiens
tctggaccccaggccat

SEQ ID NO: 303280 - DNA, 20 bp, Homo sapiens
tctggacctccccctcttgg

SEQ ID NO: 303281 - DNA, 20 bp, Homo sapiens
tctggaccttgttgttgtta

SEQ ID NO: 303282 - DNA, 18 bp, Homo sapiens
tctggactcctctgtcca

SEQ ID NO: 303283 - DNA, 16 bp, Homo sapiens
tctggactctgcccca

SEQ ID NO: 303284 - DNA, 20 bp, Homo sapiens
tctggactgaagcctgcagg

SEQ ID NO: 303285 - DNA, 21 bp, Homo sapiens
tctggactgaagcctgcagga

SEQ ID NO: 303286 - DNA, 17 bp, Homo sapiens
tctggagaccaggactc

SEQ ID NO: 303287 - DNA, 19 bp, Homo sapiens
tctggagccacctgtccca

SEQ ID NO: 303288 - DNA, 13 bp, Homo sapiens
tctggagccccta

SEQ ID NO: 303289 - DNA, 16 bp, Homo sapiens
tctggagcccctatcc

SEQ ID NO: 303290 - DNA, 15 bp, Homo sapiens
tctggaggcctctgg

SEQ ID NO: 303291 - DNA, 18 bp, Homo sapiens
tctggaggtacgaaaaga

SEQ ID NO: 303292 - DNA, 12 bp, Homo sapiens
tctggagtgtgt

SEQ ID NO: 303293 - DNA, 23 bp, Homo sapiens
tctggataattttgcataaaatt

SEQ ID NO: 303294 - DNA, 14 bp, Homo sapiens
tctggattgtggga

SEQ ID NO: 303295 - DNA, 19 bp, Homo sapiens
tctggcaaacatgtgcaac

SEQ ID NO: 303296 - DNA, 20 bp, Homo sapiens
tctggcaggtggccagggct

SEQ ID NO: 303297 - DNA, 19 bp, Homo sapiens
tctggcattctacacctgg

SEQ ID NO: 303298 - DNA, 23 bp, Homo sapiens
tctggcattctacacctggacca

SEQ ID NO: 303299 - DNA, 14 bp, Homo sapiens
tctggccaaatatg

SEQ ID NO: 303300 - DNA, 16 bp, Homo sapiens
tctggccaaatatgca

SEQ ID NO: 303301 - DNA, 10 bp, Homo sapiens
tctggccacc

SEQ ID NO: 303302 - DNA, 11 bp, Homo sapiens
tctggccaccc

SEQ ID NO: 303303 - DNA, 12 bp, Homo sapiens
tctggccaccct

SEQ ID NO: 303304 - DNA, 14 bp, Homo sapiens
tctggccactctgc

SEQ ID NO: 303305 - DNA, 22 bp, Homo sapiens
tctggccactctgctctgcaca

SEQ ID NO: 303306 - DNA, 14 bp, Homo sapiens
tctggccaggcact

SEQ ID NO: 303307 - DNA, 18 bp, Homo sapiens
tctggccctgttgtgggg

SEQ ID NO: 303308 - DNA, 22 bp, Homo sapiens
tctggcctagtggggaggggcc

SEQ ID NO: 303309 - DNA, 14 bp, Homo sapiens
tctggcctggcctg

SEQ ID NO: 303310 - DNA, 21 bp, Homo sapiens
tctggccttggttcctccagc

SEQ ID NO: 303311 - DNA, 15 bp, Homo sapiens
tctggcggcttcctg

SEQ ID NO: 303312 - DNA, 19 bp, Homo sapiens
tctggcggcttcctgtcca

SEQ ID NO: 303313 - DNA, 18 bp, Homo sapiens
tctggctaaggcatcatt

SEQ ID NO: 303314 - DNA, 21 bp, Homo sapiens
tctggctgccccaacctgctg

SEQ ID NO: 303315 - DNA, 17 bp, Homo sapiens
tctggctgcctggccca

SEQ ID NO: 303316 - DNA, 19 bp, Homo sapiens
tcttcaagggaagaaacac

SEQ ID NO: 303317 - DNA, 17 bp, Homo sapiens
tcttcaagggctgcttc

SEQ ID NO: 303318 - DNA, 17 bp, Homo sapiens
tcttcaatctctgttct

SEQ ID NO: 303319 - DNA, 19 bp, Homo sapiens
tcttcaatctctgttctgc

SEQ ID NO: 303320 - DNA, 11 bp, Homo sapiens
tcttcaccccg

SEQ ID NO: 303321 - DNA, 15 bp, Homo sapiens
tcttcactgcaattt

SEQ ID NO: 303322 - DNA, 22 bp, Homo sapiens
tcttcactgcagatttctcacc

SEQ ID NO: 303323 - DNA, 16 bp, Homo sapiens
tcttcagatcctgctg

SEQ ID NO: 303324 - DNA, 15 bp, Homo sapiens
tcttcagcgagaccc

SEQ ID NO: 303325 - DNA, 12 bp, Homo sapiens
tcttcagctggt

SEQ ID NO: 303326 - DNA, 20 bp, Homo sapiens
tcttcagctggtggatggtg

SEQ ID NO: 303327 - DNA, 23 bp, Homo sapiens
tcttcaggatgcacggtttctgt

SEQ ID NO: 303328 - DNA, 13 bp, Homo sapiens
tcttcaggcctcc

SEQ ID NO: 303329 - DNA, 15 bp, Homo sapiens
tcttcagggcactgc

SEQ ID NO: 303330 - DNA, 15 bp, Homo sapiens
tcttcagggggccag

SEQ ID NO: 303331 - DNA, 21 bp, Homo sapiens
tcttcagtcatggcattcgca

SEQ ID NO: 303332 - DNA, 18 bp, Homo sapiens
tcttcagttttatcttta

SEQ ID NO: 303333 - DNA, 20 bp, Homo sapiens
tcttcataacaattttagga

SEQ ID NO: 303334 - DNA, 22 bp, Homo sapiens
tcttcatactttttttcacagt

SEQ ID NO: 303335 - DNA, 12 bp, Homo sapiens
tcttcatataaa

SEQ ID NO: 303336 - DNA, 14 bp, Homo sapiens
tcttcatataaact

SEQ ID NO: 303337 - DNA, 16 bp, Homo sapiens
tcttcatccatagaca

SEQ ID NO: 303338 - DNA, 15 bp, Homo sapiens
tcttcatcccactcc

SEQ ID NO: 303339 - DNA, 16 bp, Homo sapiens
tcttcatccttagcaa

SEQ ID NO: 303340 - DNA, 14 bp, Homo sapiens
tcttcatgcaatga

SEQ ID NO: 303341 - DNA, 16 bp, Homo sapiens
tcttcatttcattgta

SEQ ID NO: 303342 - DNA, 22 bp, Homo sapiens
tcttcatttcattgtatgatgt

SEQ ID NO: 303343 - DNA, 13 bp, Homo sapiens
tcttccacacatg

SEQ ID NO: 303344 - DNA, 15 bp, Homo sapiens
tcttccacacatgca

SEQ ID NO: 303345 - DNA, 13 bp, Homo sapiens
tcttccacagcaa

SEQ ID NO: 303346 - DNA, 20 bp, Homo sapiens
tcttccagagcctaagaaaa

SEQ ID NO: 303347 - DNA, 22 bp, Homo sapiens
tcttccagagcctaagaaaatc

SEQ ID NO: 303348 - DNA, 16 bp, Homo sapiens
tcttccaggaagcaca

SEQ ID NO: 303349 - DNA, 20 bp, Homo sapiens
tcttccaggaagcacaggcc

SEQ ID NO: 303350 - DNA, 23 bp, Homo sapiens
tcttccaggcccagtccactggg

SEQ ID NO: 303351 - DNA, 14 bp, Homo sapiens
tcttccatcagcag

SEQ ID NO: 303352 - DNA, 15 bp, Homo sapiens
tcttccatcagcagt

SEQ ID NO: 303353 - DNA, 17 bp, Homo sapiens
tcttccatcagcagtga

SEQ ID NO: 303354 - DNA, 13 bp, Homo sapiens
tcttccatcatgg

SEQ ID NO: 303355 - DNA, 22 bp, Homo sapiens
tcttcccatgactgcacccagc

SEQ ID NO: 303356 - DNA, 14 bp, Homo sapiens
tcttcccatttgta

SEQ ID NO: 303357 - DNA, 11 bp, Homo sapiens
tcttccccaca

SEQ ID NO: 303358 - DNA, 13 bp, Homo sapiens
tcttccccagggt

SEQ ID NO: 303359 - DNA, 20 bp, Homo sapiens
tcttccccagggttctgtat

SEQ ID NO: 303360 - DNA, 18 bp, Homo sapiens
tcttcccccgctaattca

SEQ ID NO: 303361 - DNA, 17 bp, Homo sapiens
tcttccccctctcccag

SEQ ID NO: 303362 - DNA, 18 bp, Homo sapiens
tcttccccctctcccagt

SEQ ID NO: 303363 - DNA, 12 bp, Homo sapiens
tcttcccccttc

SEQ ID NO: 303364 - DNA, 24 bp, Homo sapiens
tcttcccccttcccctgcgccctc

SEQ ID NO: 303365 - DNA, 17 bp, Homo sapiens
tcttcccgcctcagcct

SEQ ID NO: 303366 - DNA, 21 bp, Homo sapiens
tcttcccgcctcagcctctca

SEQ ID NO: 303367 - DNA, 12 bp, Homo sapiens
tcttccctgctt

SEQ ID NO: 303368 - DNA, 11 bp, Homo sapiens
tcttccctggg

SEQ ID NO: 303369 - DNA, 12 bp, Homo sapiens
tcttccctgggg

SEQ ID NO: 303370 - DNA, 21 bp, Homo sapiens
tcttccctgtcttccccacct

SEQ ID NO: 303371 - DNA, 19 bp, Homo sapiens
tcttccggagatgtagcaa

SEQ ID NO: 303372 - DNA, 14 bp, Homo sapiens
tcttcctcatcctg

SEQ ID NO: 303373 - DNA, 16 bp, Homo sapiens
tcttcctcatcctgct

SEQ ID NO: 303374 - DNA, 21 bp, Homo sapiens
tcttcctcatcctgcttctct

SEQ ID NO: 303375 - DNA, 13 bp, Homo sapiens
tcttcctccctcc

SEQ ID NO: 303376 - DNA, 20 bp, Homo sapiens
tcttcctccctccctgcagg

SEQ ID NO: 303377 - DNA, 21 bp, Homo sapiens
tcttcctccctccctgcaggg

SEQ ID NO: 303378 - DNA, 16 bp, Homo sapiens
tcttcctctctctcac

SEQ ID NO: 303379 - DNA, 11 bp, Homo sapiens
tcttcctctgc

SEQ ID NO: 303380 - DNA, 12 bp, Homo sapiens
tcttcctgctgc

SEQ ID NO: 303381 - DNA, 13 bp, Homo sapiens
tcttcctgctgct

SEQ ID NO: 303382 - DNA, 18 bp, Homo sapiens
tcttcctggacctgagtc

SEQ ID NO: 303383 - DNA, 12 bp, Homo sapiens
tcttcctggagc

SEQ ID NO: 303384 - DNA, 23 bp, Homo sapiens
tcttccttcccaactcactgtgc

SEQ ID NO: 303385 - DNA, 12 bp, Homo sapiens
tcttccttccgc

SEQ ID NO: 303386 - DNA, 12 bp, Homo sapiens
tcttccttctct

SEQ ID NO: 303387 - DNA, 15 bp, Homo sapiens
tcttccttctctact

SEQ ID NO: 303388 - DNA, 22 bp, Homo sapiens
tcttcgctgctctagctggcag

SEQ ID NO: 303389 - DNA, 14 bp, Homo sapiens
tcttcgggaagaga

SEQ ID NO: 303390 - DNA, 16 bp, Homo sapiens
tcttcgggaagagagg

SEQ ID NO: 303391 - DNA, 16 bp, Homo sapiens
tcttcgtccttttggt

SEQ ID NO: 303392 - DNA, 18 bp, Homo sapiens
tcttcgttcttgttagta

SEQ ID NO: 303393 - DNA, 17 bp, Homo sapiens
tcttctacctcttccag

SEQ ID NO: 303394 - DNA, 13 bp, Homo sapiens
tcttctatattaa

SEQ ID NO: 303395 - DNA, 14 bp, Homo sapiens
tcttctatcctgca

SEQ ID NO: 303396 - DNA, 22 bp, Homo sapiens
tcttctatctaatccttaaaag

SEQ ID NO: 303397 - DNA, 17 bp, Homo sapiens
tcttctcaagtgcctta

SEQ ID NO: 303398 - DNA, 16 bp, Homo sapiens
tcttctcatagcatta

SEQ ID NO: 303399 - DNA, 16 bp, Homo sapiens
tcttctccactggatg

SEQ ID NO: 303400 - DNA, 14 bp, Homo sapiens
tcttctccccaggt

SEQ ID NO: 303401 - DNA, 11 bp, Homo sapiens
tcttctccctg

SEQ ID NO: 303402 - DNA, 12 bp, Homo sapiens
tcttctccctgt

SEQ ID NO: 303403 - DNA, 14 bp, Homo sapiens
tcttctcctttcac

SEQ ID NO: 303404 - DNA, 20 bp, Homo sapiens
tcttctctcttgattgattt

SEQ ID NO: 303405 - DNA, 19 bp, Homo sapiens
tcttctctgggcccagaga

SEQ ID NO: 303406 - DNA, 12 bp, Homo sapiens
tcttctgagcct

SEQ ID NO: 303407 - DNA, 15 bp, Homo sapiens
tcttctgcctgttat

SEQ ID NO: 303408 - DNA, 15 bp, Homo sapiens
tcttctgctccaccc

SEQ ID NO: 303409 - DNA, 16 bp, Homo sapiens
tcttctgctccaccct

SEQ ID NO: 303410 - DNA, 17 bp, Homo sapiens
tcttctgctccaccctt

SEQ ID NO: 303411 - DNA, 19 bp, Homo sapiens
tcttctgctccacccttgg

SEQ ID NO: 303412 - DNA, 16 bp, Homo sapiens
tcttctgctctttctt

SEQ ID NO: 303413 - DNA, 18 bp, Homo sapiens
tcttctgctctttcttct

SEQ ID NO: 303414 - DNA, 16 bp, Homo sapiens
tcttctgggcaccctc

SEQ ID NO: 303415 - DNA, 22 bp, Homo sapiens
tcttctgggcagagcctgtccc

SEQ ID NO: 303416 - DNA, 16 bp, Homo sapiens
tcttctggtgcatgtt

SEQ ID NO: 303417 - DNA, 18 bp, Homo sapiens
tcttctggtgcatgttct

SEQ ID NO: 303418 - DNA, 23 bp, Homo sapiens
tcttctggtgcatgttcttttct

SEQ ID NO: 303419 - DNA, 14 bp, Homo sapiens
tcttctgtttttct

SEQ ID NO: 303420 - DNA, 19 bp, Homo sapiens
tcttctgtttttctcaaat

SEQ ID NO: 303421 - DNA, 22 bp, Homo sapiens
tcttctgtttttctcaaataaa

SEQ ID NO: 303422 - DNA, 23 bp, Homo sapiens
tcttcttccaatgatgcttacta

SEQ ID NO: 303423 - DNA, 13 bp, Homo sapiens
tcttcttccctcc

SEQ ID NO: 303424 - DNA, 13 bp, Homo sapiens
tcttcttctcaag

SEQ ID NO: 303425 - DNA, 20 bp, Homo sapiens
tcttcttgagcagaccgtga

SEQ ID NO: 303426 - DNA, 20 bp, Homo sapiens
tcttcttgcggcaccgccca

SEQ ID NO: 303427 - DNA, 16 bp, Homo sapiens
tcttcttgtgtcctga

SEQ ID NO: 303428 - DNA, 18 bp, Homo sapiens
tcttgaaaaagtattgtt

SEQ ID NO: 303429 - DNA, 16 bp, Homo sapiens
tcttgaaacagcctgg

SEQ ID NO: 303430 - DNA, 13 bp, Homo sapiens
tcttgaagaatat

SEQ ID NO: 303431 - DNA, 13 bp, Homo sapiens
tcttgaagacttt

SEQ ID NO: 303432 - DNA, 16 bp, Homo sapiens
tcttgaagggcccagg

SEQ ID NO: 303433 - DNA, 22 bp, Homo sapiens
tcttgaatgttgaagaactcat

SEQ ID NO: 303434 - DNA, 21 bp, Homo sapiens
tcttgaattgtaaggaatgat

SEQ ID NO: 303435 - DNA, 14 bp, Homo sapiens
tcttgaatttctgc

SEQ ID NO: 303436 - DNA, 20 bp, Homo sapiens
tcttgacctgaactctgcaa

SEQ ID NO: 303437 - DNA, 14 bp, Homo sapiens
tcttgactctaaat

SEQ ID NO: 303438 - DNA, 21 bp, Homo sapiens
tcttgactctaaatgcagttt

SEQ ID NO: 303439 - DNA, 18 bp, Homo sapiens
tcttgagagcgctggcct

SEQ ID NO: 303440 - DNA, 13 bp, Homo sapiens
tcttgagagctgc

SEQ ID NO: 303441 - DNA, 16 bp, Homo sapiens
tcttgagccctcctgg

SEQ ID NO: 303442 - DNA, 20 bp, Homo sapiens
tcttgagggtcattttcctt

SEQ ID NO: 303443 - DNA, 15 bp, Homo sapiens
tcttgagtgggcccc

SEQ ID NO: 303444 - DNA, 18 bp, Homo sapiens
tcttgagtgggccccctc

SEQ ID NO: 303445 - DNA, 19 bp, Homo sapiens
tcttgagtgggccccctct

SEQ ID NO: 303446 - DNA, 21 bp, Homo sapiens
tcttgagtgggccccctctct

SEQ ID NO: 303447 - DNA, 16 bp, Homo sapiens
tcttgatgttgcttag

SEQ ID NO: 303448 - DNA, 20 bp, Homo sapiens
tgaaagggagctatcaggaa

SEQ ID NO: 303449 - DNA, 16 bp, Homo sapiens
tgaaagggctatggca

SEQ ID NO: 303450 - DNA, 19 bp, Homo sapiens
tgaaaggtaatctgaaaca

SEQ ID NO: 303451 - DNA, 23 bp, Homo sapiens
tgaaagtacatttggagacacaa

SEQ ID NO: 303452 - DNA, 22 bp, Homo sapiens
tgaaagtcttgtgactagtgct

SEQ ID NO: 303453 - DNA, 17 bp, Homo sapiens
tgaaagtgttttactct

SEQ ID NO: 303454 - DNA, 19 bp, Homo sapiens
tgaaagtgtttttctttaa

SEQ ID NO: 303455 - DNA, 16 bp, Homo sapiens
tgaaagtttgttctgc

SEQ ID NO: 303456 - DNA, 18 bp, Homo sapiens
tgaaagttttcagaacct

SEQ ID NO: 303457 - DNA, 13 bp, Homo sapiens
tgaaagttttcca

SEQ ID NO: 303458 - DNA, 21 bp, Homo sapiens
tgaaagttttccagtattgaa

SEQ ID NO: 303459 - DNA, 17 bp, Homo sapiens
tgaaataaactagggtt

SEQ ID NO: 303460 - DNA, 20 bp, Homo sapiens
tgaaataaattggtgataag

SEQ ID NO: 303461 - DNA, 21 bp, Homo sapiens
tgaaataaattggtgataagt

SEQ ID NO: 303462 - DNA, 16 bp, Homo sapiens
tgaaataacatggcct

SEQ ID NO: 303463 - DNA, 21 bp, Homo sapiens
tgaaatacctttgcctggata

SEQ ID NO: 303464 - DNA, 16 bp, Homo sapiens
tgaaatagtctgtgtg

SEQ ID NO: 303465 - DNA, 17 bp, Homo sapiens
tgaaatagtctgtgtga

SEQ ID NO: 303466 - DNA, 13 bp, Homo sapiens
tgaaatataaact

SEQ ID NO: 303467 - DNA, 19 bp, Homo sapiens
tgaaatataaactgtgaga

SEQ ID NO: 303468 - DNA, 23 bp, Homo sapiens
tgaaatataaactgtgagataaa

SEQ ID NO: 303469 - DNA, 12 bp, Homo sapiens
tgaaatatgcat

SEQ ID NO: 303470 - DNA, 15 bp, Homo sapiens
tgaaatatgcatgta

SEQ ID NO: 303471 - DNA, 16 bp, Homo sapiens
tgaaatatgcatgtac

SEQ ID NO: 303472 - DNA, 19 bp, Homo sapiens
tgaaatatgcatgtacttt

SEQ ID NO: 303473 - DNA, 14 bp, Homo sapiens
tgaaatatttgctt

SEQ ID NO: 303474 - DNA, 18 bp, Homo sapiens
tgaaatatttgcttattt

SEQ ID NO: 303475 - DNA, 16 bp, Homo sapiens
tgaaatcaccttttct

SEQ ID NO: 303476 - DNA, 20 bp, Homo sapiens
tgaaatgaaaacatgtaata

SEQ ID NO: 303477 - DNA, 21 bp, Homo sapiens
tgaaatgaaacaaataatcac

SEQ ID NO: 303478 - DNA, 19 bp, Homo sapiens
tgaaattaggccttatgta

SEQ ID NO: 303479 - DNA, 18 bp, Homo sapiens
tgaaattatagtttcaag

SEQ ID NO: 303480 - DNA, 23 bp, Homo sapiens
tgaaattatgtatgtttacatat

SEQ ID NO: 303481 - DNA, 14 bp, Homo sapiens
tgaaattatgtcaa

SEQ ID NO: 303482 - DNA, 15 bp, Homo sapiens
tgaaattatgtcaaa

SEQ ID NO: 303483 - DNA, 18 bp, Homo sapiens
tgaaattatgtcaaatgg

SEQ ID NO: 303484 - DNA, 19 bp, Homo sapiens
tgaaattatgtcaaatgga

SEQ ID NO: 303485 - DNA, 20 bp, Homo sapiens
tgaaattatgtcaaatggat

SEQ ID NO: 303486 - DNA, 14 bp, Homo sapiens
tgaaattcacaaag

SEQ ID NO: 303487 - DNA, 20 bp, Homo sapiens
tgaaatttattagttaatat

SEQ ID NO: 303488 - DNA, 16 bp, Homo sapiens
tgaaatttgttaatat

SEQ ID NO: 303489 - DNA, 19 bp, Homo sapiens
tgaaattttctagactttc

SEQ ID NO: 303490 - DNA, 18 bp, Homo sapiens
tgaaatttttaaatcatt

SEQ ID NO: 303491 - DNA, 19 bp, Homo sapiens
tgaaatttttaaatcattt

SEQ ID NO: 303492 - DNA, 20 bp, Homo sapiens
tgaaatttttaaatcatttc

SEQ ID NO: 303493 - DNA, 13 bp, Homo sapiens
tgaacaagaaaga

SEQ ID NO: 303494 - DNA, 17 bp, Homo sapiens
tgaacaatcaaggcaac

SEQ ID NO: 303495 - DNA, 13 bp, Homo sapiens
tgaacacaggcaa

SEQ ID NO: 303496 - DNA, 14 bp, Homo sapiens
tgaacacaggcaaa

SEQ ID NO: 303497 - DNA, 17 bp, Homo sapiens
tgaacacaggcaaagag

SEQ ID NO: 303498 - DNA, 17 bp, Homo sapiens
tgaacacatactagaaa

SEQ ID NO: 303499 - DNA, 23 bp, Homo sapiens
tgaacacatctcttagtccctct

SEQ ID NO: 303500 - DNA, 13 bp, Homo sapiens
tgaacacatggca

SEQ ID NO: 303501 - DNA, 15 bp, Homo sapiens
tgaacacatggcaga

SEQ ID NO: 303502 - DNA, 23 bp, Homo sapiens
tgaacactcatgcggcccagcca

SEQ ID NO: 303503 - DNA, 23 bp, Homo sapiens
tgaacagaactgccgtgggaatt

SEQ ID NO: 303504 - DNA, 22 bp, Homo sapiens
tgaacagattgctacacacaca

SEQ ID NO: 303505 - DNA, 18 bp, Homo sapiens
tgaacagccaaaagctat

SEQ ID NO: 303506 - DNA, 15 bp, Homo sapiens
tgaacagcttcactt

SEQ ID NO: 303507 - DNA, 21 bp, Homo sapiens
tgaacagggcccaggcctgga

SEQ ID NO: 303508 - DNA, 21 bp, Homo sapiens
tgaacagtttggatgtcctca

SEQ ID NO: 303509 - DNA, 22 bp, Homo sapiens
tgaacatgcagttcattatttt

SEQ ID NO: 303510 - DNA, 16 bp, Homo sapiens
tgaaccagctcatctc

SEQ ID NO: 303511 - DNA, 21 bp, Homo sapiens
tgaaccatcattataaacgtg

SEQ ID NO: 303512 - DNA, 13 bp, Homo sapiens
tgaaccccatggg

SEQ ID NO: 303513 - DNA, 19 bp, Homo sapiens
tgaaccccatgggcttgga

SEQ ID NO: 303514 - DNA, 13 bp, Homo sapiens
tgaacccttgctt

SEQ ID NO: 303515 - DNA, 20 bp, Homo sapiens
tgaacctaccttcatttcag

SEQ ID NO: 303516 - DNA, 12 bp, Homo sapiens
tgaacctgggaa

SEQ ID NO: 303517 - DNA, 20 bp, Homo sapiens
tgaacctgttcaaaatgtta

SEQ ID NO: 303518 - DNA, 21 bp, Homo sapiens
tgaaccttgttgatgccagct

SEQ ID NO: 303519 - DNA, 13 bp, Homo sapiens
tgaacgttttaat

SEQ ID NO: 303520 - DNA, 21 bp, Homo sapiens
tgaactaagttttgtgtgtat

SEQ ID NO: 303521 - DNA, 23 bp, Homo sapiens
tgaactaagttttgtgtgtatat

SEQ ID NO: 303522 - DNA, 18 bp, Homo sapiens
tgaactcaccgctcaccc

SEQ ID NO: 303523 - DNA, 14 bp, Homo sapiens
tgaactccatacag

SEQ ID NO: 303524 - DNA, 20 bp, Homo sapiens
tgaactccatacagcctcta

SEQ ID NO: 303525 - DNA, 22 bp, Homo sapiens
tgaactctcaaaagtctatttt

SEQ ID NO: 303526 - DNA, 23 bp, Homo sapiens
tgaactctcaaaagtctattttt

SEQ ID NO: 303527 - DNA, 14 bp, Homo sapiens
tgaactcttaatca

SEQ ID NO: 303528 - DNA, 14 bp, Homo sapiens
tgaactctttctgg

SEQ ID NO: 303529 - DNA, 13 bp, Homo sapiens
tgaactgaagttt

SEQ ID NO: 303530 - DNA, 15 bp, Homo sapiens
tgaactgaagtttca

SEQ ID NO: 303531 - DNA, 17 bp, Homo sapiens
tgaactgaagtttcaca

SEQ ID NO: 303532 - DNA, 12 bp, Homo sapiens
tgaactgagccg

SEQ ID NO: 303533 - DNA, 21 bp, Homo sapiens
tgaactgagccgtgcagctgg

SEQ ID NO: 303534 - DNA, 11 bp, Homo sapiens
tgaactgtgac

SEQ ID NO: 303535 - DNA, 23 bp, Homo sapiens
tgaacttacacttggagcccgtg

SEQ ID NO: 303536 - DNA, 18 bp, Homo sapiens
tgaacttcagctagagct

SEQ ID NO: 303537 - DNA, 17 bp, Homo sapiens
tgaacttgaggacacat

SEQ ID NO: 303538 - DNA, 20 bp, Homo sapiens
tgaacttgaggacacatgtc

SEQ ID NO: 303539 - DNA, 22 bp, Homo sapiens
tgaacttgaggacacatgtcca

SEQ ID NO: 303540 - DNA, 12 bp, Homo sapiens
tgaacttggttc

SEQ ID NO: 303541 - DNA, 14 bp, Homo sapiens
tgaagaacacagca

SEQ ID NO: 303542 - DNA, 22 bp, Homo sapiens
tgaagaacacagcatgtgccaa

SEQ ID NO: 303543 - DNA, 21 bp, Homo sapiens
tgaagaacaggcttggcaaag

SEQ ID NO: 303544 - DNA, 20 bp, Homo sapiens
tgaagaagaccagtcacagc

SEQ ID NO: 303545 - DNA, 15 bp, Homo sapiens
tgaagaatacagtta

SEQ ID NO: 303546 - DNA, 17 bp, Homo sapiens
tgaagaatgcattcaaa

SEQ ID NO: 303547 - DNA, 22 bp, Homo sapiens
tgaagacactacagaggattct

SEQ ID NO: 303548 - DNA, 21 bp, Homo sapiens
tgaagacactgtcaatgaggt

SEQ ID NO: 303549 - DNA, 24 bp, Homo sapiens
tgaagacctccacattaagtggct

SEQ ID NO: 303550 - DNA, 14 bp, Homo sapiens
tgaagacttttctt

SEQ ID NO: 303551 - DNA, 22 bp, Homo sapiens
tgaagacttttctttcagccaa

SEQ ID NO: 303552 - DNA, 18 bp, Homo sapiens
tgaagaggatcggaggct

SEQ ID NO: 303553 - DNA, 16 bp, Homo sapiens
tgaagataatttgcat

SEQ ID NO: 303554 - DNA, 17 bp, Homo sapiens
tgaagatacacaagagg

SEQ ID NO: 303555 - DNA, 17 bp, Homo sapiens
tgaagatctcagataaa

SEQ ID NO: 303556 - DNA, 21 bp, Homo sapiens
tgaagatgctgaaacaggaga

SEQ ID NO: 303557 - DNA, 11 bp, Homo sapiens
tgaagatgtcc

SEQ ID NO: 303558 - DNA, 16 bp, Homo sapiens
tgaagatgtcccccag

SEQ ID NO: 303559 - DNA, 18 bp, Homo sapiens
tgaagattctcctgtgct

SEQ ID NO: 303560 - DNA, 16 bp, Homo sapiens
tgaagcaaataccaaa

SEQ ID NO: 303561 - DNA, 17 bp, Homo sapiens
tgaagcaaataccaaag

SEQ ID NO: 303562 - DNA, 23 bp, Homo sapiens
tgaagcacctactatgtgctggg

SEQ ID NO: 303563 - DNA, 20 bp, Homo sapiens
tgaagcagtcttgctctgtt

SEQ ID NO: 303564 - DNA, 13 bp, Homo sapiens
tgaagcagtgcct

SEQ ID NO: 303565 - DNA, 18 bp, Homo sapiens
tgaagcagtgcctcgagg

SEQ ID NO: 303566 - DNA, 18 bp, Homo sapiens
tgaagcatgctttgctgc

SEQ ID NO: 303567 - DNA, 15 bp, Homo sapiens
tgaagcccaggagga

SEQ ID NO: 303568 - DNA, 17 bp, Homo sapiens
tgaagccgccaggaccg

SEQ ID NO: 303569 - DNA, 21 bp, Homo sapiens
tgaagcctctgccctgcctcc

SEQ ID NO: 303570 - DNA, 22 bp, Homo sapiens
tgaagcctgtcgtgttctctcc

SEQ ID NO: 303571 - DNA, 13 bp, Homo sapiens
tgaagcctttatc

SEQ ID NO: 303572 - DNA, 15 bp, Homo sapiens
tgaagctaagattta

SEQ ID NO: 303573 - DNA, 19 bp, Homo sapiens
tgaagctcagtttggctgt

SEQ ID NO: 303574 - DNA, 13 bp, Homo sapiens
tgaagctggggac

SEQ ID NO: 303575 - DNA, 20 bp, Homo sapiens
tgaagctggggacagctttc

SEQ ID NO: 303576 - DNA, 23 bp, Homo sapiens
tgaagctggggacagctttcctg

SEQ ID NO: 303577 - DNA, 22 bp, Homo sapiens
tgacaacctttgtgtaataaaa

SEQ ID NO: 303578 - DNA, 22 bp, Homo sapiens
tgacaactgaagagacacgtgg

SEQ ID NO: 303579 - DNA, 13 bp, Homo sapiens
tgacaactgtcta

SEQ ID NO: 303580 - DNA, 19 bp, Homo sapiens
tgacaactgtttaattgaa

SEQ ID NO: 303581 - DNA, 15 bp, Homo sapiens
tgacaacttctaatt

SEQ ID NO: 303582 - DNA, 21 bp, Homo sapiens
tgacaagccccaggcaggctg

SEQ ID NO: 303583 - DNA, 15 bp, Homo sapiens
tgacaaggccccaga

SEQ ID NO: 303584 - DNA, 22 bp, Homo sapiens
tgacaaggccccagagactcag

SEQ ID NO: 303585 - DNA, 19 bp, Homo sapiens
tgacaaggtgtgcagtggc

SEQ ID NO: 303586 - DNA, 15 bp, Homo sapiens
tgacaatggcagcta

SEQ ID NO: 303587 - DNA, 17 bp, Homo sapiens
tgacaatttcaaaatgc

SEQ ID NO: 303588 - DNA, 20 bp, Homo sapiens
tgacaatttcaaaatgcatg

SEQ ID NO: 303589 - DNA, 18 bp, Homo sapiens
tgacaattttgtacaaat

SEQ ID NO: 303590 - DNA, 22 bp, Homo sapiens
tgacaattttgtacaaatttgt

SEQ ID NO: 303591 - DNA, 18 bp, Homo sapiens
tgacacactcaccattta

SEQ ID NO: 303592 - DNA, 22 bp, Homo sapiens
tgacacaggggacactgaacct

SEQ ID NO: 303593 - DNA, 22 bp, Homo sapiens
tgacacagtcttggctcactgc

SEQ ID NO: 303594 - DNA, 19 bp, Homo sapiens
tgacacataaaagtaatta

SEQ ID NO: 303595 - DNA, 22 bp, Homo sapiens
tgacacataaaagtaattaatt

SEQ ID NO: 303596 - DNA, 22 bp, Homo sapiens
tgacacataatttgaatggtgc

SEQ ID NO: 303597 - DNA, 13 bp, Homo sapiens
tgacacatgctct

SEQ ID NO: 303598 - DNA, 15 bp, Homo sapiens
tgacaccaagaaacc

SEQ ID NO: 303599 - DNA, 13 bp, Homo sapiens
tgacacctaccat

SEQ ID NO: 303600 - DNA, 20 bp, Homo sapiens
tgacacctaccatgctgctt

SEQ ID NO: 303601 - DNA, 22 bp, Homo sapiens
tgacacctcccttcgtgtgtgc

SEQ ID NO: 303602 - DNA, 16 bp, Homo sapiens
tgacacggccatgacc

SEQ ID NO: 303603 - DNA, 18 bp, Homo sapiens
tgacactatagtttaaaa

SEQ ID NO: 303604 - DNA, 20 bp, Homo sapiens
tgacactatagtttaaaaca

SEQ ID NO: 303605 - DNA, 18 bp, Homo sapiens
tgacactcatcaggtaaa

SEQ ID NO: 303606 - DNA, 19 bp, Homo sapiens
tgacactctagtgacttcc

SEQ ID NO: 303607 - DNA, 13 bp, Homo sapiens
tgacactgagccc

SEQ ID NO: 303608 - DNA, 17 bp, Homo sapiens
tgacactgagccccacc

SEQ ID NO: 303609 - DNA, 18 bp, Homo sapiens
tgacactgagccccacct

SEQ ID NO: 303610 - DNA, 21 bp, Homo sapiens
tgacactggaagggtccggct

SEQ ID NO: 303611 - DNA, 16 bp, Homo sapiens
tgacacttcagagagc

SEQ ID NO: 303612 - DNA, 17 bp, Homo sapiens
tgacacttcagagagct

SEQ ID NO: 303613 - DNA, 18 bp, Homo sapiens
tgacacttcagagagctg

SEQ ID NO: 303614 - DNA, 24 bp, Homo sapiens
tgacacttcagagagctggtagtt

SEQ ID NO: 303615 - DNA, 14 bp, Homo sapiens
tgacagacaggctc

SEQ ID NO: 303616 - DNA, 19 bp, Homo sapiens
tgacagacaggctcttagc

SEQ ID NO: 303617 - DNA, 21 bp, Homo sapiens
tgacagagcaagactctgtct

SEQ ID NO: 303618 - DNA, 21 bp, Homo sapiens
tgacagagcgagattccgtct

SEQ ID NO: 303619 - DNA, 22 bp, Homo sapiens
tgacagatcctccatttttgtt

SEQ ID NO: 303620 - DNA, 19 bp, Homo sapiens
tgacagatgtcagccgagc

SEQ ID NO: 303621 - DNA, 15 bp, Homo sapiens
tgacagcagcctgtg

SEQ ID NO: 303622 - DNA, 16 bp, Homo sapiens
tgacagcagcctgtga

SEQ ID NO: 303623 - DNA, 19 bp, Homo sapiens
tgacagcagcctgtgaggg

SEQ ID NO: 303624 - DNA, 21 bp, Homo sapiens
tgacagcagcctgtgagggag

SEQ ID NO: 303625 - DNA, 12 bp, Homo sapiens
tgacagcctccc

SEQ ID NO: 303626 - DNA, 17 bp, Homo sapiens
tgacagcctcccacccc

SEQ ID NO: 303627 - DNA, 19 bp, Homo sapiens
tgacagcctcccaccccca

SEQ ID NO: 303628 - DNA, 17 bp, Homo sapiens
tgacagccttgggcctt

SEQ ID NO: 303629 - DNA, 22 bp, Homo sapiens
tgacagctactaacctggagac

SEQ ID NO: 303630 - DNA, 23 bp, Homo sapiens
tgacagctactaacctggagaca

SEQ ID NO: 303631 - DNA, 16 bp, Homo sapiens
tgacagctgtgctgta

SEQ ID NO: 303632 - DNA, 12 bp, Homo sapiens
tgacaggaagac

SEQ ID NO: 303633 - DNA, 19 bp, Homo sapiens
tgacaggaagactggagac

SEQ ID NO: 303634 - DNA, 21 bp, Homo sapiens
tgacaggaagcccaaggcagt

SEQ ID NO: 303635 - DNA, 16 bp, Homo sapiens
tgacaggcagacacat

SEQ ID NO: 303636 - DNA, 14 bp, Homo sapiens
tgacaggcccagtg

SEQ ID NO: 303637 - DNA, 17 bp, Homo sapiens
tgacaggtaaattaaga

SEQ ID NO: 303638 - DNA, 15 bp, Homo sapiens
tgacagtagcatact

SEQ ID NO: 303639 - DNA, 15 bp, Homo sapiens
tgacagtcttgtgct

SEQ ID NO: 303640 - DNA, 17 bp, Homo sapiens
tgacagtgcctgggaat

SEQ ID NO: 303641 - DNA, 20 bp, Homo sapiens
tgacagtgcctgggaatgta

SEQ ID NO: 303642 - DNA, 21 bp, Homo sapiens
tgacagtgcctgggaatgtat

SEQ ID NO: 303643 - DNA, 21 bp, Homo sapiens
tgacagttactcttcagtttt

SEQ ID NO: 303644 - DNA, 19 bp, Homo sapiens
tgacataaacccatctgta

SEQ ID NO: 303645 - DNA, 20 bp, Homo sapiens
tgacataaacccatctgtaa

SEQ ID NO: 303646 - DNA, 18 bp, Homo sapiens
tgacataatgtagtgagt

SEQ ID NO: 303647 - DNA, 20 bp, Homo sapiens
tgacatcaggtgatccacct

SEQ ID NO: 303648 - DNA, 13 bp, Homo sapiens
tgacatcctgacc

SEQ ID NO: 303649 - DNA, 22 bp, Homo sapiens
tgacatgattccttcctgttct

SEQ ID NO: 303650 - DNA, 19 bp, Homo sapiens
tgacatgcgggctgggcag

SEQ ID NO: 303651 - DNA, 17 bp, Homo sapiens
tgacatgtggaaagtga

SEQ ID NO: 303652 - DNA, 18 bp, Homo sapiens
tgacatgttatatatttt

SEQ ID NO: 303653 - DNA, 19 bp, Homo sapiens
tgacattaacagttttcca

SEQ ID NO: 303654 - DNA, 21 bp, Homo sapiens
tgacattaacagttttccatg

SEQ ID NO: 303655 - DNA, 17 bp, Homo sapiens
tgacattccttgtcacc

SEQ ID NO: 303656 - DNA, 22 bp, Homo sapiens
tgacattgtagagcttctggca

SEQ ID NO: 303657 - DNA, 15 bp, Homo sapiens
tgacatttaataact

SEQ ID NO: 303658 - DNA, 13 bp, Homo sapiens
tgacatttctcaa

SEQ ID NO: 303659 - DNA, 15 bp, Homo sapiens
tgacatttggtggta

SEQ ID NO: 303660 - DNA, 16 bp, Homo sapiens
tgacatttgtagttgg

SEQ ID NO: 303661 - DNA, 18 bp, Homo sapiens
tgacatttgtcctgcaga

SEQ ID NO: 303662 - DNA, 18 bp, Homo sapiens
tgacattttgtagctagt

SEQ ID NO: 303663 - DNA, 23 bp, Homo sapiens
tgacattttgtagctagtttaaa

SEQ ID NO: 303664 - DNA, 20 bp, Homo sapiens
tgaccaagttataaatcaat

SEQ ID NO: 303665 - DNA, 15 bp, Homo sapiens
tgaccaatctctgtg

SEQ ID NO: 303666 - DNA, 20 bp, Homo sapiens
tgaccaattgccctgccagg

SEQ ID NO: 303667 - DNA, 17 bp, Homo sapiens
tgaccacacctgcctct

SEQ ID NO: 303668 - DNA, 22 bp, Homo sapiens
tgaccaccttctgtccccagcc

SEQ ID NO: 303669 - DNA, 20 bp, Homo sapiens
tgaccacggacgtttccatc

SEQ ID NO: 303670 - DNA, 19 bp, Homo sapiens
tgaccagaaaatatgatat

SEQ ID NO: 303671 - DNA, 19 bp, Homo sapiens
tgaccagcaacttgtcttt

SEQ ID NO: 303672 - DNA, 15 bp, Homo sapiens
tgaccaggccaccat

SEQ ID NO: 303673 - DNA, 13 bp, Homo sapiens
tgaccataaaatt

SEQ ID NO: 303674 - DNA, 16 bp, Homo sapiens
tgaccatactgaggga

SEQ ID NO: 303675 - DNA, 19 bp, Homo sapiens
tgaccatccactctaccct

SEQ ID NO: 303676 - DNA, 17 bp, Homo sapiens
tgaccatgtgattatgg

SEQ ID NO: 303677 - DNA, 17 bp, Homo sapiens
tgacccaagtggggcct

SEQ ID NO: 303678 - DNA, 15 bp, Homo sapiens
tgacccaccagtgcc

SEQ ID NO: 303679 - DNA, 19 bp, Homo sapiens
tgacccagccccttgagaa

SEQ ID NO: 303680 - DNA, 21 bp, Homo sapiens
tgacccagtccccgtgccccg

SEQ ID NO: 303681 - DNA, 17 bp, Homo sapiens
tgaccccttcctgtctg

SEQ ID NO: 303682 - DNA, 22 bp, Homo sapiens
tgaccccttcctgtctggccca

SEQ ID NO: 303683 - DNA, 14 bp, Homo sapiens
tgacccggaggcca

SEQ ID NO: 303684 - DNA, 17 bp, Homo sapiens
tgacccggaggccacat

SEQ ID NO: 303685 - DNA, 20 bp, Homo sapiens
tgacccggaggccacatgag

SEQ ID NO: 303686 - DNA, 19 bp, Homo sapiens
tgacccggcccctaccagc

SEQ ID NO: 303687 - DNA, 17 bp, Homo sapiens
tgacccggggcagctgg

SEQ ID NO: 303688 - DNA, 18 bp, Homo sapiens
tgaccctagctctttcct

SEQ ID NO: 303689 - DNA, 16 bp, Homo sapiens
tgaccctgatcagtct

SEQ ID NO: 303690 - DNA, 18 bp, Homo sapiens
tgaccctggagcccggca

SEQ ID NO: 303691 - DNA, 13 bp, Homo sapiens
tgacccttcaggg

SEQ ID NO: 303692 - DNA, 16 bp, Homo sapiens
tgacccttcagggcca

SEQ ID NO: 303693 - DNA, 20 bp, Homo sapiens
tgacccttcagggccagaag

SEQ ID NO: 303694 - DNA, 21 bp, Homo sapiens
tgacccttcagggccagaagg

SEQ ID NO: 303695 - DNA, 14 bp, Homo sapiens
tgaccgcccagctc

SEQ ID NO: 303696 - DNA, 19 bp, Homo sapiens
tgaccggcccgccaccttg

SEQ ID NO: 303697 - DNA, 14 bp, Homo sapiens
tgaccggggtcctg

SEQ ID NO: 303698 - DNA, 20 bp, Homo sapiens
tgaccgtactctcacatgtg

SEQ ID NO: 303699 - DNA, 21 bp, Homo sapiens
tgaccgtactctcacatgtgg

SEQ ID NO: 303700 - DNA, 20 bp, Homo sapiens
tgacctaaatccattttcta

SEQ ID NO: 303701 - DNA, 21 bp, Homo sapiens
tgacctaaatccattttctaa

SEQ ID NO: 303702 - DNA, 17 bp, Homo sapiens
tgacctcaacctgtgat

SEQ ID NO: 303703 - DNA, 21 bp, Homo sapiens
tgacctcagctgcacattcct

SEQ ID NO: 303704 - DNA, 20 bp, Homo sapiens
tgacctcaggtgatccaccc

SEQ ID NO: 303705 - DNA, 13 bp, Homo sapiens
tgagaagataaaa

SEQ ID NO: 303706 - DNA, 19 bp, Homo sapiens
tgagaagcctcatgggagt

SEQ ID NO: 303707 - DNA, 18 bp, Homo sapiens
tgagaaggccctgtgccc

SEQ ID NO: 303708 - DNA, 23 bp, Homo sapiens
tgagaaggggaggacctctgggc

SEQ ID NO: 303709 - DNA, 15 bp, Homo sapiens
tgagaataattgtgt

SEQ ID NO: 303710 - DNA, 17 bp, Homo sapiens
tgagaataattgtgtac

SEQ ID NO: 303711 - DNA, 20 bp, Homo sapiens
tgagaataattgtgtacaaa

SEQ ID NO: 303712 - DNA, 16 bp, Homo sapiens
tgagaatcctgcctct

SEQ ID NO: 303713 - DNA, 17 bp, Homo sapiens
tgagaatcctgcctctc

SEQ ID NO: 303714 - DNA, 15 bp, Homo sapiens
tgagaatctgtgcag

SEQ ID NO: 303715 - DNA, 16 bp, Homo sapiens
tgagaatgtcatttgc

SEQ ID NO: 303716 - DNA, 16 bp, Homo sapiens
tgagaattcagctgcc

SEQ ID NO: 303717 - DNA, 18 bp, Homo sapiens
tgagaattcagctgcccc

SEQ ID NO: 303718 - DNA, 23 bp, Homo sapiens
tgagaattcagctgcccccgctc

SEQ ID NO: 303719 - DNA, 16 bp, Homo sapiens
tgagacaaaattttag

SEQ ID NO: 303720 - DNA, 16 bp, Homo sapiens
tgagacaacacacaca

SEQ ID NO: 303721 - DNA, 15 bp, Homo sapiens
tgagacaagccctgg

SEQ ID NO: 303722 - DNA, 16 bp, Homo sapiens
tgagacaagccctggc

SEQ ID NO: 303723 - DNA, 17 bp, Homo sapiens
tgagacaagccctggca

SEQ ID NO: 303724 - DNA, 13 bp, Homo sapiens
tgagacactgtca

SEQ ID NO: 303725 - DNA, 14 bp, Homo sapiens
tgagacactgtcaa

SEQ ID NO: 303726 - DNA, 22 bp, Homo sapiens
tgagacactgtcaagattaagt

SEQ ID NO: 303727 - DNA, 12 bp, Homo sapiens
tgagacagagtc

SEQ ID NO: 303728 - DNA, 14 bp, Homo sapiens
tgagacagcaagtt

SEQ ID NO: 303729 - DNA, 18 bp, Homo sapiens
tgagacagccacttggtt

SEQ ID NO: 303730 - DNA, 19 bp, Homo sapiens
tgagacagggttttttcat

SEQ ID NO: 303731 - DNA, 21 bp, Homo sapiens
tgagacagggttttttcattt

SEQ ID NO: 303732 - DNA, 14 bp, Homo sapiens
tgagacagtggggg

SEQ ID NO: 303733 - DNA, 16 bp, Homo sapiens
tgagacagtgggggtg

SEQ ID NO: 303734 - DNA, 12 bp, Homo sapiens
tgagaccacctc

SEQ ID NO: 303735 - DNA, 12 bp, Homo sapiens
tgagaccagttg

SEQ ID NO: 303736 - DNA, 21 bp, Homo sapiens
tgagaccagttgaataaaagt

SEQ ID NO: 303737 - DNA, 21 bp, Homo sapiens
tgagacccccaagcttccacc

SEQ ID NO: 303738 - DNA, 21 bp, Homo sapiens
tgagaccctcttctctgggcc

SEQ ID NO: 303739 - DNA, 17 bp, Homo sapiens
tgagacctggaaccaga

SEQ ID NO: 303740 - DNA, 17 bp, Homo sapiens
tgagacggatggaagga

SEQ ID NO: 303741 - DNA, 19 bp, Homo sapiens
tgagacggatggaaggaga

SEQ ID NO: 303742 - DNA, 20 bp, Homo sapiens
tgagacggatggaaggagag

SEQ ID NO: 303743 - DNA, 22 bp, Homo sapiens
tgagactataaagcagtagaca

SEQ ID NO: 303744 - DNA, 20 bp, Homo sapiens
tgagactcagacaggaaagg

SEQ ID NO: 303745 - DNA, 23 bp, Homo sapiens
tgagactcctgattgctctggaa

SEQ ID NO: 303746 - DNA, 16 bp, Homo sapiens
tgagactgcagaggag

SEQ ID NO: 303747 - DNA, 19 bp, Homo sapiens
tgagactgtcggagaggct

SEQ ID NO: 303748 - DNA, 15 bp, Homo sapiens
tgagactttgcccag

SEQ ID NO: 303749 - DNA, 19 bp, Homo sapiens
tgagagaaaaagtgcccct

SEQ ID NO: 303750 - DNA, 21 bp, Homo sapiens
tgagagaccctcgcaaaatga

SEQ ID NO: 303751 - DNA, 15 bp, Homo sapiens
tgagagagagtgaga

SEQ ID NO: 303752 - DNA, 16 bp, Homo sapiens
tgagagagagtgagag

SEQ ID NO: 303753 - DNA, 18 bp, Homo sapiens
tgagagagagtgagagca

SEQ ID NO: 303754 - DNA, 22 bp, Homo sapiens
tgagagccccagctgacatgga

SEQ ID NO: 303755 - DNA, 21 bp, Homo sapiens
tgagagcctttggtgaataac

SEQ ID NO: 303756 - DNA, 15 bp, Homo sapiens
tgagagctgctgagg

SEQ ID NO: 303757 - DNA, 19 bp, Homo sapiens
tgagagctgctgagggacc

SEQ ID NO: 303758 - DNA, 21 bp, Homo sapiens
tgagaggaggggtaaatatat

SEQ ID NO: 303759 - DNA, 23 bp, Homo sapiens
tgagaggaggggtaaatatatgt

SEQ ID NO: 303760 - DNA, 22 bp, Homo sapiens
tgagaggatgaatgtatgtgca

SEQ ID NO: 303761 - DNA, 23 bp, Homo sapiens
tgagaggcatccagtatcttgaa

SEQ ID NO: 303762 - DNA, 18 bp, Homo sapiens
tgagaggcatgacagctg

SEQ ID NO: 303763 - DNA, 19 bp, Homo sapiens
tgagaggctgaggtgggca

SEQ ID NO: 303764 - DNA, 19 bp, Homo sapiens
tgagaggtgggggatgctg

SEQ ID NO: 303765 - DNA, 21 bp, Homo sapiens
tgagagtgtctctgataaaag

SEQ ID NO: 303766 - DNA, 20 bp, Homo sapiens
tgagatacccagagagaaaa

SEQ ID NO: 303767 - DNA, 21 bp, Homo sapiens
tgagatatatctttatactta

SEQ ID NO: 303768 - DNA, 18 bp, Homo sapiens
tgagatatttttacctgc

SEQ ID NO: 303769 - DNA, 14 bp, Homo sapiens
tgagatcacagcct

SEQ ID NO: 303770 - DNA, 19 bp, Homo sapiens
tgagatcacagcctccagg

SEQ ID NO: 303771 - DNA, 21 bp, Homo sapiens
tgagatcacagcctccagggc

SEQ ID NO: 303772 - DNA, 18 bp, Homo sapiens
tgagatcagcattcaaaa

SEQ ID NO: 303773 - DNA, 20 bp, Homo sapiens
tgagatcagcattcaaaata

SEQ ID NO: 303774 - DNA, 22 bp, Homo sapiens
tgagatccttcacaggcagtgc

SEQ ID NO: 303775 - DNA, 16 bp, Homo sapiens
tgagatctaagccttt

SEQ ID NO: 303776 - DNA, 13 bp, Homo sapiens
tgagatgcaccaa

SEQ ID NO: 303777 - DNA, 17 bp, Homo sapiens
tgagatgtttagtagct

SEQ ID NO: 303778 - DNA, 13 bp, Homo sapiens
tgagattctaaat

SEQ ID NO: 303779 - DNA, 15 bp, Homo sapiens
tgagattctgggaaa

SEQ ID NO: 303780 - DNA, 23 bp, Homo sapiens
tgagattctgggaaaggtgctca

SEQ ID NO: 303781 - DNA, 16 bp, Homo sapiens
tgagattggcatggct

SEQ ID NO: 303782 - DNA, 17 bp, Homo sapiens
tgagattggcatggctt

SEQ ID NO: 303783 - DNA, 15 bp, Homo sapiens
tgagatttgccagca

SEQ ID NO: 303784 - DNA, 20 bp, Homo sapiens
tgagatttgccagcacaggg

SEQ ID NO: 303785 - DNA, 14 bp, Homo sapiens
tgagatttgtattt

SEQ ID NO: 303786 - DNA, 19 bp, Homo sapiens
tgagatttgtatttatatt

SEQ ID NO: 303787 - DNA, 20 bp, Homo sapiens
tgagcaaaaatgccaggcag

SEQ ID NO: 303788 - DNA, 19 bp, Homo sapiens
tgagcaaaatatgcccctt

SEQ ID NO: 303789 - DNA, 20 bp, Homo sapiens
tgagcaaaatatgccccttc

SEQ ID NO: 303790 - DNA, 18 bp, Homo sapiens
tgagcaactgtgcagcac

SEQ ID NO: 303791 - DNA, 14 bp, Homo sapiens
tgagcaaggacatt

SEQ ID NO: 303792 - DNA, 17 bp, Homo sapiens
tgagcaaggacattgcc

SEQ ID NO: 303793 - DNA, 18 bp, Homo sapiens
tgagcaagtcccatctca

SEQ ID NO: 303794 - DNA, 15 bp, Homo sapiens
tgagcaatcctgcaa

SEQ ID NO: 303795 - DNA, 19 bp, Homo sapiens
tgagcacgggcaaagaaaa

SEQ ID NO: 303796 - DNA, 20 bp, Homo sapiens
tgagcactcctgatttttat

SEQ ID NO: 303797 - DNA, 17 bp, Homo sapiens
tgagcagactggtgagc

SEQ ID NO: 303798 - DNA, 19 bp, Homo sapiens
tgagcagactggtgagcag

SEQ ID NO: 303799 - DNA, 20 bp, Homo sapiens
tgagcagcaggcgtgcctcg

SEQ ID NO: 303800 - DNA, 21 bp, Homo sapiens
tgagcagcaggcgtgcctcgt

SEQ ID NO: 303801 - DNA, 17 bp, Homo sapiens
tgagcagcctctgccag

SEQ ID NO: 303802 - DNA, 18 bp, Homo sapiens
tgagcagcctctgccagg

SEQ ID NO: 303803 - DNA, 19 bp, Homo sapiens
tgagcagggccctcagagg

SEQ ID NO: 303804 - DNA, 13 bp, Homo sapiens
tgagcagtccaga

SEQ ID NO: 303805 - DNA, 18 bp, Homo sapiens
tgagcagtctacttctgt

SEQ ID NO: 303806 - DNA, 15 bp, Homo sapiens
tgagcagtggctggt

SEQ ID NO: 303807 - DNA, 22 bp, Homo sapiens
tgagcagtggctggtccagggc

SEQ ID NO: 303808 - DNA, 17 bp, Homo sapiens
tgagcagtgtgtctcct

SEQ ID NO: 303809 - DNA, 16 bp, Homo sapiens
tgagcatgttactgac

SEQ ID NO: 303810 - DNA, 15 bp, Homo sapiens
tgagccaaagagaaa

SEQ ID NO: 303811 - DNA, 19 bp, Homo sapiens
tgagccacagtggggccca

SEQ ID NO: 303812 - DNA, 15 bp, Homo sapiens
tgagccaccacgccc

SEQ ID NO: 303813 - DNA, 18 bp, Homo sapiens
tgagccaccgcgagggcc

SEQ ID NO: 303814 - DNA, 20 bp, Homo sapiens
tgagccaccgcgagggcctg

SEQ ID NO: 303815 - DNA, 17 bp, Homo sapiens
tgagccaccgctgccag

SEQ ID NO: 303816 - DNA, 22 bp, Homo sapiens
tgagccactcgcagtcgcagga

SEQ ID NO: 303817 - DNA, 14 bp, Homo sapiens
tgagccaggcctgg

SEQ ID NO: 303818 - DNA, 18 bp, Homo sapiens
tgagccaggcctgggtct

SEQ ID NO: 303819 - DNA, 18 bp, Homo sapiens
tgagccagtcccaggggc

SEQ ID NO: 303820 - DNA, 22 bp, Homo sapiens
tgagccatagagatatttaaaa

SEQ ID NO: 303821 - DNA, 15 bp, Homo sapiens
tgagcccacaaagcc

SEQ ID NO: 303822 - DNA, 17 bp, Homo sapiens
tgagcccacaaagcctt

SEQ ID NO: 303823 - DNA, 12 bp, Homo sapiens
tgagcccactcc

SEQ ID NO: 303824 - DNA, 18 bp, Homo sapiens
tgagcccagccctgttct

SEQ ID NO: 303825 - DNA, 13 bp, Homo sapiens
tgagcccaggaag

SEQ ID NO: 303826 - DNA, 13 bp, Homo sapiens
tgagcccaggagt

SEQ ID NO: 303827 - DNA, 12 bp, Homo sapiens
tgagcccaggcc

SEQ ID NO: 303828 - DNA, 18 bp, Homo sapiens
tgagcccccacctgcctg

SEQ ID NO: 303829 - DNA, 15 bp, Homo sapiens
tgagcccccggctag

SEQ ID NO: 303830 - DNA, 15 bp, Homo sapiens
tgagccccctgcacc

SEQ ID NO: 303831 - DNA, 19 bp, Homo sapiens
tgagccccctgcacccacc

SEQ ID NO: 303832 - DNA, 23 bp, Homo sapiens
tgagccccctgcacccacccctg

SEQ ID NO: 303833 - DNA, 21 bp, Homo sapiens
tgagcccctaccccacaccag

SEQ ID NO: 303834 - DNA, 19 bp, Homo sapiens
tgatattccatgaatgtat

SEQ ID NO: 303835 - DNA, 22 bp, Homo sapiens
tgatattccatgaatgtatcag

SEQ ID NO: 303836 - DNA, 17 bp, Homo sapiens
tgatattgaccatgtga

SEQ ID NO: 303837 - DNA, 14 bp, Homo sapiens
tgatattggtgtga

SEQ ID NO: 303838 - DNA, 22 bp, Homo sapiens
tgatattgtcacctagcagata

SEQ ID NO: 303839 - DNA, 15 bp, Homo sapiens
tgatatttcttgctt

SEQ ID NO: 303840 - DNA, 23 bp, Homo sapiens
tgatattttcaacgcagccctgc

SEQ ID NO: 303841 - DNA, 20 bp, Homo sapiens
tgatattttcacatcttaat

SEQ ID NO: 303842 - DNA, 18 bp, Homo sapiens
tgatcaaaacctgtgcca

SEQ ID NO: 303843 - DNA, 19 bp, Homo sapiens
tgatcaacaatttaatgta

SEQ ID NO: 303844 - DNA, 13 bp, Homo sapiens
tgatcaataaaat

SEQ ID NO: 303845 - DNA, 18 bp, Homo sapiens
tgatcaataaaatgtgat

SEQ ID NO: 303846 - DNA, 14 bp, Homo sapiens
tgatcaattaaatg

SEQ ID NO: 303847 - DNA, 16 bp, Homo sapiens
tgatcaattaaatgta

SEQ ID NO: 303848 - DNA, 18 bp, Homo sapiens
tgatcacccccctgctta

SEQ ID NO: 303849 - DNA, 19 bp, Homo sapiens
tgatcacccccctgcttag

SEQ ID NO: 303850 - DNA, 15 bp, Homo sapiens
tgatcagatctgaca

SEQ ID NO: 303851 - DNA, 15 bp, Homo sapiens
tgatcagatcttaca

SEQ ID NO: 303852 - DNA, 22 bp, Homo sapiens
tgatcagtgagctcaggagaga

SEQ ID NO: 303853 - DNA, 13 bp, Homo sapiens
tgatcatgcattg

SEQ ID NO: 303854 - DNA, 23 bp, Homo sapiens
tgatcatttattttaagcactct

SEQ ID NO: 303855 - DNA, 16 bp, Homo sapiens
tgatcatttgcagctg

SEQ ID NO: 303856 - DNA, 16 bp, Homo sapiens
tgatcattttcccccc

SEQ ID NO: 303857 - DNA, 18 bp, Homo sapiens
tgatcattttccccccac

SEQ ID NO: 303858 - DNA, 22 bp, Homo sapiens
tgatcattttccccccactctc

SEQ ID NO: 303859 - DNA, 21 bp, Homo sapiens
tgatccacccacctcagcctc

SEQ ID NO: 303860 - DNA, 22 bp, Homo sapiens
tgatccacccacctcagcctcc

SEQ ID NO: 303861 - DNA, 16 bp, Homo sapiens
tgatccacccacctgg

SEQ ID NO: 303862 - DNA, 14 bp, Homo sapiens
tgatccatccatct

SEQ ID NO: 303863 - DNA, 16 bp, Homo sapiens
tgatccatccatctcc

SEQ ID NO: 303864 - DNA, 21 bp, Homo sapiens
tgatccatgagtttgccctgg

SEQ ID NO: 303865 - DNA, 17 bp, Homo sapiens
tgatcccataaagaaag

SEQ ID NO: 303866 - DNA, 15 bp, Homo sapiens
tgatcccccaggttc

SEQ ID NO: 303867 - DNA, 21 bp, Homo sapiens
tgatcccctttggttttacta

SEQ ID NO: 303868 - DNA, 21 bp, Homo sapiens
tgatccctgttacccagagaa

SEQ ID NO: 303869 - DNA, 14 bp, Homo sapiens
tgatcctctatttt

SEQ ID NO: 303870 - DNA, 15 bp, Homo sapiens
tgatcctctattttg

SEQ ID NO: 303871 - DNA, 19 bp, Homo sapiens
tgatcctgaacaagaaaga

SEQ ID NO: 303872 - DNA, 18 bp, Homo sapiens
tgatccttatgatgtcca

SEQ ID NO: 303873 - DNA, 22 bp, Homo sapiens
tgatctacttcatagctccttg

SEQ ID NO: 303874 - DNA, 15 bp, Homo sapiens
tgatctaggtttaac

SEQ ID NO: 303875 - DNA, 16 bp, Homo sapiens
tgatctaggtttaact

SEQ ID NO: 303876 - DNA, 20 bp, Homo sapiens
tgatctaggtttaactcaga

SEQ ID NO: 303877 - DNA, 15 bp, Homo sapiens
tgatctagttcctga

SEQ ID NO: 303878 - DNA, 15 bp, Homo sapiens
tgatctattactctg

SEQ ID NO: 303879 - DNA, 11 bp, Homo sapiens
tgatctcctga

SEQ ID NO: 303880 - DNA, 22 bp, Homo sapiens
tgatctctactaccacaaggaa

SEQ ID NO: 303881 - DNA, 19 bp, Homo sapiens
tgatctggtgcgtgtggcc

SEQ ID NO: 303882 - DNA, 12 bp, Homo sapiens
tgatctgtcaaa

SEQ ID NO: 303883 - DNA, 16 bp, Homo sapiens
tgatctgtggagaatg

SEQ ID NO: 303884 - DNA, 19 bp, Homo sapiens
tgatcttgtgctcagcatg

SEQ ID NO: 303885 - DNA, 20 bp, Homo sapiens
tgatgaaactcctgattttg

SEQ ID NO: 303886 - DNA, 13 bp, Homo sapiens
tgatgaaagctga

SEQ ID NO: 303887 - DNA, 19 bp, Homo sapiens
tgatgaaagctgattactg

SEQ ID NO: 303888 - DNA, 16 bp, Homo sapiens
tgatgaaattcttgaa

SEQ ID NO: 303889 - DNA, 18 bp, Homo sapiens
tgatgaactcttaatcaa

SEQ ID NO: 303890 - DNA, 13 bp, Homo sapiens
tgatgaactttct

SEQ ID NO: 303891 - DNA, 22 bp, Homo sapiens
tgatgaataaacactttttctg

SEQ ID NO: 303892 - DNA, 15 bp, Homo sapiens
tgatgatgctgtgac

SEQ ID NO: 303893 - DNA, 20 bp, Homo sapiens
tgatgattaaacacctgaca

SEQ ID NO: 303894 - DNA, 15 bp, Homo sapiens
tgatgatttggggga

SEQ ID NO: 303895 - DNA, 14 bp, Homo sapiens
tgatgcaagtcact

SEQ ID NO: 303896 - DNA, 14 bp, Homo sapiens
tgatgcacttattt

SEQ ID NO: 303897 - DNA, 14 bp, Homo sapiens
tgatgccatttgtc

SEQ ID NO: 303898 - DNA, 14 bp, Homo sapiens
tgatgccccttccc

SEQ ID NO: 303899 - DNA, 22 bp, Homo sapiens
tgatgcctcccggctttgcagg

SEQ ID NO: 303900 - DNA, 14 bp, Homo sapiens
tgatgcgccttgct

SEQ ID NO: 303901 - DNA, 23 bp, Homo sapiens
tgatgcgccttgctgatggcttg

SEQ ID NO: 303902 - DNA, 15 bp, Homo sapiens
tgatgctcaggcttg

SEQ ID NO: 303903 - DNA, 17 bp, Homo sapiens
tgatgctccctcccctg

SEQ ID NO: 303904 - DNA, 15 bp, Homo sapiens
tgatgctggagaggt

SEQ ID NO: 303905 - DNA, 16 bp, Homo sapiens
tgatgctggagaggtt

SEQ ID NO: 303906 - DNA, 20 bp, Homo sapiens
tgatggaacacacacacacg

SEQ ID NO: 303907 - DNA, 18 bp, Homo sapiens
tgatggaccgggtgggcc

SEQ ID NO: 303908 - DNA, 20 bp, Homo sapiens
tgatggaccgggtgggcctg

SEQ ID NO: 303909 - DNA, 17 bp, Homo sapiens
tgatggagaaggaaaag

SEQ ID NO: 303910 - DNA, 17 bp, Homo sapiens
tgatggaggtatttgaa

SEQ ID NO: 303911 - DNA, 19 bp, Homo sapiens
tgatggcattactctgcac

SEQ ID NO: 303912 - DNA, 16 bp, Homo sapiens
tgatggccaagagcat

SEQ ID NO: 303913 - DNA, 14 bp, Homo sapiens
tgatggccaagggg

SEQ ID NO: 303914 - DNA, 18 bp, Homo sapiens
tgatggcgcgggaggcac

SEQ ID NO: 303915 - DNA, 23 bp, Homo sapiens
tgatggcgcgggaggcaccagct

SEQ ID NO: 303916 - DNA, 22 bp, Homo sapiens
tgatggctaagatactgctgat

SEQ ID NO: 303917 - DNA, 16 bp, Homo sapiens
tgatgggtcctgctgc

SEQ ID NO: 303918 - DNA, 19 bp, Homo sapiens
tgatggtgaatattacatt

SEQ ID NO: 303919 - DNA, 16 bp, Homo sapiens
tgatggtgagctggga

SEQ ID NO: 303920 - DNA, 14 bp, Homo sapiens
tgatggttcccctg

SEQ ID NO: 303921 - DNA, 18 bp, Homo sapiens
tgatggtttatgttgacc

SEQ ID NO: 303922 - DNA, 11 bp, Homo sapiens
tgatgtaaaat

SEQ ID NO: 303923 - DNA, 17 bp, Homo sapiens
tgatgtacagtctgtca

SEQ ID NO: 303924 - DNA, 18 bp, Homo sapiens
tgatgtaccatgaaacaa

SEQ ID NO: 303925 - DNA, 15 bp, Homo sapiens
tgatgtaggagctgg

SEQ ID NO: 303926 - DNA, 13 bp, Homo sapiens
tgatgtatatgtt

SEQ ID NO: 303927 - DNA, 19 bp, Homo sapiens
tgatgtatgttggtttttt

SEQ ID NO: 303928 - DNA, 20 bp, Homo sapiens
tgatgtatgttggtttttta

SEQ ID NO: 303929 - DNA, 11 bp, Homo sapiens
tgatgtcatct

SEQ ID NO: 303930 - DNA, 13 bp, Homo sapiens
tgatgtcatcttg

SEQ ID NO: 303931 - DNA, 13 bp, Homo sapiens
tgatgtccagaag

SEQ ID NO: 303932 - DNA, 19 bp, Homo sapiens
tgatgtcccaacttgtaaa

SEQ ID NO: 303933 - DNA, 15 bp, Homo sapiens
tgatgtcctgtaaac

SEQ ID NO: 303934 - DNA, 16 bp, Homo sapiens
tgatgtctagataaca

SEQ ID NO: 303935 - DNA, 15 bp, Homo sapiens
tgatgtcttgagagc

SEQ ID NO: 303936 - DNA, 13 bp, Homo sapiens
tgatgtgatggaa

SEQ ID NO: 303937 - DNA, 19 bp, Homo sapiens
tgatgtgatggaacacaca

SEQ ID NO: 303938 - DNA, 18 bp, Homo sapiens
tgatgtggagtggggcag

SEQ ID NO: 303939 - DNA, 15 bp, Homo sapiens
tgatgtggtgcctga

SEQ ID NO: 303940 - DNA, 16 bp, Homo sapiens
tgatgtggtgcctgag

SEQ ID NO: 303941 - DNA, 16 bp, Homo sapiens
tgatgtgtatgtgttt

SEQ ID NO: 303942 - DNA, 14 bp, Homo sapiens
tgatgtgtgcccag

SEQ ID NO: 303943 - DNA, 23 bp, Homo sapiens
tgatgtgttgtgatagctaacat

SEQ ID NO: 303944 - DNA, 17 bp, Homo sapiens
tgatgttaaaattccat

SEQ ID NO: 303945 - DNA, 18 bp, Homo sapiens
tgatgtttccagctgcca

SEQ ID NO: 303946 - DNA, 11 bp, Homo sapiens
tgatgtttgtg

SEQ ID NO: 303947 - DNA, 18 bp, Homo sapiens
tgatgttttcctataata

SEQ ID NO: 303948 - DNA, 16 bp, Homo sapiens
tgattaaacacctgac

SEQ ID NO: 303949 - DNA, 17 bp, Homo sapiens
tgattaaatatttaatg

SEQ ID NO: 303950 - DNA, 19 bp, Homo sapiens
tgattaaatttaatatact

SEQ ID NO: 303951 - DNA, 18 bp, Homo sapiens
tgattaagtatatctatc

SEQ ID NO: 303952 - DNA, 14 bp, Homo sapiens
tgattaatgtttct

SEQ ID NO: 303953 - DNA, 19 bp, Homo sapiens
tgattactgtcaataaaca

SEQ ID NO: 303954 - DNA, 21 bp, Homo sapiens
tgattagaaggcaagtttcta

SEQ ID NO: 303955 - DNA, 14 bp, Homo sapiens
tgattatcttgaaa

SEQ ID NO: 303956 - DNA, 20 bp, Homo sapiens
tgattatgtaccttttgata

SEQ ID NO: 303957 - DNA, 17 bp, Homo sapiens
tgattattgaatgttat

SEQ ID NO: 303958 - DNA, 20 bp, Homo sapiens
tgattcaacaggttttcctg

SEQ ID NO: 303959 - DNA, 16 bp, Homo sapiens
tgattcataacaatgt

SEQ ID NO: 303960 - DNA, 17 bp, Homo sapiens
tgattccaagggcccag

SEQ ID NO: 303961 - DNA, 16 bp, Homo sapiens
tgattccatctccttg

SEQ ID NO: 303962 - DNA, 18 bp, Homo sapiens
tgattccccggagctggg

SEQ ID NO: 303963 - DNA, 14 bp, Homo sapiens
tgattccttcctgt

SEQ ID NO: 303964 - DNA, 20 bp, Homo sapiens
tgattccttcctgttctgaa

SEQ ID NO: 303965 - DNA, 12 bp, Homo sapiens
tgcaatgttttt

SEQ ID NO: 303966 - DNA, 15 bp, Homo sapiens
tgcaattaactctgg

SEQ ID NO: 303967 - DNA, 18 bp, Homo sapiens
tgcaattgcacaaataca

SEQ ID NO: 303968 - DNA, 14 bp, Homo sapiens
tgcaatttattaaa

SEQ ID NO: 303969 - DNA, 18 bp, Homo sapiens
tgcaatttattaaaatga

SEQ ID NO: 303970 - DNA, 20 bp, Homo sapiens
tgcaatttcatatgctgtat

SEQ ID NO: 303971 - DNA, 23 bp, Homo sapiens
tgcaatttccattcttttaaatg

SEQ ID NO: 303972 - DNA, 20 bp, Homo sapiens
tgcaatttcttctgtagcta

SEQ ID NO: 303973 - DNA, 22 bp, Homo sapiens
tgcaatttgtttaaagaataaa

SEQ ID NO: 303974 - DNA, 17 bp, Homo sapiens
tgcacaaagcccttcca

SEQ ID NO: 303975 - DNA, 13 bp, Homo sapiens
tgcacaagccagg

SEQ ID NO: 303976 - DNA, 13 bp, Homo sapiens
tgcacaagctcag

SEQ ID NO: 303977 - DNA, 12 bp, Homo sapiens
tgcacacacagc

SEQ ID NO: 303978 - DNA, 13 bp, Homo sapiens
tgcacacacagct

SEQ ID NO: 303979 - DNA, 14 bp, Homo sapiens
tgcacacacctgcc

SEQ ID NO: 303980 - DNA, 13 bp, Homo sapiens
tgcacacataaca

SEQ ID NO: 303981 - DNA, 19 bp, Homo sapiens
tgcacacattaggcattga

SEQ ID NO: 303982 - DNA, 22 bp, Homo sapiens
tgcacaccaaattgctgagatg

SEQ ID NO: 303983 - DNA, 11 bp, Homo sapiens
tgcacacttca

SEQ ID NO: 303984 - DNA, 14 bp, Homo sapiens
tgcacacttcaaat

SEQ ID NO: 303985 - DNA, 21 bp, Homo sapiens
tgcacacttcaaatcagagca

SEQ ID NO: 303986 - DNA, 23 bp, Homo sapiens
tgcacacttgtgtgtgggctgtg

SEQ ID NO: 303987 - DNA, 16 bp, Homo sapiens
tgcacagaacaagcca

SEQ ID NO: 303988 - DNA, 18 bp, Homo sapiens
tgcacagattaaacttca

SEQ ID NO: 303989 - DNA, 21 bp, Homo sapiens
tgcacagattaaacttcacct

SEQ ID NO: 303990 - DNA, 18 bp, Homo sapiens
tgcacagctaacatggaa

SEQ ID NO: 303991 - DNA, 23 bp, Homo sapiens
tgcacagctaacatggaagtact

SEQ ID NO: 303992 - DNA, 18 bp, Homo sapiens
tgcacaggaaagagtcac

SEQ ID NO: 303993 - DNA, 16 bp, Homo sapiens
tgcacaggccacttgc

SEQ ID NO: 303994 - DNA, 19 bp, Homo sapiens
tgcacaggccacttgctca

SEQ ID NO: 303995 - DNA, 23 bp, Homo sapiens
tgcacaggggaaggaaataacat

SEQ ID NO: 303996 - DNA, 16 bp, Homo sapiens
tgcacagtgcatctca

SEQ ID NO: 303997 - DNA, 17 bp, Homo sapiens
tgcacagtgcatctcag

SEQ ID NO: 303998 - DNA, 19 bp, Homo sapiens
tgcacagtgcatctcagcc

SEQ ID NO: 303999 - DNA, 18 bp, Homo sapiens
tgcacagtgctgttggtg

SEQ ID NO: 304000 - DNA, 22 bp, Homo sapiens
tgcacagtttgcaatcttatgt

SEQ ID NO: 304001 - DNA, 19 bp, Homo sapiens
tgcacatatattttttaca

SEQ ID NO: 304002 - DNA, 14 bp, Homo sapiens
tgcacatctctgct

SEQ ID NO: 304003 - DNA, 19 bp, Homo sapiens
tgcacatgtgtgcgtgtgc

SEQ ID NO: 304004 - DNA, 23 bp, Homo sapiens
tgcacattaggaacagagtatat

SEQ ID NO: 304005 - DNA, 15 bp, Homo sapiens
tgcacattcctggcc

SEQ ID NO: 304006 - DNA, 18 bp, Homo sapiens
tgcacattcctggccccg

SEQ ID NO: 304007 - DNA, 15 bp, Homo sapiens
tgcacattctccctt

SEQ ID NO: 304008 - DNA, 16 bp, Homo sapiens
tgcacattctcccttg

SEQ ID NO: 304009 - DNA, 21 bp, Homo sapiens
tgcacatttgtgcataaattt

SEQ ID NO: 304010 - DNA, 23 bp, Homo sapiens
tgcacattttccacggaaacaga

SEQ ID NO: 304011 - DNA, 18 bp, Homo sapiens
tgcaccagcccttccctg

SEQ ID NO: 304012 - DNA, 22 bp, Homo sapiens
tgcaccagcccttccctgcttt

SEQ ID NO: 304013 - DNA, 13 bp, Homo sapiens
tgcacccacccct

SEQ ID NO: 304014 - DNA, 14 bp, Homo sapiens
tgcacccacccctg

SEQ ID NO: 304015 - DNA, 21 bp, Homo sapiens
tgcacccacccctgcccaggc

SEQ ID NO: 304016 - DNA, 17 bp, Homo sapiens
tgcacccactcaccagg

SEQ ID NO: 304017 - DNA, 18 bp, Homo sapiens
tgcacccactcaccaggg

SEQ ID NO: 304018 - DNA, 20 bp, Homo sapiens
tgcacccagcatcaccagct

SEQ ID NO: 304019 - DNA, 18 bp, Homo sapiens
tgcacccagctccagggg

SEQ ID NO: 304020 - DNA, 19 bp, Homo sapiens
tgcaccccaaagctttcct

SEQ ID NO: 304021 - DNA, 20 bp, Homo sapiens
tgcaccccaaagctttcctg

SEQ ID NO: 304022 - DNA, 22 bp, Homo sapiens
tgcaccccaaagctttcctgcc

SEQ ID NO: 304023 - DNA, 12 bp, Homo sapiens
tgcaccccagca

SEQ ID NO: 304024 - DNA, 18 bp, Homo sapiens
tgcaccccagcattccag

SEQ ID NO: 304025 - DNA, 19 bp, Homo sapiens
tgcaccccagcattccagc

SEQ ID NO: 304026 - DNA, 20 bp, Homo sapiens
tgcaccccagcattccagct

SEQ ID NO: 304027 - DNA, 23 bp, Homo sapiens
tgcaccccagcattccagctctg

SEQ ID NO: 304028 - DNA, 14 bp, Homo sapiens
tgcacccctggaac

SEQ ID NO: 304029 - DNA, 23 bp, Homo sapiens
tgcaccctctgctatgtctgtga

SEQ ID NO: 304030 - DNA, 24 bp, Homo sapiens
tgcaccctctgctatgtctgtgat

SEQ ID NO: 304031 - DNA, 22 bp, Homo sapiens
tgcaccctggggcctggacctg

SEQ ID NO: 304032 - DNA, 14 bp, Homo sapiens
tgcaccgtggtcag

SEQ ID NO: 304033 - DNA, 14 bp, Homo sapiens
tgcacctataaata

SEQ ID NO: 304034 - DNA, 20 bp, Homo sapiens
tgcacctcctaccctcccac

SEQ ID NO: 304035 - DNA, 21 bp, Homo sapiens
tgcacctcctaccctcccacc

SEQ ID NO: 304036 - DNA, 13 bp, Homo sapiens
tgcaccttaccaa

SEQ ID NO: 304037 - DNA, 18 bp, Homo sapiens
tgcaccttaccaactttc

SEQ ID NO: 304038 - DNA, 14 bp, Homo sapiens
tgcaccttgggcac

SEQ ID NO: 304039 - DNA, 19 bp, Homo sapiens
tgcacgcccatgtgtgagt

SEQ ID NO: 304040 - DNA, 13 bp, Homo sapiens
tgcacggggccag

SEQ ID NO: 304041 - DNA, 19 bp, Homo sapiens
tgcacggtttctgttctgc

SEQ ID NO: 304042 - DNA, 21 bp, Homo sapiens
tgcacggtttctgttctgccc

SEQ ID NO: 304043 - DNA, 17 bp, Homo sapiens
tgcacgtggagagctgg

SEQ ID NO: 304044 - DNA, 21 bp, Homo sapiens
tgcacgtggagagctggtgcc

SEQ ID NO: 304045 - DNA, 22 bp, Homo sapiens
tgcacgtggcctcttgagcagt

SEQ ID NO: 304046 - DNA, 18 bp, Homo sapiens
tgcactaaaagtgatgtg

SEQ ID NO: 304047 - DNA, 19 bp, Homo sapiens
tgcactactcctctgcagt

SEQ ID NO: 304048 - DNA, 18 bp, Homo sapiens
tgcactactgacatgtgg

SEQ ID NO: 304049 - DNA, 14 bp, Homo sapiens
tgcactagccaacc

SEQ ID NO: 304050 - DNA, 16 bp, Homo sapiens
tgcactatagccattt

SEQ ID NO: 304051 - DNA, 17 bp, Homo sapiens
tgcactcacaggctaca

SEQ ID NO: 304052 - DNA, 19 bp, Homo sapiens
tgcactccagcctgggcga

SEQ ID NO: 304053 - DNA, 14 bp, Homo sapiens
tgcactccatggcc

SEQ ID NO: 304054 - DNA, 19 bp, Homo sapiens
tgcactccatggccacccc

SEQ ID NO: 304055 - DNA, 14 bp, Homo sapiens
tgcactctgctaat

SEQ ID NO: 304056 - DNA, 16 bp, Homo sapiens
tgcactgaagttgtct

SEQ ID NO: 304057 - DNA, 13 bp, Homo sapiens
tgcactgacctgc

SEQ ID NO: 304058 - DNA, 15 bp, Homo sapiens
tgcactgagggccac

SEQ ID NO: 304059 - DNA, 17 bp, Homo sapiens
tgcactgagggccacac

SEQ ID NO: 304060 - DNA, 19 bp, Homo sapiens
tgcactgagggccacacta

SEQ ID NO: 304061 - DNA, 22 bp, Homo sapiens
tgcactgtcactttgctctggg

SEQ ID NO: 304062 - DNA, 23 bp, Homo sapiens
tgcactgtcactttgctctgggt

SEQ ID NO: 304063 - DNA, 12 bp, Homo sapiens
tgcactgtgctt

SEQ ID NO: 304064 - DNA, 19 bp, Homo sapiens
tgcactgtgcttgctccta

SEQ ID NO: 304065 - DNA, 23 bp, Homo sapiens
tgcacttattttttaatgtgaga

SEQ ID NO: 304066 - DNA, 17 bp, Homo sapiens
tgcacttggtgctgctt

SEQ ID NO: 304067 - DNA, 18 bp, Homo sapiens
tgcacttggtgctgcttt

SEQ ID NO: 304068 - DNA, 16 bp, Homo sapiens
tgcactttaaatggaa

SEQ ID NO: 304069 - DNA, 21 bp, Homo sapiens
tgcactttagtgtattttctg

SEQ ID NO: 304070 - DNA, 18 bp, Homo sapiens
tgcactttataaacactg

SEQ ID NO: 304071 - DNA, 15 bp, Homo sapiens
tgcactttccctaga

SEQ ID NO: 304072 - DNA, 16 bp, Homo sapiens
tgcactttccctagaa

SEQ ID NO: 304073 - DNA, 17 bp, Homo sapiens
tgcactttccctagaaa

SEQ ID NO: 304074 - DNA, 21 bp, Homo sapiens
tgcagaaaaaaaaaaagaaac

SEQ ID NO: 304075 - DNA, 23 bp, Homo sapiens
tgcagaaggaagggcatccttct

SEQ ID NO: 304076 - DNA, 13 bp, Homo sapiens
tgcagacaggcca

SEQ ID NO: 304077 - DNA, 14 bp, Homo sapiens
tgcagacctgggac

SEQ ID NO: 304078 - DNA, 17 bp, Homo sapiens
tgcagactggaggggac

SEQ ID NO: 304079 - DNA, 15 bp, Homo sapiens
tgcagaggaccacag

SEQ ID NO: 304080 - DNA, 21 bp, Homo sapiens
tgcagaggagccacctgggct

SEQ ID NO: 304081 - DNA, 16 bp, Homo sapiens
tgcagaggaggagaaa

SEQ ID NO: 304082 - DNA, 21 bp, Homo sapiens
tgcagaggaggagaaaagtga

SEQ ID NO: 304083 - DNA, 17 bp, Homo sapiens
tgcagaggctgagcagg

SEQ ID NO: 304084 - DNA, 17 bp, Homo sapiens
tgcagataacagctggt

SEQ ID NO: 304085 - DNA, 17 bp, Homo sapiens
tgcagataactttgact

SEQ ID NO: 304086 - DNA, 15 bp, Homo sapiens
tgcagatctagccag

SEQ ID NO: 304087 - DNA, 18 bp, Homo sapiens
tgcagattcctgggcctg

SEQ ID NO: 304088 - DNA, 23 bp, Homo sapiens
tgcagattcctgggcctgtcccc

SEQ ID NO: 304089 - DNA, 22 bp, Homo sapiens
tgcagcaacacccaagtccacc

SEQ ID NO: 304090 - DNA, 14 bp, Homo sapiens
tgcagcagcccagc

SEQ ID NO: 304091 - DNA, 20 bp, Homo sapiens
tgcagcagcccagcttcctg

SEQ ID NO: 304092 - DNA, 12 bp, Homo sapiens
tgcagcaggcag

SEQ ID NO: 304093 - DNA, 21 bp, Homo sapiens
tgcagcagtaccatcccactg

SEQ ID NO: 304094 - DNA, 15 bp, Homo sapiens
tgccagagatggagg

SEQ ID NO: 304095 - DNA, 19 bp, Homo sapiens
tgccagagcaaagggccag

SEQ ID NO: 304096 - DNA, 23 bp, Homo sapiens
tgccagagcaaagggccaggaag

SEQ ID NO: 304097 - DNA, 15 bp, Homo sapiens
tgccagcacaggggc

SEQ ID NO: 304098 - DNA, 22 bp, Homo sapiens
tgccagcccaaagctggagcca

SEQ ID NO: 304099 - DNA, 22 bp, Homo sapiens
tgccagcccctcggctctgccg

SEQ ID NO: 304100 - DNA, 19 bp, Homo sapiens
tgccagccgtgatgctcag

SEQ ID NO: 304101 - DNA, 21 bp, Homo sapiens
tgccagccgtgatgctcaggc

SEQ ID NO: 304102 - DNA, 14 bp, Homo sapiens
tgccagccttcctc

SEQ ID NO: 304103 - DNA, 16 bp, Homo sapiens
tgccagcgcatgtgtc

SEQ ID NO: 304104 - DNA, 13 bp, Homo sapiens
tgccagctgcctt

SEQ ID NO: 304105 - DNA, 22 bp, Homo sapiens
tgccagctgccttcctcatccc

SEQ ID NO: 304106 - DNA, 19 bp, Homo sapiens
tgccagcttttcctccctt

SEQ ID NO: 304107 - DNA, 20 bp, Homo sapiens
tgccagcttttcctcccttg

SEQ ID NO: 304108 - DNA, 17 bp, Homo sapiens
tgccaggacagctgcag

SEQ ID NO: 304109 - DNA, 14 bp, Homo sapiens
tgccaggactgtga

SEQ ID NO: 304110 - DNA, 16 bp, Homo sapiens
tgccaggagcaatggg

SEQ ID NO: 304111 - DNA, 16 bp, Homo sapiens
tgccaggagcagcctc

SEQ ID NO: 304112 - DNA, 22 bp, Homo sapiens
tgccaggagcagcctccaagaa

SEQ ID NO: 304113 - DNA, 16 bp, Homo sapiens
tgccaggaggcggcag

SEQ ID NO: 304114 - DNA, 17 bp, Homo sapiens
tgccaggaggctggcag

SEQ ID NO: 304115 - DNA, 13 bp, Homo sapiens
tgccaggcacctg

SEQ ID NO: 304116 - DNA, 19 bp, Homo sapiens
tgccaggcacctggcctgc

SEQ ID NO: 304117 - DNA, 23 bp, Homo sapiens
tgccaggcacctggcctgctggg

SEQ ID NO: 304118 - DNA, 11 bp, Homo sapiens
tgccaggcagg

SEQ ID NO: 304119 - DNA, 16 bp, Homo sapiens
tgccaggcaggcacct

SEQ ID NO: 304120 - DNA, 18 bp, Homo sapiens
tgccaggcgttggtgcca

SEQ ID NO: 304121 - DNA, 23 bp, Homo sapiens
tgccaggctgcggtgggcagcca

SEQ ID NO: 304122 - DNA, 12 bp, Homo sapiens
tgccaggctggg

SEQ ID NO: 304123 - DNA, 21 bp, Homo sapiens
tgccaggctgtaagcattctg

SEQ ID NO: 304124 - DNA, 15 bp, Homo sapiens
tgccaggctgtcagc

SEQ ID NO: 304125 - DNA, 12 bp, Homo sapiens
tgccagggagct

SEQ ID NO: 304126 - DNA, 17 bp, Homo sapiens
tgccaggtggctcagtg

SEQ ID NO: 304127 - DNA, 18 bp, Homo sapiens
tgccaggttgcagctgct

SEQ ID NO: 304128 - DNA, 18 bp, Homo sapiens
tgccagtaacgcgtcttc

SEQ ID NO: 304129 - DNA, 21 bp, Homo sapiens
tgccagtaacgcgtcttcctg

SEQ ID NO: 304130 - DNA, 22 bp, Homo sapiens
tgccagtaacgcgtcttcctga

SEQ ID NO: 304131 - DNA, 23 bp, Homo sapiens
tgccagtaacgcgtcttcctgag

SEQ ID NO: 304132 - DNA, 16 bp, Homo sapiens
tgccagtatataagct

SEQ ID NO: 304133 - DNA, 17 bp, Homo sapiens
tgccagtccccctgccc

SEQ ID NO: 304134 - DNA, 19 bp, Homo sapiens
tgccagtccccctgcccca

SEQ ID NO: 304135 - DNA, 14 bp, Homo sapiens
tgccagtcctgggg

SEQ ID NO: 304136 - DNA, 20 bp, Homo sapiens
tgccagtgacagacaggctc

SEQ ID NO: 304137 - DNA, 22 bp, Homo sapiens
tgccagtgacagacaggctctt

SEQ ID NO: 304138 - DNA, 14 bp, Homo sapiens
tgccagtggtgtcc

SEQ ID NO: 304139 - DNA, 17 bp, Homo sapiens
tgccagtggtgtccaag

SEQ ID NO: 304140 - DNA, 22 bp, Homo sapiens
tgccagttgaaaatggattttt

SEQ ID NO: 304141 - DNA, 13 bp, Homo sapiens
tgccataattcta

SEQ ID NO: 304142 - DNA, 23 bp, Homo sapiens
tgccataattctaagttatttac

SEQ ID NO: 304143 - DNA, 23 bp, Homo sapiens
tgccatacatcagttattcattc

SEQ ID NO: 304144 - DNA, 23 bp, Homo sapiens
tgccatacatgttattgttttca

SEQ ID NO: 304145 - DNA, 14 bp, Homo sapiens
tgccatagccccat

SEQ ID NO: 304146 - DNA, 15 bp, Homo sapiens
tgccatcacgcttgt

SEQ ID NO: 304147 - DNA, 13 bp, Homo sapiens
tgccatcagcccc

SEQ ID NO: 304148 - DNA, 14 bp, Homo sapiens
tgccatcagcccct

SEQ ID NO: 304149 - DNA, 20 bp, Homo sapiens
tgccatgaggaacaaggcaa

SEQ ID NO: 304150 - DNA, 23 bp, Homo sapiens
tgccatgaggaacaaggcaaggc

SEQ ID NO: 304151 - DNA, 14 bp, Homo sapiens
tgccatgccactgc

SEQ ID NO: 304152 - DNA, 18 bp, Homo sapiens
tgccatgccactgccagg

SEQ ID NO: 304153 - DNA, 16 bp, Homo sapiens
tgccatggaggcacac

SEQ ID NO: 304154 - DNA, 17 bp, Homo sapiens
tgccatggcctgtgctg

SEQ ID NO: 304155 - DNA, 15 bp, Homo sapiens
tgccatgtgaagagg

SEQ ID NO: 304156 - DNA, 15 bp, Homo sapiens
tgccatgtgtaagtt

SEQ ID NO: 304157 - DNA, 17 bp, Homo sapiens
tgccatgtgtgctgaac

SEQ ID NO: 304158 - DNA, 11 bp, Homo sapiens
tgccattccca

SEQ ID NO: 304159 - DNA, 17 bp, Homo sapiens
tgccattgtactccagc

SEQ ID NO: 304160 - DNA, 22 bp, Homo sapiens
tgccattgtactccagcctggg

SEQ ID NO: 304161 - DNA, 14 bp, Homo sapiens
tgccatttcccttc

SEQ ID NO: 304162 - DNA, 15 bp, Homo sapiens
tgccatttcttccca

SEQ ID NO: 304163 - DNA, 16 bp, Homo sapiens
tgccatttcttcccaa

SEQ ID NO: 304164 - DNA, 17 bp, Homo sapiens
tgccatttcttcccaag

SEQ ID NO: 304165 - DNA, 19 bp, Homo sapiens
tgccattttgtctggctgt

SEQ ID NO: 304166 - DNA, 16 bp, Homo sapiens
tgccatttttgcaaac

SEQ ID NO: 304167 - DNA, 19 bp, Homo sapiens
tgccatttttttcactcag

SEQ ID NO: 304168 - DNA, 15 bp, Homo sapiens
tgcccaacctcagca

SEQ ID NO: 304169 - DNA, 17 bp, Homo sapiens
tgcccaactcccagcca

SEQ ID NO: 304170 - DNA, 19 bp, Homo sapiens
tgcccaactcccagccacc

SEQ ID NO: 304171 - DNA, 23 bp, Homo sapiens
tgcccaactcccagccaccacca

SEQ ID NO: 304172 - DNA, 18 bp, Homo sapiens
tgcccaactttcattggt

SEQ ID NO: 304173 - DNA, 22 bp, Homo sapiens
tgcccaagggcctcccaccaga

SEQ ID NO: 304174 - DNA, 20 bp, Homo sapiens
tgcccaatatgcagttctgc

SEQ ID NO: 304175 - DNA, 20 bp, Homo sapiens
tgcccaatgctttgggaggc

SEQ ID NO: 304176 - DNA, 22 bp, Homo sapiens
tgcccaatgctttgggaggcca

SEQ ID NO: 304177 - DNA, 15 bp, Homo sapiens
tgcccacccagggcc

SEQ ID NO: 304178 - DNA, 16 bp, Homo sapiens
tgcccacccagggccc

SEQ ID NO: 304179 - DNA, 16 bp, Homo sapiens
tgcccacccctgctgc

SEQ ID NO: 304180 - DNA, 18 bp, Homo sapiens
tgcccacccgtcttcaat

SEQ ID NO: 304181 - DNA, 21 bp, Homo sapiens
tgcccacccgtggagatggga

SEQ ID NO: 304182 - DNA, 14 bp, Homo sapiens
tgcccaccctgggc

SEQ ID NO: 304183 - DNA, 15 bp, Homo sapiens
tgcccaccctgggcc

SEQ ID NO: 304184 - DNA, 16 bp, Homo sapiens
tgcccaccctgggcct

SEQ ID NO: 304185 - DNA, 17 bp, Homo sapiens
tgcccaccctgggcctc

SEQ ID NO: 304186 - DNA, 16 bp, Homo sapiens
tgcccaccgaccccct

SEQ ID NO: 304187 - DNA, 22 bp, Homo sapiens
tgcccaccgaccccctttctaa

SEQ ID NO: 304188 - DNA, 19 bp, Homo sapiens
tgcccacgctcctgccctc

SEQ ID NO: 304189 - DNA, 21 bp, Homo sapiens
tgcccactaagaagttccact

SEQ ID NO: 304190 - DNA, 17 bp, Homo sapiens
tgcccagactacagggc

SEQ ID NO: 304191 - DNA, 12 bp, Homo sapiens
tgcccagagctg

SEQ ID NO: 304192 - DNA, 13 bp, Homo sapiens
tgcccagagctgg

SEQ ID NO: 304193 - DNA, 17 bp, Homo sapiens
tgcccagagctgggtga

SEQ ID NO: 304194 - DNA, 16 bp, Homo sapiens
tgcccagatcccagaa

SEQ ID NO: 304195 - DNA, 17 bp, Homo sapiens
tgcccagatcccagaag

SEQ ID NO: 304196 - DNA, 22 bp, Homo sapiens
tgcccagatcccagaaggacct

SEQ ID NO: 304197 - DNA, 12 bp, Homo sapiens
tgcccagccctc

SEQ ID NO: 304198 - DNA, 11 bp, Homo sapiens
tgcccagctct

SEQ ID NO: 304199 - DNA, 18 bp, Homo sapiens
tgcccagctctgaccctg

SEQ ID NO: 304200 - DNA, 16 bp, Homo sapiens
tgcccaggcagtcttt

SEQ ID NO: 304201 - DNA, 22 bp, Homo sapiens
tgcccaggccggccagcctcac

SEQ ID NO: 304202 - DNA, 18 bp, Homo sapiens
tgcccaggctctgctgac

SEQ ID NO: 304203 - DNA, 20 bp, Homo sapiens
tgcccagggtcagtgtatct

SEQ ID NO: 304204 - DNA, 21 bp, Homo sapiens
tgcccagggtcagtgtatcta

SEQ ID NO: 304205 - DNA, 18 bp, Homo sapiens
tgcccaggtaccaccctt

SEQ ID NO: 304206 - DNA, 22 bp, Homo sapiens
tgcccaggtaccacccttcaga

SEQ ID NO: 304207 - DNA, 17 bp, Homo sapiens
tgcccagtgatggcatt

SEQ ID NO: 304208 - DNA, 23 bp, Homo sapiens
tgcccatcatacgcatggtcctg

SEQ ID NO: 304209 - DNA, 14 bp, Homo sapiens
tgcccatcatctct

SEQ ID NO: 304210 - DNA, 19 bp, Homo sapiens
tgcccatcatctctgcctt

SEQ ID NO: 304211 - DNA, 20 bp, Homo sapiens
tgcccatcatctctgccttt

SEQ ID NO: 304212 - DNA, 20 bp, Homo sapiens
tgccccaaacaaatatgcaa

SEQ ID NO: 304213 - DNA, 22 bp, Homo sapiens
tgccccaaaggaagctttctct

SEQ ID NO: 304214 - DNA, 16 bp, Homo sapiens
tgccccaacctgctga

SEQ ID NO: 304215 - DNA, 19 bp, Homo sapiens
tgccccaagaggctagccc

SEQ ID NO: 304216 - DNA, 14 bp, Homo sapiens
tgccccaagcagcc

SEQ ID NO: 304217 - DNA, 22 bp, Homo sapiens
tgccccaatcgggtccagagac

SEQ ID NO: 304218 - DNA, 17 bp, Homo sapiens
tgccccacacaggcctg

SEQ ID NO: 304219 - DNA, 16 bp, Homo sapiens
tgccccacacggactc

SEQ ID NO: 304220 - DNA, 11 bp, Homo sapiens
tgccccacagc

SEQ ID NO: 304221 - DNA, 12 bp, Homo sapiens
tgccccacccac

SEQ ID NO: 304222 - DNA, 22 bp, Homo sapiens
tgccccacccacccctcctggg

SEQ ID NO: 304223 - DNA, 17 bp, Homo sapiens
tgcctgtgaccggggtc

SEQ ID NO: 304224 - DNA, 20 bp, Homo sapiens
tgcctgtgaccggggtcctg

SEQ ID NO: 304225 - DNA, 20 bp, Homo sapiens
tgcctgtgccacccaccagg

SEQ ID NO: 304226 - DNA, 14 bp, Homo sapiens
tgcctgtggaactg

SEQ ID NO: 304227 - DNA, 21 bp, Homo sapiens
tgcctgtgtgacatcagtggc

SEQ ID NO: 304228 - DNA, 13 bp, Homo sapiens
tgcctgttttgat

SEQ ID NO: 304229 - DNA, 13 bp, Homo sapiens
tgccttaaagaaa

SEQ ID NO: 304230 - DNA, 14 bp, Homo sapiens
tgccttaattctta

SEQ ID NO: 304231 - DNA, 18 bp, Homo sapiens
tgccttaattcttacctc

SEQ ID NO: 304232 - DNA, 17 bp, Homo sapiens
tgccttagaacctttct

SEQ ID NO: 304233 - DNA, 21 bp, Homo sapiens
tgccttagaacctttcttaca

SEQ ID NO: 304234 - DNA, 18 bp, Homo sapiens
tgccttagaggagcccac

SEQ ID NO: 304235 - DNA, 15 bp, Homo sapiens
tgccttcagccctaa

SEQ ID NO: 304236 - DNA, 16 bp, Homo sapiens
tgccttcataaattat

SEQ ID NO: 304237 - DNA, 18 bp, Homo sapiens
tgccttcatcttcactgc

SEQ ID NO: 304238 - DNA, 13 bp, Homo sapiens
tgccttccacgct

SEQ ID NO: 304239 - DNA, 17 bp, Homo sapiens
tgccttccacgctgtct

SEQ ID NO: 304240 - DNA, 19 bp, Homo sapiens
tgccttccacgctgtctcc

SEQ ID NO: 304241 - DNA, 17 bp, Homo sapiens
tgccttccataattatg

SEQ ID NO: 304242 - DNA, 20 bp, Homo sapiens
tgccttcgttaactgtgtat

SEQ ID NO: 304243 - DNA, 21 bp, Homo sapiens
tgccttctcctctctgggcct

SEQ ID NO: 304244 - DNA, 22 bp, Homo sapiens
tgccttctcctctctgggcctt

SEQ ID NO: 304245 - DNA, 14 bp, Homo sapiens
tgccttctcttcta

SEQ ID NO: 304246 - DNA, 16 bp, Homo sapiens
tgccttctcttctatc

SEQ ID NO: 304247 - DNA, 18 bp, Homo sapiens
tgccttctgacggccctg

SEQ ID NO: 304248 - DNA, 16 bp, Homo sapiens
tgccttctgtctgctc

SEQ ID NO: 304249 - DNA, 13 bp, Homo sapiens
tgccttcttcacc

SEQ ID NO: 304250 - DNA, 14 bp, Homo sapiens
tgccttgagacccc

SEQ ID NO: 304251 - DNA, 13 bp, Homo sapiens
tgccttgagctgc

SEQ ID NO: 304252 - DNA, 20 bp, Homo sapiens
tgccttgctgcacctgaggc

SEQ ID NO: 304253 - DNA, 17 bp, Homo sapiens
tgccttgggctgctcct

SEQ ID NO: 304254 - DNA, 21 bp, Homo sapiens
tgccttggggaatttcctcta

SEQ ID NO: 304255 - DNA, 23 bp, Homo sapiens
tgccttgttgatgggccttcaga

SEQ ID NO: 304256 - DNA, 19 bp, Homo sapiens
tgccttgttgtattcctgc

SEQ ID NO: 304257 - DNA, 14 bp, Homo sapiens
tgcctttaaatctg

SEQ ID NO: 304258 - DNA, 15 bp, Homo sapiens
tgcctttaaatctgt

SEQ ID NO: 304259 - DNA, 12 bp, Homo sapiens
tgcctttcacag

SEQ ID NO: 304260 - DNA, 14 bp, Homo sapiens
tgcctttccccatt

SEQ ID NO: 304261 - DNA, 15 bp, Homo sapiens
tgcctttctgcagtt

SEQ ID NO: 304262 - DNA, 20 bp, Homo sapiens
tgcctttctgcagtttttca

SEQ ID NO: 304263 - DNA, 14 bp, Homo sapiens
tgcctttcttccat

SEQ ID NO: 304264 - DNA, 21 bp, Homo sapiens
tgcctttgagtttcctcaggc

SEQ ID NO: 304265 - DNA, 22 bp, Homo sapiens
tgcctttgagtttcctcaggct

SEQ ID NO: 304266 - DNA, 16 bp, Homo sapiens
tgcctttgctcttata

SEQ ID NO: 304267 - DNA, 15 bp, Homo sapiens
tgcctttgctgttta

SEQ ID NO: 304268 - DNA, 22 bp, Homo sapiens
tgcctttgctgtttagcttcct

SEQ ID NO: 304269 - DNA, 19 bp, Homo sapiens
tgcctttggcaattcttct

SEQ ID NO: 304270 - DNA, 15 bp, Homo sapiens
tgcctttgtaagtta

SEQ ID NO: 304271 - DNA, 12 bp, Homo sapiens
tgccttttgtgt

SEQ ID NO: 304272 - DNA, 16 bp, Homo sapiens
tgcctttttccttatt

SEQ ID NO: 304273 - DNA, 22 bp, Homo sapiens
tgcgaccagaggtgggaggccc

SEQ ID NO: 304274 - DNA, 15 bp, Homo sapiens
tgcgacggagagaaa

SEQ ID NO: 304275 - DNA, 19 bp, Homo sapiens
tgcgacggagagaaaaaag

SEQ ID NO: 304276 - DNA, 13 bp, Homo sapiens
tgcgagtgtgtgc

SEQ ID NO: 304277 - DNA, 21 bp, Homo sapiens
tgcgagtgtgtgcatgtgtgt

SEQ ID NO: 304278 - DNA, 23 bp, Homo sapiens
tgcgatcatggctcactgcagcc

SEQ ID NO: 304279 - DNA, 17 bp, Homo sapiens
tgcgcaaaactgcctga

SEQ ID NO: 304280 - DNA, 23 bp, Homo sapiens
tgcgcaggccctccgcgggggac

SEQ ID NO: 304281 - DNA, 16 bp, Homo sapiens
tgcgcccctccccacc

SEQ ID NO: 304282 - DNA, 18 bp, Homo sapiens
tgcgcctgcccgcccgcc

SEQ ID NO: 304283 - DNA, 17 bp, Homo sapiens
tgcgctcacctgcagcc

SEQ ID NO: 304284 - DNA, 20 bp, Homo sapiens
tgcgctcacctgcagcccct

SEQ ID NO: 304285 - DNA, 18 bp, Homo sapiens
tgcgctcttcaccaggaa

SEQ ID NO: 304286 - DNA, 11 bp, Homo sapiens
tgcgctgtgct

SEQ ID NO: 304287 - DNA, 12 bp, Homo sapiens
tgcgctgtgctc

SEQ ID NO: 304288 - DNA, 18 bp, Homo sapiens
tgcggactccatggccct

SEQ ID NO: 304289 - DNA, 18 bp, Homo sapiens
tgcggagtccattatttg

SEQ ID NO: 304290 - DNA, 16 bp, Homo sapiens
tgcggcaccgcccacc

SEQ ID NO: 304291 - DNA, 16 bp, Homo sapiens
tgcggcccagccatgg

SEQ ID NO: 304292 - DNA, 21 bp, Homo sapiens
tgcggcccagccatgggccct

SEQ ID NO: 304293 - DNA, 23 bp, Homo sapiens
tgcggcccgtgcgcagccgcgct

SEQ ID NO: 304294 - DNA, 18 bp, Homo sapiens
tgcggccggcctggggcc

SEQ ID NO: 304295 - DNA, 11 bp, Homo sapiens
tgcggctgctg

SEQ ID NO: 304296 - DNA, 15 bp, Homo sapiens
tgcgggcccagctga

SEQ ID NO: 304297 - DNA, 16 bp, Homo sapiens
tgcgggcccagctgag

SEQ ID NO: 304298 - DNA, 16 bp, Homo sapiens
tgcggggtggagtgag

SEQ ID NO: 304299 - DNA, 18 bp, Homo sapiens
tgcgggtgggtatcccac

SEQ ID NO: 304300 - DNA, 14 bp, Homo sapiens
tgcggtgaggcagg

SEQ ID NO: 304301 - DNA, 16 bp, Homo sapiens
tgcggtgaggcagggg

SEQ ID NO: 304302 - DNA, 23 bp, Homo sapiens
tgcggtgaggcaggggagtctgc

SEQ ID NO: 304303 - DNA, 16 bp, Homo sapiens
tgcggtgggcagccat

SEQ ID NO: 304304 - DNA, 13 bp, Homo sapiens
tgcggtgtgtctc

SEQ ID NO: 304305 - DNA, 21 bp, Homo sapiens
tgcggtttgttggatcttcaa

SEQ ID NO: 304306 - DNA, 22 bp, Homo sapiens
tgcgtatgtaaacattcatatt

SEQ ID NO: 304307 - DNA, 22 bp, Homo sapiens
tgcgtcatggctcaaggattca

SEQ ID NO: 304308 - DNA, 16 bp, Homo sapiens
tgcgtctgacatcctg

SEQ ID NO: 304309 - DNA, 22 bp, Homo sapiens
tgcgtgaaacacaccaggctgt

SEQ ID NO: 304310 - DNA, 22 bp, Homo sapiens
tgcgtgaccggcccgccacctt

SEQ ID NO: 304311 - DNA, 12 bp, Homo sapiens
tgcgtgctgtct

SEQ ID NO: 304312 - DNA, 20 bp, Homo sapiens
tgcgtggatcaagcttgtgt

SEQ ID NO: 304313 - DNA, 22 bp, Homo sapiens
tgcgtggatcaagcttgtgtac

SEQ ID NO: 304314 - DNA, 22 bp, Homo sapiens
tgcgtgtctctgccatgtggca

SEQ ID NO: 304315 - DNA, 16 bp, Homo sapiens
tgcgtgtggccctgtg

SEQ ID NO: 304316 - DNA, 19 bp, Homo sapiens
tgcgtgtggccctgtggga

SEQ ID NO: 304317 - DNA, 16 bp, Homo sapiens
tgcgttggagccactc

SEQ ID NO: 304318 - DNA, 21 bp, Homo sapiens
tgctaaaaaattaaaccaagc

SEQ ID NO: 304319 - DNA, 13 bp, Homo sapiens
tgctaaaaggaat

SEQ ID NO: 304320 - DNA, 15 bp, Homo sapiens
tgctaaaaggaatag

SEQ ID NO: 304321 - DNA, 12 bp, Homo sapiens
tgctaaatagtt

SEQ ID NO: 304322 - DNA, 13 bp, Homo sapiens
tgctaagagtttt

SEQ ID NO: 304323 - DNA, 19 bp, Homo sapiens
tgctaaggctcctccttgc

SEQ ID NO: 304324 - DNA, 18 bp, Homo sapiens
tgctaagtaaattagtaa

SEQ ID NO: 304325 - DNA, 15 bp, Homo sapiens
tgctaataaatgacc

SEQ ID NO: 304326 - DNA, 19 bp, Homo sapiens
tgctaataaatgaccagtt

SEQ ID NO: 304327 - DNA, 22 bp, Homo sapiens
tgctaatcagggaggtcatttt

SEQ ID NO: 304328 - DNA, 19 bp, Homo sapiens
tgctaatctctcttttgtt

SEQ ID NO: 304329 - DNA, 13 bp, Homo sapiens
tgctaatgtaatc

SEQ ID NO: 304330 - DNA, 22 bp, Homo sapiens
tgctaatgtaatcatttatctt

SEQ ID NO: 304331 - DNA, 15 bp, Homo sapiens
tgctaattttctcaa

SEQ ID NO: 304332 - DNA, 22 bp, Homo sapiens
tgctaattttctcaaaagcatt

SEQ ID NO: 304333 - DNA, 17 bp, Homo sapiens
tgctacacttacaagta

SEQ ID NO: 304334 - DNA, 12 bp, Homo sapiens
tgctacacttct

SEQ ID NO: 304335 - DNA, 15 bp, Homo sapiens
tgctacagagaaaat

SEQ ID NO: 304336 - DNA, 19 bp, Homo sapiens
tgctacagtagctgtgggg

SEQ ID NO: 304337 - DNA, 15 bp, Homo sapiens
tgctaccgccctggg

SEQ ID NO: 304338 - DNA, 20 bp, Homo sapiens
tgctaccgccctgggctgga

SEQ ID NO: 304339 - DNA, 21 bp, Homo sapiens
tgctaccgccctgggctggac

SEQ ID NO: 304340 - DNA, 22 bp, Homo sapiens
tgctacctctaacaccacactg

SEQ ID NO: 304341 - DNA, 18 bp, Homo sapiens
tgctacctgatcccactc

SEQ ID NO: 304342 - DNA, 14 bp, Homo sapiens
tgctacgaagaaag

SEQ ID NO: 304343 - DNA, 20 bp, Homo sapiens
tgctacggtagtgatgaaat

SEQ ID NO: 304344 - DNA, 21 bp, Homo sapiens
tgctacggtagtgatgaaatt

SEQ ID NO: 304345 - DNA, 21 bp, Homo sapiens
tgctactggacttgaatggtt

SEQ ID NO: 304346 - DNA, 22 bp, Homo sapiens
tgctactgtcagtgtcctcagg

SEQ ID NO: 304347 - DNA, 14 bp, Homo sapiens
tgctacttgagagt

SEQ ID NO: 304348 - DNA, 17 bp, Homo sapiens
tgctacttttacttgtt

SEQ ID NO: 304349 - DNA, 20 bp, Homo sapiens
tgctacttttacttgttcat

SEQ ID NO: 304350 - DNA, 22 bp, Homo sapiens
tgctacttttacttgttcattt

SEQ ID NO: 304351 - DNA, 13 bp, Homo sapiens
tgctagaatactt

SEQ ID NO: 304352 - DNA, 21 bp, Homo sapiens
tgctagacaaggttgctgttg

SEQ ID NO: 304353 - DNA, 22 bp, Homo sapiens
tgcttttatatggcccagcctt

SEQ ID NO: 304354 - DNA, 23 bp, Homo sapiens
tgcttttatatggcccagccttg

SEQ ID NO: 304355 - DNA, 12 bp, Homo sapiens
tgcttttccatc

SEQ ID NO: 304356 - DNA, 15 bp, Homo sapiens
tgcttttccctagtg

SEQ ID NO: 304357 - DNA, 15 bp, Homo sapiens
tgcttttctcatggt

SEQ ID NO: 304358 - DNA, 16 bp, Homo sapiens
tgcttttgcaaacaga

SEQ ID NO: 304359 - DNA, 21 bp, Homo sapiens
tgcttttgttttcctgctggt

SEQ ID NO: 304360 - DNA, 23 bp, Homo sapiens
tgcttttttatggcgattcccat

SEQ ID NO: 304361 - DNA, 17 bp, Homo sapiens
tgcttttttttttccag

SEQ ID NO: 304362 - DNA, 19 bp, Homo sapiens
tgcttttttttttccagca

SEQ ID NO: 304363 - DNA, 15 bp, Homo sapiens
tggaaaaaaaaaaca

SEQ ID NO: 304364 - DNA, 16 bp, Homo sapiens
tggaaaaaatatttta

SEQ ID NO: 304365 - DNA, 18 bp, Homo sapiens
tggaaaaagaaattctgt

SEQ ID NO: 304366 - DNA, 16 bp, Homo sapiens
tggaaaactgcctgtt

SEQ ID NO: 304367 - DNA, 19 bp, Homo sapiens
tggaaaagaaatcaatttt

SEQ ID NO: 304368 - DNA, 15 bp, Homo sapiens
tggaaaagaactgtt

SEQ ID NO: 304369 - DNA, 12 bp, Homo sapiens
tggaaaatgatc

SEQ ID NO: 304370 - DNA, 21 bp, Homo sapiens
tggaaaccacacttcttgaaa

SEQ ID NO: 304371 - DNA, 20 bp, Homo sapiens
tggaaaccatgcactagcca

SEQ ID NO: 304372 - DNA, 15 bp, Homo sapiens
tggaaacctgccctg

SEQ ID NO: 304373 - DNA, 16 bp, Homo sapiens
tggaaacctgccctgc

SEQ ID NO: 304374 - DNA, 20 bp, Homo sapiens
tggaaacctgccctgcctga

SEQ ID NO: 304375 - DNA, 24 bp, Homo sapiens
tggaaacctgccctgcctgagggc

SEQ ID NO: 304376 - DNA, 19 bp, Homo sapiens
tggaaacctgttatgccaa

SEQ ID NO: 304377 - DNA, 23 bp, Homo sapiens
tggaaactaccagtgggcatgta

SEQ ID NO: 304378 - DNA, 21 bp, Homo sapiens
tggaaactgttgccagagatg

SEQ ID NO: 304379 - DNA, 12 bp, Homo sapiens
tggaaagacagg

SEQ ID NO: 304380 - DNA, 13 bp, Homo sapiens
tggaaagaggaga

SEQ ID NO: 304381 - DNA, 14 bp, Homo sapiens
tggaaagaggagaa

SEQ ID NO: 304382 - DNA, 17 bp, Homo sapiens
tggaaagattgtgtctg

SEQ ID NO: 304383 - DNA, 20 bp, Homo sapiens
tggaaaggattctaaacaga

SEQ ID NO: 304384 - DNA, 17 bp, Homo sapiens
tggaaaggggagttgag

SEQ ID NO: 304385 - DNA, 20 bp, Homo sapiens
tggaaaggtcattgtggcta

SEQ ID NO: 304386 - DNA, 14 bp, Homo sapiens
tggaaaggtcctgc

SEQ ID NO: 304387 - DNA, 21 bp, Homo sapiens
tggaaagtgaatttgaatgaa

SEQ ID NO: 304388 - DNA, 17 bp, Homo sapiens
tggaaataaactgtgca

SEQ ID NO: 304389 - DNA, 22 bp, Homo sapiens
tggaaataataaattaacatta

SEQ ID NO: 304390 - DNA, 13 bp, Homo sapiens
tggaaatattaaa

SEQ ID NO: 304391 - DNA, 16 bp, Homo sapiens
tggaaatattaaaaga

SEQ ID NO: 304392 - DNA, 14 bp, Homo sapiens
tggaaatattttga

SEQ ID NO: 304393 - DNA, 21 bp, Homo sapiens
tggaaatattttgataataaa

SEQ ID NO: 304394 - DNA, 14 bp, Homo sapiens
tggaaatcattgtg

SEQ ID NO: 304395 - DNA, 21 bp, Homo sapiens
tggaaattgggtgtgccctgg

SEQ ID NO: 304396 - DNA, 21 bp, Homo sapiens
tggaacagtcacccttctggg

SEQ ID NO: 304397 - DNA, 17 bp, Homo sapiens
tggaacatatgcacagg

SEQ ID NO: 304398 - DNA, 18 bp, Homo sapiens
tggaacatatgcacaggg

SEQ ID NO: 304399 - DNA, 11 bp, Homo sapiens
tggaaccaatc

SEQ ID NO: 304400 - DNA, 18 bp, Homo sapiens
tggaacccttttggcccc

SEQ ID NO: 304401 - DNA, 21 bp, Homo sapiens
tggaacccttttggcccccga

SEQ ID NO: 304402 - DNA, 14 bp, Homo sapiens
tggaacctccctgg

SEQ ID NO: 304403 - DNA, 22 bp, Homo sapiens
tggaacctccctgggcctgtct

SEQ ID NO: 304404 - DNA, 20 bp, Homo sapiens
tggaactcgcccccctaccc

SEQ ID NO: 304405 - DNA, 16 bp, Homo sapiens
tggaactctaccctgg

SEQ ID NO: 304406 - DNA, 15 bp, Homo sapiens
tggaactctatctgg

SEQ ID NO: 304407 - DNA, 23 bp, Homo sapiens
tggaactctcctgctcctcagga

SEQ ID NO: 304408 - DNA, 18 bp, Homo sapiens
tggaactctgtgcaggtg

SEQ ID NO: 304409 - DNA, 23 bp, Homo sapiens
tggaactctgtgcaggtgctgcc

SEQ ID NO: 304410 - DNA, 13 bp, Homo sapiens
tggaactgacccc

SEQ ID NO: 304411 - DNA, 16 bp, Homo sapiens
tggaactgctgccatg

SEQ ID NO: 304412 - DNA, 13 bp, Homo sapiens
tggaacttctaat

SEQ ID NO: 304413 - DNA, 14 bp, Homo sapiens
tggaacttctaata

SEQ ID NO: 304414 - DNA, 16 bp, Homo sapiens
tggaacttctaatata

SEQ ID NO: 304415 - DNA, 18 bp, Homo sapiens
tggaacttctaatatatt

SEQ ID NO: 304416 - DNA, 17 bp, Homo sapiens
tggaactttagggggtg

SEQ ID NO: 304417 - DNA, 23 bp, Homo sapiens
tggaactttagggggtgggaggg

SEQ ID NO: 304418 - DNA, 17 bp, Homo sapiens
tggaagaccccacccaa

SEQ ID NO: 304419 - DNA, 12 bp, Homo sapiens
tggaagacgtgg

SEQ ID NO: 304420 - DNA, 22 bp, Homo sapiens
tggaagacttagatctgagccc

SEQ ID NO: 304421 - DNA, 13 bp, Homo sapiens
tggaagagaggca

SEQ ID NO: 304422 - DNA, 14 bp, Homo sapiens
tggaagagaggcac

SEQ ID NO: 304423 - DNA, 16 bp, Homo sapiens
tggaagagaggcacct

SEQ ID NO: 304424 - DNA, 19 bp, Homo sapiens
tggaagagaggcacctgct

SEQ ID NO: 304425 - DNA, 23 bp, Homo sapiens
tggaagagaggcacctgctggaa

SEQ ID NO: 304426 - DNA, 16 bp, Homo sapiens
tggaagagcagcctga

SEQ ID NO: 304427 - DNA, 15 bp, Homo sapiens
tggaagagctgggta

SEQ ID NO: 304428 - DNA, 22 bp, Homo sapiens
tggaagagctgggtaccaggcc

SEQ ID NO: 304429 - DNA, 22 bp, Homo sapiens
tggaagagggagggtcagtgcc

SEQ ID NO: 304430 - DNA, 20 bp, Homo sapiens
tggaagaggttctcagcaag

SEQ ID NO: 304431 - DNA, 13 bp, Homo sapiens
tggaaggaaaaca

SEQ ID NO: 304432 - DNA, 16 bp, Homo sapiens
tggaaggaaaggaata

SEQ ID NO: 304433 - DNA, 21 bp, Homo sapiens
tggaaggagcctgcggctgct

SEQ ID NO: 304434 - DNA, 16 bp, Homo sapiens
tggaaggcagggcaga

SEQ ID NO: 304435 - DNA, 18 bp, Homo sapiens
tggaaggcagggcagagg

SEQ ID NO: 304436 - DNA, 18 bp, Homo sapiens
tggaagggccttctccac

SEQ ID NO: 304437 - DNA, 15 bp, Homo sapiens
tggaagggtttgtgg

SEQ ID NO: 304438 - DNA, 15 bp, Homo sapiens
tggaaggtctattgg

SEQ ID NO: 304439 - DNA, 20 bp, Homo sapiens
tggaaggttcaggggccgct

SEQ ID NO: 304440 - DNA, 18 bp, Homo sapiens
tggaaggttttaacattg

SEQ ID NO: 304441 - DNA, 17 bp, Homo sapiens
tggaagtgttcaagaaa

SEQ ID NO: 304442 - DNA, 23 bp, Homo sapiens
tggaagtttgtgttctgtttgtt

SEQ ID NO: 304443 - DNA, 14 bp, Homo sapiens
tggaagttttgcat

SEQ ID NO: 304444 - DNA, 15 bp, Homo sapiens
tggaataaaggctga

SEQ ID NO: 304445 - DNA, 17 bp, Homo sapiens
tggaataggaataagct

SEQ ID NO: 304446 - DNA, 14 bp, Homo sapiens
tggaatataaggaa

SEQ ID NO: 304447 - DNA, 23 bp, Homo sapiens
tggaatcagcttttaataaaatt

SEQ ID NO: 304448 - DNA, 17 bp, Homo sapiens
tggaatccagaaggaag

SEQ ID NO: 304449 - DNA, 21 bp, Homo sapiens
tggaatcttctctttgacaat

SEQ ID NO: 304450 - DNA, 22 bp, Homo sapiens
tggaatcttctctttgacaatt

SEQ ID NO: 304451 - DNA, 13 bp, Homo sapiens
tggaatgaagcat

SEQ ID NO: 304452 - DNA, 16 bp, Homo sapiens
tggaatgaagcatgta

SEQ ID NO: 304453 - DNA, 14 bp, Homo sapiens
tggaatgtgcccct

SEQ ID NO: 304454 - DNA, 18 bp, Homo sapiens
tggaatgtgcccctggcc

SEQ ID NO: 304455 - DNA, 14 bp, Homo sapiens
tggaattaaaacaa

SEQ ID NO: 304456 - DNA, 16 bp, Homo sapiens
tggaattaaaacaatg

SEQ ID NO: 304457 - DNA, 19 bp, Homo sapiens
tggaattaacctggtgctg

SEQ ID NO: 304458 - DNA, 21 bp, Homo sapiens
tggaattaacctggtgctgga

SEQ ID NO: 304459 - DNA, 19 bp, Homo sapiens
tggaattacataacaggca

SEQ ID NO: 304460 - DNA, 14 bp, Homo sapiens
tggaattatgtata

SEQ ID NO: 304461 - DNA, 23 bp, Homo sapiens
tggaattcaccctctcatgtttc

SEQ ID NO: 304462 - DNA, 19 bp, Homo sapiens
tggaattcagcaccctggg

SEQ ID NO: 304463 - DNA, 11 bp, Homo sapiens
tggaattgctt

SEQ ID NO: 304464 - DNA, 16 bp, Homo sapiens
tggaattgcttaccaa

SEQ ID NO: 304465 - DNA, 18 bp, Homo sapiens
tggaattgcttaccaaag

SEQ ID NO: 304466 - DNA, 23 bp, Homo sapiens
tggaattgcttaccaaaggatag

SEQ ID NO: 304467 - DNA, 13 bp, Homo sapiens
tggaattggtgta

SEQ ID NO: 304468 - DNA, 16 bp, Homo sapiens
tggaattggtgtatat

SEQ ID NO: 304469 - DNA, 19 bp, Homo sapiens
tggaattggtgtatatcat

SEQ ID NO: 304470 - DNA, 16 bp, Homo sapiens
tggacaatcatgaaat

SEQ ID NO: 304471 - DNA, 20 bp, Homo sapiens
tggacacactgtaaacccct

SEQ ID NO: 304472 - DNA, 21 bp, Homo sapiens
tggacacactgtaaacccctg

SEQ ID NO: 304473 - DNA, 22 bp, Homo sapiens
tggacacactgtaaacccctgg

SEQ ID NO: 304474 - DNA, 10 bp, Homo sapiens
tggacacctg

SEQ ID NO: 304475 - DNA, 11 bp, Homo sapiens
tggacacctgc

SEQ ID NO: 304476 - DNA, 17 bp, Homo sapiens
tggacacctgccctgcc

SEQ ID NO: 304477 - DNA, 18 bp, Homo sapiens
tggacacctgccctgccc

SEQ ID NO: 304478 - DNA, 20 bp, Homo sapiens
tggacagcaaaaccattgct

SEQ ID NO: 304479 - DNA, 12 bp, Homo sapiens
tggacagggcca

SEQ ID NO: 304480 - DNA, 14 bp, Homo sapiens
tggacagggccagg

SEQ ID NO: 304481 - DNA, 16 bp, Homo sapiens
tggacagggccagggt

SEQ ID NO: 304482 - DNA, 17 bp, Homo sapiens
tggacaggtctgggaga

SEQ ID NO: 304483 - DNA, 22 bp, Homo sapiens
tggcagcctcagggcttcctta

SEQ ID NO: 304484 - DNA, 15 bp, Homo sapiens
tggcagctagactgg

SEQ ID NO: 304485 - DNA, 17 bp, Homo sapiens
tggcagctagactggag

SEQ ID NO: 304486 - DNA, 14 bp, Homo sapiens
tggcagctcctctc

SEQ ID NO: 304487 - DNA, 22 bp, Homo sapiens
tggcagctggggagcagctgag

SEQ ID NO: 304488 - DNA, 15 bp, Homo sapiens
tggcagcttcaaaac

SEQ ID NO: 304489 - DNA, 23 bp, Homo sapiens
tggcagcttcaaaacagaacggg

SEQ ID NO: 304490 - DNA, 19 bp, Homo sapiens
tggcaggagagagccttgg

SEQ ID NO: 304491 - DNA, 13 bp, Homo sapiens
tggcaggagggtg

SEQ ID NO: 304492 - DNA, 15 bp, Homo sapiens
tggcaggcatctgta

SEQ ID NO: 304493 - DNA, 18 bp, Homo sapiens
tggcaggtgttgggacct

SEQ ID NO: 304494 - DNA, 20 bp, Homo sapiens
tggcaggtgttgggacctgc

SEQ ID NO: 304495 - DNA, 13 bp, Homo sapiens
tggcagtacagag

SEQ ID NO: 304496 - DNA, 16 bp, Homo sapiens
tggcagtacagagtgc

SEQ ID NO: 304497 - DNA, 18 bp, Homo sapiens
tggcagtacagagtgcag

SEQ ID NO: 304498 - DNA, 13 bp, Homo sapiens
tggcagtggccag

SEQ ID NO: 304499 - DNA, 17 bp, Homo sapiens
tggcagtggccaggcag

SEQ ID NO: 304500 - DNA, 19 bp, Homo sapiens
tggcagtggccaggcaggg

SEQ ID NO: 304501 - DNA, 13 bp, Homo sapiens
tggcagtgtttgt

SEQ ID NO: 304502 - DNA, 20 bp, Homo sapiens
tggcatctttgccttgggct

SEQ ID NO: 304503 - DNA, 21 bp, Homo sapiens
tggcatctttgccttgggctg

SEQ ID NO: 304504 - DNA, 20 bp, Homo sapiens
tggcatgtgctgtgaccatt

SEQ ID NO: 304505 - DNA, 20 bp, Homo sapiens
tggcatgtgggttgtgatat

SEQ ID NO: 304506 - DNA, 23 bp, Homo sapiens
tggcatgtgggttgtgatattga

SEQ ID NO: 304507 - DNA, 15 bp, Homo sapiens
tggcattaaaactta

SEQ ID NO: 304508 - DNA, 13 bp, Homo sapiens
tggcattactctg

SEQ ID NO: 304509 - DNA, 15 bp, Homo sapiens
tggcattactctgca

SEQ ID NO: 304510 - DNA, 16 bp, Homo sapiens
tggcattgtccctgtg

SEQ ID NO: 304511 - DNA, 13 bp, Homo sapiens
tggcattgttgat

SEQ ID NO: 304512 - DNA, 17 bp, Homo sapiens
tggcatttttagctcct

SEQ ID NO: 304513 - DNA, 14 bp, Homo sapiens
tggccaaatatgca

SEQ ID NO: 304514 - DNA, 18 bp, Homo sapiens
tggccaaattatttgtgt

SEQ ID NO: 304515 - DNA, 19 bp, Homo sapiens
tggccaacgtggacctgcc

SEQ ID NO: 304516 - DNA, 17 bp, Homo sapiens
tggccaaggggccagct

SEQ ID NO: 304517 - DNA, 21 bp, Homo sapiens
tggccaaggggccagctgccc

SEQ ID NO: 304518 - DNA, 18 bp, Homo sapiens
tggccacaatcctcccca

SEQ ID NO: 304519 - DNA, 21 bp, Homo sapiens
tggccacaatcctccccacca

SEQ ID NO: 304520 - DNA, 12 bp, Homo sapiens
tggccacagcag

SEQ ID NO: 304521 - DNA, 15 bp, Homo sapiens
tggccacagccacct

SEQ ID NO: 304522 - DNA, 15 bp, Homo sapiens
tggccacctctctcc

SEQ ID NO: 304523 - DNA, 16 bp, Homo sapiens
tggccacgcagccagg

SEQ ID NO: 304524 - DNA, 17 bp, Homo sapiens
tggccactccagacccc

SEQ ID NO: 304525 - DNA, 22 bp, Homo sapiens
tggccactccagacccctggct

SEQ ID NO: 304526 - DNA, 18 bp, Homo sapiens
tggccactctgctctgca

SEQ ID NO: 304527 - DNA, 20 bp, Homo sapiens
tggccactgggtctcactcc

SEQ ID NO: 304528 - DNA, 21 bp, Homo sapiens
tggccacttgggtcttccctg

SEQ ID NO: 304529 - DNA, 23 bp, Homo sapiens
tggccactttgcagacctgggac

SEQ ID NO: 304530 - DNA, 17 bp, Homo sapiens
tggccagaccagagctc

SEQ ID NO: 304531 - DNA, 23 bp, Homo sapiens
tggccagaccagagctctggagc

SEQ ID NO: 304532 - DNA, 23 bp, Homo sapiens
tggccagacggcccgccgtgcct

SEQ ID NO: 304533 - DNA, 18 bp, Homo sapiens
tggccagagagggcccag

SEQ ID NO: 304534 - DNA, 20 bp, Homo sapiens
tggccagagagggcccagct

SEQ ID NO: 304535 - DNA, 22 bp, Homo sapiens
tggccagagagggcccagctgt

SEQ ID NO: 304536 - DNA, 14 bp, Homo sapiens
tggccagaggcagc

SEQ ID NO: 304537 - DNA, 19 bp, Homo sapiens
tggccagcaaggcaggttg

SEQ ID NO: 304538 - DNA, 13 bp, Homo sapiens
tggccagcagctt

SEQ ID NO: 304539 - DNA, 15 bp, Homo sapiens
tggccaggagctctt

SEQ ID NO: 304540 - DNA, 16 bp, Homo sapiens
tggccaggagctcttc

SEQ ID NO: 304541 - DNA, 21 bp, Homo sapiens
tggccaggaggttggtgactg

SEQ ID NO: 304542 - DNA, 16 bp, Homo sapiens
tggccaggcactgcct

SEQ ID NO: 304543 - DNA, 12 bp, Homo sapiens
tggccaggcaga

SEQ ID NO: 304544 - DNA, 17 bp, Homo sapiens
tggccaggcagatctgt

SEQ ID NO: 304545 - DNA, 20 bp, Homo sapiens
tggccaggcagatctgtgcc

SEQ ID NO: 304546 - DNA, 14 bp, Homo sapiens
tggccaggcaggga

SEQ ID NO: 304547 - DNA, 14 bp, Homo sapiens
tggccaggcctgcc

SEQ ID NO: 304548 - DNA, 21 bp, Homo sapiens
tggccaggcctgccagcccct

SEQ ID NO: 304549 - DNA, 20 bp, Homo sapiens
tggccaggctggtcttgaac

SEQ ID NO: 304550 - DNA, 23 bp, Homo sapiens
tggccaggctggtcttgaactcc

SEQ ID NO: 304551 - DNA, 17 bp, Homo sapiens
tggccagggctccacgg

SEQ ID NO: 304552 - DNA, 15 bp, Homo sapiens
tggccaggtggccac

SEQ ID NO: 304553 - DNA, 15 bp, Homo sapiens
tggccagtagctgcc

SEQ ID NO: 304554 - DNA, 12 bp, Homo sapiens
tggcccacccct

SEQ ID NO: 304555 - DNA, 14 bp, Homo sapiens
tggcccacccctct

SEQ ID NO: 304556 - DNA, 17 bp, Homo sapiens
tggcccacccctcttcc

SEQ ID NO: 304557 - DNA, 18 bp, Homo sapiens
tggcccagagctggaaca

SEQ ID NO: 304558 - DNA, 12 bp, Homo sapiens
tggcccagcagc

SEQ ID NO: 304559 - DNA, 18 bp, Homo sapiens
tggcccagcagcggccca

SEQ ID NO: 304560 - DNA, 23 bp, Homo sapiens
tggcccagcagcttggctgagcc

SEQ ID NO: 304561 - DNA, 14 bp, Homo sapiens
tggcccagccagca

SEQ ID NO: 304562 - DNA, 15 bp, Homo sapiens
tggcccagccagcag

SEQ ID NO: 304563 - DNA, 19 bp, Homo sapiens
tggcccagcctggagccgt

SEQ ID NO: 304564 - DNA, 17 bp, Homo sapiens
tggcccagcggcccctc

SEQ ID NO: 304565 - DNA, 15 bp, Homo sapiens
tggcccagctcccca

SEQ ID NO: 304566 - DNA, 14 bp, Homo sapiens
tggcccaggaaaaa

SEQ ID NO: 304567 - DNA, 22 bp, Homo sapiens
tggcccaggaaaaacctgtggg

SEQ ID NO: 304568 - DNA, 12 bp, Homo sapiens
tggcccagtgtc

SEQ ID NO: 304569 - DNA, 18 bp, Homo sapiens
tggcccatctcagcctcc

SEQ ID NO: 304570 - DNA, 14 bp, Homo sapiens
tggccccaaatgtt

SEQ ID NO: 304571 - DNA, 12 bp, Homo sapiens
tggccccagctg

SEQ ID NO: 304572 - DNA, 18 bp, Homo sapiens
tggccccagctgtgactg

SEQ ID NO: 304573 - DNA, 14 bp, Homo sapiens
tggccccaggtgcc

SEQ ID NO: 304574 - DNA, 15 bp, Homo sapiens
tggccccaggtgcca

SEQ ID NO: 304575 - DNA, 21 bp, Homo sapiens
tggccccatccagcatgtgtg

SEQ ID NO: 304576 - DNA, 17 bp, Homo sapiens
tggcccccctccaggca

SEQ ID NO: 304577 - DNA, 21 bp, Homo sapiens
tggcccccctccaggcatgct

SEQ ID NO: 304578 - DNA, 23 bp, Homo sapiens
tggcccccctccaggcatgctgg

SEQ ID NO: 304579 - DNA, 15 bp, Homo sapiens
tggccccgccctcag

SEQ ID NO: 304580 - DNA, 20 bp, Homo sapiens
tggccccgggctctggccac

SEQ ID NO: 304581 - DNA, 21 bp, Homo sapiens
tggcccctcacctgggcacct

SEQ ID NO: 304582 - DNA, 19 bp, Homo sapiens
tggcccctcacctgggcct

SEQ ID NO: 304583 - DNA, 21 bp, Homo sapiens
tggcccctccagaccctgcct

SEQ ID NO: 304584 - DNA, 13 bp, Homo sapiens
tggcccctcccca

SEQ ID NO: 304585 - DNA, 23 bp, Homo sapiens
tggcccctccccaactccttcct

SEQ ID NO: 304586 - DNA, 21 bp, Homo sapiens
tggcccctccttctcccctcc

SEQ ID NO: 304587 - DNA, 23 bp, Homo sapiens
tggcccctccttctcccctccag

SEQ ID NO: 304588 - DNA, 10 bp, Homo sapiens
tggcccctct

SEQ ID NO: 304589 - DNA, 14 bp, Homo sapiens
tggcccctgccttg

SEQ ID NO: 304590 - DNA, 16 bp, Homo sapiens
tggccccttcacttct

SEQ ID NO: 304591 - DNA, 15 bp, Homo sapiens
tggcccgacagcctg

SEQ ID NO: 304592 - DNA, 16 bp, Homo sapiens
tggcccgacagcctgg

SEQ ID NO: 304593 - DNA, 19 bp, Homo sapiens
tggcccgacagcctggcac

SEQ ID NO: 304594 - DNA, 13 bp, Homo sapiens
tggcccgcccctc

SEQ ID NO: 304595 - DNA, 21 bp, Homo sapiens
tggcccgcccctcgctgctgc

SEQ ID NO: 304596 - DNA, 12 bp, Homo sapiens
tggccctgccct

SEQ ID NO: 304597 - DNA, 15 bp, Homo sapiens
tggccctgccctccc

SEQ ID NO: 304598 - DNA, 16 bp, Homo sapiens
tggccctgccctcccc

SEQ ID NO: 304599 - DNA, 17 bp, Homo sapiens
tggccctgccctccccc

SEQ ID NO: 304600 - DNA, 18 bp, Homo sapiens
tggccctgccctccccca

SEQ ID NO: 304601 - DNA, 13 bp, Homo sapiens
tggccctggggaa

SEQ ID NO: 304602 - DNA, 13 bp, Homo sapiens
tggccctgtggga

SEQ ID NO: 304603 - DNA, 14 bp, Homo sapiens
tggccctgtgggag

SEQ ID NO: 304604 - DNA, 16 bp, Homo sapiens
tggccctgtgggagtc

SEQ ID NO: 304605 - DNA, 20 bp, Homo sapiens
tggccctgtgggagtccact

SEQ ID NO: 304606 - DNA, 16 bp, Homo sapiens
tggcccttcctggact

SEQ ID NO: 304607 - DNA, 22 bp, Homo sapiens
tggcccttcctggactggccct

SEQ ID NO: 304608 - DNA, 13 bp, Homo sapiens
tggcccttgccca

SEQ ID NO: 304609 - DNA, 20 bp, Homo sapiens
tggcccttgcccaactccca

SEQ ID NO: 304610 - DNA, 20 bp, Homo sapiens
tggccgagggtcctggctcc

SEQ ID NO: 304611 - DNA, 21 bp, Homo sapiens
tggccgcacctaaagcagcca

SEQ ID NO: 304612 - DNA, 23 bp, Homo sapiens
tggccgcacctaaagcagccagc

SEQ ID NO: 304613 - DNA, 13 bp, Homo sapiens
tggctgataaaag

SEQ ID NO: 304614 - DNA, 13 bp, Homo sapiens
tggctgcacagcc

SEQ ID NO: 304615 - DNA, 15 bp, Homo sapiens
tggctgcacagccca

SEQ ID NO: 304616 - DNA, 19 bp, Homo sapiens
tggctgcacagcccaacca

SEQ ID NO: 304617 - DNA, 20 bp, Homo sapiens
tggctgcacagcccaaccag

SEQ ID NO: 304618 - DNA, 21 bp, Homo sapiens
tggctgcacagcccaaccagg

SEQ ID NO: 304619 - DNA, 22 bp, Homo sapiens
tggctgcacagcccaaccagga

SEQ ID NO: 304620 - DNA, 16 bp, Homo sapiens
tggctgcctctgggag

SEQ ID NO: 304621 - DNA, 16 bp, Homo sapiens
tggctgcctggcccag

SEQ ID NO: 304622 - DNA, 17 bp, Homo sapiens
tggctgcctggcccagg

SEQ ID NO: 304623 - DNA, 20 bp, Homo sapiens
tggctgcgaactgtgcagtt

SEQ ID NO: 304624 - DNA, 17 bp, Homo sapiens
tggctgcggcacccttg

SEQ ID NO: 304625 - DNA, 12 bp, Homo sapiens
tggctgctctgt

SEQ ID NO: 304626 - DNA, 12 bp, Homo sapiens
tggctgctgcca

SEQ ID NO: 304627 - DNA, 19 bp, Homo sapiens
tggctggatgaaattttct

SEQ ID NO: 304628 - DNA, 22 bp, Homo sapiens
tggctggatgaaattttctaga

SEQ ID NO: 304629 - DNA, 15 bp, Homo sapiens
tggctggcaggtgtt

SEQ ID NO: 304630 - DNA, 23 bp, Homo sapiens
tggctggcaggtgttgggacctg

SEQ ID NO: 304631 - DNA, 19 bp, Homo sapiens
tggctgggagggggccctt

SEQ ID NO: 304632 - DNA, 20 bp, Homo sapiens
tggctggggacttggccgct

SEQ ID NO: 304633 - DNA, 12 bp, Homo sapiens
tggctggggatg

SEQ ID NO: 304634 - DNA, 14 bp, Homo sapiens
tggctggggcagag

SEQ ID NO: 304635 - DNA, 16 bp, Homo sapiens
tggctgggtcgcccct

SEQ ID NO: 304636 - DNA, 17 bp, Homo sapiens
tggctgggtggtcagca

SEQ ID NO: 304637 - DNA, 13 bp, Homo sapiens
tggctgggttcag

SEQ ID NO: 304638 - DNA, 19 bp, Homo sapiens
tggctgggtttgggcagtg

SEQ ID NO: 304639 - DNA, 22 bp, Homo sapiens
tggctgggtttgggcagtggag

SEQ ID NO: 304640 - DNA, 22 bp, Homo sapiens
tggctggtaagggccaagtccc

SEQ ID NO: 304641 - DNA, 23 bp, Homo sapiens
tggctggtcacgacttcttcgga

SEQ ID NO: 304642 - DNA, 15 bp, Homo sapiens
tggctggtgtcccct

SEQ ID NO: 304643 - DNA, 21 bp, Homo sapiens
tggctggtgtccccttcccct

SEQ ID NO: 304644 - DNA, 21 bp, Homo sapiens
tggctgtaatttaattcccct

SEQ ID NO: 304645 - DNA, 13 bp, Homo sapiens
tggctgtattttt

SEQ ID NO: 304646 - DNA, 18 bp, Homo sapiens
tggctgtatttttagaga

SEQ ID NO: 304647 - DNA, 20 bp, Homo sapiens
tggctgtcctcttaagacac

SEQ ID NO: 304648 - DNA, 22 bp, Homo sapiens
tggctgtcctcttaagacacta

SEQ ID NO: 304649 - DNA, 19 bp, Homo sapiens
tggctgtctgcctgtattt

SEQ ID NO: 304650 - DNA, 17 bp, Homo sapiens
tggctgtgagacgaggc

SEQ ID NO: 304651 - DNA, 17 bp, Homo sapiens
tggctgtgagcagcctc

SEQ ID NO: 304652 - DNA, 22 bp, Homo sapiens
tggctgtgcctctgcctgtctc

SEQ ID NO: 304653 - DNA, 13 bp, Homo sapiens
tggctgtggaggc

SEQ ID NO: 304654 - DNA, 16 bp, Homo sapiens
tggctgtggaggcctg

SEQ ID NO: 304655 - DNA, 20 bp, Homo sapiens
tggctgtggaggcctgatgc

SEQ ID NO: 304656 - DNA, 13 bp, Homo sapiens
tggctgtggcaca

SEQ ID NO: 304657 - DNA, 16 bp, Homo sapiens
tggctgtggcacagac

SEQ ID NO: 304658 - DNA, 17 bp, Homo sapiens
tggctgtggcacagact

SEQ ID NO: 304659 - DNA, 18 bp, Homo sapiens
tggctgtggcattgttga

SEQ ID NO: 304660 - DNA, 19 bp, Homo sapiens
tggctgtggcattgttgat

SEQ ID NO: 304661 - DNA, 16 bp, Homo sapiens
tggctgtgtactttga

SEQ ID NO: 304662 - DNA, 14 bp, Homo sapiens
tggctgtgtgactt

SEQ ID NO: 304663 - DNA, 20 bp, Homo sapiens
tggctgttggcccctctgct

SEQ ID NO: 304664 - DNA, 14 bp, Homo sapiens
tggcttaatgttta

SEQ ID NO: 304665 - DNA, 23 bp, Homo sapiens
tggcttactacatgtgggagctt

SEQ ID NO: 304666 - DNA, 16 bp, Homo sapiens
tggcttataaacacat

SEQ ID NO: 304667 - DNA, 18 bp, Homo sapiens
tggcttccagcgggccct

SEQ ID NO: 304668 - DNA, 20 bp, Homo sapiens
tggcttccagcgggccctct

SEQ ID NO: 304669 - DNA, 13 bp, Homo sapiens
tggcttcccagga

SEQ ID NO: 304670 - DNA, 16 bp, Homo sapiens
tggcttcccgctcagc

SEQ ID NO: 304671 - DNA, 21 bp, Homo sapiens
tggcttcccgctcagccctcc

SEQ ID NO: 304672 - DNA, 23 bp, Homo sapiens
tggcttcctccgtccacccaggc

SEQ ID NO: 304673 - DNA, 18 bp, Homo sapiens
tggcttctgcttgtcatc

SEQ ID NO: 304674 - DNA, 17 bp, Homo sapiens
tggcttgacatgtgcaa

SEQ ID NO: 304675 - DNA, 18 bp, Homo sapiens
tggcttgacatgtgcaat

SEQ ID NO: 304676 - DNA, 17 bp, Homo sapiens
tggcttgcactttgtga

SEQ ID NO: 304677 - DNA, 12 bp, Homo sapiens
tggcttgctcca

SEQ ID NO: 304678 - DNA, 16 bp, Homo sapiens
tggcttgctccagggt

SEQ ID NO: 304679 - DNA, 19 bp, Homo sapiens
tggcttgctccagggtctt

SEQ ID NO: 304680 - DNA, 12 bp, Homo sapiens
tggcttggagca

SEQ ID NO: 304681 - DNA, 23 bp, Homo sapiens
tggcttgggactaaatgccctgc

SEQ ID NO: 304682 - DNA, 12 bp, Homo sapiens
tggcttgtaggg

SEQ ID NO: 304683 - DNA, 22 bp, Homo sapiens
tggcttgtagggtgaggcgtgg

SEQ ID NO: 304684 - DNA, 17 bp, Homo sapiens
tggctttatttgttttt

SEQ ID NO: 304685 - DNA, 14 bp, Homo sapiens
tggctttcatcctg

SEQ ID NO: 304686 - DNA, 17 bp, Homo sapiens
tggctttcatcctgtgt

SEQ ID NO: 304687 - DNA, 17 bp, Homo sapiens
tggctttgcccaacctc

SEQ ID NO: 304688 - DNA, 22 bp, Homo sapiens
tggctttgcccaacctcagcaa

SEQ ID NO: 304689 - DNA, 14 bp, Homo sapiens
tggctttgccttta

SEQ ID NO: 304690 - DNA, 12 bp, Homo sapiens
tggcttttactt

SEQ ID NO: 304691 - DNA, 14 bp, Homo sapiens
tggcttttcactgc

SEQ ID NO: 304692 - DNA, 21 bp, Homo sapiens
tggcttttcactgctggctgc

SEQ ID NO: 304693 - DNA, 21 bp, Homo sapiens
tggcttttcatgcgtgtgtgt

SEQ ID NO: 304694 - DNA, 19 bp, Homo sapiens
tggcttttctggctgggga

SEQ ID NO: 304695 - DNA, 16 bp, Homo sapiens
tgggaaaaactggctt

SEQ ID NO: 304696 - DNA, 19 bp, Homo sapiens
tgggaaacagagtccaatt

SEQ ID NO: 304697 - DNA, 20 bp, Homo sapiens
tgggaaagccacctctccct

SEQ ID NO: 304698 - DNA, 21 bp, Homo sapiens
tgggaaagccacctctccctc

SEQ ID NO: 304699 - DNA, 22 bp, Homo sapiens
tgggaaagccacctctccctca

SEQ ID NO: 304700 - DNA, 20 bp, Homo sapiens
tgggaaagggtgaggacttc

SEQ ID NO: 304701 - DNA, 16 bp, Homo sapiens
tgggaaaggtgctcaa

SEQ ID NO: 304702 - DNA, 17 bp, Homo sapiens
tgggaaattcttgcact

SEQ ID NO: 304703 - DNA, 15 bp, Homo sapiens
tgggaacaagtgtac

SEQ ID NO: 304704 - DNA, 18 bp, Homo sapiens
tgggaacaagtgtacaga

SEQ ID NO: 304705 - DNA, 22 bp, Homo sapiens
tgggaacaagtgtacagaagaa

SEQ ID NO: 304706 - DNA, 16 bp, Homo sapiens
tgggaacactggcctg

SEQ ID NO: 304707 - DNA, 19 bp, Homo sapiens
tgggaactccactctcctt

SEQ ID NO: 304708 - DNA, 22 bp, Homo sapiens
tgggaactcccaagaacagcag

SEQ ID NO: 304709 - DNA, 12 bp, Homo sapiens
tgggaagaaaca

SEQ ID NO: 304710 - DNA, 17 bp, Homo sapiens
tgggaagataggctctg

SEQ ID NO: 304711 - DNA, 24 bp, Homo sapiens
tgggaagccaggaaagcgtttgga

SEQ ID NO: 304712 - DNA, 17 bp, Homo sapiens
tgggaagctggagtgct

SEQ ID NO: 304713 - DNA, 14 bp, Homo sapiens
tgggaagcttgagc

SEQ ID NO: 304714 - DNA, 16 bp, Homo sapiens
tgggaagcttgagcct

SEQ ID NO: 304715 - DNA, 19 bp, Homo sapiens
tgggaagcttgagcctccc

SEQ ID NO: 304716 - DNA, 12 bp, Homo sapiens
tgggaaggactt

SEQ ID NO: 304717 - DNA, 13 bp, Homo sapiens
tgggaaggacttg

SEQ ID NO: 304718 - DNA, 23 bp, Homo sapiens
tgggaaggagggagctgctcaga

SEQ ID NO: 304719 - DNA, 22 bp, Homo sapiens
tgggaagtggaggttgagtgag

SEQ ID NO: 304720 - DNA, 16 bp, Homo sapiens
tgggaatatgtagagg

SEQ ID NO: 304721 - DNA, 22 bp, Homo sapiens
tgggaatgaatgtcagtgtgac

SEQ ID NO: 304722 - DNA, 21 bp, Homo sapiens
tgggaatgtattattctgcag

SEQ ID NO: 304723 - DNA, 22 bp, Homo sapiens
tgggaatgtattattctgcagc

SEQ ID NO: 304724 - DNA, 20 bp, Homo sapiens
tgggacacagaccggccgca

SEQ ID NO: 304725 - DNA, 13 bp, Homo sapiens
tgggacacagaga

SEQ ID NO: 304726 - DNA, 23 bp, Homo sapiens
tgggacagccagagctgggtggg

SEQ ID NO: 304727 - DNA, 23 bp, Homo sapiens
tgggacagctaggctgagatgca

SEQ ID NO: 304728 - DNA, 18 bp, Homo sapiens
tgggacccagctactctg

SEQ ID NO: 304729 - DNA, 21 bp, Homo sapiens
tgggacccatagatcttctga

SEQ ID NO: 304730 - DNA, 20 bp, Homo sapiens
tgggacccctcccaacctca

SEQ ID NO: 304731 - DNA, 21 bp, Homo sapiens
tgggacccctcccaacctcaa

SEQ ID NO: 304732 - DNA, 22 bp, Homo sapiens
tgggacccctcccaacctcaat

SEQ ID NO: 304733 - DNA, 14 bp, Homo sapiens
tgggacctgctgct

SEQ ID NO: 304734 - DNA, 20 bp, Homo sapiens
tgggacggaagtggcctgag

SEQ ID NO: 304735 - DNA, 22 bp, Homo sapiens
tgggacggaagtggcctgagaa

SEQ ID NO: 304736 - DNA, 20 bp, Homo sapiens
tgggactctcctcctcccct

SEQ ID NO: 304737 - DNA, 23 bp, Homo sapiens
tgggactctcctcctcccctcct

SEQ ID NO: 304738 - DNA, 11 bp, Homo sapiens
tgggactgatg

SEQ ID NO: 304739 - DNA, 15 bp, Homo sapiens
tgggactgatgtcat

SEQ ID NO: 304740 - DNA, 17 bp, Homo sapiens
tgggactgatgtcatct

SEQ ID NO: 304741 - DNA, 19 bp, Homo sapiens
tgggactgatgtcatcttg

SEQ ID NO: 304742 - DNA, 13 bp, Homo sapiens
tggggcctcaccc

SEQ ID NO: 304743 - DNA, 16 bp, Homo sapiens
tggggcctcacccaga

SEQ ID NO: 304744 - DNA, 16 bp, Homo sapiens
tggggcctggacctgc

SEQ ID NO: 304745 - DNA, 19 bp, Homo sapiens
tggggcctggacctgcctc

SEQ ID NO: 304746 - DNA, 14 bp, Homo sapiens
tggggcctggccca

SEQ ID NO: 304747 - DNA, 22 bp, Homo sapiens
tggggcctggcccacgccctcc

SEQ ID NO: 304748 - DNA, 14 bp, Homo sapiens
tggggcctggccta

SEQ ID NO: 304749 - DNA, 15 bp, Homo sapiens
tggggcctggcctat

SEQ ID NO: 304750 - DNA, 23 bp, Homo sapiens
tggggcctggcctatttaagccc

SEQ ID NO: 304751 - DNA, 16 bp, Homo sapiens
tggggcctggcttgct

SEQ ID NO: 304752 - DNA, 21 bp, Homo sapiens
tggggcctggcttgctccagg

SEQ ID NO: 304753 - DNA, 22 bp, Homo sapiens
tggggcctggcttgctccaggg

SEQ ID NO: 304754 - DNA, 17 bp, Homo sapiens
tggggcgaggcagagga

SEQ ID NO: 304755 - DNA, 19 bp, Homo sapiens
tggggcgaggcagaggaca

SEQ ID NO: 304756 - DNA, 17 bp, Homo sapiens
tggggcgggaaagccag

SEQ ID NO: 304757 - DNA, 19 bp, Homo sapiens
tggggcgggaaagccagtg

SEQ ID NO: 304758 - DNA, 22 bp, Homo sapiens
tggggcggtcaataattgtgga

SEQ ID NO: 304759 - DNA, 21 bp, Homo sapiens
tggggctcacggggcctccaa

SEQ ID NO: 304760 - DNA, 18 bp, Homo sapiens
tggggctccggtgcggtg

SEQ ID NO: 304761 - DNA, 21 bp, Homo sapiens
tggggctcgccccacccaggg

SEQ ID NO: 304762 - DNA, 13 bp, Homo sapiens
tggggctgagcct

SEQ ID NO: 304763 - DNA, 18 bp, Homo sapiens
tggggctgagtgcagagg

SEQ ID NO: 304764 - DNA, 16 bp, Homo sapiens
tggggctgccgtgcac

SEQ ID NO: 304765 - DNA, 19 bp, Homo sapiens
tggggctgcgaccgccaga

SEQ ID NO: 304766 - DNA, 13 bp, Homo sapiens
tggggctggggtg

SEQ ID NO: 304767 - DNA, 22 bp, Homo sapiens
tggggcttggaagggcgctgag

SEQ ID NO: 304768 - DNA, 17 bp, Homo sapiens
tgggggagagcaggctg

SEQ ID NO: 304769 - DNA, 19 bp, Homo sapiens
tgggggagagcaggctggc

SEQ ID NO: 304770 - DNA, 12 bp, Homo sapiens
tgggggagcctg

SEQ ID NO: 304771 - DNA, 14 bp, Homo sapiens
tgggggagcctgga

SEQ ID NO: 304772 - DNA, 16 bp, Homo sapiens
tgggggagcctggagc

SEQ ID NO: 304773 - DNA, 19 bp, Homo sapiens
tgggggagcctggagcccc

SEQ ID NO: 304774 - DNA, 18 bp, Homo sapiens
tgggggaggccaccccaa

SEQ ID NO: 304775 - DNA, 12 bp, Homo sapiens
tgggggaggctc

SEQ ID NO: 304776 - DNA, 14 bp, Homo sapiens
tgggggaggctctg

SEQ ID NO: 304777 - DNA, 17 bp, Homo sapiens
tgggggcagggcatgac

SEQ ID NO: 304778 - DNA, 18 bp, Homo sapiens
tgggggcagtgactggca

SEQ ID NO: 304779 - DNA, 13 bp, Homo sapiens
tgggggccatgag

SEQ ID NO: 304780 - DNA, 16 bp, Homo sapiens
tgggggccatgagctc

SEQ ID NO: 304781 - DNA, 17 bp, Homo sapiens
tgggggcctgctgtggg

SEQ ID NO: 304782 - DNA, 15 bp, Homo sapiens
tgggggctggtgcca

SEQ ID NO: 304783 - DNA, 17 bp, Homo sapiens
tggggggcacagccaga

SEQ ID NO: 304784 - DNA, 18 bp, Homo sapiens
tggggggcacagccagaa

SEQ ID NO: 304785 - DNA, 13 bp, Homo sapiens
tggggggcagggc

SEQ ID NO: 304786 - DNA, 17 bp, Homo sapiens
tggggggccaacaccag

SEQ ID NO: 304787 - DNA, 15 bp, Homo sapiens
tggggggctgtcctg

SEQ ID NO: 304788 - DNA, 14 bp, Homo sapiens
tgggggtcccagga

SEQ ID NO: 304789 - DNA, 20 bp, Homo sapiens
tgggggtctgctctgtgcct

SEQ ID NO: 304790 - DNA, 18 bp, Homo sapiens
tgggggtctgggaggcag

SEQ ID NO: 304791 - DNA, 20 bp, Homo sapiens
tgggggtctgggaggcaggt

SEQ ID NO: 304792 - DNA, 16 bp, Homo sapiens
tgggggtgcaggcagc

SEQ ID NO: 304793 - DNA, 23 bp, Homo sapiens
tgggggtgccaaccacctctggc

SEQ ID NO: 304794 - DNA, 13 bp, Homo sapiens
tgggggtgcctgg

SEQ ID NO: 304795 - DNA, 14 bp, Homo sapiens
tgggggtgcctggt

SEQ ID NO: 304796 - DNA, 22 bp, Homo sapiens
tgggggttctttcttcctctgc

SEQ ID NO: 304797 - DNA, 23 bp, Homo sapiens
tgggggtttccctgtgtggacca

SEQ ID NO: 304798 - DNA, 20 bp, Homo sapiens
tggggtactactctccagct

SEQ ID NO: 304799 - DNA, 13 bp, Homo sapiens
tggggtagagagg

SEQ ID NO: 304800 - DNA, 14 bp, Homo sapiens
tggggtagagagga

SEQ ID NO: 304801 - DNA, 21 bp, Homo sapiens
tggggtcccccctgagtgggc

SEQ ID NO: 304802 - DNA, 22 bp, Homo sapiens
tggggtcctgtggggcccccac

SEQ ID NO: 304803 - DNA, 22 bp, Homo sapiens
tggggtccttttttatacagga

SEQ ID NO: 304804 - DNA, 15 bp, Homo sapiens
tggggtctctgagca

SEQ ID NO: 304805 - DNA, 16 bp, Homo sapiens
tggggtctctgagcag

SEQ ID NO: 304806 - DNA, 17 bp, Homo sapiens
tggggtgaggaccactc

SEQ ID NO: 304807 - DNA, 16 bp, Homo sapiens
tggggtgggcctctgg

SEQ ID NO: 304808 - DNA, 20 bp, Homo sapiens
tggggtgggcctctggtttg

SEQ ID NO: 304809 - DNA, 16 bp, Homo sapiens
tggggtggggcttgga

SEQ ID NO: 304810 - DNA, 17 bp, Homo sapiens
tggggtggggcttggaa

SEQ ID NO: 304811 - DNA, 19 bp, Homo sapiens
tggggtggggcttggaagg

SEQ ID NO: 304812 - DNA, 18 bp, Homo sapiens
tggggtgtggggtggggt

SEQ ID NO: 304813 - DNA, 20 bp, Homo sapiens
tggggttcgtggaaagggtg

SEQ ID NO: 304814 - DNA, 17 bp, Homo sapiens
tggggttgggctctgcg

SEQ ID NO: 304815 - DNA, 20 bp, Homo sapiens
tggggtttccacacaggccc

SEQ ID NO: 304816 - DNA, 21 bp, Homo sapiens
tggggtttgcttttgttttgt

SEQ ID NO: 304817 - DNA, 15 bp, Homo sapiens
tgggtacagagaggt

SEQ ID NO: 304818 - DNA, 16 bp, Homo sapiens
tgggtaccaggccacc

SEQ ID NO: 304819 - DNA, 13 bp, Homo sapiens
tgggtacccaggc

SEQ ID NO: 304820 - DNA, 17 bp, Homo sapiens
tgggtatcaaacagctc

SEQ ID NO: 304821 - DNA, 12 bp, Homo sapiens
tgggtatcccac

SEQ ID NO: 304822 - DNA, 19 bp, Homo sapiens
tgggtatcccacctccagc

SEQ ID NO: 304823 - DNA, 19 bp, Homo sapiens
tgggtatcctgcccagtgt

SEQ ID NO: 304824 - DNA, 23 bp, Homo sapiens
tgggtcaaagtggtacaggaagg

SEQ ID NO: 304825 - DNA, 18 bp, Homo sapiens
tgggtcaccttcctgggc

SEQ ID NO: 304826 - DNA, 22 bp, Homo sapiens
tgggtcatcccagcacctgcca

SEQ ID NO: 304827 - DNA, 23 bp, Homo sapiens
tgggtccaggaaggcagctgctc

SEQ ID NO: 304828 - DNA, 12 bp, Homo sapiens
tgggtcccagct

SEQ ID NO: 304829 - DNA, 21 bp, Homo sapiens
tgggtcccgggttagcctggt

SEQ ID NO: 304830 - DNA, 19 bp, Homo sapiens
tgggtcctgcaatctccag

SEQ ID NO: 304831 - DNA, 22 bp, Homo sapiens
tgggtcctgcaatctccagggc

SEQ ID NO: 304832 - DNA, 18 bp, Homo sapiens
tgggtctcactcctgagt

SEQ ID NO: 304833 - DNA, 14 bp, Homo sapiens
tgggtctgtgtctc

SEQ ID NO: 304834 - DNA, 22 bp, Homo sapiens
tgggtcttcagggggccaggtg

SEQ ID NO: 304835 - DNA, 17 bp, Homo sapiens
tgggtgacagagcgaga

SEQ ID NO: 304836 - DNA, 15 bp, Homo sapiens
tgggtgaccaggtcc

SEQ ID NO: 304837 - DNA, 17 bp, Homo sapiens
tgggtgagaaattttag

SEQ ID NO: 304838 - DNA, 13 bp, Homo sapiens
tgggtgagaacaa

SEQ ID NO: 304839 - DNA, 17 bp, Homo sapiens
tgggtgagcgggtgggg

SEQ ID NO: 304840 - DNA, 18 bp, Homo sapiens
tgggtgcccacagcccgc

SEQ ID NO: 304841 - DNA, 16 bp, Homo sapiens
tgggtgctctggctgg

SEQ ID NO: 304842 - DNA, 19 bp, Homo sapiens
tgggtggaaccaggaacct

SEQ ID NO: 304843 - DNA, 17 bp, Homo sapiens
tgggtgggacacagaga

SEQ ID NO: 304844 - DNA, 16 bp, Homo sapiens
tgggtgggcaggaaaa

SEQ ID NO: 304845 - DNA, 13 bp, Homo sapiens
tgggtggggacag

SEQ ID NO: 304846 - DNA, 14 bp, Homo sapiens
tgggtggggaggga

SEQ ID NO: 304847 - DNA, 21 bp, Homo sapiens
tgggtggggcagggcctggcc

SEQ ID NO: 304848 - DNA, 20 bp, Homo sapiens
tgggtgtattaggactggct

SEQ ID NO: 304849 - DNA, 19 bp, Homo sapiens
tgggtgtgtgagtgggagg

SEQ ID NO: 304850 - DNA, 15 bp, Homo sapiens
tgggtgtttcagttt

SEQ ID NO: 304851 - DNA, 21 bp, Homo sapiens
tgggttcagaaatgctgcctg

SEQ ID NO: 304852 - DNA, 22 bp, Homo sapiens
tgggttcagaaatgctgcctgc

SEQ ID NO: 304853 - DNA, 11 bp, Homo sapiens
tgggttcatta

SEQ ID NO: 304854 - DNA, 20 bp, Homo sapiens
tgggttcattattggaatta

SEQ ID NO: 304855 - DNA, 13 bp, Homo sapiens
tgggttccagaca

SEQ ID NO: 304856 - DNA, 23 bp, Homo sapiens
tgggttgggcacggcttatacca

SEQ ID NO: 304857 - DNA, 16 bp, Homo sapiens
tgggttggtgcttcta

SEQ ID NO: 304858 - DNA, 16 bp, Homo sapiens
tgggtttacaacaaac

SEQ ID NO: 304859 - DNA, 18 bp, Homo sapiens
tgggtttacaacaaacac

SEQ ID NO: 304860 - DNA, 20 bp, Homo sapiens
tgggtttacaacaaacactg

SEQ ID NO: 304861 - DNA, 23 bp, Homo sapiens
tgggtttagcaggctgcagcagg

SEQ ID NO: 304862 - DNA, 20 bp, Homo sapiens
tgggtttgggcagtggagag

SEQ ID NO: 304863 - DNA, 14 bp, Homo sapiens
tgggttttatcagt

SEQ ID NO: 304864 - DNA, 18 bp, Homo sapiens
tgggttttccgcccacag

SEQ ID NO: 304865 - DNA, 14 bp, Homo sapiens
tggtaacaagagga

SEQ ID NO: 304866 - DNA, 16 bp, Homo sapiens
tggtaactgccagcct

SEQ ID NO: 304867 - DNA, 17 bp, Homo sapiens
tggtaactgccagcctt

SEQ ID NO: 304868 - DNA, 16 bp, Homo sapiens
tggtaacttgctgtga

SEQ ID NO: 304869 - DNA, 10 bp, Homo sapiens
tggtaattat

SEQ ID NO: 304870 - DNA, 23 bp, Homo sapiens
tggtaatttatagtttatacagt

SEQ ID NO: 304871 - DNA, 21 bp, Homo sapiens
tggtaatttgtatctgaagga

SEQ ID NO: 304872 - DNA, 14 bp, Homo sapiens
tggtgggctccaga

SEQ ID NO: 304873 - DNA, 15 bp, Homo sapiens
tggtgggctccagag

SEQ ID NO: 304874 - DNA, 22 bp, Homo sapiens
tggtgggtttcggggtgaagca

SEQ ID NO: 304875 - DNA, 16 bp, Homo sapiens
tggtggtttcagaaag

SEQ ID NO: 304876 - DNA, 18 bp, Homo sapiens
tggtggtttcagaaaggg

SEQ ID NO: 304877 - DNA, 21 bp, Homo sapiens
tggtgtactgggttaatggct

SEQ ID NO: 304878 - DNA, 15 bp, Homo sapiens
tggtgtagctgtcct

SEQ ID NO: 304879 - DNA, 17 bp, Homo sapiens
tggtgtagctgtcctct

SEQ ID NO: 304880 - DNA, 15 bp, Homo sapiens
tggtgtatatcatga

SEQ ID NO: 304881 - DNA, 21 bp, Homo sapiens
tggtgtatatcatgaagcctt

SEQ ID NO: 304882 - DNA, 23 bp, Homo sapiens
tggtgtatatcatgaagccttgc

SEQ ID NO: 304883 - DNA, 18 bp, Homo sapiens
tggtgtcacatggggcct

SEQ ID NO: 304884 - DNA, 17 bp, Homo sapiens
tggtgtcatagaatagc

SEQ ID NO: 304885 - DNA, 20 bp, Homo sapiens
tggtgtcatagaatagcatg

SEQ ID NO: 304886 - DNA, 13 bp, Homo sapiens
tggtgtccccttc

SEQ ID NO: 304887 - DNA, 22 bp, Homo sapiens
tggtgtccccttcccctgctga

SEQ ID NO: 304888 - DNA, 18 bp, Homo sapiens
tggtgtccttcttcctca

SEQ ID NO: 304889 - DNA, 13 bp, Homo sapiens
tggtgtctgatgt

SEQ ID NO: 304890 - DNA, 13 bp, Homo sapiens
tggtgtgaggccc

SEQ ID NO: 304891 - DNA, 14 bp, Homo sapiens
tggtgtgaggcccc

SEQ ID NO: 304892 - DNA, 15 bp, Homo sapiens
tggtgtgttcgtgga

SEQ ID NO: 304893 - DNA, 14 bp, Homo sapiens
tggtgttacacata

SEQ ID NO: 304894 - DNA, 14 bp, Homo sapiens
tggtgttcctggcc

SEQ ID NO: 304895 - DNA, 19 bp, Homo sapiens
tggtgttgttatggcaagt

SEQ ID NO: 304896 - DNA, 20 bp, Homo sapiens
tggtgttttttttaagggca

SEQ ID NO: 304897 - DNA, 17 bp, Homo sapiens
tggttaataaaactgca

SEQ ID NO: 304898 - DNA, 13 bp, Homo sapiens
tggttaatcactt

SEQ ID NO: 304899 - DNA, 23 bp, Homo sapiens
tggttaatcacttaacctgcttt

SEQ ID NO: 304900 - DNA, 17 bp, Homo sapiens
tggttacagtgcagaca

SEQ ID NO: 304901 - DNA, 16 bp, Homo sapiens
tggttaccgagtatct

SEQ ID NO: 304902 - DNA, 22 bp, Homo sapiens
tggttaccgagtatctgtaacc

SEQ ID NO: 304903 - DNA, 15 bp, Homo sapiens
tggttacctattgct

SEQ ID NO: 304904 - DNA, 19 bp, Homo sapiens
tggttacctattgctgtaa

SEQ ID NO: 304905 - DNA, 15 bp, Homo sapiens
tggttagctcagccc

SEQ ID NO: 304906 - DNA, 20 bp, Homo sapiens
tggttagctcagccccagcc

SEQ ID NO: 304907 - DNA, 22 bp, Homo sapiens
tggttagtagacactaattctg

SEQ ID NO: 304908 - DNA, 14 bp, Homo sapiens
tggttatgtcccat

SEQ ID NO: 304909 - DNA, 21 bp, Homo sapiens
tggttcagagactggcagcca

SEQ ID NO: 304910 - DNA, 14 bp, Homo sapiens
tggttcagtgggaa

SEQ ID NO: 304911 - DNA, 15 bp, Homo sapiens
tggttcagtgggaat

SEQ ID NO: 304912 - DNA, 18 bp, Homo sapiens
tggttcatcagtgttaaa

SEQ ID NO: 304913 - DNA, 22 bp, Homo sapiens
tggttccacaatcatctattga

SEQ ID NO: 304914 - DNA, 15 bp, Homo sapiens
tggttccatgcctga

SEQ ID NO: 304915 - DNA, 17 bp, Homo sapiens
tggttccatgcctgagg

SEQ ID NO: 304916 - DNA, 16 bp, Homo sapiens
tggttcccaataaaag

SEQ ID NO: 304917 - DNA, 19 bp, Homo sapiens
tggttcccaataaaagtga

SEQ ID NO: 304918 - DNA, 24 bp, Homo sapiens
tggttccctctttcctgtgccagg

SEQ ID NO: 304919 - DNA, 16 bp, Homo sapiens
tggttcctcatggctg

SEQ ID NO: 304920 - DNA, 13 bp, Homo sapiens
tggttcctgcccc

SEQ ID NO: 304921 - DNA, 14 bp, Homo sapiens
tggttctacaatct

SEQ ID NO: 304922 - DNA, 12 bp, Homo sapiens
tggttctggggc

SEQ ID NO: 304923 - DNA, 15 bp, Homo sapiens
tggttcttcatttat

SEQ ID NO: 304924 - DNA, 23 bp, Homo sapiens
tggttcttctgacacttgtggta

SEQ ID NO: 304925 - DNA, 13 bp, Homo sapiens
tggttcttgcctt

SEQ ID NO: 304926 - DNA, 19 bp, Homo sapiens
tggttcttgtgttggctgt

SEQ ID NO: 304927 - DNA, 22 bp, Homo sapiens
tggttcttttaccccacgaaga

SEQ ID NO: 304928 - DNA, 18 bp, Homo sapiens
tggttgaaaagattccat

SEQ ID NO: 304929 - DNA, 14 bp, Homo sapiens
tggttgcagcctga

SEQ ID NO: 304930 - DNA, 17 bp, Homo sapiens
tggttgccttaaagaaa

SEQ ID NO: 304931 - DNA, 18 bp, Homo sapiens
tggttgccttaaagaaag

SEQ ID NO: 304932 - DNA, 18 bp, Homo sapiens
tggttggacctattgcca

SEQ ID NO: 304933 - DNA, 21 bp, Homo sapiens
tggttgttgccaggttgcagc

SEQ ID NO: 304934 - DNA, 12 bp, Homo sapiens
tggttgtttctc

SEQ ID NO: 304935 - DNA, 14 bp, Homo sapiens
tggttgtttctctg

SEQ ID NO: 304936 - DNA, 16 bp, Homo sapiens
tggttgtttctctgag

SEQ ID NO: 304937 - DNA, 11 bp, Homo sapiens
tggtttactgc

SEQ ID NO: 304938 - DNA, 11 bp, Homo sapiens
tggtttataga

SEQ ID NO: 304939 - DNA, 21 bp, Homo sapiens
tggtttatagagggccaagac

SEQ ID NO: 304940 - DNA, 19 bp, Homo sapiens
tggtttcattgccttccta

SEQ ID NO: 304941 - DNA, 18 bp, Homo sapiens
tggtttccacatgctctg

SEQ ID NO: 304942 - DNA, 15 bp, Homo sapiens
tggtttctatacatg

SEQ ID NO: 304943 - DNA, 17 bp, Homo sapiens
tggtttgccatgtcgct

SEQ ID NO: 304944 - DNA, 19 bp, Homo sapiens
tggtttggggcgaggcaga

SEQ ID NO: 304945 - DNA, 21 bp, Homo sapiens
tggtttgtgagccttgctgcc

SEQ ID NO: 304946 - DNA, 13 bp, Homo sapiens
tggtttgttattc

SEQ ID NO: 304947 - DNA, 18 bp, Homo sapiens
tggttttaacaatttcct

SEQ ID NO: 304948 - DNA, 16 bp, Homo sapiens
tggttttcctaaatgc

SEQ ID NO: 304949 - DNA, 15 bp, Homo sapiens
tggttttggtttcca

SEQ ID NO: 304950 - DNA, 12 bp, Homo sapiens
tggtttttactc

SEQ ID NO: 304951 - DNA, 21 bp, Homo sapiens
tggtttttctgttccctgctg

SEQ ID NO: 304952 - DNA, 19 bp, Homo sapiens
tggtttttggctctttcag

SEQ ID NO: 304953 - DNA, 14 bp, Homo sapiens
tggtttttgttgag

SEQ ID NO: 304954 - DNA, 23 bp, Homo sapiens
tggttttttttttttttttggct

SEQ ID NO: 304955 - DNA, 13 bp, Homo sapiens
tgtaaaaaagaaa

SEQ ID NO: 304956 - DNA, 17 bp, Homo sapiens
tgtaaaaaagaaaaaca

SEQ ID NO: 304957 - DNA, 11 bp, Homo sapiens
tgtaaaacaaa

SEQ ID NO: 304958 - DNA, 13 bp, Homo sapiens
tgtaaaacagaat

SEQ ID NO: 304959 - DNA, 18 bp, Homo sapiens
tgtaaaacctgtcaatga

SEQ ID NO: 304960 - DNA, 22 bp, Homo sapiens
tgtaaaacgagaatccacccat

SEQ ID NO: 304961 - DNA, 13 bp, Homo sapiens
tgtaaaactttat

SEQ ID NO: 304962 - DNA, 16 bp, Homo sapiens
tgtaaaactttatttt

SEQ ID NO: 304963 - DNA, 23 bp, Homo sapiens
tgtaaaactttattttatataat

SEQ ID NO: 304964 - DNA, 18 bp, Homo sapiens
tgtaaaagcaacatcagc

SEQ ID NO: 304965 - DNA, 22 bp, Homo sapiens
tgtaaaagcaacatcagcttga

SEQ ID NO: 304966 - DNA, 18 bp, Homo sapiens
tgtaaaataagaatgatt

SEQ ID NO: 304967 - DNA, 14 bp, Homo sapiens
tgtaaaatagcttg

SEQ ID NO: 304968 - DNA, 20 bp, Homo sapiens
tgtaaaatagcttgtatagt

SEQ ID NO: 304969 - DNA, 21 bp, Homo sapiens
tgtaaaatagcttgtatagtg

SEQ ID NO: 304970 - DNA, 15 bp, Homo sapiens
tgtaaaatcttcagc

SEQ ID NO: 304971 - DNA, 12 bp, Homo sapiens
tgtaaaatcttg

SEQ ID NO: 304972 - DNA, 14 bp, Homo sapiens
tgtaaaatgaaatt

SEQ ID NO: 304973 - DNA, 22 bp, Homo sapiens
tgtaaaatggaaaacttagttt

SEQ ID NO: 304974 - DNA, 21 bp, Homo sapiens
tgtaaacaaactgtgtaactg

SEQ ID NO: 304975 - DNA, 17 bp, Homo sapiens
tgtaaacactcagctgt

SEQ ID NO: 304976 - DNA, 18 bp, Homo sapiens
tgtaaacactcagctgtt

SEQ ID NO: 304977 - DNA, 14 bp, Homo sapiens
tgtaaacatgtgtt

SEQ ID NO: 304978 - DNA, 20 bp, Homo sapiens
tgtaaacattcatatttgca

SEQ ID NO: 304979 - DNA, 17 bp, Homo sapiens
tgtaaacattcatcaag

SEQ ID NO: 304980 - DNA, 22 bp, Homo sapiens
tgtaaaccatcgcgtgcaatga

SEQ ID NO: 304981 - DNA, 16 bp, Homo sapiens
tgtaaactcaaaactt

SEQ ID NO: 304982 - DNA, 22 bp, Homo sapiens
tgtaaactcaaaacttaacata

SEQ ID NO: 304983 - DNA, 19 bp, Homo sapiens
tgtaaactttttcaatggt

SEQ ID NO: 304984 - DNA, 15 bp, Homo sapiens
tgtaaaggtaggtgc

SEQ ID NO: 304985 - DNA, 20 bp, Homo sapiens
tgtaaagttgaggggagagg

SEQ ID NO: 304986 - DNA, 23 bp, Homo sapiens
tgtaaagttgaggggagaggaaa

SEQ ID NO: 304987 - DNA, 17 bp, Homo sapiens
tgtaaataaaaatagct

SEQ ID NO: 304988 - DNA, 12 bp, Homo sapiens
tgtaaatattct

SEQ ID NO: 304989 - DNA, 13 bp, Homo sapiens
tgtaaatattctt

SEQ ID NO: 304990 - DNA, 14 bp, Homo sapiens
tgtaaatattcttg

SEQ ID NO: 304991 - DNA, 15 bp, Homo sapiens
tgtaaatattcttgt

SEQ ID NO: 304992 - DNA, 18 bp, Homo sapiens
tgtaaatattcttgtcca

SEQ ID NO: 304993 - DNA, 15 bp, Homo sapiens
tgtaaatccaacaca

SEQ ID NO: 304994 - DNA, 16 bp, Homo sapiens
tgtaaatccaacacaa

SEQ ID NO: 304995 - DNA, 17 bp, Homo sapiens
tgtaaatccaacacaag

SEQ ID NO: 304996 - DNA, 20 bp, Homo sapiens
tgtaaatcctagacttgaaa

SEQ ID NO: 304997 - DNA, 22 bp, Homo sapiens
tgtaaatgaagggtcatttctc

SEQ ID NO: 304998 - DNA, 20 bp, Homo sapiens
tgtaaatgatatgtctttaa

SEQ ID NO: 304999 - DNA, 13 bp, Homo sapiens
tgtaaatgctcaa

SEQ ID NO: 305000 - DNA, 17 bp, Homo sapiens
tgtaaatggagcttgta

SEQ ID NO: 305001 - DNA, 15 bp, Homo sapiens
tgtaaattaatactt

SEQ ID NO: 305002 - DNA, 20 bp, Homo sapiens
tgtaaattatgtaatgcaaa

SEQ ID NO: 305003 - DNA, 16 bp, Homo sapiens
tgtattaccagccccc

SEQ ID NO: 305004 - DNA, 21 bp, Homo sapiens
tgtattaggtgtcatttccat

SEQ ID NO: 305005 - DNA, 14 bp, Homo sapiens
tgtattcaagcaaa

SEQ ID NO: 305006 - DNA, 17 bp, Homo sapiens
tgtattcactaaaataa

SEQ ID NO: 305007 - DNA, 22 bp, Homo sapiens
tgtattctagctaatgtaataa

SEQ ID NO: 305008 - DNA, 15 bp, Homo sapiens
tgtattctctgtcca

SEQ ID NO: 305009 - DNA, 20 bp, Homo sapiens
tgtattctgcaacagcctgt

SEQ ID NO: 305010 - DNA, 22 bp, Homo sapiens
tgtattgctccattttcttgtc

SEQ ID NO: 305011 - DNA, 14 bp, Homo sapiens
tgtattggcctgga

SEQ ID NO: 305012 - DNA, 15 bp, Homo sapiens
tgtattgtaaacatg

SEQ ID NO: 305013 - DNA, 21 bp, Homo sapiens
tgtatttataaatatatttaa

SEQ ID NO: 305014 - DNA, 16 bp, Homo sapiens
tgtatttatgtgtgag

SEQ ID NO: 305015 - DNA, 18 bp, Homo sapiens
tgtatttattttcctccc

SEQ ID NO: 305016 - DNA, 13 bp, Homo sapiens
tgtatttcattgc

SEQ ID NO: 305017 - DNA, 15 bp, Homo sapiens
tgtatttccaacaaa

SEQ ID NO: 305018 - DNA, 17 bp, Homo sapiens
tgtatttctgtagaatg

SEQ ID NO: 305019 - DNA, 14 bp, Homo sapiens
tgtatttcttttat

SEQ ID NO: 305020 - DNA, 18 bp, Homo sapiens
tgtatttcttttatatat

SEQ ID NO: 305021 - DNA, 19 bp, Homo sapiens
tgtatttcttttatatata

SEQ ID NO: 305022 - DNA, 22 bp, Homo sapiens
tgtatttcttttatatataaaa

SEQ ID NO: 305023 - DNA, 23 bp, Homo sapiens
tgtatttcttttatatataaaat

SEQ ID NO: 305024 - DNA, 15 bp, Homo sapiens
tgtattttaactcat

SEQ ID NO: 305025 - DNA, 18 bp, Homo sapiens
tgtattttactttgtgca

SEQ ID NO: 305026 - DNA, 20 bp, Homo sapiens
tgtattttcaataaagaaaa

SEQ ID NO: 305027 - DNA, 20 bp, Homo sapiens
tgtattttcgggattctttg

SEQ ID NO: 305028 - DNA, 15 bp, Homo sapiens
tgtattttctgtcac

SEQ ID NO: 305029 - DNA, 20 bp, Homo sapiens
tgtattttcttcccatttgt

SEQ ID NO: 305030 - DNA, 21 bp, Homo sapiens
tgtattttcttcccatttgta

SEQ ID NO: 305031 - DNA, 20 bp, Homo sapiens
tgtattttcttttatatctg

SEQ ID NO: 305032 - DNA, 23 bp, Homo sapiens
tgtattttcttttatatctgtaa

SEQ ID NO: 305033 - DNA, 19 bp, Homo sapiens
tgtattttgtccaagttca

SEQ ID NO: 305034 - DNA, 17 bp, Homo sapiens
tgtatttttaaattctg

SEQ ID NO: 305035 - DNA, 16 bp, Homo sapiens
tgtatttttgaataaa

SEQ ID NO: 305036 - DNA, 18 bp, Homo sapiens
tgtcaaacgtgcccccca

SEQ ID NO: 305037 - DNA, 16 bp, Homo sapiens
tgtcaaactgtagaaa

SEQ ID NO: 305038 - DNA, 18 bp, Homo sapiens
tgtcaaactgtagaaatg

SEQ ID NO: 305039 - DNA, 15 bp, Homo sapiens
tgtcaaagtgaaaga

SEQ ID NO: 305040 - DNA, 18 bp, Homo sapiens
tgtcaaagtgaaagacat

SEQ ID NO: 305041 - DNA, 23 bp, Homo sapiens
tgtcaaagtgaaagacatttcaa

SEQ ID NO: 305042 - DNA, 15 bp, Homo sapiens
tgtcaaataaaatga

SEQ ID NO: 305043 - DNA, 16 bp, Homo sapiens
tgtcaaatatctcaga

SEQ ID NO: 305044 - DNA, 13 bp, Homo sapiens
tgtcaaatggatg

SEQ ID NO: 305045 - DNA, 14 bp, Homo sapiens
tgtcaactccagga

SEQ ID NO: 305046 - DNA, 15 bp, Homo sapiens
tgtcaacttctggct

SEQ ID NO: 305047 - DNA, 18 bp, Homo sapiens
tgtcaacttctggctcct

SEQ ID NO: 305048 - DNA, 19 bp, Homo sapiens
tgtcaagttaacaaggaat

SEQ ID NO: 305049 - DNA, 15 bp, Homo sapiens
tgtcaagttgtgctt

SEQ ID NO: 305050 - DNA, 23 bp, Homo sapiens
tgtcaagttttgggggtgggctg

SEQ ID NO: 305051 - DNA, 23 bp, Homo sapiens
tgtcaataaacagcttcatgcct

SEQ ID NO: 305052 - DNA, 19 bp, Homo sapiens
tgtcaatatatagagactt

SEQ ID NO: 305053 - DNA, 18 bp, Homo sapiens
tgtcaatgctctaacaaa

SEQ ID NO: 305054 - DNA, 17 bp, Homo sapiens
tgtcaatggaagaaacc

SEQ ID NO: 305055 - DNA, 15 bp, Homo sapiens
tgtcaatgtttgctt

SEQ ID NO: 305056 - DNA, 17 bp, Homo sapiens
tgtcaattacaggaagt

SEQ ID NO: 305057 - DNA, 15 bp, Homo sapiens
tgtcacaaattgatc

SEQ ID NO: 305058 - DNA, 18 bp, Homo sapiens
tgtcacaacctctctgat

SEQ ID NO: 305059 - DNA, 19 bp, Homo sapiens
tgtcacaatcctaacacat

SEQ ID NO: 305060 - DNA, 14 bp, Homo sapiens
tgtcacagaaatca

SEQ ID NO: 305061 - DNA, 19 bp, Homo sapiens
tgtcacagaaatcagagga

SEQ ID NO: 305062 - DNA, 15 bp, Homo sapiens
tgtcacagaggcagt

SEQ ID NO: 305063 - DNA, 20 bp, Homo sapiens
tgtcacagaggcagtggcag

SEQ ID NO: 305064 - DNA, 14 bp, Homo sapiens
tgtcacagctcttg

SEQ ID NO: 305065 - DNA, 20 bp, Homo sapiens
tgtcacagggtgttggaaga

SEQ ID NO: 305066 - DNA, 14 bp, Homo sapiens
tgtcaccaagaagg

SEQ ID NO: 305067 - DNA, 17 bp, Homo sapiens
tgtcaccagcaacatct

SEQ ID NO: 305068 - DNA, 17 bp, Homo sapiens
tgtcacccagcaaggca

SEQ ID NO: 305069 - DNA, 17 bp, Homo sapiens
tgtcaccctgcagagct

SEQ ID NO: 305070 - DNA, 17 bp, Homo sapiens
tgtcaccgccatgcaac

SEQ ID NO: 305071 - DNA, 13 bp, Homo sapiens
tgtcacgctctgg

SEQ ID NO: 305072 - DNA, 20 bp, Homo sapiens
tgtcacgctctggtgcagtc

SEQ ID NO: 305073 - DNA, 14 bp, Homo sapiens
tgtcactaaagcag

SEQ ID NO: 305074 - DNA, 23 bp, Homo sapiens
tgtcactaccctcctgtaaaata

SEQ ID NO: 305075 - DNA, 22 bp, Homo sapiens
tgtcactactcacagtctcttt

SEQ ID NO: 305076 - DNA, 19 bp, Homo sapiens
tgtcactcagctgagaagg

SEQ ID NO: 305077 - DNA, 15 bp, Homo sapiens
tgtcactgagctgtg

SEQ ID NO: 305078 - DNA, 17 bp, Homo sapiens
tgtcactgtttctctgc

SEQ ID NO: 305079 - DNA, 18 bp, Homo sapiens
tgtcacttgactcttgaa

SEQ ID NO: 305080 - DNA, 13 bp, Homo sapiens
tgtcacttttttc

SEQ ID NO: 305081 - DNA, 15 bp, Homo sapiens
tgtcagaagcctcca

SEQ ID NO: 305082 - DNA, 18 bp, Homo sapiens
tgtcagaatttctttgtc

SEQ ID NO: 305083 - DNA, 14 bp, Homo sapiens
tgtcagagaatatg

SEQ ID NO: 305084 - DNA, 12 bp, Homo sapiens
tgtcagagctgg

SEQ ID NO: 305085 - DNA, 15 bp, Homo sapiens
tgtcagagtgttgtt

SEQ ID NO: 305086 - DNA, 18 bp, Homo sapiens
tgtcagcagctctgagac

SEQ ID NO: 305087 - DNA, 18 bp, Homo sapiens
tgtcagccaacattgcct

SEQ ID NO: 305088 - DNA, 11 bp, Homo sapiens
tgtcagccttg

SEQ ID NO: 305089 - DNA, 19 bp, Homo sapiens
tgtcagcgtttctccacct

SEQ ID NO: 305090 - DNA, 19 bp, Homo sapiens
tgtcagctactaatgatgt

SEQ ID NO: 305091 - DNA, 20 bp, Homo sapiens
tgtcagctgagcttgagctc

SEQ ID NO: 305092 - DNA, 21 bp, Homo sapiens
tgtcagctgagcttgagctcc

SEQ ID NO: 305093 - DNA, 19 bp, Homo sapiens
tgtcaggctctgaatctct

SEQ ID NO: 305094 - DNA, 10 bp, Homo sapiens
tgtcagtagt

SEQ ID NO: 305095 - DNA, 13 bp, Homo sapiens
tgtcagtagtgcc

SEQ ID NO: 305096 - DNA, 17 bp, Homo sapiens
tgtcagtctgagtcatc

SEQ ID NO: 305097 - DNA, 16 bp, Homo sapiens
tgtcagtgcagcccgt

SEQ ID NO: 305098 - DNA, 15 bp, Homo sapiens
tgtcagtgtcctcag

SEQ ID NO: 305099 - DNA, 16 bp, Homo sapiens
tgtcagtgtcctcagg

SEQ ID NO: 305100 - DNA, 12 bp, Homo sapiens
tgtcagtgtgac

SEQ ID NO: 305101 - DNA, 21 bp, Homo sapiens
tgtcagttgtgaagaggggcc

SEQ ID NO: 305102 - DNA, 14 bp, Homo sapiens
tgtcagtttgtgaa

SEQ ID NO: 305103 - DNA, 13 bp, Homo sapiens
tgtcatactctgt

SEQ ID NO: 305104 - DNA, 20 bp, Homo sapiens
tgtcatactctgtgtaatct

SEQ ID NO: 305105 - DNA, 22 bp, Homo sapiens
tgtcatatatggggggccaaca

SEQ ID NO: 305106 - DNA, 14 bp, Homo sapiens
tgtcatcactccct

SEQ ID NO: 305107 - DNA, 17 bp, Homo sapiens
tgtcatcactccctgga

SEQ ID NO: 305108 - DNA, 20 bp, Homo sapiens
tgtcatcactccctggatgt

SEQ ID NO: 305109 - DNA, 13 bp, Homo sapiens
tgtcatctgtcag

SEQ ID NO: 305110 - DNA, 15 bp, Homo sapiens
tgtcatctgtcagct

SEQ ID NO: 305111 - DNA, 16 bp, Homo sapiens
tgtcatctgtcagctt

SEQ ID NO: 305112 - DNA, 17 bp, Homo sapiens
tgtcatgaaagcacctg

SEQ ID NO: 305113 - DNA, 12 bp, Homo sapiens
tgtcatgaacat

SEQ ID NO: 305114 - DNA, 16 bp, Homo sapiens
tgtcatgaacatgttc

SEQ ID NO: 305115 - DNA, 19 bp, Homo sapiens
tgtcatgatttcaatgatt

SEQ ID NO: 305116 - DNA, 19 bp, Homo sapiens
tgtcatggaaaatgtcctg

SEQ ID NO: 305117 - DNA, 11 bp, Homo sapiens
tgtcatgtgta

SEQ ID NO: 305118 - DNA, 14 bp, Homo sapiens
tgtcatgtgtataa

SEQ ID NO: 305119 - DNA, 17 bp, Homo sapiens
tgtcatgtgtatgagaa

SEQ ID NO: 305120 - DNA, 18 bp, Homo sapiens
tgtcatgtgtatgagaag

SEQ ID NO: 305121 - DNA, 16 bp, Homo sapiens
tgtcattcaagcctgt

SEQ ID NO: 305122 - DNA, 19 bp, Homo sapiens
tgtcattcaagcctgtgaa

SEQ ID NO: 305123 - DNA, 20 bp, Homo sapiens
tgtcattgtccatgcctaca

SEQ ID NO: 305124 - DNA, 13 bp, Homo sapiens
tgtcatttctcat

SEQ ID NO: 305125 - DNA, 16 bp, Homo sapiens
tgtcatttctcatgga

SEQ ID NO: 305126 - DNA, 23 bp, Homo sapiens
tgtcatttttaatattactgtct

SEQ ID NO: 305127 - DNA, 16 bp, Homo sapiens
tgtccaaatttaatgt

SEQ ID NO: 305128 - DNA, 17 bp, Homo sapiens
tgtccaaatttaatgta

SEQ ID NO: 305129 - DNA, 11 bp, Homo sapiens
tgtccaagcat

SEQ ID NO: 305130 - DNA, 16 bp, Homo sapiens
tgtccaagcatcagca

SEQ ID NO: 305131 - DNA, 17 bp, Homo sapiens
tgtccaagtgtttcttg

SEQ ID NO: 305132 - DNA, 22 bp, Homo sapiens
tgtccaagttcttcacctctat

SEQ ID NO: 305133 - DNA, 23 bp, Homo sapiens
tgtccaagttcttcacctctatc

SEQ ID NO: 305134 - DNA, 14 bp, Homo sapiens
tgtgaatcgcaagg

SEQ ID NO: 305135 - DNA, 17 bp, Homo sapiens
tgtgaatgctgtacctt

SEQ ID NO: 305136 - DNA, 14 bp, Homo sapiens
tgtgaattcagatt

SEQ ID NO: 305137 - DNA, 14 bp, Homo sapiens
tgtgaattctgtga

SEQ ID NO: 305138 - DNA, 19 bp, Homo sapiens
tgtgacaaaggatgaagaa

SEQ ID NO: 305139 - DNA, 14 bp, Homo sapiens
tgtgacaacctttg

SEQ ID NO: 305140 - DNA, 15 bp, Homo sapiens
tgtgacaacctttgt

SEQ ID NO: 305141 - DNA, 22 bp, Homo sapiens
tgtgacaacctttgtgtaataa

SEQ ID NO: 305142 - DNA, 22 bp, Homo sapiens
tgtgacaggaagcccaaggcag

SEQ ID NO: 305143 - DNA, 14 bp, Homo sapiens
tgtgacattccaca

SEQ ID NO: 305144 - DNA, 15 bp, Homo sapiens
tgtgacattccacag

SEQ ID NO: 305145 - DNA, 18 bp, Homo sapiens
tgtgacccaccagtgcct

SEQ ID NO: 305146 - DNA, 16 bp, Homo sapiens
tgtgacccagggtgca

SEQ ID NO: 305147 - DNA, 22 bp, Homo sapiens
tgtgaccggggtcctgaggctg

SEQ ID NO: 305148 - DNA, 14 bp, Homo sapiens
tgtgactagtgctg

SEQ ID NO: 305149 - DNA, 20 bp, Homo sapiens
tgtgactagtgctgaagctt

SEQ ID NO: 305150 - DNA, 22 bp, Homo sapiens
tgtgactatgaaacgaatataa

SEQ ID NO: 305151 - DNA, 17 bp, Homo sapiens
tgtgactcagtgtattt

SEQ ID NO: 305152 - DNA, 22 bp, Homo sapiens
tgtgactcagtgtattttaaat

SEQ ID NO: 305153 - DNA, 15 bp, Homo sapiens
tgtgactcattccca

SEQ ID NO: 305154 - DNA, 23 bp, Homo sapiens
tgtgactcgcttagctgaaacct

SEQ ID NO: 305155 - DNA, 20 bp, Homo sapiens
tgtgactgaaggggcacacc

SEQ ID NO: 305156 - DNA, 15 bp, Homo sapiens
tgtgactgagggcct

SEQ ID NO: 305157 - DNA, 17 bp, Homo sapiens
tgtgacttaagaagcct

SEQ ID NO: 305158 - DNA, 19 bp, Homo sapiens
tgtgacttcagctctgttt

SEQ ID NO: 305159 - DNA, 18 bp, Homo sapiens
tgtgactttgaacacatc

SEQ ID NO: 305160 - DNA, 19 bp, Homo sapiens
tgtgactttttagccagtg

SEQ ID NO: 305161 - DNA, 15 bp, Homo sapiens
tgtgagacagcaagt

SEQ ID NO: 305162 - DNA, 16 bp, Homo sapiens
tgtgagacagcaagtt

SEQ ID NO: 305163 - DNA, 18 bp, Homo sapiens
tgtgagacccccacacct

SEQ ID NO: 305164 - DNA, 19 bp, Homo sapiens
tgtgagacccccacacctc

SEQ ID NO: 305165 - DNA, 21 bp, Homo sapiens
tgtgagacggctggaaattct

SEQ ID NO: 305166 - DNA, 17 bp, Homo sapiens
tgtgagagcgaggctga

SEQ ID NO: 305167 - DNA, 13 bp, Homo sapiens
tgtgagataaata

SEQ ID NO: 305168 - DNA, 15 bp, Homo sapiens
tgtgagataaatatc

SEQ ID NO: 305169 - DNA, 19 bp, Homo sapiens
tgtgagccaaagagaaaag

SEQ ID NO: 305170 - DNA, 14 bp, Homo sapiens
tgtgagcttctaca

SEQ ID NO: 305171 - DNA, 21 bp, Homo sapiens
tgtgaggaatgctctgtgcca

SEQ ID NO: 305172 - DNA, 17 bp, Homo sapiens
tgtgaggagctgctggc

SEQ ID NO: 305173 - DNA, 17 bp, Homo sapiens
tgtgaggcggcagctgg

SEQ ID NO: 305174 - DNA, 18 bp, Homo sapiens
tgtgaggtaactgggatc

SEQ ID NO: 305175 - DNA, 19 bp, Homo sapiens
tgtgagtagagcatgactt

SEQ ID NO: 305176 - DNA, 15 bp, Homo sapiens
tgtgagtattctatg

SEQ ID NO: 305177 - DNA, 17 bp, Homo sapiens
tgtgagtattctatgta

SEQ ID NO: 305178 - DNA, 22 bp, Homo sapiens
tgtgagtattctatgtaaaaat

SEQ ID NO: 305179 - DNA, 17 bp, Homo sapiens
tgtgagtcccagagccc

SEQ ID NO: 305180 - DNA, 20 bp, Homo sapiens
tgtgagtctgtcctttccca

SEQ ID NO: 305181 - DNA, 19 bp, Homo sapiens
tgtgagtggcagccatgcc

SEQ ID NO: 305182 - DNA, 16 bp, Homo sapiens
tgtgagtgtaagtgtg

SEQ ID NO: 305183 - DNA, 14 bp, Homo sapiens
tgtgagtgtgtgca

SEQ ID NO: 305184 - DNA, 19 bp, Homo sapiens
tgtgagtgtgtgtttgtgc

SEQ ID NO: 305185 - DNA, 16 bp, Homo sapiens
tgtgatagagcctttg

SEQ ID NO: 305186 - DNA, 14 bp, Homo sapiens
tgtgatatgtgtaa

SEQ ID NO: 305187 - DNA, 15 bp, Homo sapiens
tgtgatattgaccat

SEQ ID NO: 305188 - DNA, 12 bp, Homo sapiens
tgtgatcaactg

SEQ ID NO: 305189 - DNA, 17 bp, Homo sapiens
tgtgatcactgagacag

SEQ ID NO: 305190 - DNA, 13 bp, Homo sapiens
tgtgatctattac

SEQ ID NO: 305191 - DNA, 20 bp, Homo sapiens
tgtgatctattactctgaca

SEQ ID NO: 305192 - DNA, 21 bp, Homo sapiens
tgtgatctattactctgacat

SEQ ID NO: 305193 - DNA, 15 bp, Homo sapiens
tgtgatgaactttct

SEQ ID NO: 305194 - DNA, 21 bp, Homo sapiens
tgtgatgatagcactggtttg

SEQ ID NO: 305195 - DNA, 18 bp, Homo sapiens
tgtgatgatgctgtgaca

SEQ ID NO: 305196 - DNA, 16 bp, Homo sapiens
tgtgatgcatgagctc

SEQ ID NO: 305197 - DNA, 20 bp, Homo sapiens
tgtgatgtatgttggttttt

SEQ ID NO: 305198 - DNA, 20 bp, Homo sapiens
tgtgatgttgggaagctatt

SEQ ID NO: 305199 - DNA, 17 bp, Homo sapiens
tgtgattaattattgaa

SEQ ID NO: 305200 - DNA, 16 bp, Homo sapiens
tgtgattctaatgtct

SEQ ID NO: 305201 - DNA, 21 bp, Homo sapiens
tgtgattggcagcttcaaaac

SEQ ID NO: 305202 - DNA, 18 bp, Homo sapiens
tgtgatttttataataca

SEQ ID NO: 305203 - DNA, 14 bp, Homo sapiens
tgtgcaaaagcagg

SEQ ID NO: 305204 - DNA, 15 bp, Homo sapiens
tgtgcaaattaacag

SEQ ID NO: 305205 - DNA, 16 bp, Homo sapiens
tgtgcaactcttgtat

SEQ ID NO: 305206 - DNA, 23 bp, Homo sapiens
tgtgcaagacacccagtggaacc

SEQ ID NO: 305207 - DNA, 21 bp, Homo sapiens
tgtgcaagagtatactttgta

SEQ ID NO: 305208 - DNA, 16 bp, Homo sapiens
tgtgcaagtgtatgca

SEQ ID NO: 305209 - DNA, 15 bp, Homo sapiens
tgtgcaagtgtctgt

SEQ ID NO: 305210 - DNA, 21 bp, Homo sapiens
tgtgcaagtgtgtgcatgtgt

SEQ ID NO: 305211 - DNA, 13 bp, Homo sapiens
tgtgcaatatgag

SEQ ID NO: 305212 - DNA, 21 bp, Homo sapiens
tgtgcaccttaccaactttct

SEQ ID NO: 305213 - DNA, 17 bp, Homo sapiens
tgtgcactgtcactttg

SEQ ID NO: 305214 - DNA, 23 bp, Homo sapiens
tgtgcagcaccctttcaccccca

SEQ ID NO: 305215 - DNA, 18 bp, Homo sapiens
tgtgcagcagcccagctt

SEQ ID NO: 305216 - DNA, 23 bp, Homo sapiens
tgtgcagcagcccagcttcctgg

SEQ ID NO: 305217 - DNA, 12 bp, Homo sapiens
tgtgcaggctcc

SEQ ID NO: 305218 - DNA, 18 bp, Homo sapiens
tgtgcaggtgctgccttg

SEQ ID NO: 305219 - DNA, 17 bp, Homo sapiens
tgtgcagtcatcaacaa

SEQ ID NO: 305220 - DNA, 13 bp, Homo sapiens
tgtgcatgagaat

SEQ ID NO: 305221 - DNA, 20 bp, Homo sapiens
tgtgcatgagaatgtcattt

SEQ ID NO: 305222 - DNA, 21 bp, Homo sapiens
tgtgcatgagaatgtcatttg

SEQ ID NO: 305223 - DNA, 23 bp, Homo sapiens
tgtgcatgagaatgtcatttgct

SEQ ID NO: 305224 - DNA, 21 bp, Homo sapiens
tgtgcatgcaaaccaggagca

SEQ ID NO: 305225 - DNA, 17 bp, Homo sapiens
tgtgcatgcaaccagat

SEQ ID NO: 305226 - DNA, 19 bp, Homo sapiens
tgtgcatttgtgtctgcct

SEQ ID NO: 305227 - DNA, 22 bp, Homo sapiens
tgtgcatttttgtgaaatgaaa

SEQ ID NO: 305228 - DNA, 17 bp, Homo sapiens
tgtgccaacctgatgcc

SEQ ID NO: 305229 - DNA, 17 bp, Homo sapiens
tgtgccaatatgtattg

SEQ ID NO: 305230 - DNA, 18 bp, Homo sapiens
tgtgccaatatgtattgt

SEQ ID NO: 305231 - DNA, 14 bp, Homo sapiens
tgtgccacaggctg

SEQ ID NO: 305232 - DNA, 19 bp, Homo sapiens
tgtgccaccctctgcaggg

SEQ ID NO: 305233 - DNA, 21 bp, Homo sapiens
tgtgccaggactctctttctt

SEQ ID NO: 305234 - DNA, 18 bp, Homo sapiens
tgtgccaggactgtgact

SEQ ID NO: 305235 - DNA, 20 bp, Homo sapiens
tgtgccaggactgtgactca

SEQ ID NO: 305236 - DNA, 23 bp, Homo sapiens
tgtgccaggaggcggcagctctt

SEQ ID NO: 305237 - DNA, 22 bp, Homo sapiens
tgtgccaggagtgggtgggaca

SEQ ID NO: 305238 - DNA, 13 bp, Homo sapiens
tgtgccaggctga

SEQ ID NO: 305239 - DNA, 15 bp, Homo sapiens
tgtgccatcatgcct

SEQ ID NO: 305240 - DNA, 19 bp, Homo sapiens
tgtgccatcatgcctgact

SEQ ID NO: 305241 - DNA, 20 bp, Homo sapiens
tgtgcccacatcccaggctt

SEQ ID NO: 305242 - DNA, 21 bp, Homo sapiens
tgtgcccacatcccaggcttc

SEQ ID NO: 305243 - DNA, 18 bp, Homo sapiens
tgtgcccacccagggccc

SEQ ID NO: 305244 - DNA, 20 bp, Homo sapiens
tgtgcccacccgtcttcaat

SEQ ID NO: 305245 - DNA, 22 bp, Homo sapiens
tgtgcccacccgtcttcaatct

SEQ ID NO: 305246 - DNA, 20 bp, Homo sapiens
tgtgcccacccgtgttctcc

SEQ ID NO: 305247 - DNA, 22 bp, Homo sapiens
tgtgcccacccgtgttctcctc

SEQ ID NO: 305248 - DNA, 12 bp, Homo sapiens
tgtgcccagctc

SEQ ID NO: 305249 - DNA, 12 bp, Homo sapiens
tgtgcccagtta

SEQ ID NO: 305250 - DNA, 21 bp, Homo sapiens
tgtgcccatcatctctgcctt

SEQ ID NO: 305251 - DNA, 14 bp, Homo sapiens
tgtgccccatgcct

SEQ ID NO: 305252 - DNA, 12 bp, Homo sapiens
tgtgccctgcct

SEQ ID NO: 305253 - DNA, 15 bp, Homo sapiens
tgtgccctgcctcca

SEQ ID NO: 305254 - DNA, 14 bp, Homo sapiens
tgtgccctggctcc

SEQ ID NO: 305255 - DNA, 15 bp, Homo sapiens
tgtgccctggctccc

SEQ ID NO: 305256 - DNA, 15 bp, Homo sapiens
tgtgcccttgctggg

SEQ ID NO: 305257 - DNA, 15 bp, Homo sapiens
tgtgccgaatgtgca

SEQ ID NO: 305258 - DNA, 12 bp, Homo sapiens
tgtgcctaataa

SEQ ID NO: 305259 - DNA, 21 bp, Homo sapiens
tgtgcctcccccgccacctgt

SEQ ID NO: 305260 - DNA, 15 bp, Homo sapiens
tgtgcctcccttccc

SEQ ID NO: 305261 - DNA, 22 bp, Homo sapiens
tgtgcctcccttcccagtgggc

SEQ ID NO: 305262 - DNA, 14 bp, Homo sapiens
tgtgcctctgcctg

SEQ ID NO: 305263 - DNA, 19 bp, Homo sapiens
tgtgcctgcaccaggagac

SEQ ID NO: 305264 - DNA, 20 bp, Homo sapiens
tgtgtacaaagtagagaagt

SEQ ID NO: 305265 - DNA, 22 bp, Homo sapiens
tgtgtacaaagtagagaagtat

SEQ ID NO: 305266 - DNA, 15 bp, Homo sapiens
tgtgtacagtatgtg

SEQ ID NO: 305267 - DNA, 21 bp, Homo sapiens
tgtgtacttcttcatccatag

SEQ ID NO: 305268 - DNA, 17 bp, Homo sapiens
tgtgtagagcctgcatc

SEQ ID NO: 305269 - DNA, 22 bp, Homo sapiens
tgtgtagagtggcgattgaatg

SEQ ID NO: 305270 - DNA, 21 bp, Homo sapiens
tgtgtataaaaataaaaaaga

SEQ ID NO: 305271 - DNA, 19 bp, Homo sapiens
tgtgtatatatttaaaaaa

SEQ ID NO: 305272 - DNA, 20 bp, Homo sapiens
tgtgtatcaccctcagctgg

SEQ ID NO: 305273 - DNA, 14 bp, Homo sapiens
tgtgtatgtctggt

SEQ ID NO: 305274 - DNA, 13 bp, Homo sapiens
tgtgtatgtgtaa

SEQ ID NO: 305275 - DNA, 14 bp, Homo sapiens
tgtgtatgtgttta

SEQ ID NO: 305276 - DNA, 14 bp, Homo sapiens
tgtgtatttctgta

SEQ ID NO: 305277 - DNA, 15 bp, Homo sapiens
tgtgtcaagctgctt

SEQ ID NO: 305278 - DNA, 15 bp, Homo sapiens
tgtgtcatctgtcag

SEQ ID NO: 305279 - DNA, 18 bp, Homo sapiens
tgtgtcatctgtcagctt

SEQ ID NO: 305280 - DNA, 14 bp, Homo sapiens
tgtgtcatgatttc

SEQ ID NO: 305281 - DNA, 19 bp, Homo sapiens
tgtgtccaagtgtgtgtgc

SEQ ID NO: 305282 - DNA, 14 bp, Homo sapiens
tgtgtccatgtgtg

SEQ ID NO: 305283 - DNA, 17 bp, Homo sapiens
tgtgtccatgtgtgtgc

SEQ ID NO: 305284 - DNA, 20 bp, Homo sapiens
tgtgtcccatgatccctgtg

SEQ ID NO: 305285 - DNA, 16 bp, Homo sapiens
tgtgtcccctgacctg

SEQ ID NO: 305286 - DNA, 20 bp, Homo sapiens
tgtgtcccctgacctgtcca

SEQ ID NO: 305287 - DNA, 21 bp, Homo sapiens
tgtgtcccctgacctgtccag

SEQ ID NO: 305288 - DNA, 13 bp, Homo sapiens
tgtgtccctgtgg

SEQ ID NO: 305289 - DNA, 21 bp, Homo sapiens
tgtgtccgctctctcatgtgg

SEQ ID NO: 305290 - DNA, 22 bp, Homo sapiens
tgtgtctaaatttgaatgttaa

SEQ ID NO: 305291 - DNA, 16 bp, Homo sapiens
tgtgtctagcaaagcc

SEQ ID NO: 305292 - DNA, 23 bp, Homo sapiens
tgtgtctccagctgattttaact

SEQ ID NO: 305293 - DNA, 19 bp, Homo sapiens
tgtgtctcctgcatgcaga

SEQ ID NO: 305294 - DNA, 12 bp, Homo sapiens
tgtgtctgcctg

SEQ ID NO: 305295 - DNA, 23 bp, Homo sapiens
tgtgtctgcctgcctcatgctct

SEQ ID NO: 305296 - DNA, 12 bp, Homo sapiens
tgtgtctgctgt

SEQ ID NO: 305297 - DNA, 18 bp, Homo sapiens
tgtgtgaattctgcaact

SEQ ID NO: 305298 - DNA, 17 bp, Homo sapiens
tgtgtgatgaactttct

SEQ ID NO: 305299 - DNA, 16 bp, Homo sapiens
tgtgtgcaatgttccg

SEQ ID NO: 305300 - DNA, 13 bp, Homo sapiens
tgtgtgcctgtgg

SEQ ID NO: 305301 - DNA, 15 bp, Homo sapiens
tgtgtgcctgtggca

SEQ ID NO: 305302 - DNA, 19 bp, Homo sapiens
tgtgtggactgtgatgcca

SEQ ID NO: 305303 - DNA, 23 bp, Homo sapiens
tgtgtggagggattgaacacagg

SEQ ID NO: 305304 - DNA, 15 bp, Homo sapiens
tgtgtggatgtgtaa

SEQ ID NO: 305305 - DNA, 17 bp, Homo sapiens
tgtgtggcaaacattta

SEQ ID NO: 305306 - DNA, 18 bp, Homo sapiens
tgtgtggccgcctggcag

SEQ ID NO: 305307 - DNA, 12 bp, Homo sapiens
tgtgtgggaggg

SEQ ID NO: 305308 - DNA, 15 bp, Homo sapiens
tgtgtgggatactta

SEQ ID NO: 305309 - DNA, 16 bp, Homo sapiens
tgtgtggggcccaagc

SEQ ID NO: 305310 - DNA, 18 bp, Homo sapiens
tgtgtggggcccaagcat

SEQ ID NO: 305311 - DNA, 19 bp, Homo sapiens
tgtgtgggggtctgggagg

SEQ ID NO: 305312 - DNA, 22 bp, Homo sapiens
tgtgtgggggtctgggaggcag

SEQ ID NO: 305313 - DNA, 18 bp, Homo sapiens
tgtgtgggtttactctgt

SEQ ID NO: 305314 - DNA, 14 bp, Homo sapiens
tgtgtgtatgctga

SEQ ID NO: 305315 - DNA, 22 bp, Homo sapiens
tgtgtgtccagcacctttgtaa

SEQ ID NO: 305316 - DNA, 20 bp, Homo sapiens
tgtgtgtctttttttactta

SEQ ID NO: 305317 - DNA, 13 bp, Homo sapiens
tgtgtgtgtctct

SEQ ID NO: 305318 - DNA, 12 bp, Homo sapiens
tgtgtgtgtgca

SEQ ID NO: 305319 - DNA, 15 bp, Homo sapiens
tgtgtgtgtgtatga

SEQ ID NO: 305320 - DNA, 14 bp, Homo sapiens
tgtgtgttgactgc

SEQ ID NO: 305321 - DNA, 17 bp, Homo sapiens
tgtgtgttgccacagga

SEQ ID NO: 305322 - DNA, 19 bp, Homo sapiens
tgtgtgtttaaataaagta

SEQ ID NO: 305323 - DNA, 19 bp, Homo sapiens
tgtgtgtttattgtcaaag

SEQ ID NO: 305324 - DNA, 17 bp, Homo sapiens
tgtgtgtttgtgtgtct

SEQ ID NO: 305325 - DNA, 17 bp, Homo sapiens
tgtgttaaacatgctaa

SEQ ID NO: 305326 - DNA, 19 bp, Homo sapiens
tgtgttaagtatgtgtaaa

SEQ ID NO: 305327 - DNA, 19 bp, Homo sapiens
tgtgttcctctttgcatga

SEQ ID NO: 305328 - DNA, 11 bp, Homo sapiens
tgtgttcctgg

SEQ ID NO: 305329 - DNA, 15 bp, Homo sapiens
tgtgttcctggcaat

SEQ ID NO: 305330 - DNA, 16 bp, Homo sapiens
tgtgttcctggcaata

SEQ ID NO: 305331 - DNA, 17 bp, Homo sapiens
tgtgttcgttcttgttc

SEQ ID NO: 305332 - DNA, 18 bp, Homo sapiens
tgtgttctgtttgttaaa

SEQ ID NO: 305333 - DNA, 21 bp, Homo sapiens
tgtgttctgtttgttaaaact

SEQ ID NO: 305334 - DNA, 15 bp, Homo sapiens
tgtgttcttttgata

SEQ ID NO: 305335 - DNA, 17 bp, Homo sapiens
tgtgttcttttgataca

SEQ ID NO: 305336 - DNA, 20 bp, Homo sapiens
tgtgttcttttgatacattt

SEQ ID NO: 305337 - DNA, 19 bp, Homo sapiens
tgtgttgcaaattattcta

SEQ ID NO: 305338 - DNA, 21 bp, Homo sapiens
tgtgttgcaaattattctagt

SEQ ID NO: 305339 - DNA, 24 bp, Homo sapiens
tgtgttgccattttgtctggctgt

SEQ ID NO: 305340 - DNA, 15 bp, Homo sapiens
tgtgttgctatcctg

SEQ ID NO: 305341 - DNA, 14 bp, Homo sapiens
tgtgttgctttctg

SEQ ID NO: 305342 - DNA, 15 bp, Homo sapiens
tgtgttgctttctga

SEQ ID NO: 305343 - DNA, 20 bp, Homo sapiens
tgtgttgctttggatacaca

SEQ ID NO: 305344 - DNA, 13 bp, Homo sapiens
tgtgttgtgaatg

SEQ ID NO: 305345 - DNA, 14 bp, Homo sapiens
tgtgttgtttgaaa

SEQ ID NO: 305346 - DNA, 12 bp, Homo sapiens
tgtgtttaaata

SEQ ID NO: 305347 - DNA, 14 bp, Homo sapiens
tgtgtttaaataaa

SEQ ID NO: 305348 - DNA, 16 bp, Homo sapiens
tgtgtttataattgtt

SEQ ID NO: 305349 - DNA, 17 bp, Homo sapiens
tgtgtttataattgtta

SEQ ID NO: 305350 - DNA, 23 bp, Homo sapiens
tgtgtttatatgtcttgcaaagc

SEQ ID NO: 305351 - DNA, 13 bp, Homo sapiens
tgtgtttattgtc

SEQ ID NO: 305352 - DNA, 16 bp, Homo sapiens
tgtgtttcaggacagc

SEQ ID NO: 305353 - DNA, 24 bp, Homo sapiens
tgtgtttcaggacagctgcttctg

SEQ ID NO: 305354 - DNA, 10 bp, Homo sapiens
tgtgtttcta

SEQ ID NO: 305355 - DNA, 14 bp, Homo sapiens
tgtgtttgttccta

SEQ ID NO: 305356 - DNA, 20 bp, Homo sapiens
tgtgttttattcacttgtgt

SEQ ID NO: 305357 - DNA, 19 bp, Homo sapiens
tgtgttttgctaaaggaaa

SEQ ID NO: 305358 - DNA, 18 bp, Homo sapiens
tgtgttttgtctgagcct

SEQ ID NO: 305359 - DNA, 14 bp, Homo sapiens
tgtgtttttattgt

SEQ ID NO: 305360 - DNA, 16 bp, Homo sapiens
tgtgttttttttcctt

SEQ ID NO: 305361 - DNA, 18 bp, Homo sapiens
tgttaaaaaatttttgaa

SEQ ID NO: 305362 - DNA, 21 bp, Homo sapiens
tgttaaaacaaattaaaaaca

SEQ ID NO: 305363 - DNA, 19 bp, Homo sapiens
tgttaaaactggcatctga

SEQ ID NO: 305364 - DNA, 19 bp, Homo sapiens
tgttaaaatctctctctgt

SEQ ID NO: 305365 - DNA, 18 bp, Homo sapiens
tgttaaacgtcacagcag

SEQ ID NO: 305366 - DNA, 19 bp, Homo sapiens
tgttaaacgtcacagcagt

SEQ ID NO: 305367 - DNA, 20 bp, Homo sapiens
tgttaacactgtaatatctt

SEQ ID NO: 305368 - DNA, 21 bp, Homo sapiens
tgttaaccctccacctcctct

SEQ ID NO: 305369 - DNA, 22 bp, Homo sapiens
tgttaactagtgtttctgcaga

SEQ ID NO: 305370 - DNA, 16 bp, Homo sapiens
tgttaagtatgtgtaa

SEQ ID NO: 305371 - DNA, 13 bp, Homo sapiens
tgttaagtctgag

SEQ ID NO: 305372 - DNA, 15 bp, Homo sapiens
tgttaatactgtatt

SEQ ID NO: 305373 - DNA, 13 bp, Homo sapiens
tgttaatagtact

SEQ ID NO: 305374 - DNA, 16 bp, Homo sapiens
tgttaatatatataat

SEQ ID NO: 305375 - DNA, 21 bp, Homo sapiens
tgttaatattaatttatattt

SEQ ID NO: 305376 - DNA, 20 bp, Homo sapiens
tgttaatcctagctgtgtgc

SEQ ID NO: 305377 - DNA, 19 bp, Homo sapiens
tgttaatgaaaatgataaa

SEQ ID NO: 305378 - DNA, 14 bp, Homo sapiens
tgttaattgattaa

SEQ ID NO: 305379 - DNA, 20 bp, Homo sapiens
tgttaattgattaaactgta

SEQ ID NO: 305380 - DNA, 15 bp, Homo sapiens
tgttacacaatatgt

SEQ ID NO: 305381 - DNA, 21 bp, Homo sapiens
tgttacaggcaccgagaatgt

SEQ ID NO: 305382 - DNA, 16 bp, Homo sapiens
tgttacaggtgtacta

SEQ ID NO: 305383 - DNA, 15 bp, Homo sapiens
tgttacatgtagaaa

SEQ ID NO: 305384 - DNA, 20 bp, Homo sapiens
tgttacctaattagagcaga

SEQ ID NO: 305385 - DNA, 13 bp, Homo sapiens
tgttactctggtt

SEQ ID NO: 305386 - DNA, 20 bp, Homo sapiens
tgttactctggttctttgtt

SEQ ID NO: 305387 - DNA, 13 bp, Homo sapiens
tgttactgaattt

SEQ ID NO: 305388 - DNA, 15 bp, Homo sapiens
tgttactgaccagca

SEQ ID NO: 305389 - DNA, 18 bp, Homo sapiens
tgttacttaaacatcatt

SEQ ID NO: 305390 - DNA, 12 bp, Homo sapiens
tgttacttaaat

SEQ ID NO: 305391 - DNA, 13 bp, Homo sapiens
tgttacttaaata

SEQ ID NO: 305392 - DNA, 12 bp, Homo sapiens
tgttacttacct

SEQ ID NO: 305393 - DNA, 12 bp, Homo sapiens
tgttactttctt

SEQ ID NO: 305394 - DNA, 21 bp, Homo sapiens
tgttactttctttcagatgtt

SEQ ID NO: 305395 - DNA, 20 bp, Homo sapiens
tgttttgatgtttgtggcct

SEQ ID NO: 305396 - DNA, 14 bp, Homo sapiens
tgttttgcactttt

SEQ ID NO: 305397 - DNA, 21 bp, Homo sapiens
tgttttggatgaatgcagtat

SEQ ID NO: 305398 - DNA, 16 bp, Homo sapiens
tgttttgtctgagcct

SEQ ID NO: 305399 - DNA, 22 bp, Homo sapiens
tgttttgtgcggtgtgtctcca

SEQ ID NO: 305400 - DNA, 13 bp, Homo sapiens
tgttttgttttaa

SEQ ID NO: 305401 - DNA, 20 bp, Homo sapiens
tgttttgtttttttcctttt

SEQ ID NO: 305402 - DNA, 18 bp, Homo sapiens
tgtttttaagaaaaacat

SEQ ID NO: 305403 - DNA, 20 bp, Homo sapiens
tgtttttaagaaaaacatgt

SEQ ID NO: 305404 - DNA, 22 bp, Homo sapiens
tgtttttaagctgtttccatag

SEQ ID NO: 305405 - DNA, 22 bp, Homo sapiens
tgtttttatatattataagttg

SEQ ID NO: 305406 - DNA, 19 bp, Homo sapiens
tgtttttccatgtgttttg

SEQ ID NO: 305407 - DNA, 14 bp, Homo sapiens
tgtttttgaagaag

SEQ ID NO: 305408 - DNA, 14 bp, Homo sapiens
tgtttttgtgtaga

SEQ ID NO: 305409 - DNA, 20 bp, Homo sapiens
tgttttttaaggtgagttct

SEQ ID NO: 305410 - DNA, 17 bp, Homo sapiens
tgttttttaatatacta

SEQ ID NO: 305411 - DNA, 15 bp, Homo sapiens
tgtttttttctaata

SEQ ID NO: 305412 - DNA, 15 bp, Homo sapiens
tgttttttttccttt

SEQ ID NO: 305413 - DNA, 21 bp, Homo sapiens
tgtttttttttttttacatgt

SEQ ID NO: 305414 - DNA, 12 bp, Homo sapiens
ttaaaaaaaata

SEQ ID NO: 305415 - DNA, 13 bp, Homo sapiens
ttaaaaaaaataa

SEQ ID NO: 305416 - DNA, 14 bp, Homo sapiens
ttaaaaaaataaca

SEQ ID NO: 305417 - DNA, 21 bp, Homo sapiens
ttaaaaaaataatataaatga

SEQ ID NO: 305418 - DNA, 11 bp, Homo sapiens
ttaaaaaataa

SEQ ID NO: 305419 - DNA, 16 bp, Homo sapiens
ttaaaaaatttttgaa

SEQ ID NO: 305420 - DNA, 15 bp, Homo sapiens
ttaaaaactcctttt

SEQ ID NO: 305421 - DNA, 17 bp, Homo sapiens
ttaaaaagcagctgcat

SEQ ID NO: 305422 - DNA, 16 bp, Homo sapiens
ttaaaaaggcctttgg

SEQ ID NO: 305423 - DNA, 17 bp, Homo sapiens
ttaaaaaggcctttggg

SEQ ID NO: 305424 - DNA, 18 bp, Homo sapiens
ttaaaaagttgcacatta

SEQ ID NO: 305425 - DNA, 11 bp, Homo sapiens
ttaaaaagttt

SEQ ID NO: 305426 - DNA, 13 bp, Homo sapiens
ttaaaaatctttc

SEQ ID NO: 305427 - DNA, 22 bp, Homo sapiens
ttaaaaatctttcagaatacaa

SEQ ID NO: 305428 - DNA, 20 bp, Homo sapiens
ttaaaaatttttttaaggaa

SEQ ID NO: 305429 - DNA, 12 bp, Homo sapiens
ttaaaacaaaca

SEQ ID NO: 305430 - DNA, 16 bp, Homo sapiens
ttaaaacaaattaaaa

SEQ ID NO: 305431 - DNA, 12 bp, Homo sapiens
ttaaaacaatgt

SEQ ID NO: 305432 - DNA, 12 bp, Homo sapiens
ttaaaaccacta

SEQ ID NO: 305433 - DNA, 20 bp, Homo sapiens
ttaaaactaggcatttgtaa

SEQ ID NO: 305434 - DNA, 22 bp, Homo sapiens
ttaaaactaggcatttgtaaat

SEQ ID NO: 305435 - DNA, 12 bp, Homo sapiens
ttaaaactgctt

SEQ ID NO: 305436 - DNA, 13 bp, Homo sapiens
ttaaaactgcttt

SEQ ID NO: 305437 - DNA, 22 bp, Homo sapiens
ttaaaactgcttttttttttcc

SEQ ID NO: 305438 - DNA, 20 bp, Homo sapiens
ttaaaagaaagggttctgta

SEQ ID NO: 305439 - DNA, 21 bp, Homo sapiens
ttaaaagaaagggttctgtaa

SEQ ID NO: 305440 - DNA, 23 bp, Homo sapiens
ttaaaagaaagggttctgtaaaa

SEQ ID NO: 305441 - DNA, 14 bp, Homo sapiens
ttaaaagaagactg

SEQ ID NO: 305442 - DNA, 18 bp, Homo sapiens
ttaaaagaagactggaag

SEQ ID NO: 305443 - DNA, 13 bp, Homo sapiens
ttaaaagacagtg

SEQ ID NO: 305444 - DNA, 15 bp, Homo sapiens
ttaaaagactttgat

SEQ ID NO: 305445 - DNA, 13 bp, Homo sapiens
ttaaaagaggaaa

SEQ ID NO: 305446 - DNA, 12 bp, Homo sapiens
ttaaaagcatat

SEQ ID NO: 305447 - DNA, 15 bp, Homo sapiens
ttaaaagtaaaagag

SEQ ID NO: 305448 - DNA, 12 bp, Homo sapiens
ttaaaagtattc

SEQ ID NO: 305449 - DNA, 15 bp, Homo sapiens
ttaaaagtattcata

SEQ ID NO: 305450 - DNA, 18 bp, Homo sapiens
ttaaaagtgtatttgtta

SEQ ID NO: 305451 - DNA, 16 bp, Homo sapiens
ttaaaagtttcaatgt

SEQ ID NO: 305452 - DNA, 19 bp, Homo sapiens
ttaaaagtttcaatgtgat

SEQ ID NO: 305453 - DNA, 13 bp, Homo sapiens
ttaaaagttttat

SEQ ID NO: 305454 - DNA, 13 bp, Homo sapiens
ttaaaataaaacg

SEQ ID NO: 305455 - DNA, 13 bp, Homo sapiens
ttaaaatataaat

SEQ ID NO: 305456 - DNA, 14 bp, Homo sapiens
ttaaaatatggcta

SEQ ID NO: 305457 - DNA, 16 bp, Homo sapiens
ttaaaatattcctgca

SEQ ID NO: 305458 - DNA, 15 bp, Homo sapiens
ttaaaatcattcaat

SEQ ID NO: 305459 - DNA, 12 bp, Homo sapiens
ttaaaatggact

SEQ ID NO: 305460 - DNA, 17 bp, Homo sapiens
ttaaaatgtaaactctt

SEQ ID NO: 305461 - DNA, 19 bp, Homo sapiens
ttaaaatgtaaactcttca

SEQ ID NO: 305462 - DNA, 21 bp, Homo sapiens
ttaaaatgtcggatttatctt

SEQ ID NO: 305463 - DNA, 17 bp, Homo sapiens
ttaaaattagtgagatt

SEQ ID NO: 305464 - DNA, 13 bp, Homo sapiens
ttaaaattattaa

SEQ ID NO: 305465 - DNA, 16 bp, Homo sapiens
ttaaaattcaccccca

SEQ ID NO: 305466 - DNA, 19 bp, Homo sapiens
ttaaacaaaaactttccat

SEQ ID NO: 305467 - DNA, 18 bp, Homo sapiens
ttaaacaatttattttat

SEQ ID NO: 305468 - DNA, 18 bp, Homo sapiens
ttaaacacctgacacatc

SEQ ID NO: 305469 - DNA, 14 bp, Homo sapiens
ttaaacactgtaat

SEQ ID NO: 305470 - DNA, 19 bp, Homo sapiens
ttaaacatgaatttaatgt

SEQ ID NO: 305471 - DNA, 13 bp, Homo sapiens
ttaaacattgaag

SEQ ID NO: 305472 - DNA, 11 bp, Homo sapiens
ttaaacatttt

SEQ ID NO: 305473 - DNA, 18 bp, Homo sapiens
ttaaactaaccttttatc

SEQ ID NO: 305474 - DNA, 23 bp, Homo sapiens
ttaaacttataaatcatattgat

SEQ ID NO: 305475 - DNA, 12 bp, Homo sapiens
ttaaacttcagc

SEQ ID NO: 305476 - DNA, 20 bp, Homo sapiens
ttaaagaaaaaccacagata

SEQ ID NO: 305477 - DNA, 17 bp, Homo sapiens
ttaaagaaaatgtgtct

SEQ ID NO: 305478 - DNA, 17 bp, Homo sapiens
ttaaagaaactgatttt

SEQ ID NO: 305479 - DNA, 18 bp, Homo sapiens
ttaaagaagtctcttaat

SEQ ID NO: 305480 - DNA, 17 bp, Homo sapiens
ttaaagaatcattattt

SEQ ID NO: 305481 - DNA, 12 bp, Homo sapiens
ttaaagacagag

SEQ ID NO: 305482 - DNA, 18 bp, Homo sapiens
ttaaagacttaagattaa

SEQ ID NO: 305483 - DNA, 19 bp, Homo sapiens
ttaaagacttaagattaaa

SEQ ID NO: 305484 - DNA, 20 bp, Homo sapiens
ttaaagagaggttatagagt

SEQ ID NO: 305485 - DNA, 21 bp, Homo sapiens
ttaaagaggcgtcttgtattt

SEQ ID NO: 305486 - DNA, 16 bp, Homo sapiens
ttaaagcaaaaaatga

SEQ ID NO: 305487 - DNA, 22 bp, Homo sapiens
ttaaagcaataagttcattaaa

SEQ ID NO: 305488 - DNA, 22 bp, Homo sapiens
ttaaagcagagggactttgtat

SEQ ID NO: 305489 - DNA, 14 bp, Homo sapiens
ttaaagctgcctgt

SEQ ID NO: 305490 - DNA, 12 bp, Homo sapiens
ttaaaggaaaaa

SEQ ID NO: 305491 - DNA, 18 bp, Homo sapiens
ttaaaggaattaaactaa

SEQ ID NO: 305492 - DNA, 20 bp, Homo sapiens
ttaaaggacaaacagtgaat

SEQ ID NO: 305493 - DNA, 18 bp, Homo sapiens
ttaaaggcaccatctaat

SEQ ID NO: 305494 - DNA, 22 bp, Homo sapiens
ttaaaggcagtccagagctttt

SEQ ID NO: 305495 - DNA, 12 bp, Homo sapiens
ttaaagggcaga

SEQ ID NO: 305496 - DNA, 22 bp, Homo sapiens
ttaaagtacctgtagtgagaaa

SEQ ID NO: 305497 - DNA, 13 bp, Homo sapiens
ttaaataaaagaa

SEQ ID NO: 305498 - DNA, 15 bp, Homo sapiens
ttaaataaaataacc

SEQ ID NO: 305499 - DNA, 22 bp, Homo sapiens
ttaaataataatagttaatgaa

SEQ ID NO: 305500 - DNA, 14 bp, Homo sapiens
ttaaataattttac

SEQ ID NO: 305501 - DNA, 19 bp, Homo sapiens
ttaaatagagtatatgcac

SEQ ID NO: 305502 - DNA, 18 bp, Homo sapiens
ttaaataggatattaaca

SEQ ID NO: 305503 - DNA, 14 bp, Homo sapiens
ttaaatataattct

SEQ ID NO: 305504 - DNA, 12 bp, Homo sapiens
ttaaatatacaa

SEQ ID NO: 305505 - DNA, 16 bp, Homo sapiens
ttaaatatacaacttt

SEQ ID NO: 305506 - DNA, 12 bp, Homo sapiens
ttaaatatcatt

SEQ ID NO: 305507 - DNA, 19 bp, Homo sapiens
ttaaatatcattctttgta

SEQ ID NO: 305508 - DNA, 13 bp, Homo sapiens
ttaaatatttaat

SEQ ID NO: 305509 - DNA, 13 bp, Homo sapiens
ttaaatatttttg

SEQ ID NO: 305510 - DNA, 12 bp, Homo sapiens
ttaaatcactga

SEQ ID NO: 305511 - DNA, 14 bp, Homo sapiens
ttaaatcagttttg

SEQ ID NO: 305512 - DNA, 22 bp, Homo sapiens
ttaaatcagttttgtgtacagt

SEQ ID NO: 305513 - DNA, 16 bp, Homo sapiens
ttaaatcctaccaaag

SEQ ID NO: 305514 - DNA, 15 bp, Homo sapiens
ttaaatctgtgatga

SEQ ID NO: 305515 - DNA, 16 bp, Homo sapiens
ttaaatctgtgatgat

SEQ ID NO: 305516 - DNA, 15 bp, Homo sapiens
ttaaatgaaatactt

SEQ ID NO: 305517 - DNA, 23 bp, Homo sapiens
ttaaatgaaattgtaaaacctgt

SEQ ID NO: 305518 - DNA, 14 bp, Homo sapiens
ttaaatgatgtaca

SEQ ID NO: 305519 - DNA, 12 bp, Homo sapiens
ttaaatgattcc

SEQ ID NO: 305520 - DNA, 17 bp, Homo sapiens
ttaaatgcaaattaaag

SEQ ID NO: 305521 - DNA, 20 bp, Homo sapiens
ttaaatgctttgttttccca

SEQ ID NO: 305522 - DNA, 12 bp, Homo sapiens
ttaaatggcatg

SEQ ID NO: 305523 - DNA, 16 bp, Homo sapiens
ttaaatgtttgttgaa

SEQ ID NO: 305524 - DNA, 14 bp, Homo sapiens
ttaaattaaacaat

SEQ ID NO: 305525 - DNA, 19 bp, Homo sapiens
ttaaattataaggactgca

SEQ ID NO: 305526 - DNA, 20 bp, Homo sapiens
ttaaattataaggactgcat

SEQ ID NO: 305527 - DNA, 18 bp, Homo sapiens
ttactcttgttgcccagg

SEQ ID NO: 305528 - DNA, 19 bp, Homo sapiens
ttactcttgttgcccaggc

SEQ ID NO: 305529 - DNA, 17 bp, Homo sapiens
ttactgagcttctctgt

SEQ ID NO: 305530 - DNA, 19 bp, Homo sapiens
ttactgagcttctctgtga

SEQ ID NO: 305531 - DNA, 17 bp, Homo sapiens
ttactgatcatgcattg

SEQ ID NO: 305532 - DNA, 18 bp, Homo sapiens
ttactgatcatgcattgt

SEQ ID NO: 305533 - DNA, 19 bp, Homo sapiens
ttactgatcatgcattgtt

SEQ ID NO: 305534 - DNA, 15 bp, Homo sapiens
ttactgatgtgtgca

SEQ ID NO: 305535 - DNA, 21 bp, Homo sapiens
ttactgccaaagggaaatatc

SEQ ID NO: 305536 - DNA, 12 bp, Homo sapiens
ttactgctgtca

SEQ ID NO: 305537 - DNA, 20 bp, Homo sapiens
ttactggagccatgtctaca

SEQ ID NO: 305538 - DNA, 16 bp, Homo sapiens
ttactggcttctcttg

SEQ ID NO: 305539 - DNA, 14 bp, Homo sapiens
ttactgtcaataaa

SEQ ID NO: 305540 - DNA, 15 bp, Homo sapiens
ttactgtcaataaac

SEQ ID NO: 305541 - DNA, 20 bp, Homo sapiens
ttactgtcaataaacagctt

SEQ ID NO: 305542 - DNA, 14 bp, Homo sapiens
ttactgtcagagaa

SEQ ID NO: 305543 - DNA, 15 bp, Homo sapiens
ttactgtctgtagtg

SEQ ID NO: 305544 - DNA, 15 bp, Homo sapiens
ttactgtggaggtgg

SEQ ID NO: 305545 - DNA, 15 bp, Homo sapiens
ttactgtgtaaataa

SEQ ID NO: 305546 - DNA, 18 bp, Homo sapiens
ttactgttagtcatttgc

SEQ ID NO: 305547 - DNA, 16 bp, Homo sapiens
ttactgttgcatttac

SEQ ID NO: 305548 - DNA, 18 bp, Homo sapiens
ttactgtttatttctgtt

SEQ ID NO: 305549 - DNA, 22 bp, Homo sapiens
ttacttaaatagcatctgctct

SEQ ID NO: 305550 - DNA, 14 bp, Homo sapiens
ttacttagagatgc

SEQ ID NO: 305551 - DNA, 16 bp, Homo sapiens
ttacttatcttatgcc

SEQ ID NO: 305552 - DNA, 24 bp, Homo sapiens
ttacttatttaaaaatgcatgata

SEQ ID NO: 305553 - DNA, 22 bp, Homo sapiens
ttacttccacagaatacaagcc

SEQ ID NO: 305554 - DNA, 15 bp, Homo sapiens
ttacttcctatcaag

SEQ ID NO: 305555 - DNA, 12 bp, Homo sapiens
ttacttccttcc

SEQ ID NO: 305556 - DNA, 16 bp, Homo sapiens
ttacttgtctgaggcc

SEQ ID NO: 305557 - DNA, 20 bp, Homo sapiens
ttacttgtttgtaagattta

SEQ ID NO: 305558 - DNA, 15 bp, Homo sapiens
ttactttaacatgcc

SEQ ID NO: 305559 - DNA, 21 bp, Homo sapiens
ttactttaatactcacctcct

SEQ ID NO: 305560 - DNA, 19 bp, Homo sapiens
ttactttgtacttgtgttt

SEQ ID NO: 305561 - DNA, 18 bp, Homo sapiens
ttactttgtgcaatatga

SEQ ID NO: 305562 - DNA, 21 bp, Homo sapiens
ttacttttatttgcaacattt

SEQ ID NO: 305563 - DNA, 14 bp, Homo sapiens
ttacttttgggagg

SEQ ID NO: 305564 - DNA, 15 bp, Homo sapiens
ttagaaaatatagtt

SEQ ID NO: 305565 - DNA, 14 bp, Homo sapiens
ttagaaaccttaat

SEQ ID NO: 305566 - DNA, 18 bp, Homo sapiens
ttagaaactgagtcctgt

SEQ ID NO: 305567 - DNA, 22 bp, Homo sapiens
ttagaaataaagcatctcattt

SEQ ID NO: 305568 - DNA, 14 bp, Homo sapiens
ttagaaatataatt

SEQ ID NO: 305569 - DNA, 18 bp, Homo sapiens
ttagaaatgaccaatatt

SEQ ID NO: 305570 - DNA, 12 bp, Homo sapiens
ttagaaattaca

SEQ ID NO: 305571 - DNA, 17 bp, Homo sapiens
ttagaaattacaagttt

SEQ ID NO: 305572 - DNA, 21 bp, Homo sapiens
ttagaaatttattcttatctt

SEQ ID NO: 305573 - DNA, 15 bp, Homo sapiens
ttagaacagaaaaca

SEQ ID NO: 305574 - DNA, 18 bp, Homo sapiens
ttagaacagatggctgtg

SEQ ID NO: 305575 - DNA, 16 bp, Homo sapiens
ttagaagaaaacatat

SEQ ID NO: 305576 - DNA, 22 bp, Homo sapiens
ttagaagctaatgtaggactgt

SEQ ID NO: 305577 - DNA, 18 bp, Homo sapiens
ttagaatcaagtctgtga

SEQ ID NO: 305578 - DNA, 20 bp, Homo sapiens
ttagaatcaagtctgtgaaa

SEQ ID NO: 305579 - DNA, 17 bp, Homo sapiens
ttagaatcccatggatg

SEQ ID NO: 305580 - DNA, 14 bp, Homo sapiens
ttagaattgatttc

SEQ ID NO: 305581 - DNA, 19 bp, Homo sapiens
ttagacctcatctccaaga

SEQ ID NO: 305582 - DNA, 16 bp, Homo sapiens
ttagagaaaataaatt

SEQ ID NO: 305583 - DNA, 13 bp, Homo sapiens
ttagagacaggga

SEQ ID NO: 305584 - DNA, 20 bp, Homo sapiens
ttagagaggtagcgagctgc

SEQ ID NO: 305585 - DNA, 21 bp, Homo sapiens
ttagagaggtagcgagctgct

SEQ ID NO: 305586 - DNA, 16 bp, Homo sapiens
ttagagggacagccaa

SEQ ID NO: 305587 - DNA, 21 bp, Homo sapiens
ttagaggtgagttttaaagaa

SEQ ID NO: 305588 - DNA, 14 bp, Homo sapiens
ttagatataacact

SEQ ID NO: 305589 - DNA, 17 bp, Homo sapiens
ttagatgctactaagaa

SEQ ID NO: 305590 - DNA, 16 bp, Homo sapiens
ttagatgtttaccttc

SEQ ID NO: 305591 - DNA, 14 bp, Homo sapiens
ttagattatattga

SEQ ID NO: 305592 - DNA, 22 bp, Homo sapiens
ttagattatattgagacaaaaa

SEQ ID NO: 305593 - DNA, 14 bp, Homo sapiens
ttagatttctttga

SEQ ID NO: 305594 - DNA, 13 bp, Homo sapiens
ttagattttaatc

SEQ ID NO: 305595 - DNA, 14 bp, Homo sapiens
ttagcaatatttat

SEQ ID NO: 305596 - DNA, 14 bp, Homo sapiens
ttagcagctcaggc

SEQ ID NO: 305597 - DNA, 18 bp, Homo sapiens
ttagcagctcaggcgcag

SEQ ID NO: 305598 - DNA, 22 bp, Homo sapiens
ttagcaggaaatagtgttcttt

SEQ ID NO: 305599 - DNA, 12 bp, Homo sapiens
ttagcagttctg

SEQ ID NO: 305600 - DNA, 24 bp, Homo sapiens
ttagcatgacaagccccaggcagg

SEQ ID NO: 305601 - DNA, 15 bp, Homo sapiens
ttagcatgcacaaag

SEQ ID NO: 305602 - DNA, 12 bp, Homo sapiens
ttagccagtgac

SEQ ID NO: 305603 - DNA, 14 bp, Homo sapiens
ttagccccataatt

SEQ ID NO: 305604 - DNA, 17 bp, Homo sapiens
ttagcccggatgcccac

SEQ ID NO: 305605 - DNA, 15 bp, Homo sapiens
ttagcctccctgaaa

SEQ ID NO: 305606 - DNA, 18 bp, Homo sapiens
ttagccttgctgtagaga

SEQ ID NO: 305607 - DNA, 23 bp, Homo sapiens
ttagccttgctgtagagacttcc

SEQ ID NO: 305608 - DNA, 14 bp, Homo sapiens
ttagcgttctggac

SEQ ID NO: 305609 - DNA, 16 bp, Homo sapiens
ttagcgttctggactc

SEQ ID NO: 305610 - DNA, 21 bp, Homo sapiens
ttagctacaatcctacctttt

SEQ ID NO: 305611 - DNA, 12 bp, Homo sapiens
ttagctccttga

SEQ ID NO: 305612 - DNA, 13 bp, Homo sapiens
ttagctgtaaata

SEQ ID NO: 305613 - DNA, 14 bp, Homo sapiens
ttagcttacaggaa

SEQ ID NO: 305614 - DNA, 20 bp, Homo sapiens
ttagcttgttcacactttgc

SEQ ID NO: 305615 - DNA, 13 bp, Homo sapiens
ttagctttctcag

SEQ ID NO: 305616 - DNA, 11 bp, Homo sapiens
ttaggaaataa

SEQ ID NO: 305617 - DNA, 12 bp, Homo sapiens
ttaggaaataaa

SEQ ID NO: 305618 - DNA, 17 bp, Homo sapiens
ttaggaaataaaacctt

SEQ ID NO: 305619 - DNA, 18 bp, Homo sapiens
ttaggaaataaaaccttt

SEQ ID NO: 305620 - DNA, 20 bp, Homo sapiens
ttaggaaataaaacctttca

SEQ ID NO: 305621 - DNA, 14 bp, Homo sapiens
ttaggaagtgactt

SEQ ID NO: 305622 - DNA, 19 bp, Homo sapiens
ttaggaagtgtaacagctg

SEQ ID NO: 305623 - DNA, 21 bp, Homo sapiens
ttaggaagtgtaacagctgag

SEQ ID NO: 305624 - DNA, 17 bp, Homo sapiens
ttaggaataacactgca

SEQ ID NO: 305625 - DNA, 17 bp, Homo sapiens
ttaggaatgctcaatgt

SEQ ID NO: 305626 - DNA, 15 bp, Homo sapiens
ttaggacttgccctc

SEQ ID NO: 305627 - DNA, 13 bp, Homo sapiens
ttaggagaagttg

SEQ ID NO: 305628 - DNA, 22 bp, Homo sapiens
ttaggatttaacagtcatttaa

SEQ ID NO: 305629 - DNA, 15 bp, Homo sapiens
ttaggcagattgaaa

SEQ ID NO: 305630 - DNA, 23 bp, Homo sapiens
ttaggcagcagcttttaatacag

SEQ ID NO: 305631 - DNA, 22 bp, Homo sapiens
ttaggcaggaagtcaggagcca

SEQ ID NO: 305632 - DNA, 22 bp, Homo sapiens
ttaggccaaaaaaatgtaagat

SEQ ID NO: 305633 - DNA, 16 bp, Homo sapiens
ttaggctgggcccaga

SEQ ID NO: 305634 - DNA, 20 bp, Homo sapiens
ttagggctaaccagttctct

SEQ ID NO: 305635 - DNA, 14 bp, Homo sapiens
ttaggggaaaatag

SEQ ID NO: 305636 - DNA, 14 bp, Homo sapiens
ttaggtcccgggag

SEQ ID NO: 305637 - DNA, 21 bp, Homo sapiens
ttaggtctgcattttctcagg

SEQ ID NO: 305638 - DNA, 15 bp, Homo sapiens
ttaggtgaggaagca

SEQ ID NO: 305639 - DNA, 19 bp, Homo sapiens
ttaggtgttgattttctgt

SEQ ID NO: 305640 - DNA, 12 bp, Homo sapiens
ttagtaatagat

SEQ ID NO: 305641 - DNA, 15 bp, Homo sapiens
ttagtacccacctga

SEQ ID NO: 305642 - DNA, 15 bp, Homo sapiens
ttagtactatatctg

SEQ ID NO: 305643 - DNA, 20 bp, Homo sapiens
ttagtactatatctgtttta

SEQ ID NO: 305644 - DNA, 19 bp, Homo sapiens
ttagtagacactaattctg

SEQ ID NO: 305645 - DNA, 19 bp, Homo sapiens
ttagtatatttatataatt

SEQ ID NO: 305646 - DNA, 18 bp, Homo sapiens
ttagtatctaacatgtat

SEQ ID NO: 305647 - DNA, 13 bp, Homo sapiens
ttagtcattatta

SEQ ID NO: 305648 - DNA, 23 bp, Homo sapiens
ttagtcctaaagggacaataact

SEQ ID NO: 305649 - DNA, 13 bp, Homo sapiens
ttagtcctcacct

SEQ ID NO: 305650 - DNA, 16 bp, Homo sapiens
ttagtcctccctgctc

SEQ ID NO: 305651 - DNA, 13 bp, Homo sapiens
ttagtcttctcat

SEQ ID NO: 305652 - DNA, 15 bp, Homo sapiens
ttagtgaacaggttc

SEQ ID NO: 305653 - DNA, 11 bp, Homo sapiens
ttagtgactgt

SEQ ID NO: 305654 - DNA, 13 bp, Homo sapiens
ttagtgagatttg

SEQ ID NO: 305655 - DNA, 19 bp, Homo sapiens
ttagtgcggacaagtttta

SEQ ID NO: 305656 - DNA, 16 bp, Homo sapiens
ttagtggaaagtgatt

SEQ ID NO: 305657 - DNA, 16 bp, Homo sapiens
ttagtggcatatttgc

SEQ ID NO: 305658 - DNA, 21 bp, Homo sapiens
ttatgcacatttgtgcataaa

SEQ ID NO: 305659 - DNA, 15 bp, Homo sapiens
ttatgcagtgctgct

SEQ ID NO: 305660 - DNA, 19 bp, Homo sapiens
ttatgcatgagaactaaat

SEQ ID NO: 305661 - DNA, 18 bp, Homo sapiens
ttatgcatttatgcatga

SEQ ID NO: 305662 - DNA, 13 bp, Homo sapiens
ttatgctgaaaca

SEQ ID NO: 305663 - DNA, 12 bp, Homo sapiens
ttatgctgctgt

SEQ ID NO: 305664 - DNA, 16 bp, Homo sapiens
ttatggcagaagggaa

SEQ ID NO: 305665 - DNA, 14 bp, Homo sapiens
ttatgggaacaagt

SEQ ID NO: 305666 - DNA, 23 bp, Homo sapiens
ttatgggaaccccttcatcctct

SEQ ID NO: 305667 - DNA, 13 bp, Homo sapiens
ttatggtattttc

SEQ ID NO: 305668 - DNA, 22 bp, Homo sapiens
ttatggtattttcgtgcatttg

SEQ ID NO: 305669 - DNA, 23 bp, Homo sapiens
ttatggtggaagaggttctcagc

SEQ ID NO: 305670 - DNA, 11 bp, Homo sapiens
ttatggttttg

SEQ ID NO: 305671 - DNA, 12 bp, Homo sapiens
ttatgtaccttt

SEQ ID NO: 305672 - DNA, 11 bp, Homo sapiens
ttatgtacttt

SEQ ID NO: 305673 - DNA, 13 bp, Homo sapiens
ttatgtctaaaga

SEQ ID NO: 305674 - DNA, 17 bp, Homo sapiens
ttatgtgacaacctttg

SEQ ID NO: 305675 - DNA, 13 bp, Homo sapiens
ttatgtgagagaa

SEQ ID NO: 305676 - DNA, 18 bp, Homo sapiens
ttatgtgtatgtgccatt

SEQ ID NO: 305677 - DNA, 19 bp, Homo sapiens
ttatgtgtgaggagctgct

SEQ ID NO: 305678 - DNA, 17 bp, Homo sapiens
ttatgttgtatagatta

SEQ ID NO: 305679 - DNA, 15 bp, Homo sapiens
ttatgtttgtacaca

SEQ ID NO: 305680 - DNA, 14 bp, Homo sapiens
ttattaaaatgatt

SEQ ID NO: 305681 - DNA, 12 bp, Homo sapiens
ttattaaacttc

SEQ ID NO: 305682 - DNA, 14 bp, Homo sapiens
ttattaaacttcag

SEQ ID NO: 305683 - DNA, 17 bp, Homo sapiens
ttattaaacttcagcaa

SEQ ID NO: 305684 - DNA, 17 bp, Homo sapiens
ttattaacatatattgt

SEQ ID NO: 305685 - DNA, 15 bp, Homo sapiens
ttattaactacattt

SEQ ID NO: 305686 - DNA, 16 bp, Homo sapiens
ttattaactacattta

SEQ ID NO: 305687 - DNA, 18 bp, Homo sapiens
ttattaactacatttatg

SEQ ID NO: 305688 - DNA, 20 bp, Homo sapiens
ttattaagatggattctcag

SEQ ID NO: 305689 - DNA, 21 bp, Homo sapiens
ttattaagatggattctcaga

SEQ ID NO: 305690 - DNA, 23 bp, Homo sapiens
ttattaagatggattctcagata

SEQ ID NO: 305691 - DNA, 18 bp, Homo sapiens
ttattaagcaaccttaaa

SEQ ID NO: 305692 - DNA, 21 bp, Homo sapiens
ttattaagcaaccttaaagca

SEQ ID NO: 305693 - DNA, 24 bp, Homo sapiens
ttattaagtctgggatgtagaact

SEQ ID NO: 305694 - DNA, 15 bp, Homo sapiens
ttattaatgaactgt

SEQ ID NO: 305695 - DNA, 22 bp, Homo sapiens
ttattaattgttttgcactttt

SEQ ID NO: 305696 - DNA, 19 bp, Homo sapiens
ttattacaaattttcactg

SEQ ID NO: 305697 - DNA, 18 bp, Homo sapiens
ttattacatttatacatc

SEQ ID NO: 305698 - DNA, 14 bp, Homo sapiens
ttattactattatt

SEQ ID NO: 305699 - DNA, 22 bp, Homo sapiens
ttattagccaggtaatgtgaat

SEQ ID NO: 305700 - DNA, 16 bp, Homo sapiens
ttattattagattctc

SEQ ID NO: 305701 - DNA, 15 bp, Homo sapiens
ttattattatttgct

SEQ ID NO: 305702 - DNA, 11 bp, Homo sapiens
ttattattcag

SEQ ID NO: 305703 - DNA, 19 bp, Homo sapiens
ttattcaagaaagatatct

SEQ ID NO: 305704 - DNA, 18 bp, Homo sapiens
ttattcaattcctctggg

SEQ ID NO: 305705 - DNA, 21 bp, Homo sapiens
ttattcatgctttctcctttt

SEQ ID NO: 305706 - DNA, 13 bp, Homo sapiens
ttattcatttaaa

SEQ ID NO: 305707 - DNA, 20 bp, Homo sapiens
ttattcatttaaaatgatta

SEQ ID NO: 305708 - DNA, 17 bp, Homo sapiens
ttattcctgataataat

SEQ ID NO: 305709 - DNA, 11 bp, Homo sapiens
ttattctagtc

SEQ ID NO: 305710 - DNA, 15 bp, Homo sapiens
ttattctcaaagcag

SEQ ID NO: 305711 - DNA, 13 bp, Homo sapiens
ttattctcctccc

SEQ ID NO: 305712 - DNA, 13 bp, Homo sapiens
ttattcttgctgg

SEQ ID NO: 305713 - DNA, 21 bp, Homo sapiens
ttattcttgctgggcatactt

SEQ ID NO: 305714 - DNA, 16 bp, Homo sapiens
ttattgaatcttaatt

SEQ ID NO: 305715 - DNA, 12 bp, Homo sapiens
ttattgaatgtt

SEQ ID NO: 305716 - DNA, 13 bp, Homo sapiens
ttattgcattata

SEQ ID NO: 305717 - DNA, 18 bp, Homo sapiens
ttattgcccatgggatat

SEQ ID NO: 305718 - DNA, 20 bp, Homo sapiens
ttattgcctgggcagtgccc

SEQ ID NO: 305719 - DNA, 22 bp, Homo sapiens
ttattggaattaacctggtgct

SEQ ID NO: 305720 - DNA, 12 bp, Homo sapiens
ttattggccact

SEQ ID NO: 305721 - DNA, 22 bp, Homo sapiens
ttattgtaaaagtgacatgaaa

SEQ ID NO: 305722 - DNA, 14 bp, Homo sapiens
ttattgtaaacttt

SEQ ID NO: 305723 - DNA, 19 bp, Homo sapiens
ttattgtacagctgtttaa

SEQ ID NO: 305724 - DNA, 22 bp, Homo sapiens
ttattgtataaactatcagttt

SEQ ID NO: 305725 - DNA, 18 bp, Homo sapiens
ttattgtcaaagtggtga

SEQ ID NO: 305726 - DNA, 18 bp, Homo sapiens
ttattgtccttcagagct

SEQ ID NO: 305727 - DNA, 20 bp, Homo sapiens
ttattgtgtttttaatttat

SEQ ID NO: 305728 - DNA, 16 bp, Homo sapiens
ttattgttttattgta

SEQ ID NO: 305729 - DNA, 14 bp, Homo sapiens
ttatttaaactatt

SEQ ID NO: 305730 - DNA, 17 bp, Homo sapiens
ttatttaaactattcag

SEQ ID NO: 305731 - DNA, 14 bp, Homo sapiens
ttatttaaagaaag

SEQ ID NO: 305732 - DNA, 19 bp, Homo sapiens
ttatttaaagaaagtgaaa

SEQ ID NO: 305733 - DNA, 13 bp, Homo sapiens
ttatttaatatgc

SEQ ID NO: 305734 - DNA, 21 bp, Homo sapiens
ttatttactgagcttctctgt

SEQ ID NO: 305735 - DNA, 22 bp, Homo sapiens
ttatttactgagcttctctgtg

SEQ ID NO: 305736 - DNA, 12 bp, Homo sapiens
ttatttactttt

SEQ ID NO: 305737 - DNA, 14 bp, Homo sapiens
ttatttatatatga

SEQ ID NO: 305738 - DNA, 18 bp, Homo sapiens
ttatttatcagtgacaga

SEQ ID NO: 305739 - DNA, 16 bp, Homo sapiens
ttatttattaaacttc

SEQ ID NO: 305740 - DNA, 17 bp, Homo sapiens
ttatttattaaacttca

SEQ ID NO: 305741 - DNA, 15 bp, Homo sapiens
ttatttattaagatg

SEQ ID NO: 305742 - DNA, 13 bp, Homo sapiens
ttatttattatta

SEQ ID NO: 305743 - DNA, 20 bp, Homo sapiens
ttatttatttttgtactgtg

SEQ ID NO: 305744 - DNA, 18 bp, Homo sapiens
ttatttcataaacaactt

SEQ ID NO: 305745 - DNA, 13 bp, Homo sapiens
ttatttcattcat

SEQ ID NO: 305746 - DNA, 16 bp, Homo sapiens
ttatttcattcatatc

SEQ ID NO: 305747 - DNA, 19 bp, Homo sapiens
ttatttccaaataaaatga

SEQ ID NO: 305748 - DNA, 14 bp, Homo sapiens
ttatttcctgcttt

SEQ ID NO: 305749 - DNA, 21 bp, Homo sapiens
ttatttcctgctttctaatta

SEQ ID NO: 305750 - DNA, 22 bp, Homo sapiens
ttatttctaaaacattaattga

SEQ ID NO: 305751 - DNA, 15 bp, Homo sapiens
ttatttctaaatcct

SEQ ID NO: 305752 - DNA, 17 bp, Homo sapiens
ttatttctaagtattta

SEQ ID NO: 305753 - DNA, 18 bp, Homo sapiens
ttatttctacctttctga

SEQ ID NO: 305754 - DNA, 12 bp, Homo sapiens
ttatttctgtct

SEQ ID NO: 305755 - DNA, 20 bp, Homo sapiens
ttatttgaaaacactgctgt

SEQ ID NO: 305756 - DNA, 13 bp, Homo sapiens
ttatttgtacagt

SEQ ID NO: 305757 - DNA, 15 bp, Homo sapiens
ttatttgtacagttc

SEQ ID NO: 305758 - DNA, 15 bp, Homo sapiens
ttatttgtcagtgta

SEQ ID NO: 305759 - DNA, 16 bp, Homo sapiens
ttatttgtgtaataga

SEQ ID NO: 305760 - DNA, 18 bp, Homo sapiens
ttatttgttattttcagt

SEQ ID NO: 305761 - DNA, 12 bp, Homo sapiens
ttattttaaatt

SEQ ID NO: 305762 - DNA, 14 bp, Homo sapiens
ttattttaatacct

SEQ ID NO: 305763 - DNA, 19 bp, Homo sapiens
ttattttacacagcaattt

SEQ ID NO: 305764 - DNA, 16 bp, Homo sapiens
ttattttagcagttct

SEQ ID NO: 305765 - DNA, 18 bp, Homo sapiens
ttattttaggagacagtc

SEQ ID NO: 305766 - DNA, 16 bp, Homo sapiens
ttattttatcctctgg

SEQ ID NO: 305767 - DNA, 14 bp, Homo sapiens
ttattttcacctgt

SEQ ID NO: 305768 - DNA, 21 bp, Homo sapiens
ttattttcagtatactgtgtg

SEQ ID NO: 305769 - DNA, 16 bp, Homo sapiens
ttattttcctccccag

SEQ ID NO: 305770 - DNA, 12 bp, Homo sapiens
ttattttctggt

SEQ ID NO: 305771 - DNA, 13 bp, Homo sapiens
ttattttgaatgt

SEQ ID NO: 305772 - DNA, 17 bp, Homo sapiens
ttattttgttactgtct

SEQ ID NO: 305773 - DNA, 19 bp, Homo sapiens
ttattttgttactgtctgt

SEQ ID NO: 305774 - DNA, 21 bp, Homo sapiens
ttattttgttactgtctgtag

SEQ ID NO: 305775 - DNA, 13 bp, Homo sapiens
ttatttttgtact

SEQ ID NO: 305776 - DNA, 19 bp, Homo sapiens
ttatttttgtactgtgctg

SEQ ID NO: 305777 - DNA, 18 bp, Homo sapiens
ttattttttaagtattta

SEQ ID NO: 305778 - DNA, 18 bp, Homo sapiens
ttattttttaagttcaat

SEQ ID NO: 305779 - DNA, 20 bp, Homo sapiens
ttatttttttaagctgtaaa

SEQ ID NO: 305780 - DNA, 17 bp, Homo sapiens
ttatttttttattcttc

SEQ ID NO: 305781 - DNA, 20 bp, Homo sapiens
ttcaaaaaaaaaatataagg

SEQ ID NO: 305782 - DNA, 13 bp, Homo sapiens
ttcaaaaagtgtt

SEQ ID NO: 305783 - DNA, 15 bp, Homo sapiens
ttcaaaaggtgatta

SEQ ID NO: 305784 - DNA, 12 bp, Homo sapiens
ttcaaaatactt

SEQ ID NO: 305785 - DNA, 15 bp, Homo sapiens
ttcaaaatagttcta

SEQ ID NO: 305786 - DNA, 18 bp, Homo sapiens
ttcaaaatagttctattt

SEQ ID NO: 305787 - DNA, 21 bp, Homo sapiens
ttcaaaatagttctatttcta

SEQ ID NO: 305788 - DNA, 19 bp, Homo sapiens
ttcaaaatccttccaaaga

SEQ ID NO: 305789 - DNA, 23 bp, Homo sapiens
ttcagaagtttggcaatagtttg

SEQ ID NO: 305790 - DNA, 21 bp, Homo sapiens
ttcagacaagcaacaggtttt

SEQ ID NO: 305791 - DNA, 16 bp, Homo sapiens
ttcagacactttggaa

SEQ ID NO: 305792 - DNA, 15 bp, Homo sapiens
ttcagacccctgcct

SEQ ID NO: 305793 - DNA, 19 bp, Homo sapiens
ttcagagactggcagccag

SEQ ID NO: 305794 - DNA, 19 bp, Homo sapiens
ttcagagagctaaattaca

SEQ ID NO: 305795 - DNA, 13 bp, Homo sapiens
ttcagagagctgg

SEQ ID NO: 305796 - DNA, 14 bp, Homo sapiens
ttcagagagctggt

SEQ ID NO: 305797 - DNA, 15 bp, Homo sapiens
ttcagagagctggta

SEQ ID NO: 305798 - DNA, 18 bp, Homo sapiens
ttcagagatgtaccatgt

SEQ ID NO: 305799 - DNA, 9 bp, Homo sapiens
ttcagaggg

SEQ ID NO: 305800 - DNA, 22 bp, Homo sapiens
ttcagagggaaactcagatgtc

SEQ ID NO: 305801 - DNA, 21 bp, Homo sapiens
ttcagagggtgtcgtcctgca

SEQ ID NO: 305802 - DNA, 22 bp, Homo sapiens
ttcagagggtgtcgtcctgcag

SEQ ID NO: 305803 - DNA, 19 bp, Homo sapiens
ttcagaggtggctctggaa

SEQ ID NO: 305804 - DNA, 15 bp, Homo sapiens
ttcagagtgaatcat

SEQ ID NO: 305805 - DNA, 15 bp, Homo sapiens
ttcagagttctctgt

SEQ ID NO: 305806 - DNA, 15 bp, Homo sapiens
ttcagatcctgctgc

SEQ ID NO: 305807 - DNA, 16 bp, Homo sapiens
ttcagatcctgctgcc

SEQ ID NO: 305808 - DNA, 14 bp, Homo sapiens
ttcagatgctttag

SEQ ID NO: 305809 - DNA, 19 bp, Homo sapiens
ttcagatgtcttctgcctg

SEQ ID NO: 305810 - DNA, 14 bp, Homo sapiens
ttcagatgtgcatt

SEQ ID NO: 305811 - DNA, 23 bp, Homo sapiens
ttcagattatttccagttttttg

SEQ ID NO: 305812 - DNA, 20 bp, Homo sapiens
ttcagattttaaaaagtctt

SEQ ID NO: 305813 - DNA, 14 bp, Homo sapiens
ttcagcaaccctac

SEQ ID NO: 305814 - DNA, 19 bp, Homo sapiens
ttcagcaaccctacagtat

SEQ ID NO: 305815 - DNA, 21 bp, Homo sapiens
ttcagcaaccctacagtatat

SEQ ID NO: 305816 - DNA, 16 bp, Homo sapiens
ttcagcaccaccctag

SEQ ID NO: 305817 - DNA, 13 bp, Homo sapiens
ttcagcaccccca

SEQ ID NO: 305818 - DNA, 14 bp, Homo sapiens
ttcagcacccccac

SEQ ID NO: 305819 - DNA, 17 bp, Homo sapiens
ttcagcaccctgggtgc

SEQ ID NO: 305820 - DNA, 23 bp, Homo sapiens
ttcagcaccctgggtgccattcc

SEQ ID NO: 305821 - DNA, 14 bp, Homo sapiens
ttcagcactgtccc

SEQ ID NO: 305822 - DNA, 16 bp, Homo sapiens
ttcagcactgtccctt

SEQ ID NO: 305823 - DNA, 20 bp, Homo sapiens
ttcagcatcaaacatgaaaa

SEQ ID NO: 305824 - DNA, 14 bp, Homo sapiens
ttcagccaatttgt

SEQ ID NO: 305825 - DNA, 18 bp, Homo sapiens
ttcagccaatttgtctcc

SEQ ID NO: 305826 - DNA, 23 bp, Homo sapiens
ttcagctgcagttgaagagcctg

SEQ ID NO: 305827 - DNA, 12 bp, Homo sapiens
ttcagctgcccc

SEQ ID NO: 305828 - DNA, 21 bp, Homo sapiens
ttcagctggtggatggtgact

SEQ ID NO: 305829 - DNA, 22 bp, Homo sapiens
ttcagctggtggatggtgactt

SEQ ID NO: 305830 - DNA, 14 bp, Homo sapiens
ttcagcttcatttg

SEQ ID NO: 305831 - DNA, 14 bp, Homo sapiens
ttcagcttctgttg

SEQ ID NO: 305832 - DNA, 21 bp, Homo sapiens
ttcagcttgtttctatactgt

SEQ ID NO: 305833 - DNA, 16 bp, Homo sapiens
ttcaggaacctggacc

SEQ ID NO: 305834 - DNA, 22 bp, Homo sapiens
ttcaggaacctggaccaaagct

SEQ ID NO: 305835 - DNA, 18 bp, Homo sapiens
ttcaggaagggagaggag

SEQ ID NO: 305836 - DNA, 13 bp, Homo sapiens
ttcaggacagctg

SEQ ID NO: 305837 - DNA, 14 bp, Homo sapiens
ttcaggagaatgtg

SEQ ID NO: 305838 - DNA, 23 bp, Homo sapiens
ttcaggagaatgtgcagtgtctt

SEQ ID NO: 305839 - DNA, 17 bp, Homo sapiens
ttcaggagatgatgtga

SEQ ID NO: 305840 - DNA, 19 bp, Homo sapiens
ttcaggagcgcaagataga

SEQ ID NO: 305841 - DNA, 16 bp, Homo sapiens
ttcaggatacatgtgc

SEQ ID NO: 305842 - DNA, 20 bp, Homo sapiens
ttcaggcgattctcctgcct

SEQ ID NO: 305843 - DNA, 15 bp, Homo sapiens
ttcaggctcttctcc

SEQ ID NO: 305844 - DNA, 16 bp, Homo sapiens
ttcaggctcttctcct

SEQ ID NO: 305845 - DNA, 13 bp, Homo sapiens
ttcaggctgcttg

SEQ ID NO: 305846 - DNA, 16 bp, Homo sapiens
ttcaggctgcttggga

SEQ ID NO: 305847 - DNA, 21 bp, Homo sapiens
ttcaggcttcctgcaattttc

SEQ ID NO: 305848 - DNA, 13 bp, Homo sapiens
ttcagggccagaa

SEQ ID NO: 305849 - DNA, 23 bp, Homo sapiens
ttcagggccagaaggagggcaga

SEQ ID NO: 305850 - DNA, 13 bp, Homo sapiens
ttcagggcctcca

SEQ ID NO: 305851 - DNA, 16 bp, Homo sapiens
ttcaggggactcagcc

SEQ ID NO: 305852 - DNA, 19 bp, Homo sapiens
ttcagggtggtaaagtatg

SEQ ID NO: 305853 - DNA, 17 bp, Homo sapiens
ttcaggtcagggctatg

SEQ ID NO: 305854 - DNA, 22 bp, Homo sapiens
ttcaggtggaacaggaggaact

SEQ ID NO: 305855 - DNA, 16 bp, Homo sapiens
ttcaggttgttctgta

SEQ ID NO: 305856 - DNA, 18 bp, Homo sapiens
ttcagtaataaaacatct

SEQ ID NO: 305857 - DNA, 20 bp, Homo sapiens
ttcagtaataaactgtgttt

SEQ ID NO: 305858 - DNA, 16 bp, Homo sapiens
ttcagtaatagctgaa

SEQ ID NO: 305859 - DNA, 19 bp, Homo sapiens
ttcagtaatagctgaacct

SEQ ID NO: 305860 - DNA, 14 bp, Homo sapiens
ttcagtaccaaaga

SEQ ID NO: 305861 - DNA, 14 bp, Homo sapiens
ttcagtactgcagc

SEQ ID NO: 305862 - DNA, 17 bp, Homo sapiens
ttcagtatactgtgtgg

SEQ ID NO: 305863 - DNA, 15 bp, Homo sapiens
ttcagtccctgagca

SEQ ID NO: 305864 - DNA, 14 bp, Homo sapiens
ttcagtctgcagct

SEQ ID NO: 305865 - DNA, 16 bp, Homo sapiens
ttcagtgagcccctcc

SEQ ID NO: 305866 - DNA, 19 bp, Homo sapiens
ttcagtgagcccctcccca

SEQ ID NO: 305867 - DNA, 22 bp, Homo sapiens
ttcagtgagcccctccccagcc

SEQ ID NO: 305868 - DNA, 13 bp, Homo sapiens
ttcagttccagct

SEQ ID NO: 305869 - DNA, 14 bp, Homo sapiens
ttcagttccagctt

SEQ ID NO: 305870 - DNA, 17 bp, Homo sapiens
ttcagttccagcttttg

SEQ ID NO: 305871 - DNA, 23 bp, Homo sapiens
ttcagttcctctttgcatggaat

SEQ ID NO: 305872 - DNA, 19 bp, Homo sapiens
ttcataaattggctccttt

SEQ ID NO: 305873 - DNA, 21 bp, Homo sapiens
ttcataaattggctcctttcc

SEQ ID NO: 305874 - DNA, 22 bp, Homo sapiens
ttcataaattggctcctttccc

SEQ ID NO: 305875 - DNA, 15 bp, Homo sapiens
ttcataagatattct

SEQ ID NO: 305876 - DNA, 19 bp, Homo sapiens
ttcataaggcctgccctcc

SEQ ID NO: 305877 - DNA, 23 bp, Homo sapiens
ttcataatgacttaagcacactt

SEQ ID NO: 305878 - DNA, 13 bp, Homo sapiens
ttcatacagcact

SEQ ID NO: 305879 - DNA, 20 bp, Homo sapiens
ttcatacagcactacttact

SEQ ID NO: 305880 - DNA, 16 bp, Homo sapiens
ttcatacctccctcct

SEQ ID NO: 305881 - DNA, 12 bp, Homo sapiens
ttcatacctgtt

SEQ ID NO: 305882 - DNA, 17 bp, Homo sapiens
ttcatactctgttgcct

SEQ ID NO: 305883 - DNA, 20 bp, Homo sapiens
ttcatactctgttgcctcct

SEQ ID NO: 305884 - DNA, 21 bp, Homo sapiens
ttcatactctgttgcctcctc

SEQ ID NO: 305885 - DNA, 23 bp, Homo sapiens
ttcatactctgttgcctcctctc

SEQ ID NO: 305886 - DNA, 23 bp, Homo sapiens
ttcatagataccattttgaaata

SEQ ID NO: 305887 - DNA, 13 bp, Homo sapiens
ttcataggagaca

SEQ ID NO: 305888 - DNA, 20 bp, Homo sapiens
ttcataggtaacacattata

SEQ ID NO: 305889 - DNA, 17 bp, Homo sapiens
ttcatagtgcctttttc

SEQ ID NO: 305890 - DNA, 12 bp, Homo sapiens
ttcatagttctg

SEQ ID NO: 305891 - DNA, 17 bp, Homo sapiens
ttcatagttctgttaaa

SEQ ID NO: 305892 - DNA, 16 bp, Homo sapiens
ttcatagtttctgtaa

SEQ ID NO: 305893 - DNA, 20 bp, Homo sapiens
ttcatatctatttattaaat

SEQ ID NO: 305894 - DNA, 16 bp, Homo sapiens
ttcatatgttgctcag

SEQ ID NO: 305895 - DNA, 14 bp, Homo sapiens
ttcatattcctgcc

SEQ ID NO: 305896 - DNA, 12 bp, Homo sapiens
ttcatattgtgc

SEQ ID NO: 305897 - DNA, 22 bp, Homo sapiens
ttcatattgtgccaatatgtat

SEQ ID NO: 305898 - DNA, 21 bp, Homo sapiens
ttcatatttacttcttataca

SEQ ID NO: 305899 - DNA, 17 bp, Homo sapiens
ttcatatttgcaataaa

SEQ ID NO: 305900 - DNA, 14 bp, Homo sapiens
ttcatcaaataaac

SEQ ID NO: 305901 - DNA, 21 bp, Homo sapiens
ttcatcaagtagcgttggaga

SEQ ID NO: 305902 - DNA, 16 bp, Homo sapiens
ttcatcaccagacttt

SEQ ID NO: 305903 - DNA, 13 bp, Homo sapiens
ttcatccctgcca

SEQ ID NO: 305904 - DNA, 21 bp, Homo sapiens
ttcatccctgccaagaactct

SEQ ID NO: 305905 - DNA, 15 bp, Homo sapiens
ttcatcctcagcaag

SEQ ID NO: 305906 - DNA, 13 bp, Homo sapiens
ttcatcctggcct

SEQ ID NO: 305907 - DNA, 20 bp, Homo sapiens
ttcatcctgttggctgctgc

SEQ ID NO: 305908 - DNA, 13 bp, Homo sapiens
ttcatccttagca

SEQ ID NO: 305909 - DNA, 17 bp, Homo sapiens
ttcatccttttttctct

SEQ ID NO: 305910 - DNA, 23 bp, Homo sapiens
ttcatccttttttctcttctgtc

SEQ ID NO: 305911 - DNA, 14 bp, Homo sapiens
ttcatctagttaag

SEQ ID NO: 305912 - DNA, 19 bp, Homo sapiens
ttcatctagttaagtcgct

SEQ ID NO: 305913 - DNA, 15 bp, Homo sapiens
ttcatctctgctgaa

SEQ ID NO: 305914 - DNA, 16 bp, Homo sapiens
ttcatctctgctgaac

SEQ ID NO: 305915 - DNA, 17 bp, Homo sapiens
ttcatctctgctgaaca

SEQ ID NO: 305916 - DNA, 21 bp, Homo sapiens
ttcatctgaggagtccaaaat

SEQ ID NO: 305917 - DNA, 14 bp, Homo sapiens
ttcatctttccaaa

SEQ ID NO: 305918 - DNA, 22 bp, Homo sapiens
ttcatcttttgaggcttctgtt

SEQ ID NO: 305919 - DNA, 16 bp, Homo sapiens
ttcctacttaaacaaa

SEQ ID NO: 305920 - DNA, 18 bp, Homo sapiens
ttcctagataaaaagatg

SEQ ID NO: 305921 - DNA, 18 bp, Homo sapiens
ttcctagcttatctccct

SEQ ID NO: 305922 - DNA, 21 bp, Homo sapiens
ttcctagtatacccactgcat

SEQ ID NO: 305923 - DNA, 22 bp, Homo sapiens
ttcctatctgtatgtctgccta

SEQ ID NO: 305924 - DNA, 15 bp, Homo sapiens
ttcctatgactaatt

SEQ ID NO: 305925 - DNA, 21 bp, Homo sapiens
ttcctatttgttttcatggtg

SEQ ID NO: 305926 - DNA, 14 bp, Homo sapiens
ttcctcaccaataa

SEQ ID NO: 305927 - DNA, 15 bp, Homo sapiens
ttcctcaccaataac

SEQ ID NO: 305928 - DNA, 21 bp, Homo sapiens
ttcctcaccaataacttcaga

SEQ ID NO: 305929 - DNA, 14 bp, Homo sapiens
ttcctcagctgcca

SEQ ID NO: 305930 - DNA, 14 bp, Homo sapiens
ttcctcatcctgct

SEQ ID NO: 305931 - DNA, 14 bp, Homo sapiens
ttcctcatgaatgt

SEQ ID NO: 305932 - DNA, 20 bp, Homo sapiens
ttcctcatttgttcattaaa

SEQ ID NO: 305933 - DNA, 15 bp, Homo sapiens
ttcctccagaggagg

SEQ ID NO: 305934 - DNA, 17 bp, Homo sapiens
ttcctccagcctcccct

SEQ ID NO: 305935 - DNA, 18 bp, Homo sapiens
ttcctccagcctcccctc

SEQ ID NO: 305936 - DNA, 21 bp, Homo sapiens
ttcctccagcctcccctcccc

SEQ ID NO: 305937 - DNA, 16 bp, Homo sapiens
ttcctcccccagagcc

SEQ ID NO: 305938 - DNA, 17 bp, Homo sapiens
ttcctccctccctgcag

SEQ ID NO: 305939 - DNA, 12 bp, Homo sapiens
ttcctcccttct

SEQ ID NO: 305940 - DNA, 20 bp, Homo sapiens
ttcctccgctcccctttccc

SEQ ID NO: 305941 - DNA, 18 bp, Homo sapiens
ttcctccgtccacccagg

SEQ ID NO: 305942 - DNA, 22 bp, Homo sapiens
ttcctccgtccacccaggctgc

SEQ ID NO: 305943 - DNA, 20 bp, Homo sapiens
ttcctcctccacagtgctgc

SEQ ID NO: 305944 - DNA, 17 bp, Homo sapiens
ttcctcctgtctcctct

SEQ ID NO: 305945 - DNA, 19 bp, Homo sapiens
ttcctcgcctaggcctgtg

SEQ ID NO: 305946 - DNA, 14 bp, Homo sapiens
ttcctctccactgc

SEQ ID NO: 305947 - DNA, 14 bp, Homo sapiens
ttcctctctatctt

SEQ ID NO: 305948 - DNA, 14 bp, Homo sapiens
ttcctctctctcac

SEQ ID NO: 305949 - DNA, 14 bp, Homo sapiens
ttcctctctctctc

SEQ ID NO: 305950 - DNA, 17 bp, Homo sapiens
ttcctctgcagctgacc

SEQ ID NO: 305951 - DNA, 16 bp, Homo sapiens
ttcctctgcaggacac

SEQ ID NO: 305952 - DNA, 21 bp, Homo sapiens
ttcctctgtattgtgctgatt

SEQ ID NO: 305953 - DNA, 13 bp, Homo sapiens
ttcctcttccttc

SEQ ID NO: 305954 - DNA, 14 bp, Homo sapiens
ttcctcttccttct

SEQ ID NO: 305955 - DNA, 18 bp, Homo sapiens
ttcctcttgcctctctca

SEQ ID NO: 305956 - DNA, 15 bp, Homo sapiens
ttcctctttgcatga

SEQ ID NO: 305957 - DNA, 22 bp, Homo sapiens
ttcctgaattctatttgctggg

SEQ ID NO: 305958 - DNA, 14 bp, Homo sapiens
ttcctgactgggaa

SEQ ID NO: 305959 - DNA, 19 bp, Homo sapiens
ttcctgagaaagcccacct

SEQ ID NO: 305960 - DNA, 15 bp, Homo sapiens
ttcctgagattctgg

SEQ ID NO: 305961 - DNA, 16 bp, Homo sapiens
ttcctgagattctggg

SEQ ID NO: 305962 - DNA, 19 bp, Homo sapiens
ttcctgatactgggtacaa

SEQ ID NO: 305963 - DNA, 20 bp, Homo sapiens
ttcctgcaactcaaggactt

SEQ ID NO: 305964 - DNA, 17 bp, Homo sapiens
ttcctgcaattttctaa

SEQ ID NO: 305965 - DNA, 20 bp, Homo sapiens
ttcctgcagaggcccagcca

SEQ ID NO: 305966 - DNA, 14 bp, Homo sapiens
ttcctgcagcctgg

SEQ ID NO: 305967 - DNA, 17 bp, Homo sapiens
ttcctgcatctttcata

SEQ ID NO: 305968 - DNA, 22 bp, Homo sapiens
ttcctgcatctttcatagttct

SEQ ID NO: 305969 - DNA, 15 bp, Homo sapiens
ttcctgccaggctct

SEQ ID NO: 305970 - DNA, 16 bp, Homo sapiens
ttcctgccccaggcct

SEQ ID NO: 305971 - DNA, 16 bp, Homo sapiens
ttcctgcccccgccct

SEQ ID NO: 305972 - DNA, 13 bp, Homo sapiens
ttcctgccctgta

SEQ ID NO: 305973 - DNA, 15 bp, Homo sapiens
ttcctgccttctctt

SEQ ID NO: 305974 - DNA, 18 bp, Homo sapiens
ttcctgccttctcttcta

SEQ ID NO: 305975 - DNA, 13 bp, Homo sapiens
ttcctgcctttga

SEQ ID NO: 305976 - DNA, 20 bp, Homo sapiens
ttcctggaatgcattcactc

SEQ ID NO: 305977 - DNA, 24 bp, Homo sapiens
ttcctggacatcctcttctgctta

SEQ ID NO: 305978 - DNA, 17 bp, Homo sapiens
ttcctggactggccctt

SEQ ID NO: 305979 - DNA, 18 bp, Homo sapiens
ttcctggactggcccttg

SEQ ID NO: 305980 - DNA, 19 bp, Homo sapiens
ttcctggagagtctcactc

SEQ ID NO: 305981 - DNA, 24 bp, Homo sapiens
ttcctggccccgggctctggccac

SEQ ID NO: 305982 - DNA, 10 bp, Homo sapiens
ttcctggcct

SEQ ID NO: 305983 - DNA, 20 bp, Homo sapiens
ttcctggcctcactggctgg

SEQ ID NO: 305984 - DNA, 22 bp, Homo sapiens
ttcctggcctcagccagctgcc

SEQ ID NO: 305985 - DNA, 14 bp, Homo sapiens
ttcctggccttctg

SEQ ID NO: 305986 - DNA, 17 bp, Homo sapiens
ttcctgggactgtcaga

SEQ ID NO: 305987 - DNA, 17 bp, Homo sapiens
ttcctgggcagcccaga

SEQ ID NO: 305988 - DNA, 16 bp, Homo sapiens
ttcctgggcctgtccc

SEQ ID NO: 305989 - DNA, 15 bp, Homo sapiens
ttcctggggtgccct

SEQ ID NO: 305990 - DNA, 20 bp, Homo sapiens
ttcctggggtggattcctaa

SEQ ID NO: 305991 - DNA, 16 bp, Homo sapiens
ttcctgtcctgctcac

SEQ ID NO: 305992 - DNA, 21 bp, Homo sapiens
ttcctgtcctgctcacgtctg

SEQ ID NO: 305993 - DNA, 15 bp, Homo sapiens
ttcctgtctcagcct

SEQ ID NO: 305994 - DNA, 14 bp, Homo sapiens
ttcctgtctggccc

SEQ ID NO: 305995 - DNA, 15 bp, Homo sapiens
ttcctgtctggccca

SEQ ID NO: 305996 - DNA, 17 bp, Homo sapiens
ttcctgtgactgttttt

SEQ ID NO: 305997 - DNA, 17 bp, Homo sapiens
ttcctgtgccaggactc

SEQ ID NO: 305998 - DNA, 21 bp, Homo sapiens
ttcctgtgccaggactctctt

SEQ ID NO: 305999 - DNA, 20 bp, Homo sapiens
ttcctgtgcccatcatctct

SEQ ID NO: 306000 - DNA, 17 bp, Homo sapiens
ttcctgttctcagcatc

SEQ ID NO: 306001 - DNA, 12 bp, Homo sapiens
ttcctgtttcta

SEQ ID NO: 306002 - DNA, 13 bp, Homo sapiens
ttccttaaactgt

SEQ ID NO: 306003 - DNA, 15 bp, Homo sapiens
ttccttaaactgtgt

SEQ ID NO: 306004 - DNA, 17 bp, Homo sapiens
ttccttagcagctcagg

SEQ ID NO: 306005 - DNA, 15 bp, Homo sapiens
ttccttatttcaagg

SEQ ID NO: 306006 - DNA, 23 bp, Homo sapiens
ttccttccattgctcccagtgcc

SEQ ID NO: 306007 - DNA, 21 bp, Homo sapiens
ttccttcccaactcactgtgc

SEQ ID NO: 306008 - DNA, 22 bp, Homo sapiens
ttccttcccaactcactgtgct

SEQ ID NO: 306009 - DNA, 15 bp, Homo sapiens
ttccttcctgttctg

SEQ ID NO: 306010 - DNA, 18 bp, Homo sapiens
ttccttctaacatgttat

SEQ ID NO: 306011 - DNA, 19 bp, Homo sapiens
ttccttctcgtcttcctct

SEQ ID NO: 306012 - DNA, 22 bp, Homo sapiens
ttccttctcgtcttcctctctc

SEQ ID NO: 306013 - DNA, 17 bp, Homo sapiens
ttccttctgtgaaagta

SEQ ID NO: 306014 - DNA, 18 bp, Homo sapiens
ttccttgaccttcctctg

SEQ ID NO: 306015 - DNA, 13 bp, Homo sapiens
ttccttgctcaac

SEQ ID NO: 306016 - DNA, 17 bp, Homo sapiens
ttccttggcccagcagc

SEQ ID NO: 306017 - DNA, 16 bp, Homo sapiens
ttccttgtcaccagca

SEQ ID NO: 306018 - DNA, 19 bp, Homo sapiens
ttccttgttggtcagagga

SEQ ID NO: 306019 - DNA, 22 bp, Homo sapiens
ttccttgttggtcagaggagtg

SEQ ID NO: 306020 - DNA, 16 bp, Homo sapiens
ttcctttacaactaaa

SEQ ID NO: 306021 - DNA, 14 bp, Homo sapiens
ttcctttatattta

SEQ ID NO: 306022 - DNA, 17 bp, Homo sapiens
ttcctttcatcctcagc

SEQ ID NO: 306023 - DNA, 14 bp, Homo sapiens
ttcctttgctctgg

SEQ ID NO: 306024 - DNA, 20 bp, Homo sapiens
ttccttttaaaacacttcca

SEQ ID NO: 306025 - DNA, 21 bp, Homo sapiens
ttccttttaaaacacttccat

SEQ ID NO: 306026 - DNA, 16 bp, Homo sapiens
ttcgaagctcagccca

SEQ ID NO: 306027 - DNA, 13 bp, Homo sapiens
ttcgagactccat

SEQ ID NO: 306028 - DNA, 21 bp, Homo sapiens
ttcgccgtggctgcggcaccc

SEQ ID NO: 306029 - DNA, 23 bp, Homo sapiens
ttcgcgctggaatccagaaggaa

SEQ ID NO: 306030 - DNA, 19 bp, Homo sapiens
ttcgcgtgccctcgctgct

SEQ ID NO: 306031 - DNA, 16 bp, Homo sapiens
ttcgctattcccaggc

SEQ ID NO: 306032 - DNA, 19 bp, Homo sapiens
ttcgctgctctagctggca

SEQ ID NO: 306033 - DNA, 13 bp, Homo sapiens
ttcgctttcctct

SEQ ID NO: 306034 - DNA, 18 bp, Homo sapiens
ttcggaagggaaaacagt

SEQ ID NO: 306035 - DNA, 21 bp, Homo sapiens
ttcggccaatttatgcagagt

SEQ ID NO: 306036 - DNA, 14 bp, Homo sapiens
ttcgggaagagagg

SEQ ID NO: 306037 - DNA, 18 bp, Homo sapiens
ttcggttctccagaatgt

SEQ ID NO: 306038 - DNA, 15 bp, Homo sapiens
ttcgtaagacaaaaa

SEQ ID NO: 306039 - DNA, 20 bp, Homo sapiens
ttcgtacagttcttcgggaa

SEQ ID NO: 306040 - DNA, 19 bp, Homo sapiens
ttcgtagcccctgctaagt

SEQ ID NO: 306041 - DNA, 18 bp, Homo sapiens
ttcgtcttccctgcttca

SEQ ID NO: 306042 - DNA, 13 bp, Homo sapiens
ttcgtcttctaat

SEQ ID NO: 306043 - DNA, 15 bp, Homo sapiens
ttcgtgcactctgct

SEQ ID NO: 306044 - DNA, 15 bp, Homo sapiens
ttcgtgcatttgtga

SEQ ID NO: 306045 - DNA, 23 bp, Homo sapiens
ttcgtgtagtggaagagcagcct

SEQ ID NO: 306046 - DNA, 17 bp, Homo sapiens
ttcgttcttgttagtac

SEQ ID NO: 306047 - DNA, 20 bp, Homo sapiens
ttcgttcttgttctgttttg

SEQ ID NO: 306048 - DNA, 18 bp, Homo sapiens
ttcgttggttgtttctct

SEQ ID NO: 306049 - DNA, 22 bp, Homo sapiens
ttcttactattaagcagtaaaa

SEQ ID NO: 306050 - DNA, 14 bp, Homo sapiens
ttcttactgcttgg

SEQ ID NO: 306051 - DNA, 17 bp, Homo sapiens
ttcttagctcttgggat

SEQ ID NO: 306052 - DNA, 20 bp, Homo sapiens
ttcttaggcaccatagaaga

SEQ ID NO: 306053 - DNA, 18 bp, Homo sapiens
ttcttagttctcactgtt

SEQ ID NO: 306054 - DNA, 14 bp, Homo sapiens
ttcttatacacatt

SEQ ID NO: 306055 - DNA, 17 bp, Homo sapiens
ttcttcaacatcaatgt

SEQ ID NO: 306056 - DNA, 14 bp, Homo sapiens
ttcttcacccagct

SEQ ID NO: 306057 - DNA, 13 bp, Homo sapiens
ttcttcacctcta

SEQ ID NO: 306058 - DNA, 20 bp, Homo sapiens
ttcttcaggagatgatgtga

SEQ ID NO: 306059 - DNA, 21 bp, Homo sapiens
ttcttcataacaattttagga

SEQ ID NO: 306060 - DNA, 18 bp, Homo sapiens
ttcttcatgcaatgacat

SEQ ID NO: 306061 - DNA, 21 bp, Homo sapiens
ttcttcccatttgtaatgtat

SEQ ID NO: 306062 - DNA, 22 bp, Homo sapiens
ttcttccccagggttctgtatt

SEQ ID NO: 306063 - DNA, 23 bp, Homo sapiens
ttcttccccagggttctgtattg

SEQ ID NO: 306064 - DNA, 12 bp, Homo sapiens
ttcttccctggg

SEQ ID NO: 306065 - DNA, 14 bp, Homo sapiens
ttcttccctggggg

SEQ ID NO: 306066 - DNA, 20 bp, Homo sapiens
ttcttcctccagtctgttct

SEQ ID NO: 306067 - DNA, 18 bp, Homo sapiens
ttcttccttaaactcctg

SEQ ID NO: 306068 - DNA, 14 bp, Homo sapiens
ttcttcctttggta

SEQ ID NO: 306069 - DNA, 20 bp, Homo sapiens
ttcttccttttgtatcctcc

SEQ ID NO: 306070 - DNA, 16 bp, Homo sapiens
ttcttcgctgctctag

SEQ ID NO: 306071 - DNA, 19 bp, Homo sapiens
ttcttcgtccttttggttt

SEQ ID NO: 306072 - DNA, 17 bp, Homo sapiens
ttcttctacaaccagag

SEQ ID NO: 306073 - DNA, 19 bp, Homo sapiens
ttcttctacaaccagagcc

SEQ ID NO: 306074 - DNA, 20 bp, Homo sapiens
ttcttctacaaccagagccc

SEQ ID NO: 306075 - DNA, 18 bp, Homo sapiens
ttcttctcaaggacacat

SEQ ID NO: 306076 - DNA, 17 bp, Homo sapiens
ttcttctttttgcttca

SEQ ID NO: 306077 - DNA, 17 bp, Homo sapiens
ttcttgaagttcatggt

SEQ ID NO: 306078 - DNA, 12 bp, Homo sapiens
ttcttgaataaa

SEQ ID NO: 306079 - DNA, 21 bp, Homo sapiens
ttcttgacaaaacctaacttg

SEQ ID NO: 306080 - DNA, 19 bp, Homo sapiens
ttcttgatgtaaaatcttg

SEQ ID NO: 306081 - DNA, 16 bp, Homo sapiens
ttcttgatgttgctta

SEQ ID NO: 306082 - DNA, 15 bp, Homo sapiens
ttcttgattttcaag

SEQ ID NO: 306083 - DNA, 13 bp, Homo sapiens
ttcttgcactatt

SEQ ID NO: 306084 - DNA, 16 bp, Homo sapiens
ttcttgccagctcagc

SEQ ID NO: 306085 - DNA, 12 bp, Homo sapiens
ttcttgccctga

SEQ ID NO: 306086 - DNA, 13 bp, Homo sapiens
ttcttgccctgag

SEQ ID NO: 306087 - DNA, 16 bp, Homo sapiens
ttcttgccctgagctt

SEQ ID NO: 306088 - DNA, 12 bp, Homo sapiens
ttcttgccttcc

SEQ ID NO: 306089 - DNA, 22 bp, Homo sapiens
ttcttgcggcaccgcccaccca

SEQ ID NO: 306090 - DNA, 14 bp, Homo sapiens
ttcttgcttctggc

SEQ ID NO: 306091 - DNA, 15 bp, Homo sapiens
ttcttgcttgtaaaa

SEQ ID NO: 306092 - DNA, 14 bp, Homo sapiens
ttcttgctttcaca

SEQ ID NO: 306093 - DNA, 19 bp, Homo sapiens
ttcttgctttcacaaatat

SEQ ID NO: 306094 - DNA, 17 bp, Homo sapiens
ttcttggacacttaatt

SEQ ID NO: 306095 - DNA, 16 bp, Homo sapiens
ttcttgggaaaatatc

SEQ ID NO: 306096 - DNA, 22 bp, Homo sapiens
ttcttgggaaaatatcactttg

SEQ ID NO: 306097 - DNA, 14 bp, Homo sapiens
ttcttgggccctcc

SEQ ID NO: 306098 - DNA, 23 bp, Homo sapiens
ttcttgggctaggtagtggggac

SEQ ID NO: 306099 - DNA, 21 bp, Homo sapiens
ttcttggtgcttacacatctc

SEQ ID NO: 306100 - DNA, 18 bp, Homo sapiens
ttcttgtaaaactgtgac

SEQ ID NO: 306101 - DNA, 21 bp, Homo sapiens
ttcttgtaaaactgtgacatt

SEQ ID NO: 306102 - DNA, 13 bp, Homo sapiens
ttcttgtcaaaaa

SEQ ID NO: 306103 - DNA, 20 bp, Homo sapiens
ttcttgtccacattctactt

SEQ ID NO: 306104 - DNA, 15 bp, Homo sapiens
ttcttgtgtctcctt

SEQ ID NO: 306105 - DNA, 16 bp, Homo sapiens
ttcttgtgtttgaaac

SEQ ID NO: 306106 - DNA, 18 bp, Homo sapiens
ttcttgtgtttgaaacac

SEQ ID NO: 306107 - DNA, 13 bp, Homo sapiens
ttcttgttctgtt

SEQ ID NO: 306108 - DNA, 15 bp, Homo sapiens
ttcttgttttatata

SEQ ID NO: 306109 - DNA, 21 bp, Homo sapiens
ttcttgttttgttatataaaa

SEQ ID NO: 306110 - DNA, 23 bp, Homo sapiens
ttctttacaaactgaagataatg

SEQ ID NO: 306111 - DNA, 20 bp, Homo sapiens
ttctttacctgagaccagtt

SEQ ID NO: 306112 - DNA, 18 bp, Homo sapiens
ttctttactcggcgtgct

SEQ ID NO: 306113 - DNA, 22 bp, Homo sapiens
ttctttaggagattttaggtgt

SEQ ID NO: 306114 - DNA, 12 bp, Homo sapiens
ttctttcagcca

SEQ ID NO: 306115 - DNA, 14 bp, Homo sapiens
ttctttccaaaggt

SEQ ID NO: 306116 - DNA, 17 bp, Homo sapiens
ttctttccattatgatt

SEQ ID NO: 306117 - DNA, 20 bp, Homo sapiens
ttctttccattatgattctt

SEQ ID NO: 306118 - DNA, 14 bp, Homo sapiens
ttctttctatgtag

SEQ ID NO: 306119 - DNA, 13 bp, Homo sapiens
ttctttctctcag

SEQ ID NO: 306120 - DNA, 13 bp, Homo sapiens
ttctttctgctat

SEQ ID NO: 306121 - DNA, 12 bp, Homo sapiens
ttctttcttcct

SEQ ID NO: 306122 - DNA, 13 bp, Homo sapiens
ttctttcttcctc

SEQ ID NO: 306123 - DNA, 15 bp, Homo sapiens
ttctttcttcctcca

SEQ ID NO: 306124 - DNA, 12 bp, Homo sapiens
ttctttcttggt

SEQ ID NO: 306125 - DNA, 18 bp, Homo sapiens
ttctttgaccaaactgtg

SEQ ID NO: 306126 - DNA, 12 bp, Homo sapiens
ttctttgagaag

SEQ ID NO: 306127 - DNA, 21 bp, Homo sapiens
ttctttgagggactgcctctg

SEQ ID NO: 306128 - DNA, 13 bp, Homo sapiens
ttctttgtatctt

SEQ ID NO: 306129 - DNA, 17 bp, Homo sapiens
ttctttgtatcttaaat

SEQ ID NO: 306130 - DNA, 16 bp, Homo sapiens
ttctttgttcctgctt

SEQ ID NO: 306131 - DNA, 15 bp, Homo sapiens
ttctttgttgcttaa

SEQ ID NO: 306132 - DNA, 13 bp, Homo sapiens
ttcttttaatttt

SEQ ID NO: 306133 - DNA, 20 bp, Homo sapiens
ttcttttagatgtttacctt

SEQ ID NO: 306134 - DNA, 16 bp, Homo sapiens
ttcttttatatataaa

SEQ ID NO: 306135 - DNA, 18 bp, Homo sapiens
ttcttttatatataaaat

SEQ ID NO: 306136 - DNA, 19 bp, Homo sapiens
ttcttttatatataaaata

SEQ ID NO: 306137 - DNA, 21 bp, Homo sapiens
ttcttttatatataaaataaa

SEQ ID NO: 306138 - DNA, 23 bp, Homo sapiens
ttcttttatatataaaataaata

SEQ ID NO: 306139 - DNA, 16 bp, Homo sapiens
ttcttttatatctgta

SEQ ID NO: 306140 - DNA, 19 bp, Homo sapiens
ttcttttatatctgtaaat

SEQ ID NO: 306141 - DNA, 14 bp, Homo sapiens
ttcttttatgtggt

SEQ ID NO: 306142 - DNA, 21 bp, Homo sapiens
ttcttttctggaatgtaatca

SEQ ID NO: 306143 - DNA, 16 bp, Homo sapiens
ttcttttgatacattt

SEQ ID NO: 306144 - DNA, 12 bp, Homo sapiens
ttcttttgctta

SEQ ID NO: 306145 - DNA, 18 bp, Homo sapiens
ttctttttgggagagact

SEQ ID NO: 306146 - DNA, 19 bp, Homo sapiens
ttctttttgggagagactt

SEQ ID NO: 306147 - DNA, 21 bp, Homo sapiens
ttctttttgggagagacttgt

SEQ ID NO: 306148 - DNA, 12 bp, Homo sapiens
ttgaaaaaagaa

SEQ ID NO: 306149 - DNA, 20 bp, Homo sapiens
ttgaaaaaccattttgctgt

SEQ ID NO: 306150 - DNA, 21 bp, Homo sapiens
ttgaaaacacttattttacac

SEQ ID NO: 306151 - DNA, 19 bp, Homo sapiens
ttgaaaagaagaaagtcta

SEQ ID NO: 306152 - DNA, 20 bp, Homo sapiens
ttgaaaagaagaaagtctat

SEQ ID NO: 306153 - DNA, 16 bp, Homo sapiens
ttgaaaaggtgacctt

SEQ ID NO: 306154 - DNA, 14 bp, Homo sapiens
ttgaaaatatttct

SEQ ID NO: 306155 - DNA, 22 bp, Homo sapiens
ttgaaaatatttctatgtaaat

SEQ ID NO: 306156 - DNA, 18 bp, Homo sapiens
ttgaaaattcaaaaagtg

SEQ ID NO: 306157 - DNA, 20 bp, Homo sapiens
ttgaaaattcaaaaagtgtt

SEQ ID NO: 306158 - DNA, 18 bp, Homo sapiens
ttgaaaattttacttcca

SEQ ID NO: 306159 - DNA, 13 bp, Homo sapiens
ttgaaacagaaaa

SEQ ID NO: 306160 - DNA, 14 bp, Homo sapiens
ttgaaacagcctgg

SEQ ID NO: 306161 - DNA, 12 bp, Homo sapiens
ttgaaaggaaaa

SEQ ID NO: 306162 - DNA, 11 bp, Homo sapiens
ttgaaagtgtt

SEQ ID NO: 306163 - DNA, 23 bp, Homo sapiens
ttgaaagttttccagtattgaaa

SEQ ID NO: 306164 - DNA, 14 bp, Homo sapiens
ttgaaatatgcatg

SEQ ID NO: 306165 - DNA, 18 bp, Homo sapiens
ttgaaatatgcatgtact

SEQ ID NO: 306166 - DNA, 17 bp, Homo sapiens
ttgaaatcaccttttct

SEQ ID NO: 306167 - DNA, 11 bp, Homo sapiens
ttgaaatgtac

SEQ ID NO: 306168 - DNA, 23 bp, Homo sapiens
ttgaaattatgtatgtttacata

SEQ ID NO: 306169 - DNA, 13 bp, Homo sapiens
ttgaaattgtgaa

SEQ ID NO: 306170 - DNA, 15 bp, Homo sapiens
ttgaaatttttaaat

SEQ ID NO: 306171 - DNA, 13 bp, Homo sapiens
ttgaacacaggca

SEQ ID NO: 306172 - DNA, 15 bp, Homo sapiens
ttgaaccaaaacatt

SEQ ID NO: 306173 - DNA, 17 bp, Homo sapiens
ttgaaccaggccttctg

SEQ ID NO: 306174 - DNA, 12 bp, Homo sapiens
ttgaacctcatt

SEQ ID NO: 306175 - DNA, 15 bp, Homo sapiens
ttgaactcacgagcc

SEQ ID NO: 306176 - DNA, 22 bp, Homo sapiens
ttgaactccatgggattttatc

SEQ ID NO: 306177 - DNA, 15 bp, Homo sapiens
ttgaactcctgggct

SEQ ID NO: 306178 - DNA, 13 bp, Homo sapiens
ttgaactgagccg

SEQ ID NO: 306179 - DNA, 17 bp, Homo sapiens
ttgaactgttagatgct

SEQ ID NO: 306180 - DNA, 13 bp, Homo sapiens
ttgccactgcaaa

SEQ ID NO: 306181 - DNA, 14 bp, Homo sapiens
ttgccagacttaaa

SEQ ID NO: 306182 - DNA, 12 bp, Homo sapiens
ttgccagcacag

SEQ ID NO: 306183 - DNA, 14 bp, Homo sapiens
ttgccagcacaggg

SEQ ID NO: 306184 - DNA, 21 bp, Homo sapiens
ttgccagcacaggggccccag

SEQ ID NO: 306185 - DNA, 22 bp, Homo sapiens
ttgccagctcagcagttcactt

SEQ ID NO: 306186 - DNA, 22 bp, Homo sapiens
ttgccagcttttcctcccttgg

SEQ ID NO: 306187 - DNA, 17 bp, Homo sapiens
ttgccaggaatgtttca

SEQ ID NO: 306188 - DNA, 14 bp, Homo sapiens
ttgccaggttgcag

SEQ ID NO: 306189 - DNA, 19 bp, Homo sapiens
ttgccaggttgcagctgct

SEQ ID NO: 306190 - DNA, 21 bp, Homo sapiens
ttgccagtatataagctgttt

SEQ ID NO: 306191 - DNA, 14 bp, Homo sapiens
ttgccatgggcctg

SEQ ID NO: 306192 - DNA, 14 bp, Homo sapiens
ttgccatttcttcc

SEQ ID NO: 306193 - DNA, 17 bp, Homo sapiens
ttgccatttcttcccaa

SEQ ID NO: 306194 - DNA, 18 bp, Homo sapiens
ttgccatttcttcccaag

SEQ ID NO: 306195 - DNA, 24 bp, Homo sapiens
ttgccatttcttcccaaggccagt

SEQ ID NO: 306196 - DNA, 16 bp, Homo sapiens
ttgcccaactcccagc

SEQ ID NO: 306197 - DNA, 19 bp, Homo sapiens
ttgcccacacctgcctctg

SEQ ID NO: 306198 - DNA, 20 bp, Homo sapiens
ttgcccaggctggagtgcaa

SEQ ID NO: 306199 - DNA, 17 bp, Homo sapiens
ttgcccagttcatccca

SEQ ID NO: 306200 - DNA, 15 bp, Homo sapiens
ttgccccagtcctgg

SEQ ID NO: 306201 - DNA, 13 bp, Homo sapiens
ttgcccccatccc

SEQ ID NO: 306202 - DNA, 15 bp, Homo sapiens
ttgcccgccagcctc

SEQ ID NO: 306203 - DNA, 23 bp, Homo sapiens
ttgcccgctcccacagcttcctg

SEQ ID NO: 306204 - DNA, 15 bp, Homo sapiens
ttgccctagatgagc

SEQ ID NO: 306205 - DNA, 12 bp, Homo sapiens
ttgccctgagct

SEQ ID NO: 306206 - DNA, 21 bp, Homo sapiens
ttgccctgagctttccgggga

SEQ ID NO: 306207 - DNA, 13 bp, Homo sapiens
ttgccctgccagg

SEQ ID NO: 306208 - DNA, 15 bp, Homo sapiens
ttgccctgccaggct

SEQ ID NO: 306209 - DNA, 20 bp, Homo sapiens
ttgcccttcaggacccttct

SEQ ID NO: 306210 - DNA, 21 bp, Homo sapiens
ttgcccttcaggacccttcta

SEQ ID NO: 306211 - DNA, 22 bp, Homo sapiens
ttgcccttcaggacccttctac

SEQ ID NO: 306212 - DNA, 18 bp, Homo sapiens
ttgccgagcctaatgaaa

SEQ ID NO: 306213 - DNA, 17 bp, Homo sapiens
ttgccgaggagccaggc

SEQ ID NO: 306214 - DNA, 13 bp, Homo sapiens
ttgccgggcctgg

SEQ ID NO: 306215 - DNA, 18 bp, Homo sapiens
ttgcctaagtattccttt

SEQ ID NO: 306216 - DNA, 20 bp, Homo sapiens
ttgcctcaaaattgtgtcca

SEQ ID NO: 306217 - DNA, 18 bp, Homo sapiens
ttgcctccatggtgcctc

SEQ ID NO: 306218 - DNA, 12 bp, Homo sapiens
ttgcctcccctc

SEQ ID NO: 306219 - DNA, 15 bp, Homo sapiens
ttgcctcccttcctc

SEQ ID NO: 306220 - DNA, 15 bp, Homo sapiens
ttgcctcctctctcc

SEQ ID NO: 306221 - DNA, 15 bp, Homo sapiens
ttgcctcctgtgtaa

SEQ ID NO: 306222 - DNA, 20 bp, Homo sapiens
ttgcctgaagttggagtgag

SEQ ID NO: 306223 - DNA, 22 bp, Homo sapiens
ttgcctgcctggaaacagcctg

SEQ ID NO: 306224 - DNA, 22 bp, Homo sapiens
ttgcctggctgtggaggcctga

SEQ ID NO: 306225 - DNA, 16 bp, Homo sapiens
ttgcctggttttgtct

SEQ ID NO: 306226 - DNA, 16 bp, Homo sapiens
ttgcctgtagagccag

SEQ ID NO: 306227 - DNA, 16 bp, Homo sapiens
ttgccttaaagaaagt

SEQ ID NO: 306228 - DNA, 22 bp, Homo sapiens
ttgccttaggaagtgacttgaa

SEQ ID NO: 306229 - DNA, 17 bp, Homo sapiens
ttgccttctagacactg

SEQ ID NO: 306230 - DNA, 21 bp, Homo sapiens
ttgccttctctgttcccttgc

SEQ ID NO: 306231 - DNA, 15 bp, Homo sapiens
ttgccttctttactc

SEQ ID NO: 306232 - DNA, 14 bp, Homo sapiens
ttgccttgagttta

SEQ ID NO: 306233 - DNA, 19 bp, Homo sapiens
ttgcctttaggcaggaagt

SEQ ID NO: 306234 - DNA, 23 bp, Homo sapiens
ttgcctttaggcaggaagtcagg

SEQ ID NO: 306235 - DNA, 14 bp, Homo sapiens
ttgcctttgaggtt

SEQ ID NO: 306236 - DNA, 18 bp, Homo sapiens
ttgcctttgctcttataa

SEQ ID NO: 306237 - DNA, 14 bp, Homo sapiens
ttgccttttttatc

SEQ ID NO: 306238 - DNA, 18 bp, Homo sapiens
ttgcgacggagagaaaaa

SEQ ID NO: 306239 - DNA, 12 bp, Homo sapiens
ttgcgatgtgtt

SEQ ID NO: 306240 - DNA, 13 bp, Homo sapiens
ttgcgatgtgttt

SEQ ID NO: 306241 - DNA, 15 bp, Homo sapiens
ttgcgatgtgtttta

SEQ ID NO: 306242 - DNA, 20 bp, Homo sapiens
ttgcggaactcttcctggaa

SEQ ID NO: 306243 - DNA, 21 bp, Homo sapiens
ttgcggcaccgcccacccaca

SEQ ID NO: 306244 - DNA, 16 bp, Homo sapiens
ttgcgtatgtctgtta

SEQ ID NO: 306245 - DNA, 20 bp, Homo sapiens
ttgcgtatgtctgttaccat

SEQ ID NO: 306246 - DNA, 15 bp, Homo sapiens
ttgcgtcctgcagag

SEQ ID NO: 306247 - DNA, 16 bp, Homo sapiens
ttgcgtgtctgtttcc

SEQ ID NO: 306248 - DNA, 13 bp, Homo sapiens
ttgctaaactgat

SEQ ID NO: 306249 - DNA, 19 bp, Homo sapiens
ttgctaagataattaaatg

SEQ ID NO: 306250 - DNA, 18 bp, Homo sapiens
ttgctacacttacaagta

SEQ ID NO: 306251 - DNA, 21 bp, Homo sapiens
ttgctagacaaggttgctgtt

SEQ ID NO: 306252 - DNA, 22 bp, Homo sapiens
ttgctagcaacaacttactaaa

SEQ ID NO: 306253 - DNA, 16 bp, Homo sapiens
ttgctaggtataaaaa

SEQ ID NO: 306254 - DNA, 23 bp, Homo sapiens
ttgctaggtataaaaaataagta

SEQ ID NO: 306255 - DNA, 21 bp, Homo sapiens
ttgctagtgatacactgtatc

SEQ ID NO: 306256 - DNA, 19 bp, Homo sapiens
ttgctatataaataaagca

SEQ ID NO: 306257 - DNA, 20 bp, Homo sapiens
ttgctatataaataaagcaa

SEQ ID NO: 306258 - DNA, 15 bp, Homo sapiens
ttgctatttgcttta

SEQ ID NO: 306259 - DNA, 17 bp, Homo sapiens
ttgctcaaaaaatgagc

SEQ ID NO: 306260 - DNA, 16 bp, Homo sapiens
ttgctcaaaaatctgt

SEQ ID NO: 306261 - DNA, 15 bp, Homo sapiens
ttgctcaataaaggt

SEQ ID NO: 306262 - DNA, 22 bp, Homo sapiens
ttgctcactccctaaagccctc

SEQ ID NO: 306263 - DNA, 17 bp, Homo sapiens
ttgctcagagaaggaaa

SEQ ID NO: 306264 - DNA, 13 bp, Homo sapiens
ttgctcagtctcc

SEQ ID NO: 306265 - DNA, 23 bp, Homo sapiens
ttgctcatctcagtcctcaaagc

SEQ ID NO: 306266 - DNA, 16 bp, Homo sapiens
ttgctccaccccactc

SEQ ID NO: 306267 - DNA, 16 bp, Homo sapiens
ttgctccattttcttg

SEQ ID NO: 306268 - DNA, 20 bp, Homo sapiens
ttgctccattttcttgtcaa

SEQ ID NO: 306269 - DNA, 13 bp, Homo sapiens
ttgctcccagttt

SEQ ID NO: 306270 - DNA, 16 bp, Homo sapiens
ttgctccccagtgaag

SEQ ID NO: 306271 - DNA, 13 bp, Homo sapiens
ttgctccgcctct

SEQ ID NO: 306272 - DNA, 11 bp, Homo sapiens
ttgctcctacc

SEQ ID NO: 306273 - DNA, 12 bp, Homo sapiens
ttgctcctaccc

SEQ ID NO: 306274 - DNA, 20 bp, Homo sapiens
ttgctcctacccctgtcctg

SEQ ID NO: 306275 - DNA, 15 bp, Homo sapiens
ttgctccttgaataa

SEQ ID NO: 306276 - DNA, 16 bp, Homo sapiens
ttgctccttgaataag

SEQ ID NO: 306277 - DNA, 12 bp, Homo sapiens
ttgctccttgac

SEQ ID NO: 306278 - DNA, 16 bp, Homo sapiens
ttgctctatctctcaa

SEQ ID NO: 306279 - DNA, 14 bp, Homo sapiens
ttgctctggaagcc

SEQ ID NO: 306280 - DNA, 19 bp, Homo sapiens
ttgctctggaagcctgctg

SEQ ID NO: 306281 - DNA, 21 bp, Homo sapiens
ttgctctggaagcctgctgat

SEQ ID NO: 306282 - DNA, 22 bp, Homo sapiens
ttgctgaaggattatatgtatt

SEQ ID NO: 306283 - DNA, 14 bp, Homo sapiens
ttgctgaataacaa

SEQ ID NO: 306284 - DNA, 21 bp, Homo sapiens
ttgctgaataacaacaattta

SEQ ID NO: 306285 - DNA, 15 bp, Homo sapiens
ttgctgaatatgcaa

SEQ ID NO: 306286 - DNA, 19 bp, Homo sapiens
ttgctgcagtcatctactt

SEQ ID NO: 306287 - DNA, 12 bp, Homo sapiens
ttgctgccaagt

SEQ ID NO: 306288 - DNA, 23 bp, Homo sapiens
ttgctgccataattctaagttat

SEQ ID NO: 306289 - DNA, 15 bp, Homo sapiens
ttgctgcccctgtct

SEQ ID NO: 306290 - DNA, 13 bp, Homo sapiens
ttgctgctgtgga

SEQ ID NO: 306291 - DNA, 14 bp, Homo sapiens
ttgctggagtcctg

SEQ ID NO: 306292 - DNA, 16 bp, Homo sapiens
ttgctggagtcctgtt

SEQ ID NO: 306293 - DNA, 21 bp, Homo sapiens
ttgctggattaatgttttgta

SEQ ID NO: 306294 - DNA, 22 bp, Homo sapiens
ttgctgggcatactttctctct

SEQ ID NO: 306295 - DNA, 23 bp, Homo sapiens
ttgctgggcatactttctctcta

SEQ ID NO: 306296 - DNA, 14 bp, Homo sapiens
ttgctgtagagact

SEQ ID NO: 306297 - DNA, 17 bp, Homo sapiens
ttgctgtccccttccag

SEQ ID NO: 306298 - DNA, 14 bp, Homo sapiens
ttgctgtgaaacag

SEQ ID NO: 306299 - DNA, 20 bp, Homo sapiens
ttgctgtgaggaatgctctg

SEQ ID NO: 306300 - DNA, 20 bp, Homo sapiens
ttgctgtgaggctgtcctgt

SEQ ID NO: 306301 - DNA, 15 bp, Homo sapiens
ttgctgtgccaaagc

SEQ ID NO: 306302 - DNA, 15 bp, Homo sapiens
ttgctgtgccaggag

SEQ ID NO: 306303 - DNA, 20 bp, Homo sapiens
ttgctgtgtcataccaggcc

SEQ ID NO: 306304 - DNA, 22 bp, Homo sapiens
ttgctgtttagcttcctccaga

SEQ ID NO: 306305 - DNA, 17 bp, Homo sapiens
ttgctgtttatatatat

SEQ ID NO: 306306 - DNA, 14 bp, Homo sapiens
ttgcttaattgtga

SEQ ID NO: 306307 - DNA, 17 bp, Homo sapiens
ttgcttaattgtgaaca

SEQ ID NO: 306308 - DNA, 18 bp, Homo sapiens
ttgcttattgttccaaga

SEQ ID NO: 306309 - DNA, 20 bp, Homo sapiens
ttgcttattgttccaagaca

SEQ ID NO: 306310 - DNA, 13 bp, Homo sapiens
ttgtatatatctg

SEQ ID NO: 306311 - DNA, 14 bp, Homo sapiens
ttgtatatatgtgt

SEQ ID NO: 306312 - DNA, 15 bp, Homo sapiens
ttgtatatatgtgtg

SEQ ID NO: 306313 - DNA, 16 bp, Homo sapiens
ttgtatatatgtgtgt

SEQ ID NO: 306314 - DNA, 13 bp, Homo sapiens
ttgtatctagtgc

SEQ ID NO: 306315 - DNA, 18 bp, Homo sapiens
ttgtatctagtgcagctg

SEQ ID NO: 306316 - DNA, 20 bp, Homo sapiens
ttgtatctagtgcagctgat

SEQ ID NO: 306317 - DNA, 22 bp, Homo sapiens
ttgtatgaaagatggctgtgcc

SEQ ID NO: 306318 - DNA, 15 bp, Homo sapiens
ttgtatgaagtactt

SEQ ID NO: 306319 - DNA, 18 bp, Homo sapiens
ttgtatgatgtgttgtga

SEQ ID NO: 306320 - DNA, 12 bp, Homo sapiens
ttgtatgccttt

SEQ ID NO: 306321 - DNA, 21 bp, Homo sapiens
ttgtatgcctttaaatctgtg

SEQ ID NO: 306322 - DNA, 12 bp, Homo sapiens
ttgtatgtatgt

SEQ ID NO: 306323 - DNA, 15 bp, Homo sapiens
ttgtatgtatgtgta

SEQ ID NO: 306324 - DNA, 12 bp, Homo sapiens
ttgtatgttaaa

SEQ ID NO: 306325 - DNA, 17 bp, Homo sapiens
ttgtatgttatgaacat

SEQ ID NO: 306326 - DNA, 16 bp, Homo sapiens
ttgtattaaacttgaa

SEQ ID NO: 306327 - DNA, 20 bp, Homo sapiens
ttgtattatcagtgaatata

SEQ ID NO: 306328 - DNA, 14 bp, Homo sapiens
ttgtattatttgga

SEQ ID NO: 306329 - DNA, 15 bp, Homo sapiens
ttgtattctctgtcc

SEQ ID NO: 306330 - DNA, 10 bp, Homo sapiens
ttgtatttct

SEQ ID NO: 306331 - DNA, 11 bp, Homo sapiens
ttgtatttctt

SEQ ID NO: 306332 - DNA, 14 bp, Homo sapiens
ttgtattttagtat

SEQ ID NO: 306333 - DNA, 18 bp, Homo sapiens
ttgtattttcttcccatt

SEQ ID NO: 306334 - DNA, 22 bp, Homo sapiens
ttgtattttcttcccatttgta

SEQ ID NO: 306335 - DNA, 20 bp, Homo sapiens
ttgtatttttagtagagaca

SEQ ID NO: 306336 - DNA, 15 bp, Homo sapiens
ttgtcaaaaaccaga

SEQ ID NO: 306337 - DNA, 22 bp, Homo sapiens
ttgtcaaactgtagaaatgatg

SEQ ID NO: 306338 - DNA, 20 bp, Homo sapiens
ttgtcaagtctctgctggcc

SEQ ID NO: 306339 - DNA, 18 bp, Homo sapiens
ttgtcaatgctctaacaa

SEQ ID NO: 306340 - DNA, 18 bp, Homo sapiens
ttgtcaatggaagaaacc

SEQ ID NO: 306341 - DNA, 13 bp, Homo sapiens
ttgtcacaataaa

SEQ ID NO: 306342 - DNA, 14 bp, Homo sapiens
ttgtcacaataaat

SEQ ID NO: 306343 - DNA, 17 bp, Homo sapiens
ttgtcacagaaatcaga

SEQ ID NO: 306344 - DNA, 20 bp, Homo sapiens
ttgtcacagaaatcagagga

SEQ ID NO: 306345 - DNA, 23 bp, Homo sapiens
ttgtcaccagttaaaagcatttt

SEQ ID NO: 306346 - DNA, 13 bp, Homo sapiens
ttgtcactgaata

SEQ ID NO: 306347 - DNA, 21 bp, Homo sapiens
ttgtcactggaacctccctgg

SEQ ID NO: 306348 - DNA, 16 bp, Homo sapiens
ttgtcacttctgctgt

SEQ ID NO: 306349 - DNA, 13 bp, Homo sapiens
ttgtcagagctgg

SEQ ID NO: 306350 - DNA, 15 bp, Homo sapiens
ttgtcagagctggga

SEQ ID NO: 306351 - DNA, 15 bp, Homo sapiens
ttgtcagtatctgta

SEQ ID NO: 306352 - DNA, 23 bp, Homo sapiens
ttgtcatcattgtatatatgtgt

SEQ ID NO: 306353 - DNA, 13 bp, Homo sapiens
ttgtcatgtgtat

SEQ ID NO: 306354 - DNA, 22 bp, Homo sapiens
ttgtcatgtgtataaaaataaa

SEQ ID NO: 306355 - DNA, 21 bp, Homo sapiens
ttgtcattcaagcctgtgaat

SEQ ID NO: 306356 - DNA, 20 bp, Homo sapiens
ttgtcattcttacaaaacat

SEQ ID NO: 306357 - DNA, 13 bp, Homo sapiens
ttgtcattgcttt

SEQ ID NO: 306358 - DNA, 17 bp, Homo sapiens
ttgtccaagttcacagt

SEQ ID NO: 306359 - DNA, 14 bp, Homo sapiens
ttgtccacaaatgt

SEQ ID NO: 306360 - DNA, 23 bp, Homo sapiens
ttgtccacaaatgtcctcagagg

SEQ ID NO: 306361 - DNA, 21 bp, Homo sapiens
ttgtccacattctacttcagc

SEQ ID NO: 306362 - DNA, 22 bp, Homo sapiens
ttgtccatatcagacctctgat

SEQ ID NO: 306363 - DNA, 13 bp, Homo sapiens
ttgtccatgccta

SEQ ID NO: 306364 - DNA, 21 bp, Homo sapiens
ttgtccatgcctacagataat

SEQ ID NO: 306365 - DNA, 18 bp, Homo sapiens
ttgtccatttacctggaa

SEQ ID NO: 306366 - DNA, 14 bp, Homo sapiens
ttgtcccacagctt

SEQ ID NO: 306367 - DNA, 14 bp, Homo sapiens
ttgtcccccaactt

SEQ ID NO: 306368 - DNA, 15 bp, Homo sapiens
ttgtccctgtgccta

SEQ ID NO: 306369 - DNA, 19 bp, Homo sapiens
ttgtcctgatgcttttgtc

SEQ ID NO: 306370 - DNA, 17 bp, Homo sapiens
ttgtcctgcagagctgg

SEQ ID NO: 306371 - DNA, 16 bp, Homo sapiens
ttgtcctgccagctgc

SEQ ID NO: 306372 - DNA, 19 bp, Homo sapiens
ttgtcctgtatagcaacct

SEQ ID NO: 306373 - DNA, 20 bp, Homo sapiens
ttgtcctgtgtcatctgtca

SEQ ID NO: 306374 - DNA, 17 bp, Homo sapiens
ttgtcctttaactatca

SEQ ID NO: 306375 - DNA, 17 bp, Homo sapiens
ttgtcctttgagaaaga

SEQ ID NO: 306376 - DNA, 16 bp, Homo sapiens
ttgtctattctgagcc

SEQ ID NO: 306377 - DNA, 19 bp, Homo sapiens
ttgtctcaaagcatcaaat

SEQ ID NO: 306378 - DNA, 20 bp, Homo sapiens
ttgtctcaaagcatcaaata

SEQ ID NO: 306379 - DNA, 23 bp, Homo sapiens
ttgtctcaaagcatcaaataata

SEQ ID NO: 306380 - DNA, 13 bp, Homo sapiens
ttgtctcaagatt

SEQ ID NO: 306381 - DNA, 13 bp, Homo sapiens
ttgtctcaccagc

SEQ ID NO: 306382 - DNA, 16 bp, Homo sapiens
ttgtctcattttgtat

SEQ ID NO: 306383 - DNA, 16 bp, Homo sapiens
ttgtctcctactctgt

SEQ ID NO: 306384 - DNA, 20 bp, Homo sapiens
ttgtctcttcctctgcagga

SEQ ID NO: 306385 - DNA, 14 bp, Homo sapiens
ttgtctgaggcctc

SEQ ID NO: 306386 - DNA, 19 bp, Homo sapiens
ttgtctgaggcctcatccc

SEQ ID NO: 306387 - DNA, 20 bp, Homo sapiens
ttgtctgccgtgagagccca

SEQ ID NO: 306388 - DNA, 12 bp, Homo sapiens
ttgtctgctgct

SEQ ID NO: 306389 - DNA, 13 bp, Homo sapiens
ttgtctgctgctc

SEQ ID NO: 306390 - DNA, 14 bp, Homo sapiens
ttgtctttaactgt

SEQ ID NO: 306391 - DNA, 11 bp, Homo sapiens
ttgtctttctt

SEQ ID NO: 306392 - DNA, 16 bp, Homo sapiens
ttgtctttttccttta

SEQ ID NO: 306393 - DNA, 20 bp, Homo sapiens
ttgtcttttttttcatcctt

SEQ ID NO: 306394 - DNA, 17 bp, Homo sapiens
ttgtgaaatgaaaacat

SEQ ID NO: 306395 - DNA, 16 bp, Homo sapiens
ttgtgaaatttgttaa

SEQ ID NO: 306396 - DNA, 13 bp, Homo sapiens
ttgtgaagtgatt

SEQ ID NO: 306397 - DNA, 13 bp, Homo sapiens
ttgtgactagtgc

SEQ ID NO: 306398 - DNA, 17 bp, Homo sapiens
ttgtgactagtgctgaa

SEQ ID NO: 306399 - DNA, 15 bp, Homo sapiens
ttgtgactatataga

SEQ ID NO: 306400 - DNA, 13 bp, Homo sapiens
ttgtgagccttgc

SEQ ID NO: 306401 - DNA, 16 bp, Homo sapiens
ttgtgatatggagccc

SEQ ID NO: 306402 - DNA, 20 bp, Homo sapiens
ttgtgatattgaccatgtga

SEQ ID NO: 306403 - DNA, 23 bp, Homo sapiens
ttgtgatcagaccataatgttac

SEQ ID NO: 306404 - DNA, 16 bp, Homo sapiens
ttgtgatgatgctgtg

SEQ ID NO: 306405 - DNA, 16 bp, Homo sapiens
ttgtgatttttataat

SEQ ID NO: 306406 - DNA, 18 bp, Homo sapiens
ttgtgcaaaagcaggctt

SEQ ID NO: 306407 - DNA, 23 bp, Homo sapiens
ttgtgcattggataacaccacca

SEQ ID NO: 306408 - DNA, 22 bp, Homo sapiens
ttgtgccctgcccccatctccc

SEQ ID NO: 306409 - DNA, 17 bp, Homo sapiens
ttgtgcctcttgggaga

SEQ ID NO: 306410 - DNA, 18 bp, Homo sapiens
ttgtgcctcttgggagac

SEQ ID NO: 306411 - DNA, 16 bp, Homo sapiens
ttgtgccttttatagc

SEQ ID NO: 306412 - DNA, 16 bp, Homo sapiens
ttgtgctaatttctgt

SEQ ID NO: 306413 - DNA, 17 bp, Homo sapiens
ttgtgctaatttctgtc

SEQ ID NO: 306414 - DNA, 14 bp, Homo sapiens
ttgtgctctttcct

SEQ ID NO: 306415 - DNA, 22 bp, Homo sapiens
ttgtgctgatcgtgctaaattt

SEQ ID NO: 306416 - DNA, 15 bp, Homo sapiens
ttgtgcttgttcttc

SEQ ID NO: 306417 - DNA, 14 bp, Homo sapiens
ttgtgcttgtttac

SEQ ID NO: 306418 - DNA, 12 bp, Homo sapiens
ttgtggacttta

SEQ ID NO: 306419 - DNA, 13 bp, Homo sapiens
ttgtggactttat

SEQ ID NO: 306420 - DNA, 14 bp, Homo sapiens
ttgtggatgtcttc

SEQ ID NO: 306421 - DNA, 21 bp, Homo sapiens
ttgtggcccccgccccctccc

SEQ ID NO: 306422 - DNA, 19 bp, Homo sapiens
ttgtggctcctatctgtgt

SEQ ID NO: 306423 - DNA, 14 bp, Homo sapiens
ttgtggctttatga

SEQ ID NO: 306424 - DNA, 11 bp, Homo sapiens
ttgtgggcgct

SEQ ID NO: 306425 - DNA, 20 bp, Homo sapiens
ttgtgtacagtatgtgtcta

SEQ ID NO: 306426 - DNA, 22 bp, Homo sapiens
ttgtgtatggatatgtgtaaat

SEQ ID NO: 306427 - DNA, 19 bp, Homo sapiens
ttgtgtcagagctgggagt

SEQ ID NO: 306428 - DNA, 18 bp, Homo sapiens
ttgtgtcccatgatccct

SEQ ID NO: 306429 - DNA, 17 bp, Homo sapiens
ttgtgtggtattcaact

SEQ ID NO: 306430 - DNA, 19 bp, Homo sapiens
ttgtgtgtgggctgtgagt

SEQ ID NO: 306431 - DNA, 12 bp, Homo sapiens
ttgtgtgtgtgc

SEQ ID NO: 306432 - DNA, 21 bp, Homo sapiens
ttgtgttcagttccagctttt

SEQ ID NO: 306433 - DNA, 17 bp, Homo sapiens
ttgtgtttgcttaaaca

SEQ ID NO: 306434 - DNA, 21 bp, Homo sapiens
ttgtgtttttaatttatttat

SEQ ID NO: 306435 - DNA, 18 bp, Homo sapiens
ttgttaaaaccttactta

SEQ ID NO: 306436 - DNA, 20 bp, Homo sapiens
ttgttaaaactggcatctga

SEQ ID NO: 306437 - DNA, 18 bp, Homo sapiens
ttgttaactcttgtctat

SEQ ID NO: 306438 - DNA, 18 bp, Homo sapiens
ttgttaagctcaggattt

SEQ ID NO: 306439 - DNA, 17 bp, Homo sapiens
ttgttaatgaaaatgtc

SEQ ID NO: 306440 - DNA, 17 bp, Homo sapiens
ttgttacaattctagga

SEQ ID NO: 306441 - DNA, 22 bp, Homo sapiens
tttaactcatacctttaaagga

SEQ ID NO: 306442 - DNA, 23 bp, Homo sapiens
tttaactgactattcttgatgta

SEQ ID NO: 306443 - DNA, 13 bp, Homo sapiens
tttaactgctgca

SEQ ID NO: 306444 - DNA, 13 bp, Homo sapiens
tttaacttctgcc

SEQ ID NO: 306445 - DNA, 19 bp, Homo sapiens
tttaacttgagggtaataa

SEQ ID NO: 306446 - DNA, 18 bp, Homo sapiens
tttaactttaagtttcag

SEQ ID NO: 306447 - DNA, 18 bp, Homo sapiens
tttaagaaaaaataacac

SEQ ID NO: 306448 - DNA, 22 bp, Homo sapiens
tttaagaaaaaataacacacat

SEQ ID NO: 306449 - DNA, 16 bp, Homo sapiens
tttaagaaaatacaat

SEQ ID NO: 306450 - DNA, 20 bp, Homo sapiens
tttaagaaaatacaataaac

SEQ ID NO: 306451 - DNA, 22 bp, Homo sapiens
tttaagaaaatacaataaacta

SEQ ID NO: 306452 - DNA, 20 bp, Homo sapiens
tttaagaatagttctaaaat

SEQ ID NO: 306453 - DNA, 22 bp, Homo sapiens
tttaagacagtcccatcaaaac

SEQ ID NO: 306454 - DNA, 15 bp, Homo sapiens
tttaagataattata

SEQ ID NO: 306455 - DNA, 15 bp, Homo sapiens
tttaagcactcttaa

SEQ ID NO: 306456 - DNA, 21 bp, Homo sapiens
tttaagcattttactgtctgt

SEQ ID NO: 306457 - DNA, 17 bp, Homo sapiens
tttaagccaataaataa

SEQ ID NO: 306458 - DNA, 18 bp, Homo sapiens
tttaagccaataaataat

SEQ ID NO: 306459 - DNA, 15 bp, Homo sapiens
tttaagctccagctt

SEQ ID NO: 306460 - DNA, 17 bp, Homo sapiens
tttaagctccagcttta

SEQ ID NO: 306461 - DNA, 14 bp, Homo sapiens
tttaagctgtaaaa

SEQ ID NO: 306462 - DNA, 12 bp, Homo sapiens
tttaagctgttt

SEQ ID NO: 306463 - DNA, 16 bp, Homo sapiens
tttaagggttgtgagc

SEQ ID NO: 306464 - DNA, 10 bp, Homo sapiens
tttaagtcct

SEQ ID NO: 306465 - DNA, 18 bp, Homo sapiens
tttaagtgctttgtaatg

SEQ ID NO: 306466 - DNA, 11 bp, Homo sapiens
tttaataaaag

SEQ ID NO: 306467 - DNA, 23 bp, Homo sapiens
tttaataactttgctggaaaatc

SEQ ID NO: 306468 - DNA, 20 bp, Homo sapiens
tttaatacctttaaatatca

SEQ ID NO: 306469 - DNA, 17 bp, Homo sapiens
tttaatagtcattccaa

SEQ ID NO: 306470 - DNA, 19 bp, Homo sapiens
tttaatagtggcaaatgaa

SEQ ID NO: 306471 - DNA, 13 bp, Homo sapiens
tttaatagtttct

SEQ ID NO: 306472 - DNA, 22 bp, Homo sapiens
tttaatatactaaccatttctt

SEQ ID NO: 306473 - DNA, 14 bp, Homo sapiens
tttaatattactgt

SEQ ID NO: 306474 - DNA, 17 bp, Homo sapiens
tttaatattactgtctt

SEQ ID NO: 306475 - DNA, 20 bp, Homo sapiens
tttaatattactgtctttat

SEQ ID NO: 306476 - DNA, 17 bp, Homo sapiens
tttaatcaaatttgtag

SEQ ID NO: 306477 - DNA, 15 bp, Homo sapiens
tttaatcatttccag

SEQ ID NO: 306478 - DNA, 14 bp, Homo sapiens
tttaatccagaatt

SEQ ID NO: 306479 - DNA, 21 bp, Homo sapiens
tttaatccagaattgaccttt

SEQ ID NO: 306480 - DNA, 21 bp, Homo sapiens
tttaatgatactgtctaagaa

SEQ ID NO: 306481 - DNA, 18 bp, Homo sapiens
tttaatgatttttgtgta

SEQ ID NO: 306482 - DNA, 22 bp, Homo sapiens
tttaatgatttttgtgtatcca

SEQ ID NO: 306483 - DNA, 19 bp, Homo sapiens
tttaatggggtgcacctgt

SEQ ID NO: 306484 - DNA, 17 bp, Homo sapiens
tttaatgttatcctctt

SEQ ID NO: 306485 - DNA, 23 bp, Homo sapiens
tttaattattattcttcataaca

SEQ ID NO: 306486 - DNA, 12 bp, Homo sapiens
tttaattcagtt

SEQ ID NO: 306487 - DNA, 22 bp, Homo sapiens
tttaattccccttcccttattt

SEQ ID NO: 306488 - DNA, 15 bp, Homo sapiens
tttaatttcataaat

SEQ ID NO: 306489 - DNA, 11 bp, Homo sapiens
tttacaaaaga

SEQ ID NO: 306490 - DNA, 16 bp, Homo sapiens
tttacaaactgaagat

SEQ ID NO: 306491 - DNA, 15 bp, Homo sapiens
tttacaaataaagat

SEQ ID NO: 306492 - DNA, 12 bp, Homo sapiens
tttacaactaaa

SEQ ID NO: 306493 - DNA, 16 bp, Homo sapiens
tttacaactaaataac

SEQ ID NO: 306494 - DNA, 21 bp, Homo sapiens
tttacaagtgtatatcagaaa

SEQ ID NO: 306495 - DNA, 13 bp, Homo sapiens
tttacacagcaat

SEQ ID NO: 306496 - DNA, 17 bp, Homo sapiens
tttacagaaaaatcttg

SEQ ID NO: 306497 - DNA, 21 bp, Homo sapiens
tttacagcactactctgtgcc

SEQ ID NO: 306498 - DNA, 13 bp, Homo sapiens
tttacagctgcct

SEQ ID NO: 306499 - DNA, 16 bp, Homo sapiens
tttacagctgcctgca

SEQ ID NO: 306500 - DNA, 23 bp, Homo sapiens
tttacagctttcatgattagcaa

SEQ ID NO: 306501 - DNA, 18 bp, Homo sapiens
tttacagcttttctcttt

SEQ ID NO: 306502 - DNA, 18 bp, Homo sapiens
tttacaggaaattgcaaa

SEQ ID NO: 306503 - DNA, 16 bp, Homo sapiens
tttacagtccttcaaa

SEQ ID NO: 306504 - DNA, 14 bp, Homo sapiens
tttacagttactgc

SEQ ID NO: 306505 - DNA, 21 bp, Homo sapiens
tttacatacagtgatatggta

SEQ ID NO: 306506 - DNA, 20 bp, Homo sapiens
tttacattgtaaatagtatt

SEQ ID NO: 306507 - DNA, 13 bp, Homo sapiens
tttacattttatt

SEQ ID NO: 306508 - DNA, 18 bp, Homo sapiens
tttacattttcagtacca

SEQ ID NO: 306509 - DNA, 23 bp, Homo sapiens
tttaccatttgtaataaagtata

SEQ ID NO: 306510 - DNA, 22 bp, Homo sapiens
tttaccattttgcgatgtgttt

SEQ ID NO: 306511 - DNA, 21 bp, Homo sapiens
tttacccaataagatacatca

SEQ ID NO: 306512 - DNA, 18 bp, Homo sapiens
tttacctaccacagtgtc

SEQ ID NO: 306513 - DNA, 18 bp, Homo sapiens
tttacctcactggtgcat

SEQ ID NO: 306514 - DNA, 16 bp, Homo sapiens
tttacctgagaccagt

SEQ ID NO: 306515 - DNA, 17 bp, Homo sapiens
tttacctggaaaccaga

SEQ ID NO: 306516 - DNA, 16 bp, Homo sapiens
tttaccttcagcagtt

SEQ ID NO: 306517 - DNA, 22 bp, Homo sapiens
tttaccttcatttcatcctgtt

SEQ ID NO: 306518 - DNA, 17 bp, Homo sapiens
tttacctttattaatga

SEQ ID NO: 306519 - DNA, 17 bp, Homo sapiens
tttaccttttctgttgt

SEQ ID NO: 306520 - DNA, 17 bp, Homo sapiens
tttacgtaaaaagatat

SEQ ID NO: 306521 - DNA, 20 bp, Homo sapiens
tttacgttgtaccattctgt

SEQ ID NO: 306522 - DNA, 20 bp, Homo sapiens
tttactaaagatatcagagc

SEQ ID NO: 306523 - DNA, 13 bp, Homo sapiens
tttactaaagcag

SEQ ID NO: 306524 - DNA, 22 bp, Homo sapiens
tttactacataattaaatttta

SEQ ID NO: 306525 - DNA, 21 bp, Homo sapiens
tttactacccaaatctaaata

SEQ ID NO: 306526 - DNA, 14 bp, Homo sapiens
tttactactgcaag

SEQ ID NO: 306527 - DNA, 19 bp, Homo sapiens
tttactcccttcctggcct

SEQ ID NO: 306528 - DNA, 13 bp, Homo sapiens
tttactgaacaat

SEQ ID NO: 306529 - DNA, 14 bp, Homo sapiens
tttactgagcttct

SEQ ID NO: 306530 - DNA, 18 bp, Homo sapiens
tttactgagcttctctgt

SEQ ID NO: 306531 - DNA, 22 bp, Homo sapiens
tttactgccaaagggaaatatc

SEQ ID NO: 306532 - DNA, 12 bp, Homo sapiens
tttactgctgtc

SEQ ID NO: 306533 - DNA, 22 bp, Homo sapiens
tttactgctgtcattgtccatg

SEQ ID NO: 306534 - DNA, 16 bp, Homo sapiens
tttacttatcttatgc

SEQ ID NO: 306535 - DNA, 17 bp, Homo sapiens
tttacttatcttatgcc

SEQ ID NO: 306536 - DNA, 14 bp, Homo sapiens
tttacttccacaga

SEQ ID NO: 306537 - DNA, 14 bp, Homo sapiens
tttacttcttatac

SEQ ID NO: 306538 - DNA, 14 bp, Homo sapiens
tttacttggaaata

SEQ ID NO: 306539 - DNA, 14 bp, Homo sapiens
tttactttgtgcaa

SEQ ID NO: 306540 - DNA, 11 bp, Homo sapiens
tttagaaatta

SEQ ID NO: 306541 - DNA, 14 bp, Homo sapiens
tttagaaattacaa

SEQ ID NO: 306542 - DNA, 16 bp, Homo sapiens
tttagaacagaaaaca

SEQ ID NO: 306543 - DNA, 23 bp, Homo sapiens
tttagaacagaaaacaacaaaaa

SEQ ID NO: 306544 - DNA, 19 bp, Homo sapiens
tttagaagtgcatttctga

SEQ ID NO: 306545 - DNA, 17 bp, Homo sapiens
tttagaatttgaaagga

SEQ ID NO: 306546 - DNA, 19 bp, Homo sapiens
tttagaatttgaaaggaaa

SEQ ID NO: 306547 - DNA, 17 bp, Homo sapiens
tttagagatattttcca

SEQ ID NO: 306548 - DNA, 19 bp, Homo sapiens
tttagagatattttccatt

SEQ ID NO: 306549 - DNA, 23 bp, Homo sapiens
tttagagtatgcaagaagaatat

SEQ ID NO: 306550 - DNA, 14 bp, Homo sapiens
tttagcagttctgc

SEQ ID NO: 306551 - DNA, 21 bp, Homo sapiens
tttagcagttctgcaaataga

SEQ ID NO: 306552 - DNA, 23 bp, Homo sapiens
tttagcatgacaagccccaggca

SEQ ID NO: 306553 - DNA, 19 bp, Homo sapiens
tttagctagtatcttcaaa

SEQ ID NO: 306554 - DNA, 16 bp, Homo sapiens
tttagcttctctgcca

SEQ ID NO: 306555 - DNA, 16 bp, Homo sapiens
tttaggaatgctcaat

SEQ ID NO: 306556 - DNA, 11 bp, Homo sapiens
tttaggagaaa

SEQ ID NO: 306557 - DNA, 14 bp, Homo sapiens
tttaggagaagttg

SEQ ID NO: 306558 - DNA, 11 bp, Homo sapiens
tttaggcagcc

SEQ ID NO: 306559 - DNA, 17 bp, Homo sapiens
tttaggcagcctgccgc

SEQ ID NO: 306560 - DNA, 22 bp, Homo sapiens
tttaggcaggaagtcaggagcc

SEQ ID NO: 306561 - DNA, 19 bp, Homo sapiens
tttaggcagggatttgagg

SEQ ID NO: 306562 - DNA, 20 bp, Homo sapiens
tttagggagacccaataaag

SEQ ID NO: 306563 - DNA, 23 bp, Homo sapiens
tttagggagacccaataaagaat

SEQ ID NO: 306564 - DNA, 21 bp, Homo sapiens
tttagggatctggggaaggac

SEQ ID NO: 306565 - DNA, 16 bp, Homo sapiens
tttagggtaaaaattg

SEQ ID NO: 306566 - DNA, 13 bp, Homo sapiens
tttaggtgtcttt

SEQ ID NO: 306567 - DNA, 21 bp, Homo sapiens
tttagtcacgtgtattttcat

SEQ ID NO: 306568 - DNA, 12 bp, Homo sapiens
tttagtgcaatt

SEQ ID NO: 306569 - DNA, 15 bp, Homo sapiens
tttagtgcaatttct

SEQ ID NO: 306570 - DNA, 16 bp, Homo sapiens
tttagtgtattttctg

SEQ ID NO: 306571 - DNA, 19 bp, Homo sapiens
tttctagaaaagcttccta

SEQ ID NO: 306572 - DNA, 22 bp, Homo sapiens
tttctagctagaaatatgattt

SEQ ID NO: 306573 - DNA, 18 bp, Homo sapiens
tttctagctataacaact

SEQ ID NO: 306574 - DNA, 21 bp, Homo sapiens
tttctagctgttgagctgttt

SEQ ID NO: 306575 - DNA, 23 bp, Homo sapiens
tttctaggtcaaggcctgtccct

SEQ ID NO: 306576 - DNA, 14 bp, Homo sapiens
tttctatgtaaatt

SEQ ID NO: 306577 - DNA, 21 bp, Homo sapiens
tttctatgtaaattattgtaa

SEQ ID NO: 306578 - DNA, 17 bp, Homo sapiens
tttctatgtagaactgt

SEQ ID NO: 306579 - DNA, 18 bp, Homo sapiens
tttctatgtatgtgccaa

SEQ ID NO: 306580 - DNA, 18 bp, Homo sapiens
tttctattccttctggcc

SEQ ID NO: 306581 - DNA, 14 bp, Homo sapiens
tttctcaaaagcat

SEQ ID NO: 306582 - DNA, 21 bp, Homo sapiens
tttctcaaagtttttacagtg

SEQ ID NO: 306583 - DNA, 14 bp, Homo sapiens
tttctcactccctt

SEQ ID NO: 306584 - DNA, 11 bp, Homo sapiens
tttctcatgtg

SEQ ID NO: 306585 - DNA, 14 bp, Homo sapiens
tttctccatcccct

SEQ ID NO: 306586 - DNA, 16 bp, Homo sapiens
tttctccatcccctcc

SEQ ID NO: 306587 - DNA, 17 bp, Homo sapiens
tttctccatcccctccc

SEQ ID NO: 306588 - DNA, 20 bp, Homo sapiens
tttctccatcccctccctgc

SEQ ID NO: 306589 - DNA, 22 bp, Homo sapiens
tttctccatcccctccctgcct

SEQ ID NO: 306590 - DNA, 23 bp, Homo sapiens
tttctccatcccctccctgcctg

SEQ ID NO: 306591 - DNA, 12 bp, Homo sapiens
tttctcccagct

SEQ ID NO: 306592 - DNA, 21 bp, Homo sapiens
tttctcccccgacactgctgc

SEQ ID NO: 306593 - DNA, 18 bp, Homo sapiens
tttctcctccccaaggac

SEQ ID NO: 306594 - DNA, 16 bp, Homo sapiens
tttctcgagtccaaaa

SEQ ID NO: 306595 - DNA, 21 bp, Homo sapiens
tttctcgagtccaaaatcatt

SEQ ID NO: 306596 - DNA, 22 bp, Homo sapiens
tttctctaacttcaaggcccat

SEQ ID NO: 306597 - DNA, 11 bp, Homo sapiens
tttctctctgt

SEQ ID NO: 306598 - DNA, 21 bp, Homo sapiens
tttctctgcttcagcttgctt

SEQ ID NO: 306599 - DNA, 11 bp, Homo sapiens
tttctctgtgc

SEQ ID NO: 306600 - DNA, 18 bp, Homo sapiens
tttctctgtgtttgttcc

SEQ ID NO: 306601 - DNA, 19 bp, Homo sapiens
tttctcttcagtgtgttga

SEQ ID NO: 306602 - DNA, 21 bp, Homo sapiens
tttctcttcagtgtgttgact

SEQ ID NO: 306603 - DNA, 16 bp, Homo sapiens
tttctcttctgtccat

SEQ ID NO: 306604 - DNA, 22 bp, Homo sapiens
tttctcttctgtccatcagtgc

SEQ ID NO: 306605 - DNA, 12 bp, Homo sapiens
tttctcttgggc

SEQ ID NO: 306606 - DNA, 21 bp, Homo sapiens
tttctcttgggctgagactgg

SEQ ID NO: 306607 - DNA, 13 bp, Homo sapiens
tttctctttcagt

SEQ ID NO: 306608 - DNA, 22 bp, Homo sapiens
tttctctttttttaaaaagttg

SEQ ID NO: 306609 - DNA, 13 bp, Homo sapiens
tttctgcagaggc

SEQ ID NO: 306610 - DNA, 17 bp, Homo sapiens
tttctgcagaggcagca

SEQ ID NO: 306611 - DNA, 16 bp, Homo sapiens
tttctgccagggagct

SEQ ID NO: 306612 - DNA, 12 bp, Homo sapiens
tttctgccctgc

SEQ ID NO: 306613 - DNA, 22 bp, Homo sapiens
tttctggaaattcttccctggg

SEQ ID NO: 306614 - DNA, 11 bp, Homo sapiens
tttctggctcc

SEQ ID NO: 306615 - DNA, 17 bp, Homo sapiens
tttctggtagatagaaa

SEQ ID NO: 306616 - DNA, 19 bp, Homo sapiens
tttctggtagatagaaata

SEQ ID NO: 306617 - DNA, 13 bp, Homo sapiens
tttctgtaaataa

SEQ ID NO: 306618 - DNA, 14 bp, Homo sapiens
tttctgtctcccct

SEQ ID NO: 306619 - DNA, 22 bp, Homo sapiens
tttctgtggagagtgagaataa

SEQ ID NO: 306620 - DNA, 20 bp, Homo sapiens
tttctgtgtgcaccttacca

SEQ ID NO: 306621 - DNA, 15 bp, Homo sapiens
tttctgttccctgct

SEQ ID NO: 306622 - DNA, 13 bp, Homo sapiens
tttctgttctgcc

SEQ ID NO: 306623 - DNA, 20 bp, Homo sapiens
tttctgtttcttcttgtgat

SEQ ID NO: 306624 - DNA, 18 bp, Homo sapiens
tttcttagtcgaatgtta

SEQ ID NO: 306625 - DNA, 19 bp, Homo sapiens
tttcttagtttcagaagta

SEQ ID NO: 306626 - DNA, 18 bp, Homo sapiens
tttcttcaacatcaatgt

SEQ ID NO: 306627 - DNA, 20 bp, Homo sapiens
tttcttcaagtgagtggcat

SEQ ID NO: 306628 - DNA, 23 bp, Homo sapiens
tttcttcaagtgagtggcatgtg

SEQ ID NO: 306629 - DNA, 15 bp, Homo sapiens
tttcttcactgcaga

SEQ ID NO: 306630 - DNA, 21 bp, Homo sapiens
tttcttcactgttgaaaatta

SEQ ID NO: 306631 - DNA, 16 bp, Homo sapiens
tttcttcccatttgta

SEQ ID NO: 306632 - DNA, 20 bp, Homo sapiens
tttcttcccccgctaattca

SEQ ID NO: 306633 - DNA, 23 bp, Homo sapiens
tttcttccctcatgttctcatgt

SEQ ID NO: 306634 - DNA, 14 bp, Homo sapiens
tttcttcctgcaga

SEQ ID NO: 306635 - DNA, 18 bp, Homo sapiens
tttcttctacaaccagag

SEQ ID NO: 306636 - DNA, 12 bp, Homo sapiens
tttcttctgtag

SEQ ID NO: 306637 - DNA, 13 bp, Homo sapiens
tttcttcttccct

SEQ ID NO: 306638 - DNA, 16 bp, Homo sapiens
tttcttgcaaaacaaa

SEQ ID NO: 306639 - DNA, 17 bp, Homo sapiens
tttcttgcaaaacaaac

SEQ ID NO: 306640 - DNA, 19 bp, Homo sapiens
tttcttgcactattccaca

SEQ ID NO: 306641 - DNA, 23 bp, Homo sapiens
tttcttgccaatgaggtctgaaa

SEQ ID NO: 306642 - DNA, 18 bp, Homo sapiens
tttcttgccccagtgtgg

SEQ ID NO: 306643 - DNA, 21 bp, Homo sapiens
tttcttggcgttcctgccagg

SEQ ID NO: 306644 - DNA, 19 bp, Homo sapiens
tttcttgtaaacctggagg

SEQ ID NO: 306645 - DNA, 12 bp, Homo sapiens
tttcttgtttac

SEQ ID NO: 306646 - DNA, 20 bp, Homo sapiens
tttctttaagataatagttt

SEQ ID NO: 306647 - DNA, 15 bp, Homo sapiens
tttctttatttctgt

SEQ ID NO: 306648 - DNA, 17 bp, Homo sapiens
tttctttatttctgtct

SEQ ID NO: 306649 - DNA, 15 bp, Homo sapiens
tttctttctgtctct

SEQ ID NO: 306650 - DNA, 22 bp, Homo sapiens
tttctttgaatgctttttgaat

SEQ ID NO: 306651 - DNA, 13 bp, Homo sapiens
tttctttgctgct

SEQ ID NO: 306652 - DNA, 15 bp, Homo sapiens
tttctttgctgtgcc

SEQ ID NO: 306653 - DNA, 13 bp, Homo sapiens
tttcttttatata

SEQ ID NO: 306654 - DNA, 18 bp, Homo sapiens
tttcttttatatataaaa

SEQ ID NO: 306655 - DNA, 22 bp, Homo sapiens
tttcttttctggaatgtaatca

SEQ ID NO: 306656 - DNA, 18 bp, Homo sapiens
tttcttttgaatcaatct

SEQ ID NO: 306657 - DNA, 14 bp, Homo sapiens
tttcttttttaaat

SEQ ID NO: 306658 - DNA, 23 bp, Homo sapiens
tttgaaaacaccaagagtacagg

SEQ ID NO: 306659 - DNA, 14 bp, Homo sapiens
tttgaaaacactta

SEQ ID NO: 306660 - DNA, 22 bp, Homo sapiens
tttgaaaaccaacaccatcaca

SEQ ID NO: 306661 - DNA, 20 bp, Homo sapiens
tttgaaagaagtcaaatgaa

SEQ ID NO: 306662 - DNA, 19 bp, Homo sapiens
tttgaaatagtctgtgtga

SEQ ID NO: 306663 - DNA, 17 bp, Homo sapiens
tttgaaatatgcatgta

SEQ ID NO: 306664 - DNA, 20 bp, Homo sapiens
tttgaaatccagaagtttta

SEQ ID NO: 306665 - DNA, 19 bp, Homo sapiens
tttgaaatgccacgtgcca

SEQ ID NO: 306666 - DNA, 14 bp, Homo sapiens
tttgaaccaaaaca

SEQ ID NO: 306667 - DNA, 16 bp, Homo sapiens
tttgaaccaaaacatt

SEQ ID NO: 306668 - DNA, 23 bp, Homo sapiens
tttgaacctttttttttgaaaca

SEQ ID NO: 306669 - DNA, 21 bp, Homo sapiens
tttgaactgttagatgctgaa

SEQ ID NO: 306670 - DNA, 17 bp, Homo sapiens
tttgaagaagggaaatt

SEQ ID NO: 306671 - DNA, 16 bp, Homo sapiens
tttgaagcagttgtgt

SEQ ID NO: 306672 - DNA, 17 bp, Homo sapiens
tttgaataaaaaacatt

SEQ ID NO: 306673 - DNA, 23 bp, Homo sapiens
tttgaataaaaaacatttgtaca

SEQ ID NO: 306674 - DNA, 15 bp, Homo sapiens
tttgaataatgtagt

SEQ ID NO: 306675 - DNA, 17 bp, Homo sapiens
tttgaatcaaagaatag

SEQ ID NO: 306676 - DNA, 19 bp, Homo sapiens
tttgaatcaatctggcttc

SEQ ID NO: 306677 - DNA, 15 bp, Homo sapiens
tttgaatgaaaaatt

SEQ ID NO: 306678 - DNA, 21 bp, Homo sapiens
tttgaatgaaaaatttaagca

SEQ ID NO: 306679 - DNA, 24 bp, Homo sapiens
tttgaatgaaaaatttaagcattg

SEQ ID NO: 306680 - DNA, 17 bp, Homo sapiens
tttgaatggattaaatg

SEQ ID NO: 306681 - DNA, 19 bp, Homo sapiens
tttgaatggattaaatggc

SEQ ID NO: 306682 - DNA, 17 bp, Homo sapiens
tttgaatggtgcagaaa

SEQ ID NO: 306683 - DNA, 20 bp, Homo sapiens
tttgaatgttatttgttatt

SEQ ID NO: 306684 - DNA, 19 bp, Homo sapiens
tttgaatttaaataaagtt

SEQ ID NO: 306685 - DNA, 13 bp, Homo sapiens
tttgacacactca

SEQ ID NO: 306686 - DNA, 16 bp, Homo sapiens
tttgacacataaaagt

SEQ ID NO: 306687 - DNA, 13 bp, Homo sapiens
tttgacatgtgga

SEQ ID NO: 306688 - DNA, 14 bp, Homo sapiens
tttgacattcttca

SEQ ID NO: 306689 - DNA, 19 bp, Homo sapiens
tttgacatttaataacttt

SEQ ID NO: 306690 - DNA, 14 bp, Homo sapiens
tttgaccccttcct

SEQ ID NO: 306691 - DNA, 18 bp, Homo sapiens
tttgaccccttcctgtct

SEQ ID NO: 306692 - DNA, 20 bp, Homo sapiens
tttgaccccttcctgtctgg

SEQ ID NO: 306693 - DNA, 14 bp, Homo sapiens
tttgacgaagaaac

SEQ ID NO: 306694 - DNA, 21 bp, Homo sapiens
tttgactagggattcaggctg

SEQ ID NO: 306695 - DNA, 17 bp, Homo sapiens
tttgactcattaatttc

SEQ ID NO: 306696 - DNA, 12 bp, Homo sapiens
tttgacttcagc

SEQ ID NO: 306697 - DNA, 13 bp, Homo sapiens
tttgacttcagct

SEQ ID NO: 306698 - DNA, 15 bp, Homo sapiens
tttgactttcttctg

SEQ ID NO: 306699 - DNA, 11 bp, Homo sapiens
tttgagaaaaa

SEQ ID NO: 306700 - DNA, 15 bp, Homo sapiens
tttgagacaagccct

SEQ ID NO: 306701 - DNA, 11 bp, Homo sapiens
ttttatatttg

SEQ ID NO: 306702 - DNA, 17 bp, Homo sapiens
ttttatcatttctactg

SEQ ID NO: 306703 - DNA, 22 bp, Homo sapiens
ttttatctacccagtcatgtac

SEQ ID NO: 306704 - DNA, 13 bp, Homo sapiens
ttttatctcagtg

SEQ ID NO: 306705 - DNA, 19 bp, Homo sapiens
ttttatctgaaatcaatta

SEQ ID NO: 306706 - DNA, 12 bp, Homo sapiens
ttttatgtactt

SEQ ID NO: 306707 - DNA, 18 bp, Homo sapiens
ttttatgtgagagaaagt

SEQ ID NO: 306708 - DNA, 12 bp, Homo sapiens
ttttattgtttt

SEQ ID NO: 306709 - DNA, 16 bp, Homo sapiens
ttttatttaaactatt

SEQ ID NO: 306710 - DNA, 19 bp, Homo sapiens
ttttatttagttgaaaaat

SEQ ID NO: 306711 - DNA, 13 bp, Homo sapiens
ttttatttcagtg

SEQ ID NO: 306712 - DNA, 15 bp, Homo sapiens
ttttatttgacaaaa

SEQ ID NO: 306713 - DNA, 16 bp, Homo sapiens
ttttattttcatactt

SEQ ID NO: 306714 - DNA, 14 bp, Homo sapiens
ttttattttgtttt

SEQ ID NO: 306715 - DNA, 16 bp, Homo sapiens
ttttatttttatccca

SEQ ID NO: 306716 - DNA, 13 bp, Homo sapiens
ttttatttttcta

SEQ ID NO: 306717 - DNA, 14 bp, Homo sapiens
ttttattttttaag

SEQ ID NO: 306718 - DNA, 17 bp, Homo sapiens
ttttcaaaactagttct

SEQ ID NO: 306719 - DNA, 22 bp, Homo sapiens
ttttcaacgcagccctgctttg

SEQ ID NO: 306720 - DNA, 13 bp, Homo sapiens
ttttcaccccacc

SEQ ID NO: 306721 - DNA, 23 bp, Homo sapiens
ttttcacctgtttttaagctgtt

SEQ ID NO: 306722 - DNA, 16 bp, Homo sapiens
ttttcactgctgctcc

SEQ ID NO: 306723 - DNA, 13 bp, Homo sapiens
ttttcacttgtct

SEQ ID NO: 306724 - DNA, 19 bp, Homo sapiens
ttttcacttgtcttgctct

SEQ ID NO: 306725 - DNA, 15 bp, Homo sapiens
ttttcagaaaatatt

SEQ ID NO: 306726 - DNA, 16 bp, Homo sapiens
ttttcagaaaatatta

SEQ ID NO: 306727 - DNA, 23 bp, Homo sapiens
ttttcagaaaatattatgtgttt

SEQ ID NO: 306728 - DNA, 18 bp, Homo sapiens
ttttcagaacctcttccc

SEQ ID NO: 306729 - DNA, 16 bp, Homo sapiens
ttttcagaatgctctt

SEQ ID NO: 306730 - DNA, 21 bp, Homo sapiens
ttttcagcatcaaacatgaaa

SEQ ID NO: 306731 - DNA, 22 bp, Homo sapiens
ttttcagcatcaaacatgaaaa

SEQ ID NO: 306732 - DNA, 18 bp, Homo sapiens
ttttcagccaatttgtct

SEQ ID NO: 306733 - DNA, 19 bp, Homo sapiens
ttttcagccaatttgtctc

SEQ ID NO: 306734 - DNA, 19 bp, Homo sapiens
ttttcagcccatatttcat

SEQ ID NO: 306735 - DNA, 20 bp, Homo sapiens
ttttcagcttgtttctatac

SEQ ID NO: 306736 - DNA, 21 bp, Homo sapiens
ttttcagcttgtttctatact

SEQ ID NO: 306737 - DNA, 23 bp, Homo sapiens
ttttcaggaaggtatcacacact

SEQ ID NO: 306738 - DNA, 22 bp, Homo sapiens
ttttcaggagcgcaagatagat

SEQ ID NO: 306739 - DNA, 15 bp, Homo sapiens
ttttcagtatactgt

SEQ ID NO: 306740 - DNA, 17 bp, Homo sapiens
ttttcagtatactgtgt

SEQ ID NO: 306741 - DNA, 19 bp, Homo sapiens
ttttcagtatactgtgtgg

SEQ ID NO: 306742 - DNA, 18 bp, Homo sapiens
ttttcagtgctttctcaa

SEQ ID NO: 306743 - DNA, 12 bp, Homo sapiens
ttttcataataa

SEQ ID NO: 306744 - DNA, 15 bp, Homo sapiens
ttttcatagtgcctt

SEQ ID NO: 306745 - DNA, 16 bp, Homo sapiens
ttttcatattgtgcca

SEQ ID NO: 306746 - DNA, 11 bp, Homo sapiens
ttttcatccca

SEQ ID NO: 306747 - DNA, 16 bp, Homo sapiens
ttttcatcctggcctc

SEQ ID NO: 306748 - DNA, 15 bp, Homo sapiens
ttttcatctgttgtt

SEQ ID NO: 306749 - DNA, 15 bp, Homo sapiens
ttttccaaaataatt

SEQ ID NO: 306750 - DNA, 13 bp, Homo sapiens
ttttccaagccct

SEQ ID NO: 306751 - DNA, 13 bp, Homo sapiens
ttttccagtattg

SEQ ID NO: 306752 - DNA, 16 bp, Homo sapiens
ttttccatctaaaata

SEQ ID NO: 306753 - DNA, 16 bp, Homo sapiens
ttttccatgaaaacgt

SEQ ID NO: 306754 - DNA, 18 bp, Homo sapiens
ttttccatttttgtcagt

SEQ ID NO: 306755 - DNA, 17 bp, Homo sapiens
ttttcccacctctttgg

SEQ ID NO: 306756 - DNA, 14 bp, Homo sapiens
ttttccctctggca

SEQ ID NO: 306757 - DNA, 15 bp, Homo sapiens
ttttccctgtttgcc

SEQ ID NO: 306758 - DNA, 20 bp, Homo sapiens
ttttcctagttttatgtttc

SEQ ID NO: 306759 - DNA, 22 bp, Homo sapiens
ttttcctcccttgggttctgat

SEQ ID NO: 306760 - DNA, 19 bp, Homo sapiens
ttttcctccgggagagggg

SEQ ID NO: 306761 - DNA, 12 bp, Homo sapiens
ttttcctgtctt

SEQ ID NO: 306762 - DNA, 14 bp, Homo sapiens
ttttcctgtcttct

SEQ ID NO: 306763 - DNA, 13 bp, Homo sapiens
ttttcctgtgact

SEQ ID NO: 306764 - DNA, 12 bp, Homo sapiens
ttttcctttaga

SEQ ID NO: 306765 - DNA, 13 bp, Homo sapiens
ttttcctttctgt

SEQ ID NO: 306766 - DNA, 17 bp, Homo sapiens
ttttctaaaaagtcaat

SEQ ID NO: 306767 - DNA, 20 bp, Homo sapiens
ttttctaaaaagtcaattca

SEQ ID NO: 306768 - DNA, 15 bp, Homo sapiens
ttttctaaaacaagt

SEQ ID NO: 306769 - DNA, 12 bp, Homo sapiens
ttttctaaactg

SEQ ID NO: 306770 - DNA, 13 bp, Homo sapiens
ttttctaaactgt

SEQ ID NO: 306771 - DNA, 19 bp, Homo sapiens
ttttctaagcaatttcttg

SEQ ID NO: 306772 - DNA, 13 bp, Homo sapiens
ttttctactcgag

SEQ ID NO: 306773 - DNA, 23 bp, Homo sapiens
ttttctactcgagttacagacaa

SEQ ID NO: 306774 - DNA, 13 bp, Homo sapiens
ttttctagacttt

SEQ ID NO: 306775 - DNA, 20 bp, Homo sapiens
ttttctagtttcagtaaata

SEQ ID NO: 306776 - DNA, 18 bp, Homo sapiens
ttttctatgtccagcctt

SEQ ID NO: 306777 - DNA, 19 bp, Homo sapiens
ttttctattccttctggcc

SEQ ID NO: 306778 - DNA, 22 bp, Homo sapiens
ttttctcaaaagcatttatcat

SEQ ID NO: 306779 - DNA, 18 bp, Homo sapiens
ttttctcagaacagctga

SEQ ID NO: 306780 - DNA, 13 bp, Homo sapiens
ttttctcttctgt

SEQ ID NO: 306781 - DNA, 14 bp, Homo sapiens
ttttctctttctcc

SEQ ID NO: 306782 - DNA, 21 bp, Homo sapiens
ttttctgaattcataaaaata

SEQ ID NO: 306783 - DNA, 15 bp, Homo sapiens
ttttctgagcgatta

SEQ ID NO: 306784 - DNA, 21 bp, Homo sapiens
ttttctgcatcatctgtagat

SEQ ID NO: 306785 - DNA, 14 bp, Homo sapiens
ttttctggctgggg

SEQ ID NO: 306786 - DNA, 16 bp, Homo sapiens
ttttctggtagataga

SEQ ID NO: 306787 - DNA, 23 bp, Homo sapiens
ttttctgttgaagtttacaatca

SEQ ID NO: 306788 - DNA, 21 bp, Homo sapiens
ttttcttcaacatcaatgttc

SEQ ID NO: 306789 - DNA, 14 bp, Homo sapiens
ttttcttcttccct

SEQ ID NO: 306790 - DNA, 18 bp, Homo sapiens
ttttcttcttccctccct

SEQ ID NO: 306791 - DNA, 20 bp, Homo sapiens
ttttcttgcaaaacaaacat

SEQ ID NO: 306792 - DNA, 11 bp, Homo sapiens
ttttcttggtg

SEQ ID NO: 306793 - DNA, 18 bp, Homo sapiens
ttttcttgttgcatcttt

SEQ ID NO: 306794 - DNA, 16 bp, Homo sapiens
ttttctttaatcaaaa

SEQ ID NO: 306795 - DNA, 16 bp, Homo sapiens
ttttctttcagccaag

SEQ ID NO: 306796 - DNA, 15 bp, Homo sapiens
ttttctttctatgta

SEQ ID NO: 306797 - DNA, 15 bp, Homo sapiens
ttttcttttaatttt

SEQ ID NO: 306798 - DNA, 14 bp, Homo sapiens
ttttcttttctatg

SEQ ID NO: 306799 - DNA, 16 bp, Homo sapiens
ttttcttttctatgga

SEQ ID NO: 306800 - DNA, 13 bp, Homo sapiens
ttttgaaaacact

SEQ ID NO: 306801 - DNA, 14 bp, Homo sapiens
ttttgaaacagcag

SEQ ID NO: 306802 - DNA, 15 bp, Homo sapiens
ttttgaaagaaaaat

SEQ ID NO: 306803 - DNA, 16 bp, Homo sapiens
ttttgaagaacaaaag

SEQ ID NO: 306804 - DNA, 16 bp, Homo sapiens
ttttgaagaagggaaa

SEQ ID NO: 306805 - DNA, 22 bp, Homo sapiens
ttttgaagaagggaaattcaca

SEQ ID NO: 306806 - DNA, 15 bp, Homo sapiens
ttttgaataaaaact

SEQ ID NO: 306807 - DNA, 21 bp, Homo sapiens
ttttgaataccattaaaactg

SEQ ID NO: 306808 - DNA, 20 bp, Homo sapiens
ttttgaatcaatctggcttc

SEQ ID NO: 306809 - DNA, 18 bp, Homo sapiens
ttttgaatggtgttgtat

SEQ ID NO: 306810 - DNA, 19 bp, Homo sapiens
ttttgaatttaaataaagt

SEQ ID NO: 306811 - DNA, 12 bp, Homo sapiens
ttttgacacagt

SEQ ID NO: 306812 - DNA, 13 bp, Homo sapiens
ttttgacataatg

SEQ ID NO: 306813 - DNA, 18 bp, Homo sapiens
ttttgacataatgagtaa

SEQ ID NO: 306814 - DNA, 22 bp, Homo sapiens
ttttgactagggattcaggctg

SEQ ID NO: 306815 - DNA, 17 bp, Homo sapiens
ttttgagacagaatctc

SEQ ID NO: 306816 - DNA, 19 bp, Homo sapiens
ttttgataaaatgttcctt

SEQ ID NO: 306817 - DNA, 13 bp, Homo sapiens
ttttgatacattt

SEQ ID NO: 306818 - DNA, 20 bp, Homo sapiens
ttttgatacatttatcttct

SEQ ID NO: 306819 - DNA, 13 bp, Homo sapiens
ttttgatggctaa

SEQ ID NO: 306820 - DNA, 22 bp, Homo sapiens
ttttgatgtttgtggcctcaga

SEQ ID NO: 306821 - DNA, 13 bp, Homo sapiens
ttttgcaaaattt

SEQ ID NO: 306822 - DNA, 19 bp, Homo sapiens
ttttgcacgaattttaaaa

SEQ ID NO: 306823 - DNA, 12 bp, Homo sapiens
ttttgcagcttt

SEQ ID NO: 306824 - DNA, 16 bp, Homo sapiens
ttttgccactgcaaac

SEQ ID NO: 306825 - DNA, 22 bp, Homo sapiens
ttttgcctggctgtggaggcct

SEQ ID NO: 306826 - DNA, 16 bp, Homo sapiens
ttttgctgaattcctt

SEQ ID NO: 306827 - DNA, 20 bp, Homo sapiens
ttttgctgaattcctttaca

SEQ ID NO: 306828 - DNA, 11 bp, Homo sapiens
ttttgctttat

SEQ ID NO: 306829 - DNA, 19 bp, Homo sapiens
ttttggaattggtgtatat

SEQ ID NO: 306830 - DNA, 14 bp, Homo sapiens
ttttggactttgtt

SEQ ID NO: 306831 - DNA, 15 bp, Homo sapiens
ttttggaggtgctta

SEQ ID NO: 306832 - DNA, 17 bp, Homo sapiens
ttttggccaaagtgtta

SEQ ID NO: 306833 - DNA, 23 bp, Homo sapiens
aattttaatgtaaaattcatagc

SEQ ID NO: 306834 - DNA, 21 bp, Homo sapiens
aattttacatgtctcatattt

SEQ ID NO: 306835 - DNA, 20 bp, Homo sapiens
aattttatagctcagtttat

SEQ ID NO: 306836 - DNA, 23 bp, Homo sapiens
aattttatctacccagtcatgta

SEQ ID NO: 306837 - DNA, 20 bp, Homo sapiens
aattttatgaactgcatgta

SEQ ID NO: 306838 - DNA, 17 bp, Homo sapiens
aattttctagactttct

SEQ ID NO: 306839 - DNA, 17 bp, Homo sapiens
aattttctcaaaagcat

SEQ ID NO: 306840 - DNA, 14 bp, Homo sapiens
aattttcttcatgc

SEQ ID NO: 306841 - DNA, 22 bp, Homo sapiens
aattttcttcatgcaatgacat

SEQ ID NO: 306842 - DNA, 23 bp, Homo sapiens
aattttctttaaccagtctgaag

SEQ ID NO: 306843 - DNA, 22 bp, Homo sapiens
aattttggccaaagtgttaatc

SEQ ID NO: 306844 - DNA, 19 bp, Homo sapiens
aattttggtgatgtaaaac

SEQ ID NO: 306845 - DNA, 23 bp, Homo sapiens
aattttggtgatgtaaaacagaa

SEQ ID NO: 306846 - DNA, 18 bp, Homo sapiens
aattttgtatccatttaa

SEQ ID NO: 306847 - DNA, 11 bp, Homo sapiens
aattttgtcac

SEQ ID NO: 306848 - DNA, 22 bp, Homo sapiens
aatttttatatttaattattaa

SEQ ID NO: 306849 - DNA, 13 bp, Homo sapiens
aatttttgaaaag

SEQ ID NO: 306850 - DNA, 13 bp, Homo sapiens
aatttttgctgaa

SEQ ID NO: 306851 - DNA, 19 bp, Homo sapiens
aattttttgatgtcagcct

SEQ ID NO: 306852 - DNA, 19 bp, Homo sapiens
aatttttttatactaccaa

SEQ ID NO: 306853 - DNA, 18 bp, Homo sapiens
aatttttttccagaattg

SEQ ID NO: 306854 - DNA, 13 bp, Homo sapiens
acaaaaaaatata

SEQ ID NO: 306855 - DNA, 17 bp, Homo sapiens
acaaaaaaatatattta

SEQ ID NO: 306856 - DNA, 17 bp, Homo sapiens
acaaaaaacaatattta

SEQ ID NO: 306857 - DNA, 13 bp, Homo sapiens
acaaaaacaagac

SEQ ID NO: 306858 - DNA, 13 bp, Homo sapiens
acaaaaacatggc

SEQ ID NO: 306859 - DNA, 19 bp, Homo sapiens
acaaaaactttccatgaca

SEQ ID NO: 306860 - DNA, 20 bp, Homo sapiens
acaaaaactttccatgacag

SEQ ID NO: 306861 - DNA, 14 bp, Homo sapiens
acaaaaagaaagct

SEQ ID NO: 306862 - DNA, 17 bp, Homo sapiens
acaaaaagaaagctgtg

SEQ ID NO: 306863 - DNA, 18 bp, Homo sapiens
acaaaaaggaaatgaata

SEQ ID NO: 306864 - DNA, 17 bp, Homo sapiens
acaaaaaggagcgggca

SEQ ID NO: 306865 - DNA, 13 bp, Homo sapiens
acaaaaaggtgct

SEQ ID NO: 306866 - DNA, 13 bp, Homo sapiens
acaaaaatatatt

SEQ ID NO: 306867 - DNA, 14 bp, Homo sapiens
acaaaaattgaata

SEQ ID NO: 306868 - DNA, 12 bp, Homo sapiens
acaaaacaacag

SEQ ID NO: 306869 - DNA, 13 bp, Homo sapiens
acaaaacaacagc

SEQ ID NO: 306870 - DNA, 14 bp, Homo sapiens
acaaaacaacagca

SEQ ID NO: 306871 - DNA, 17 bp, Homo sapiens
acaaaacaacagcaaca

SEQ ID NO: 306872 - DNA, 18 bp, Homo sapiens
acaaaacaacagcaacaa

SEQ ID NO: 306873 - DNA, 20 bp, Homo sapiens
acaaaacttaaaagtattca

SEQ ID NO: 306874 - DNA, 17 bp, Homo sapiens
acaaaagcaaagtgaag

SEQ ID NO: 306875 - DNA, 15 bp, Homo sapiens
acaaaagctgtgtct

SEQ ID NO: 306876 - DNA, 23 bp, Homo sapiens
acaaaagtctcaatgttccattc

SEQ ID NO: 306877 - DNA, 16 bp, Homo sapiens
acaaaataaaattatg

SEQ ID NO: 306878 - DNA, 15 bp, Homo sapiens
acaaaatagaagctg

SEQ ID NO: 306879 - DNA, 18 bp, Homo sapiens
acaaaatatataatggtt

SEQ ID NO: 306880 - DNA, 22 bp, Homo sapiens
acaaaatatttatttgttttgg

SEQ ID NO: 306881 - DNA, 13 bp, Homo sapiens
acaaaatatttct

SEQ ID NO: 306882 - DNA, 19 bp, Homo sapiens
acaaaatatttctaagctt

SEQ ID NO: 306883 - DNA, 19 bp, Homo sapiens
acaaaatcgattggcttta

SEQ ID NO: 306884 - DNA, 16 bp, Homo sapiens
acaaaatctaaaacaa

SEQ ID NO: 306885 - DNA, 15 bp, Homo sapiens
acaaaatctgaactc

SEQ ID NO: 306886 - DNA, 22 bp, Homo sapiens
acaaaatgaaacgcaaccacca

SEQ ID NO: 306887 - DNA, 20 bp, Homo sapiens
acaaaatgtagggttataat

SEQ ID NO: 306888 - DNA, 22 bp, Homo sapiens
acaaaatgtagggttataataa

SEQ ID NO: 306889 - DNA, 13 bp, Homo sapiens
acaaacacctcct

SEQ ID NO: 306890 - DNA, 18 bp, Homo sapiens
acaaacagaaacgagatt

SEQ ID NO: 306891 - DNA, 21 bp, Homo sapiens
acaaacagtgaatttaagcat

SEQ ID NO: 306892 - DNA, 17 bp, Homo sapiens
acaaacatacccatctg

SEQ ID NO: 306893 - DNA, 14 bp, Homo sapiens
acaaaccctgggga

SEQ ID NO: 306894 - DNA, 15 bp, Homo sapiens
acaaaccctggggac

SEQ ID NO: 306895 - DNA, 22 bp, Homo sapiens
acaaacctctatatgttgctga

SEQ ID NO: 306896 - DNA, 20 bp, Homo sapiens
acaaactctactaattttta

SEQ ID NO: 306897 - DNA, 14 bp, Homo sapiens
acaaactgaaaaat

SEQ ID NO: 306898 - DNA, 11 bp, Homo sapiens
acaaactgcaa

SEQ ID NO: 306899 - DNA, 13 bp, Homo sapiens
acaaactgcaata

SEQ ID NO: 306900 - DNA, 13 bp, Homo sapiens
acaaactgcctgt

SEQ ID NO: 306901 - DNA, 15 bp, Homo sapiens
acaaacttactgtca

SEQ ID NO: 306902 - DNA, 18 bp, Homo sapiens
acaaagaaggaaaagagt

SEQ ID NO: 306903 - DNA, 11 bp, Homo sapiens
acaaagacagg

SEQ ID NO: 306904 - DNA, 19 bp, Homo sapiens
acaaagaccaatgtgaaga

SEQ ID NO: 306905 - DNA, 18 bp, Homo sapiens
acaaagagaataaagact

SEQ ID NO: 306906 - DNA, 23 bp, Homo sapiens
acaaagataacgcaggagagaga

SEQ ID NO: 306907 - DNA, 23 bp, Homo sapiens
acaaagataagacttgtttcttt

SEQ ID NO: 306908 - DNA, 19 bp, Homo sapiens
acaaagatacttgatgcac

SEQ ID NO: 306909 - DNA, 22 bp, Homo sapiens
acaaagatacttgatgcactta

SEQ ID NO: 306910 - DNA, 16 bp, Homo sapiens
acaaagcacagtgtta

SEQ ID NO: 306911 - DNA, 15 bp, Homo sapiens
acaaagcatgctcag

SEQ ID NO: 306912 - DNA, 20 bp, Homo sapiens
acaaagcatgctcagtattg

SEQ ID NO: 306913 - DNA, 22 bp, Homo sapiens
acaaagcttctatcccaggagg

SEQ ID NO: 306914 - DNA, 16 bp, Homo sapiens
acaaaggatgaagaac

SEQ ID NO: 306915 - DNA, 22 bp, Homo sapiens
acaaaggatgaagaacacagca

SEQ ID NO: 306916 - DNA, 15 bp, Homo sapiens
acaaaggccttaaca

SEQ ID NO: 306917 - DNA, 14 bp, Homo sapiens
acaaagtaattcct

SEQ ID NO: 306918 - DNA, 19 bp, Homo sapiens
acaaataactactgcaaaa

SEQ ID NO: 306919 - DNA, 15 bp, Homo sapiens
acaaatactcttagg

SEQ ID NO: 306920 - DNA, 17 bp, Homo sapiens
acaaatactcttaggaa

SEQ ID NO: 306921 - DNA, 21 bp, Homo sapiens
acaaatagtcggattagaaat

SEQ ID NO: 306922 - DNA, 16 bp, Homo sapiens
acaaatatagttgaac

SEQ ID NO: 306923 - DNA, 22 bp, Homo sapiens
acaaatatagttgaacaagatt

SEQ ID NO: 306924 - DNA, 19 bp, Homo sapiens
acaaatatgcaaaaggttc

SEQ ID NO: 306925 - DNA, 14 bp, Homo sapiens
acaaatatgctaaa

SEQ ID NO: 306926 - DNA, 17 bp, Homo sapiens
acaaatatgctaaatgt

SEQ ID NO: 306927 - DNA, 19 bp, Homo sapiens
acaaatattgcttggacta

SEQ ID NO: 306928 - DNA, 13 bp, Homo sapiens
acaaatatttcac

SEQ ID NO: 306929 - DNA, 17 bp, Homo sapiens
acaaatcacacctctgg

SEQ ID NO: 306930 - DNA, 13 bp, Homo sapiens
acaaatgcagaca

SEQ ID NO: 306931 - DNA, 18 bp, Homo sapiens
acaaatgcagacacacaa

SEQ ID NO: 306932 - DNA, 22 bp, Homo sapiens
acaaatgctgcgcccttcccca

SEQ ID NO: 306933 - DNA, 20 bp, Homo sapiens
acaaatgggactgatgtcat

SEQ ID NO: 306934 - DNA, 22 bp, Homo sapiens
acaaatgggggcggctggaaag

SEQ ID NO: 306935 - DNA, 17 bp, Homo sapiens
acaaatgtcctcagagg

SEQ ID NO: 306936 - DNA, 14 bp, Homo sapiens
acaaattaaaaaca

SEQ ID NO: 306937 - DNA, 14 bp, Homo sapiens
acaaattgaaagct

SEQ ID NO: 306938 - DNA, 15 bp, Homo sapiens
acaaatttaaaacaa

SEQ ID NO: 306939 - DNA, 23 bp, Homo sapiens
acaaatttgctttgggattttct

SEQ ID NO: 306940 - DNA, 17 bp, Homo sapiens
acaaattttcagaaggt

SEQ ID NO: 306941 - DNA, 10 bp, Homo sapiens
acaacaaaaa

SEQ ID NO: 306942 - DNA, 14 bp, Homo sapiens
acaacaaaaatttg

SEQ ID NO: 306943 - DNA, 15 bp, Homo sapiens
acaacaaaaatttga

SEQ ID NO: 306944 - DNA, 14 bp, Homo sapiens
acaacaacagaaca

SEQ ID NO: 306945 - DNA, 21 bp, Homo sapiens
acaacaagttgtttcaaacag

SEQ ID NO: 306946 - DNA, 15 bp, Homo sapiens
acaacaatcccagca

SEQ ID NO: 306947 - DNA, 22 bp, Homo sapiens
acaacaatttaggaatgctcaa

SEQ ID NO: 306948 - DNA, 13 bp, Homo sapiens
acaacaccaggac

SEQ ID NO: 306949 - DNA, 16 bp, Homo sapiens
acaacaccccacagga

SEQ ID NO: 306950 - DNA, 14 bp, Homo sapiens
acaacagcaacaac

SEQ ID NO: 306951 - DNA, 17 bp, Homo sapiens
acaacagcttcttgctt

SEQ ID NO: 306952 - DNA, 12 bp, Homo sapiens
acaacaggcatt

SEQ ID NO: 306953 - DNA, 14 bp, Homo sapiens
acaacagtcagcca

SEQ ID NO: 306954 - DNA, 17 bp, Homo sapiens
acaacagtcagccagct

SEQ ID NO: 306955 - DNA, 17 bp, Homo sapiens
acaacatctttttctac

SEQ ID NO: 306956 - DNA, 13 bp, Homo sapiens
acaacatgtatgt

SEQ ID NO: 306957 - DNA, 14 bp, Homo sapiens
acaacatgtatgtg

SEQ ID NO: 306958 - DNA, 13 bp, Homo sapiens
acaacattttatt

SEQ ID NO: 306959 - DNA, 21 bp, Homo sapiens
acaaccacatttctggccatt

SEQ ID NO: 306960 - DNA, 18 bp, Homo sapiens
acaaccactgggatcagc

SEQ ID NO: 306961 - DNA, 14 bp, Homo sapiens
acaaccatagaact

SEQ ID NO: 306962 - DNA, 15 bp, Homo sapiens
acaaccatagaactg

SEQ ID NO: 306963 - DNA, 14 bp, Homo sapiens
acaacctccacctt

SEQ ID NO: 306964 - DNA, 14 bp, Homo sapiens
acaacctgaaagac

SEQ ID NO: 306965 - DNA, 14 bp, Homo sapiens
acaacctgccacaa

SEQ ID NO: 306966 - DNA, 15 bp, Homo sapiens
acaacctgcccctcc

SEQ ID NO: 306967 - DNA, 13 bp, Homo sapiens
acaactaaataac

SEQ ID NO: 306968 - DNA, 14 bp, Homo sapiens
aattccagagctgt

SEQ ID NO: 306969 - DNA, 17 bp, Homo sapiens
aattcccattttgcaaa

SEQ ID NO: 306970 - DNA, 21 bp, Homo sapiens
aattcccattttgcaaaattt

SEQ ID NO: 306971 - DNA, 22 bp, Homo sapiens
aattccctatcttttagtttta

SEQ ID NO: 306972 - DNA, 13 bp, Homo sapiens
aattccctgctgt

SEQ ID NO: 306973 - DNA, 14 bp, Homo sapiens
aattccctgctgtc

SEQ ID NO: 306974 - DNA, 14 bp, Homo sapiens
aattcctcatttgt

SEQ ID NO: 306975 - DNA, 23 bp, Homo sapiens
aattcctcatttgttcattaaac

SEQ ID NO: 306976 - DNA, 14 bp, Homo sapiens
aattcctcctgtct

SEQ ID NO: 306977 - DNA, 21 bp, Homo sapiens
aattcctctcactaaacttta

SEQ ID NO: 306978 - DNA, 16 bp, Homo sapiens
aattcctggcatgaca

SEQ ID NO: 306979 - DNA, 21 bp, Homo sapiens
aattcctggcatgacactcta

SEQ ID NO: 306980 - DNA, 23 bp, Homo sapiens
aattcgtacataataagtttcat

SEQ ID NO: 306981 - DNA, 13 bp, Homo sapiens
aattctaaatgaa

SEQ ID NO: 306982 - DNA, 16 bp, Homo sapiens
aattctagtctctgat

SEQ ID NO: 306983 - DNA, 19 bp, Homo sapiens
aattctcctgcctcagcct

SEQ ID NO: 306984 - DNA, 15 bp, Homo sapiens
aattctcttatccaa

SEQ ID NO: 306985 - DNA, 20 bp, Homo sapiens
aattctgcaactagccaagg

SEQ ID NO: 306986 - DNA, 20 bp, Homo sapiens
aattctgcaatgttttcctt

SEQ ID NO: 306987 - DNA, 11 bp, Homo sapiens
aattctgctgc

SEQ ID NO: 306988 - DNA, 12 bp, Homo sapiens
aattctgctgct

SEQ ID NO: 306989 - DNA, 13 bp, Homo sapiens
aattctgctgctt

SEQ ID NO: 306990 - DNA, 12 bp, Homo sapiens
aattctgtccct

SEQ ID NO: 306991 - DNA, 16 bp, Homo sapiens
aattctgtccctgtcc

SEQ ID NO: 306992 - DNA, 15 bp, Homo sapiens
aattctgtgaagaat

SEQ ID NO: 306993 - DNA, 18 bp, Homo sapiens
aattctgtgaagaatgaa

SEQ ID NO: 306994 - DNA, 16 bp, Homo sapiens
aattcttaagtatgtt

SEQ ID NO: 306995 - DNA, 21 bp, Homo sapiens
aattcttacctcatttgcatc

SEQ ID NO: 306996 - DNA, 23 bp, Homo sapiens
aattcttacctcatttgcatcct

SEQ ID NO: 306997 - DNA, 13 bp, Homo sapiens
aattcttccctgg

SEQ ID NO: 306998 - DNA, 23 bp, Homo sapiens
aatacatctttatcattaaacat

SEQ ID NO: 306999 - DNA, 13 bp, Homo sapiens
aatacatgcatct

SEQ ID NO: 307000 - DNA, 20 bp, Homo sapiens
aatacatgtgtggatgtgta

SEQ ID NO: 307001 - DNA, 21 bp, Homo sapiens
aatacattccatcacagccag

SEQ ID NO: 307002 - DNA, 16 bp, Homo sapiens
aataccagactgcagg

SEQ ID NO: 307003 - DNA, 15 bp, Homo sapiens
aataccattaaaact

SEQ ID NO: 307004 - DNA, 21 bp, Homo sapiens
aataccattaaaactgctttt

SEQ ID NO: 307005 - DNA, 14 bp, Homo sapiens
aatacccaaaccct

SEQ ID NO: 307006 - DNA, 23 bp, Homo sapiens
aatacccccgtcggaatggtaac

SEQ ID NO: 307007 - DNA, 12 bp, Homo sapiens
aatacccttggc

SEQ ID NO: 307008 - DNA, 19 bp, Homo sapiens
aatacctccattaaatggt

SEQ ID NO: 307009 - DNA, 16 bp, Homo sapiens
aatacctttaaatatc

SEQ ID NO: 307010 - DNA, 16 bp, Homo sapiens
aatacgcactacatgt

SEQ ID NO: 307011 - DNA, 14 bp, Homo sapiens
aatactaaatatga

SEQ ID NO: 307012 - DNA, 21 bp, Homo sapiens
aatactaagaccctaattctt

SEQ ID NO: 307013 - DNA, 13 bp, Homo sapiens
aatactaatttat

SEQ ID NO: 307014 - DNA, 22 bp, Homo sapiens
aatactataaatatattgtata

SEQ ID NO: 307015 - DNA, 20 bp, Homo sapiens
aatactattggacagacaca

SEQ ID NO: 307016 - DNA, 16 bp, Homo sapiens
aatactcaccaaaata

SEQ ID NO: 307017 - DNA, 18 bp, Homo sapiens
aatactcaccaaaatata

SEQ ID NO: 307018 - DNA, 22 bp, Homo sapiens
aatactcaccaaaatatagtta

SEQ ID NO: 307019 - DNA, 16 bp, Homo sapiens
aatactcacctcctcc

SEQ ID NO: 307020 - DNA, 20 bp, Homo sapiens
aatactcttggtcacctcaa

SEQ ID NO: 307021 - DNA, 19 bp, Homo sapiens
aatactgaatttctttgat

SEQ ID NO: 307022 - DNA, 22 bp, Homo sapiens
aatactgcttttgcaaacagaa

SEQ ID NO: 307023 - DNA, 18 bp, Homo sapiens
aatacttaaaaatagtct

SEQ ID NO: 307024 - DNA, 13 bp, Homo sapiens
aatacttaataaa

SEQ ID NO: 307025 - DNA, 18 bp, Homo sapiens
aatacttctgcaactcat

SEQ ID NO: 307026 - DNA, 16 bp, Homo sapiens
aatacttgaatatgga

SEQ ID NO: 307027 - DNA, 15 bp, Homo sapiens
aatacttgacaacat

SEQ ID NO: 307028 - DNA, 16 bp, Homo sapiens
aatactttaacttcca

SEQ ID NO: 307029 - DNA, 19 bp, Homo sapiens
aatacttttgtgtattctg

SEQ ID NO: 307030 - DNA, 17 bp, Homo sapiens
aatagaaagtcatcttt

SEQ ID NO: 307031 - DNA, 13 bp, Homo sapiens
aatagaaatgcat

SEQ ID NO: 307032 - DNA, 14 bp, Homo sapiens
aatagaatttccta

SEQ ID NO: 307033 - DNA, 22 bp, Homo sapiens
aatagacttatatgcaggctgt

SEQ ID NO: 307034 - DNA, 19 bp, Homo sapiens
aatagagatgagctttctt

SEQ ID NO: 307035 - DNA, 12 bp, Homo sapiens
aatagagtactt

SEQ ID NO: 307036 - DNA, 19 bp, Homo sapiens
aatagagtacttaatatac

SEQ ID NO: 307037 - DNA, 17 bp, Homo sapiens
aatagagtatatgcact

SEQ ID NO: 307038 - DNA, 14 bp, Homo sapiens
aatagatacttttg

SEQ ID NO: 307039 - DNA, 15 bp, Homo sapiens
aatagatcagtattt

SEQ ID NO: 307040 - DNA, 17 bp, Homo sapiens
aatagatgagtcctgtt

SEQ ID NO: 307041 - DNA, 20 bp, Homo sapiens
aatagattaaaggaattaaa

SEQ ID NO: 307042 - DNA, 15 bp, Homo sapiens
aatagatttttagat

SEQ ID NO: 307043 - DNA, 17 bp, Homo sapiens
aatagcaacatgcttca

SEQ ID NO: 307044 - DNA, 21 bp, Homo sapiens
aatagcaccaatacaaattga

SEQ ID NO: 307045 - DNA, 17 bp, Homo sapiens
aatagcatgttgtagat

SEQ ID NO: 307046 - DNA, 12 bp, Homo sapiens
aatagctgaacc

SEQ ID NO: 307047 - DNA, 13 bp, Homo sapiens
aatagctgaacct

SEQ ID NO: 307048 - DNA, 19 bp, Homo sapiens
aatagcttgtatagtgtaa

SEQ ID NO: 307049 - DNA, 17 bp, Homo sapiens
aatagcttttattgtat

SEQ ID NO: 307050 - DNA, 23 bp, Homo sapiens
aataggaaagatttaatgttaca

SEQ ID NO: 307051 - DNA, 17 bp, Homo sapiens
aataggagaaaatgaaa

SEQ ID NO: 307052 - DNA, 13 bp, Homo sapiens
aatagtaatgttt

SEQ ID NO: 307053 - DNA, 11 bp, Homo sapiens
aatagtacatg

SEQ ID NO: 307054 - DNA, 19 bp, Homo sapiens
aatagtaggctaaaaacat

SEQ ID NO: 307055 - DNA, 15 bp, Homo sapiens
aatagtatttgagag

SEQ ID NO: 307056 - DNA, 20 bp, Homo sapiens
aatagtatttgagagttcta

SEQ ID NO: 307057 - DNA, 23 bp, Homo sapiens
aatagtatttgagagttctaaat

SEQ ID NO: 307058 - DNA, 18 bp, Homo sapiens
aatagtcatatgtgaaga

SEQ ID NO: 307059 - DNA, 17 bp, Homo sapiens
aatagtcctccaaaaca

SEQ ID NO: 307060 - DNA, 22 bp, Homo sapiens
aatagtctctgggtttacaaca

SEQ ID NO: 307061 - DNA, 13 bp, Homo sapiens
aatagtctgtgtg

SEQ ID NO: 307062 - DNA, 14 bp, Homo sapiens
aatagtctgtgtga

SEQ ID NO: 307063 - DNA, 19 bp, Homo sapiens
aatagtgcagaatctcata

SEQ ID NO: 307064 - DNA, 20 bp, Homo sapiens
aatagtgcctcagcgctgcc

SEQ ID NO: 307065 - DNA, 21 bp, Homo sapiens
aatagtggttcttggaaaaat

SEQ ID NO: 307066 - DNA, 19 bp, Homo sapiens
aatagttattttaatacct

SEQ ID NO: 307067 - DNA, 17 bp, Homo sapiens
aatagttctatttctat

SEQ ID NO: 307068 - DNA, 18 bp, Homo sapiens
aatagttctatttctatc

SEQ ID NO: 307069 - DNA, 17 bp, Homo sapiens
aatataaaaataattaa

SEQ ID NO: 307070 - DNA, 16 bp, Homo sapiens
aatataaacaatgttc

SEQ ID NO: 307071 - DNA, 17 bp, Homo sapiens
aatataaacaatgttca

SEQ ID NO: 307072 - DNA, 12 bp, Homo sapiens
aatataaactgt

SEQ ID NO: 307073 - DNA, 18 bp, Homo sapiens
aatataaagttctacagt

SEQ ID NO: 307074 - DNA, 18 bp, Homo sapiens
aatataacaatatatgat

SEQ ID NO: 307075 - DNA, 23 bp, Homo sapiens
aatataataatgtcctttccctg

SEQ ID NO: 307076 - DNA, 21 bp, Homo sapiens
aatatacaactttggaatttg

SEQ ID NO: 307077 - DNA, 14 bp, Homo sapiens
aatatactaataaa

SEQ ID NO: 307078 - DNA, 19 bp, Homo sapiens
aatatactaataaaaaggt

SEQ ID NO: 307079 - DNA, 14 bp, Homo sapiens
aatatactgcatat

SEQ ID NO: 307080 - DNA, 16 bp, Homo sapiens
aatatagttgaacaag

SEQ ID NO: 307081 - DNA, 22 bp, Homo sapiens
aatatagttgaacaagatttcc

SEQ ID NO: 307082 - DNA, 13 bp, Homo sapiens
aatatagttgtct

SEQ ID NO: 307083 - DNA, 12 bp, Homo sapiens
aatatatataat

SEQ ID NO: 307084 - DNA, 20 bp, Homo sapiens
aatatatataatacttaaaa

SEQ ID NO: 307085 - DNA, 13 bp, Homo sapiens
aatatatattctg

SEQ ID NO: 307086 - DNA, 22 bp, Homo sapiens
aatatatatttatcatatttaa

SEQ ID NO: 307087 - DNA, 16 bp, Homo sapiens
aatatatcccagaaat

SEQ ID NO: 307088 - DNA, 14 bp, Homo sapiens
aatatatgatatat

SEQ ID NO: 307089 - DNA, 18 bp, Homo sapiens
aatatatgatatataaac

SEQ ID NO: 307090 - DNA, 20 bp, Homo sapiens
aatatatgatatataaacct

SEQ ID NO: 307091 - DNA, 23 bp, Homo sapiens
aatatatggggggagtgagctct

SEQ ID NO: 307092 - DNA, 12 bp, Homo sapiens
aatatatgtatg

SEQ ID NO: 307093 - DNA, 13 bp, Homo sapiens
aatatatgtatgt

SEQ ID NO: 307094 - DNA, 14 bp, Homo sapiens
aatatatgtatgta

SEQ ID NO: 307095 - DNA, 19 bp, Homo sapiens
aatatatgtatgtaaaaat

SEQ ID NO: 307096 - DNA, 23 bp, Homo sapiens
aatatatgttttaaatatagaat

SEQ ID NO: 307097 - DNA, 18 bp, Homo sapiens
aatatatgttttgagaaa

SEQ ID NO: 307098 - DNA, 19 bp, Homo sapiens
aatatatgttttgagaaaa

SEQ ID NO: 307099 - DNA, 20 bp, Homo sapiens
aatatatgttttgagaaaaa

SEQ ID NO: 307100 - DNA, 11 bp, Homo sapiens
aatatattaaa

SEQ ID NO: 307101 - DNA, 19 bp, Homo sapiens
aatatattaaaaatataaa

SEQ ID NO: 307102 - DNA, 22 bp, Homo sapiens
aatatattaccagcaagaataa

SEQ ID NO: 307103 - DNA, 16 bp, Homo sapiens
aatatattcaggagtt

SEQ ID NO: 307104 - DNA, 14 bp, Homo sapiens
aatatattgaacac

SEQ ID NO: 307105 - DNA, 20 bp, Homo sapiens
aatatatttaagataattat

SEQ ID NO: 307106 - DNA, 14 bp, Homo sapiens
aatatatttaatga

SEQ ID NO: 307107 - DNA, 19 bp, Homo sapiens
aatatattttatcttggta

SEQ ID NO: 307108 - DNA, 15 bp, Homo sapiens
aatatatttttatat

SEQ ID NO: 307109 - DNA, 20 bp, Homo sapiens
aatatatttttatatttagt

SEQ ID NO: 307110 - DNA, 18 bp, Homo sapiens
aatatatttttccctgtt

SEQ ID NO: 307111 - DNA, 18 bp, Homo sapiens
aatatcataatgtaatga

SEQ ID NO: 307112 - DNA, 16 bp, Homo sapiens
aatatcattatagcat

SEQ ID NO: 307113 - DNA, 13 bp, Homo sapiens
aatatcattcagc

SEQ ID NO: 307114 - DNA, 15 bp, Homo sapiens
aatatcattcagcaa

SEQ ID NO: 307115 - DNA, 23 bp, Homo sapiens
aatatcatttattttttacatta

SEQ ID NO: 307116 - DNA, 17 bp, Homo sapiens
aatatcatttcataaaa

SEQ ID NO: 307117 - DNA, 18 bp, Homo sapiens
aatatcattttcctggga

SEQ ID NO: 307118 - DNA, 19 bp, Homo sapiens
aatatcccagagaacaatc

SEQ ID NO: 307119 - DNA, 23 bp, Homo sapiens
aatatcctatactggttatagtt

SEQ ID NO: 307120 - DNA, 22 bp, Homo sapiens
aatatctatttatctgtctgag

SEQ ID NO: 307121 - DNA, 13 bp, Homo sapiens
aatatctgggatt

SEQ ID NO: 307122 - DNA, 21 bp, Homo sapiens
aatatcttgctggattaatgt

SEQ ID NO: 307123 - DNA, 15 bp, Homo sapiens
aatatgaaatgataa

SEQ ID NO: 307124 - DNA, 19 bp, Homo sapiens
aatatgacggaagaacata

SEQ ID NO: 307125 - DNA, 21 bp, Homo sapiens
aatatgacggaagaacataga

SEQ ID NO: 307126 - DNA, 15 bp, Homo sapiens
aatatgagattggaa

SEQ ID NO: 307127 - DNA, 17 bp, Homo sapiens
aatatgaggggactgca

SEQ ID NO: 307128 - DNA, 15 bp, Homo sapiens
agtgaatataaatgt

SEQ ID NO: 307129 - DNA, 19 bp, Homo sapiens
agtgaatataaatgtacta

SEQ ID NO: 307130 - DNA, 13 bp, Homo sapiens
agtgaatcttatg

SEQ ID NO: 307131 - DNA, 17 bp, Homo sapiens
agtgaatcttatggtgg

SEQ ID NO: 307132 - DNA, 20 bp, Homo sapiens
agtgaatgagtaaataaact

SEQ ID NO: 307133 - DNA, 20 bp, Homo sapiens
agtgaatgagtttccagcta

SEQ ID NO: 307134 - DNA, 13 bp, Homo sapiens
agtgaatgggaaa

SEQ ID NO: 307135 - DNA, 15 bp, Homo sapiens
agtgaatgggaaagg

SEQ ID NO: 307136 - DNA, 20 bp, Homo sapiens
agtgaattcttgaaggaaaa

SEQ ID NO: 307137 - DNA, 19 bp, Homo sapiens
agtgaatttgaatgaaaaa

SEQ ID NO: 307138 - DNA, 16 bp, Homo sapiens
agtgacaagatgctct

SEQ ID NO: 307139 - DNA, 17 bp, Homo sapiens
agtgacaagatgctctg

SEQ ID NO: 307140 - DNA, 14 bp, Homo sapiens
agtgacaaggcccc

SEQ ID NO: 307141 - DNA, 18 bp, Homo sapiens
agtgacaaggccccagag

SEQ ID NO: 307142 - DNA, 21 bp, Homo sapiens
agtgacaaggccccagagact

SEQ ID NO: 307143 - DNA, 23 bp, Homo sapiens
agtgacaaggccccagagactca

SEQ ID NO: 307144 - DNA, 18 bp, Homo sapiens
agtgacacagcagcttca

SEQ ID NO: 307145 - DNA, 20 bp, Homo sapiens
agtgacacttcagagagctg

SEQ ID NO: 307146 - DNA, 19 bp, Homo sapiens
agtgacagagttcactata

SEQ ID NO: 307147 - DNA, 15 bp, Homo sapiens
agtgacagtattttg

SEQ ID NO: 307148 - DNA, 21 bp, Homo sapiens
agtgaccaggctcacaactgt

SEQ ID NO: 307149 - DNA, 23 bp, Homo sapiens
agtgaccaggctcacaactgttt

SEQ ID NO: 307150 - DNA, 21 bp, Homo sapiens
agtgaccataaaggcatggca

SEQ ID NO: 307151 - DNA, 16 bp, Homo sapiens
agtgacccggaggcca

SEQ ID NO: 307152 - DNA, 22 bp, Homo sapiens
agtgactaccacttatttctaa

SEQ ID NO: 307153 - DNA, 23 bp, Homo sapiens
agtgactaccacttatttctaaa

SEQ ID NO: 307154 - DNA, 17 bp, Homo sapiens
agtgactagtacaaatt

SEQ ID NO: 307155 - DNA, 13 bp, Homo sapiens
agtgactggcagg

SEQ ID NO: 307156 - DNA, 16 bp, Homo sapiens
agtgactgtaattaat

SEQ ID NO: 307157 - DNA, 13 bp, Homo sapiens
agtgacttcctgg

SEQ ID NO: 307158 - DNA, 16 bp, Homo sapiens
agtgacttcctggtga

SEQ ID NO: 307159 - DNA, 14 bp, Homo sapiens
agtgacttgaatgt

SEQ ID NO: 307160 - DNA, 16 bp, Homo sapiens
agtgactttttctgag

SEQ ID NO: 307161 - DNA, 20 bp, Homo sapiens
agtgagaatctggctcctgt

SEQ ID NO: 307162 - DNA, 19 bp, Homo sapiens
agtgagacaaaattttagt

SEQ ID NO: 307163 - DNA, 11 bp, Homo sapiens
agtgagagaga

SEQ ID NO: 307164 - DNA, 18 bp, Homo sapiens
agtgagagagacaagaag

SEQ ID NO: 307165 - DNA, 13 bp, Homo sapiens
agtgagagagagt

SEQ ID NO: 307166 - DNA, 16 bp, Homo sapiens
agtgagatgggaaggg

SEQ ID NO: 307167 - DNA, 23 bp, Homo sapiens
agtgagatttgtatttatattag

SEQ ID NO: 307168 - DNA, 15 bp, Homo sapiens
agtgagctctctcag

SEQ ID NO: 307169 - DNA, 16 bp, Homo sapiens
agtgaggatgaaaaaa

SEQ ID NO: 307170 - DNA, 19 bp, Homo sapiens
agtgaggcaagagaaatga

SEQ ID NO: 307171 - DNA, 17 bp, Homo sapiens
agtgaggcttccaggct

SEQ ID NO: 307172 - DNA, 18 bp, Homo sapiens
agtgaggcttccaggctc

SEQ ID NO: 307173 - DNA, 15 bp, Homo sapiens
agtgagtctgtcagc

SEQ ID NO: 307174 - DNA, 12 bp, Homo sapiens
agtgagtggcat

SEQ ID NO: 307175 - DNA, 16 bp, Homo sapiens
agtgagtgtggctccc

SEQ ID NO: 307176 - DNA, 19 bp, Homo sapiens
agtgagtttccagctgctc

SEQ ID NO: 307177 - DNA, 19 bp, Homo sapiens
agtgataacactggagtgg

SEQ ID NO: 307178 - DNA, 15 bp, Homo sapiens
agtgatacactgtat

SEQ ID NO: 307179 - DNA, 18 bp, Homo sapiens
agtgatacactgtatcta

SEQ ID NO: 307180 - DNA, 16 bp, Homo sapiens
agtgataggcccaagg

SEQ ID NO: 307181 - DNA, 19 bp, Homo sapiens
agtgatcaataaaatgtga

SEQ ID NO: 307182 - DNA, 21 bp, Homo sapiens
agtgatctccatatgttacac

SEQ ID NO: 307183 - DNA, 20 bp, Homo sapiens
agtgatgaaattataagtag

SEQ ID NO: 307184 - DNA, 14 bp, Homo sapiens
agtgatgagctgaa

SEQ ID NO: 307185 - DNA, 13 bp, Homo sapiens
agtgatggcatta

SEQ ID NO: 307186 - DNA, 21 bp, Homo sapiens
agtgatggcattactctgcac

SEQ ID NO: 307187 - DNA, 19 bp, Homo sapiens
agtgatggcgcgggaggca

SEQ ID NO: 307188 - DNA, 20 bp, Homo sapiens
agtgatggcgcgggaggcac

SEQ ID NO: 307189 - DNA, 21 bp, Homo sapiens
agtgatggcgcgggaggcacc

SEQ ID NO: 307190 - DNA, 16 bp, Homo sapiens
agtgatgtgatttatg

SEQ ID NO: 307191 - DNA, 21 bp, Homo sapiens
agtgatgtgatttatgcattt

SEQ ID NO: 307192 - DNA, 22 bp, Homo sapiens
agtgattctcctgcctcagcct

SEQ ID NO: 307193 - DNA, 18 bp, Homo sapiens
agtgattctctcttctct

SEQ ID NO: 307194 - DNA, 22 bp, Homo sapiens
agtgattgacattttgtagcta

SEQ ID NO: 307195 - DNA, 13 bp, Homo sapiens
agtgatttgctat

SEQ ID NO: 307196 - DNA, 18 bp, Homo sapiens
agtgcaatgacacagtct

SEQ ID NO: 307197 - DNA, 14 bp, Homo sapiens
agtgcaatttcttc

SEQ ID NO: 307198 - DNA, 18 bp, Homo sapiens
agtgcacctgtggcctct

SEQ ID NO: 307199 - DNA, 16 bp, Homo sapiens
agtgcagaacacctgg

SEQ ID NO: 307200 - DNA, 12 bp, Homo sapiens
agtgcagacagg

SEQ ID NO: 307201 - DNA, 15 bp, Homo sapiens
agtgcagcccttcct

SEQ ID NO: 307202 - DNA, 16 bp, Homo sapiens
agtgcagctgatttta

SEQ ID NO: 307203 - DNA, 15 bp, Homo sapiens
agtgcaggctggcac

SEQ ID NO: 307204 - DNA, 16 bp, Homo sapiens
agtgcatggccacagc

SEQ ID NO: 307205 - DNA, 17 bp, Homo sapiens
agtgcatggccacagcc

SEQ ID NO: 307206 - DNA, 19 bp, Homo sapiens
agtgcatggccacagccac

SEQ ID NO: 307207 - DNA, 20 bp, Homo sapiens
agtgcatgtgaagcatgctt

SEQ ID NO: 307208 - DNA, 12 bp, Homo sapiens
agtgcatttctg

SEQ ID NO: 307209 - DNA, 16 bp, Homo sapiens
agtgccaaaaacaaca

SEQ ID NO: 307210 - DNA, 19 bp, Homo sapiens
agtgccacctatgcctgtg

SEQ ID NO: 307211 - DNA, 22 bp, Homo sapiens
agtgccacctatgcctgtggtg

SEQ ID NO: 307212 - DNA, 20 bp, Homo sapiens
agtgccactgcccgagctgg

SEQ ID NO: 307213 - DNA, 21 bp, Homo sapiens
agtgccactgcccgagctggt

SEQ ID NO: 307214 - DNA, 19 bp, Homo sapiens
agtgccacttgacattcct

SEQ ID NO: 307215 - DNA, 20 bp, Homo sapiens
agtgccacttgacattcctt

SEQ ID NO: 307216 - DNA, 23 bp, Homo sapiens
agtgccacttgacattccttgtc

SEQ ID NO: 307217 - DNA, 20 bp, Homo sapiens
agtgccatacatgttattgt

SEQ ID NO: 307218 - DNA, 13 bp, Homo sapiens
agtgccatatatt

SEQ ID NO: 307219 - DNA, 14 bp, Homo sapiens
actcttgtcatttt

SEQ ID NO: 307220 - DNA, 18 bp, Homo sapiens
actcttgtcatttttaat

SEQ ID NO: 307221 - DNA, 21 bp, Homo sapiens
actcttgttgcccaggctgga

SEQ ID NO: 307222 - DNA, 14 bp, Homo sapiens
actctttgtaagag

SEQ ID NO: 307223 - DNA, 23 bp, Homo sapiens
actctttgttttctttcctcccc

SEQ ID NO: 307224 - DNA, 18 bp, Homo sapiens
actcttttgagcagtaaa

SEQ ID NO: 307225 - DNA, 23 bp, Homo sapiens
actcttttgagcagtaaatgtat

SEQ ID NO: 307226 - DNA, 22 bp, Homo sapiens
actctttttcccaactttggaa

SEQ ID NO: 307227 - DNA, 12 bp, Homo sapiens
actgaaaacata

SEQ ID NO: 307228 - DNA, 13 bp, Homo sapiens
actgaaaaccagt

SEQ ID NO: 307229 - DNA, 15 bp, Homo sapiens
actgaaaactgtaaa

SEQ ID NO: 307230 - DNA, 16 bp, Homo sapiens
actgaaaactgtaaat

SEQ ID NO: 307231 - DNA, 15 bp, Homo sapiens
actgaaaatctaata

SEQ ID NO: 307232 - DNA, 13 bp, Homo sapiens
actgaaaatgtaa

SEQ ID NO: 307233 - DNA, 15 bp, Homo sapiens
actgaaagcagcagc

SEQ ID NO: 307234 - DNA, 19 bp, Homo sapiens
actgaaagcagcagctagg

SEQ ID NO: 307235 - DNA, 20 bp, Homo sapiens
actgaaagtgttttactctt

SEQ ID NO: 307236 - DNA, 15 bp, Homo sapiens
actgaaatggcttct

SEQ ID NO: 307237 - DNA, 21 bp, Homo sapiens
actgaaatttgttatacttca

SEQ ID NO: 307238 - DNA, 12 bp, Homo sapiens
actgaacaaaaa

SEQ ID NO: 307239 - DNA, 13 bp, Homo sapiens
actgaacaaaaaa

SEQ ID NO: 307240 - DNA, 17 bp, Homo sapiens
actgaacctctggctag

SEQ ID NO: 307241 - DNA, 13 bp, Homo sapiens
actgaactgttac

SEQ ID NO: 307242 - DNA, 16 bp, Homo sapiens
actgaagcaaatacca

SEQ ID NO: 307243 - DNA, 21 bp, Homo sapiens
actgaagcaaataccaaagca

SEQ ID NO: 307244 - DNA, 12 bp, Homo sapiens
actgaagcctgc

SEQ ID NO: 307245 - DNA, 15 bp, Homo sapiens
actgaagcgaacatc

SEQ ID NO: 307246 - DNA, 13 bp, Homo sapiens
actgaagcttttt

SEQ ID NO: 307247 - DNA, 12 bp, Homo sapiens
actgaaggcaaa

SEQ ID NO: 307248 - DNA, 16 bp, Homo sapiens
actgaaggcaaatctc

SEQ ID NO: 307249 - DNA, 20 bp, Homo sapiens
actgaaggctttcagggcct

SEQ ID NO: 307250 - DNA, 20 bp, Homo sapiens
actgaaggggcacaccactg

SEQ ID NO: 307251 - DNA, 15 bp, Homo sapiens
actgaagtgaataca

SEQ ID NO: 307252 - DNA, 19 bp, Homo sapiens
actgaagtgaatacatggt

SEQ ID NO: 307253 - DNA, 15 bp, Homo sapiens
actgaagtttcacat

SEQ ID NO: 307254 - DNA, 19 bp, Homo sapiens
actgaagtttcacatgagc

SEQ ID NO: 307255 - DNA, 21 bp, Homo sapiens
actgaataatggaattatgta

SEQ ID NO: 307256 - DNA, 16 bp, Homo sapiens
actgaatacttgaagt

SEQ ID NO: 307257 - DNA, 16 bp, Homo sapiens
actgaatatcatatgt

SEQ ID NO: 307258 - DNA, 17 bp, Homo sapiens
aagcctttaaattgttc

SEQ ID NO: 307259 - DNA, 22 bp, Homo sapiens
aagcctttaaattgttcctctt

SEQ ID NO: 307260 - DNA, 15 bp, Homo sapiens
aagcctttccataag

SEQ ID NO: 307261 - DNA, 18 bp, Homo sapiens
aagcgaacatcttcatat

SEQ ID NO: 307262 - DNA, 21 bp, Homo sapiens
aagcgaacatcttcatataaa

SEQ ID NO: 307263 - DNA, 16 bp, Homo sapiens
aagcgatatacagatg

SEQ ID NO: 307264 - DNA, 22 bp, Homo sapiens
aagcgatatacagatgaaaatt

SEQ ID NO: 307265 - DNA, 16 bp, Homo sapiens
aagcgtggtcccgagg

SEQ ID NO: 307266 - DNA, 20 bp, Homo sapiens
aagcgttcctggccttctga

SEQ ID NO: 307267 - DNA, 18 bp, Homo sapiens
aagctaataaaatatcat

SEQ ID NO: 307268 - DNA, 19 bp, Homo sapiens
aagctaatgtaggactgta

SEQ ID NO: 307269 - DNA, 20 bp, Homo sapiens
aagctaatgtaggactgtat

SEQ ID NO: 307270 - DNA, 21 bp, Homo sapiens
aagctacttgccttgagttta

SEQ ID NO: 307271 - DNA, 17 bp, Homo sapiens
aagctagaatggtggga

SEQ ID NO: 307272 - DNA, 13 bp, Homo sapiens
aagctaggaaagg

SEQ ID NO: 307273 - DNA, 18 bp, Homo sapiens
aagctaggaaaggcagaa

SEQ ID NO: 307274 - DNA, 21 bp, Homo sapiens
aagctaggaaaggcagaaaca

SEQ ID NO: 307275 - DNA, 15 bp, Homo sapiens
aagctagggtggccc

SEQ ID NO: 307276 - DNA, 19 bp, Homo sapiens
aagctagtggcttcaaaat

SEQ ID NO: 307277 - DNA, 17 bp, Homo sapiens
aagctatatatgaataa

SEQ ID NO: 307278 - DNA, 21 bp, Homo sapiens
aagctatgacacgagaatcag

SEQ ID NO: 307279 - DNA, 15 bp, Homo sapiens
aagctcaaatgtata

SEQ ID NO: 307280 - DNA, 16 bp, Homo sapiens
aagctcaaatgtatat

SEQ ID NO: 307281 - DNA, 22 bp, Homo sapiens
aagctcaaatgtatatttaact

SEQ ID NO: 307282 - DNA, 19 bp, Homo sapiens
aagctcaaggctgcagtga

SEQ ID NO: 307283 - DNA, 16 bp, Homo sapiens
aagctcacttgcttta

SEQ ID NO: 307284 - DNA, 18 bp, Homo sapiens
aagctcagagcagcctct

SEQ ID NO: 307285 - DNA, 14 bp, Homo sapiens
aagctcagcccacc

SEQ ID NO: 307286 - DNA, 23 bp, Homo sapiens
aagctccacggtgcgtggctgtg

SEQ ID NO: 307287 - DNA, 17 bp, Homo sapiens
aagctccaggtgccctg

SEQ ID NO: 307288 - DNA, 14 bp, Homo sapiens
aagctccatctcca

SEQ ID NO: 307289 - DNA, 20 bp, Homo sapiens
aagctccatctccactccag

SEQ ID NO: 307290 - DNA, 16 bp, Homo sapiens
aagctccatcttattt

SEQ ID NO: 307291 - DNA, 21 bp, Homo sapiens
aagctccatgtttagaaataa

SEQ ID NO: 307292 - DNA, 22 bp, Homo sapiens
aagctccatgtttagaaataaa

SEQ ID NO: 307293 - DNA, 19 bp, Homo sapiens
aagctcctggtcttgagat

SEQ ID NO: 307294 - DNA, 20 bp, Homo sapiens
aagctctagttcttaacaac

SEQ ID NO: 307295 - DNA, 23 bp, Homo sapiens
aagctctcttgccgaggagccag

SEQ ID NO: 307296 - DNA, 17 bp, Homo sapiens
aagctctgcatgtgtgt

SEQ ID NO: 307297 - DNA, 16 bp, Homo sapiens
aagctctttgaaacaa

SEQ ID NO: 307298 - DNA, 13 bp, Homo sapiens
aagctgaagaaaa

SEQ ID NO: 307299 - DNA, 15 bp, Homo sapiens
aagctgaagccgcca

SEQ ID NO: 307300 - DNA, 14 bp, Homo sapiens
aagctgaataaagt

SEQ ID NO: 307301 - DNA, 17 bp, Homo sapiens
aagctgaggcgggagaa

SEQ ID NO: 307302 - DNA, 21 bp, Homo sapiens
aagctgagttacttgtctgag

SEQ ID NO: 307303 - DNA, 22 bp, Homo sapiens
aagctgattactgtcaataaac

SEQ ID NO: 307304 - DNA, 17 bp, Homo sapiens
aagctgattcccagagc

SEQ ID NO: 307305 - DNA, 14 bp, Homo sapiens
aagctgcctccctg

SEQ ID NO: 307306 - DNA, 15 bp, Homo sapiens
aagctgcctccctgt

SEQ ID NO: 307307 - DNA, 14 bp, Homo sapiens
aagctgcctgtagt

SEQ ID NO: 307308 - DNA, 22 bp, Homo sapiens
aagctgcctgtagttaggaaat

SEQ ID NO: 307309 - DNA, 14 bp, Homo sapiens
aagctgcttctggg

SEQ ID NO: 307310 - DNA, 23 bp, Homo sapiens
aagctgcttggacctcgtgcttt

SEQ ID NO: 307311 - DNA, 18 bp, Homo sapiens
aagctggagtgctgcttg

SEQ ID NO: 307312 - DNA, 15 bp, Homo sapiens
aagctggggacagct

SEQ ID NO: 307313 - DNA, 18 bp, Homo sapiens
aagctgtactcagagcag

SEQ ID NO: 307314 - DNA, 13 bp, Homo sapiens
aagctgtggccag

SEQ ID NO: 307315 - DNA, 21 bp, Homo sapiens
aagctgtttagtttgttaatt

SEQ ID NO: 307316 - DNA, 16 bp, Homo sapiens
aagcttaaaaaaaact

SEQ ID NO: 307317 - DNA, 13 bp, Homo sapiens
aagcttaaggaga

SEQ ID NO: 307318 - DNA, 17 bp, Homo sapiens
aagcttaatagccctcc

SEQ ID NO: 307319 - DNA, 16 bp, Homo sapiens
aagcttattaatgcta

SEQ ID NO: 307320 - DNA, 19 bp, Homo sapiens
aagcttattaatgctaagg

SEQ ID NO: 307321 - DNA, 15 bp, Homo sapiens
aagcttccacctgtc

SEQ ID NO: 307322 - DNA, 19 bp, Homo sapiens
aagcttcctagcttatctc

SEQ ID NO: 307323 - DNA, 14 bp, Homo sapiens
aagcttgagcctcc

SEQ ID NO: 307324 - DNA, 13 bp, Homo sapiens
aagcttgtttccc

SEQ ID NO: 307325 - DNA, 16 bp, Homo sapiens
aagcttgtttccctgc

SEQ ID NO: 307326 - DNA, 22 bp, Homo sapiens
aagcttgtttccctgctggcca

SEQ ID NO: 307327 - DNA, 18 bp, Homo sapiens
aagctttcctgccccagg

SEQ ID NO: 307328 - DNA, 16 bp, Homo sapiens
aagctttctcctttga

SEQ ID NO: 307329 - DNA, 17 bp, Homo sapiens
aagctttctctgcttca

SEQ ID NO: 307330 - DNA, 13 bp, Homo sapiens
aaggaaaaacaga

SEQ ID NO: 307331 - DNA, 18 bp, Homo sapiens
aaggaaaactcaccattt

SEQ ID NO: 307332 - DNA, 22 bp, Homo sapiens
aaggaaaactcaccatttcatc

SEQ ID NO: 307333 - DNA, 23 bp, Homo sapiens
aaggaaaagagtatcaaaggcag

SEQ ID NO: 307334 - DNA, 14 bp, Homo sapiens
aaggaaaatgatac

SEQ ID NO: 307335 - DNA, 13 bp, Homo sapiens
aaggaaagcaata

SEQ ID NO: 307336 - DNA, 13 bp, Homo sapiens
aaggaaataacat

SEQ ID NO: 307337 - DNA, 14 bp, Homo sapiens
aaggaaataacatt

SEQ ID NO: 307338 - DNA, 12 bp, Homo sapiens
aaggaaatccag

SEQ ID NO: 307339 - DNA, 16 bp, Homo sapiens
aaggaaatctcacccc

SEQ ID NO: 307340 - DNA, 14 bp, Homo sapiens
aaggaagagggctg

SEQ ID NO: 307341 - DNA, 13 bp, Homo sapiens
aaggaataaatga

SEQ ID NO: 307342 - DNA, 21 bp, Homo sapiens
aaggaatagccagagaggagc

SEQ ID NO: 307343 - DNA, 18 bp, Homo sapiens
aaggaataggtaggagac

SEQ ID NO: 307344 - DNA, 18 bp, Homo sapiens
aaggaatgcaagagaagg

SEQ ID NO: 307345 - DNA, 23 bp, Homo sapiens
aaggaattacattttatatgtga

SEQ ID NO: 307346 - DNA, 23 bp, Homo sapiens
aaggacaaaaatgaactgaagtt

SEQ ID NO: 307347 - DNA, 21 bp, Homo sapiens
aaggacattgccccaagatag

SEQ ID NO: 307348 - DNA, 23 bp, Homo sapiens
aaggacatttgggactgtcttga

SEQ ID NO: 307349 - DNA, 21 bp, Homo sapiens
aaggaccaacccatgccctgc

SEQ ID NO: 307350 - DNA, 12 bp, Homo sapiens
aaggaccaggac

SEQ ID NO: 307351 - DNA, 13 bp, Homo sapiens
aaggaccaggact

SEQ ID NO: 307352 - DNA, 13 bp, Homo sapiens
aaggacccaccca

SEQ ID NO: 307353 - DNA, 18 bp, Homo sapiens
aaggacccacccatcttc

SEQ ID NO: 307354 - DNA, 15 bp, Homo sapiens
aaggacctaaattcg

SEQ ID NO: 307355 - DNA, 17 bp, Homo sapiens
aaggacctatgtttgct

SEQ ID NO: 307356 - DNA, 22 bp, Homo sapiens
aaggacctatgtttgctcagaa

SEQ ID NO: 307357 - DNA, 18 bp, Homo sapiens
aaggactaacataaaatc

SEQ ID NO: 307358 - DNA, 18 bp, Homo sapiens
aaggactgacgagagatg

SEQ ID NO: 307359 - DNA, 22 bp, Homo sapiens
aaggactgcatggtaatttata

SEQ ID NO: 307360 - DNA, 22 bp, Homo sapiens
aaggactgccgaccgaggctgg

SEQ ID NO: 307361 - DNA, 24 bp, Homo sapiens
aaggacttcctgctacagtagctg

SEQ ID NO: 307362 - DNA, 17 bp, Homo sapiens
aaggacttgaaagcatc

SEQ ID NO: 307363 - DNA, 22 bp, Homo sapiens
aaggacttgaaagcatccatgt

SEQ ID NO: 307364 - DNA, 17 bp, Homo sapiens
aaggagacaaagcagga

SEQ ID NO: 307365 - DNA, 18 bp, Homo sapiens
aaggagagaaggggagga

SEQ ID NO: 307366 - DNA, 23 bp, Homo sapiens
aaggagaggagtgcgctagagca

SEQ ID NO: 307367 - DNA, 12 bp, Homo sapiens
aaggagagggag

SEQ ID NO: 307368 - DNA, 11 bp, Homo sapiens
aaggagcctgc

SEQ ID NO: 307369 - DNA, 17 bp, Homo sapiens
agaaatcaaagagagaa

SEQ ID NO: 307370 - DNA, 22 bp, Homo sapiens
agaaatcacaggggcggggcag

SEQ ID NO: 307371 - DNA, 22 bp, Homo sapiens
agaaatcccagttcatgttgct

SEQ ID NO: 307372 - DNA, 14 bp, Homo sapiens
agaaatgccgctgt

SEQ ID NO: 307373 - DNA, 12 bp, Homo sapiens
agaaatgctaat

SEQ ID NO: 307374 - DNA, 23 bp, Homo sapiens
agaaatgctgcctgcctgtctgt

SEQ ID NO: 307375 - DNA, 14 bp, Homo sapiens
agaaatgtattttg

SEQ ID NO: 307376 - DNA, 22 bp, Homo sapiens
agaaatgtgaagttttctttta

SEQ ID NO: 307377 - DNA, 19 bp, Homo sapiens
agaaatgtggatgctcttt

SEQ ID NO: 307378 - DNA, 15 bp, Homo sapiens
agaaattacaagttt

SEQ ID NO: 307379 - DNA, 19 bp, Homo sapiens
agaaattacaagtttcagt

SEQ ID NO: 307380 - DNA, 21 bp, Homo sapiens
agaaattagggctctaatttc

SEQ ID NO: 307381 - DNA, 22 bp, Homo sapiens
agaaattagggctctaatttcc

SEQ ID NO: 307382 - DNA, 15 bp, Homo sapiens
agaaattatttaata

SEQ ID NO: 307383 - DNA, 18 bp, Homo sapiens
agaaattcattaaagaaa

SEQ ID NO: 307384 - DNA, 19 bp, Homo sapiens
agaaattcattaaagaaaa

SEQ ID NO: 307385 - DNA, 20 bp, Homo sapiens
agaaattcattaaagaaaaa

SEQ ID NO: 307386 - DNA, 23 bp, Homo sapiens
agaaattgacctgatttccattt

SEQ ID NO: 307387 - DNA, 17 bp, Homo sapiens
aaggagtgcccgccttg

SEQ ID NO: 307388 - DNA, 19 bp, Homo sapiens
aaggatagatcaaagtcaa

SEQ ID NO: 307389 - DNA, 16 bp, Homo sapiens
aaggatagcctttgta

SEQ ID NO: 307390 - DNA, 17 bp, Homo sapiens
aaggatatttaagaaaa

SEQ ID NO: 307391 - DNA, 19 bp, Homo sapiens
aaggatatttaagaaaata

SEQ ID NO: 307392 - DNA, 23 bp, Homo sapiens
aaggatatttaagaaaatacaat

SEQ ID NO: 307393 - DNA, 16 bp, Homo sapiens
aaggatcctctccact

SEQ ID NO: 307394 - DNA, 18 bp, Homo sapiens
aaggatcctctccactcc

SEQ ID NO: 307395 - DNA, 20 bp, Homo sapiens
aaggatcctctccactccat

SEQ ID NO: 307396 - DNA, 20 bp, Homo sapiens
aaggatctctataacagatc

SEQ ID NO: 307397 - DNA, 20 bp, Homo sapiens
aaggatgaaagacaaagaag

SEQ ID NO: 307398 - DNA, 13 bp, Homo sapiens
aaggatgaaagct

SEQ ID NO: 307399 - DNA, 20 bp, Homo sapiens
aaggatgaagaacacagcat

SEQ ID NO: 307400 - DNA, 22 bp, Homo sapiens
aaggatgaagaacacagcatgt

SEQ ID NO: 307401 - DNA, 19 bp, Homo sapiens
aaggatggcagcctcaggg

SEQ ID NO: 307402 - DNA, 18 bp, Homo sapiens
aaggattaagatacactc

SEQ ID NO: 307403 - DNA, 14 bp, Homo sapiens
aaggattgcctttg

SEQ ID NO: 307404 - DNA, 21 bp, Homo sapiens
aaggatttactttttgtaaaa

SEQ ID NO: 307405 - DNA, 13 bp, Homo sapiens
aaggcaaatctcc

SEQ ID NO: 307406 - DNA, 12 bp, Homo sapiens
aaggcaaatgtc

SEQ ID NO: 307407 - DNA, 22 bp, Homo sapiens
aaggcaactagtggagagaact

SEQ ID NO: 307408 - DNA, 15 bp, Homo sapiens
aaggcaagaagtggg

SEQ ID NO: 307409 - DNA, 21 bp, Homo sapiens
aaggcaagattggaaagacag

SEQ ID NO: 307410 - DNA, 14 bp, Homo sapiens
aaggcaataaaact

SEQ ID NO: 307411 - DNA, 23 bp, Homo sapiens
aaggcacccgccctttccttgcc

SEQ ID NO: 307412 - DNA, 22 bp, Homo sapiens
aaggcagaaacacaaccactca

SEQ ID NO: 307413 - DNA, 16 bp, Homo sapiens
aaggcagaaaggagat

SEQ ID NO: 307414 - DNA, 16 bp, Homo sapiens
aaggcagagaaaacac

SEQ ID NO: 307415 - DNA, 11 bp, Homo sapiens
aaggcagcctc

SEQ ID NO: 307416 - DNA, 16 bp, Homo sapiens
aaggcagcctccagag

SEQ ID NO: 307417 - DNA, 17 bp, Homo sapiens
aaggcagcctccagagc

SEQ ID NO: 307418 - DNA, 18 bp, Homo sapiens
aaggcagcctccagagcc

SEQ ID NO: 307419 - DNA, 21 bp, Homo sapiens
aaggcagcctccagagccagc

SEQ ID NO: 307420 - DNA, 12 bp, Homo sapiens
aaggcagctgct

SEQ ID NO: 307421 - DNA, 17 bp, Homo sapiens
aaggcagtattcccttt

SEQ ID NO: 307422 - DNA, 16 bp, Homo sapiens
aaggcagtccagagct

SEQ ID NO: 307423 - DNA, 18 bp, Homo sapiens
aaggcagtccagagcttt

SEQ ID NO: 307424 - DNA, 17 bp, Homo sapiens
aaggcatctaagacatt

SEQ ID NO: 307425 - DNA, 14 bp, Homo sapiens
aaggccacctgcag

SEQ ID NO: 307426 - DNA, 17 bp, Homo sapiens
aaggccagagtggcctg

SEQ ID NO: 307427 - DNA, 20 bp, Homo sapiens
aaggccagagtggcctggcc

SEQ ID NO: 307428 - DNA, 14 bp, Homo sapiens
aaggccccagagac

SEQ ID NO: 307429 - DNA, 15 bp, Homo sapiens
aaggccgcccacctg

SEQ ID NO: 307430 - DNA, 16 bp, Homo sapiens
aaggccgcccacctgc

SEQ ID NO: 307431 - DNA, 15 bp, Homo sapiens
aaggccggtgggaag

SEQ ID NO: 307432 - DNA, 21 bp, Homo sapiens
aaggcctatgccacctgcagc

SEQ ID NO: 307433 - DNA, 12 bp, Homo sapiens
aaggcctcagga

SEQ ID NO: 307434 - DNA, 12 bp, Homo sapiens
aaggcctgaggg

SEQ ID NO: 307435 - DNA, 18 bp, Homo sapiens
aaggcctgccccccttcc

SEQ ID NO: 307436 - DNA, 14 bp, Homo sapiens
aaggcctgccctcc

SEQ ID NO: 307437 - DNA, 18 bp, Homo sapiens
aaggcctgccctcccatg

SEQ ID NO: 307438 - DNA, 16 bp, Homo sapiens
aaggcctgtccctggc

SEQ ID NO: 307439 - DNA, 21 bp, Homo sapiens
aaggccttattctacatttca

SEQ ID NO: 307440 - DNA, 15 bp, Homo sapiens
aaggccttctcctcc

SEQ ID NO: 307441 - DNA, 16 bp, Homo sapiens
aaggcgaggagagtgg

SEQ ID NO: 307442 - DNA, 21 bp, Homo sapiens
aaggctaaagaagacacacag

SEQ ID NO: 307443 - DNA, 14 bp, Homo sapiens
aaggctctcacccc

SEQ ID NO: 307444 - DNA, 17 bp, Homo sapiens
aaggctctcccctctcg

SEQ ID NO: 307445 - DNA, 15 bp, Homo sapiens
aaggctgaaaagtgc

SEQ ID NO: 307446 - DNA, 17 bp, Homo sapiens
aaggctgcacactgaca

SEQ ID NO: 307447 - DNA, 14 bp, Homo sapiens
aaggctgccggctg

SEQ ID NO: 307448 - DNA, 20 bp, Homo sapiens
aaggctggctgaaaatcact

SEQ ID NO: 307449 - DNA, 21 bp, Homo sapiens
aaggctggctgaaaatcacta

SEQ ID NO: 307450 - DNA, 14 bp, Homo sapiens
aaggcttaggactt

SEQ ID NO: 307451 - DNA, 17 bp, Homo sapiens
aaggctttggcaacaga

SEQ ID NO: 307452 - DNA, 21 bp, Homo sapiens
aagggaaaaaagcaactttcc

SEQ ID NO: 307453 - DNA, 23 bp, Homo sapiens
aagggaaaacaaatatttcactt

SEQ ID NO: 307454 - DNA, 13 bp, Homo sapiens
aagggaaatatca

SEQ ID NO: 307455 - DNA, 16 bp, Homo sapiens
aagggaaccagccctc

SEQ ID NO: 307456 - DNA, 23 bp, Homo sapiens
aagggaaggccccacagacaagg

SEQ ID NO: 307457 - DNA, 18 bp, Homo sapiens
aagggaatgaatccatta

SEQ ID NO: 307458 - DNA, 15 bp, Homo sapiens
aagggacagcatgcc

SEQ ID NO: 307459 - DNA, 20 bp, Homo sapiens
aagggactggtccaggcatg

SEQ ID NO: 307460 - DNA, 17 bp, Homo sapiens
aagggagagacctcatc

SEQ ID NO: 307461 - DNA, 23 bp, Homo sapiens
aagggagcccctcctctgagcag

SEQ ID NO: 307462 - DNA, 16 bp, Homo sapiens
aagggagtaggctgta

SEQ ID NO: 307463 - DNA, 19 bp, Homo sapiens
aagggagtaggctgtattt

SEQ ID NO: 307464 - DNA, 11 bp, Homo sapiens
aagggattctg

SEQ ID NO: 307465 - DNA, 15 bp, Homo sapiens
aagggattctgggaa

SEQ ID NO: 307466 - DNA, 14 bp, Homo sapiens
aagggcaaatctgc

SEQ ID NO: 307467 - DNA, 18 bp, Homo sapiens
aagggcagcaagataaac

SEQ ID NO: 307468 - DNA, 15 bp, Homo sapiens
aagggcagcccctcc

SEQ ID NO: 307469 - DNA, 15 bp, Homo sapiens
aagggcagcttcagt

SEQ ID NO: 307470 - DNA, 21 bp, Homo sapiens
aagggcaggaaggagagcctg

SEQ ID NO: 307471 - DNA, 15 bp, Homo sapiens
aagggccagagcctg

SEQ ID NO: 307472 - DNA, 22 bp, Homo sapiens
aagggccagtcctgcctggcca

SEQ ID NO: 307473 - DNA, 20 bp, Homo sapiens
aagggcttatctagccaaag

SEQ ID NO: 307474 - DNA, 15 bp, Homo sapiens
aaggggaattaacaa

SEQ ID NO: 307475 - DNA, 22 bp, Homo sapiens
aaggggagaaactgaaagtgtt

SEQ ID NO: 307476 - DNA, 23 bp, Homo sapiens
aaggggagaaactgaaagtgttt

SEQ ID NO: 307477 - DNA, 13 bp, Homo sapiens
aaggggagagtaa

SEQ ID NO: 307478 - DNA, 13 bp, Homo sapiens
aaggggaggaggg

SEQ ID NO: 307479 - DNA, 15 bp, Homo sapiens
aaggggaggagggcg

SEQ ID NO: 307480 - DNA, 13 bp, Homo sapiens
aaggggagttgag

SEQ ID NO: 307481 - DNA, 16 bp, Homo sapiens
aaggggatctaaaagg

SEQ ID NO: 307482 - DNA, 17 bp, Homo sapiens
aaggggcacaccactgc

SEQ ID NO: 307483 - DNA, 15 bp, Homo sapiens
aaggggcaggaatca

SEQ ID NO: 307484 - DNA, 16 bp, Homo sapiens
aaggggccccggggct

SEQ ID NO: 307485 - DNA, 17 bp, Homo sapiens
aaggggccccggggctg

SEQ ID NO: 307486 - DNA, 15 bp, Homo sapiens
aaggggcgtgtccct

SEQ ID NO: 307487 - DNA, 12 bp, Homo sapiens
aaggggctgctg

SEQ ID NO: 307488 - DNA, 22 bp, Homo sapiens
aagggggctattccctggagac

SEQ ID NO: 307489 - DNA, 18 bp, Homo sapiens
aagggtgggcatcaaaga

SEQ ID NO: 307490 - DNA, 16 bp, Homo sapiens
aagggttctgtaaaat

SEQ ID NO: 307491 - DNA, 15 bp, Homo sapiens
aagggttgaaggcag

SEQ ID NO: 307492 - DNA, 20 bp, Homo sapiens
aagggttgcttctgagtggt

SEQ ID NO: 307493 - DNA, 12 bp, Homo sapiens
aagggttgtgag

SEQ ID NO: 307494 - DNA, 22 bp, Homo sapiens
aagggttgtgagccccttgggg

SEQ ID NO: 307495 - DNA, 13 bp, Homo sapiens
aaggtaaatacaa

SEQ ID NO: 307496 - DNA, 17 bp, Homo sapiens
aaggtaatctgaaacac

SEQ ID NO: 307497 - DNA, 17 bp, Homo sapiens
aaggtaatttcttgtgc

SEQ ID NO: 307498 - DNA, 20 bp, Homo sapiens
aaggtaccaagatcacaaat

SEQ ID NO: 307499 - DNA, 22 bp, Homo sapiens
aaggtacggtgagactctgagg

SEQ ID NO: 307500 - DNA, 16 bp, Homo sapiens
aaggtatcacacactt

SEQ ID NO: 307501 - DNA, 14 bp, Homo sapiens
aaggtatctggtat

SEQ ID NO: 307502 - DNA, 17 bp, Homo sapiens
aaggtcagattagggcg

SEQ ID NO: 307503 - DNA, 22 bp, Homo sapiens
aaggtcagtgttataaaatctg

SEQ ID NO: 307504 - DNA, 12 bp, Homo sapiens
aaggtcatctca

SEQ ID NO: 307505 - DNA, 17 bp, Homo sapiens
aaggtcattgtggctat

SEQ ID NO: 307506 - DNA, 17 bp, Homo sapiens
aaggtcctgtggggagc

SEQ ID NO: 307507 - DNA, 14 bp, Homo sapiens
agaagccttggtac

SEQ ID NO: 307508 - DNA, 18 bp, Homo sapiens
agaagctctcgagggaag

SEQ ID NO: 307509 - DNA, 17 bp, Homo sapiens
agaagctgatctgattg

SEQ ID NO: 307510 - DNA, 16 bp, Homo sapiens
agaagcttcagaagtt

SEQ ID NO: 307511 - DNA, 14 bp, Homo sapiens
agaagcttgtatta

SEQ ID NO: 307512 - DNA, 20 bp, Homo sapiens
agaaggaacccggtcccagg

SEQ ID NO: 307513 - DNA, 23 bp, Homo sapiens
agaaggaacccggtcccaggccg

SEQ ID NO: 307514 - DNA, 21 bp, Homo sapiens
agaaggacttcctgctacagt

SEQ ID NO: 307515 - DNA, 13 bp, Homo sapiens
agaaggagagccc

SEQ ID NO: 307516 - DNA, 20 bp, Homo sapiens
agaaggagagcccaggcctg

SEQ ID NO: 307517 - DNA, 21 bp, Homo sapiens
agaaggagagggagtacaaag

SEQ ID NO: 307518 - DNA, 13 bp, Homo sapiens
aaggtgcccagga

SEQ ID NO: 307519 - DNA, 16 bp, Homo sapiens
aaggtgccgtgagcag

SEQ ID NO: 307520 - DNA, 22 bp, Homo sapiens
aaggtgctacggtagtgatgaa

SEQ ID NO: 307521 - DNA, 14 bp, Homo sapiens
aaggtgctgagctt

SEQ ID NO: 307522 - DNA, 14 bp, Homo sapiens
aaggtgcttgggct

SEQ ID NO: 307523 - DNA, 17 bp, Homo sapiens
aaggtgggccttgctac

SEQ ID NO: 307524 - DNA, 22 bp, Homo sapiens
aaggtgggccttgctacctcaa

SEQ ID NO: 307525 - DNA, 16 bp, Homo sapiens
aaggtgggggagcctg

SEQ ID NO: 307526 - DNA, 18 bp, Homo sapiens
aaggtgggggagcctgga

SEQ ID NO: 307527 - DNA, 19 bp, Homo sapiens
aaggtgggggagcctggag

SEQ ID NO: 307528 - DNA, 20 bp, Homo sapiens
aaggtgggggagcctggagc

SEQ ID NO: 307529 - DNA, 22 bp, Homo sapiens
aaggtgggggttggctgggtac

SEQ ID NO: 307530 - DNA, 15 bp, Homo sapiens
aaggtgggtccagga

SEQ ID NO: 307531 - DNA, 21 bp, Homo sapiens
aaggtgggtccaggaaggcag

SEQ ID NO: 307532 - DNA, 20 bp, Homo sapiens
aaggtgtctggacattcaga

SEQ ID NO: 307533 - DNA, 17 bp, Homo sapiens
aaggttaggatttaaca

SEQ ID NO: 307534 - DNA, 13 bp, Homo sapiens
aaggttctggtaa

SEQ ID NO: 307535 - DNA, 21 bp, Homo sapiens
aaggttggaactgctgccatg

SEQ ID NO: 307536 - DNA, 23 bp, Homo sapiens
aaggttggaactgctgccatgat

SEQ ID NO: 307537 - DNA, 22 bp, Homo sapiens
aaggttgggttagcaatattta

SEQ ID NO: 307538 - DNA, 16 bp, Homo sapiens
aaggttgtacatagtg

SEQ ID NO: 307539 - DNA, 20 bp, Homo sapiens
aaggtttgttttccatccat

SEQ ID NO: 307540 - DNA, 13 bp, Homo sapiens
aagtaaaaacact

SEQ ID NO: 307541 - DNA, 13 bp, Homo sapiens
aagtaaactgccc

SEQ ID NO: 307542 - DNA, 15 bp, Homo sapiens
aagtaaatagcaaca

SEQ ID NO: 307543 - DNA, 15 bp, Homo sapiens
aagtaaatgtctgtg

SEQ ID NO: 307544 - DNA, 12 bp, Homo sapiens
aagtaacatata

SEQ ID NO: 307545 - DNA, 21 bp, Homo sapiens
aagtaagaaagtgaagcaaat

SEQ ID NO: 307546 - DNA, 15 bp, Homo sapiens
aagtaaggtgcagtt

SEQ ID NO: 307547 - DNA, 21 bp, Homo sapiens
aagtaagtttatccaaatctt

SEQ ID NO: 307548 - DNA, 22 bp, Homo sapiens
aagtaattatcgggaacagtgt

SEQ ID NO: 307549 - DNA, 14 bp, Homo sapiens
aagtaattcctctc

SEQ ID NO: 307550 - DNA, 16 bp, Homo sapiens
aagtacaaaaaagttt

SEQ ID NO: 307551 - DNA, 14 bp, Homo sapiens
aagtacagccttca

SEQ ID NO: 307552 - DNA, 20 bp, Homo sapiens
aagtacatattaggaaaata

SEQ ID NO: 307553 - DNA, 13 bp, Homo sapiens
aagtacatttaat

SEQ ID NO: 307554 - DNA, 24 bp, Homo sapiens
aagtaccaatgctgttgtaaacaa

SEQ ID NO: 307555 - DNA, 15 bp, Homo sapiens
aagtacgttattgtt

SEQ ID NO: 307556 - DNA, 13 bp, Homo sapiens
aagtactaaaact

SEQ ID NO: 307557 - DNA, 19 bp, Homo sapiens
aagtagacttcatttttcc

SEQ ID NO: 307558 - DNA, 14 bp, Homo sapiens
aagtagagaagtat

SEQ ID NO: 307559 - DNA, 15 bp, Homo sapiens
aagtagagaagtatc

SEQ ID NO: 307560 - DNA, 14 bp, Homo sapiens
aagtaggtatacaa

SEQ ID NO: 307561 - DNA, 15 bp, Homo sapiens
aagtaggtatacaaa

SEQ ID NO: 307562 - DNA, 17 bp, Homo sapiens
aagtagtccaggctgtc

SEQ ID NO: 307563 - DNA, 20 bp, Homo sapiens
aagtagtttgtataacttct

SEQ ID NO: 307564 - DNA, 16 bp, Homo sapiens
aagtataaatttgtgt

SEQ ID NO: 307565 - DNA, 18 bp, Homo sapiens
aagtataaatttgtgtaa

SEQ ID NO: 307566 - DNA, 13 bp, Homo sapiens
aagtatcagaaag

SEQ ID NO: 307567 - DNA, 11 bp, Homo sapiens
aagtatcatgc

SEQ ID NO: 307568 - DNA, 18 bp, Homo sapiens
aagtatcttttttcaaaa

SEQ ID NO: 307569 - DNA, 21 bp, Homo sapiens
aagtatgtaaacaggagacag

SEQ ID NO: 307570 - DNA, 18 bp, Homo sapiens
aagtatgtgagtgtgtcc

SEQ ID NO: 307571 - DNA, 18 bp, Homo sapiens
aagtatgtgatatctgaa

SEQ ID NO: 307572 - DNA, 21 bp, Homo sapiens
aagtattcatacaccttgcta

SEQ ID NO: 307573 - DNA, 21 bp, Homo sapiens
aagtattccaccttaaattaa

SEQ ID NO: 307574 - DNA, 18 bp, Homo sapiens
aagtattccttggcccag

SEQ ID NO: 307575 - DNA, 13 bp, Homo sapiens
aagtattgaaagt

SEQ ID NO: 307576 - DNA, 14 bp, Homo sapiens
aagtatttaaatgt

SEQ ID NO: 307577 - DNA, 15 bp, Homo sapiens
aagtatttaaatgtt

SEQ ID NO: 307578 - DNA, 16 bp, Homo sapiens
aagtatttaaatgttc

SEQ ID NO: 307579 - DNA, 13 bp, Homo sapiens
aagtatttatata

SEQ ID NO: 307580 - DNA, 14 bp, Homo sapiens
aagtatttatatat

SEQ ID NO: 307581 - DNA, 15 bp, Homo sapiens
aagtatttatatatt

SEQ ID NO: 307582 - DNA, 20 bp, Homo sapiens
aagtatttatatatttataa

SEQ ID NO: 307583 - DNA, 11 bp, Homo sapiens
aagtattttgc

SEQ ID NO: 307584 - DNA, 16 bp, Homo sapiens
aagtcacagctgcagc

SEQ ID NO: 307585 - DNA, 17 bp, Homo sapiens
aagtcacagctgcagct

SEQ ID NO: 307586 - DNA, 23 bp, Homo sapiens
aagtcacagctgcagctgggccc

SEQ ID NO: 307587 - DNA, 16 bp, Homo sapiens
aagtcactcaattgtt

SEQ ID NO: 307588 - DNA, 21 bp, Homo sapiens
aagtcactcaattgtttttgt

SEQ ID NO: 307589 - DNA, 14 bp, Homo sapiens
aagtcactgcacag

SEQ ID NO: 307590 - DNA, 17 bp, Homo sapiens
aagtcagagaaaacact

SEQ ID NO: 307591 - DNA, 15 bp, Homo sapiens
aagtcaggagccagc

SEQ ID NO: 307592 - DNA, 19 bp, Homo sapiens
aagtcagtcaacatttaca

SEQ ID NO: 307593 - DNA, 14 bp, Homo sapiens
aagtcatcataaaa

SEQ ID NO: 307594 - DNA, 13 bp, Homo sapiens
aagtcatctttga

SEQ ID NO: 307595 - DNA, 21 bp, Homo sapiens
aagtcatgaagctcagtttgg

SEQ ID NO: 307596 - DNA, 19 bp, Homo sapiens
aagtcatgatggagacttc

SEQ ID NO: 307597 - DNA, 15 bp, Homo sapiens
aagtcatgtgcattt

SEQ ID NO: 307598 - DNA, 20 bp, Homo sapiens
aagtcattttaactttatca

SEQ ID NO: 307599 - DNA, 16 bp, Homo sapiens
aagtccaacctgcctg

SEQ ID NO: 307600 - DNA, 19 bp, Homo sapiens
aagtccaacctgcctgtgc

SEQ ID NO: 307601 - DNA, 15 bp, Homo sapiens
aagtccagctctccc

SEQ ID NO: 307602 - DNA, 17 bp, Homo sapiens
aagtccagctctcccct

SEQ ID NO: 307603 - DNA, 21 bp, Homo sapiens
aagtccagctctcccctgcgc

SEQ ID NO: 307604 - DNA, 20 bp, Homo sapiens
aagtccaggcagagacaata

SEQ ID NO: 307605 - DNA, 19 bp, Homo sapiens
aagtccaggtcgggctcag

SEQ ID NO: 307606 - DNA, 11 bp, Homo sapiens
aagtccctgag

SEQ ID NO: 307607 - DNA, 14 bp, Homo sapiens
aagtccctgccccc

SEQ ID NO: 307608 - DNA, 13 bp, Homo sapiens
aagtcccttcctg

SEQ ID NO: 307609 - DNA, 18 bp, Homo sapiens
aagtcctccctcctgcag

SEQ ID NO: 307610 - DNA, 22 bp, Homo sapiens
aagtcctccctcctgcaggctg

SEQ ID NO: 307611 - DNA, 16 bp, Homo sapiens
aagtcctgcctttggg

SEQ ID NO: 307612 - DNA, 21 bp, Homo sapiens
aagtccttcagtgagcccctc

SEQ ID NO: 307613 - DNA, 14 bp, Homo sapiens
aagtcgctgaacaa

SEQ ID NO: 307614 - DNA, 11 bp, Homo sapiens
aagtctatttt

SEQ ID NO: 307615 - DNA, 15 bp, Homo sapiens
aagtctctgctggcc

SEQ ID NO: 307616 - DNA, 15 bp, Homo sapiens
aagtctctttttctt

SEQ ID NO: 307617 - DNA, 22 bp, Homo sapiens
aagtctctttttttggcccagg

SEQ ID NO: 307618 - DNA, 22 bp, Homo sapiens
aagtctgaggcacctgcatatc

SEQ ID NO: 307619 - DNA, 16 bp, Homo sapiens
aagtctgcattacatt

SEQ ID NO: 307620 - DNA, 23 bp, Homo sapiens
aagtctgtgcctggagctcctgg

SEQ ID NO: 307621 - DNA, 16 bp, Homo sapiens
aagtcttacaggaagc

SEQ ID NO: 307622 - DNA, 17 bp, Homo sapiens
aagtcttcaagggctgc

SEQ ID NO: 307623 - DNA, 21 bp, Homo sapiens
aagtcttcaagggctgcttca

SEQ ID NO: 307624 - DNA, 20 bp, Homo sapiens
aagtcttcactctctgaaga

SEQ ID NO: 307625 - DNA, 20 bp, Homo sapiens
aagtcttccatcagcagtga

SEQ ID NO: 307626 - DNA, 12 bp, Homo sapiens
aagtcttgcatt

SEQ ID NO: 307627 - DNA, 17 bp, Homo sapiens
aagtcttgctgtggtct

SEQ ID NO: 307628 - DNA, 21 bp, Homo sapiens
aagtcttgctgtggtctcttt

SEQ ID NO: 307629 - DNA, 23 bp, Homo sapiens
aagtcttgtgactagtgctgaag

SEQ ID NO: 307630 - DNA, 13 bp, Homo sapiens
aagtgaaaatctt

SEQ ID NO: 307631 - DNA, 14 bp, Homo sapiens
aagtgaaaatctta

SEQ ID NO: 307632 - DNA, 14 bp, Homo sapiens
aagtgaaagacatt

SEQ ID NO: 307633 - DNA, 16 bp, Homo sapiens
aagtgaaagacatttc

SEQ ID NO: 307634 - DNA, 16 bp, Homo sapiens
aagtgaagaagccatc

SEQ ID NO: 307635 - DNA, 15 bp, Homo sapiens
aagtgaataaaaatt

SEQ ID NO: 307636 - DNA, 18 bp, Homo sapiens
aagtgaatctaataaaat

SEQ ID NO: 307637 - DNA, 17 bp, Homo sapiens
aagtgaatttgaatgaa

SEQ ID NO: 307638 - DNA, 16 bp, Homo sapiens
aagtgacaaggcccca

SEQ ID NO: 307639 - DNA, 19 bp, Homo sapiens
aagtgacaaggccccagag

SEQ ID NO: 307640 - DNA, 20 bp, Homo sapiens
aagtgactaccagaaagtga

SEQ ID NO: 307641 - DNA, 23 bp, Homo sapiens
aagtgactgtttggcttataaac

SEQ ID NO: 307642 - DNA, 16 bp, Homo sapiens
aagtgacttgaatgta

SEQ ID NO: 307643 - DNA, 15 bp, Homo sapiens
aagtgagcaaacctg

SEQ ID NO: 307644 - DNA, 17 bp, Homo sapiens
aagtgagcactgagggt

SEQ ID NO: 307645 - DNA, 19 bp, Homo sapiens
agacaatgacactggaagg

SEQ ID NO: 307646 - DNA, 17 bp, Homo sapiens
agacaatgcagatgcca

SEQ ID NO: 307647 - DNA, 17 bp, Homo sapiens
agacaatggctatatta

SEQ ID NO: 307648 - DNA, 18 bp, Homo sapiens
agacaatggctatattaa

SEQ ID NO: 307649 - DNA, 20 bp, Homo sapiens
aagtgagcgtgtagcgtcct

SEQ ID NO: 307650 - DNA, 13 bp, Homo sapiens
aagtgagtggcat

SEQ ID NO: 307651 - DNA, 23 bp, Homo sapiens
aagtgatcaataaaatgtgattt

SEQ ID NO: 307652 - DNA, 21 bp, Homo sapiens
aagtgatgagctgaaaagtga

SEQ ID NO: 307653 - DNA, 16 bp, Homo sapiens
aagtgatgatggatga

SEQ ID NO: 307654 - DNA, 20 bp, Homo sapiens
aagtgatgtgatttatgcat

SEQ ID NO: 307655 - DNA, 23 bp, Homo sapiens
aagtgatgtgatttatgcattta

SEQ ID NO: 307656 - DNA, 21 bp, Homo sapiens
aagtgattctcctgcctcagc

SEQ ID NO: 307657 - DNA, 13 bp, Homo sapiens
aagtgattgacat

SEQ ID NO: 307658 - DNA, 21 bp, Homo sapiens
aagtgatttgtaatatgattt

SEQ ID NO: 307659 - DNA, 23 bp, Homo sapiens
aagtgcatttctgaatagaaatg

SEQ ID NO: 307660 - DNA, 21 bp, Homo sapiens
aagtgccactgcccgagctgg

SEQ ID NO: 307661 - DNA, 16 bp, Homo sapiens
aagtgcccaaagtggg

SEQ ID NO: 307662 - DNA, 18 bp, Homo sapiens
aagtgcccaaagtgggga

SEQ ID NO: 307663 - DNA, 22 bp, Homo sapiens
aagtgcctgcttttaggtcatc

SEQ ID NO: 307664 - DNA, 12 bp, Homo sapiens
aagtgccttaat

SEQ ID NO: 307665 - DNA, 18 bp, Homo sapiens
aagtgcctttctgcagtt

SEQ ID NO: 307666 - DNA, 17 bp, Homo sapiens
aagtgctcagttccaat

SEQ ID NO: 307667 - DNA, 13 bp, Homo sapiens
aagtgctgtaccc

SEQ ID NO: 307668 - DNA, 22 bp, Homo sapiens
aagtgctgtacccttccacctc

SEQ ID NO: 307669 - DNA, 21 bp, Homo sapiens
aagtgctttgctggagtcctg

SEQ ID NO: 307670 - DNA, 21 bp, Homo sapiens
aagtgcttttaaactggagag

SEQ ID NO: 307671 - DNA, 11 bp, Homo sapiens
aagtggaaaaa

SEQ ID NO: 307672 - DNA, 14 bp, Homo sapiens
aagtggatggaagt

SEQ ID NO: 307673 - DNA, 18 bp, Homo sapiens
aagtggcctgagaagagt

SEQ ID NO: 307674 - DNA, 18 bp, Homo sapiens
aagtgggagatgaaaacc

SEQ ID NO: 307675 - DNA, 19 bp, Homo sapiens
aagtgggattcaggaatgg

SEQ ID NO: 307676 - DNA, 11 bp, Homo sapiens
aagtgggctgg

SEQ ID NO: 307677 - DNA, 12 bp, Homo sapiens
aagtgggctggt

SEQ ID NO: 307678 - DNA, 23 bp, Homo sapiens
aagtgggctggtattctctctat

SEQ ID NO: 307679 - DNA, 23 bp, Homo sapiens
aagtggggcctccttgtccaggt

SEQ ID NO: 307680 - DNA, 14 bp, Homo sapiens
aagtggtacaggaa

SEQ ID NO: 307681 - DNA, 15 bp, Homo sapiens
aagtgtaaaatagaa

SEQ ID NO: 307682 - DNA, 16 bp, Homo sapiens
aagtgtacagaagaat

SEQ ID NO: 307683 - DNA, 17 bp, Homo sapiens
aagtgtacagaagaatt

SEQ ID NO: 307684 - DNA, 15 bp, Homo sapiens
aagtgtacagtattt

SEQ ID NO: 307685 - DNA, 17 bp, Homo sapiens
aagtgtactaattaaca

SEQ ID NO: 307686 - DNA, 15 bp, Homo sapiens
aagtgtactggattt

SEQ ID NO: 307687 - DNA, 17 bp, Homo sapiens
aagtgtagatgtagcat

SEQ ID NO: 307688 - DNA, 23 bp, Homo sapiens
aagtgtatatcagaaaagggaag

SEQ ID NO: 307689 - DNA, 17 bp, Homo sapiens
aagtgtatgtgtgaatt

SEQ ID NO: 307690 - DNA, 15 bp, Homo sapiens
aagtgtccgagaact

SEQ ID NO: 307691 - DNA, 18 bp, Homo sapiens
aagtgtctacatgtgcca

SEQ ID NO: 307692 - DNA, 19 bp, Homo sapiens
aagtgtctcagtccacctg

SEQ ID NO: 307693 - DNA, 13 bp, Homo sapiens
aagtgtgagcaaa

SEQ ID NO: 307694 - DNA, 13 bp, Homo sapiens
aagtgtgcctgct

SEQ ID NO: 307695 - DNA, 14 bp, Homo sapiens
aagtgtgcctgcta

SEQ ID NO: 307696 - DNA, 17 bp, Homo sapiens
aagtgtggctggtgtcc

SEQ ID NO: 307697 - DNA, 22 bp, Homo sapiens
aagtgtgtatgtgcgtgtgtgc

SEQ ID NO: 307698 - DNA, 17 bp, Homo sapiens
aagtgtgtgtgcaatgt

SEQ ID NO: 307699 - DNA, 17 bp, Homo sapiens
aagtgttcaagaaataa

SEQ ID NO: 307700 - DNA, 16 bp, Homo sapiens
aagtgttgctcttgga

SEQ ID NO: 307701 - DNA, 11 bp, Homo sapiens
aagtgttggtc

SEQ ID NO: 307702 - DNA, 15 bp, Homo sapiens
aagtgtttatttttc

SEQ ID NO: 307703 - DNA, 19 bp, Homo sapiens
aagtgtttatttttcatat

SEQ ID NO: 307704 - DNA, 16 bp, Homo sapiens
aagtgtttttctttaa

SEQ ID NO: 307705 - DNA, 20 bp, Homo sapiens
aagtgtttttctttaatcaa

SEQ ID NO: 307706 - DNA, 22 bp, Homo sapiens
aagtgtttttctttaatcaaaa

SEQ ID NO: 307707 - DNA, 21 bp, Homo sapiens
aagttaaaaaaaataataaat

SEQ ID NO: 307708 - DNA, 11 bp, Homo sapiens
aagttaaaagt

SEQ ID NO: 307709 - DNA, 16 bp, Homo sapiens
aagttaaagagacaaa

SEQ ID NO: 307710 - DNA, 17 bp, Homo sapiens
aagttaaagtgaataac

SEQ ID NO: 307711 - DNA, 14 bp, Homo sapiens
aagttaaataaatc

SEQ ID NO: 307712 - DNA, 17 bp, Homo sapiens
aagttaacaaggaatgc

SEQ ID NO: 307713 - DNA, 12 bp, Homo sapiens
aagttaacatta

SEQ ID NO: 307714 - DNA, 16 bp, Homo sapiens
aagttaagattcttgg

SEQ ID NO: 307715 - DNA, 20 bp, Homo sapiens
aagttaagcagcctttctgt

SEQ ID NO: 307716 - DNA, 20 bp, Homo sapiens
aagttaagctgctatagtaa

SEQ ID NO: 307717 - DNA, 19 bp, Homo sapiens
aagttacagaaatactata

SEQ ID NO: 307718 - DNA, 18 bp, Homo sapiens
aagttactatcctggctt

SEQ ID NO: 307719 - DNA, 13 bp, Homo sapiens
aagttaggcagtc

SEQ ID NO: 307720 - DNA, 20 bp, Homo sapiens
aagttataaatcaatgtcac

SEQ ID NO: 307721 - DNA, 18 bp, Homo sapiens
aagttataccagcaaaag

SEQ ID NO: 307722 - DNA, 17 bp, Homo sapiens
aagttatagtatatctg

SEQ ID NO: 307723 - DNA, 12 bp, Homo sapiens
aagttattgtac

SEQ ID NO: 307724 - DNA, 13 bp, Homo sapiens
aagttatttactt

SEQ ID NO: 307725 - DNA, 14 bp, Homo sapiens
aagttatttacttt

SEQ ID NO: 307726 - DNA, 15 bp, Homo sapiens
aagttatttactttt

SEQ ID NO: 307727 - DNA, 13 bp, Homo sapiens
aagttatttcttg

SEQ ID NO: 307728 - DNA, 19 bp, Homo sapiens
aagttatttcttgtttgtt

SEQ ID NO: 307729 - DNA, 18 bp, Homo sapiens
aagttcaagactgaaatg

SEQ ID NO: 307730 - DNA, 14 bp, Homo sapiens
aagttcatagggtc

SEQ ID NO: 307731 - DNA, 17 bp, Homo sapiens
aagttcatagtttctgt

SEQ ID NO: 307732 - DNA, 18 bp, Homo sapiens
aagttcatagtttctgta

SEQ ID NO: 307733 - DNA, 20 bp, Homo sapiens
aagttcatgtttgtaaatta

SEQ ID NO: 307734 - DNA, 17 bp, Homo sapiens
aagttccagttttgttt

SEQ ID NO: 307735 - DNA, 20 bp, Homo sapiens
aagttccagttttgttttga

SEQ ID NO: 307736 - DNA, 18 bp, Homo sapiens
aagttccgtctcctctcc

SEQ ID NO: 307737 - DNA, 15 bp, Homo sapiens
aagttcgaaagaaaa

SEQ ID NO: 307738 - DNA, 15 bp, Homo sapiens
aagttctatttaagt

SEQ ID NO: 307739 - DNA, 17 bp, Homo sapiens
aagttctatttaagtgt

SEQ ID NO: 307740 - DNA, 18 bp, Homo sapiens
aagttcttcacctctatc

SEQ ID NO: 307741 - DNA, 18 bp, Homo sapiens
aagttgaagctaagattt

SEQ ID NO: 307742 - DNA, 13 bp, Homo sapiens
aagttgaccttta

SEQ ID NO: 307743 - DNA, 22 bp, Homo sapiens
aagttgcagtgagctgatatca

SEQ ID NO: 307744 - DNA, 14 bp, Homo sapiens
aagttgcgacggag

SEQ ID NO: 307745 - DNA, 19 bp, Homo sapiens
aagttgctgagaaatgggg

SEQ ID NO: 307746 - DNA, 20 bp, Homo sapiens
aagttgtaaggattgccttt

SEQ ID NO: 307747 - DNA, 21 bp, Homo sapiens
aagttgttagtgatttgctat

SEQ ID NO: 307748 - DNA, 14 bp, Homo sapiens
aagtttaaatacca

SEQ ID NO: 307749 - DNA, 15 bp, Homo sapiens
aagtttaaataccag

SEQ ID NO: 307750 - DNA, 17 bp, Homo sapiens
aagtttaaataccagta

SEQ ID NO: 307751 - DNA, 19 bp, Homo sapiens
aagtttacaatcaaaggaa

SEQ ID NO: 307752 - DNA, 20 bp, Homo sapiens
aagtttacagtaaataaatt

SEQ ID NO: 307753 - DNA, 22 bp, Homo sapiens
aagtttacagtaaataaattgt

SEQ ID NO: 307754 - DNA, 13 bp, Homo sapiens
aagtttagaaatt

SEQ ID NO: 307755 - DNA, 20 bp, Homo sapiens
aagtttagaaattacaagtt

SEQ ID NO: 307756 - DNA, 18 bp, Homo sapiens
aagtttatccaaatcttg

SEQ ID NO: 307757 - DNA, 17 bp, Homo sapiens
aagtttatgtctaaaga

SEQ ID NO: 307758 - DNA, 13 bp, Homo sapiens
aagtttcatttat

SEQ ID NO: 307759 - DNA, 12 bp, Homo sapiens
aagtttccatat

SEQ ID NO: 307760 - DNA, 18 bp, Homo sapiens
aagtttccatatgttata

SEQ ID NO: 307761 - DNA, 17 bp, Homo sapiens
aagtttctacattctct

SEQ ID NO: 307762 - DNA, 18 bp, Homo sapiens
aagtttgggctaacattt

SEQ ID NO: 307763 - DNA, 23 bp, Homo sapiens
aagtttgtagtttttgctgaagg

SEQ ID NO: 307764 - DNA, 18 bp, Homo sapiens
aagtttgtcctttaacta

SEQ ID NO: 307765 - DNA, 15 bp, Homo sapiens
aagtttgtgttctgt

SEQ ID NO: 307766 - DNA, 15 bp, Homo sapiens
aagttttaacctcag

SEQ ID NO: 307767 - DNA, 21 bp, Homo sapiens
aagttttaacttccagtggct

SEQ ID NO: 307768 - DNA, 13 bp, Homo sapiens
aagttttatcaag

SEQ ID NO: 307769 - DNA, 19 bp, Homo sapiens
aagttttgatgaaattctt

SEQ ID NO: 307770 - DNA, 21 bp, Homo sapiens
aagttttgattaatgtttctt

SEQ ID NO: 307771 - DNA, 22 bp, Homo sapiens
aagttttgtataaataataaag

SEQ ID NO: 307772 - DNA, 12 bp, Homo sapiens
aagttttgtcat

SEQ ID NO: 307773 - DNA, 15 bp, Homo sapiens
aagtttttacagtgt

SEQ ID NO: 307774 - DNA, 19 bp, Homo sapiens
aagtttttacagtgtatct

SEQ ID NO: 307775 - DNA, 15 bp, Homo sapiens
aagtttttggtaatg

SEQ ID NO: 307776 - DNA, 14 bp, Homo sapiens
aataaaaaaaaacc

SEQ ID NO: 307777 - DNA, 19 bp, Homo sapiens
aataaaaaaaaacctacaa

SEQ ID NO: 307778 - DNA, 16 bp, Homo sapiens
aataaaaaacaagaaa

SEQ ID NO: 307779 - DNA, 21 bp, Homo sapiens
agagaccgtcgggggctgagg

SEQ ID NO: 307780 - DNA, 14 bp, Homo sapiens
agagacctgaggca

SEQ ID NO: 307781 - DNA, 14 bp, Homo sapiens
agagactagacaaa

SEQ ID NO: 307782 - DNA, 23 bp, Homo sapiens
agagactgaaagcagcagctagg

SEQ ID NO: 307783 - DNA, 14 bp, Homo sapiens
agagactgcccacc

SEQ ID NO: 307784 - DNA, 16 bp, Homo sapiens
agagactgcccaccct

SEQ ID NO: 307785 - DNA, 19 bp, Homo sapiens
agagactgcccaccctggg

SEQ ID NO: 307786 - DNA, 12 bp, Homo sapiens
agagactggcca

SEQ ID NO: 307787 - DNA, 16 bp, Homo sapiens
agagactggccagagg

SEQ ID NO: 307788 - DNA, 16 bp, Homo sapiens
aataaaaatttgttta

SEQ ID NO: 307789 - DNA, 12 bp, Homo sapiens
aataaaaccttt

SEQ ID NO: 307790 - DNA, 16 bp, Homo sapiens
aataaaacctttcaaa

SEQ ID NO: 307791 - DNA, 23 bp, Homo sapiens
aataaaacgttatctcattgcaa

SEQ ID NO: 307792 - DNA, 22 bp, Homo sapiens
aataaaactaagctctttgaga

SEQ ID NO: 307793 - DNA, 23 bp, Homo sapiens
aataaaactaagctctttgagaa

SEQ ID NO: 307794 - DNA, 24 bp, Homo sapiens
aataaaactatttaaaattggcac

SEQ ID NO: 307795 - DNA, 19 bp, Homo sapiens
aataaaactgcacagtgct

SEQ ID NO: 307796 - DNA, 22 bp, Homo sapiens
aataaaacttatgctagtttat

SEQ ID NO: 307797 - DNA, 13 bp, Homo sapiens
aataaaagagaga

SEQ ID NO: 307798 - DNA, 21 bp, Homo sapiens
aataaaagcagcatctgctaa

SEQ ID NO: 307799 - DNA, 14 bp, Homo sapiens
aataaaagtacaaa

SEQ ID NO: 307800 - DNA, 12 bp, Homo sapiens
aataaaatatca

SEQ ID NO: 307801 - DNA, 14 bp, Homo sapiens
aataaaatatcatt

SEQ ID NO: 307802 - DNA, 17 bp, Homo sapiens
aataaaatatcattcag

SEQ ID NO: 307803 - DNA, 13 bp, Homo sapiens
aataaaatattta

SEQ ID NO: 307804 - DNA, 16 bp, Homo sapiens
aataaaatcttgaaaa

SEQ ID NO: 307805 - DNA, 14 bp, Homo sapiens
aataaaatgatgta

SEQ ID NO: 307806 - DNA, 13 bp, Homo sapiens
aataaaatgcatt

SEQ ID NO: 307807 - DNA, 14 bp, Homo sapiens
aataaaatgtgatt

SEQ ID NO: 307808 - DNA, 23 bp, Homo sapiens
aataaaatttaaaaaactcctgt

SEQ ID NO: 307809 - DNA, 22 bp, Homo sapiens
aataaacacatagattcacctg

SEQ ID NO: 307810 - DNA, 13 bp, Homo sapiens
aataaacactttt

SEQ ID NO: 307811 - DNA, 17 bp, Homo sapiens
aataaacctcaaaatgt

SEQ ID NO: 307812 - DNA, 21 bp, Homo sapiens
aataaactccccagcgtatcc

SEQ ID NO: 307813 - DNA, 14 bp, Homo sapiens
aataaactccttaa

SEQ ID NO: 307814 - DNA, 17 bp, Homo sapiens
aataaacttagaataaa

SEQ ID NO: 307815 - DNA, 21 bp, Homo sapiens
aataaacttagaataaaattg

SEQ ID NO: 307816 - DNA, 21 bp, Homo sapiens
aataaagaactccttattttg

SEQ ID NO: 307817 - DNA, 13 bp, Homo sapiens
aataaagaagaaa

SEQ ID NO: 307818 - DNA, 19 bp, Homo sapiens
aataaagaagaaaataacc

SEQ ID NO: 307819 - DNA, 15 bp, Homo sapiens
aataaagcactattg

SEQ ID NO: 307820 - DNA, 11 bp, Homo sapiens
aataaagccac

SEQ ID NO: 307821 - DNA, 21 bp, Homo sapiens
aataaagccttgtgatcactt

SEQ ID NO: 307822 - DNA, 14 bp, Homo sapiens
aataaagctgctga

SEQ ID NO: 307823 - DNA, 13 bp, Homo sapiens
aataaagctggac

SEQ ID NO: 307824 - DNA, 23 bp, Homo sapiens
aataaagctggacaagaagctgc

SEQ ID NO: 307825 - DNA, 18 bp, Homo sapiens
aataaagcttgtggcccc

SEQ ID NO: 307826 - DNA, 19 bp, Homo sapiens
aataaagtattccacctta

SEQ ID NO: 307827 - DNA, 20 bp, Homo sapiens
aataaagtattccaccttaa

SEQ ID NO: 307828 - DNA, 20 bp, Homo sapiens
aataaagtctgtctgcactg

SEQ ID NO: 307829 - DNA, 17 bp, Homo sapiens
aataaataaagaagaaa

SEQ ID NO: 307830 - DNA, 16 bp, Homo sapiens
aataaatacattcttg

SEQ ID NO: 307831 - DNA, 19 bp, Homo sapiens
aataaatagctatatccat

SEQ ID NO: 307832 - DNA, 21 bp, Homo sapiens
aataaatagctatatccatgt

SEQ ID NO: 307833 - DNA, 21 bp, Homo sapiens
aataaatatactaataaaaag

SEQ ID NO: 307834 - DNA, 14 bp, Homo sapiens
aataaatatagttg

SEQ ID NO: 307835 - DNA, 21 bp, Homo sapiens
aataaatatagttgtctttct

SEQ ID NO: 307836 - DNA, 21 bp, Homo sapiens
aataaatcattaatactcttc

SEQ ID NO: 307837 - DNA, 14 bp, Homo sapiens
aataaatctgccat

SEQ ID NO: 307838 - DNA, 11 bp, Homo sapiens
aataaatgacc

SEQ ID NO: 307839 - DNA, 11 bp, Homo sapiens
aataaatggga

SEQ ID NO: 307840 - DNA, 16 bp, Homo sapiens
aataaatgggaaatgt

SEQ ID NO: 307841 - DNA, 18 bp, Homo sapiens
aataaatgtgtgttgact

SEQ ID NO: 307842 - DNA, 15 bp, Homo sapiens
aataaattaacatta

SEQ ID NO: 307843 - DNA, 20 bp, Homo sapiens
aataaattgcatgctgcttt

SEQ ID NO: 307844 - DNA, 20 bp, Homo sapiens
aataaattgctccttgacat

SEQ ID NO: 307845 - DNA, 19 bp, Homo sapiens
aataaattggtgataagtg

SEQ ID NO: 307846 - DNA, 23 bp, Homo sapiens
aataaattggtgataagtggaaa

SEQ ID NO: 307847 - DNA, 17 bp, Homo sapiens
aataaatttataacaat

SEQ ID NO: 307848 - DNA, 13 bp, Homo sapiens
aataaatttctgg

SEQ ID NO: 307849 - DNA, 23 bp, Homo sapiens
aataaatttctgggatatttaac

SEQ ID NO: 307850 - DNA, 23 bp, Homo sapiens
aataacacagagagacagacttg

SEQ ID NO: 307851 - DNA, 12 bp, Homo sapiens
aataacactgca

SEQ ID NO: 307852 - DNA, 21 bp, Homo sapiens
aataacactgcagccctctcc

SEQ ID NO: 307853 - DNA, 14 bp, Homo sapiens
aataacatctgaaa

SEQ ID NO: 307854 - DNA, 16 bp, Homo sapiens
aataacatctgaaaag

SEQ ID NO: 307855 - DNA, 21 bp, Homo sapiens
aataacattgcactttataaa

SEQ ID NO: 307856 - DNA, 21 bp, Homo sapiens
aataaccacaaggtccactcc

SEQ ID NO: 307857 - DNA, 14 bp, Homo sapiens
aataaccacttaaa

SEQ ID NO: 307858 - DNA, 20 bp, Homo sapiens
aataaccatggcaagagaga

SEQ ID NO: 307859 - DNA, 14 bp, Homo sapiens
aataactactgtgt

SEQ ID NO: 307860 - DNA, 16 bp, Homo sapiens
aataactactgtgttc

SEQ ID NO: 307861 - DNA, 18 bp, Homo sapiens
aataactactgtgttcct

SEQ ID NO: 307862 - DNA, 22 bp, Homo sapiens
aataactagatctcctgtaatt

SEQ ID NO: 307863 - DNA, 21 bp, Homo sapiens
aataactccttcttgtagtag

SEQ ID NO: 307864 - DNA, 17 bp, Homo sapiens
aataagactcttaccta

SEQ ID NO: 307865 - DNA, 13 bp, Homo sapiens
aataagagatttg

SEQ ID NO: 307866 - DNA, 16 bp, Homo sapiens
aataagatacatcaca

SEQ ID NO: 307867 - DNA, 16 bp, Homo sapiens
aataagcagaggtgga

SEQ ID NO: 307868 - DNA, 21 bp, Homo sapiens
aataagcagaggtggaaaatg

SEQ ID NO: 307869 - DNA, 14 bp, Homo sapiens
aataagctaaagag

SEQ ID NO: 307870 - DNA, 20 bp, Homo sapiens
aataaggctccttcatgtgg

SEQ ID NO: 307871 - DNA, 23 bp, Homo sapiens
aataagttaaaggcagtccagag

SEQ ID NO: 307872 - DNA, 14 bp, Homo sapiens
aataagtttgaacc

SEQ ID NO: 307873 - DNA, 12 bp, Homo sapiens
aataataaatgt

SEQ ID NO: 307874 - DNA, 13 bp, Homo sapiens
aataataaattaa

SEQ ID NO: 307875 - DNA, 13 bp, Homo sapiens
aataataaattgc

SEQ ID NO: 307876 - DNA, 14 bp, Homo sapiens
aataataaattgca

SEQ ID NO: 307877 - DNA, 16 bp, Homo sapiens
aataatacaacaatcc

SEQ ID NO: 307878 - DNA, 14 bp, Homo sapiens
aataatacatcttt

SEQ ID NO: 307879 - DNA, 23 bp, Homo sapiens
aataatagacttatatgcaggct

SEQ ID NO: 307880 - DNA, 21 bp, Homo sapiens
aataatagttcaggatttggt

SEQ ID NO: 307881 - DNA, 11 bp, Homo sapiens
aataatatgca

SEQ ID NO: 307882 - DNA, 13 bp, Homo sapiens
aataatatgcatt

SEQ ID NO: 307883 - DNA, 15 bp, Homo sapiens
aataatatgcattgt

SEQ ID NO: 307884 - DNA, 14 bp, Homo sapiens
aataatattatatt

SEQ ID NO: 307885 - DNA, 18 bp, Homo sapiens
aataatctggtgttcttg

SEQ ID NO: 307886 - DNA, 16 bp, Homo sapiens
aataatgtgggaagaa

SEQ ID NO: 307887 - DNA, 21 bp, Homo sapiens
aataattgatcaaattcattt

SEQ ID NO: 307888 - DNA, 21 bp, Homo sapiens
aataatttaagccaataaata

SEQ ID NO: 307889 - DNA, 12 bp, Homo sapiens
aataattttaca

SEQ ID NO: 307890 - DNA, 15 bp, Homo sapiens
aataattttacatgt

SEQ ID NO: 307891 - DNA, 19 bp, Homo sapiens
aataattttacatgtctca

SEQ ID NO: 307892 - DNA, 14 bp, Homo sapiens
aataattttatgaa

SEQ ID NO: 307893 - DNA, 19 bp, Homo sapiens
aataatttttgctgaattc

SEQ ID NO: 307894 - DNA, 12 bp, Homo sapiens
aatacaaaataa

SEQ ID NO: 307895 - DNA, 15 bp, Homo sapiens
aatacaaattgagga

SEQ ID NO: 307896 - DNA, 23 bp, Homo sapiens
aatacaagccaagctagaaggaa

SEQ ID NO: 307897 - DNA, 17 bp, Homo sapiens
aatacaagtaaagctag

SEQ ID NO: 307898 - DNA, 20 bp, Homo sapiens
aatacaccacctcactcctg

SEQ ID NO: 307899 - DNA, 21 bp, Homo sapiens
aatacaccacctcactcctgt

SEQ ID NO: 307900 - DNA, 14 bp, Homo sapiens
aatacactacaaat

SEQ ID NO: 307901 - DNA, 19 bp, Homo sapiens
aatacagtaagctgctcta

SEQ ID NO: 307902 - DNA, 15 bp, Homo sapiens
aatacagtattctgt

SEQ ID NO: 307903 - DNA, 13 bp, Homo sapiens
aatacagtgcttt

SEQ ID NO: 307904 - DNA, 22 bp, Homo sapiens
aatacatctttatcattaaaca

SEQ ID NO: 307905 - DNA, 17 bp, Homo sapiens
aatacatgatgatttca

SEQ ID NO: 307906 - DNA, 22 bp, Homo sapiens
aatacattccatcacagccagc

SEQ ID NO: 307907 - DNA, 12 bp, Homo sapiens
aatacattcttg

SEQ ID NO: 307908 - DNA, 16 bp, Homo sapiens
aatacatttaaaactt

SEQ ID NO: 307909 - DNA, 17 bp, Homo sapiens
aatacatttaaaactta

SEQ ID NO: 307910 - DNA, 19 bp, Homo sapiens
aatatgaggggactgcatg

SEQ ID NO: 307911 - DNA, 21 bp, Homo sapiens
aatatgaggggactgcatgca

SEQ ID NO: 307912 - DNA, 14 bp, Homo sapiens
aatatgagttactg

SEQ ID NO: 307913 - DNA, 15 bp, Homo sapiens
aatatgcaatttgtt

SEQ ID NO: 307914 - DNA, 12 bp, Homo sapiens
aatatgcacttt

SEQ ID NO: 307915 - DNA, 16 bp, Homo sapiens
aatatgctaaatgtta

SEQ ID NO: 307916 - DNA, 15 bp, Homo sapiens
aatatggctataaat

SEQ ID NO: 307917 - DNA, 16 bp, Homo sapiens
aatatgggaggaacaa

SEQ ID NO: 307918 - DNA, 20 bp, Homo sapiens
aatatggtggccctggggaa

SEQ ID NO: 307919 - DNA, 13 bp, Homo sapiens
aatatgtcctggg

SEQ ID NO: 307920 - DNA, 19 bp, Homo sapiens
aatatgtgttttttaatat

SEQ ID NO: 307921 - DNA, 18 bp, Homo sapiens
aatatgttgagtgttcat

SEQ ID NO: 307922 - DNA, 24 bp, Homo sapiens
aatatgtttgaggttaaaatataa

SEQ ID NO: 307923 - DNA, 13 bp, Homo sapiens
aatattaaaagaa

SEQ ID NO: 307924 - DNA, 13 bp, Homo sapiens
aatattaaataca

SEQ ID NO: 307925 - DNA, 16 bp, Homo sapiens
aatattaaatacagac

SEQ ID NO: 307926 - DNA, 19 bp, Homo sapiens
aatattaaatacagacact

SEQ ID NO: 307927 - DNA, 22 bp, Homo sapiens
aatattaaatacagacactaag

SEQ ID NO: 307928 - DNA, 19 bp, Homo sapiens
aatattaagaaacaattta

SEQ ID NO: 307929 - DNA, 15 bp, Homo sapiens
agagctggtgcccgg

SEQ ID NO: 307930 - DNA, 16 bp, Homo sapiens
agagctggtgcccgga

SEQ ID NO: 307931 - DNA, 16 bp, Homo sapiens
agagctgtctgaactc

SEQ ID NO: 307932 - DNA, 19 bp, Homo sapiens
agagctgtttatggcctca

SEQ ID NO: 307933 - DNA, 21 bp, Homo sapiens
agagctgtttatggcctcagc

SEQ ID NO: 307934 - DNA, 16 bp, Homo sapiens
agagcttattggccac

SEQ ID NO: 307935 - DNA, 17 bp, Homo sapiens
agagcttattggccact

SEQ ID NO: 307936 - DNA, 16 bp, Homo sapiens
agagcttcagaggtgg

SEQ ID NO: 307937 - DNA, 17 bp, Homo sapiens
agagcttgatgcctccc

SEQ ID NO: 307938 - DNA, 21 bp, Homo sapiens
agagcttgatgcctcccggct

SEQ ID NO: 307939 - DNA, 23 bp, Homo sapiens
agagctttctgtccttttggcac

SEQ ID NO: 307940 - DNA, 17 bp, Homo sapiens
agaggaaaaacagagga

SEQ ID NO: 307941 - DNA, 13 bp, Homo sapiens
agaggaaattaaa

SEQ ID NO: 307942 - DNA, 13 bp, Homo sapiens
agaggaagagaga

SEQ ID NO: 307943 - DNA, 22 bp, Homo sapiens
agaggaagccacgtgctggaga

SEQ ID NO: 307944 - DNA, 16 bp, Homo sapiens
agaggacagtgctgac

SEQ ID NO: 307945 - DNA, 16 bp, Homo sapiens
agaggacatattcaca

SEQ ID NO: 307946 - DNA, 12 bp, Homo sapiens
agaggagaagga

SEQ ID NO: 307947 - DNA, 15 bp, Homo sapiens
agaggagaccctgga

SEQ ID NO: 307948 - DNA, 20 bp, Homo sapiens
agaggagagcatctgctctg

SEQ ID NO: 307949 - DNA, 22 bp, Homo sapiens
agaggagagtacccccctgaga

SEQ ID NO: 307950 - DNA, 17 bp, Homo sapiens
agaggagccacctgggc

SEQ ID NO: 307951 - DNA, 14 bp, Homo sapiens
agaggagcctggag

SEQ ID NO: 307952 - DNA, 21 bp, Homo sapiens
agaggagcgggacctgtggct

SEQ ID NO: 307953 - DNA, 20 bp, Homo sapiens
agaggagctgggagccgggc

SEQ ID NO: 307954 - DNA, 17 bp, Homo sapiens
agaggagggatagagac

SEQ ID NO: 307955 - DNA, 19 bp, Homo sapiens
agaggaggggtaaatatat

SEQ ID NO: 307956 - DNA, 20 bp, Homo sapiens
agaggaggggtaaatatatg

SEQ ID NO: 307957 - DNA, 13 bp, Homo sapiens
agaggaggtgtgg

SEQ ID NO: 307958 - DNA, 17 bp, Homo sapiens
agaggaggtgtggagtg

SEQ ID NO: 307959 - DNA, 22 bp, Homo sapiens
agaggagtgattgaaccagctc

SEQ ID NO: 307960 - DNA, 12 bp, Homo sapiens
agaggagttcaa

SEQ ID NO: 307961 - DNA, 16 bp, Homo sapiens
agaggagttcaatgat

SEQ ID NO: 307962 - DNA, 17 bp, Homo sapiens
agaggagttcaatgatc

SEQ ID NO: 307963 - DNA, 21 bp, Homo sapiens
agaggatgaatgtatgtgcac

SEQ ID NO: 307964 - DNA, 20 bp, Homo sapiens
agaggatttttttctgagcg

SEQ ID NO: 307965 - DNA, 21 bp, Homo sapiens
agaggatttttttctgagcga

SEQ ID NO: 307966 - DNA, 15 bp, Homo sapiens
agaggcagaaccctg

SEQ ID NO: 307967 - DNA, 16 bp, Homo sapiens
agaggcagaaccctgg

SEQ ID NO: 307968 - DNA, 19 bp, Homo sapiens
agaggcagaagtcagcccg

SEQ ID NO: 307969 - DNA, 19 bp, Homo sapiens
agaggcagagtgccccacc

SEQ ID NO: 307970 - DNA, 17 bp, Homo sapiens
agaggcagcaggagcca

SEQ ID NO: 307971 - DNA, 21 bp, Homo sapiens
agaggcagctaaggggcagga

SEQ ID NO: 307972 - DNA, 11 bp, Homo sapiens
agaggcagggc

SEQ ID NO: 307973 - DNA, 13 bp, Homo sapiens
agaggccaatgcc

SEQ ID NO: 307974 - DNA, 16 bp, Homo sapiens
agaggccagccccacc

SEQ ID NO: 307975 - DNA, 17 bp, Homo sapiens
agaggccagccccaccc

SEQ ID NO: 307976 - DNA, 14 bp, Homo sapiens
agaggccaggcatg

SEQ ID NO: 307977 - DNA, 13 bp, Homo sapiens
agaggcccagcca

SEQ ID NO: 307978 - DNA, 13 bp, Homo sapiens
agaggccttgggg

SEQ ID NO: 307979 - DNA, 16 bp, Homo sapiens
agaggcgcgtctgccc

SEQ ID NO: 307980 - DNA, 18 bp, Homo sapiens
agaggcgcgtctgcccca

SEQ ID NO: 307981 - DNA, 21 bp, Homo sapiens
agaggcgcgtctgccccaccc

SEQ ID NO: 307982 - DNA, 14 bp, Homo sapiens
agaggcgtcttgta

SEQ ID NO: 307983 - DNA, 20 bp, Homo sapiens
agaggctaacctcaaaatat

SEQ ID NO: 307984 - DNA, 20 bp, Homo sapiens
agaggctagccccagggtga

SEQ ID NO: 307985 - DNA, 17 bp, Homo sapiens
agaggctatgtgagcac

SEQ ID NO: 307986 - DNA, 12 bp, Homo sapiens
agaggctcctgg

SEQ ID NO: 307987 - DNA, 15 bp, Homo sapiens
agaggctcctggagc

SEQ ID NO: 307988 - DNA, 22 bp, Homo sapiens
agaggctcctggagccagccac

SEQ ID NO: 307989 - DNA, 13 bp, Homo sapiens
agaggctgaaaga

SEQ ID NO: 307990 - DNA, 19 bp, Homo sapiens
agaggctgaaagaggccaa

SEQ ID NO: 307991 - DNA, 14 bp, Homo sapiens
agaggctgaggcct

SEQ ID NO: 307992 - DNA, 18 bp, Homo sapiens
agaggctgaggcctggac

SEQ ID NO: 307993 - DNA, 20 bp, Homo sapiens
agagggaaacgtgccctctg

SEQ ID NO: 307994 - DNA, 18 bp, Homo sapiens
agagggaaaggctgaaca

SEQ ID NO: 307995 - DNA, 19 bp, Homo sapiens
agagggaaatacaaggagg

SEQ ID NO: 307996 - DNA, 21 bp, Homo sapiens
agagggaaggtgaccgcccag

SEQ ID NO: 307997 - DNA, 16 bp, Homo sapiens
agagggaatgtgaaat

SEQ ID NO: 307998 - DNA, 18 bp, Homo sapiens
agagggaatgttccctgc

SEQ ID NO: 307999 - DNA, 21 bp, Homo sapiens
agagggacagcccactgagaa

SEQ ID NO: 308000 - DNA, 21 bp, Homo sapiens
agagggactgtatttctgtgg

SEQ ID NO: 308001 - DNA, 16 bp, Homo sapiens
agagggagaagcatga

SEQ ID NO: 308002 - DNA, 22 bp, Homo sapiens
agagggatgaggtgctgggagg

SEQ ID NO: 308003 - DNA, 17 bp, Homo sapiens
agagggatgcagtgcct

SEQ ID NO: 308004 - DNA, 17 bp, Homo sapiens
agagggcagtacctggg

SEQ ID NO: 308005 - DNA, 13 bp, Homo sapiens
agagggcccagct

SEQ ID NO: 308006 - DNA, 15 bp, Homo sapiens
agagggcccagctgt

SEQ ID NO: 308007 - DNA, 20 bp, Homo sapiens
agagggcccagctgtagcca

SEQ ID NO: 308008 - DNA, 19 bp, Homo sapiens
agagggcctgtgggagcct

SEQ ID NO: 308009 - DNA, 12 bp, Homo sapiens
agagggctgagc

SEQ ID NO: 308010 - DNA, 19 bp, Homo sapiens
agagggctgagcccctcct

SEQ ID NO: 308011 - DNA, 20 bp, Homo sapiens
agagggctgagcccctcctc

SEQ ID NO: 308012 - DNA, 17 bp, Homo sapiens
agagggctgtggctggg

SEQ ID NO: 308013 - DNA, 13 bp, Homo sapiens
agaggggagagga

SEQ ID NO: 308014 - DNA, 15 bp, Homo sapiens
agaggggagaggaag

SEQ ID NO: 308015 - DNA, 15 bp, Homo sapiens
agaggggcggggcca

SEQ ID NO: 308016 - DNA, 22 bp, Homo sapiens
agagggggtaatggaggccaag

SEQ ID NO: 308017 - DNA, 20 bp, Homo sapiens
agagggtgtcgtcctgcagt

SEQ ID NO: 308018 - DNA, 18 bp, Homo sapiens
agagggttttctctccca

SEQ ID NO: 308019 - DNA, 19 bp, Homo sapiens
agagggttttgattttaaa

SEQ ID NO: 308020 - DNA, 15 bp, Homo sapiens
agaggtagcgagctg

SEQ ID NO: 308021 - DNA, 16 bp, Homo sapiens
agaggtagggctgcca

SEQ ID NO: 308022 - DNA, 16 bp, Homo sapiens
agaggtcccctgaggt

SEQ ID NO: 308023 - DNA, 22 bp, Homo sapiens
agaggtctctgccggctctttc

SEQ ID NO: 308024 - DNA, 15 bp, Homo sapiens
agaggtgctgctttg

SEQ ID NO: 308025 - DNA, 22 bp, Homo sapiens
agaggtgggaggcccctggtgg

SEQ ID NO: 308026 - DNA, 15 bp, Homo sapiens
agaggtgggcagctg

SEQ ID NO: 308027 - DNA, 20 bp, Homo sapiens
agaggtgggcagctgggccc

SEQ ID NO: 308028 - DNA, 16 bp, Homo sapiens
agaggttaaggtgcaa

SEQ ID NO: 308029 - DNA, 16 bp, Homo sapiens
agaggttatctgcctg

SEQ ID NO: 308030 - DNA, 18 bp, Homo sapiens
agaggttatctgcctggc

SEQ ID NO: 308031 - DNA, 21 bp, Homo sapiens
agaggttcctggggtggattc

SEQ ID NO: 308032 - DNA, 13 bp, Homo sapiens
agaggttctcagc

SEQ ID NO: 308033 - DNA, 22 bp, Homo sapiens
agaggtttctagggtgggcccc

SEQ ID NO: 308034 - DNA, 12 bp, Homo sapiens
agaggttttgtt

SEQ ID NO: 308035 - DNA, 19 bp, Homo sapiens
agagtaaatattgtcacaa

SEQ ID NO: 308036 - DNA, 19 bp, Homo sapiens
agagtacaggtcttcttta

SEQ ID NO: 308037 - DNA, 13 bp, Homo sapiens
agagtacatccat

SEQ ID NO: 308038 - DNA, 22 bp, Homo sapiens
agagtacccccctgagagcatg

SEQ ID NO: 308039 - DNA, 18 bp, Homo sapiens
agagtagggtagaaggaa

SEQ ID NO: 308040 - DNA, 22 bp, Homo sapiens
agatctccaaagctttcctgga

SEQ ID NO: 308041 - DNA, 16 bp, Homo sapiens
agatctcctgtaattt

SEQ ID NO: 308042 - DNA, 23 bp, Homo sapiens
agatctcctgtaattttgtagta

SEQ ID NO: 308043 - DNA, 21 bp, Homo sapiens
agatctgacatgattccttcc

SEQ ID NO: 308044 - DNA, 16 bp, Homo sapiens
agatctgatggtgagc

SEQ ID NO: 308045 - DNA, 18 bp, Homo sapiens
agatctgatggtgagctg

SEQ ID NO: 308046 - DNA, 19 bp, Homo sapiens
agatctgatggtgagctgg

SEQ ID NO: 308047 - DNA, 23 bp, Homo sapiens
agatctgatggtgagctgggaag

SEQ ID NO: 308048 - DNA, 20 bp, Homo sapiens
agatctgcctcccctgtgga

SEQ ID NO: 308049 - DNA, 14 bp, Homo sapiens
agatctgcctgggc

SEQ ID NO: 308050 - DNA, 15 bp, Homo sapiens
agatctgcctgggcc

SEQ ID NO: 308051 - DNA, 16 bp, Homo sapiens
agatctgcctgggcct

SEQ ID NO: 308052 - DNA, 16 bp, Homo sapiens
agatctgtgccccatg

SEQ ID NO: 308053 - DNA, 16 bp, Homo sapiens
agatcttacatctgca

SEQ ID NO: 308054 - DNA, 17 bp, Homo sapiens
agatcttacatctgcag

SEQ ID NO: 308055 - DNA, 17 bp, Homo sapiens
agatcttcaaccatgag

SEQ ID NO: 308056 - DNA, 13 bp, Homo sapiens
agatcttccttcc

SEQ ID NO: 308057 - DNA, 15 bp, Homo sapiens
agatcttccttccgc

SEQ ID NO: 308058 - DNA, 16 bp, Homo sapiens
agatcttgagagctgc

SEQ ID NO: 308059 - DNA, 19 bp, Homo sapiens
agatcttgagagctgctga

SEQ ID NO: 308060 - DNA, 12 bp, Homo sapiens
agatctttacat

SEQ ID NO: 308061 - DNA, 21 bp, Homo sapiens
agatctttcgttggttgtttc

SEQ ID NO: 308062 - DNA, 13 bp, Homo sapiens
agatgaaaataaa

SEQ ID NO: 308063 - DNA, 15 bp, Homo sapiens
agatgaaaataaaat

SEQ ID NO: 308064 - DNA, 17 bp, Homo sapiens
agatgaaaataaaataa

SEQ ID NO: 308065 - DNA, 18 bp, Homo sapiens
agatgaaaccgtccctga

SEQ ID NO: 308066 - DNA, 23 bp, Homo sapiens
agatgaaagcagggaatttctat

SEQ ID NO: 308067 - DNA, 16 bp, Homo sapiens
agatgaatatgagctc

SEQ ID NO: 308068 - DNA, 16 bp, Homo sapiens
agatgaatgccgtgga

SEQ ID NO: 308069 - DNA, 20 bp, Homo sapiens
agatgagaaatgatgaaaag

SEQ ID NO: 308070 - DNA, 15 bp, Homo sapiens
agatgagattggcat

SEQ ID NO: 308071 - DNA, 19 bp, Homo sapiens
aatcgagtgagacaaaatt

SEQ ID NO: 308072 - DNA, 20 bp, Homo sapiens
aatcgatgggggatgcttca

SEQ ID NO: 308073 - DNA, 21 bp, Homo sapiens
aatcgatgggggatgcttcat

SEQ ID NO: 308074 - DNA, 21 bp, Homo sapiens
aatcgcttgaacctgggaagt

SEQ ID NO: 308075 - DNA, 17 bp, Homo sapiens
aatctaaaaatcctttt

SEQ ID NO: 308076 - DNA, 12 bp, Homo sapiens
aatctaataaaa

SEQ ID NO: 308077 - DNA, 17 bp, Homo sapiens
aatctaatattaaaaat

SEQ ID NO: 308078 - DNA, 16 bp, Homo sapiens
aatctacgatgttaaa

SEQ ID NO: 308079 - DNA, 17 bp, Homo sapiens
aatctactcttaaatat

SEQ ID NO: 308080 - DNA, 17 bp, Homo sapiens
aatctagtttacagaaa

SEQ ID NO: 308081 - DNA, 19 bp, Homo sapiens
aatctagtttacagaaaaa

SEQ ID NO: 308082 - DNA, 21 bp, Homo sapiens
aatctagttttttttgtaaac

SEQ ID NO: 308083 - DNA, 18 bp, Homo sapiens
aatctattcagacaagca

SEQ ID NO: 308084 - DNA, 15 bp, Homo sapiens
aatctattgggttca

SEQ ID NO: 308085 - DNA, 19 bp, Homo sapiens
aatctattgggttcattat

SEQ ID NO: 308086 - DNA, 22 bp, Homo sapiens
aatctatttattggacatgtcc

SEQ ID NO: 308087 - DNA, 23 bp, Homo sapiens
aatctatttattggacatgtcca

SEQ ID NO: 308088 - DNA, 17 bp, Homo sapiens
aatctcacacagctggg

SEQ ID NO: 308089 - DNA, 13 bp, Homo sapiens
aatctcaccccat

SEQ ID NO: 308090 - DNA, 23 bp, Homo sapiens
aatctcagaggtagggctgccac

SEQ ID NO: 308091 - DNA, 11 bp, Homo sapiens
aatctcagcac

SEQ ID NO: 308092 - DNA, 19 bp, Homo sapiens
aatctcagcactttgtttc

SEQ ID NO: 308093 - DNA, 21 bp, Homo sapiens
aatctccaatccacacatatt

SEQ ID NO: 308094 - DNA, 11 bp, Homo sapiens
aatctccaggg

SEQ ID NO: 308095 - DNA, 22 bp, Homo sapiens
aatctccagggctgcccctgta

SEQ ID NO: 308096 - DNA, 19 bp, Homo sapiens
aatctcccgctgctgctgc

SEQ ID NO: 308097 - DNA, 19 bp, Homo sapiens
aatctctaaaattctagtc

SEQ ID NO: 308098 - DNA, 20 bp, Homo sapiens
aatctctagcctctttgtgt

SEQ ID NO: 308099 - DNA, 17 bp, Homo sapiens
aatctctcaaaatgtgc

SEQ ID NO: 308100 - DNA, 19 bp, Homo sapiens
aatctctcaaaatgtgccg

SEQ ID NO: 308101 - DNA, 20 bp, Homo sapiens
aatctctcggttccacgtcc

SEQ ID NO: 308102 - DNA, 13 bp, Homo sapiens
aatctctgtgact

SEQ ID NO: 308103 - DNA, 20 bp, Homo sapiens
aatctctgtgactcgcttag

SEQ ID NO: 308104 - DNA, 16 bp, Homo sapiens
aatctgaactctcaaa

SEQ ID NO: 308105 - DNA, 22 bp, Homo sapiens
aatctgaactctcaaaagtcta

SEQ ID NO: 308106 - DNA, 21 bp, Homo sapiens
aatctgatcccataaagaaag

SEQ ID NO: 308107 - DNA, 17 bp, Homo sapiens
aatctgcatttagcaca

SEQ ID NO: 308108 - DNA, 23 bp, Homo sapiens
aatctgcccaccgaccccctttc

SEQ ID NO: 308109 - DNA, 15 bp, Homo sapiens
aatctgctttgttaa

SEQ ID NO: 308110 - DNA, 20 bp, Homo sapiens
aatctgctttgttaatgaaa

SEQ ID NO: 308111 - DNA, 17 bp, Homo sapiens
aatctggactcctctgt

SEQ ID NO: 308112 - DNA, 21 bp, Homo sapiens
aatctggcattctacacctgg

SEQ ID NO: 308113 - DNA, 22 bp, Homo sapiens
aatctgggaaggcaacacctgt

SEQ ID NO: 308114 - DNA, 16 bp, Homo sapiens
aatctgggtggtaact

SEQ ID NO: 308115 - DNA, 17 bp, Homo sapiens
aatctgtaaaaaagaaa

SEQ ID NO: 308116 - DNA, 15 bp, Homo sapiens
aatctgtagggctgg

SEQ ID NO: 308117 - DNA, 16 bp, Homo sapiens
aatctgtagggctgga

SEQ ID NO: 308118 - DNA, 22 bp, Homo sapiens
aatctgtagggctggacctatg

SEQ ID NO: 308119 - DNA, 18 bp, Homo sapiens
aatctgtatatgttgtaa

SEQ ID NO: 308120 - DNA, 13 bp, Homo sapiens
aatctgtctagaa

SEQ ID NO: 308121 - DNA, 23 bp, Homo sapiens
aatctgtctagaatcctgcttta

SEQ ID NO: 308122 - DNA, 19 bp, Homo sapiens
aatctgtctgattctatgc

SEQ ID NO: 308123 - DNA, 23 bp, Homo sapiens
aatctgtgaattaaaaaagctca

SEQ ID NO: 308124 - DNA, 19 bp, Homo sapiens
aatctgttgtttgaagaac

SEQ ID NO: 308125 - DNA, 19 bp, Homo sapiens
aatcttcagctgaacacaa

SEQ ID NO: 308126 - DNA, 23 bp, Homo sapiens
aatcttcagctggtggatggtga

SEQ ID NO: 308127 - DNA, 10 bp, Homo sapiens
aatcttcctc

SEQ ID NO: 308128 - DNA, 14 bp, Homo sapiens
aatcttcctctgga

SEQ ID NO: 308129 - DNA, 15 bp, Homo sapiens
aatcttctctcttga

SEQ ID NO: 308130 - DNA, 16 bp, Homo sapiens
aatcttctctcttgat

SEQ ID NO: 308131 - DNA, 17 bp, Homo sapiens
aatcttctctcttgatt

SEQ ID NO: 308132 - DNA, 19 bp, Homo sapiens
aatcttctctcttgattga

SEQ ID NO: 308133 - DNA, 15 bp, Homo sapiens
aatcttgaatttctg

SEQ ID NO: 308134 - DNA, 16 bp, Homo sapiens
aatcttgaatttctgc

SEQ ID NO: 308135 - DNA, 18 bp, Homo sapiens
aatcttgctgtgaaacag

SEQ ID NO: 308136 - DNA, 18 bp, Homo sapiens
aatcttgctttctttgtt

SEQ ID NO: 308137 - DNA, 16 bp, Homo sapiens
aatcttgtgctagaat

SEQ ID NO: 308138 - DNA, 20 bp, Homo sapiens
aatcttgtgctagaatactt

SEQ ID NO: 308139 - DNA, 16 bp, Homo sapiens
aatctttaagaatagt

SEQ ID NO: 308140 - DNA, 13 bp, Homo sapiens
aatctttatttta

SEQ ID NO: 308141 - DNA, 15 bp, Homo sapiens
aatctttattttatt

SEQ ID NO: 308142 - DNA, 20 bp, Homo sapiens
aatctttattttattattca

SEQ ID NO: 308143 - DNA, 22 bp, Homo sapiens
aatctttattttattattcaga

SEQ ID NO: 308144 - DNA, 13 bp, Homo sapiens
aatctttcagaat

SEQ ID NO: 308145 - DNA, 19 bp, Homo sapiens
aatctttcagcctgcttct

SEQ ID NO: 308146 - DNA, 16 bp, Homo sapiens
aatctttgctgaagaa

SEQ ID NO: 308147 - DNA, 21 bp, Homo sapiens
aatcttttaaaaattcaaatg

SEQ ID NO: 308148 - DNA, 14 bp, Homo sapiens
aatcttttactgtg

SEQ ID NO: 308149 - DNA, 22 bp, Homo sapiens
aatcttttgtagtttgtattaa

SEQ ID NO: 308150 - DNA, 12 bp, Homo sapiens
aatgaaaagaga

SEQ ID NO: 308151 - DNA, 13 bp, Homo sapiens
aatgaaaagagaa

SEQ ID NO: 308152 - DNA, 15 bp, Homo sapiens
aatgaaaaggaagtt

SEQ ID NO: 308153 - DNA, 20 bp, Homo sapiens
aatgaaaatgtcagaaacca

SEQ ID NO: 308154 - DNA, 17 bp, Homo sapiens
aatgaaacattttgtca

SEQ ID NO: 308155 - DNA, 17 bp, Homo sapiens
aatgaaacctgtgtctc

SEQ ID NO: 308156 - DNA, 23 bp, Homo sapiens
aatgaaagcataagcttaagcat

SEQ ID NO: 308157 - DNA, 20 bp, Homo sapiens
aatgaaagtcttgtgactag

SEQ ID NO: 308158 - DNA, 22 bp, Homo sapiens
aatgaaatagttattttaatac

SEQ ID NO: 308159 - DNA, 14 bp, Homo sapiens
aatgaaattgtaaa

SEQ ID NO: 308160 - DNA, 17 bp, Homo sapiens
aatgaacagctcctcct

SEQ ID NO: 308161 - DNA, 14 bp, Homo sapiens
aatgaactgaagtt

SEQ ID NO: 308162 - DNA, 14 bp, Homo sapiens
aatgaactgtgaca

SEQ ID NO: 308163 - DNA, 16 bp, Homo sapiens
aatgaactgtgacagg

SEQ ID NO: 308164 - DNA, 19 bp, Homo sapiens
aatgaactgtgacaggaag

SEQ ID NO: 308165 - DNA, 14 bp, Homo sapiens
aatgaagcaaacac

SEQ ID NO: 308166 - DNA, 16 bp, Homo sapiens
aatgaagggtcatttc

SEQ ID NO: 308167 - DNA, 14 bp, Homo sapiens
aatgaagtttatac

SEQ ID NO: 308168 - DNA, 15 bp, Homo sapiens
aatgaagtttataca

SEQ ID NO: 308169 - DNA, 13 bp, Homo sapiens
aatgaatattgaa

SEQ ID NO: 308170 - DNA, 16 bp, Homo sapiens
agcacagagcgtcctt

SEQ ID NO: 308171 - DNA, 16 bp, Homo sapiens
agcacagccctgggag

SEQ ID NO: 308172 - DNA, 17 bp, Homo sapiens
agcacagcctcacccct

SEQ ID NO: 308173 - DNA, 22 bp, Homo sapiens
agcacagcctcacccctgcagg

SEQ ID NO: 308174 - DNA, 16 bp, Homo sapiens
agcacaggcaacatta

SEQ ID NO: 308175 - DNA, 23 bp, Homo sapiens
agcacaggcaacattacaaacaa

SEQ ID NO: 308176 - DNA, 13 bp, Homo sapiens
agcacaggccagg

SEQ ID NO: 308177 - DNA, 20 bp, Homo sapiens
agcacatcatggcagtggga

SEQ ID NO: 308178 - DNA, 14 bp, Homo sapiens
agcacatccaggca

SEQ ID NO: 308179 - DNA, 18 bp, Homo sapiens
agcacatgcactactgaa

SEQ ID NO: 308180 - DNA, 15 bp, Homo sapiens
agcacatttcctctc

SEQ ID NO: 308181 - DNA, 13 bp, Homo sapiens
agcaccagcctga

SEQ ID NO: 308182 - DNA, 21 bp, Homo sapiens
agcaccccaccacacacaccc

SEQ ID NO: 308183 - DNA, 19 bp, Homo sapiens
agcaccccatgccaaagct

SEQ ID NO: 308184 - DNA, 15 bp, Homo sapiens
agcacccccacccac

SEQ ID NO: 308185 - DNA, 17 bp, Homo sapiens
agcacccccacccacct

SEQ ID NO: 308186 - DNA, 17 bp, Homo sapiens
agcacccccagcctccc

SEQ ID NO: 308187 - DNA, 13 bp, Homo sapiens
agcaccctgggtg

SEQ ID NO: 308188 - DNA, 14 bp, Homo sapiens
agcaccctgggtgc

SEQ ID NO: 308189 - DNA, 17 bp, Homo sapiens
agcacccttctgctgta

SEQ ID NO: 308190 - DNA, 14 bp, Homo sapiens
agcaccgcagcatg

SEQ ID NO: 308191 - DNA, 16 bp, Homo sapiens
agcaccgtggtgtgag

SEQ ID NO: 308192 - DNA, 23 bp, Homo sapiens
agcacctactatgtgctgggtgc

SEQ ID NO: 308193 - DNA, 12 bp, Homo sapiens
agcacctcagga

SEQ ID NO: 308194 - DNA, 17 bp, Homo sapiens
agcacctcctctctgct

SEQ ID NO: 308195 - DNA, 19 bp, Homo sapiens
agcacctccttgtcacttt

SEQ ID NO: 308196 - DNA, 21 bp, Homo sapiens
agcacctgaaccccatgggct

SEQ ID NO: 308197 - DNA, 23 bp, Homo sapiens
agcacctgaaccccatgggcttg

SEQ ID NO: 308198 - DNA, 13 bp, Homo sapiens
agcacctgccagg

SEQ ID NO: 308199 - DNA, 17 bp, Homo sapiens
agcacctgccagggccc

SEQ ID NO: 308200 - DNA, 18 bp, Homo sapiens
agcacctgccagggcccg

SEQ ID NO: 308201 - DNA, 12 bp, Homo sapiens
agcacctggagc

SEQ ID NO: 308202 - DNA, 16 bp, Homo sapiens
agcaccttcctcactt

SEQ ID NO: 308203 - DNA, 13 bp, Homo sapiens
agcacctttgtaa

SEQ ID NO: 308204 - DNA, 17 bp, Homo sapiens
agcacgaaatgttattt

SEQ ID NO: 308205 - DNA, 18 bp, Homo sapiens
agcacgaaatgttatttt

SEQ ID NO: 308206 - DNA, 16 bp, Homo sapiens
agcacgggcaaagaaa

SEQ ID NO: 308207 - DNA, 17 bp, Homo sapiens
agcacgggcaaagaaaa

SEQ ID NO: 308208 - DNA, 14 bp, Homo sapiens
agcacgtggagata

SEQ ID NO: 308209 - DNA, 21 bp, Homo sapiens
agcactacataaactgacttt

SEQ ID NO: 308210 - DNA, 17 bp, Homo sapiens
agcactactctgtgcca

SEQ ID NO: 308211 - DNA, 20 bp, Homo sapiens
agcactatcgaggtatttgg

SEQ ID NO: 308212 - DNA, 12 bp, Homo sapiens
agcactcccagg

SEQ ID NO: 308213 - DNA, 14 bp, Homo sapiens
agcactcccagggc

SEQ ID NO: 308214 - DNA, 15 bp, Homo sapiens
agcactcccagggcc

SEQ ID NO: 308215 - DNA, 18 bp, Homo sapiens
agcactcccagggcccga

SEQ ID NO: 308216 - DNA, 19 bp, Homo sapiens
agcactcctgatttttatc

SEQ ID NO: 308217 - DNA, 18 bp, Homo sapiens
aatgtcttttcaaaagga

SEQ ID NO: 308218 - DNA, 12 bp, Homo sapiens
aatgtgaagaca

SEQ ID NO: 308219 - DNA, 14 bp, Homo sapiens
aatgtgagacagca

SEQ ID NO: 308220 - DNA, 16 bp, Homo sapiens
aatgtgagacagcaag

SEQ ID NO: 308221 - DNA, 17 bp, Homo sapiens
aatgtgagacagcaagt

SEQ ID NO: 308222 - DNA, 18 bp, Homo sapiens
aatgtgagacagcaagtt

SEQ ID NO: 308223 - DNA, 13 bp, Homo sapiens
aatgtgatcatct

SEQ ID NO: 308224 - DNA, 20 bp, Homo sapiens
aatgtgcccagtcatgacat

SEQ ID NO: 308225 - DNA, 21 bp, Homo sapiens
aatgtgctgttgattctttca

SEQ ID NO: 308226 - DNA, 20 bp, Homo sapiens
aatgtggaaaaaatatttta

SEQ ID NO: 308227 - DNA, 15 bp, Homo sapiens
aatgtggaattacat

SEQ ID NO: 308228 - DNA, 21 bp, Homo sapiens
aatgtgggaagaaacaaaccc

SEQ ID NO: 308229 - DNA, 14 bp, Homo sapiens
aatgtgggattatg

SEQ ID NO: 308230 - DNA, 16 bp, Homo sapiens
aatgtggtaagtggag

SEQ ID NO: 308231 - DNA, 20 bp, Homo sapiens
aatgtggtggcaataaatgt

SEQ ID NO: 308232 - DNA, 10 bp, Homo sapiens
aatgtgtctg

SEQ ID NO: 308233 - DNA, 23 bp, Homo sapiens
aatgtgtctgcaacatggattcc

SEQ ID NO: 308234 - DNA, 19 bp, Homo sapiens
aatgtgtgccatagagttt

SEQ ID NO: 308235 - DNA, 14 bp, Homo sapiens
aatgttaacaactt

SEQ ID NO: 308236 - DNA, 13 bp, Homo sapiens
aatgttaagcaga

SEQ ID NO: 308237 - DNA, 22 bp, Homo sapiens
aatgttaataaagcccgcgtct

SEQ ID NO: 308238 - DNA, 15 bp, Homo sapiens
aatgttacattatta

SEQ ID NO: 308239 - DNA, 13 bp, Homo sapiens
aatgttagaattg

SEQ ID NO: 308240 - DNA, 16 bp, Homo sapiens
aatgttatatcatcaa

SEQ ID NO: 308241 - DNA, 21 bp, Homo sapiens
aatgttattattggcttgcac

SEQ ID NO: 308242 - DNA, 19 bp, Homo sapiens
aatgttattttttaattat

SEQ ID NO: 308243 - DNA, 12 bp, Homo sapiens
aatgttcattgt

SEQ ID NO: 308244 - DNA, 22 bp, Homo sapiens
aatgttcattgtaatgttactg

SEQ ID NO: 308245 - DNA, 24 bp, Homo sapiens
aatgttcattgtaatgttactgat

SEQ ID NO: 308246 - DNA, 22 bp, Homo sapiens
aatgttccattcagtctgcagc

SEQ ID NO: 308247 - DNA, 12 bp, Homo sapiens
aatgttctctgg

SEQ ID NO: 308248 - DNA, 12 bp, Homo sapiens
aatgttctgaca

SEQ ID NO: 308249 - DNA, 17 bp, Homo sapiens
aatgttctgacattaac

SEQ ID NO: 308250 - DNA, 21 bp, Homo sapiens
aatgttgacctttgaggtcta

SEQ ID NO: 308251 - DNA, 17 bp, Homo sapiens
aatgttggcctgtcaga

SEQ ID NO: 308252 - DNA, 16 bp, Homo sapiens
aatgttggtgcaatta

SEQ ID NO: 308253 - DNA, 23 bp, Homo sapiens
aatgttggtgcaattaactctgg

SEQ ID NO: 308254 - DNA, 12 bp, Homo sapiens
aatgttgtccag

SEQ ID NO: 308255 - DNA, 18 bp, Homo sapiens
aatgttgttatgctatta

SEQ ID NO: 308256 - DNA, 15 bp, Homo sapiens
aatgttgttatttaa

SEQ ID NO: 308257 - DNA, 14 bp, Homo sapiens
aatgtttaaatata

SEQ ID NO: 308258 - DNA, 16 bp, Homo sapiens
aatgtttatgagccag

SEQ ID NO: 308259 - DNA, 17 bp, Homo sapiens
aatgtttatgagccaga

SEQ ID NO: 308260 - DNA, 18 bp, Homo sapiens
aatgtttatgagccagac

SEQ ID NO: 308261 - DNA, 21 bp, Homo sapiens
aatgtttccaggcatgaccct

SEQ ID NO: 308262 - DNA, 22 bp, Homo sapiens
aatgtttgccctgttcaaagta

SEQ ID NO: 308263 - DNA, 12 bp, Homo sapiens
aatgttttcatt

SEQ ID NO: 308264 - DNA, 12 bp, Homo sapiens
aatgttttgtac

SEQ ID NO: 308265 - DNA, 15 bp, Homo sapiens
aatgtttttctgcca

SEQ ID NO: 308266 - DNA, 18 bp, Homo sapiens
aattaaaaaatggtcagt

SEQ ID NO: 308267 - DNA, 11 bp, Homo sapiens
aattaaaacaa

SEQ ID NO: 308268 - DNA, 17 bp, Homo sapiens
aattaaaacaaaatcct

SEQ ID NO: 308269 - DNA, 12 bp, Homo sapiens
aattaaaacaat

SEQ ID NO: 308270 - DNA, 19 bp, Homo sapiens
aattaaatatatgtatgta

SEQ ID NO: 308271 - DNA, 23 bp, Homo sapiens
aattaaatatatgtatgtaaaaa

SEQ ID NO: 308272 - DNA, 14 bp, Homo sapiens
aattaaatgaaata

SEQ ID NO: 308273 - DNA, 17 bp, Homo sapiens
aattaaatgaaatactt

SEQ ID NO: 308274 - DNA, 11 bp, Homo sapiens
aattaaatgta

SEQ ID NO: 308275 - DNA, 15 bp, Homo sapiens
aattaacatataata

SEQ ID NO: 308276 - DNA, 12 bp, Homo sapiens
aattaacattat

SEQ ID NO: 308277 - DNA, 15 bp, Homo sapiens
aattaacattatatt

SEQ ID NO: 308278 - DNA, 13 bp, Homo sapiens
aattaacctggtg

SEQ ID NO: 308279 - DNA, 14 bp, Homo sapiens
aattaacctggtgc

SEQ ID NO: 308280 - DNA, 15 bp, Homo sapiens
aattaacctggtgct

SEQ ID NO: 308281 - DNA, 16 bp, Homo sapiens
aattaacctggtgctg

SEQ ID NO: 308282 - DNA, 14 bp, Homo sapiens
aattaactctggac

SEQ ID NO: 308283 - DNA, 15 bp, Homo sapiens
aattaactgaagcaa

SEQ ID NO: 308284 - DNA, 17 bp, Homo sapiens
aattaacttgagtttta

SEQ ID NO: 308285 - DNA, 13 bp, Homo sapiens
aattaagaatctc

SEQ ID NO: 308286 - DNA, 12 bp, Homo sapiens
aattaagacttt

SEQ ID NO: 308287 - DNA, 19 bp, Homo sapiens
aattaagctccttcagttt

SEQ ID NO: 308288 - DNA, 16 bp, Homo sapiens
aattaaggcataagaa

SEQ ID NO: 308289 - DNA, 13 bp, Homo sapiens
aattaaggtttgt

SEQ ID NO: 308290 - DNA, 14 bp, Homo sapiens
aattaagttatctt

SEQ ID NO: 308291 - DNA, 14 bp, Homo sapiens
aattaatacataag

SEQ ID NO: 308292 - DNA, 22 bp, Homo sapiens
aattaattgctggagactacaa

SEQ ID NO: 308293 - DNA, 12 bp, Homo sapiens
aattaatttcag

SEQ ID NO: 308294 - DNA, 15 bp, Homo sapiens
aattacaagtttcag

SEQ ID NO: 308295 - DNA, 19 bp, Homo sapiens
aattacaagtttcagtaat

SEQ ID NO: 308296 - DNA, 14 bp, Homo sapiens
aattacaattgtca

SEQ ID NO: 308297 - DNA, 23 bp, Homo sapiens
aattacaattgtcatttataaaa

SEQ ID NO: 308298 - DNA, 17 bp, Homo sapiens
aattacagcttcaccct

SEQ ID NO: 308299 - DNA, 17 bp, Homo sapiens
aattacaggaagtactg

SEQ ID NO: 308300 - DNA, 19 bp, Homo sapiens
aattacagtggattgctca

SEQ ID NO: 308301 - DNA, 19 bp, Homo sapiens
aattacataacaggcattg

SEQ ID NO: 308302 - DNA, 15 bp, Homo sapiens
aattgatgtatatgt

SEQ ID NO: 308303 - DNA, 16 bp, Homo sapiens
aattgattaaactgta

SEQ ID NO: 308304 - DNA, 15 bp, Homo sapiens
aattgcaagggaaga

SEQ ID NO: 308305 - DNA, 16 bp, Homo sapiens
aattgcatgctgcttt

SEQ ID NO: 308306 - DNA, 18 bp, Homo sapiens
aattgcatgctgctttaa

SEQ ID NO: 308307 - DNA, 17 bp, Homo sapiens
aattgcatttttacctt

SEQ ID NO: 308308 - DNA, 21 bp, Homo sapiens
aattgcattttttaaaacaag

SEQ ID NO: 308309 - DNA, 20 bp, Homo sapiens
aattgccatgtacagtatgt

SEQ ID NO: 308310 - DNA, 14 bp, Homo sapiens
aattgccctgccag

SEQ ID NO: 308311 - DNA, 16 bp, Homo sapiens
aattgcctcccttcct

SEQ ID NO: 308312 - DNA, 13 bp, Homo sapiens
aattgcctttgag

SEQ ID NO: 308313 - DNA, 19 bp, Homo sapiens
aattgctaaatataaaaac

SEQ ID NO: 308314 - DNA, 12 bp, Homo sapiens
aattgctccttg

SEQ ID NO: 308315 - DNA, 15 bp, Homo sapiens
aattgcttctctaaa

SEQ ID NO: 308316 - DNA, 21 bp, Homo sapiens
aattgcttctctaaaacagca

SEQ ID NO: 308317 - DNA, 16 bp, Homo sapiens
aattgcttgtttgctt

SEQ ID NO: 308318 - DNA, 19 bp, Homo sapiens
aattgcttgtttgcttcaa

SEQ ID NO: 308319 - DNA, 20 bp, Homo sapiens
aattggacagttttgataca

SEQ ID NO: 308320 - DNA, 16 bp, Homo sapiens
aattggcattaaaact

SEQ ID NO: 308321 - DNA, 17 bp, Homo sapiens
aattggcattaaaactt

SEQ ID NO: 308322 - DNA, 13 bp, Homo sapiens
aattggcttgttt

SEQ ID NO: 308323 - DNA, 21 bp, Homo sapiens
aattggcttttgaatcaaaga

SEQ ID NO: 308324 - DNA, 13 bp, Homo sapiens
aattggtcattcc

SEQ ID NO: 308325 - DNA, 16 bp, Homo sapiens
aattggtgataagtgg

SEQ ID NO: 308326 - DNA, 17 bp, Homo sapiens
aattggtgataagtgga

SEQ ID NO: 308327 - DNA, 20 bp, Homo sapiens
aattggtgataagtggaaaa

SEQ ID NO: 308328 - DNA, 22 bp, Homo sapiens
aattggttagaacctcctattt

SEQ ID NO: 308329 - DNA, 16 bp, Homo sapiens
aattgtaaggaatgat

SEQ ID NO: 308330 - DNA, 13 bp, Homo sapiens
aattgtatagaga

SEQ ID NO: 308331 - DNA, 15 bp, Homo sapiens
aattgtatagagata

SEQ ID NO: 308332 - DNA, 23 bp, Homo sapiens
aattgtatagagatatgcagaag

SEQ ID NO: 308333 - DNA, 13 bp, Homo sapiens
aattgtatctagt

SEQ ID NO: 308334 - DNA, 23 bp, Homo sapiens
aattgtatctagtgcagctgatt

SEQ ID NO: 308335 - DNA, 14 bp, Homo sapiens
aattgtatgaaaat

SEQ ID NO: 308336 - DNA, 19 bp, Homo sapiens
aattgtcaaatgtcattat

SEQ ID NO: 308337 - DNA, 22 bp, Homo sapiens
aattgtctcaaagcatcaaata

SEQ ID NO: 308338 - DNA, 23 bp, Homo sapiens
aattgtgaaagctccatgtttag

SEQ ID NO: 308339 - DNA, 21 bp, Homo sapiens
aattgtgaacagccaaaagct

SEQ ID NO: 308340 - DNA, 15 bp, Homo sapiens
aattgtgaactcatt

SEQ ID NO: 308341 - DNA, 16 bp, Homo sapiens
aattgtgaattgataa

SEQ ID NO: 308342 - DNA, 21 bp, Homo sapiens
aattgtgaattgataataaac

SEQ ID NO: 308343 - DNA, 14 bp, Homo sapiens
aattgtgagggaca

SEQ ID NO: 308344 - DNA, 19 bp, Homo sapiens
aattgtggagaggagagaa

SEQ ID NO: 308345 - DNA, 16 bp, Homo sapiens
aattgtggtgtcttac

SEQ ID NO: 308346 - DNA, 13 bp, Homo sapiens
aattgtgtacaaa

SEQ ID NO: 308347 - DNA, 16 bp, Homo sapiens
aattgttacaattttc

SEQ ID NO: 308348 - DNA, 14 bp, Homo sapiens
aattgttcctcttt

SEQ ID NO: 308349 - DNA, 15 bp, Homo sapiens
aattgttcctctttg

SEQ ID NO: 308350 - DNA, 17 bp, Homo sapiens
aattgttcctgatgtgc

SEQ ID NO: 308351 - DNA, 22 bp, Homo sapiens
aattgtttttgaatttaaataa

SEQ ID NO: 308352 - DNA, 23 bp, Homo sapiens
aattgtttttgaatttaaataaa

SEQ ID NO: 308353 - DNA, 14 bp, Homo sapiens
aatttaaaaaaata

SEQ ID NO: 308354 - DNA, 13 bp, Homo sapiens
aatttaaaaaata

SEQ ID NO: 308355 - DNA, 13 bp, Homo sapiens
aatttaaaaatct

SEQ ID NO: 308356 - DNA, 17 bp, Homo sapiens
aatttaaaaatctttca

SEQ ID NO: 308357 - DNA, 13 bp, Homo sapiens
aatttaaaacaaa

SEQ ID NO: 308358 - DNA, 16 bp, Homo sapiens
aatttaaaacaaacaa

SEQ ID NO: 308359 - DNA, 18 bp, Homo sapiens
aatttaaagctgtttcta

SEQ ID NO: 308360 - DNA, 18 bp, Homo sapiens
aatttaaataaagttact

SEQ ID NO: 308361 - DNA, 20 bp, Homo sapiens
agcatactgatgagacaaca

SEQ ID NO: 308362 - DNA, 20 bp, Homo sapiens
agcataggctagtgggcagg

SEQ ID NO: 308363 - DNA, 13 bp, Homo sapiens
agcatatataaaa

SEQ ID NO: 308364 - DNA, 21 bp, Homo sapiens
agcatatggagtgcctgtaca

SEQ ID NO: 308365 - DNA, 23 bp, Homo sapiens
agcatattttctccgaaaggcaa

SEQ ID NO: 308366 - DNA, 15 bp, Homo sapiens
agcatcaaaatacaa

SEQ ID NO: 308367 - DNA, 16 bp, Homo sapiens
agcatcaaacatgaaa

SEQ ID NO: 308368 - DNA, 16 bp, Homo sapiens
agcatcacacagtggc

SEQ ID NO: 308369 - DNA, 19 bp, Homo sapiens
agcatcacacagtggcact

SEQ ID NO: 308370 - DNA, 12 bp, Homo sapiens
agcatcagagat

SEQ ID NO: 308371 - DNA, 13 bp, Homo sapiens
agcatcagcaaga

SEQ ID NO: 308372 - DNA, 14 bp, Homo sapiens
agcatcagcaagac

SEQ ID NO: 308373 - DNA, 16 bp, Homo sapiens
agcatcagcgtggcag

SEQ ID NO: 308374 - DNA, 23 bp, Homo sapiens
agcatccatgcggccggcctggg

SEQ ID NO: 308375 - DNA, 20 bp, Homo sapiens
agcatcccatctcagaagat

SEQ ID NO: 308376 - DNA, 12 bp, Homo sapiens
agcatcccccaa

SEQ ID NO: 308377 - DNA, 13 bp, Homo sapiens
agcatccctgtga

SEQ ID NO: 308378 - DNA, 13 bp, Homo sapiens
agcatcggaggga

SEQ ID NO: 308379 - DNA, 18 bp, Homo sapiens
agcatcgtgacccttcag

SEQ ID NO: 308380 - DNA, 20 bp, Homo sapiens
agcatcgtgacccttcaggg

SEQ ID NO: 308381 - DNA, 22 bp, Homo sapiens
agcatcgtgacccttcagggcc

SEQ ID NO: 308382 - DNA, 20 bp, Homo sapiens
agcatctcagcctaccatga

SEQ ID NO: 308383 - DNA, 14 bp, Homo sapiens
agcatctgctctga

SEQ ID NO: 308384 - DNA, 19 bp, Homo sapiens
agcatctgtcccactggga

SEQ ID NO: 308385 - DNA, 17 bp, Homo sapiens
agcatgaaaatgtgtgt

SEQ ID NO: 308386 - DNA, 18 bp, Homo sapiens
agcatgacaagccccagg

SEQ ID NO: 308387 - DNA, 21 bp, Homo sapiens
agcatgacaagccccaggcag

SEQ ID NO: 308388 - DNA, 22 bp, Homo sapiens
agcatgacaagccccaggcagg

SEQ ID NO: 308389 - DNA, 19 bp, Homo sapiens
agcatgaccttttggcctt

SEQ ID NO: 308390 - DNA, 23 bp, Homo sapiens
agcatgaccttttggcctttgta

SEQ ID NO: 308391 - DNA, 17 bp, Homo sapiens
agcatgccaatttctct

SEQ ID NO: 308392 - DNA, 14 bp, Homo sapiens
agcatgccccaccc

SEQ ID NO: 308393 - DNA, 15 bp, Homo sapiens
agcatgccccaccca

SEQ ID NO: 308394 - DNA, 17 bp, Homo sapiens
agcatgccccacccacc

SEQ ID NO: 308395 - DNA, 11 bp, Homo sapiens
agcatgctcag

SEQ ID NO: 308396 - DNA, 13 bp, Homo sapiens
agcatgctttctg

SEQ ID NO: 308397 - DNA, 18 bp, Homo sapiens
agcatggactctgggttt

SEQ ID NO: 308398 - DNA, 16 bp, Homo sapiens
agcatggagaacagtg

SEQ ID NO: 308399 - DNA, 15 bp, Homo sapiens
agcatggagagcctc

SEQ ID NO: 308400 - DNA, 20 bp, Homo sapiens
agcatggagagcctcttagt

SEQ ID NO: 308401 - DNA, 21 bp, Homo sapiens
agcatgggactgtgcctttgg

SEQ ID NO: 308402 - DNA, 14 bp, Homo sapiens
agcatgggcctggc

SEQ ID NO: 308403 - DNA, 15 bp, Homo sapiens
agcatggtgcatgcc

SEQ ID NO: 308404 - DNA, 16 bp, Homo sapiens
agcatggtgcatgccg

SEQ ID NO: 308405 - DNA, 12 bp, Homo sapiens
agcatgtaatat

SEQ ID NO: 308406 - DNA, 16 bp, Homo sapiens
agcatgtcactaaagc

SEQ ID NO: 308407 - DNA, 17 bp, Homo sapiens
agcatgtctactgcttg

SEQ ID NO: 308408 - DNA, 14 bp, Homo sapiens
agcatgtgccaaga

SEQ ID NO: 308409 - DNA, 22 bp, Homo sapiens
agcatgtgccaagattctactc

SEQ ID NO: 308410 - DNA, 16 bp, Homo sapiens
agcatgtgtcagagtg

SEQ ID NO: 308411 - DNA, 16 bp, Homo sapiens
agcatgtgtcccagga

SEQ ID NO: 308412 - DNA, 15 bp, Homo sapiens
agcatgtgtgtgtct

SEQ ID NO: 308413 - DNA, 16 bp, Homo sapiens
agcatgtgtgtgtctc

SEQ ID NO: 308414 - DNA, 17 bp, Homo sapiens
agcatgtgtgtgtctct

SEQ ID NO: 308415 - DNA, 19 bp, Homo sapiens
agcatgtgtgtgtctctat

SEQ ID NO: 308416 - DNA, 22 bp, Homo sapiens
agcatgtgtttggttctggggc

SEQ ID NO: 308417 - DNA, 20 bp, Homo sapiens
agcatgttgagccaggcctg

SEQ ID NO: 308418 - DNA, 14 bp, Homo sapiens
agcattaaaaataa

SEQ ID NO: 308419 - DNA, 18 bp, Homo sapiens
agcattaactaatctatt

SEQ ID NO: 308420 - DNA, 18 bp, Homo sapiens
agcattaacttctctgga

SEQ ID NO: 308421 - DNA, 21 bp, Homo sapiens
agcattactttgtagatgtat

SEQ ID NO: 308422 - DNA, 18 bp, Homo sapiens
agcattataccaagagta

SEQ ID NO: 308423 - DNA, 13 bp, Homo sapiens
agcattcaaaata

SEQ ID NO: 308424 - DNA, 20 bp, Homo sapiens
agcattcaaaatagttctat

SEQ ID NO: 308425 - DNA, 22 bp, Homo sapiens
agcattcaaaatagttctattt

SEQ ID NO: 308426 - DNA, 13 bp, Homo sapiens
agcattccagctc

SEQ ID NO: 308427 - DNA, 15 bp, Homo sapiens
agcattccagctctg

SEQ ID NO: 308428 - DNA, 19 bp, Homo sapiens
agcattccagctctgcccc

SEQ ID NO: 308429 - DNA, 19 bp, Homo sapiens
agcattccttagcagctca

SEQ ID NO: 308430 - DNA, 22 bp, Homo sapiens
agcattccttagcagctcaggc

SEQ ID NO: 308431 - DNA, 20 bp, Homo sapiens
agcattcttgtcacaataaa

SEQ ID NO: 308432 - DNA, 21 bp, Homo sapiens
agcattcttgtcacaataaat

SEQ ID NO: 308433 - DNA, 12 bp, Homo sapiens
acaactccagcc

SEQ ID NO: 308434 - DNA, 15 bp, Homo sapiens
acaactccaggaaaa

SEQ ID NO: 308435 - DNA, 20 bp, Homo sapiens
acaactccaggaaaactgtt

SEQ ID NO: 308436 - DNA, 15 bp, Homo sapiens
acaactccttccatc

SEQ ID NO: 308437 - DNA, 14 bp, Homo sapiens
acaactgagtcctt

SEQ ID NO: 308438 - DNA, 19 bp, Homo sapiens
acaactgagtccttaaaca

SEQ ID NO: 308439 - DNA, 18 bp, Homo sapiens
acaactgatcatttgcag

SEQ ID NO: 308440 - DNA, 19 bp, Homo sapiens
acaactgtttttgaagaag

SEQ ID NO: 308441 - DNA, 15 bp, Homo sapiens
acaacttaaataata

SEQ ID NO: 308442 - DNA, 18 bp, Homo sapiens
acaacttcccagtgaatt

SEQ ID NO: 308443 - DNA, 19 bp, Homo sapiens
acaactttggaatttgaag

SEQ ID NO: 308444 - DNA, 19 bp, Homo sapiens
acaagaccccgtctcaaaa

SEQ ID NO: 308445 - DNA, 16 bp, Homo sapiens
acaagacccctgctcc

SEQ ID NO: 308446 - DNA, 14 bp, Homo sapiens
acaagactaacctt

SEQ ID NO: 308447 - DNA, 13 bp, Homo sapiens
acaagactgcctc

SEQ ID NO: 308448 - DNA, 20 bp, Homo sapiens
acaagactttccccatactc

SEQ ID NO: 308449 - DNA, 16 bp, Homo sapiens
acaagagcagcctgtg

SEQ ID NO: 308450 - DNA, 23 bp, Homo sapiens
acaagaggagcaggaagcaaggc

SEQ ID NO: 308451 - DNA, 18 bp, Homo sapiens
acaagagggactgtattt

SEQ ID NO: 308452 - DNA, 20 bp, Homo sapiens
acaagagggactgtatttct

SEQ ID NO: 308453 - DNA, 15 bp, Homo sapiens
acaagatgccaagga

SEQ ID NO: 308454 - DNA, 22 bp, Homo sapiens
acaagatggaaaaaaaaaacaa

SEQ ID NO: 308455 - DNA, 21 bp, Homo sapiens
acaagcattccttagcagctc

SEQ ID NO: 308456 - DNA, 22 bp, Homo sapiens
acaagcattccttagcagctca

SEQ ID NO: 308457 - DNA, 23 bp, Homo sapiens
acaagcattccttagcagctcag

SEQ ID NO: 308458 - DNA, 21 bp, Homo sapiens
acaagccaagctagaaggaag

SEQ ID NO: 308459 - DNA, 22 bp, Homo sapiens
acaagccaagctagaaggaagc

SEQ ID NO: 308460 - DNA, 13 bp, Homo sapiens
acaagccagctgg

SEQ ID NO: 308461 - DNA, 11 bp, Homo sapiens
acaagccaggg

SEQ ID NO: 308462 - DNA, 16 bp, Homo sapiens
acaagccccaggcagg

SEQ ID NO: 308463 - DNA, 16 bp, Homo sapiens
acaagcctcttctgaa

SEQ ID NO: 308464 - DNA, 14 bp, Homo sapiens
acaagctaaaatta

SEQ ID NO: 308465 - DNA, 13 bp, Homo sapiens
acaagctgcctct

SEQ ID NO: 308466 - DNA, 23 bp, Homo sapiens
acaaggaataaatgagagggaat

SEQ ID NO: 308467 - DNA, 16 bp, Homo sapiens
acaaggaatgcctgtg

SEQ ID NO: 308468 - DNA, 14 bp, Homo sapiens
acaaggagggcaca

SEQ ID NO: 308469 - DNA, 17 bp, Homo sapiens
acaaggagggcctctgg

SEQ ID NO: 308470 - DNA, 15 bp, Homo sapiens
acaaggaggtagaga

SEQ ID NO: 308471 - DNA, 16 bp, Homo sapiens
acaaggcaaggctgtc

SEQ ID NO: 308472 - DNA, 19 bp, Homo sapiens
acaaggcaaggctgtcaat

SEQ ID NO: 308473 - DNA, 13 bp, Homo sapiens
acaaggcaggcct

SEQ ID NO: 308474 - DNA, 23 bp, Homo sapiens
acaaggcattcaagtgtacagtg

SEQ ID NO: 308475 - DNA, 11 bp, Homo sapiens
acaaggcccca

SEQ ID NO: 308476 - DNA, 17 bp, Homo sapiens
acaaggccccagagact

SEQ ID NO: 308477 - DNA, 16 bp, Homo sapiens
acaaggctgaaaagtg

SEQ ID NO: 308478 - DNA, 18 bp, Homo sapiens
acaaggctgaaaagtgct

SEQ ID NO: 308479 - DNA, 18 bp, Homo sapiens
acaagggagagacctcat

SEQ ID NO: 308480 - DNA, 19 bp, Homo sapiens
acaagggagagacctcatc

SEQ ID NO: 308481 - DNA, 17 bp, Homo sapiens
acaagggattctgggaa

SEQ ID NO: 308482 - DNA, 16 bp, Homo sapiens
acaaggtagtttttac

SEQ ID NO: 308483 - DNA, 18 bp, Homo sapiens
acaagtaatgaattttat

SEQ ID NO: 308484 - DNA, 22 bp, Homo sapiens
acaagtaccaaagttttatcaa

SEQ ID NO: 308485 - DNA, 20 bp, Homo sapiens
acaagtagatgcctgaactt

SEQ ID NO: 308486 - DNA, 13 bp, Homo sapiens
acaagtaggagac

SEQ ID NO: 308487 - DNA, 17 bp, Homo sapiens
acaagtcacagctgcag

SEQ ID NO: 308488 - DNA, 12 bp, Homo sapiens
acaagtgccact

SEQ ID NO: 308489 - DNA, 14 bp, Homo sapiens
acaagtgctcagtt

SEQ ID NO: 308490 - DNA, 17 bp, Homo sapiens
acaagtgctcagttcca

SEQ ID NO: 308491 - DNA, 18 bp, Homo sapiens
acaagtgtatatcagaaa

SEQ ID NO: 308492 - DNA, 22 bp, Homo sapiens
acaagttgcgacggagagaaaa

SEQ ID NO: 308493 - DNA, 23 bp, Homo sapiens
acaagttggctagaagaaagtaa

SEQ ID NO: 308494 - DNA, 12 bp, Homo sapiens
acaagtttcaga

SEQ ID NO: 308495 - DNA, 13 bp, Homo sapiens
acaagtttcagac

SEQ ID NO: 308496 - DNA, 16 bp, Homo sapiens
acaagtttcagacagg

SEQ ID NO: 308497 - DNA, 13 bp, Homo sapiens
acaagttttgtat

SEQ ID NO: 308498 - DNA, 12 bp, Homo sapiens
acaataaaacat

SEQ ID NO: 308499 - DNA, 10 bp, Homo sapiens
acaataaact

SEQ ID NO: 308500 - DNA, 14 bp, Homo sapiens
acaataaataatct

SEQ ID NO: 308501 - DNA, 18 bp, Homo sapiens
acaataaatgtattcaaa

SEQ ID NO: 308502 - DNA, 19 bp, Homo sapiens
acaataaatgtattcaaat

SEQ ID NO: 308503 - DNA, 14 bp, Homo sapiens
acaataaatgtgca

SEQ ID NO: 308504 - DNA, 14 bp, Homo sapiens
acaataaattttat

SEQ ID NO: 308505 - DNA, 22 bp, Homo sapiens
acaataactactgtgttcctgg

SEQ ID NO: 308506 - DNA, 18 bp, Homo sapiens
acaataataaatcctcag

SEQ ID NO: 308507 - DNA, 15 bp, Homo sapiens
acaataataaatgtt

SEQ ID NO: 308508 - DNA, 18 bp, Homo sapiens
agccccagccagcccttc

SEQ ID NO: 308509 - DNA, 15 bp, Homo sapiens
agccccagcccagcc

SEQ ID NO: 308510 - DNA, 16 bp, Homo sapiens
agccccaggcaggctg

SEQ ID NO: 308511 - DNA, 14 bp, Homo sapiens
agccccagggccct

SEQ ID NO: 308512 - DNA, 15 bp, Homo sapiens
agccccagggccctg

SEQ ID NO: 308513 - DNA, 20 bp, Homo sapiens
agccccagggccctgctcag

SEQ ID NO: 308514 - DNA, 20 bp, Homo sapiens
agccccagggcctgggggca

SEQ ID NO: 308515 - DNA, 22 bp, Homo sapiens
agccccagggtcttccctacct

SEQ ID NO: 308516 - DNA, 23 bp, Homo sapiens
agccccagggtcttccctacctc

SEQ ID NO: 308517 - DNA, 16 bp, Homo sapiens
agccccatccttcccg

SEQ ID NO: 308518 - DNA, 13 bp, Homo sapiens
agcccccaccagc

SEQ ID NO: 308519 - DNA, 12 bp, Homo sapiens
agcccccacctg

SEQ ID NO: 308520 - DNA, 15 bp, Homo sapiens
agccccctccacacc

SEQ ID NO: 308521 - DNA, 15 bp, Homo sapiens
agccccctctcctga

SEQ ID NO: 308522 - DNA, 12 bp, Homo sapiens
agccccctgcac

SEQ ID NO: 308523 - DNA, 20 bp, Homo sapiens
agccccctggatgggcattg

SEQ ID NO: 308524 - DNA, 15 bp, Homo sapiens
agccccctggcccct

SEQ ID NO: 308525 - DNA, 19 bp, Homo sapiens
agccccgctcaggtagcca

SEQ ID NO: 308526 - DNA, 23 bp, Homo sapiens
agccccgctcaggtagccaccac

SEQ ID NO: 308527 - DNA, 21 bp, Homo sapiens
agccccggccactccctgcca

SEQ ID NO: 308528 - DNA, 22 bp, Homo sapiens
agccccggccactccctgccaa

SEQ ID NO: 308529 - DNA, 17 bp, Homo sapiens
agcccctaccccacacc

SEQ ID NO: 308530 - DNA, 20 bp, Homo sapiens
agcccctatcctgcaccctc

SEQ ID NO: 308531 - DNA, 17 bp, Homo sapiens
agcccctcacctcagga

SEQ ID NO: 308532 - DNA, 20 bp, Homo sapiens
agcccctcacctcaggaccc

SEQ ID NO: 308533 - DNA, 15 bp, Homo sapiens
agcccctcagccctt

SEQ ID NO: 308534 - DNA, 16 bp, Homo sapiens
agcccctcagcccttg

SEQ ID NO: 308535 - DNA, 15 bp, Homo sapiens
agcccctccccagcc

SEQ ID NO: 308536 - DNA, 21 bp, Homo sapiens
agcccctccccagccagccct

SEQ ID NO: 308537 - DNA, 22 bp, Homo sapiens
agcccctccccatggtgcagtg

SEQ ID NO: 308538 - DNA, 13 bp, Homo sapiens
agcccctcctctc

SEQ ID NO: 308539 - DNA, 18 bp, Homo sapiens
agcccctcctctcctcgt

SEQ ID NO: 308540 - DNA, 21 bp, Homo sapiens
agcccctcttgccccccaccc

SEQ ID NO: 308541 - DNA, 20 bp, Homo sapiens
agcccctggagctcctgctg

SEQ ID NO: 308542 - DNA, 22 bp, Homo sapiens
agcccctggggcctagactctg

SEQ ID NO: 308543 - DNA, 13 bp, Homo sapiens
agcccctgtctaa

SEQ ID NO: 308544 - DNA, 23 bp, Homo sapiens
agcccctgtgtgggagggcgagg

SEQ ID NO: 308545 - DNA, 14 bp, Homo sapiens
agccccttctccca

SEQ ID NO: 308546 - DNA, 18 bp, Homo sapiens
agcccgagtggtctcctc

SEQ ID NO: 308547 - DNA, 12 bp, Homo sapiens
agcccgcatgca

SEQ ID NO: 308548 - DNA, 16 bp, Homo sapiens
agcccgcatgcagcag

SEQ ID NO: 308549 - DNA, 17 bp, Homo sapiens
agcccgcatgcagcagc

SEQ ID NO: 308550 - DNA, 22 bp, Homo sapiens
agcccgccgtcagggtggctgg

SEQ ID NO: 308551 - DNA, 20 bp, Homo sapiens
agcccgcctgccgtgcatgg

SEQ ID NO: 308552 - DNA, 21 bp, Homo sapiens
agcccgcctgccgtgcatggc

SEQ ID NO: 308553 - DNA, 15 bp, Homo sapiens
agcccgcgtctgtgc

SEQ ID NO: 308554 - DNA, 21 bp, Homo sapiens
agcccgcttttgttcttcccc

SEQ ID NO: 308555 - DNA, 16 bp, Homo sapiens
agcccggatgcccacc

SEQ ID NO: 308556 - DNA, 14 bp, Homo sapiens
agcccggatgcttc

SEQ ID NO: 308557 - DNA, 14 bp, Homo sapiens
agcccggccaagga

SEQ ID NO: 308558 - DNA, 19 bp, Homo sapiens
agcccggccaaggacactg

SEQ ID NO: 308559 - DNA, 18 bp, Homo sapiens
agcccggcgcccctgcca

SEQ ID NO: 308560 - DNA, 15 bp, Homo sapiens
agcccgtcaccctta

SEQ ID NO: 308561 - DNA, 22 bp, Homo sapiens
agcccgtcacccttatttatta

SEQ ID NO: 308562 - DNA, 15 bp, Homo sapiens
agcccgtgtggcccc

SEQ ID NO: 308563 - DNA, 13 bp, Homo sapiens
acacccctgctct

SEQ ID NO: 308564 - DNA, 23 bp, Homo sapiens
acacccctgctctacccatgagc

SEQ ID NO: 308565 - DNA, 20 bp, Homo sapiens
acaccctcactctgccaggg

SEQ ID NO: 308566 - DNA, 20 bp, Homo sapiens
acaccctgcaaggcccacag

SEQ ID NO: 308567 - DNA, 18 bp, Homo sapiens
acacccttggacttgagg

SEQ ID NO: 308568 - DNA, 18 bp, Homo sapiens
acaccgtacatctgcaat

SEQ ID NO: 308569 - DNA, 16 bp, Homo sapiens
acacctaagtgactac

SEQ ID NO: 308570 - DNA, 10 bp, Homo sapiens
acacctcaga

SEQ ID NO: 308571 - DNA, 20 bp, Homo sapiens
acacctcccttcgtgtgtgc

SEQ ID NO: 308572 - DNA, 22 bp, Homo sapiens
acacctcctagcaagacctgtt

SEQ ID NO: 308573 - DNA, 15 bp, Homo sapiens
acacctctgggccct

SEQ ID NO: 308574 - DNA, 18 bp, Homo sapiens
acacctctgggccctgca

SEQ ID NO: 308575 - DNA, 22 bp, Homo sapiens
acacctctgggccctgcaggag

SEQ ID NO: 308576 - DNA, 11 bp, Homo sapiens
acacctgacac

SEQ ID NO: 308577 - DNA, 12 bp, Homo sapiens
acacctgacaca

SEQ ID NO: 308578 - DNA, 13 bp, Homo sapiens
acacctgccctgc

SEQ ID NO: 308579 - DNA, 18 bp, Homo sapiens
acacctgccctgccctgc

SEQ ID NO: 308580 - DNA, 19 bp, Homo sapiens
acacctgcctctgaactgc

SEQ ID NO: 308581 - DNA, 23 bp, Homo sapiens
acacctgggcccgggcaggccag

SEQ ID NO: 308582 - DNA, 18 bp, Homo sapiens
acacctggtctgttttct

SEQ ID NO: 308583 - DNA, 20 bp, Homo sapiens
acaccttcttggcttctggg

SEQ ID NO: 308584 - DNA, 15 bp, Homo sapiens
acaccttttaactca

SEQ ID NO: 308585 - DNA, 16 bp, Homo sapiens
acacgcaagggcatca

SEQ ID NO: 308586 - DNA, 23 bp, Homo sapiens
acacgcacacacacacacaggag

SEQ ID NO: 308587 - DNA, 13 bp, Homo sapiens
acacgcacgcaca

SEQ ID NO: 308588 - DNA, 15 bp, Homo sapiens
acacgcacgcacaca

SEQ ID NO: 308589 - DNA, 16 bp, Homo sapiens
acacgcacgcacacac

SEQ ID NO: 308590 - DNA, 20 bp, Homo sapiens
acacgcacgcacacacacaa

SEQ ID NO: 308591 - DNA, 13 bp, Homo sapiens
acacgcagacaca

SEQ ID NO: 308592 - DNA, 15 bp, Homo sapiens
acacgcagacacaca

SEQ ID NO: 308593 - DNA, 16 bp, Homo sapiens
acacgcagacacacac

SEQ ID NO: 308594 - DNA, 14 bp, Homo sapiens
acacgccctcttag

SEQ ID NO: 308595 - DNA, 15 bp, Homo sapiens
acacgccggggctgg

SEQ ID NO: 308596 - DNA, 17 bp, Homo sapiens
acacgccggggctggcc

SEQ ID NO: 308597 - DNA, 18 bp, Homo sapiens
acacgccggggctggccc

SEQ ID NO: 308598 - DNA, 22 bp, Homo sapiens
acacgccggggctggccctgcc

SEQ ID NO: 308599 - DNA, 20 bp, Homo sapiens
acacgctccctccccctgcc

SEQ ID NO: 308600 - DNA, 23 bp, Homo sapiens
acacgctcctctgcccttccttt

SEQ ID NO: 308601 - DNA, 13 bp, Homo sapiens
acacgctgcccag

SEQ ID NO: 308602 - DNA, 15 bp, Homo sapiens
acacgctgcccaggc

SEQ ID NO: 308603 - DNA, 19 bp, Homo sapiens
acacgctgcccaggctctg

SEQ ID NO: 308604 - DNA, 17 bp, Homo sapiens
acacggcagctgtagct

SEQ ID NO: 308605 - DNA, 14 bp, Homo sapiens
acacggcctctggg

SEQ ID NO: 308606 - DNA, 16 bp, Homo sapiens
acacgggcagcctggc

SEQ ID NO: 308607 - DNA, 17 bp, Homo sapiens
acacggggtattttagg

SEQ ID NO: 308608 - DNA, 23 bp, Homo sapiens
acacgtacttaaatgaaagcatg

SEQ ID NO: 308609 - DNA, 13 bp, Homo sapiens
acacgtgggtgag

SEQ ID NO: 308610 - DNA, 14 bp, Homo sapiens
acacgtgtgatgta

SEQ ID NO: 308611 - DNA, 20 bp, Homo sapiens
acactaaacagactatttaa

SEQ ID NO: 308612 - DNA, 21 bp, Homo sapiens
acactaaacagactatttaac

SEQ ID NO: 308613 - DNA, 14 bp, Homo sapiens
acactaaagagcta

SEQ ID NO: 308614 - DNA, 21 bp, Homo sapiens
acactaaagagctaggaaaga

SEQ ID NO: 308615 - DNA, 13 bp, Homo sapiens
acactaatacact

SEQ ID NO: 308616 - DNA, 19 bp, Homo sapiens
acactaatagtaagattaa

SEQ ID NO: 308617 - DNA, 15 bp, Homo sapiens
acactagccaaggaa

SEQ ID NO: 308618 - DNA, 18 bp, Homo sapiens
acactagttttgtgccag

SEQ ID NO: 308619 - DNA, 17 bp, Homo sapiens
acactatggtatttgag

SEQ ID NO: 308620 - DNA, 13 bp, Homo sapiens
acactcagctgtt

SEQ ID NO: 308621 - DNA, 18 bp, Homo sapiens
acactcagtcccccacca

SEQ ID NO: 308622 - DNA, 16 bp, Homo sapiens
acactcatcaggtaaa

SEQ ID NO: 308623 - DNA, 20 bp, Homo sapiens
acactctagtgacttcctgg

SEQ ID NO: 308624 - DNA, 14 bp, Homo sapiens
acactctcctgggc

SEQ ID NO: 308625 - DNA, 15 bp, Homo sapiens
acactctcctgggcc

SEQ ID NO: 308626 - DNA, 19 bp, Homo sapiens
acactctcctgggcccctc

SEQ ID NO: 308627 - DNA, 21 bp, Homo sapiens
acactctcctgggcccctccc

SEQ ID NO: 308628 - DNA, 22 bp, Homo sapiens
acactctcttcttactgtattt

SEQ ID NO: 308629 - DNA, 14 bp, Homo sapiens
acactctgtgtttt

SEQ ID NO: 308630 - DNA, 13 bp, Homo sapiens
acactcttcttga

SEQ ID NO: 308631 - DNA, 20 bp, Homo sapiens
acactcttcttgagcagacc

SEQ ID NO: 308632 - DNA, 20 bp, Homo sapiens
acactgacataatgtagtga

SEQ ID NO: 308633 - DNA, 17 bp, Homo sapiens
acactgaccacactgta

SEQ ID NO: 308634 - DNA, 17 bp, Homo sapiens
acactgagccccacctc

SEQ ID NO: 308635 - DNA, 21 bp, Homo sapiens
acactgagccccacctctcca

SEQ ID NO: 308636 - DNA, 17 bp, Homo sapiens
acactgcagccctctcc

SEQ ID NO: 308637 - DNA, 16 bp, Homo sapiens
acactgccagaagtgt

SEQ ID NO: 308638 - DNA, 19 bp, Homo sapiens
acactgccagaagtgtgtt

SEQ ID NO: 308639 - DNA, 21 bp, Homo sapiens
acactgccagaagtgtgtttt

SEQ ID NO: 308640 - DNA, 11 bp, Homo sapiens
acactgctgca

SEQ ID NO: 308641 - DNA, 19 bp, Homo sapiens
acactgctgcaccagagtg

SEQ ID NO: 308642 - DNA, 21 bp, Homo sapiens
acactgctgggaagtggctta

SEQ ID NO: 308643 - DNA, 16 bp, Homo sapiens
acactgtaatatcttt

SEQ ID NO: 308644 - DNA, 18 bp, Homo sapiens
acactgtaatatctttaa

SEQ ID NO: 308645 - DNA, 14 bp, Homo sapiens
acactgtatctaaa

SEQ ID NO: 308646 - DNA, 18 bp, Homo sapiens
acactgtatctaaaaaat

SEQ ID NO: 308647 - DNA, 19 bp, Homo sapiens
acactgtatctaaaaaata

SEQ ID NO: 308648 - DNA, 23 bp, Homo sapiens
acactgtattgtaagtggaaaat

SEQ ID NO: 308649 - DNA, 21 bp, Homo sapiens
acactgtatttgtatctctga

SEQ ID NO: 308650 - DNA, 22 bp, Homo sapiens
acactgtgcgttttagagtatg

SEQ ID NO: 308651 - DNA, 12 bp, Homo sapiens
acactgtggaac

SEQ ID NO: 308652 - DNA, 21 bp, Homo sapiens
acactgtggaacactaaagag

SEQ ID NO: 308653 - DNA, 14 bp, Homo sapiens
acacttaattctgt

SEQ ID NO: 308654 - DNA, 14 bp, Homo sapiens
acacttacaagtaa

SEQ ID NO: 308655 - DNA, 18 bp, Homo sapiens
acacttattttctgaatt

SEQ ID NO: 308656 - DNA, 17 bp, Homo sapiens
acacttcagagagctgg

SEQ ID NO: 308657 - DNA, 20 bp, Homo sapiens
acacttcagagagctggtag

SEQ ID NO: 308658 - DNA, 19 bp, Homo sapiens
acacttcaggctcttctcc

SEQ ID NO: 308659 - DNA, 19 bp, Homo sapiens
acacttcctgtccagagag

SEQ ID NO: 308660 - DNA, 20 bp, Homo sapiens
acacttctgtgagaccccca

SEQ ID NO: 308661 - DNA, 16 bp, Homo sapiens
acacttcttgaaacag

SEQ ID NO: 308662 - DNA, 19 bp, Homo sapiens
acacttcttgaaacagcct

SEQ ID NO: 308663 - DNA, 18 bp, Homo sapiens
acacttgccttcttcacc

SEQ ID NO: 308664 - DNA, 16 bp, Homo sapiens
acacttgctcccaacc

SEQ ID NO: 308665 - DNA, 17 bp, Homo sapiens
acacttggagcccgtgc

SEQ ID NO: 308666 - DNA, 17 bp, Homo sapiens
acacttgtccacatagg

SEQ ID NO: 308667 - DNA, 18 bp, Homo sapiens
acacttgtgttgctttct

SEQ ID NO: 308668 - DNA, 23 bp, Homo sapiens
acactttcctggataaaaaagaa

SEQ ID NO: 308669 - DNA, 18 bp, Homo sapiens
acactttgccaaggctct

SEQ ID NO: 308670 - DNA, 21 bp, Homo sapiens
acactttgccaaggctctccc

SEQ ID NO: 308671 - DNA, 22 bp, Homo sapiens
acactttggaagtttgtgttct

SEQ ID NO: 308672 - DNA, 16 bp, Homo sapiens
acagaaaaaaaacaca

SEQ ID NO: 308673 - DNA, 15 bp, Homo sapiens
acagaaaaatcttgt

SEQ ID NO: 308674 - DNA, 22 bp, Homo sapiens
acagaaaaatcttgtgctagaa

SEQ ID NO: 308675 - DNA, 10 bp, Homo sapiens
acagaaaaca

SEQ ID NO: 308676 - DNA, 14 bp, Homo sapiens
acagaaaacaacaa

SEQ ID NO: 308677 - DNA, 19 bp, Homo sapiens
acagaaaacaacaaaaaat

SEQ ID NO: 308678 - DNA, 21 bp, Homo sapiens
acagaaaacaacaaaaaataa

SEQ ID NO: 308679 - DNA, 15 bp, Homo sapiens
acagaaaagagaaga

SEQ ID NO: 308680 - DNA, 16 bp, Homo sapiens
acagaaaagagaagaa

SEQ ID NO: 308681 - DNA, 17 bp, Homo sapiens
acagaaaagagaagaaa

SEQ ID NO: 308682 - DNA, 16 bp, Homo sapiens
acagaaacgagatttg

SEQ ID NO: 308683 - DNA, 21 bp, Homo sapiens
acagaaagcaaatcagacaca

SEQ ID NO: 308684 - DNA, 20 bp, Homo sapiens
acagaaatcagaggagagac

SEQ ID NO: 308685 - DNA, 19 bp, Homo sapiens
acagaaatggggaattctc

SEQ ID NO: 308686 - DNA, 13 bp, Homo sapiens
acagaacaagcca

SEQ ID NO: 308687 - DNA, 13 bp, Homo sapiens
acagaacactaaa

SEQ ID NO: 308688 - DNA, 21 bp, Homo sapiens
acagaaccaacgggtctgtgg

SEQ ID NO: 308689 - DNA, 14 bp, Homo sapiens
acagaaccagcact

SEQ ID NO: 308690 - DNA, 22 bp, Homo sapiens
acagaaccagcactcccagggc

SEQ ID NO: 308691 - DNA, 15 bp, Homo sapiens
acagaacctttgtca

SEQ ID NO: 308692 - DNA, 19 bp, Homo sapiens
acagaactcgatgcactga

SEQ ID NO: 308693 - DNA, 20 bp, Homo sapiens
actccaggttcgtatagaaa

SEQ ID NO: 308694 - DNA, 22 bp, Homo sapiens
actccatacagcctctacagcc

SEQ ID NO: 308695 - DNA, 18 bp, Homo sapiens
actccatgaccaggccac

SEQ ID NO: 308696 - DNA, 19 bp, Homo sapiens
actccatgaccaggccacc

SEQ ID NO: 308697 - DNA, 13 bp, Homo sapiens
actccatgagcac

SEQ ID NO: 308698 - DNA, 13 bp, Homo sapiens
actccatgcctat

SEQ ID NO: 308699 - DNA, 19 bp, Homo sapiens
actccatgcctatttactg

SEQ ID NO: 308700 - DNA, 17 bp, Homo sapiens
actccatggccaccccg

SEQ ID NO: 308701 - DNA, 14 bp, Homo sapiens
actccatggccctt

SEQ ID NO: 308702 - DNA, 15 bp, Homo sapiens
actcccaaagagctg

SEQ ID NO: 308703 - DNA, 16 bp, Homo sapiens
actcccaaagagctgc

SEQ ID NO: 308704 - DNA, 19 bp, Homo sapiens
actcccaaagagctgccta

SEQ ID NO: 308705 - DNA, 17 bp, Homo sapiens
actcccaagaacagcag

SEQ ID NO: 308706 - DNA, 14 bp, Homo sapiens
actcccagccacca

SEQ ID NO: 308707 - DNA, 23 bp, Homo sapiens
actcccagccaccaccactgtcc

SEQ ID NO: 308708 - DNA, 11 bp, Homo sapiens
actcccagggc

SEQ ID NO: 308709 - DNA, 16 bp, Homo sapiens
actcccagggcccgag

SEQ ID NO: 308710 - DNA, 14 bp, Homo sapiens
actccccagcccca

SEQ ID NO: 308711 - DNA, 23 bp, Homo sapiens
actccccgcccgccctcctctgc

SEQ ID NO: 308712 - DNA, 16 bp, Homo sapiens
actcccgccacacgct

SEQ ID NO: 308713 - DNA, 23 bp, Homo sapiens
actcccgggccacgccccagccc

SEQ ID NO: 308714 - DNA, 22 bp, Homo sapiens
actcccgggttcacgccattct

SEQ ID NO: 308715 - DNA, 19 bp, Homo sapiens
actccctccctttctcttt

SEQ ID NO: 308716 - DNA, 19 bp, Homo sapiens
actccctcctcacctctgg

SEQ ID NO: 308717 - DNA, 20 bp, Homo sapiens
actccctcctcacctctgga

SEQ ID NO: 308718 - DNA, 11 bp, Homo sapiens
actccctgcca

SEQ ID NO: 308719 - DNA, 12 bp, Homo sapiens
actccctgccaa

SEQ ID NO: 308720 - DNA, 13 bp, Homo sapiens
actccctgccaac

SEQ ID NO: 308721 - DNA, 17 bp, Homo sapiens
actccctgccaactcca

SEQ ID NO: 308722 - DNA, 22 bp, Homo sapiens
actccctgccaccgtcacacag

SEQ ID NO: 308723 - DNA, 20 bp, Homo sapiens
actcccttcctggcctcact

SEQ ID NO: 308724 - DNA, 18 bp, Homo sapiens
actccgcccagcctctcc

SEQ ID NO: 308725 - DNA, 22 bp, Homo sapiens
actccgcccagcctctccccgc

SEQ ID NO: 308726 - DNA, 18 bp, Homo sapiens
actccggaatgaccagca

SEQ ID NO: 308727 - DNA, 14 bp, Homo sapiens
actccgtttccaaa

SEQ ID NO: 308728 - DNA, 22 bp, Homo sapiens
actcctacaagatttagaaaaa

SEQ ID NO: 308729 - DNA, 15 bp, Homo sapiens
actcctacctggtca

SEQ ID NO: 308730 - DNA, 22 bp, Homo sapiens
actcctactgcttcctctgaat

SEQ ID NO: 308731 - DNA, 14 bp, Homo sapiens
actcctaggagagc

SEQ ID NO: 308732 - DNA, 22 bp, Homo sapiens
actcctatccccaggccaggtc

SEQ ID NO: 308733 - DNA, 12 bp, Homo sapiens
actcctcctcca

SEQ ID NO: 308734 - DNA, 17 bp, Homo sapiens
actcctcgggcaagggc

SEQ ID NO: 308735 - DNA, 17 bp, Homo sapiens
actcctctgcagtgcct

SEQ ID NO: 308736 - DNA, 13 bp, Homo sapiens
actcctctgtcca

SEQ ID NO: 308737 - DNA, 14 bp, Homo sapiens
actcctcttatttg

SEQ ID NO: 308738 - DNA, 19 bp, Homo sapiens
actcctgacagtcttgtgc

SEQ ID NO: 308739 - DNA, 15 bp, Homo sapiens
actcctgacctcaag

SEQ ID NO: 308740 - DNA, 15 bp, Homo sapiens
aacactcgtgtgcat

SEQ ID NO: 308741 - DNA, 15 bp, Homo sapiens
aacactgtaatatct

SEQ ID NO: 308742 - DNA, 17 bp, Homo sapiens
aacacttattttctgaa

SEQ ID NO: 308743 - DNA, 18 bp, Homo sapiens
aacacttattttctgaat

SEQ ID NO: 308744 - DNA, 23 bp, Homo sapiens
aacacttattttctgaattcata

SEQ ID NO: 308745 - DNA, 12 bp, Homo sapiens
aacacttgtaat

SEQ ID NO: 308746 - DNA, 18 bp, Homo sapiens
aacactttcctggataaa

SEQ ID NO: 308747 - DNA, 14 bp, Homo sapiens
aacagaaaacaaca

SEQ ID NO: 308748 - DNA, 20 bp, Homo sapiens
aacagaaaacaacaaaaaat

SEQ ID NO: 308749 - DNA, 14 bp, Homo sapiens
aacagaaaagagaa

SEQ ID NO: 308750 - DNA, 14 bp, Homo sapiens
aacagaacatttct

SEQ ID NO: 308751 - DNA, 17 bp, Homo sapiens
aacagaacatttctcat

SEQ ID NO: 308752 - DNA, 13 bp, Homo sapiens
aacagactattta

SEQ ID NO: 308753 - DNA, 20 bp, Homo sapiens
aacagagccattcccttgga

SEQ ID NO: 308754 - DNA, 23 bp, Homo sapiens
aacagaggcctcccccagccagg

SEQ ID NO: 308755 - DNA, 17 bp, Homo sapiens
aacagagtatatatgta

SEQ ID NO: 308756 - DNA, 20 bp, Homo sapiens
aacagagtccaatttaagga

SEQ ID NO: 308757 - DNA, 13 bp, Homo sapiens
aacagataatcag

SEQ ID NO: 308758 - DNA, 16 bp, Homo sapiens
aacagatcaatttgta

SEQ ID NO: 308759 - DNA, 19 bp, Homo sapiens
aacagatgagaagactagc

SEQ ID NO: 308760 - DNA, 22 bp, Homo sapiens
aacagatgtccctgaagtcttg

SEQ ID NO: 308761 - DNA, 16 bp, Homo sapiens
aacagatgtttgtttt

SEQ ID NO: 308762 - DNA, 20 bp, Homo sapiens
aacagattgctacacacaca

SEQ ID NO: 308763 - DNA, 15 bp, Homo sapiens
aacagatttgttcat

SEQ ID NO: 308764 - DNA, 17 bp, Homo sapiens
aacagcaacaacaacag

SEQ ID NO: 308765 - DNA, 23 bp, Homo sapiens
aacagcactggctctctccagga

SEQ ID NO: 308766 - DNA, 13 bp, Homo sapiens
aacagcaggccca

SEQ ID NO: 308767 - DNA, 22 bp, Homo sapiens
aacagcaggggcattagtttca

SEQ ID NO: 308768 - DNA, 21 bp, Homo sapiens
aacagcagggtagtctggttt

SEQ ID NO: 308769 - DNA, 17 bp, Homo sapiens
aacagcatgtctactgc

SEQ ID NO: 308770 - DNA, 18 bp, Homo sapiens
aacagcatgtctactgct

SEQ ID NO: 308771 - DNA, 15 bp, Homo sapiens
aacagccctaaataa

SEQ ID NO: 308772 - DNA, 11 bp, Homo sapiens
aacagccttag

SEQ ID NO: 308773 - DNA, 19 bp, Homo sapiens
aacagctatgggagcccca

SEQ ID NO: 308774 - DNA, 14 bp, Homo sapiens
aacagctcaggatc

SEQ ID NO: 308775 - DNA, 20 bp, Homo sapiens
aacagctgaggtctcttgag

SEQ ID NO: 308776 - DNA, 21 bp, Homo sapiens
aacagctgaggtctcttgagg

SEQ ID NO: 308777 - DNA, 20 bp, Homo sapiens
aacagcttcatgcctttgta

SEQ ID NO: 308778 - DNA, 21 bp, Homo sapiens
aacagcttcttgcttgtaaaa

SEQ ID NO: 308779 - DNA, 22 bp, Homo sapiens
aacagcttcttgcttgtaaaaa

SEQ ID NO: 308780 - DNA, 12 bp, Homo sapiens
aacagctttctc

SEQ ID NO: 308781 - DNA, 11 bp, Homo sapiens
aacaggaaaag

SEQ ID NO: 308782 - DNA, 14 bp, Homo sapiens
aacaggaccaggag

SEQ ID NO: 308783 - DNA, 11 bp, Homo sapiens
aacaggaggaa

SEQ ID NO: 308784 - DNA, 19 bp, Homo sapiens
aacagggcccaggcctgga

SEQ ID NO: 308785 - DNA, 15 bp, Homo sapiens
aacaggggctggtgg

SEQ ID NO: 308786 - DNA, 19 bp, Homo sapiens
aacaggtctttgaaatatg

SEQ ID NO: 308787 - DNA, 21 bp, Homo sapiens
aacaggttttcttctaatcat

SEQ ID NO: 308788 - DNA, 16 bp, Homo sapiens
aacagtacctgtgcct

SEQ ID NO: 308789 - DNA, 12 bp, Homo sapiens
aacagtcagcca

SEQ ID NO: 308790 - DNA, 13 bp, Homo sapiens
aacagtcatttaa

SEQ ID NO: 308791 - DNA, 21 bp, Homo sapiens
aacagtctcattacagattta

SEQ ID NO: 308792 - DNA, 17 bp, Homo sapiens
aacagtcttcaggcaaa

SEQ ID NO: 308793 - DNA, 14 bp, Homo sapiens
aacagtggctgggt

SEQ ID NO: 308794 - DNA, 16 bp, Homo sapiens
aacagtggctgggtgg

SEQ ID NO: 308795 - DNA, 22 bp, Homo sapiens
aacagtgggagccctgaccttg

SEQ ID NO: 308796 - DNA, 17 bp, Homo sapiens
aacagtgttctgagccc

SEQ ID NO: 308797 - DNA, 15 bp, Homo sapiens
aacagtgtttcccat

SEQ ID NO: 308798 - DNA, 23 bp, Homo sapiens
aacagtgtttcccataattttct

SEQ ID NO: 308799 - DNA, 13 bp, Homo sapiens
aacagttaacttt

SEQ ID NO: 308800 - DNA, 17 bp, Homo sapiens
aacagttaactttcaga

SEQ ID NO: 308801 - DNA, 17 bp, Homo sapiens
aacagttaagacaacag

SEQ ID NO: 308802 - DNA, 21 bp, Homo sapiens
aacagttaagacaacaggcat

SEQ ID NO: 308803 - DNA, 23 bp, Homo sapiens
aacagtttgatgctgagtcatgc

SEQ ID NO: 308804 - DNA, 15 bp, Homo sapiens
aacagttttccatga

SEQ ID NO: 308805 - DNA, 17 bp, Homo sapiens
aacagttttccatgaaa

SEQ ID NO: 308806 - DNA, 16 bp, Homo sapiens
aacataaaacaaaacc

SEQ ID NO: 308807 - DNA, 21 bp, Homo sapiens
aacataaaacaaaaccaagcc

SEQ ID NO: 308808 - DNA, 17 bp, Homo sapiens
aacataaaagagtggaa

SEQ ID NO: 308809 - DNA, 21 bp, Homo sapiens
aacataaagaaatcatacttt

SEQ ID NO: 308810 - DNA, 22 bp, Homo sapiens
aacataatatcttgaagaatat

SEQ ID NO: 308811 - DNA, 16 bp, Homo sapiens
aacataatctagttta

SEQ ID NO: 308812 - DNA, 13 bp, Homo sapiens
aacatataaatta

SEQ ID NO: 308813 - DNA, 18 bp, Homo sapiens
aacatataatgttgttat

SEQ ID NO: 308814 - DNA, 22 bp, Homo sapiens
aacatataatgttgttatttaa

SEQ ID NO: 308815 - DNA, 13 bp, Homo sapiens
aacatatatttta

SEQ ID NO: 308816 - DNA, 19 bp, Homo sapiens
aacatatattttattttca

SEQ ID NO: 308817 - DNA, 19 bp, Homo sapiens
aacatatgtacataaattg

SEQ ID NO: 308818 - DNA, 21 bp, Homo sapiens
aacatattcttgctttcacaa

SEQ ID NO: 308819 - DNA, 16 bp, Homo sapiens
aacatcaaataaattt

SEQ ID NO: 308820 - DNA, 19 bp, Homo sapiens
aacatcaaataaatttctg

SEQ ID NO: 308821 - DNA, 20 bp, Homo sapiens
aacatcaaataaatttctgg

SEQ ID NO: 308822 - DNA, 12 bp, Homo sapiens
aacatcaatgtt

SEQ ID NO: 308823 - DNA, 20 bp, Homo sapiens
actctctcctctctctccct

SEQ ID NO: 308824 - DNA, 22 bp, Homo sapiens
actctctcctctctctccctcc

SEQ ID NO: 308825 - DNA, 23 bp, Homo sapiens
actctctcctctctctccctcca

SEQ ID NO: 308826 - DNA, 17 bp, Homo sapiens
actctctgccagctcca

SEQ ID NO: 308827 - DNA, 13 bp, Homo sapiens
actctctgctcta

SEQ ID NO: 308828 - DNA, 15 bp, Homo sapiens
actctctgctctagc

SEQ ID NO: 308829 - DNA, 16 bp, Homo sapiens
actctctgctctagcc

SEQ ID NO: 308830 - DNA, 18 bp, Homo sapiens
actctctgctctagccag

SEQ ID NO: 308831 - DNA, 17 bp, Homo sapiens
actctctgggactctcc

SEQ ID NO: 308832 - DNA, 20 bp, Homo sapiens
actctctgtcttctctccac

SEQ ID NO: 308833 - DNA, 16 bp, Homo sapiens
actctctttcttccac

SEQ ID NO: 308834 - DNA, 10 bp, Homo sapiens
actctgaaaa

SEQ ID NO: 308835 - DNA, 23 bp, Homo sapiens
actctgaagtcccttcctgtcct

SEQ ID NO: 308836 - DNA, 19 bp, Homo sapiens
actctgacgcaaaaccact

SEQ ID NO: 308837 - DNA, 12 bp, Homo sapiens
actctgagccca

SEQ ID NO: 308838 - DNA, 18 bp, Homo sapiens
actctgagtccactgctc

SEQ ID NO: 308839 - DNA, 16 bp, Homo sapiens
actctgagtttaccat

SEQ ID NO: 308840 - DNA, 16 bp, Homo sapiens
actctgcaactgaata

SEQ ID NO: 308841 - DNA, 19 bp, Homo sapiens
actctgcactactcctctg

SEQ ID NO: 308842 - DNA, 21 bp, Homo sapiens
actctgcactatagccatttg

SEQ ID NO: 308843 - DNA, 14 bp, Homo sapiens
actctgcactccat

SEQ ID NO: 308844 - DNA, 21 bp, Homo sapiens
actctgcactccatggccacc

SEQ ID NO: 308845 - DNA, 22 bp, Homo sapiens
actctgcactccatggccaccc

SEQ ID NO: 308846 - DNA, 17 bp, Homo sapiens
actctgcatagacaaag

SEQ ID NO: 308847 - DNA, 18 bp, Homo sapiens
actctgcatagacaaagg

SEQ ID NO: 308848 - DNA, 15 bp, Homo sapiens
actctgccccttctg

SEQ ID NO: 308849 - DNA, 12 bp, Homo sapiens
actctgcctcct

SEQ ID NO: 308850 - DNA, 18 bp, Homo sapiens
actctgccttccaggcgt

SEQ ID NO: 308851 - DNA, 9 bp, Homo sapiens
actctgctc

SEQ ID NO: 308852 - DNA, 18 bp, Homo sapiens
actctgctcccagcccct

SEQ ID NO: 308853 - DNA, 15 bp, Homo sapiens
actctggacctctct

SEQ ID NO: 308854 - DNA, 22 bp, Homo sapiens
actctggccttggttcctccag

SEQ ID NO: 308855 - DNA, 20 bp, Homo sapiens
actctgggcacttttgaact

SEQ ID NO: 308856 - DNA, 21 bp, Homo sapiens
actctgggcacttttgaactc

SEQ ID NO: 308857 - DNA, 18 bp, Homo sapiens
actctgtccaggccactg

SEQ ID NO: 308858 - DNA, 19 bp, Homo sapiens
actctgtccaggccactgt

SEQ ID NO: 308859 - DNA, 21 bp, Homo sapiens
actctgtccaggccactgtgg

SEQ ID NO: 308860 - DNA, 21 bp, Homo sapiens
actctgtgcaggtgctgcctt

SEQ ID NO: 308861 - DNA, 12 bp, Homo sapiens
actctgtgctca

SEQ ID NO: 308862 - DNA, 16 bp, Homo sapiens
actctgtggggccaca

SEQ ID NO: 308863 - DNA, 14 bp, Homo sapiens
actctgtgtcccag

SEQ ID NO: 308864 - DNA, 22 bp, Homo sapiens
actctgtgtgagcgtgtccaca

SEQ ID NO: 308865 - DNA, 22 bp, Homo sapiens
actctgttcccccaccctccat

SEQ ID NO: 308866 - DNA, 15 bp, Homo sapiens
actctgttcctggct

SEQ ID NO: 308867 - DNA, 15 bp, Homo sapiens
actctgttgcctcct

SEQ ID NO: 308868 - DNA, 23 bp, Homo sapiens
actctgttgcctcctctctccct

SEQ ID NO: 308869 - DNA, 12 bp, Homo sapiens
actcttaaagca

SEQ ID NO: 308870 - DNA, 14 bp, Homo sapiens
actcttaatcaaat

SEQ ID NO: 308871 - DNA, 14 bp, Homo sapiens
actcttcaaggcca

SEQ ID NO: 308872 - DNA, 15 bp, Homo sapiens
actcttcaaggccaa

SEQ ID NO: 308873 - DNA, 11 bp, Homo sapiens
actcttcctgc

SEQ ID NO: 308874 - DNA, 21 bp, Homo sapiens
actcttgagccctcctggaat

SEQ ID NO: 308875 - DNA, 10 bp, Homo sapiens
actcttgatg

SEQ ID NO: 308876 - DNA, 14 bp, Homo sapiens
actcttgatgtgaa

SEQ ID NO: 308877 - DNA, 19 bp, Homo sapiens
actcttgtattgctccatt

SEQ ID NO: 308878 - DNA, 16 bp, Homo sapiens
actcttgttgcccagg

SEQ ID NO: 308879 - DNA, 17 bp, Homo sapiens
actcttgttgcccaggc

SEQ ID NO: 308880 - DNA, 23 bp, Homo sapiens
actctttcccccaaatcttcctc

SEQ ID NO: 308881 - DNA, 19 bp, Homo sapiens
actctttctattgtttctt

SEQ ID NO: 308882 - DNA, 17 bp, Homo sapiens
aacctggtggctggagg

SEQ ID NO: 308883 - DNA, 11 bp, Homo sapiens
aacctgtaaat

SEQ ID NO: 308884 - DNA, 23 bp, Homo sapiens
aacctgtacttcaagttaaagtg

SEQ ID NO: 308885 - DNA, 17 bp, Homo sapiens
aacctgtgccaggctga

SEQ ID NO: 308886 - DNA, 13 bp, Homo sapiens
aaccttaaagcaa

SEQ ID NO: 308887 - DNA, 16 bp, Homo sapiens
aaccttattgtacctc

SEQ ID NO: 308888 - DNA, 17 bp, Homo sapiens
aaccttattgtacctct

SEQ ID NO: 308889 - DNA, 18 bp, Homo sapiens
aaccttattgtacctctc

SEQ ID NO: 308890 - DNA, 13 bp, Homo sapiens
aaccttctcagga

SEQ ID NO: 308891 - DNA, 15 bp, Homo sapiens
aaccttgtttgtttt

SEQ ID NO: 308892 - DNA, 14 bp, Homo sapiens
aacctttcccattt

SEQ ID NO: 308893 - DNA, 21 bp, Homo sapiens
aaccttttaaaaaaataatat

SEQ ID NO: 308894 - DNA, 23 bp, Homo sapiens
aaccttttgagtgccttacacaa

SEQ ID NO: 308895 - DNA, 13 bp, Homo sapiens
aacctttttgtaa

SEQ ID NO: 308896 - DNA, 19 bp, Homo sapiens
aacctttttttttgaaaca

SEQ ID NO: 308897 - DNA, 12 bp, Homo sapiens
aacgaaaagcac

SEQ ID NO: 308898 - DNA, 16 bp, Homo sapiens
aacgaagatccgagcg

SEQ ID NO: 308899 - DNA, 23 bp, Homo sapiens
aacgaaggggccccggggctggc

SEQ ID NO: 308900 - DNA, 20 bp, Homo sapiens
aacgagatttgccaaaaact

SEQ ID NO: 308901 - DNA, 18 bp, Homo sapiens
aacgagcactggccagag

SEQ ID NO: 308902 - DNA, 19 bp, Homo sapiens
aacgagcactggccagaga

SEQ ID NO: 308903 - DNA, 17 bp, Homo sapiens
aacgatgatgcttgtaa

SEQ ID NO: 308904 - DNA, 15 bp, Homo sapiens
aacgatttaatttat

SEQ ID NO: 308905 - DNA, 12 bp, Homo sapiens
aacgcaccccac

SEQ ID NO: 308906 - DNA, 17 bp, Homo sapiens
aacgccagtctcccagg

SEQ ID NO: 308907 - DNA, 15 bp, Homo sapiens
aacgctcagcgctgg

SEQ ID NO: 308908 - DNA, 17 bp, Homo sapiens
aacggaacgttggactt

SEQ ID NO: 308909 - DNA, 14 bp, Homo sapiens
aacggaactcttca

SEQ ID NO: 308910 - DNA, 19 bp, Homo sapiens
aacgggttactaagatgaa

SEQ ID NO: 308911 - DNA, 16 bp, Homo sapiens
aacgggttctcccatg

SEQ ID NO: 308912 - DNA, 13 bp, Homo sapiens
aacggttaaaact

SEQ ID NO: 308913 - DNA, 20 bp, Homo sapiens
aacgtaactctttctatgcc

SEQ ID NO: 308914 - DNA, 20 bp, Homo sapiens
aacgtccatctctctccctt

SEQ ID NO: 308915 - DNA, 15 bp, Homo sapiens
aacgtggacctgcct

SEQ ID NO: 308916 - DNA, 18 bp, Homo sapiens
aacgtgggagttcagctg

SEQ ID NO: 308917 - DNA, 17 bp, Homo sapiens
aacgtggggcagcacag

SEQ ID NO: 308918 - DNA, 22 bp, Homo sapiens
aacgtggggcagcacagagagg

SEQ ID NO: 308919 - DNA, 15 bp, Homo sapiens
aacgttaaaagacag

SEQ ID NO: 308920 - DNA, 13 bp, Homo sapiens
aacgttggacttt

SEQ ID NO: 308921 - DNA, 21 bp, Homo sapiens
aacgtttcagtaataaaacat

SEQ ID NO: 308922 - DNA, 13 bp, Homo sapiens
aacgttttattgt

SEQ ID NO: 308923 - DNA, 15 bp, Homo sapiens
aacgttttattgtgt

SEQ ID NO: 308924 - DNA, 13 bp, Homo sapiens
aactaaaatacaa

SEQ ID NO: 308925 - DNA, 17 bp, Homo sapiens
aactaaaattcaacaaa

SEQ ID NO: 308926 - DNA, 14 bp, Homo sapiens
aactaaggacagga

SEQ ID NO: 308927 - DNA, 21 bp, Homo sapiens
aactaagttttttacttccac

SEQ ID NO: 308928 - DNA, 20 bp, Homo sapiens
aactaatctattgggttcat

SEQ ID NO: 308929 - DNA, 20 bp, Homo sapiens
aactaattataatgcaaatt

SEQ ID NO: 308930 - DNA, 16 bp, Homo sapiens
aactaccagtgggcat

SEQ ID NO: 308931 - DNA, 21 bp, Homo sapiens
aactaccctacacctctgggc

SEQ ID NO: 308932 - DNA, 21 bp, Homo sapiens
aactactaagaataaataaag

SEQ ID NO: 308933 - DNA, 14 bp, Homo sapiens
aactactgattgaa

SEQ ID NO: 308934 - DNA, 17 bp, Homo sapiens
aactactgcaaaaagta

SEQ ID NO: 308935 - DNA, 19 bp, Homo sapiens
aactagatctcctgtaatt

SEQ ID NO: 308936 - DNA, 14 bp, Homo sapiens
aactagatggtgct

SEQ ID NO: 308937 - DNA, 17 bp, Homo sapiens
aactagatggtgctgag

SEQ ID NO: 308938 - DNA, 20 bp, Homo sapiens
aactagatggtgctgagaag

SEQ ID NO: 308939 - DNA, 17 bp, Homo sapiens
aactagattgactattt

SEQ ID NO: 308940 - DNA, 15 bp, Homo sapiens
aactaggcatttgta

SEQ ID NO: 308941 - DNA, 18 bp, Homo sapiens
aactaggcatttgtaaat

SEQ ID NO: 308942 - DNA, 20 bp, Homo sapiens
aactagtggtggctctgaga

SEQ ID NO: 308943 - DNA, 15 bp, Homo sapiens
aactatccaattaaa

SEQ ID NO: 308944 - DNA, 21 bp, Homo sapiens
aactatccaattaaaattaag

SEQ ID NO: 308945 - DNA, 18 bp, Homo sapiens
aactatcctgacttctaa

SEQ ID NO: 308946 - DNA, 17 bp, Homo sapiens
aactatcggttcaagtt

SEQ ID NO: 308947 - DNA, 16 bp, Homo sapiens
aactatggttcccaat

SEQ ID NO: 308948 - DNA, 22 bp, Homo sapiens
aactatggttcccaataaaagt

SEQ ID NO: 308949 - DNA, 18 bp, Homo sapiens
aactatttgtctttcagg

SEQ ID NO: 308950 - DNA, 14 bp, Homo sapiens
aactcacaaatgat

SEQ ID NO: 308951 - DNA, 13 bp, Homo sapiens
aactcaccatttc

SEQ ID NO: 308952 - DNA, 15 bp, Homo sapiens
aactcaccatttcat

SEQ ID NO: 308953 - DNA, 16 bp, Homo sapiens
aactcaccatttcatc

SEQ ID NO: 308954 - DNA, 14 bp, Homo sapiens
aactgtgacaggaa

SEQ ID NO: 308955 - DNA, 16 bp, Homo sapiens
aactgtgacaggaagc

SEQ ID NO: 308956 - DNA, 18 bp, Homo sapiens
aactgtgacattccacag

SEQ ID NO: 308957 - DNA, 13 bp, Homo sapiens
aactgtgagataa

SEQ ID NO: 308958 - DNA, 20 bp, Homo sapiens
aactgtgagataaatatcat

SEQ ID NO: 308959 - DNA, 13 bp, Homo sapiens
aactgtgctcaga

SEQ ID NO: 308960 - DNA, 13 bp, Homo sapiens
aactgtgtaactg

SEQ ID NO: 308961 - DNA, 15 bp, Homo sapiens
aactgtgtatgtaca

SEQ ID NO: 308962 - DNA, 17 bp, Homo sapiens
aactgtgtatgtacata

SEQ ID NO: 308963 - DNA, 14 bp, Homo sapiens
aactgtgtgaagaa

SEQ ID NO: 308964 - DNA, 15 bp, Homo sapiens
aactgtgtgaagaaa

SEQ ID NO: 308965 - DNA, 14 bp, Homo sapiens
aactgttagatgct

SEQ ID NO: 308966 - DNA, 16 bp, Homo sapiens
aactgttagatgctga

SEQ ID NO: 308967 - DNA, 22 bp, Homo sapiens
aactgttgtgggcgctgcttcc

SEQ ID NO: 308968 - DNA, 10 bp, Homo sapiens
aactgtttat

SEQ ID NO: 308969 - DNA, 19 bp, Homo sapiens
aactgtttatggtattttc

SEQ ID NO: 308970 - DNA, 13 bp, Homo sapiens
aactgttttcatg

SEQ ID NO: 308971 - DNA, 17 bp, Homo sapiens
aacttaaaaatgtaaat

SEQ ID NO: 308972 - DNA, 11 bp, Homo sapiens
aacttaaaaga

SEQ ID NO: 308973 - DNA, 15 bp, Homo sapiens
aacttaaaagattca

SEQ ID NO: 308974 - DNA, 15 bp, Homo sapiens
aacttaaatcactga

SEQ ID NO: 308975 - DNA, 13 bp, Homo sapiens
aacttaacatgct

SEQ ID NO: 308976 - DNA, 15 bp, Homo sapiens
aacttaacatgctgt

SEQ ID NO: 308977 - DNA, 13 bp, Homo sapiens
aacttaactttaa

SEQ ID NO: 308978 - DNA, 18 bp, Homo sapiens
aacttaagtttagaaatt

SEQ ID NO: 308979 - DNA, 12 bp, Homo sapiens
aacttacacaca

SEQ ID NO: 308980 - DNA, 18 bp, Homo sapiens
aacttacacttggagccc

SEQ ID NO: 308981 - DNA, 19 bp, Homo sapiens
aacttagaataaaattgta

SEQ ID NO: 308982 - DNA, 21 bp, Homo sapiens
aacttagaataaaattgtaaa

SEQ ID NO: 308983 - DNA, 22 bp, Homo sapiens
aacttagtgcggacaagtttta

SEQ ID NO: 308984 - DNA, 21 bp, Homo sapiens
aacttagtgtttagcattaaa

SEQ ID NO: 308985 - DNA, 18 bp, Homo sapiens
aacttagttttgttccaa

SEQ ID NO: 308986 - DNA, 13 bp, Homo sapiens
aacttcagagaag

SEQ ID NO: 308987 - DNA, 16 bp, Homo sapiens
aacttcagagaagtca

SEQ ID NO: 308988 - DNA, 18 bp, Homo sapiens
aacttcagcagtacctat

SEQ ID NO: 308989 - DNA, 12 bp, Homo sapiens
aacttcaggaaa

SEQ ID NO: 308990 - DNA, 13 bp, Homo sapiens
aacttcagtcctg

SEQ ID NO: 308991 - DNA, 16 bp, Homo sapiens
aacttcatctgtctgt

SEQ ID NO: 308992 - DNA, 20 bp, Homo sapiens
aacttcatgtcaacttctgg

SEQ ID NO: 308993 - DNA, 14 bp, Homo sapiens
aacttccaactttt

SEQ ID NO: 308994 - DNA, 13 bp, Homo sapiens
aacttccaattta

SEQ ID NO: 308995 - DNA, 17 bp, Homo sapiens
aacttccattctttctt

SEQ ID NO: 308996 - DNA, 16 bp, Homo sapiens
aacttcccaacttccc

SEQ ID NO: 308997 - DNA, 15 bp, Homo sapiens
aacttctaattgcca

SEQ ID NO: 308998 - DNA, 17 bp, Homo sapiens
aacttctaattgccatg

SEQ ID NO: 308999 - DNA, 20 bp, Homo sapiens
aacttctcgtagatgctgcc

SEQ ID NO: 309000 - DNA, 16 bp, Homo sapiens
aacttcttgttcaaaa

SEQ ID NO: 309001 - DNA, 13 bp, Homo sapiens
aacttgaattaca

SEQ ID NO: 309002 - DNA, 15 bp, Homo sapiens
aacttgagatgtatg

SEQ ID NO: 309003 - DNA, 19 bp, Homo sapiens
aacttgaggacacatgtcc

SEQ ID NO: 309004 - DNA, 20 bp, Homo sapiens
aacttgaggacacatgtcca

SEQ ID NO: 309005 - DNA, 22 bp, Homo sapiens
aacttgagggtaataaacttag

SEQ ID NO: 309006 - DNA, 14 bp, Homo sapiens
aacttgatttgcat

SEQ ID NO: 309007 - DNA, 12 bp, Homo sapiens
aacttgctgtga

SEQ ID NO: 309008 - DNA, 15 bp, Homo sapiens
aacttgctgtgaaat

SEQ ID NO: 309009 - DNA, 13 bp, Homo sapiens
aacttggggaaca

SEQ ID NO: 309010 - DNA, 19 bp, Homo sapiens
aacttggggaacaagggtg

SEQ ID NO: 309011 - DNA, 13 bp, Homo sapiens
aacttggggaggc

SEQ ID NO: 309012 - DNA, 17 bp, Homo sapiens
aacttggttctgcttca

SEQ ID NO: 309013 - DNA, 15 bp, Homo sapiens
aacttgtaaatacac

SEQ ID NO: 309014 - DNA, 22 bp, Homo sapiens
aacttgtcagaatttctttgtc

SEQ ID NO: 309015 - DNA, 20 bp, Homo sapiens
aacttgtctttttctggact

SEQ ID NO: 309016 - DNA, 18 bp, Homo sapiens
aactttaagtttcaggat

SEQ ID NO: 309017 - DNA, 17 bp, Homo sapiens
aactttatgtactgctg

SEQ ID NO: 309018 - DNA, 21 bp, Homo sapiens
aactttcacctcagattttct

SEQ ID NO: 309019 - DNA, 10 bp, Homo sapiens
aactttccat

SEQ ID NO: 309020 - DNA, 14 bp, Homo sapiens
aactttccatgaca

SEQ ID NO: 309021 - DNA, 17 bp, Homo sapiens
aactttccatgacagta

SEQ ID NO: 309022 - DNA, 19 bp, Homo sapiens
aactttccatgacagtagc

SEQ ID NO: 309023 - DNA, 14 bp, Homo sapiens
aactttctgctttg

SEQ ID NO: 309024 - DNA, 12 bp, Homo sapiens
aactttcttgct

SEQ ID NO: 309025 - DNA, 12 bp, Homo sapiens
aactttgatctc

SEQ ID NO: 309026 - DNA, 13 bp, Homo sapiens
aactttgcatgtt

SEQ ID NO: 309027 - DNA, 23 bp, Homo sapiens
actgcccccagaaagcctcctgc

SEQ ID NO: 309028 - DNA, 17 bp, Homo sapiens
actgccccgtgcagact

SEQ ID NO: 309029 - DNA, 23 bp, Homo sapiens
actgccccgtgcagactggaggg

SEQ ID NO: 309030 - DNA, 18 bp, Homo sapiens
actgcccgagctggtgca

SEQ ID NO: 309031 - DNA, 19 bp, Homo sapiens
actgcccgagctggtgcat

SEQ ID NO: 309032 - DNA, 20 bp, Homo sapiens
actgcccgagctggtgcatt

SEQ ID NO: 309033 - DNA, 21 bp, Homo sapiens
actgcccggggcagctgccag

SEQ ID NO: 309034 - DNA, 22 bp, Homo sapiens
actgcccggggcagctgccaga

SEQ ID NO: 309035 - DNA, 15 bp, Homo sapiens
actgccctctccaca

SEQ ID NO: 309036 - DNA, 24 bp, Homo sapiens
actgccctctccacacccatgact

SEQ ID NO: 309037 - DNA, 21 bp, Homo sapiens
actgccctctgttcagtaaca

SEQ ID NO: 309038 - DNA, 22 bp, Homo sapiens
actgccctctgttcagtaacag

SEQ ID NO: 309039 - DNA, 12 bp, Homo sapiens
actgccctgcct

SEQ ID NO: 309040 - DNA, 16 bp, Homo sapiens
actgccctgcctgccc

SEQ ID NO: 309041 - DNA, 19 bp, Homo sapiens
actgcccttttaaatggca

SEQ ID NO: 309042 - DNA, 22 bp, Homo sapiens
actgcccttttaaatggcatga

SEQ ID NO: 309043 - DNA, 22 bp, Homo sapiens
actgccgaccgaggctggagct

SEQ ID NO: 309044 - DNA, 22 bp, Homo sapiens
actgcctctgccttagaggagc

SEQ ID NO: 309045 - DNA, 14 bp, Homo sapiens
actgcctgaaagca

SEQ ID NO: 309046 - DNA, 13 bp, Homo sapiens
actgcctgcccac

SEQ ID NO: 309047 - DNA, 22 bp, Homo sapiens
actgcctgcccacccgtggaga

SEQ ID NO: 309048 - DNA, 23 bp, Homo sapiens
actgcctgcccacccgtggagat

SEQ ID NO: 309049 - DNA, 16 bp, Homo sapiens
actgccttaaaacttt

SEQ ID NO: 309050 - DNA, 21 bp, Homo sapiens
actgccttcagtatcaaggct

SEQ ID NO: 309051 - DNA, 16 bp, Homo sapiens
actgccttctcctctc

SEQ ID NO: 309052 - DNA, 14 bp, Homo sapiens
actgcgccacctgc

SEQ ID NO: 309053 - DNA, 19 bp, Homo sapiens
actgctaataaatgaccag

SEQ ID NO: 309054 - DNA, 10 bp, Homo sapiens
actgctacac

SEQ ID NO: 309055 - DNA, 17 bp, Homo sapiens
actgctacacttctgat

SEQ ID NO: 309056 - DNA, 17 bp, Homo sapiens
actgctaggtgggccag

SEQ ID NO: 309057 - DNA, 18 bp, Homo sapiens
actgctcaagaagacatg

SEQ ID NO: 309058 - DNA, 13 bp, Homo sapiens
actgctgagccac

SEQ ID NO: 309059 - DNA, 15 bp, Homo sapiens
actgctgatgctgaa

SEQ ID NO: 309060 - DNA, 18 bp, Homo sapiens
actgctgcccagcctcca

SEQ ID NO: 309061 - DNA, 10 bp, Homo sapiens
actgctgctc

SEQ ID NO: 309062 - DNA, 12 bp, Homo sapiens
actgctgctccc

SEQ ID NO: 309063 - DNA, 12 bp, Homo sapiens
actgctgctcct

SEQ ID NO: 309064 - DNA, 15 bp, Homo sapiens
actgctgctcctctt

SEQ ID NO: 309065 - DNA, 18 bp, Homo sapiens
actgctgctcctctttcc

SEQ ID NO: 309066 - DNA, 18 bp, Homo sapiens
actgctgtcattgtccat

SEQ ID NO: 309067 - DNA, 22 bp, Homo sapiens
actgctgtcattgtccatgcct

SEQ ID NO: 309068 - DNA, 13 bp, Homo sapiens
actgctgttcctg

SEQ ID NO: 309069 - DNA, 12 bp, Homo sapiens
actgctgtttta

SEQ ID NO: 309070 - DNA, 19 bp, Homo sapiens
actgctgttttatgtcata

SEQ ID NO: 309071 - DNA, 19 bp, Homo sapiens
actgcttcacggactcttt

SEQ ID NO: 309072 - DNA, 22 bp, Homo sapiens
actgcttcacggactctttgct

SEQ ID NO: 309073 - DNA, 19 bp, Homo sapiens
actgcttctaagatgccag

SEQ ID NO: 309074 - DNA, 21 bp, Homo sapiens
actgcttgaccgtactctcac

SEQ ID NO: 309075 - DNA, 14 bp, Homo sapiens
actgcttgcccagg

SEQ ID NO: 309076 - DNA, 20 bp, Homo sapiens
actgcttggatccatacaaa

SEQ ID NO: 309077 - DNA, 23 bp, Homo sapiens
actgctttcaacttaaatcactg

SEQ ID NO: 309078 - DNA, 12 bp, Homo sapiens
actgctttgtag

SEQ ID NO: 309079 - DNA, 20 bp, Homo sapiens
actgcttttaacttctgata

SEQ ID NO: 309080 - DNA, 18 bp, Homo sapiens
actgcttttgcaaacaga

SEQ ID NO: 309081 - DNA, 12 bp, Homo sapiens
actggaaaacat

SEQ ID NO: 309082 - DNA, 14 bp, Homo sapiens
actggaaaatagtc

SEQ ID NO: 309083 - DNA, 15 bp, Homo sapiens
actggaacctccctg

SEQ ID NO: 309084 - DNA, 21 bp, Homo sapiens
actggaacggtgaaggtgaca

SEQ ID NO: 309085 - DNA, 13 bp, Homo sapiens
actggaagttttg

SEQ ID NO: 309086 - DNA, 19 bp, Homo sapiens
actgtctgtagtgttttgt

SEQ ID NO: 309087 - DNA, 17 bp, Homo sapiens
actgtcttcaaccctgc

SEQ ID NO: 309088 - DNA, 18 bp, Homo sapiens
actgtcttcaaccctgcc

SEQ ID NO: 309089 - DNA, 18 bp, Homo sapiens
actgtctttattcttatt

SEQ ID NO: 309090 - DNA, 12 bp, Homo sapiens
actgtctttcag

SEQ ID NO: 309091 - DNA, 22 bp, Homo sapiens
actgtgaagtttacattgtaaa

SEQ ID NO: 309092 - DNA, 17 bp, Homo sapiens
actgtgacacagctgag

SEQ ID NO: 309093 - DNA, 20 bp, Homo sapiens
actgtgacacagctgagctg

SEQ ID NO: 309094 - DNA, 18 bp, Homo sapiens
actgtgacattccacaga

SEQ ID NO: 309095 - DNA, 19 bp, Homo sapiens
actgtgacattccacagag

SEQ ID NO: 309096 - DNA, 19 bp, Homo sapiens
actgtgagataaatatcat

SEQ ID NO: 309097 - DNA, 19 bp, Homo sapiens
actgtgaggcggcagctgg

SEQ ID NO: 309098 - DNA, 20 bp, Homo sapiens
actgtgaggcggcagctggg

SEQ ID NO: 309099 - DNA, 20 bp, Homo sapiens
actgtgatgccacacagagt

SEQ ID NO: 309100 - DNA, 16 bp, Homo sapiens
actgtgccatgtgttt

SEQ ID NO: 309101 - DNA, 11 bp, Homo sapiens
actgtgccttt

SEQ ID NO: 309102 - DNA, 17 bp, Homo sapiens
actgtgcgttttagagt

SEQ ID NO: 309103 - DNA, 21 bp, Homo sapiens
actgtgctctcccaaagccat

SEQ ID NO: 309104 - DNA, 9 bp, Homo sapiens
actgtgctg

SEQ ID NO: 309105 - DNA, 15 bp, Homo sapiens
actgtgcttgctcct

SEQ ID NO: 309106 - DNA, 15 bp, Homo sapiens
actgtggaacactaa

SEQ ID NO: 309107 - DNA, 19 bp, Homo sapiens
actgtggattggtgggttt

SEQ ID NO: 309108 - DNA, 17 bp, Homo sapiens
actgtggggcaagcctg

SEQ ID NO: 309109 - DNA, 17 bp, Homo sapiens
actgtgtaactgcccaa

SEQ ID NO: 309110 - DNA, 16 bp, Homo sapiens
actgtgtatgtacata

SEQ ID NO: 309111 - DNA, 22 bp, Homo sapiens
actgtgtcatggtgatgcaagt

SEQ ID NO: 309112 - DNA, 12 bp, Homo sapiens
actgtgtgaaga

SEQ ID NO: 309113 - DNA, 13 bp, Homo sapiens
actgtgtgaagaa

SEQ ID NO: 309114 - DNA, 19 bp, Homo sapiens
actgtgtgttgccacagga

SEQ ID NO: 309115 - DNA, 15 bp, Homo sapiens
actgtgttcctggca

SEQ ID NO: 309116 - DNA, 21 bp, Homo sapiens
actgtgtttaatagtatatct

SEQ ID NO: 309117 - DNA, 21 bp, Homo sapiens
actgttagctttttaaaacat

SEQ ID NO: 309118 - DNA, 17 bp, Homo sapiens
actgttattttcagcat

SEQ ID NO: 309119 - DNA, 15 bp, Homo sapiens
actgttcatttccac

SEQ ID NO: 309120 - DNA, 20 bp, Homo sapiens
actgttcccagcaaagtttt

SEQ ID NO: 309121 - DNA, 22 bp, Homo sapiens
actgttccctctgctcctggag

SEQ ID NO: 309122 - DNA, 15 bp, Homo sapiens
actgttgcatttact

SEQ ID NO: 309123 - DNA, 20 bp, Homo sapiens
actgttgcatttacttttaa

SEQ ID NO: 309124 - DNA, 17 bp, Homo sapiens
actgttgcctttgctct

SEQ ID NO: 309125 - DNA, 14 bp, Homo sapiens
actgtttaattgaa

SEQ ID NO: 309126 - DNA, 12 bp, Homo sapiens
actgtttctctg

SEQ ID NO: 309127 - DNA, 15 bp, Homo sapiens
actgtttctctgctg

SEQ ID NO: 309128 - DNA, 22 bp, Homo sapiens
actgtttggacttttattttgg

SEQ ID NO: 309129 - DNA, 21 bp, Homo sapiens
actgttttgtgcggtgtgtct

SEQ ID NO: 309130 - DNA, 19 bp, Homo sapiens
actgtttttgaaaaattac

SEQ ID NO: 309131 - DNA, 17 bp, Homo sapiens
acttaaaaatgtaaata

SEQ ID NO: 309132 - DNA, 18 bp, Homo sapiens
acttaaaaatgtaaatat

SEQ ID NO: 309133 - DNA, 23 bp, Homo sapiens
acttaaaaatgtaaatattctat

SEQ ID NO: 309134 - DNA, 17 bp, Homo sapiens
acttaaaagattcacta

SEQ ID NO: 309135 - DNA, 13 bp, Homo sapiens
acttaaaatcaaa

SEQ ID NO: 309136 - DNA, 21 bp, Homo sapiens
acttaaaatcaaatttttctg

SEQ ID NO: 309137 - DNA, 16 bp, Homo sapiens
acttaaacaaaaactt

SEQ ID NO: 309138 - DNA, 20 bp, Homo sapiens
acttaaacaaaaactttcca

SEQ ID NO: 309139 - DNA, 13 bp, Homo sapiens
acttaaacagctt

SEQ ID NO: 309140 - DNA, 13 bp, Homo sapiens
acttaaacatcat

SEQ ID NO: 309141 - DNA, 16 bp, Homo sapiens
acttaaactttgtcac

SEQ ID NO: 309142 - DNA, 14 bp, Homo sapiens
acttaaatcactga

SEQ ID NO: 309143 - DNA, 14 bp, Homo sapiens
acttaaatgttacc

SEQ ID NO: 309144 - DNA, 18 bp, Homo sapiens
acttaaccgcatcagaag

SEQ ID NO: 309145 - DNA, 19 bp, Homo sapiens
acttaacggctccaggatt

SEQ ID NO: 309146 - DNA, 19 bp, Homo sapiens
acttaactgtgtgaagaaa

SEQ ID NO: 309147 - DNA, 22 bp, Homo sapiens
acttaactgtgtgaagaaatgg

SEQ ID NO: 309148 - DNA, 13 bp, Homo sapiens
acttaagcacact

SEQ ID NO: 309149 - DNA, 18 bp, Homo sapiens
acttaagtttagaaatta

SEQ ID NO: 309150 - DNA, 19 bp, Homo sapiens
acttaataaatctgccatt

SEQ ID NO: 309151 - DNA, 17 bp, Homo sapiens
acttaatactgaatttc

SEQ ID NO: 309152 - DNA, 18 bp, Homo sapiens
acttaatactgaatttct

SEQ ID NO: 309153 - DNA, 23 bp, Homo sapiens
acttaatatgtgggaaacccttt

SEQ ID NO: 309154 - DNA, 18 bp, Homo sapiens
acttaatcctttaactct

SEQ ID NO: 309155 - DNA, 14 bp, Homo sapiens
acttaatcttctct

SEQ ID NO: 309156 - DNA, 16 bp, Homo sapiens
acttaatcttctctct

SEQ ID NO: 309157 - DNA, 13 bp, Homo sapiens
acttaattctgtt

SEQ ID NO: 309158 - DNA, 15 bp, Homo sapiens
acttacaagtaatga

SEQ ID NO: 309159 - DNA, 16 bp, Homo sapiens
acttacaagtaatgaa

SEQ ID NO: 309160 - DNA, 15 bp, Homo sapiens
acttacacttggagc

SEQ ID NO: 309161 - DNA, 19 bp, Homo sapiens
acttacctaaacagatata

SEQ ID NO: 309162 - DNA, 14 bp, Homo sapiens
acttacttagagat

SEQ ID NO: 309163 - DNA, 15 bp, Homo sapiens
acttagaataaaatt

SEQ ID NO: 309164 - DNA, 16 bp, Homo sapiens
acttagcatgcacaaa

SEQ ID NO: 309165 - DNA, 21 bp, Homo sapiens
acttagccgtccatggcacca

SEQ ID NO: 309166 - DNA, 14 bp, Homo sapiens
acttaggctacaga

SEQ ID NO: 309167 - DNA, 15 bp, Homo sapiens
acttagtattttacc

SEQ ID NO: 309168 - DNA, 12 bp, Homo sapiens
acttagtccact

SEQ ID NO: 309169 - DNA, 18 bp, Homo sapiens
acttagtccactctgagt

SEQ ID NO: 309170 - DNA, 16 bp, Homo sapiens
acttagtggtatgtct

SEQ ID NO: 309171 - DNA, 23 bp, Homo sapiens
aactttgtttccagaaattcttc

SEQ ID NO: 309172 - DNA, 22 bp, Homo sapiens
aacttttagtgggtgagaaatt

SEQ ID NO: 309173 - DNA, 18 bp, Homo sapiens
aacttttctattaaaagt

SEQ ID NO: 309174 - DNA, 20 bp, Homo sapiens
aagaaaaaaataattttatg

SEQ ID NO: 309175 - DNA, 16 bp, Homo sapiens
aagaaaaacatgtcat

SEQ ID NO: 309176 - DNA, 14 bp, Homo sapiens
aagaaaaaggaaat

SEQ ID NO: 309177 - DNA, 18 bp, Homo sapiens
aagaaaacacacaaaaga

SEQ ID NO: 309178 - DNA, 23 bp, Homo sapiens
aagaaaacacacaaaagattatg

SEQ ID NO: 309179 - DNA, 14 bp, Homo sapiens
aagaaaacatatat

SEQ ID NO: 309180 - DNA, 16 bp, Homo sapiens
aagaaaagcactggga

SEQ ID NO: 309181 - DNA, 14 bp, Homo sapiens
aagaaaagccaagc

SEQ ID NO: 309182 - DNA, 22 bp, Homo sapiens
aagaaaaggttcttactgcttg

SEQ ID NO: 309183 - DNA, 16 bp, Homo sapiens
aagaaaagtgggccag

SEQ ID NO: 309184 - DNA, 12 bp, Homo sapiens
aagaaaataacc

SEQ ID NO: 309185 - DNA, 16 bp, Homo sapiens
aagaaaatacaataaa

SEQ ID NO: 309186 - DNA, 18 bp, Homo sapiens
aagaaaatacaataaact

SEQ ID NO: 309187 - DNA, 16 bp, Homo sapiens
aagaaaataccaagga

SEQ ID NO: 309188 - DNA, 12 bp, Homo sapiens
aagaaaatgaag

SEQ ID NO: 309189 - DNA, 14 bp, Homo sapiens
aagaaaatggatga

SEQ ID NO: 309190 - DNA, 14 bp, Homo sapiens
aagaaaattctcaa

SEQ ID NO: 309191 - DNA, 13 bp, Homo sapiens
aagaaacaaaccc

SEQ ID NO: 309192 - DNA, 12 bp, Homo sapiens
aagaaacacttt

SEQ ID NO: 309193 - DNA, 20 bp, Homo sapiens
aagaaaccatgcaaagcaac

SEQ ID NO: 309194 - DNA, 17 bp, Homo sapiens
aagaaaccttttaaaaa

SEQ ID NO: 309195 - DNA, 15 bp, Homo sapiens
aagaaactgatttta

SEQ ID NO: 309196 - DNA, 21 bp, Homo sapiens
aagaaagcaaaaaataaaata

SEQ ID NO: 309197 - DNA, 23 bp, Homo sapiens
aagaaagcaaaaaataaaataag

SEQ ID NO: 309198 - DNA, 18 bp, Homo sapiens
aagaaagcacctgttttt

SEQ ID NO: 309199 - DNA, 13 bp, Homo sapiens
aagaaaggcagag

SEQ ID NO: 309200 - DNA, 19 bp, Homo sapiens
aagaaagggaaaagggaga

SEQ ID NO: 309201 - DNA, 15 bp, Homo sapiens
aagaaagtaaaaaga

SEQ ID NO: 309202 - DNA, 16 bp, Homo sapiens
aagaaagtaaaaagaa

SEQ ID NO: 309203 - DNA, 12 bp, Homo sapiens
aagaaagtcaga

SEQ ID NO: 309204 - DNA, 16 bp, Homo sapiens
aagaaagtctatgctt

SEQ ID NO: 309205 - DNA, 15 bp, Homo sapiens
aagaaatcaattttt

SEQ ID NO: 309206 - DNA, 21 bp, Homo sapiens
aagaaatcgccttatgagaac

SEQ ID NO: 309207 - DNA, 23 bp, Homo sapiens
aagaaattatttaatatgcatct

SEQ ID NO: 309208 - DNA, 20 bp, Homo sapiens
aagaaattcattaaagaaaa

SEQ ID NO: 309209 - DNA, 16 bp, Homo sapiens
aagaaatttgatttct

SEQ ID NO: 309210 - DNA, 12 bp, Homo sapiens
aagaacaacact

SEQ ID NO: 309211 - DNA, 15 bp, Homo sapiens
aagaacacagcatgt

SEQ ID NO: 309212 - DNA, 16 bp, Homo sapiens
aagaacacagcatgtg

SEQ ID NO: 309213 - DNA, 18 bp, Homo sapiens
aagaacagaattgctcct

SEQ ID NO: 309214 - DNA, 12 bp, Homo sapiens
aagaacagtaca

SEQ ID NO: 309215 - DNA, 23 bp, Homo sapiens
aagaacccatttgccatgctgct

SEQ ID NO: 309216 - DNA, 18 bp, Homo sapiens
aagaacccccctccccaa

SEQ ID NO: 309217 - DNA, 23 bp, Homo sapiens
acttcagtgcacctgtggcctct

SEQ ID NO: 309218 - DNA, 13 bp, Homo sapiens
acttcataaaact

SEQ ID NO: 309219 - DNA, 20 bp, Homo sapiens
acttcataagatattcttta

SEQ ID NO: 309220 - DNA, 24 bp, Homo sapiens
acttcataagatattctttacaaa

SEQ ID NO: 309221 - DNA, 12 bp, Homo sapiens
acttcatatcta

SEQ ID NO: 309222 - DNA, 19 bp, Homo sapiens
acttcatatctagatttct

SEQ ID NO: 309223 - DNA, 19 bp, Homo sapiens
acttcatgacaagcatttt

SEQ ID NO: 309224 - DNA, 14 bp, Homo sapiens
acttcatgtcaact

SEQ ID NO: 309225 - DNA, 13 bp, Homo sapiens
acttcattctaaa

SEQ ID NO: 309226 - DNA, 20 bp, Homo sapiens
acttcattctaaaccaaaac

SEQ ID NO: 309227 - DNA, 20 bp, Homo sapiens
acttccaaacctgacagatg

SEQ ID NO: 309228 - DNA, 19 bp, Homo sapiens
acttccaggttccatccac

SEQ ID NO: 309229 - DNA, 17 bp, Homo sapiens
acttccataatctggac

SEQ ID NO: 309230 - DNA, 12 bp, Homo sapiens
acttcccagctg

SEQ ID NO: 309231 - DNA, 13 bp, Homo sapiens
acttcccagctgg

SEQ ID NO: 309232 - DNA, 14 bp, Homo sapiens
acttcccagctggc

SEQ ID NO: 309233 - DNA, 20 bp, Homo sapiens
acttcccagctggcagcgcc

SEQ ID NO: 309234 - DNA, 23 bp, Homo sapiens
acttcccagctggcagcgcctcc

SEQ ID NO: 309235 - DNA, 17 bp, Homo sapiens
acttcccagtgaattct

SEQ ID NO: 309236 - DNA, 13 bp, Homo sapiens
acttccctcaggc

SEQ ID NO: 309237 - DNA, 13 bp, Homo sapiens
acttccctgttct

SEQ ID NO: 309238 - DNA, 17 bp, Homo sapiens
acttcctagagcatctg

SEQ ID NO: 309239 - DNA, 16 bp, Homo sapiens
acttcctcctcctcct

SEQ ID NO: 309240 - DNA, 23 bp, Homo sapiens
acttcctggattttctttctatg

SEQ ID NO: 309241 - DNA, 13 bp, Homo sapiens
acttcctggggcc

SEQ ID NO: 309242 - DNA, 13 bp, Homo sapiens
acttcctgtccag

SEQ ID NO: 309243 - DNA, 14 bp, Homo sapiens
acttcctgtccaga

SEQ ID NO: 309244 - DNA, 15 bp, Homo sapiens
acttcctgtgacttc

SEQ ID NO: 309245 - DNA, 16 bp, Homo sapiens
acttccttcacatctc

SEQ ID NO: 309246 - DNA, 18 bp, Homo sapiens
acttccttcacatctccc

SEQ ID NO: 309247 - DNA, 19 bp, Homo sapiens
acttccttgctctccctct

SEQ ID NO: 309248 - DNA, 18 bp, Homo sapiens
acttcgaaaacagatgag

SEQ ID NO: 309249 - DNA, 15 bp, Homo sapiens
acttcgactcaggat

SEQ ID NO: 309250 - DNA, 14 bp, Homo sapiens
acttcgactgtgac

SEQ ID NO: 309251 - DNA, 16 bp, Homo sapiens
acttcgctattcccag

SEQ ID NO: 309252 - DNA, 15 bp, Homo sapiens
acttcgtcttctaat

SEQ ID NO: 309253 - DNA, 17 bp, Homo sapiens
acttcgtggatgacctc

SEQ ID NO: 309254 - DNA, 17 bp, Homo sapiens
acttctaaatgcatatc

SEQ ID NO: 309255 - DNA, 22 bp, Homo sapiens
acttctaatatatttttatatt

SEQ ID NO: 309256 - DNA, 16 bp, Homo sapiens
acttctaatatcattc

SEQ ID NO: 309257 - DNA, 15 bp, Homo sapiens
acttctagttgctct

SEQ ID NO: 309258 - DNA, 16 bp, Homo sapiens
acttctagttgctctt

SEQ ID NO: 309259 - DNA, 13 bp, Homo sapiens
acttctatcctgt

SEQ ID NO: 309260 - DNA, 15 bp, Homo sapiens
acttctcaaatgcta

SEQ ID NO: 309261 - DNA, 16 bp, Homo sapiens
acttctctctaaggag

SEQ ID NO: 309262 - DNA, 22 bp, Homo sapiens
acttctctctaaggagaatggc

SEQ ID NO: 309263 - DNA, 20 bp, Homo sapiens
acttctctggaaagggggga

SEQ ID NO: 309264 - DNA, 22 bp, Homo sapiens
acttctcttattctttacaaaa

SEQ ID NO: 309265 - DNA, 11 bp, Homo sapiens
acttctcttct

SEQ ID NO: 309266 - DNA, 19 bp, Homo sapiens
acttctcttctgagcctct

SEQ ID NO: 309267 - DNA, 16 bp, Homo sapiens
acttctgaccacactt

SEQ ID NO: 309268 - DNA, 13 bp, Homo sapiens
acttctgcctctt

SEQ ID NO: 309269 - DNA, 24 bp, Homo sapiens
acttctgctaggtagaggcatttg

SEQ ID NO: 309270 - DNA, 16 bp, Homo sapiens
acttctggaaggctgg

SEQ ID NO: 309271 - DNA, 13 bp, Homo sapiens
acttctggctcct

SEQ ID NO: 309272 - DNA, 14 bp, Homo sapiens
acttctggtcccct

SEQ ID NO: 309273 - DNA, 15 bp, Homo sapiens
acttctggtcccctg

SEQ ID NO: 309274 - DNA, 19 bp, Homo sapiens
acttctgtgagacccccac

SEQ ID NO: 309275 - DNA, 20 bp, Homo sapiens
acttctgtgagacccccaca

SEQ ID NO: 309276 - DNA, 20 bp, Homo sapiens
acttcttaaaggcctggaac

SEQ ID NO: 309277 - DNA, 12 bp, Homo sapiens
acttcttcatcc

SEQ ID NO: 309278 - DNA, 18 bp, Homo sapiens
acttcttcatccatagac

SEQ ID NO: 309279 - DNA, 17 bp, Homo sapiens
acttcttgaaacagcct

SEQ ID NO: 309280 - DNA, 14 bp, Homo sapiens
acttcttgttcatg

SEQ ID NO: 309281 - DNA, 17 bp, Homo sapiens
acttctttgcaacaata

SEQ ID NO: 309282 - DNA, 18 bp, Homo sapiens
acttcttttccaaaaata

SEQ ID NO: 309283 - DNA, 21 bp, Homo sapiens
acttcttttccaaaaatactt

SEQ ID NO: 309284 - DNA, 21 bp, Homo sapiens
acttgaaagttttccagtatt

SEQ ID NO: 309285 - DNA, 18 bp, Homo sapiens
acttgaaatctaggatta

SEQ ID NO: 309286 - DNA, 19 bp, Homo sapiens
acttgaatggttaataaaa

SEQ ID NO: 309287 - DNA, 11 bp, Homo sapiens
acttgaatgta

SEQ ID NO: 309288 - DNA, 14 bp, Homo sapiens
acttgacattcctt

SEQ ID NO: 309289 - DNA, 17 bp, Homo sapiens
acttgagaacttgacaa

SEQ ID NO: 309290 - DNA, 23 bp, Homo sapiens
acttgagaacttgacaagttgcg

SEQ ID NO: 309291 - DNA, 12 bp, Homo sapiens
acttgagaggat

SEQ ID NO: 309292 - DNA, 22 bp, Homo sapiens
acttgagatgtatgaaggcttt

SEQ ID NO: 309293 - DNA, 19 bp, Homo sapiens
acttgagcccagagtgaac

SEQ ID NO: 309294 - DNA, 11 bp, Homo sapiens
acttgaggaca

SEQ ID NO: 309295 - DNA, 13 bp, Homo sapiens
acttgaggacaca

SEQ ID NO: 309296 - DNA, 14 bp, Homo sapiens
acttgaggacacat

SEQ ID NO: 309297 - DNA, 15 bp, Homo sapiens
acttgaggacacatg

SEQ ID NO: 309298 - DNA, 18 bp, Homo sapiens
acttgaggattttgagta

SEQ ID NO: 309299 - DNA, 16 bp, Homo sapiens
acttgagggaccaata

SEQ ID NO: 309300 - DNA, 20 bp, Homo sapiens
acttgagggaccaatattac

SEQ ID NO: 309301 - DNA, 15 bp, Homo sapiens
acttgatatttcctt

SEQ ID NO: 309302 - DNA, 15 bp, Homo sapiens
acttgatgaataaac

SEQ ID NO: 309303 - DNA, 16 bp, Homo sapiens
acttgatgaataaaca

SEQ ID NO: 309304 - DNA, 19 bp, Homo sapiens
acttgatgaataaacactt

SEQ ID NO: 309305 - DNA, 14 bp, Homo sapiens
acttgatgcactta

SEQ ID NO: 309306 - DNA, 22 bp, Homo sapiens
acttgatgcacttattttttaa

SEQ ID NO: 309307 - DNA, 23 bp, Homo sapiens
acttgatgcacttattttttaat

SEQ ID NO: 309308 - DNA, 14 bp, Homo sapiens
acttgcactgtgct

SEQ ID NO: 309309 - DNA, 11 bp, Homo sapiens
acttgcatttc

SEQ ID NO: 309310 - DNA, 12 bp, Homo sapiens
aagagaataaag

SEQ ID NO: 309311 - DNA, 19 bp, Homo sapiens
aagagaatgccattctctt

SEQ ID NO: 309312 - DNA, 21 bp, Homo sapiens
aagagaattacttatattcat

SEQ ID NO: 309313 - DNA, 11 bp, Homo sapiens
aagagaattca

SEQ ID NO: 309314 - DNA, 21 bp, Homo sapiens
aagagaattctaagattgtac

SEQ ID NO: 309315 - DNA, 14 bp, Homo sapiens
aagagacagggaga

SEQ ID NO: 309316 - DNA, 14 bp, Homo sapiens
aagagagaaagaaa

SEQ ID NO: 309317 - DNA, 12 bp, Homo sapiens
aagagagcctgc

SEQ ID NO: 309318 - DNA, 22 bp, Homo sapiens
aagagagccttggttcatcagt

SEQ ID NO: 309319 - DNA, 16 bp, Homo sapiens
aagagaggagttcaat

SEQ ID NO: 309320 - DNA, 19 bp, Homo sapiens
aagagaggagttcaatgat

SEQ ID NO: 309321 - DNA, 21 bp, Homo sapiens
aagagaggagttcaatgatct

SEQ ID NO: 309322 - DNA, 22 bp, Homo sapiens
aagagaggagttcaatgatcta

SEQ ID NO: 309323 - DNA, 18 bp, Homo sapiens
aagagaggcacctgctgg

SEQ ID NO: 309324 - DNA, 21 bp, Homo sapiens
aagagatgtggcaaagtgctg

SEQ ID NO: 309325 - DNA, 10 bp, Homo sapiens
aagagcacaa

SEQ ID NO: 309326 - DNA, 22 bp, Homo sapiens
aagagcactgggctaatttgta

SEQ ID NO: 309327 - DNA, 11 bp, Homo sapiens
aagagcagcct

SEQ ID NO: 309328 - DNA, 12 bp, Homo sapiens
aagagcagcctg

SEQ ID NO: 309329 - DNA, 20 bp, Homo sapiens
aagagcagcctgatggccaa

SEQ ID NO: 309330 - DNA, 23 bp, Homo sapiens
aagagcagcctgatggccaaggg

SEQ ID NO: 309331 - DNA, 16 bp, Homo sapiens
aagagcagcctgtggc

SEQ ID NO: 309332 - DNA, 18 bp, Homo sapiens
aagagcagcctgtggcat

SEQ ID NO: 309333 - DNA, 19 bp, Homo sapiens
aagagcagcctgtggcatc

SEQ ID NO: 309334 - DNA, 22 bp, Homo sapiens
aagagccctggacacccctgct

SEQ ID NO: 309335 - DNA, 23 bp, Homo sapiens
aagagccctggacacccctgctc

SEQ ID NO: 309336 - DNA, 18 bp, Homo sapiens
aagagcgctcctctgcct

SEQ ID NO: 309337 - DNA, 14 bp, Homo sapiens
aagagctcaggaga

SEQ ID NO: 309338 - DNA, 20 bp, Homo sapiens
aagagctctttgtctcacca

SEQ ID NO: 309339 - DNA, 18 bp, Homo sapiens
aagagctgttttggatga

SEQ ID NO: 309340 - DNA, 14 bp, Homo sapiens
aagaggaagagaga

SEQ ID NO: 309341 - DNA, 13 bp, Homo sapiens
aagaggaagcctt

SEQ ID NO: 309342 - DNA, 14 bp, Homo sapiens
aagaggagaccctg

SEQ ID NO: 309343 - DNA, 18 bp, Homo sapiens
aagaggagcacttccaaa

SEQ ID NO: 309344 - DNA, 21 bp, Homo sapiens
aagaggagcacttccaaaatt

SEQ ID NO: 309345 - DNA, 14 bp, Homo sapiens
aagaggagcaggaa

SEQ ID NO: 309346 - DNA, 16 bp, Homo sapiens
aagaggatcggaggct

SEQ ID NO: 309347 - DNA, 23 bp, Homo sapiens
aagaggccacttagggaaagatg

SEQ ID NO: 309348 - DNA, 16 bp, Homo sapiens
acttgtggttttcaaa

SEQ ID NO: 309349 - DNA, 21 bp, Homo sapiens
acttgtgtactgataaaatac

SEQ ID NO: 309350 - DNA, 17 bp, Homo sapiens
acttgtgtattagatat

SEQ ID NO: 309351 - DNA, 20 bp, Homo sapiens
acttgtgtgtgggctgtgag

SEQ ID NO: 309352 - DNA, 15 bp, Homo sapiens
acttgtgttcaatct

SEQ ID NO: 309353 - DNA, 16 bp, Homo sapiens
acttgtgttcaatctg

SEQ ID NO: 309354 - DNA, 21 bp, Homo sapiens
acttgtgttcaatctgtgaag

SEQ ID NO: 309355 - DNA, 21 bp, Homo sapiens
acttgtgtttgcttaaacaaa

SEQ ID NO: 309356 - DNA, 20 bp, Homo sapiens
acttgtgtttgtatataaat

SEQ ID NO: 309357 - DNA, 17 bp, Homo sapiens
acttgttcttttctggt

SEQ ID NO: 309358 - DNA, 23 bp, Homo sapiens
acttgtttaattctaaaagagaa

SEQ ID NO: 309359 - DNA, 23 bp, Homo sapiens
acttgtttcctgtgcccatcatc

SEQ ID NO: 309360 - DNA, 22 bp, Homo sapiens
acttgtttctttctgtctctct

SEQ ID NO: 309361 - DNA, 16 bp, Homo sapiens
acttgtttgtaagatt

SEQ ID NO: 309362 - DNA, 18 bp, Homo sapiens
actttaaatcctaccaaa

SEQ ID NO: 309363 - DNA, 13 bp, Homo sapiens
actttaaattata

SEQ ID NO: 309364 - DNA, 15 bp, Homo sapiens
actttaaattatatg

SEQ ID NO: 309365 - DNA, 15 bp, Homo sapiens
actttaagcactaca

SEQ ID NO: 309366 - DNA, 15 bp, Homo sapiens
actttaataataaaa

SEQ ID NO: 309367 - DNA, 22 bp, Homo sapiens
actttaataataaaaatcatgc

SEQ ID NO: 309368 - DNA, 17 bp, Homo sapiens
actttacccaaaaacta

SEQ ID NO: 309369 - DNA, 14 bp, Homo sapiens
actttagaaataaa

SEQ ID NO: 309370 - DNA, 21 bp, Homo sapiens
actttagaagtgcatttctga

SEQ ID NO: 309371 - DNA, 23 bp, Homo sapiens
actttagggctaaccagttctct

SEQ ID NO: 309372 - DNA, 22 bp, Homo sapiens
actttagggtaaaaattgccat

SEQ ID NO: 309373 - DNA, 16 bp, Homo sapiens
actttagtgattgctt

SEQ ID NO: 309374 - DNA, 17 bp, Homo sapiens
actttagtgtattttct

SEQ ID NO: 309375 - DNA, 19 bp, Homo sapiens
actttagtgtattttctgt

SEQ ID NO: 309376 - DNA, 18 bp, Homo sapiens
actttatattttctatat

SEQ ID NO: 309377 - DNA, 14 bp, Homo sapiens
actttatcaattaa

SEQ ID NO: 309378 - DNA, 21 bp, Homo sapiens
actttatcacattatttgcat

SEQ ID NO: 309379 - DNA, 22 bp, Homo sapiens
actttatgaaaaaaatatattt

SEQ ID NO: 309380 - DNA, 19 bp, Homo sapiens
actttatgcagcttccttt

SEQ ID NO: 309381 - DNA, 14 bp, Homo sapiens
actttattaatatg

SEQ ID NO: 309382 - DNA, 14 bp, Homo sapiens
actttattcttgct

SEQ ID NO: 309383 - DNA, 15 bp, Homo sapiens
actttattcttgctg

SEQ ID NO: 309384 - DNA, 16 bp, Homo sapiens
actttatttaatttca

SEQ ID NO: 309385 - DNA, 17 bp, Homo sapiens
actttatttaatttcat

SEQ ID NO: 309386 - DNA, 21 bp, Homo sapiens
actttattttatataataaag

SEQ ID NO: 309387 - DNA, 23 bp, Homo sapiens
actttattttatataataaagta

SEQ ID NO: 309388 - DNA, 13 bp, Homo sapiens
actttattttctg

SEQ ID NO: 309389 - DNA, 18 bp, Homo sapiens
actttcaaaattaaatct

SEQ ID NO: 309390 - DNA, 20 bp, Homo sapiens
actttcacatagatgtccct

SEQ ID NO: 309391 - DNA, 16 bp, Homo sapiens
actttccaccccctcc

SEQ ID NO: 309392 - DNA, 20 bp, Homo sapiens
actttccaccccctccctgg

SEQ ID NO: 309393 - DNA, 14 bp, Homo sapiens
actttccatgacag

SEQ ID NO: 309394 - DNA, 21 bp, Homo sapiens
actttccatgacagtagcata

SEQ ID NO: 309395 - DNA, 22 bp, Homo sapiens
actttccatgacagtagcatac

SEQ ID NO: 309396 - DNA, 22 bp, Homo sapiens
actttccccatactctgtctcc

SEQ ID NO: 309397 - DNA, 21 bp, Homo sapiens
actttccctagaaagccatat

SEQ ID NO: 309398 - DNA, 20 bp, Homo sapiens
actttcctggataaaaaaga

SEQ ID NO: 309399 - DNA, 23 bp, Homo sapiens
actttccttagacccgccaggtc

SEQ ID NO: 309400 - DNA, 21 bp, Homo sapiens
actttccttttctattccttc

SEQ ID NO: 309401 - DNA, 22 bp, Homo sapiens
actttctccccatccccttcct

SEQ ID NO: 309402 - DNA, 14 bp, Homo sapiens
actttctgaaataa

SEQ ID NO: 309403 - DNA, 20 bp, Homo sapiens
actttctgaaataacatggc

SEQ ID NO: 309404 - DNA, 19 bp, Homo sapiens
actttctgaaattcacaaa

SEQ ID NO: 309405 - DNA, 14 bp, Homo sapiens
actttctgactgca

SEQ ID NO: 309406 - DNA, 13 bp, Homo sapiens
actttctgctttg

SEQ ID NO: 309407 - DNA, 19 bp, Homo sapiens
actttctgtaaactcaaaa

SEQ ID NO: 309408 - DNA, 14 bp, Homo sapiens
actttcttctgaat

SEQ ID NO: 309409 - DNA, 18 bp, Homo sapiens
actttctttcagatgttt

SEQ ID NO: 309410 - DNA, 21 bp, Homo sapiens
actttcttttcgccgtggctg

SEQ ID NO: 309411 - DNA, 15 bp, Homo sapiens
actttcttttctgga

SEQ ID NO: 309412 - DNA, 19 bp, Homo sapiens
actttcttttctggaatgt

SEQ ID NO: 309413 - DNA, 20 bp, Homo sapiens
actttgagcatttttaaggg

SEQ ID NO: 309414 - DNA, 14 bp, Homo sapiens
actttgaggaggaa

SEQ ID NO: 309415 - DNA, 20 bp, Homo sapiens
actttgaggaggaagcagaa

SEQ ID NO: 309416 - DNA, 15 bp, Homo sapiens
actttgatgtgtttt

SEQ ID NO: 309417 - DNA, 20 bp, Homo sapiens
actttgatgtgtttttgtat

SEQ ID NO: 309418 - DNA, 17 bp, Homo sapiens
actttgcagacctggga

SEQ ID NO: 309419 - DNA, 18 bp, Homo sapiens
actttgcagacctgggac

SEQ ID NO: 309420 - DNA, 23 bp, Homo sapiens
actttgcagccggcacagggtct

SEQ ID NO: 309421 - DNA, 15 bp, Homo sapiens
actttgcatgttctt

SEQ ID NO: 309422 - DNA, 14 bp, Homo sapiens
actttgccaaggct

SEQ ID NO: 309423 - DNA, 19 bp, Homo sapiens
actttgccagcttttcctc

SEQ ID NO: 309424 - DNA, 11 bp, Homo sapiens
actttggaaaa

SEQ ID NO: 309425 - DNA, 15 bp, Homo sapiens
actttggaatttgaa

SEQ ID NO: 309426 - DNA, 16 bp, Homo sapiens
actttggatcaggaaa

SEQ ID NO: 309427 - DNA, 16 bp, Homo sapiens
actttgggaggccaag

SEQ ID NO: 309428 - DNA, 14 bp, Homo sapiens
actttgggaggctg

SEQ ID NO: 309429 - DNA, 23 bp, Homo sapiens
actttggtcacaagtaggagaca

SEQ ID NO: 309430 - DNA, 17 bp, Homo sapiens
actttgtattctctgtc

SEQ ID NO: 309431 - DNA, 18 bp, Homo sapiens
actttgtattctctgtcc

SEQ ID NO: 309432 - DNA, 20 bp, Homo sapiens
actttgtattctctgtccag

SEQ ID NO: 309433 - DNA, 14 bp, Homo sapiens
actttgtgcctttg

SEQ ID NO: 309434 - DNA, 19 bp, Homo sapiens
actttgtggatgtcttcct

SEQ ID NO: 309435 - DNA, 17 bp, Homo sapiens
actttgttggcccttcc

SEQ ID NO: 309436 - DNA, 14 bp, Homo sapiens
actttgtttttcca

SEQ ID NO: 309437 - DNA, 17 bp, Homo sapiens
actttgtttttccatgt

SEQ ID NO: 309438 - DNA, 20 bp, Homo sapiens
acttttaacgtatgtatttc

SEQ ID NO: 309439 - DNA, 21 bp, Homo sapiens
acttttaacgtatgtatttca

SEQ ID NO: 309440 - DNA, 13 bp, Homo sapiens
acttttacagctt

SEQ ID NO: 309441 - DNA, 19 bp, Homo sapiens
acttttacagcttttctct

SEQ ID NO: 309442 - DNA, 16 bp, Homo sapiens
acttttaccactattt

SEQ ID NO: 309443 - DNA, 21 bp, Homo sapiens
acttttaccactatttaagtt

SEQ ID NO: 309444 - DNA, 15 bp, Homo sapiens
acttttataaattaa

SEQ ID NO: 309445 - DNA, 17 bp, Homo sapiens
acttttataaattaaat

SEQ ID NO: 309446 - DNA, 23 bp, Homo sapiens
acttttattatgggtatgtgttg

SEQ ID NO: 309447 - DNA, 20 bp, Homo sapiens
aagcaaccttaaagcaataa

SEQ ID NO: 309448 - DNA, 20 bp, Homo sapiens
aagcaacgactactttgcta

SEQ ID NO: 309449 - DNA, 15 bp, Homo sapiens
aagcaagagagatgt

SEQ ID NO: 309450 - DNA, 18 bp, Homo sapiens
aagcaagagagatgtttt

SEQ ID NO: 309451 - DNA, 17 bp, Homo sapiens
aagcaaggccagccctg

SEQ ID NO: 309452 - DNA, 17 bp, Homo sapiens
aagcaagggctccagca

SEQ ID NO: 309453 - DNA, 20 bp, Homo sapiens
aagcaagtatatttatttct

SEQ ID NO: 309454 - DNA, 24 bp, Homo sapiens
aagcaataagttcattaaacagaa

SEQ ID NO: 309455 - DNA, 16 bp, Homo sapiens
aagcaatcctcctgag

SEQ ID NO: 309456 - DNA, 16 bp, Homo sapiens
aagcaattgccctgta

SEQ ID NO: 309457 - DNA, 17 bp, Homo sapiens
aagcaattgccctgtaa

SEQ ID NO: 309458 - DNA, 15 bp, Homo sapiens
aagcacaaaccctgg

SEQ ID NO: 309459 - DNA, 18 bp, Homo sapiens
aagcacaaaccctgggga

SEQ ID NO: 309460 - DNA, 19 bp, Homo sapiens
aagcacaaaccctggggac

SEQ ID NO: 309461 - DNA, 17 bp, Homo sapiens
aagcacaaacttctgta

SEQ ID NO: 309462 - DNA, 15 bp, Homo sapiens
aagcacaaactttag

SEQ ID NO: 309463 - DNA, 22 bp, Homo sapiens
aagcacagctctcactggccag

SEQ ID NO: 309464 - DNA, 17 bp, Homo sapiens
aagcaccttgaatggaa

SEQ ID NO: 309465 - DNA, 15 bp, Homo sapiens
aagcacgaaatgtta

SEQ ID NO: 309466 - DNA, 17 bp, Homo sapiens
aagcactacataaactg

SEQ ID NO: 309467 - DNA, 23 bp, Homo sapiens
aagcactacataaactgacttta

SEQ ID NO: 309468 - DNA, 18 bp, Homo sapiens
aagcactgtgtttatatg

SEQ ID NO: 309469 - DNA, 22 bp, Homo sapiens
aagcactgtgtttatatgtctt

SEQ ID NO: 309470 - DNA, 18 bp, Homo sapiens
aagcactttgggattctt

SEQ ID NO: 309471 - DNA, 18 bp, Homo sapiens
aagcagaggctggcctca

SEQ ID NO: 309472 - DNA, 20 bp, Homo sapiens
aagcagaggctggcctcaga

SEQ ID NO: 309473 - DNA, 16 bp, Homo sapiens
aagcagaggtggaaaa

SEQ ID NO: 309474 - DNA, 16 bp, Homo sapiens
aagcagagttctttgc

SEQ ID NO: 309475 - DNA, 17 bp, Homo sapiens
aagcagatggaatgctg

SEQ ID NO: 309476 - DNA, 18 bp, Homo sapiens
aagcagcagctaggactg

SEQ ID NO: 309477 - DNA, 18 bp, Homo sapiens
aggacccggaggggcctg

SEQ ID NO: 309478 - DNA, 14 bp, Homo sapiens
aggaccctgagtcc

SEQ ID NO: 309479 - DNA, 20 bp, Homo sapiens
aggaccctgagtccccacct

SEQ ID NO: 309480 - DNA, 19 bp, Homo sapiens
aggacccttcagaggtggc

SEQ ID NO: 309481 - DNA, 16 bp, Homo sapiens
aggacctatgtttgct

SEQ ID NO: 309482 - DNA, 13 bp, Homo sapiens
aggacctccacct

SEQ ID NO: 309483 - DNA, 20 bp, Homo sapiens
aggacctccacctgggagat

SEQ ID NO: 309484 - DNA, 11 bp, Homo sapiens
aggacctctgg

SEQ ID NO: 309485 - DNA, 12 bp, Homo sapiens
aggacctctggg

SEQ ID NO: 309486 - DNA, 16 bp, Homo sapiens
aggaccttatctgtgc

SEQ ID NO: 309487 - DNA, 20 bp, Homo sapiens
aggacgatttcactgacact

SEQ ID NO: 309488 - DNA, 13 bp, Homo sapiens
aggacgcttctga

SEQ ID NO: 309489 - DNA, 14 bp, Homo sapiens
aggacgcttctgaa

SEQ ID NO: 309490 - DNA, 15 bp, Homo sapiens
aggacgcttctgaat

SEQ ID NO: 309491 - DNA, 16 bp, Homo sapiens
aggacggagttcagag

SEQ ID NO: 309492 - DNA, 16 bp, Homo sapiens
aggacggggcagagct

SEQ ID NO: 309493 - DNA, 16 bp, Homo sapiens
aggacggttgtaagca

SEQ ID NO: 309494 - DNA, 20 bp, Homo sapiens
aggacggttgtaagcagttg

SEQ ID NO: 309495 - DNA, 21 bp, Homo sapiens
aggacggttgtaagcagttgt

SEQ ID NO: 309496 - DNA, 16 bp, Homo sapiens
aggacgttaggcccgg

SEQ ID NO: 309497 - DNA, 22 bp, Homo sapiens
aggactaacataaaatctgtga

SEQ ID NO: 309498 - DNA, 14 bp, Homo sapiens
aggactacaggtat

SEQ ID NO: 309499 - DNA, 15 bp, Homo sapiens
aggactcaggcctgc

SEQ ID NO: 309500 - DNA, 13 bp, Homo sapiens
aggactccctcca

SEQ ID NO: 309501 - DNA, 17 bp, Homo sapiens
aggactccctccatgtg

SEQ ID NO: 309502 - DNA, 18 bp, Homo sapiens
aggactccctcctcacct

SEQ ID NO: 309503 - DNA, 21 bp, Homo sapiens
aggactctcacgatatgcaag

SEQ ID NO: 309504 - DNA, 19 bp, Homo sapiens
aggactctctttcttccac

SEQ ID NO: 309505 - DNA, 17 bp, Homo sapiens
aggactctgccccttct

SEQ ID NO: 309506 - DNA, 20 bp, Homo sapiens
aggactctgccccttctgtt

SEQ ID NO: 309507 - DNA, 13 bp, Homo sapiens
aggactctgcctc

SEQ ID NO: 309508 - DNA, 17 bp, Homo sapiens
aggactctgcctcctct

SEQ ID NO: 309509 - DNA, 18 bp, Homo sapiens
aggactctgcctcctctt

SEQ ID NO: 309510 - DNA, 19 bp, Homo sapiens
aggactctgcctcctcttc

SEQ ID NO: 309511 - DNA, 12 bp, Homo sapiens
aggactctggac

SEQ ID NO: 309512 - DNA, 19 bp, Homo sapiens
aggactgcatggtaattta

SEQ ID NO: 309513 - DNA, 18 bp, Homo sapiens
aggactgttttttcctga

SEQ ID NO: 309514 - DNA, 17 bp, Homo sapiens
aggacttcaaaaggtga

SEQ ID NO: 309515 - DNA, 16 bp, Homo sapiens
aggacttgaaagcatc

SEQ ID NO: 309516 - DNA, 23 bp, Homo sapiens
aggacttggagagaatcatgctg

SEQ ID NO: 309517 - DNA, 21 bp, Homo sapiens
aggacttgggggcagagcagc

SEQ ID NO: 309518 - DNA, 21 bp, Homo sapiens
aggacttgtgcctcttgggag

SEQ ID NO: 309519 - DNA, 22 bp, Homo sapiens
aggacttgtgcctcttgggaga

SEQ ID NO: 309520 - DNA, 22 bp, Homo sapiens
aggactttgattgcacattgtt

SEQ ID NO: 309521 - DNA, 13 bp, Homo sapiens
aggagaaaatgaa

SEQ ID NO: 309522 - DNA, 13 bp, Homo sapiens
aggagaaggagag

SEQ ID NO: 309523 - DNA, 15 bp, Homo sapiens
aggagaaggagaggg

SEQ ID NO: 309524 - DNA, 20 bp, Homo sapiens
aggagaaggcctgcccccct

SEQ ID NO: 309525 - DNA, 11 bp, Homo sapiens
aggagaagttg

SEQ ID NO: 309526 - DNA, 23 bp, Homo sapiens
aggagaatcgcttgaacctggga

SEQ ID NO: 309527 - DNA, 16 bp, Homo sapiens
aggagacacagatggc

SEQ ID NO: 309528 - DNA, 21 bp, Homo sapiens
aggagacacagatggcacctg

SEQ ID NO: 309529 - DNA, 18 bp, Homo sapiens
aggagacagtcaggaagc

SEQ ID NO: 309530 - DNA, 13 bp, Homo sapiens
aggagaccagaag

SEQ ID NO: 309531 - DNA, 16 bp, Homo sapiens
aggagaccagaagtga

SEQ ID NO: 309532 - DNA, 17 bp, Homo sapiens
aggagaccagaagtgaa

SEQ ID NO: 309533 - DNA, 13 bp, Homo sapiens
aggagaccctgga

SEQ ID NO: 309534 - DNA, 15 bp, Homo sapiens
aggagaccctgtctt

SEQ ID NO: 309535 - DNA, 19 bp, Homo sapiens
aggagactcaggcccacat

SEQ ID NO: 309536 - DNA, 13 bp, Homo sapiens
aggagactgaggc

SEQ ID NO: 309537 - DNA, 14 bp, Homo sapiens
aggagacttgtagt

SEQ ID NO: 309538 - DNA, 17 bp, Homo sapiens
aggagagaaggggagga

SEQ ID NO: 309539 - DNA, 14 bp, Homo sapiens
aggagagaatgaga

SEQ ID NO: 309540 - DNA, 18 bp, Homo sapiens
aggagagaatgagagagt

SEQ ID NO: 309541 - DNA, 23 bp, Homo sapiens
aggagagacggtgttgggagccc

SEQ ID NO: 309542 - DNA, 16 bp, Homo sapiens
aggagagactgaaagc

SEQ ID NO: 309543 - DNA, 17 bp, Homo sapiens
aggagagactgaaagca

SEQ ID NO: 309544 - DNA, 20 bp, Homo sapiens
aggagagagatgctgctccc

SEQ ID NO: 309545 - DNA, 22 bp, Homo sapiens
aggagagagatgctgctcccgc

SEQ ID NO: 309546 - DNA, 20 bp, Homo sapiens
aggagagcatcaccaccaca

SEQ ID NO: 309547 - DNA, 19 bp, Homo sapiens
aggagagcatctgctctga

SEQ ID NO: 309548 - DNA, 12 bp, Homo sapiens
aggagagcctgc

SEQ ID NO: 309549 - DNA, 16 bp, Homo sapiens
aggagagcctgctgca

SEQ ID NO: 309550 - DNA, 13 bp, Homo sapiens
aggagaggagagc

SEQ ID NO: 309551 - DNA, 18 bp, Homo sapiens
aggagagggcagaggtcc

SEQ ID NO: 309552 - DNA, 14 bp, Homo sapiens
aggagagtaaaaat

SEQ ID NO: 309553 - DNA, 19 bp, Homo sapiens
aggagagtacccccctgag

SEQ ID NO: 309554 - DNA, 20 bp, Homo sapiens
aggagagtacccccctgaga

SEQ ID NO: 309555 - DNA, 17 bp, Homo sapiens
aggagagtcacagaaca

SEQ ID NO: 309556 - DNA, 21 bp, Homo sapiens
aggagagtcccagagcaggag

SEQ ID NO: 309557 - DNA, 12 bp, Homo sapiens
aggagatataaa

SEQ ID NO: 309558 - DNA, 19 bp, Homo sapiens
aggagatataaaatctaga

SEQ ID NO: 309559 - DNA, 18 bp, Homo sapiens
aggagatgtaatgacaga

SEQ ID NO: 309560 - DNA, 22 bp, Homo sapiens
aggagatgtaatgacagagagt

SEQ ID NO: 309561 - DNA, 14 bp, Homo sapiens
aggagattttcctt

SEQ ID NO: 309562 - DNA, 17 bp, Homo sapiens
aggagcaatgggactgg

SEQ ID NO: 309563 - DNA, 15 bp, Homo sapiens
aggagcacaggcagc

SEQ ID NO: 309564 - DNA, 15 bp, Homo sapiens
aggagcacccccagc

SEQ ID NO: 309565 - DNA, 16 bp, Homo sapiens
aggagcacccccagcc

SEQ ID NO: 309566 - DNA, 14 bp, Homo sapiens
aggagcagcctcca

SEQ ID NO: 309567 - DNA, 21 bp, Homo sapiens
aggagcagcctccaagaaact

SEQ ID NO: 309568 - DNA, 14 bp, Homo sapiens
aggagcagccttag

SEQ ID NO: 309569 - DNA, 16 bp, Homo sapiens
aggagcagctgtgctg

SEQ ID NO: 309570 - DNA, 20 bp, Homo sapiens
aggagcagcttcagttgttt

SEQ ID NO: 309571 - DNA, 13 bp, Homo sapiens
aggagcaggaagc

SEQ ID NO: 309572 - DNA, 18 bp, Homo sapiens
aggagcaggaagcaaggc

SEQ ID NO: 309573 - DNA, 23 bp, Homo sapiens
aggagcaggaagcaaggccagcc

SEQ ID NO: 309574 - DNA, 23 bp, Homo sapiens
aggagccacctgggctgggagaa

SEQ ID NO: 309575 - DNA, 13 bp, Homo sapiens
aggagccagcagg

SEQ ID NO: 309576 - DNA, 14 bp, Homo sapiens
aggagccagcaggg

SEQ ID NO: 309577 - DNA, 15 bp, Homo sapiens
aggagccagcagggc

SEQ ID NO: 309578 - DNA, 12 bp, Homo sapiens
aggagccaggca

SEQ ID NO: 309579 - DNA, 13 bp, Homo sapiens
aggagccaggcaa

SEQ ID NO: 309580 - DNA, 17 bp, Homo sapiens
aggagccccagccagcc

SEQ ID NO: 309581 - DNA, 18 bp, Homo sapiens
aggagccccagccagccc

SEQ ID NO: 309582 - DNA, 20 bp, Homo sapiens
aggagcctcctgaccctgtg

SEQ ID NO: 309583 - DNA, 11 bp, Homo sapiens
aggagcctgcg

SEQ ID NO: 309584 - DNA, 18 bp, Homo sapiens
aggagcctgcggctgctg

SEQ ID NO: 309585 - DNA, 13 bp, Homo sapiens
aggagcgcaagat

SEQ ID NO: 309586 - DNA, 17 bp, Homo sapiens
aggagcgcaagatagat

SEQ ID NO: 309587 - DNA, 16 bp, Homo sapiens
aggagcgggacctgtg

SEQ ID NO: 309588 - DNA, 13 bp, Homo sapiens
aggagcgggcagg

SEQ ID NO: 309589 - DNA, 15 bp, Homo sapiens
aggagcgggcagggc

SEQ ID NO: 309590 - DNA, 18 bp, Homo sapiens
aggagctagcccagtccc

SEQ ID NO: 309591 - DNA, 14 bp, Homo sapiens
aggagctgctggct

SEQ ID NO: 309592 - DNA, 17 bp, Homo sapiens
aggagctgctggcttgc

SEQ ID NO: 309593 - DNA, 20 bp, Homo sapiens
aggagctggatttgggagct

SEQ ID NO: 309594 - DNA, 17 bp, Homo sapiens
aggagctggctggcagg

SEQ ID NO: 309595 - DNA, 16 bp, Homo sapiens
aggcaccggcgctgca

SEQ ID NO: 309596 - DNA, 17 bp, Homo sapiens
aggcaccggcgctgcag

SEQ ID NO: 309597 - DNA, 18 bp, Homo sapiens
aggcaccggcgctgcagg

SEQ ID NO: 309598 - DNA, 19 bp, Homo sapiens
aggcaccggcgctgcaggt

SEQ ID NO: 309599 - DNA, 14 bp, Homo sapiens
aggcacctggcctg

SEQ ID NO: 309600 - DNA, 16 bp, Homo sapiens
aggcacctggcctgct

SEQ ID NO: 309601 - DNA, 19 bp, Homo sapiens
aggcacctggcctgctggg

SEQ ID NO: 309602 - DNA, 22 bp, Homo sapiens
aggcacctggcctgctgggaac

SEQ ID NO: 309603 - DNA, 18 bp, Homo sapiens
aggcacctgggctttctg

SEQ ID NO: 309604 - DNA, 15 bp, Homo sapiens
aggcactgccttctc

SEQ ID NO: 309605 - DNA, 22 bp, Homo sapiens
aggcactgccttctcctctctg

SEQ ID NO: 309606 - DNA, 23 bp, Homo sapiens
aggcactgccttctcctctctgg

SEQ ID NO: 309607 - DNA, 14 bp, Homo sapiens
aggcactgctgccc

SEQ ID NO: 309608 - DNA, 22 bp, Homo sapiens
aggcactgctgcccagcctcca

SEQ ID NO: 309609 - DNA, 15 bp, Homo sapiens
aggcactggtggcat

SEQ ID NO: 309610 - DNA, 16 bp, Homo sapiens
aggcactgtactaggc

SEQ ID NO: 309611 - DNA, 16 bp, Homo sapiens
aggcagaaagcagagg

SEQ ID NO: 309612 - DNA, 18 bp, Homo sapiens
aggcagaaagcagaggct

SEQ ID NO: 309613 - DNA, 21 bp, Homo sapiens
aggcagaaagcagaggctggc

SEQ ID NO: 309614 - DNA, 12 bp, Homo sapiens
aggcagaaagga

SEQ ID NO: 309615 - DNA, 21 bp, Homo sapiens
aggcagaatcctggccctctg

SEQ ID NO: 309616 - DNA, 15 bp, Homo sapiens
aggcagactcgaggg

SEQ ID NO: 309617 - DNA, 20 bp, Homo sapiens
aggcagagaaaacacacgct

SEQ ID NO: 309618 - DNA, 21 bp, Homo sapiens
aggcagagacaataaaacatt

SEQ ID NO: 309619 - DNA, 21 bp, Homo sapiens
aggcagagctcagcacagcct

SEQ ID NO: 309620 - DNA, 17 bp, Homo sapiens
aggcagaggatgttctg

SEQ ID NO: 309621 - DNA, 11 bp, Homo sapiens
aggcagagggt

SEQ ID NO: 309622 - DNA, 22 bp, Homo sapiens
aggcagagtgccccacctgcca

SEQ ID NO: 309623 - DNA, 24 bp, Homo sapiens
aggcagagtgccccacctgccact

SEQ ID NO: 309624 - DNA, 16 bp, Homo sapiens
aggcagatctgtgccc

SEQ ID NO: 309625 - DNA, 21 bp, Homo sapiens
aggcagatctgtgccccatgc

SEQ ID NO: 309626 - DNA, 23 bp, Homo sapiens
aggcagatctgtgccccatgcct

SEQ ID NO: 309627 - DNA, 17 bp, Homo sapiens
aggcagatggagcccat

SEQ ID NO: 309628 - DNA, 16 bp, Homo sapiens
aggcagattcaatttt

SEQ ID NO: 309629 - DNA, 15 bp, Homo sapiens
aggcagattgaaaag

SEQ ID NO: 309630 - DNA, 14 bp, Homo sapiens
aggcagcaacagga

SEQ ID NO: 309631 - DNA, 20 bp, Homo sapiens
aggcagcaacaggaccagga

SEQ ID NO: 309632 - DNA, 21 bp, Homo sapiens
aggcagccccctccacaccag

SEQ ID NO: 309633 - DNA, 12 bp, Homo sapiens
aggcagcctcca

SEQ ID NO: 309634 - DNA, 23 bp, Homo sapiens
aggcagcctccagagccagcctg

SEQ ID NO: 309635 - DNA, 14 bp, Homo sapiens
aggcagcctgccgc

SEQ ID NO: 309636 - DNA, 12 bp, Homo sapiens
aggcagccttga

SEQ ID NO: 309637 - DNA, 16 bp, Homo sapiens
aggcagctaaggggca

SEQ ID NO: 309638 - DNA, 15 bp, Homo sapiens
aggcagctcacccct

SEQ ID NO: 309639 - DNA, 17 bp, Homo sapiens
aggcagctcacccctgg

SEQ ID NO: 309640 - DNA, 20 bp, Homo sapiens
aggcagctcacccctgggca

SEQ ID NO: 309641 - DNA, 20 bp, Homo sapiens
aggcagctcccaggtttaga

SEQ ID NO: 309642 - DNA, 23 bp, Homo sapiens
aggcagctgctcttagtgcccgc

SEQ ID NO: 309643 - DNA, 21 bp, Homo sapiens
aggcaggaagtcaggagccag

SEQ ID NO: 309644 - DNA, 11 bp, Homo sapiens
aggcagggagg

SEQ ID NO: 309645 - DNA, 23 bp, Homo sapiens
aggcagggagggaaacccgggga

SEQ ID NO: 309646 - DNA, 15 bp, Homo sapiens
aggcagggagggctt

SEQ ID NO: 309647 - DNA, 15 bp, Homo sapiens
aggcagggcagaggg

SEQ ID NO: 309648 - DNA, 16 bp, Homo sapiens
aggcagggcagaggga

SEQ ID NO: 309649 - DNA, 19 bp, Homo sapiens
aggcagggcagagggaatg

SEQ ID NO: 309650 - DNA, 16 bp, Homo sapiens
aggcaggggagtctgc

SEQ ID NO: 309651 - DNA, 16 bp, Homo sapiens
aggcaggggctctgct

SEQ ID NO: 309652 - DNA, 21 bp, Homo sapiens
aggcagggtcccatttctcac

SEQ ID NO: 309653 - DNA, 17 bp, Homo sapiens
aggcagtagatgtgctt

SEQ ID NO: 309654 - DNA, 15 bp, Homo sapiens
aggcagtattccctt

SEQ ID NO: 309655 - DNA, 12 bp, Homo sapiens
aggcagtccaga

SEQ ID NO: 309656 - DNA, 14 bp, Homo sapiens
aggcagtccagagc

SEQ ID NO: 309657 - DNA, 16 bp, Homo sapiens
aggcagtctgaaccct

SEQ ID NO: 309658 - DNA, 14 bp, Homo sapiens
aggcagtggcttgg

SEQ ID NO: 309659 - DNA, 23 bp, Homo sapiens
aggcagtggcttggagcagaggt

SEQ ID NO: 309660 - DNA, 14 bp, Homo sapiens
aggcatactctcca

SEQ ID NO: 309661 - DNA, 16 bp, Homo sapiens
aggcatactctccagg

SEQ ID NO: 309662 - DNA, 14 bp, Homo sapiens
aggcataggcctgg

SEQ ID NO: 309663 - DNA, 15 bp, Homo sapiens
aggcataggcctggg

SEQ ID NO: 309664 - DNA, 16 bp, Homo sapiens
aggcataggcctgggt

SEQ ID NO: 309665 - DNA, 19 bp, Homo sapiens
aggcataggcctgggtgct

SEQ ID NO: 309666 - DNA, 20 bp, Homo sapiens
aggcataggcctgggtgctg

SEQ ID NO: 309667 - DNA, 17 bp, Homo sapiens
aggcatcaaaaaaacaa

SEQ ID NO: 309668 - DNA, 18 bp, Homo sapiens
aggcatcattttcacctc

SEQ ID NO: 309669 - DNA, 21 bp, Homo sapiens
aggcatccatagtgcactagc

SEQ ID NO: 309670 - DNA, 19 bp, Homo sapiens
aggcatctgtgggcatggt

SEQ ID NO: 309671 - DNA, 19 bp, Homo sapiens
aggcatgacagctgttcca

SEQ ID NO: 309672 - DNA, 21 bp, Homo sapiens
aggcatgaccctggagcccgg

SEQ ID NO: 309673 - DNA, 13 bp, Homo sapiens
aggcatgcctgtg

SEQ ID NO: 309674 - DNA, 18 bp, Homo sapiens
aggcatgctggcctccca

SEQ ID NO: 309675 - DNA, 17 bp, Homo sapiens
aggcatggcccagcctg

SEQ ID NO: 309676 - DNA, 22 bp, Homo sapiens
aggcatgtgccacccacccaac

SEQ ID NO: 309677 - DNA, 17 bp, Homo sapiens
aggcattgcactaaaag

SEQ ID NO: 309678 - DNA, 19 bp, Homo sapiens
aggcattgcactaaaagtg

SEQ ID NO: 309679 - DNA, 12 bp, Homo sapiens
aggcatttgtct

SEQ ID NO: 309680 - DNA, 14 bp, Homo sapiens
aggccaaatgcaca

SEQ ID NO: 309681 - DNA, 16 bp, Homo sapiens
aggccaaatgcacaag

SEQ ID NO: 309682 - DNA, 21 bp, Homo sapiens
aggccaagagtttgagaccaa

SEQ ID NO: 309683 - DNA, 12 bp, Homo sapiens
aggccaagcctg

SEQ ID NO: 309684 - DNA, 13 bp, Homo sapiens
aggccaagcctgc

SEQ ID NO: 309685 - DNA, 13 bp, Homo sapiens
aggccaaggcagg

SEQ ID NO: 309686 - DNA, 11 bp, Homo sapiens
aggccaaggcc

SEQ ID NO: 309687 - DNA, 17 bp, Homo sapiens
aggccaaggccttctcc

SEQ ID NO: 309688 - DNA, 16 bp, Homo sapiens
aggccaaggtgggcgg

SEQ ID NO: 309689 - DNA, 16 bp, Homo sapiens
aggccacatgagtccc

SEQ ID NO: 309690 - DNA, 19 bp, Homo sapiens
aggccacatgagtcccagt

SEQ ID NO: 309691 - DNA, 12 bp, Homo sapiens
aggccaccccaa

SEQ ID NO: 309692 - DNA, 14 bp, Homo sapiens
aggccaccccaaac

SEQ ID NO: 309693 - DNA, 20 bp, Homo sapiens
aggccaccccaaaccccagc

SEQ ID NO: 309694 - DNA, 20 bp, Homo sapiens
aggccaccccctatcctctg

SEQ ID NO: 309695 - DNA, 14 bp, Homo sapiens
aggccacctgcagg

SEQ ID NO: 309696 - DNA, 13 bp, Homo sapiens
aggccacctgccc

SEQ ID NO: 309697 - DNA, 18 bp, Homo sapiens
aggccacctgcccccttc

SEQ ID NO: 309698 - DNA, 19 bp, Homo sapiens
aggccacgctcctctgttc

SEQ ID NO: 309699 - DNA, 14 bp, Homo sapiens
aggccacgggggag

SEQ ID NO: 309700 - DNA, 15 bp, Homo sapiens
aggccacgggggagg

SEQ ID NO: 309701 - DNA, 12 bp, Homo sapiens
aggccactgacc

SEQ ID NO: 309702 - DNA, 22 bp, Homo sapiens
aggccactgacctcccactttg

SEQ ID NO: 309703 - DNA, 17 bp, Homo sapiens
aggccactgtggccaga

SEQ ID NO: 309704 - DNA, 18 bp, Homo sapiens
aggccactgtggccagag

SEQ ID NO: 309705 - DNA, 19 bp, Homo sapiens
aggccactgtggccagagc

SEQ ID NO: 309706 - DNA, 20 bp, Homo sapiens
aggccactgtggccagagct

SEQ ID NO: 309707 - DNA, 23 bp, Homo sapiens
aggccactgtggccagagctgga

SEQ ID NO: 309708 - DNA, 15 bp, Homo sapiens
aggccacttgctcag

SEQ ID NO: 309709 - DNA, 16 bp, Homo sapiens
aggccacttgctcaga

SEQ ID NO: 309710 - DNA, 17 bp, Homo sapiens
aggccagagtggcctgg

SEQ ID NO: 309711 - DNA, 19 bp, Homo sapiens
aggccagagtggcctggcc

SEQ ID NO: 309712 - DNA, 13 bp, Homo sapiens
aggccagccccac

SEQ ID NO: 309713 - DNA, 14 bp, Homo sapiens
aggccagccccacc

SEQ ID NO: 309714 - DNA, 15 bp, Homo sapiens
aggccagccccaccc

SEQ ID NO: 309715 - DNA, 20 bp, Homo sapiens
aggccagccctccctggctg

SEQ ID NO: 309716 - DNA, 19 bp, Homo sapiens
aggccagccctggttctcc

SEQ ID NO: 309717 - DNA, 19 bp, Homo sapiens
aggccagcgaggcgaggct

SEQ ID NO: 309718 - DNA, 16 bp, Homo sapiens
aggccagctgtggttt

SEQ ID NO: 309719 - DNA, 21 bp, Homo sapiens
aggccagctgtggttttcttt

SEQ ID NO: 309720 - DNA, 23 bp, Homo sapiens
aggccagctgtggttttcttttg

SEQ ID NO: 309721 - DNA, 20 bp, Homo sapiens
aggccagcttcgtgctggag

SEQ ID NO: 309722 - DNA, 22 bp, Homo sapiens
aggccagcttcgtgctggagga

SEQ ID NO: 309723 - DNA, 17 bp, Homo sapiens
aggccaggacgtctggg

SEQ ID NO: 309724 - DNA, 15 bp, Homo sapiens
aggccaggagttcaa

SEQ ID NO: 309725 - DNA, 12 bp, Homo sapiens
cacacctggtct

SEQ ID NO: 309726 - DNA, 16 bp, Homo sapiens
cacacgcacacacaca

SEQ ID NO: 309727 - DNA, 14 bp, Homo sapiens
cacacgcacgcaca

SEQ ID NO: 309728 - DNA, 14 bp, Homo sapiens
cacacgcagacaca

SEQ ID NO: 309729 - DNA, 15 bp, Homo sapiens
cacacgcagacacac

SEQ ID NO: 309730 - DNA, 17 bp, Homo sapiens
cacacgcagacacacac

SEQ ID NO: 309731 - DNA, 19 bp, Homo sapiens
cacacgccggggctggccc

SEQ ID NO: 309732 - DNA, 23 bp, Homo sapiens
cacacgccggggctggccctgcc

SEQ ID NO: 309733 - DNA, 21 bp, Homo sapiens
cacacgctgcccaggctctgc

SEQ ID NO: 309734 - DNA, 19 bp, Homo sapiens
cacacggactcccgggcca

SEQ ID NO: 309735 - DNA, 21 bp, Homo sapiens
cacacggactcccgggccacg

SEQ ID NO: 309736 - DNA, 13 bp, Homo sapiens
cacactcagcagc

SEQ ID NO: 309737 - DNA, 15 bp, Homo sapiens
cacactcagcagccc

SEQ ID NO: 309738 - DNA, 13 bp, Homo sapiens
cacactcagtgca

SEQ ID NO: 309739 - DNA, 13 bp, Homo sapiens
cacactgctacac

SEQ ID NO: 309740 - DNA, 13 bp, Homo sapiens
cacactgctggga

SEQ ID NO: 309741 - DNA, 14 bp, Homo sapiens
cacactgctgggaa

SEQ ID NO: 309742 - DNA, 20 bp, Homo sapiens
cacactgtaaacccctgggt

SEQ ID NO: 309743 - DNA, 21 bp, Homo sapiens
cacacttcaggctcttctcct

SEQ ID NO: 309744 - DNA, 23 bp, Homo sapiens
cacacttccccttgggatgggca

SEQ ID NO: 309745 - DNA, 20 bp, Homo sapiens
cacacttcctgtccagagag

SEQ ID NO: 309746 - DNA, 22 bp, Homo sapiens
cacacttcttgaaacagcctgg

SEQ ID NO: 309747 - DNA, 19 bp, Homo sapiens
cacacttgagaggatgaat

SEQ ID NO: 309748 - DNA, 10 bp, Homo sapiens
cacacttgtc

SEQ ID NO: 309749 - DNA, 23 bp, Homo sapiens
cacacttgtgtgtgggctgtgag

SEQ ID NO: 309750 - DNA, 18 bp, Homo sapiens
cacacttgttccagctct

SEQ ID NO: 309751 - DNA, 20 bp, Homo sapiens
cacacttgttccagctcttt

SEQ ID NO: 309752 - DNA, 17 bp, Homo sapiens
cacactttctgactgca

SEQ ID NO: 309753 - DNA, 19 bp, Homo sapiens
cacacttttgcacatatat

SEQ ID NO: 309754 - DNA, 14 bp, Homo sapiens
cacagaaaaaaatg

SEQ ID NO: 309755 - DNA, 15 bp, Homo sapiens
cacagaaagggcagc

SEQ ID NO: 309756 - DNA, 18 bp, Homo sapiens
cacagaaagggcagcttc

SEQ ID NO: 309757 - DNA, 14 bp, Homo sapiens
cacagaacaagcca

SEQ ID NO: 309758 - DNA, 13 bp, Homo sapiens
cacagaacccttg

SEQ ID NO: 309759 - DNA, 13 bp, Homo sapiens
cacagacacacac

SEQ ID NO: 309760 - DNA, 20 bp, Homo sapiens
cacagacacacacacgcacg

SEQ ID NO: 309761 - DNA, 20 bp, Homo sapiens
cacagacagatcccatccat

SEQ ID NO: 309762 - DNA, 12 bp, Homo sapiens
cacagactctgt

SEQ ID NO: 309763 - DNA, 20 bp, Homo sapiens
cacagactctgtgagattct

SEQ ID NO: 309764 - DNA, 14 bp, Homo sapiens
cacagactgttccc

SEQ ID NO: 309765 - DNA, 15 bp, Homo sapiens
cacagactgttccct

SEQ ID NO: 309766 - DNA, 18 bp, Homo sapiens
cacagacttctggaaggc

SEQ ID NO: 309767 - DNA, 20 bp, Homo sapiens
cacagacttctggaaggctg

SEQ ID NO: 309768 - DNA, 21 bp, Homo sapiens
cacagacttctggaaggctgg

SEQ ID NO: 309769 - DNA, 18 bp, Homo sapiens
cacagagacacagggcat

SEQ ID NO: 309770 - DNA, 19 bp, Homo sapiens
cacagagacccccgtgcca

SEQ ID NO: 309771 - DNA, 20 bp, Homo sapiens
cacagagagacagacttgag

SEQ ID NO: 309772 - DNA, 22 bp, Homo sapiens
cacagagagggggccacctccc

SEQ ID NO: 309773 - DNA, 17 bp, Homo sapiens
cacagaggccaggcatg

SEQ ID NO: 309774 - DNA, 18 bp, Homo sapiens
cacagagtcgatgctcaa

SEQ ID NO: 309775 - DNA, 22 bp, Homo sapiens
cacagagtggtctttctggaga

SEQ ID NO: 309776 - DNA, 18 bp, Homo sapiens
cacagagtttgtagtaaa

SEQ ID NO: 309777 - DNA, 19 bp, Homo sapiens
cacagataccttgaaagga

SEQ ID NO: 309778 - DNA, 21 bp, Homo sapiens
cacagatattgttataaataa

SEQ ID NO: 309779 - DNA, 20 bp, Homo sapiens
cacagatggatttgcctgtg

SEQ ID NO: 309780 - DNA, 18 bp, Homo sapiens
cacagatggcacctgtgg

SEQ ID NO: 309781 - DNA, 19 bp, Homo sapiens
cacagatggcacctgtggc

SEQ ID NO: 309782 - DNA, 22 bp, Homo sapiens
cacagatggcacctgtggccag

SEQ ID NO: 309783 - DNA, 22 bp, Homo sapiens
cacagatgggtattaaacttgt

SEQ ID NO: 309784 - DNA, 21 bp, Homo sapiens
cacagcacatgctggccagcc

SEQ ID NO: 309785 - DNA, 20 bp, Homo sapiens
cacagcacctcctctctgct

SEQ ID NO: 309786 - DNA, 16 bp, Homo sapiens
cacagcagcagaacaa

SEQ ID NO: 309787 - DNA, 23 bp, Homo sapiens
cacagcagcagaacaagtgcctc

SEQ ID NO: 309788 - DNA, 18 bp, Homo sapiens
cacagcagtacttgctca

SEQ ID NO: 309789 - DNA, 18 bp, Homo sapiens
cacagcatgtgccaagat

SEQ ID NO: 309790 - DNA, 14 bp, Homo sapiens
cacagccaagccca

SEQ ID NO: 309791 - DNA, 23 bp, Homo sapiens
cacagccagaaactgaactggcc

SEQ ID NO: 309792 - DNA, 19 bp, Homo sapiens
cacagccagaaccccgagc

SEQ ID NO: 309793 - DNA, 14 bp, Homo sapiens
cacagccagcccag

SEQ ID NO: 309794 - DNA, 18 bp, Homo sapiens
cacagccagcccagctcc

SEQ ID NO: 309795 - DNA, 14 bp, Homo sapiens
cacagcccaaccag

SEQ ID NO: 309796 - DNA, 16 bp, Homo sapiens
cacagcccaaccagga

SEQ ID NO: 309797 - DNA, 23 bp, Homo sapiens
cacagcccagccacggacgctgg

SEQ ID NO: 309798 - DNA, 18 bp, Homo sapiens
cacagccctgtcagtgca

SEQ ID NO: 309799 - DNA, 23 bp, Homo sapiens
cacagccctgtcagtgcagcccg

SEQ ID NO: 309800 - DNA, 19 bp, Homo sapiens
cacagccggggcctgccta

SEQ ID NO: 309801 - DNA, 18 bp, Homo sapiens
cacagcctaggaccagtt

SEQ ID NO: 309802 - DNA, 15 bp, Homo sapiens
cacagcctcacccct

SEQ ID NO: 309803 - DNA, 21 bp, Homo sapiens
cacagcctcacccctgcaggc

SEQ ID NO: 309804 - DNA, 16 bp, Homo sapiens
cacagcctccagggcc

SEQ ID NO: 309805 - DNA, 13 bp, Homo sapiens
cacagcctctccc

SEQ ID NO: 309806 - DNA, 15 bp, Homo sapiens
cacagcctctccctt

SEQ ID NO: 309807 - DNA, 14 bp, Homo sapiens
cacagcctggcctc

SEQ ID NO: 309808 - DNA, 23 bp, Homo sapiens
cacagcctggcctcccctgcgga

SEQ ID NO: 309809 - DNA, 21 bp, Homo sapiens
cacagcctgtcttcagatcct

SEQ ID NO: 309810 - DNA, 16 bp, Homo sapiens
cacagcctttctgtat

SEQ ID NO: 309811 - DNA, 22 bp, Homo sapiens
cacagctcctcttaccgtagcc

SEQ ID NO: 309812 - DNA, 16 bp, Homo sapiens
cacagctctcactggc

SEQ ID NO: 309813 - DNA, 18 bp, Homo sapiens
cacagctgagctggccta

SEQ ID NO: 309814 - DNA, 18 bp, Homo sapiens
cacagctgcagagacaga

SEQ ID NO: 309815 - DNA, 17 bp, Homo sapiens
cacagctgcagctgggc

SEQ ID NO: 309816 - DNA, 13 bp, Homo sapiens
cacagctgctgga

SEQ ID NO: 309817 - DNA, 15 bp, Homo sapiens
cacagctgctggaga

SEQ ID NO: 309818 - DNA, 16 bp, Homo sapiens
cacagctgctggagaa

SEQ ID NO: 309819 - DNA, 22 bp, Homo sapiens
cacagctgctggagaataaatt

SEQ ID NO: 309820 - DNA, 14 bp, Homo sapiens
cacagctgctggcc

SEQ ID NO: 309821 - DNA, 17 bp, Homo sapiens
cacagctgctggccagg

SEQ ID NO: 309822 - DNA, 14 bp, Homo sapiens
cacagctgctgtgc

SEQ ID NO: 309823 - DNA, 19 bp, Homo sapiens
cacagctgctgtgccagga

SEQ ID NO: 309824 - DNA, 14 bp, Homo sapiens
cacagctgggcaaa

SEQ ID NO: 309825 - DNA, 15 bp, Homo sapiens
cacagcttcctgagg

SEQ ID NO: 309826 - DNA, 17 bp, Homo sapiens
cacagcttcctgagggc

SEQ ID NO: 309827 - DNA, 12 bp, Homo sapiens
cacagcttcttt

SEQ ID NO: 309828 - DNA, 14 bp, Homo sapiens
cacagcttgttttg

SEQ ID NO: 309829 - DNA, 16 bp, Homo sapiens
cacagcttgttttgga

SEQ ID NO: 309830 - DNA, 16 bp, Homo sapiens
cacagctttcccaggt

SEQ ID NO: 309831 - DNA, 22 bp, Homo sapiens
cacaggaagccgcctagtgcag

SEQ ID NO: 309832 - DNA, 17 bp, Homo sapiens
cacaggacacagtcaga

SEQ ID NO: 309833 - DNA, 15 bp, Homo sapiens
cacaggactctgcct

SEQ ID NO: 309834 - DNA, 17 bp, Homo sapiens
cacaggagggtaatttt

SEQ ID NO: 309835 - DNA, 12 bp, Homo sapiens
cacaggcaaaga

SEQ ID NO: 309836 - DNA, 21 bp, Homo sapiens
cacaggcaaagaggtgctgct

SEQ ID NO: 309837 - DNA, 22 bp, Homo sapiens
cacaggcaaagaggtgctgctt

SEQ ID NO: 309838 - DNA, 16 bp, Homo sapiens
cacaggcaacattaca

SEQ ID NO: 309839 - DNA, 11 bp, Homo sapiens
cacaggcagct

SEQ ID NO: 309840 - DNA, 23 bp, Homo sapiens
cacaggcagtgcatgtgaagcat

SEQ ID NO: 309841 - DNA, 13 bp, Homo sapiens
cacaggccacacg

SEQ ID NO: 309842 - DNA, 18 bp, Homo sapiens
cacaggcccttcctctcc

SEQ ID NO: 309843 - DNA, 23 bp, Homo sapiens
cacaggcccttcctctccactgc

SEQ ID NO: 309844 - DNA, 14 bp, Homo sapiens
cacaggcctggccc

SEQ ID NO: 309845 - DNA, 19 bp, Homo sapiens
cacaggcctggcccagcca

SEQ ID NO: 309846 - DNA, 20 bp, Homo sapiens
cacaggcctggcccagccag

SEQ ID NO: 309847 - DNA, 21 bp, Homo sapiens
cacaggcctggcccagccagc

SEQ ID NO: 309848 - DNA, 23 bp, Homo sapiens
cacaggcctggcccagccagcag

SEQ ID NO: 309849 - DNA, 16 bp, Homo sapiens
cacagggacagatctg

SEQ ID NO: 309850 - DNA, 14 bp, Homo sapiens
cacagggcctgact

SEQ ID NO: 309851 - DNA, 15 bp, Homo sapiens
cacagggcctgactt

SEQ ID NO: 309852 - DNA, 18 bp, Homo sapiens
cacagggcctgactttta

SEQ ID NO: 309853 - DNA, 16 bp, Homo sapiens
cacagggctctttgat

SEQ ID NO: 309854 - DNA, 16 bp, Homo sapiens
cacaggggacactgaa

SEQ ID NO: 309855 - DNA, 15 bp, Homo sapiens
aggcgggggagcctg

SEQ ID NO: 309856 - DNA, 16 bp, Homo sapiens
aggcgggggagcctgg

SEQ ID NO: 309857 - DNA, 19 bp, Homo sapiens
aggcgggggagcctggagc

SEQ ID NO: 309858 - DNA, 21 bp, Homo sapiens
aggcgggggagcctggagccc

SEQ ID NO: 309859 - DNA, 23 bp, Homo sapiens
aggcgggggagcctggagcccct

SEQ ID NO: 309860 - DNA, 21 bp, Homo sapiens
aggcgggggatcctggagccc

SEQ ID NO: 309861 - DNA, 17 bp, Homo sapiens
aggcggtatccagaggt

SEQ ID NO: 309862 - DNA, 19 bp, Homo sapiens
aggcgtagggccagggctc

SEQ ID NO: 309863 - DNA, 13 bp, Homo sapiens
aggcgtcttgtat

SEQ ID NO: 309864 - DNA, 12 bp, Homo sapiens
aggcgtgatcca

SEQ ID NO: 309865 - DNA, 17 bp, Homo sapiens
aggcgtgcccccctcct

SEQ ID NO: 309866 - DNA, 18 bp, Homo sapiens
aggcgtgcccccctcctc

SEQ ID NO: 309867 - DNA, 22 bp, Homo sapiens
aggcgtgcccccctcctccagt

SEQ ID NO: 309868 - DNA, 17 bp, Homo sapiens
aggcgttagtgggcagg

SEQ ID NO: 309869 - DNA, 19 bp, Homo sapiens
aggcgttagtgggcaggtg

SEQ ID NO: 309870 - DNA, 20 bp, Homo sapiens
aggctaaagaagacacacag

SEQ ID NO: 309871 - DNA, 18 bp, Homo sapiens
aggctaagttcagttctg

SEQ ID NO: 309872 - DNA, 20 bp, Homo sapiens
aggctaatcaatacccttgg

SEQ ID NO: 309873 - DNA, 21 bp, Homo sapiens
aggctaatcaatacccttggc

SEQ ID NO: 309874 - DNA, 14 bp, Homo sapiens
aggctacagaatga

SEQ ID NO: 309875 - DNA, 13 bp, Homo sapiens
aggctactcacct

SEQ ID NO: 309876 - DNA, 16 bp, Homo sapiens
aggctattcctaggcc

SEQ ID NO: 309877 - DNA, 18 bp, Homo sapiens
aggctatttgttcagaga

SEQ ID NO: 309878 - DNA, 16 bp, Homo sapiens
aggctcacaactgttt

SEQ ID NO: 309879 - DNA, 15 bp, Homo sapiens
aggctcactctttcc

SEQ ID NO: 309880 - DNA, 13 bp, Homo sapiens
aggctcaggccat

SEQ ID NO: 309881 - DNA, 16 bp, Homo sapiens
aggctccccgcctcca

SEQ ID NO: 309882 - DNA, 13 bp, Homo sapiens
aggctcccctgcc

SEQ ID NO: 309883 - DNA, 16 bp, Homo sapiens
aggctcccctggtctc

SEQ ID NO: 309884 - DNA, 12 bp, Homo sapiens
aggctcctcctc

SEQ ID NO: 309885 - DNA, 13 bp, Homo sapiens
aggctcctggagc

SEQ ID NO: 309886 - DNA, 18 bp, Homo sapiens
aggctcctggagccagcc

SEQ ID NO: 309887 - DNA, 23 bp, Homo sapiens
aggctctatttcggaaatacact

SEQ ID NO: 309888 - DNA, 16 bp, Homo sapiens
aggctctcccctctcg

SEQ ID NO: 309889 - DNA, 22 bp, Homo sapiens
aggctctccctctctgcacctg

SEQ ID NO: 309890 - DNA, 18 bp, Homo sapiens
aggctctgaaagctgctt

SEQ ID NO: 309891 - DNA, 19 bp, Homo sapiens
aggctctgaatctctcaaa

SEQ ID NO: 309892 - DNA, 21 bp, Homo sapiens
aggctctgctgacttctgagc

SEQ ID NO: 309893 - DNA, 22 bp, Homo sapiens
aggctctgctgacttctgagca

SEQ ID NO: 309894 - DNA, 13 bp, Homo sapiens
aggctctgggctc

SEQ ID NO: 309895 - DNA, 15 bp, Homo sapiens
aggctctgggctcag

SEQ ID NO: 309896 - DNA, 21 bp, Homo sapiens
aggctctgggctcagggctgg

SEQ ID NO: 309897 - DNA, 22 bp, Homo sapiens
aggctcttagcagcttccagat

SEQ ID NO: 309898 - DNA, 19 bp, Homo sapiens
aggctcttcctggacctga

SEQ ID NO: 309899 - DNA, 18 bp, Homo sapiens
caccaggtcctgtgagca

SEQ ID NO: 309900 - DNA, 11 bp, Homo sapiens
caccagtgcct

SEQ ID NO: 309901 - DNA, 19 bp, Homo sapiens
caccagttaaaagcatttt

SEQ ID NO: 309902 - DNA, 14 bp, Homo sapiens
caccagttactgtt

SEQ ID NO: 309903 - DNA, 16 bp, Homo sapiens
caccatagtttacaat

SEQ ID NO: 309904 - DNA, 21 bp, Homo sapiens
caccatcacagcttgttttgg

SEQ ID NO: 309905 - DNA, 14 bp, Homo sapiens
caccatctcaggcc

SEQ ID NO: 309906 - DNA, 20 bp, Homo sapiens
caccatctcaggccacctgc

SEQ ID NO: 309907 - DNA, 12 bp, Homo sapiens
caccatggccag

SEQ ID NO: 309908 - DNA, 19 bp, Homo sapiens
caccatgggaaactgttgt

SEQ ID NO: 309909 - DNA, 18 bp, Homo sapiens
caccatgtaaaacaaaaa

SEQ ID NO: 309910 - DNA, 19 bp, Homo sapiens
caccatgttggccaggctg

SEQ ID NO: 309911 - DNA, 18 bp, Homo sapiens
caccattaacaggtcttt

SEQ ID NO: 309912 - DNA, 20 bp, Homo sapiens
caccattgtgaagcacctac

SEQ ID NO: 309913 - DNA, 22 bp, Homo sapiens
caccatttaatcatttccagca

SEQ ID NO: 309914 - DNA, 11 bp, Homo sapiens
caccatttcat

SEQ ID NO: 309915 - DNA, 12 bp, Homo sapiens
cacccaacactt

SEQ ID NO: 309916 - DNA, 14 bp, Homo sapiens
cacccaagcttggc

SEQ ID NO: 309917 - DNA, 19 bp, Homo sapiens
cacccaagcttggcagccg

SEQ ID NO: 309918 - DNA, 15 bp, Homo sapiens
cacccacacactcgc

SEQ ID NO: 309919 - DNA, 20 bp, Homo sapiens
cacccacaccccgtctgccc

SEQ ID NO: 309920 - DNA, 16 bp, Homo sapiens
cacccaccagggctca

SEQ ID NO: 309921 - DNA, 23 bp, Homo sapiens
cacccaccagggctcagctcctt

SEQ ID NO: 309922 - DNA, 16 bp, Homo sapiens
cacccacccctcctgg

SEQ ID NO: 309923 - DNA, 15 bp, Homo sapiens
cacccacccctgccc

SEQ ID NO: 309924 - DNA, 17 bp, Homo sapiens
cacccacccctgcccag

SEQ ID NO: 309925 - DNA, 14 bp, Homo sapiens
cacccaccctctgg

SEQ ID NO: 309926 - DNA, 22 bp, Homo sapiens
cacccacccttctcccctgccc

SEQ ID NO: 309927 - DNA, 16 bp, Homo sapiens
cacccacctcagcctc

SEQ ID NO: 309928 - DNA, 13 bp, Homo sapiens
cacccacctccac

SEQ ID NO: 309929 - DNA, 16 bp, Homo sapiens
cacccactcaggattg

SEQ ID NO: 309930 - DNA, 22 bp, Homo sapiens
cacccactgtggggcaagcctg

SEQ ID NO: 309931 - DNA, 11 bp, Homo sapiens
cacccagaagg

SEQ ID NO: 309932 - DNA, 16 bp, Homo sapiens
cacccagaaggaaccc

SEQ ID NO: 309933 - DNA, 20 bp, Homo sapiens
cacccagaatgtagcatctg

SEQ ID NO: 309934 - DNA, 19 bp, Homo sapiens
cacccagcaaggcacaggc

SEQ ID NO: 309935 - DNA, 12 bp, Homo sapiens
cacccagctcca

SEQ ID NO: 309936 - DNA, 13 bp, Homo sapiens
cacccagctccag

SEQ ID NO: 309937 - DNA, 15 bp, Homo sapiens
cacccagctccaggg

SEQ ID NO: 309938 - DNA, 11 bp, Homo sapiens
cacccaggaag

SEQ ID NO: 309939 - DNA, 16 bp, Homo sapiens
cacccaggctgcactg

SEQ ID NO: 309940 - DNA, 19 bp, Homo sapiens
cacccaggctgcactgcag

SEQ ID NO: 309941 - DNA, 21 bp, Homo sapiens
cacccaggctgcactgcagtg

SEQ ID NO: 309942 - DNA, 16 bp, Homo sapiens
cacccagggctccctc

SEQ ID NO: 309943 - DNA, 17 bp, Homo sapiens
cacccagtctgttcccc

SEQ ID NO: 309944 - DNA, 13 bp, Homo sapiens
cacccagtgctgc

SEQ ID NO: 309945 - DNA, 20 bp, Homo sapiens
cacccatcttcctgctgctg

SEQ ID NO: 309946 - DNA, 21 bp, Homo sapiens
cacccatcttcctgctgctgt

SEQ ID NO: 309947 - DNA, 20 bp, Homo sapiens
cacccatgactgccccttgc

SEQ ID NO: 309948 - DNA, 16 bp, Homo sapiens
cacccatgcacagaac

SEQ ID NO: 309949 - DNA, 13 bp, Homo sapiens
cacccattgtctc

SEQ ID NO: 309950 - DNA, 17 bp, Homo sapiens
cacccattgtctcattg

SEQ ID NO: 309951 - DNA, 15 bp, Homo sapiens
cacccattttcacat

SEQ ID NO: 309952 - DNA, 17 bp, Homo sapiens
caccccaaaccccagcc

SEQ ID NO: 309953 - DNA, 17 bp, Homo sapiens
caccccaaacttccagg

SEQ ID NO: 309954 - DNA, 18 bp, Homo sapiens
caccccaaagctttcctg

SEQ ID NO: 309955 - DNA, 16 bp, Homo sapiens
caccccaactctcccc

SEQ ID NO: 309956 - DNA, 14 bp, Homo sapiens
caccccactcacag

SEQ ID NO: 309957 - DNA, 17 bp, Homo sapiens
caccccagcattccagc

SEQ ID NO: 309958 - DNA, 21 bp, Homo sapiens
caccccagcattccagctctg

SEQ ID NO: 309959 - DNA, 18 bp, Homo sapiens
caccccagcccaccctgc

SEQ ID NO: 309960 - DNA, 14 bp, Homo sapiens
caccccagtccccg

SEQ ID NO: 309961 - DNA, 16 bp, Homo sapiens
caccccagtccccggg

SEQ ID NO: 309962 - DNA, 18 bp, Homo sapiens
caccccagtgcacccact

SEQ ID NO: 309963 - DNA, 15 bp, Homo sapiens
caccccagtgcctgt

SEQ ID NO: 309964 - DNA, 12 bp, Homo sapiens
caccccatccca

SEQ ID NO: 309965 - DNA, 21 bp, Homo sapiens
caccccatcccacaccctgga

SEQ ID NO: 309966 - DNA, 15 bp, Homo sapiens
caccccatgccaaag

SEQ ID NO: 309967 - DNA, 14 bp, Homo sapiens
cacccccacccacc

SEQ ID NO: 309968 - DNA, 13 bp, Homo sapiens
cacccccacccct

SEQ ID NO: 309969 - DNA, 17 bp, Homo sapiens
cacccccacccctgtac

SEQ ID NO: 309970 - DNA, 10 bp, Homo sapiens
cacccccagc

SEQ ID NO: 309971 - DNA, 17 bp, Homo sapiens
cacccccagcctccccc

SEQ ID NO: 309972 - DNA, 13 bp, Homo sapiens
cacccccatctct

SEQ ID NO: 309973 - DNA, 17 bp, Homo sapiens
cacccccatctctccct

SEQ ID NO: 309974 - DNA, 13 bp, Homo sapiens
cacccccatgctg

SEQ ID NO: 309975 - DNA, 13 bp, Homo sapiens
caccccctgtccc

SEQ ID NO: 309976 - DNA, 18 bp, Homo sapiens
caccccgctgcctggcgg

SEQ ID NO: 309977 - DNA, 23 bp, Homo sapiens
caccccgctgcctggcgggcagc

SEQ ID NO: 309978 - DNA, 18 bp, Homo sapiens
caccccggcaggccctgc

SEQ ID NO: 309979 - DNA, 18 bp, Homo sapiens
caccccggcctccactcc

SEQ ID NO: 309980 - DNA, 19 bp, Homo sapiens
caccccggcctccactccc

SEQ ID NO: 309981 - DNA, 22 bp, Homo sapiens
caccccggctccccctgccagc

SEQ ID NO: 309982 - DNA, 15 bp, Homo sapiens
caccccgggctctct

SEQ ID NO: 309983 - DNA, 15 bp, Homo sapiens
caccccgtctgcccc

SEQ ID NO: 309984 - DNA, 16 bp, Homo sapiens
caccccgtctgcccct

SEQ ID NO: 309985 - DNA, 20 bp, Homo sapiens
cacccctaagtgcccaaagt

SEQ ID NO: 309986 - DNA, 17 bp, Homo sapiens
cacctaccctcaaagta

SEQ ID NO: 309987 - DNA, 18 bp, Homo sapiens
cacctaccttcaaagctg

SEQ ID NO: 309988 - DNA, 20 bp, Homo sapiens
cacctactacatcgccctcc

SEQ ID NO: 309989 - DNA, 20 bp, Homo sapiens
cacctactatgtgctgggtg

SEQ ID NO: 309990 - DNA, 21 bp, Homo sapiens
cacctactatgtgctgggtgc

SEQ ID NO: 309991 - DNA, 13 bp, Homo sapiens
cacctagatcaga

SEQ ID NO: 309992 - DNA, 12 bp, Homo sapiens
cacctataaata

SEQ ID NO: 309993 - DNA, 21 bp, Homo sapiens
cacctataaatactaaatatg

SEQ ID NO: 309994 - DNA, 22 bp, Homo sapiens
cacctataaatactaaatatga

SEQ ID NO: 309995 - DNA, 21 bp, Homo sapiens
cacctatgagatggccatgct

SEQ ID NO: 309996 - DNA, 22 bp, Homo sapiens
cacctatgagatggccatgctc

SEQ ID NO: 309997 - DNA, 18 bp, Homo sapiens
cacctatgcctgtggtga

SEQ ID NO: 309998 - DNA, 15 bp, Homo sapiens
cacctcacaactcct

SEQ ID NO: 309999 - DNA, 16 bp, Homo sapiens
cacctcacgctctgga

SEQ ID NO: 310000 - DNA, 14 bp, Homo sapiens
cacctcactcctgt

SEQ ID NO: 310001 - DNA, 11 bp, Homo sapiens
cacctcagaaa

SEQ ID NO: 310002 - DNA, 17 bp, Homo sapiens
cacctcagaaagtcacc

SEQ ID NO: 310003 - DNA, 20 bp, Homo sapiens
cacctcagaaagtcaccagg

SEQ ID NO: 310004 - DNA, 16 bp, Homo sapiens
cacctcagagccccgc

SEQ ID NO: 310005 - DNA, 14 bp, Homo sapiens
cacctcaggacccc

SEQ ID NO: 310006 - DNA, 21 bp, Homo sapiens
cacctcagttcccttggcctc

SEQ ID NO: 310007 - DNA, 22 bp, Homo sapiens
cacctcagttcccttggcctca

SEQ ID NO: 310008 - DNA, 12 bp, Homo sapiens
cacctcatatgc

SEQ ID NO: 310009 - DNA, 15 bp, Homo sapiens
cacctccacccagcc

SEQ ID NO: 310010 - DNA, 16 bp, Homo sapiens
cacctccacccagccc

SEQ ID NO: 310011 - DNA, 19 bp, Homo sapiens
cacctccacccagcccctg

SEQ ID NO: 310012 - DNA, 20 bp, Homo sapiens
cacctccacccagcccctgg

SEQ ID NO: 310013 - DNA, 13 bp, Homo sapiens
cacctccaccccc

SEQ ID NO: 310014 - DNA, 12 bp, Homo sapiens
cacctccacccg

SEQ ID NO: 310015 - DNA, 22 bp, Homo sapiens
cacctccagtccccctatcctt

SEQ ID NO: 310016 - DNA, 17 bp, Homo sapiens
cacctccatttcttggt

SEQ ID NO: 310017 - DNA, 11 bp, Homo sapiens
cacctccccca

SEQ ID NO: 310018 - DNA, 14 bp, Homo sapiens
cacctcccctcctt

SEQ ID NO: 310019 - DNA, 10 bp, Homo sapiens
cacctccctc

SEQ ID NO: 310020 - DNA, 13 bp, Homo sapiens
cacctccctgccc

SEQ ID NO: 310021 - DNA, 17 bp, Homo sapiens
cacctccctgcccaggc

SEQ ID NO: 310022 - DNA, 23 bp, Homo sapiens
cacctccgttgcggctgtgctcc

SEQ ID NO: 310023 - DNA, 17 bp, Homo sapiens
cacctcctaccctccca

SEQ ID NO: 310024 - DNA, 21 bp, Homo sapiens
cacctcctccaagaagccctc

SEQ ID NO: 310025 - DNA, 13 bp, Homo sapiens
cacctcctccact

SEQ ID NO: 310026 - DNA, 23 bp, Homo sapiens
cacctcctccactcactccagcc

SEQ ID NO: 310027 - DNA, 13 bp, Homo sapiens
cacctcctccagc

SEQ ID NO: 310028 - DNA, 15 bp, Homo sapiens
cacctcctctctgct

SEQ ID NO: 310029 - DNA, 16 bp, Homo sapiens
cacctcctctcttgga

SEQ ID NO: 310030 - DNA, 22 bp, Homo sapiens
cacctccttgtcactttattac

SEQ ID NO: 310031 - DNA, 15 bp, Homo sapiens
cacctcgcggcgcag

SEQ ID NO: 310032 - DNA, 14 bp, Homo sapiens
cacctctaggcctc

SEQ ID NO: 310033 - DNA, 21 bp, Homo sapiens
cacctctcaatattcaataaa

SEQ ID NO: 310034 - DNA, 14 bp, Homo sapiens
cacctctccctcaa

SEQ ID NO: 310035 - DNA, 18 bp, Homo sapiens
cacctctctgtctttttc

SEQ ID NO: 310036 - DNA, 15 bp, Homo sapiens
cacctctgctgccca

SEQ ID NO: 310037 - DNA, 18 bp, Homo sapiens
cacctctggactggctag

SEQ ID NO: 310038 - DNA, 19 bp, Homo sapiens
cacctctggactggctaga

SEQ ID NO: 310039 - DNA, 24 bp, Homo sapiens
cacctctggccaaatatgcacttt

SEQ ID NO: 310040 - DNA, 18 bp, Homo sapiens
cacctctggccctgttgt

SEQ ID NO: 310041 - DNA, 14 bp, Homo sapiens
cacctctgggccct

SEQ ID NO: 310042 - DNA, 22 bp, Homo sapiens
cacctctgggccctgcaggagg

SEQ ID NO: 310043 - DNA, 13 bp, Homo sapiens
cacctctgggctt

SEQ ID NO: 310044 - DNA, 13 bp, Homo sapiens
cacctctttgtca

SEQ ID NO: 310045 - DNA, 11 bp, Homo sapiens
cacctgacaca

SEQ ID NO: 310046 - DNA, 14 bp, Homo sapiens
cacctgagctggtg

SEQ ID NO: 310047 - DNA, 18 bp, Homo sapiens
cacctgagctttggacac

SEQ ID NO: 310048 - DNA, 21 bp, Homo sapiens
cacctgaggcccagcagagcc

SEQ ID NO: 310049 - DNA, 11 bp, Homo sapiens
cacctgcagcc

SEQ ID NO: 310050 - DNA, 17 bp, Homo sapiens
cacctgcatcagcctct

SEQ ID NO: 310051 - DNA, 18 bp, Homo sapiens
cacctgcatcagcctctg

SEQ ID NO: 310052 - DNA, 19 bp, Homo sapiens
cacctgcatcagcctctgg

SEQ ID NO: 310053 - DNA, 22 bp, Homo sapiens
cacctgcatcagcctctggcca

SEQ ID NO: 310054 - DNA, 23 bp, Homo sapiens
cacctgcatcagcctctggccag

SEQ ID NO: 310055 - DNA, 23 bp, Homo sapiens
cacctgccactaggctgggtgcc

SEQ ID NO: 310056 - DNA, 13 bp, Homo sapiens
cacctgcccagat

SEQ ID NO: 310057 - DNA, 12 bp, Homo sapiens
cacctgcccagt

SEQ ID NO: 310058 - DNA, 21 bp, Homo sapiens
cacctgcccagttagcccggc

SEQ ID NO: 310059 - DNA, 18 bp, Homo sapiens
cacctgcccatcacaggg

SEQ ID NO: 310060 - DNA, 13 bp, Homo sapiens
cacctgccccctt

SEQ ID NO: 310061 - DNA, 17 bp, Homo sapiens
cacctgcccccttctcc

SEQ ID NO: 310062 - DNA, 14 bp, Homo sapiens
cacctgccctgccc

SEQ ID NO: 310063 - DNA, 17 bp, Homo sapiens
cacctgccctgccctgc

SEQ ID NO: 310064 - DNA, 18 bp, Homo sapiens
cacctgcctcggcctccc

SEQ ID NO: 310065 - DNA, 15 bp, Homo sapiens
cacctgcctctgaac

SEQ ID NO: 310066 - DNA, 17 bp, Homo sapiens
cacctgcctctgaactg

SEQ ID NO: 310067 - DNA, 12 bp, Homo sapiens
cacctgcctgac

SEQ ID NO: 310068 - DNA, 14 bp, Homo sapiens
cacctgcctgcaga

SEQ ID NO: 310069 - DNA, 23 bp, Homo sapiens
cacctgcctgcagagcaggaaat

SEQ ID NO: 310070 - DNA, 13 bp, Homo sapiens
cacctgctggaaa

SEQ ID NO: 310071 - DNA, 13 bp, Homo sapiens
cacctgctggccc

SEQ ID NO: 310072 - DNA, 14 bp, Homo sapiens
cacctgctggcccc

SEQ ID NO: 310073 - DNA, 16 bp, Homo sapiens
cacctgctggcccctc

SEQ ID NO: 310074 - DNA, 22 bp, Homo sapiens
cacctgctggcccctcacctgg

SEQ ID NO: 310075 - DNA, 23 bp, Homo sapiens
cacctggagcccacagagtctgt

SEQ ID NO: 310076 - DNA, 18 bp, Homo sapiens
cacctggatggatctgct

SEQ ID NO: 310077 - DNA, 20 bp, Homo sapiens
cacctggatggatctgctcc

SEQ ID NO: 310078 - DNA, 12 bp, Homo sapiens
cacctggcctgc

SEQ ID NO: 310079 - DNA, 22 bp, Homo sapiens
cacctggcggccctaagccact

SEQ ID NO: 310080 - DNA, 17 bp, Homo sapiens
cacctgggagatgctgg

SEQ ID NO: 310081 - DNA, 12 bp, Homo sapiens
cacctgggcacc

SEQ ID NO: 310082 - DNA, 15 bp, Homo sapiens
cacctgggcacctgg

SEQ ID NO: 310083 - DNA, 18 bp, Homo sapiens
cacctgggccaccatgca

SEQ ID NO: 310084 - DNA, 22 bp, Homo sapiens
cacctgggcccgggcaggccag

SEQ ID NO: 310085 - DNA, 13 bp, Homo sapiens
cacctgggcccta

SEQ ID NO: 310086 - DNA, 17 bp, Homo sapiens
cacctgggccctaggca

SEQ ID NO: 310087 - DNA, 14 bp, Homo sapiens
cacctgggcctccc

SEQ ID NO: 310088 - DNA, 15 bp, Homo sapiens
cacctgggcctttcc

SEQ ID NO: 310089 - DNA, 13 bp, Homo sapiens
cacctgggctggg

SEQ ID NO: 310090 - DNA, 22 bp, Homo sapiens
cacctgggctgggagaaggtgc

SEQ ID NO: 310091 - DNA, 14 bp, Homo sapiens
cacctgggctgggc

SEQ ID NO: 310092 - DNA, 15 bp, Homo sapiens
cacctgggctttctg

SEQ ID NO: 310093 - DNA, 15 bp, Homo sapiens
cacctggggagtggg

SEQ ID NO: 310094 - DNA, 20 bp, Homo sapiens
cacctggggcagtcacctgc

SEQ ID NO: 310095 - DNA, 23 bp, Homo sapiens
cacctggttccggaatcctgtcc

SEQ ID NO: 310096 - DNA, 17 bp, Homo sapiens
cacctgtaatctcagca

SEQ ID NO: 310097 - DNA, 14 bp, Homo sapiens
cacctgtacataca

SEQ ID NO: 310098 - DNA, 18 bp, Homo sapiens
cacctgtagtcccagcta

SEQ ID NO: 310099 - DNA, 22 bp, Homo sapiens
cacctgtagtcccagctacttg

SEQ ID NO: 310100 - DNA, 12 bp, Homo sapiens
cacctgtatacc

SEQ ID NO: 310101 - DNA, 13 bp, Homo sapiens
cacctgtcccacc

SEQ ID NO: 310102 - DNA, 14 bp, Homo sapiens
cacctgtcccacct

SEQ ID NO: 310103 - DNA, 17 bp, Homo sapiens
cacctgtctcagcctcc

SEQ ID NO: 310104 - DNA, 18 bp, Homo sapiens
cacctgtctcagcctccc

SEQ ID NO: 310105 - DNA, 19 bp, Homo sapiens
cacctgtctcagcctccca

SEQ ID NO: 310106 - DNA, 18 bp, Homo sapiens
cacctgtctcatagcctc

SEQ ID NO: 310107 - DNA, 11 bp, Homo sapiens
cacctgtctgt

SEQ ID NO: 310108 - DNA, 12 bp, Homo sapiens
cacctgtctgtc

SEQ ID NO: 310109 - DNA, 13 bp, Homo sapiens
cacctgtgctgct

SEQ ID NO: 310110 - DNA, 16 bp, Homo sapiens
cacctgtgctgctgca

SEQ ID NO: 310111 - DNA, 20 bp, Homo sapiens
cacctgtggccagagcacct

SEQ ID NO: 310112 - DNA, 18 bp, Homo sapiens
cacctgtggcctctcagt

SEQ ID NO: 310113 - DNA, 14 bp, Homo sapiens
cacctgtgtgttct

SEQ ID NO: 310114 - DNA, 17 bp, Homo sapiens
cacctgtgtgttctttt

SEQ ID NO: 310115 - DNA, 20 bp, Homo sapiens
cacctgtgtgttcttttgat

SEQ ID NO: 310116 - DNA, 23 bp, Homo sapiens
cacctgtgtgttcttttgataca

SEQ ID NO: 310117 - DNA, 17 bp, Homo sapiens
cactactcacagtctct

SEQ ID NO: 310118 - DNA, 20 bp, Homo sapiens
cactactcctctgcagtgcc

SEQ ID NO: 310119 - DNA, 13 bp, Homo sapiens
cactactctgtgc

SEQ ID NO: 310120 - DNA, 12 bp, Homo sapiens
cactacttactt

SEQ ID NO: 310121 - DNA, 12 bp, Homo sapiens
cactagagacaa

SEQ ID NO: 310122 - DNA, 20 bp, Homo sapiens
cactagagacaaatctttaa

SEQ ID NO: 310123 - DNA, 18 bp, Homo sapiens
cactagccaacccaactg

SEQ ID NO: 310124 - DNA, 16 bp, Homo sapiens
cactagccctctttct

SEQ ID NO: 310125 - DNA, 22 bp, Homo sapiens
cactagccctctttctctctgt

SEQ ID NO: 310126 - DNA, 20 bp, Homo sapiens
cactaggaatcccagaggtg

SEQ ID NO: 310127 - DNA, 17 bp, Homo sapiens
cactaggataggaactg

SEQ ID NO: 310128 - DNA, 13 bp, Homo sapiens
cactaggctgggt

SEQ ID NO: 310129 - DNA, 23 bp, Homo sapiens
cactagtagagcaaagacttaat

SEQ ID NO: 310130 - DNA, 15 bp, Homo sapiens
cactagtctgtgtgc

SEQ ID NO: 310131 - DNA, 12 bp, Homo sapiens
cactataaatgg

SEQ ID NO: 310132 - DNA, 22 bp, Homo sapiens
cactataaccatcagttactgg

SEQ ID NO: 310133 - DNA, 14 bp, Homo sapiens
cactatgtttctca

SEQ ID NO: 310134 - DNA, 15 bp, Homo sapiens
cactatgtttctcag

SEQ ID NO: 310135 - DNA, 15 bp, Homo sapiens
cactattagagaaac

SEQ ID NO: 310136 - DNA, 21 bp, Homo sapiens
cactattcagaacttgtaact

SEQ ID NO: 310137 - DNA, 18 bp, Homo sapiens
cactattcttaagcactt

SEQ ID NO: 310138 - DNA, 14 bp, Homo sapiens
cactattgtttaga

SEQ ID NO: 310139 - DNA, 17 bp, Homo sapiens
cactatttttatttata

SEQ ID NO: 310140 - DNA, 19 bp, Homo sapiens
cactcaaattaatctttct

SEQ ID NO: 310141 - DNA, 20 bp, Homo sapiens
cactcaaattaatctttctt

SEQ ID NO: 310142 - DNA, 18 bp, Homo sapiens
cactcaaccataacactt

SEQ ID NO: 310143 - DNA, 13 bp, Homo sapiens
cactcaagcttgg

SEQ ID NO: 310144 - DNA, 12 bp, Homo sapiens
cactcaccaggg

SEQ ID NO: 310145 - DNA, 24 bp, Homo sapiens
cactcaccagggtccgcaccagct

SEQ ID NO: 310146 - DNA, 15 bp, Homo sapiens
cactcaccagtccta

SEQ ID NO: 310147 - DNA, 13 bp, Homo sapiens
cactcaccccctt

SEQ ID NO: 310148 - DNA, 21 bp, Homo sapiens
cactcaccccctttgctgtga

SEQ ID NO: 310149 - DNA, 14 bp, Homo sapiens
cactcactccagcc

SEQ ID NO: 310150 - DNA, 15 bp, Homo sapiens
cactcactccagccc

SEQ ID NO: 310151 - DNA, 13 bp, Homo sapiens
cactcactgcatt

SEQ ID NO: 310152 - DNA, 13 bp, Homo sapiens
cactcagcagccc

SEQ ID NO: 310153 - DNA, 14 bp, Homo sapiens
cactcagcagcccc

SEQ ID NO: 310154 - DNA, 23 bp, Homo sapiens
cactcagcatccccaaccgtgca

SEQ ID NO: 310155 - DNA, 15 bp, Homo sapiens
cactcaggattggga

SEQ ID NO: 310156 - DNA, 15 bp, Homo sapiens
cactcagggctggcc

SEQ ID NO: 310157 - DNA, 17 bp, Homo sapiens
cactcagtcccccacca

SEQ ID NO: 310158 - DNA, 23 bp, Homo sapiens
cactcagtcccccaccacactga

SEQ ID NO: 310159 - DNA, 19 bp, Homo sapiens
cactcagtgcagcaatata

SEQ ID NO: 310160 - DNA, 19 bp, Homo sapiens
cactcagtgtggactggga

SEQ ID NO: 310161 - DNA, 20 bp, Homo sapiens
cactcatgcggcccagccat

SEQ ID NO: 310162 - DNA, 13 bp, Homo sapiens
cactccactcccc

SEQ ID NO: 310163 - DNA, 20 bp, Homo sapiens
cactccaggaaggggctgga

SEQ ID NO: 310164 - DNA, 15 bp, Homo sapiens
cactccatggccacc

SEQ ID NO: 310165 - DNA, 14 bp, Homo sapiens
cactccattctcag

SEQ ID NO: 310166 - DNA, 13 bp, Homo sapiens
cactcccactgcc

SEQ ID NO: 310167 - DNA, 15 bp, Homo sapiens
cactccccagcccca

SEQ ID NO: 310168 - DNA, 15 bp, Homo sapiens
cactcccccacctga

SEQ ID NO: 310169 - DNA, 13 bp, Homo sapiens
cactccctgctcc

SEQ ID NO: 310170 - DNA, 14 bp, Homo sapiens
cactccctgctcca

SEQ ID NO: 310171 - DNA, 20 bp, Homo sapiens
cactccctgctccacgaagc

SEQ ID NO: 310172 - DNA, 18 bp, Homo sapiens
cactccctttgtggactt

SEQ ID NO: 310173 - DNA, 20 bp, Homo sapiens
cactccctttgtggacttta

SEQ ID NO: 310174 - DNA, 23 bp, Homo sapiens
cactccggattccggccctggct

SEQ ID NO: 310175 - DNA, 13 bp, Homo sapiens
cactcctacctgg

SEQ ID NO: 310176 - DNA, 16 bp, Homo sapiens
cactcctaggagagcc

SEQ ID NO: 310177 - DNA, 17 bp, Homo sapiens
cactcctaggagagcca

SEQ ID NO: 310178 - DNA, 19 bp, Homo sapiens
cactcctaggagagccaac

SEQ ID NO: 310179 - DNA, 22 bp, Homo sapiens
cactcctatccccaggccaggt

SEQ ID NO: 310180 - DNA, 15 bp, Homo sapiens
cactcctcctccagc

SEQ ID NO: 310181 - DNA, 13 bp, Homo sapiens
cactcctgctgtg

SEQ ID NO: 310182 - DNA, 19 bp, Homo sapiens
cactcctggggcctcttgg

SEQ ID NO: 310183 - DNA, 12 bp, Homo sapiens
cactcctgtccc

SEQ ID NO: 310184 - DNA, 18 bp, Homo sapiens
cactcctgttacttacct

SEQ ID NO: 310185 - DNA, 18 bp, Homo sapiens
cactccttcctgccacct

SEQ ID NO: 310186 - DNA, 24 bp, Homo sapiens
cactccttcctgccacctgctgct

SEQ ID NO: 310187 - DNA, 18 bp, Homo sapiens
cactcgcccgcccactgt

SEQ ID NO: 310188 - DNA, 13 bp, Homo sapiens
aggctcttctcct

SEQ ID NO: 310189 - DNA, 13 bp, Homo sapiens
aggctgaaaagtg

SEQ ID NO: 310190 - DNA, 16 bp, Homo sapiens
aggctgaaaagtgctt

SEQ ID NO: 310191 - DNA, 13 bp, Homo sapiens
aggctgaaagagg

SEQ ID NO: 310192 - DNA, 16 bp, Homo sapiens
aggctgaaagaggcca

SEQ ID NO: 310193 - DNA, 21 bp, Homo sapiens
aggctgaacataaatcagtta

SEQ ID NO: 310194 - DNA, 16 bp, Homo sapiens
aggctgaattacagtg

SEQ ID NO: 310195 - DNA, 17 bp, Homo sapiens
aggctgaattacagtga

SEQ ID NO: 310196 - DNA, 18 bp, Homo sapiens
aggctgactgggggcctc

SEQ ID NO: 310197 - DNA, 14 bp, Homo sapiens
aggctgagactgca

SEQ ID NO: 310198 - DNA, 19 bp, Homo sapiens
aggctgagactgcagagga

SEQ ID NO: 310199 - DNA, 21 bp, Homo sapiens
aggctgagactgcagaggagc

SEQ ID NO: 310200 - DNA, 13 bp, Homo sapiens
aggctgaggactt

SEQ ID NO: 310201 - DNA, 15 bp, Homo sapiens
aggctgaggcctgga

SEQ ID NO: 310202 - DNA, 16 bp, Homo sapiens
aggctgaggcctggac

SEQ ID NO: 310203 - DNA, 17 bp, Homo sapiens
aggctgaggcctggact

SEQ ID NO: 310204 - DNA, 23 bp, Homo sapiens
aggctgagtttagtttttcactt

SEQ ID NO: 310205 - DNA, 11 bp, Homo sapiens
aggctgcactg

SEQ ID NO: 310206 - DNA, 16 bp, Homo sapiens
aggctgcactgcagtg

SEQ ID NO: 310207 - DNA, 21 bp, Homo sapiens
aggctgcactgcagtgatggc

SEQ ID NO: 310208 - DNA, 21 bp, Homo sapiens
aggctgcagaggcacctcaac

SEQ ID NO: 310209 - DNA, 17 bp, Homo sapiens
aggctgccaaggccaga

SEQ ID NO: 310210 - DNA, 21 bp, Homo sapiens
aggctgccccacccctccatg

SEQ ID NO: 310211 - DNA, 14 bp, Homo sapiens
aggctgccggctgc

SEQ ID NO: 310212 - DNA, 14 bp, Homo sapiens
aggctgcctctggg

SEQ ID NO: 310213 - DNA, 15 bp, Homo sapiens
aggctgcctggagaa

SEQ ID NO: 310214 - DNA, 16 bp, Homo sapiens
aggctgcctggagaaa

SEQ ID NO: 310215 - DNA, 18 bp, Homo sapiens
aggctgcctggagaaagg

SEQ ID NO: 310216 - DNA, 19 bp, Homo sapiens
aggctgcctggagaaagga

SEQ ID NO: 310217 - DNA, 14 bp, Homo sapiens
aggctgcgcctgcc

SEQ ID NO: 310218 - DNA, 18 bp, Homo sapiens
aggctgcgcctgcccgcc

SEQ ID NO: 310219 - DNA, 17 bp, Homo sapiens
aggctgcggtgggcagc

SEQ ID NO: 310220 - DNA, 15 bp, Homo sapiens
aggctgctggaggaa

SEQ ID NO: 310221 - DNA, 12 bp, Homo sapiens
aggctggagctg

SEQ ID NO: 310222 - DNA, 18 bp, Homo sapiens
aggctggcagctctccag

SEQ ID NO: 310223 - DNA, 18 bp, Homo sapiens
aggctggcagtacagagt

SEQ ID NO: 310224 - DNA, 22 bp, Homo sapiens
aggctggccagcaaggcaggtt

SEQ ID NO: 310225 - DNA, 16 bp, Homo sapiens
aggctggcctcagact

SEQ ID NO: 310226 - DNA, 15 bp, Homo sapiens
aggctggctgaaaat

SEQ ID NO: 310227 - DNA, 20 bp, Homo sapiens
aggctgggccaagccaggga

SEQ ID NO: 310228 - DNA, 17 bp, Homo sapiens
aggctgggcccagaggc

SEQ ID NO: 310229 - DNA, 16 bp, Homo sapiens
aggctggggcctggcc

SEQ ID NO: 310230 - DNA, 23 bp, Homo sapiens
aggctggggcctggcctatttaa

SEQ ID NO: 310231 - DNA, 14 bp, Homo sapiens
aggctgggtgccca

SEQ ID NO: 310232 - DNA, 15 bp, Homo sapiens
aggctgggtgcccac

SEQ ID NO: 310233 - DNA, 20 bp, Homo sapiens
aggctggttcttgggctagg

SEQ ID NO: 310234 - DNA, 22 bp, Homo sapiens
aggctgtaagcattctgagctg

SEQ ID NO: 310235 - DNA, 18 bp, Homo sapiens
aggctgtattttctttta

SEQ ID NO: 310236 - DNA, 21 bp, Homo sapiens
aggctgtcaattacaggaagt

SEQ ID NO: 310237 - DNA, 16 bp, Homo sapiens
aggctgtcctgtacat

SEQ ID NO: 310238 - DNA, 17 bp, Homo sapiens
aggctgtttttgggtgc

SEQ ID NO: 310239 - DNA, 15 bp, Homo sapiens
aggcttaggtgccag

SEQ ID NO: 310240 - DNA, 17 bp, Homo sapiens
aggcttaggtgccaggc

SEQ ID NO: 310241 - DNA, 18 bp, Homo sapiens
aggcttaggtgccaggct

SEQ ID NO: 310242 - DNA, 12 bp, Homo sapiens
aggcttcaccct

SEQ ID NO: 310243 - DNA, 13 bp, Homo sapiens
aggcttccaggct

SEQ ID NO: 310244 - DNA, 18 bp, Homo sapiens
aggcttctatgtccaaca

SEQ ID NO: 310245 - DNA, 12 bp, Homo sapiens
aggcttctcctt

SEQ ID NO: 310246 - DNA, 20 bp, Homo sapiens
aggcttctgttcctctcttt

SEQ ID NO: 310247 - DNA, 18 bp, Homo sapiens
aggcttgcataataagct

SEQ ID NO: 310248 - DNA, 22 bp, Homo sapiens
aggcttgggaccgccagatggg

SEQ ID NO: 310249 - DNA, 19 bp, Homo sapiens
aggcttgggcccagtagcc

SEQ ID NO: 310250 - DNA, 20 bp, Homo sapiens
aggcttgggcccagtagccc

SEQ ID NO: 310251 - DNA, 15 bp, Homo sapiens
aggcttgtcagagct

SEQ ID NO: 310252 - DNA, 17 bp, Homo sapiens
aggctttaagctccagc

SEQ ID NO: 310253 - DNA, 14 bp, Homo sapiens
aggctttcagggcc

SEQ ID NO: 310254 - DNA, 18 bp, Homo sapiens
aggctttgccatgggcct

SEQ ID NO: 310255 - DNA, 18 bp, Homo sapiens
aggctttggcaacagaaa

SEQ ID NO: 310256 - DNA, 22 bp, Homo sapiens
aggctttggcaacagaaaacaa

SEQ ID NO: 310257 - DNA, 20 bp, Homo sapiens
aggctttgggaacactggcc

SEQ ID NO: 310258 - DNA, 22 bp, Homo sapiens
aggctttgggaacactggcctg

SEQ ID NO: 310259 - DNA, 16 bp, Homo sapiens
agggaaaactcttcat

SEQ ID NO: 310260 - DNA, 12 bp, Homo sapiens
agggaaacaaaa

SEQ ID NO: 310261 - DNA, 21 bp, Homo sapiens
agggaaacccggggaactggt

SEQ ID NO: 310262 - DNA, 15 bp, Homo sapiens
agggaaacgtgccct

SEQ ID NO: 310263 - DNA, 19 bp, Homo sapiens
agggaaactcagatgtcca

SEQ ID NO: 310264 - DNA, 14 bp, Homo sapiens
agggaaatccaact

SEQ ID NO: 310265 - DNA, 13 bp, Homo sapiens
agggaaatgctgt

SEQ ID NO: 310266 - DNA, 15 bp, Homo sapiens
agggaaatgctgttg

SEQ ID NO: 310267 - DNA, 14 bp, Homo sapiens
agggaaccagccct

SEQ ID NO: 310268 - DNA, 17 bp, Homo sapiens
agggaaccagccctcca

SEQ ID NO: 310269 - DNA, 15 bp, Homo sapiens
agggaactgcttgcc

SEQ ID NO: 310270 - DNA, 23 bp, Homo sapiens
agggaactgcttgcccagggtgc

SEQ ID NO: 310271 - DNA, 20 bp, Homo sapiens
agggaactgggaagatgctg

SEQ ID NO: 310272 - DNA, 12 bp, Homo sapiens
agggaagaactc

SEQ ID NO: 310273 - DNA, 16 bp, Homo sapiens
agggaagagggcagta

SEQ ID NO: 310274 - DNA, 16 bp, Homo sapiens
agggaagatctaacat

SEQ ID NO: 310275 - DNA, 12 bp, Homo sapiens
agggaagcaggg

SEQ ID NO: 310276 - DNA, 13 bp, Homo sapiens
agggaagcaggga

SEQ ID NO: 310277 - DNA, 16 bp, Homo sapiens
agggaaggccacctgc

SEQ ID NO: 310278 - DNA, 22 bp, Homo sapiens
agggaatgttccctgcaccctg

SEQ ID NO: 310279 - DNA, 23 bp, Homo sapiens
agggaattttcattggatgcagt

SEQ ID NO: 310280 - DNA, 21 bp, Homo sapiens
agggacagccaaaagtaagtg

SEQ ID NO: 310281 - DNA, 20 bp, Homo sapiens
agggacagcccactgagaag

SEQ ID NO: 310282 - DNA, 19 bp, Homo sapiens
agggacatgctcacctcta

SEQ ID NO: 310283 - DNA, 17 bp, Homo sapiens
agggacatgtctttggc

SEQ ID NO: 310284 - DNA, 16 bp, Homo sapiens
agggaccaactgggcc

SEQ ID NO: 310285 - DNA, 18 bp, Homo sapiens
agggaccaaggacccctc

SEQ ID NO: 310286 - DNA, 15 bp, Homo sapiens
agggacccacatcca

SEQ ID NO: 310287 - DNA, 19 bp, Homo sapiens
agggacccttggctcctgt

SEQ ID NO: 310288 - DNA, 18 bp, Homo sapiens
agggaccttggagagctc

SEQ ID NO: 310289 - DNA, 15 bp, Homo sapiens
agggactgcctctgc

SEQ ID NO: 310290 - DNA, 19 bp, Homo sapiens
agggactggtccaggcatg

SEQ ID NO: 310291 - DNA, 14 bp, Homo sapiens
agggactgtacctg

SEQ ID NO: 310292 - DNA, 21 bp, Homo sapiens
agggactgtacctgtaggaaa

SEQ ID NO: 310293 - DNA, 14 bp, Homo sapiens
agggactgtcagct

SEQ ID NO: 310294 - DNA, 17 bp, Homo sapiens
agggactgtcagctgag

SEQ ID NO: 310295 - DNA, 13 bp, Homo sapiens
agggagaaatgtt

SEQ ID NO: 310296 - DNA, 9 bp, Homo sapiens
agggagaag

SEQ ID NO: 310297 - DNA, 21 bp, Homo sapiens
agggagaaggagaggctctga

SEQ ID NO: 310298 - DNA, 18 bp, Homo sapiens
agggagaagggagaacag

SEQ ID NO: 310299 - DNA, 22 bp, Homo sapiens
agggagacaggcagggagggct

SEQ ID NO: 310300 - DNA, 13 bp, Homo sapiens
agggagaccctgg

SEQ ID NO: 310301 - DNA, 15 bp, Homo sapiens
agggagagccagctc

SEQ ID NO: 310302 - DNA, 20 bp, Homo sapiens
agggagagttggggaaggca

SEQ ID NO: 310303 - DNA, 21 bp, Homo sapiens
agggagagttggggaaggcaa

SEQ ID NO: 310304 - DNA, 20 bp, Homo sapiens
agggagcagagaaggccagg

SEQ ID NO: 310305 - DNA, 23 bp, Homo sapiens
agggagcccctcctctgagcagc

SEQ ID NO: 310306 - DNA, 17 bp, Homo sapiens
agggagcccctttgatg

SEQ ID NO: 310307 - DNA, 15 bp, Homo sapiens
agggagctgctcaga

SEQ ID NO: 310308 - DNA, 23 bp, Homo sapiens
agggaggagaggaaatgctattg

SEQ ID NO: 310309 - DNA, 15 bp, Homo sapiens
agggaggcccatgtg

SEQ ID NO: 310310 - DNA, 22 bp, Homo sapiens
agggagggaacagacctcggct

SEQ ID NO: 310311 - DNA, 13 bp, Homo sapiens
agggaggggaggc

SEQ ID NO: 310312 - DNA, 19 bp, Homo sapiens
agggagggggcgctcagga

SEQ ID NO: 310313 - DNA, 19 bp, Homo sapiens
agggagtacaaagacaggg

SEQ ID NO: 310314 - DNA, 14 bp, Homo sapiens
agggagtcccctcc

SEQ ID NO: 310315 - DNA, 16 bp, Homo sapiens
agggagtcccctcccc

SEQ ID NO: 310316 - DNA, 22 bp, Homo sapiens
agggagtgatgatttgggggag

SEQ ID NO: 310317 - DNA, 14 bp, Homo sapiens
agggagtgcagaac

SEQ ID NO: 310318 - DNA, 20 bp, Homo sapiens
agggagttcatctggagggt

SEQ ID NO: 310319 - DNA, 16 bp, Homo sapiens
agggatagaggggggc

SEQ ID NO: 310320 - DNA, 17 bp, Homo sapiens
agggatctggggaagga

SEQ ID NO: 310321 - DNA, 13 bp, Homo sapiens
agggatgcaggtg

SEQ ID NO: 310322 - DNA, 18 bp, Homo sapiens
agggattcacatctgcat

SEQ ID NO: 310323 - DNA, 17 bp, Homo sapiens
cactctaccctcccacc

SEQ ID NO: 310324 - DNA, 19 bp, Homo sapiens
cactctaccctcccacccc

SEQ ID NO: 310325 - DNA, 18 bp, Homo sapiens
cactctagtgacttcctg

SEQ ID NO: 310326 - DNA, 13 bp, Homo sapiens
cactctagttcta

SEQ ID NO: 310327 - DNA, 16 bp, Homo sapiens
cactctagttctagat

SEQ ID NO: 310328 - DNA, 12 bp, Homo sapiens
cactctcccaga

SEQ ID NO: 310329 - DNA, 20 bp, Homo sapiens
cactctcccagaggctcctg

SEQ ID NO: 310330 - DNA, 12 bp, Homo sapiens
cactctcctggg

SEQ ID NO: 310331 - DNA, 13 bp, Homo sapiens
cactctcctgggc

SEQ ID NO: 310332 - DNA, 16 bp, Homo sapiens
cactctcctgggcccc

SEQ ID NO: 310333 - DNA, 20 bp, Homo sapiens
cactctcctgggcccctccc

SEQ ID NO: 310334 - DNA, 21 bp, Homo sapiens
cactctcctgggcccctccct

SEQ ID NO: 310335 - DNA, 23 bp, Homo sapiens
cactctcctgggcccctccctac

SEQ ID NO: 310336 - DNA, 23 bp, Homo sapiens
cactctctgaagatgatcatttg

SEQ ID NO: 310337 - DNA, 22 bp, Homo sapiens
cactctctgccagctccacagg

SEQ ID NO: 310338 - DNA, 13 bp, Homo sapiens
cactctctgggac

SEQ ID NO: 310339 - DNA, 14 bp, Homo sapiens
cactctctgggact

SEQ ID NO: 310340 - DNA, 19 bp, Homo sapiens
cactctctgggactctcct

SEQ ID NO: 310341 - DNA, 11 bp, Homo sapiens
cactctgaagt

SEQ ID NO: 310342 - DNA, 20 bp, Homo sapiens
cactctgaagtcccttcctg

SEQ ID NO: 310343 - DNA, 18 bp, Homo sapiens
cactctgaccttcacagg

SEQ ID NO: 310344 - DNA, 21 bp, Homo sapiens
cactctgcctctaaggccaag

SEQ ID NO: 310345 - DNA, 11 bp, Homo sapiens
cactctgctgg

SEQ ID NO: 310346 - DNA, 18 bp, Homo sapiens
cactcttcttgagcagac

SEQ ID NO: 310347 - DNA, 14 bp, Homo sapiens
cactcttggctcgt

SEQ ID NO: 310348 - DNA, 21 bp, Homo sapiens
cactgaaacttcaagcaccag

SEQ ID NO: 310349 - DNA, 23 bp, Homo sapiens
cactgaaccttgttgatgccagc

SEQ ID NO: 310350 - DNA, 14 bp, Homo sapiens
cactgaagagtatg

SEQ ID NO: 310351 - DNA, 14 bp, Homo sapiens
cactgaaggcaaat

SEQ ID NO: 310352 - DNA, 20 bp, Homo sapiens
cactgaaggctttcagggcc

SEQ ID NO: 310353 - DNA, 22 bp, Homo sapiens
cactgaaggctttcagggcctc

SEQ ID NO: 310354 - DNA, 19 bp, Homo sapiens
cactgaagtgaatacatgg

SEQ ID NO: 310355 - DNA, 22 bp, Homo sapiens
cactgaataatggaattatgta

SEQ ID NO: 310356 - DNA, 13 bp, Homo sapiens
cactgaatattta

SEQ ID NO: 310357 - DNA, 13 bp, Homo sapiens
cactgacagcctc

SEQ ID NO: 310358 - DNA, 14 bp, Homo sapiens
cactgacagcctcc

SEQ ID NO: 310359 - DNA, 15 bp, Homo sapiens
cactgacagcctccc

SEQ ID NO: 310360 - DNA, 20 bp, Homo sapiens
cactgacagcctcccacccc

SEQ ID NO: 310361 - DNA, 17 bp, Homo sapiens
cactgacatttcacttc

SEQ ID NO: 310362 - DNA, 16 bp, Homo sapiens
cactgaccacactgta

SEQ ID NO: 310363 - DNA, 16 bp, Homo sapiens
cactgaccatccactc

SEQ ID NO: 310364 - DNA, 17 bp, Homo sapiens
cactgaccatccactct

SEQ ID NO: 310365 - DNA, 22 bp, Homo sapiens
cactgacctggaagagctgggt

SEQ ID NO: 310366 - DNA, 15 bp, Homo sapiens
cactgagcccttgca

SEQ ID NO: 310367 - DNA, 23 bp, Homo sapiens
cactgagcccttgcacaggccac

SEQ ID NO: 310368 - DNA, 18 bp, Homo sapiens
cactgagggccacactat

SEQ ID NO: 310369 - DNA, 21 bp, Homo sapiens
cactgatatcacgggcccgct

SEQ ID NO: 310370 - DNA, 22 bp, Homo sapiens
cactgatatcacgggcccgctc

SEQ ID NO: 310371 - DNA, 17 bp, Homo sapiens
cactgatgggtcctgct

SEQ ID NO: 310372 - DNA, 22 bp, Homo sapiens
cactgatgggtcctgctgctcg

SEQ ID NO: 310373 - DNA, 21 bp, Homo sapiens
cactgattacttttgggaggg

SEQ ID NO: 310374 - DNA, 17 bp, Homo sapiens
cactgcaaacaataaac

SEQ ID NO: 310375 - DNA, 21 bp, Homo sapiens
cactgcaaacaataaacatcc

SEQ ID NO: 310376 - DNA, 17 bp, Homo sapiens
cactgcaacttctgcct

SEQ ID NO: 310377 - DNA, 23 bp, Homo sapiens
cactgcacagtgcatctcagccc

SEQ ID NO: 310378 - DNA, 13 bp, Homo sapiens
cactgcactccag

SEQ ID NO: 310379 - DNA, 18 bp, Homo sapiens
cactgcactccagcctgg

SEQ ID NO: 310380 - DNA, 15 bp, Homo sapiens
cactgcagccctctc

SEQ ID NO: 310381 - DNA, 13 bp, Homo sapiens
cactgcagcctcg

SEQ ID NO: 310382 - DNA, 14 bp, Homo sapiens
cactgcagcctcga

SEQ ID NO: 310383 - DNA, 20 bp, Homo sapiens
cactgccagaagtgtgtttt

SEQ ID NO: 310384 - DNA, 13 bp, Homo sapiens
cactgccaggcac

SEQ ID NO: 310385 - DNA, 20 bp, Homo sapiens
cactgccaggcacctggcct

SEQ ID NO: 310386 - DNA, 15 bp, Homo sapiens
cactgcccgagctgg

SEQ ID NO: 310387 - DNA, 19 bp, Homo sapiens
cactgcccgcacaccctca

SEQ ID NO: 310388 - DNA, 17 bp, Homo sapiens
cactgccctctccacac

SEQ ID NO: 310389 - DNA, 18 bp, Homo sapiens
cactgccctctccacacc

SEQ ID NO: 310390 - DNA, 12 bp, Homo sapiens
cactgccctctg

SEQ ID NO: 310391 - DNA, 11 bp, Homo sapiens
cactgccctgc

SEQ ID NO: 310392 - DNA, 15 bp, Homo sapiens
cactgccctgcctgc

SEQ ID NO: 310393 - DNA, 16 bp, Homo sapiens
cactgccctgcctgcc

SEQ ID NO: 310394 - DNA, 19 bp, Homo sapiens
cactgcctcctacaaccag

SEQ ID NO: 310395 - DNA, 13 bp, Homo sapiens
cactgcctctgcc

SEQ ID NO: 310396 - DNA, 15 bp, Homo sapiens
cactgcctctgcctt

SEQ ID NO: 310397 - DNA, 16 bp, Homo sapiens
cactgcctctgcctta

SEQ ID NO: 310398 - DNA, 22 bp, Homo sapiens
cactgccttctcctctctgggc

SEQ ID NO: 310399 - DNA, 21 bp, Homo sapiens
cactgcgaactctcaggacta

SEQ ID NO: 310400 - DNA, 16 bp, Homo sapiens
cactgctaataaatga

SEQ ID NO: 310401 - DNA, 17 bp, Homo sapiens
cactgctaataaatgac

SEQ ID NO: 310402 - DNA, 22 bp, Homo sapiens
cactgctaataaatgaccagtt

SEQ ID NO: 310403 - DNA, 12 bp, Homo sapiens
cactgctgcacc

SEQ ID NO: 310404 - DNA, 16 bp, Homo sapiens
cactgctgcaccagag

SEQ ID NO: 310405 - DNA, 20 bp, Homo sapiens
cactgctgcaccagagtgaa

SEQ ID NO: 310406 - DNA, 15 bp, Homo sapiens
cactgctgcccagcc

SEQ ID NO: 310407 - DNA, 17 bp, Homo sapiens
cactgctgcccagcctc

SEQ ID NO: 310408 - DNA, 13 bp, Homo sapiens
cactgctgctcct

SEQ ID NO: 310409 - DNA, 16 bp, Homo sapiens
cactgctggctgcctt

SEQ ID NO: 310410 - DNA, 21 bp, Homo sapiens
cactgctggctgccttagaac

SEQ ID NO: 310411 - DNA, 19 bp, Homo sapiens
cactgctgtccctcctgag

SEQ ID NO: 310412 - DNA, 17 bp, Homo sapiens
cactgctgtgaacaagt

SEQ ID NO: 310413 - DNA, 16 bp, Homo sapiens
cactgctgttcctgct

SEQ ID NO: 310414 - DNA, 22 bp, Homo sapiens
cactgctgttcctgctccatga

SEQ ID NO: 310415 - DNA, 21 bp, Homo sapiens
cactgcttctcggaggccagg

SEQ ID NO: 310416 - DNA, 15 bp, Homo sapiens
cactgcttctgcttt

SEQ ID NO: 310417 - DNA, 16 bp, Homo sapiens
cactgcttctgctttt

SEQ ID NO: 310418 - DNA, 12 bp, Homo sapiens
cactgctttgca

SEQ ID NO: 310419 - DNA, 13 bp, Homo sapiens
cactggaaaacat

SEQ ID NO: 310420 - DNA, 16 bp, Homo sapiens
cactggaaaacataga

SEQ ID NO: 310421 - DNA, 14 bp, Homo sapiens
cactggaacctccc

SEQ ID NO: 310422 - DNA, 16 bp, Homo sapiens
cactggagtgcaggga

SEQ ID NO: 310423 - DNA, 17 bp, Homo sapiens
cactggagtgcagggag

SEQ ID NO: 310424 - DNA, 20 bp, Homo sapiens
cactggagtgcagggaggag

SEQ ID NO: 310425 - DNA, 22 bp, Homo sapiens
cactggagttacattaatgtta

SEQ ID NO: 310426 - DNA, 15 bp, Homo sapiens
cactggatgcagaaa

SEQ ID NO: 310427 - DNA, 16 bp, Homo sapiens
cactggcatctctgga

SEQ ID NO: 310428 - DNA, 22 bp, Homo sapiens
cactggcattgtccctgtgcct

SEQ ID NO: 310429 - DNA, 21 bp, Homo sapiens
cactggcatttttagctcctt

SEQ ID NO: 310430 - DNA, 11 bp, Homo sapiens
cactggccaga

SEQ ID NO: 310431 - DNA, 13 bp, Homo sapiens
cactggccagaga

SEQ ID NO: 310432 - DNA, 14 bp, Homo sapiens
cactggccagagag

SEQ ID NO: 310433 - DNA, 16 bp, Homo sapiens
cactggccagagaggg

SEQ ID NO: 310434 - DNA, 18 bp, Homo sapiens
cactggccagagagggcc

SEQ ID NO: 310435 - DNA, 21 bp, Homo sapiens
cactggccagagagggcccag

SEQ ID NO: 310436 - DNA, 22 bp, Homo sapiens
cactggcctgggtctccctggt

SEQ ID NO: 310437 - DNA, 21 bp, Homo sapiens
cactggcctgttctgtaggag

SEQ ID NO: 310438 - DNA, 15 bp, Homo sapiens
cactggctctctcca

SEQ ID NO: 310439 - DNA, 17 bp, Homo sapiens
cactggctctctccagg

SEQ ID NO: 310440 - DNA, 17 bp, Homo sapiens
cactggctgctctgtct

SEQ ID NO: 310441 - DNA, 16 bp, Homo sapiens
cactggctggggcaga

SEQ ID NO: 310442 - DNA, 23 bp, Homo sapiens
cactggctggggcagaggggcag

SEQ ID NO: 310443 - DNA, 22 bp, Homo sapiens
cactggctgtcagtatgacatt

SEQ ID NO: 310444 - DNA, 16 bp, Homo sapiens
cactggctgtgcctcc

SEQ ID NO: 310445 - DNA, 17 bp, Homo sapiens
cactggctgtgcctccc

SEQ ID NO: 310446 - DNA, 21 bp, Homo sapiens
cactggctgtgcctcccccgc

SEQ ID NO: 310447 - DNA, 14 bp, Homo sapiens
cactggctttacat

SEQ ID NO: 310448 - DNA, 20 bp, Homo sapiens
cactgggattcatggctttg

SEQ ID NO: 310449 - DNA, 19 bp, Homo sapiens
cactgggccccattctccc

SEQ ID NO: 310450 - DNA, 21 bp, Homo sapiens
cactgggccccattctccctc

SEQ ID NO: 310451 - DNA, 13 bp, Homo sapiens
cactgggccggca

SEQ ID NO: 310452 - DNA, 20 bp, Homo sapiens
cactgggccggcagcctggt

SEQ ID NO: 310453 - DNA, 18 bp, Homo sapiens
cactggggtaccacatgg

SEQ ID NO: 310454 - DNA, 18 bp, Homo sapiens
cactggtctcagaggagg

SEQ ID NO: 310455 - DNA, 14 bp, Homo sapiens
cactggtgcattta

SEQ ID NO: 310456 - DNA, 22 bp, Homo sapiens
cactggtggcccgacagcctgg

SEQ ID NO: 310457 - DNA, 14 bp, Homo sapiens
agggattcaggctg

SEQ ID NO: 310458 - DNA, 16 bp, Homo sapiens
agggattcaggctgct

SEQ ID NO: 310459 - DNA, 22 bp, Homo sapiens
agggattctgggcttggggtgt

SEQ ID NO: 310460 - DNA, 19 bp, Homo sapiens
agggattgaacacaggcaa

SEQ ID NO: 310461 - DNA, 17 bp, Homo sapiens
agggcaaggggtttcca

SEQ ID NO: 310462 - DNA, 20 bp, Homo sapiens
agggcaccaagcccacaggt

SEQ ID NO: 310463 - DNA, 18 bp, Homo sapiens
agggcactctctgccagc

SEQ ID NO: 310464 - DNA, 21 bp, Homo sapiens
agggcactctctgccagctcc

SEQ ID NO: 310465 - DNA, 16 bp, Homo sapiens
agggcactggtggccc

SEQ ID NO: 310466 - DNA, 18 bp, Homo sapiens
agggcagagccatgggcc

SEQ ID NO: 310467 - DNA, 19 bp, Homo sapiens
agggcagagccatgggcct

SEQ ID NO: 310468 - DNA, 13 bp, Homo sapiens
agggcagagggaa

SEQ ID NO: 310469 - DNA, 22 bp, Homo sapiens
agggcagagggaatgttccctg

SEQ ID NO: 310470 - DNA, 23 bp, Homo sapiens
agggcagagggaatgttccctgc

SEQ ID NO: 310471 - DNA, 15 bp, Homo sapiens
agggcagcccctccc

SEQ ID NO: 310472 - DNA, 15 bp, Homo sapiens
agggcagccctgcct

SEQ ID NO: 310473 - DNA, 20 bp, Homo sapiens
agggcagccgtcacccctgc

SEQ ID NO: 310474 - DNA, 23 bp, Homo sapiens
agggcagcctgtgggagaaggga

SEQ ID NO: 310475 - DNA, 19 bp, Homo sapiens
agggcaggaaggagagcct

SEQ ID NO: 310476 - DNA, 23 bp, Homo sapiens
agggcaggaaggagagcctgctg

SEQ ID NO: 310477 - DNA, 17 bp, Homo sapiens
agggcagggcatctcct

SEQ ID NO: 310478 - DNA, 21 bp, Homo sapiens
agggcagggtgggcagcctat

SEQ ID NO: 310479 - DNA, 17 bp, Homo sapiens
agggcagggttctagaa

SEQ ID NO: 310480 - DNA, 19 bp, Homo sapiens
agggcagggttctagaagg

SEQ ID NO: 310481 - DNA, 20 bp, Homo sapiens
agggcagggttctagaaggg

SEQ ID NO: 310482 - DNA, 22 bp, Homo sapiens
agggcagggttctagaaggggc

SEQ ID NO: 310483 - DNA, 15 bp, Homo sapiens
agggcagtacctggg

SEQ ID NO: 310484 - DNA, 22 bp, Homo sapiens
agggcagtgctagtgagctggg

SEQ ID NO: 310485 - DNA, 22 bp, Homo sapiens
agggcataatgatgatgggaat

SEQ ID NO: 310486 - DNA, 22 bp, Homo sapiens
agggcatcagctttccctggct

SEQ ID NO: 310487 - DNA, 15 bp, Homo sapiens
agggcatcaggcact

SEQ ID NO: 310488 - DNA, 12 bp, Homo sapiens
agggcatctcct

SEQ ID NO: 310489 - DNA, 13 bp, Homo sapiens
agggcatctcctg

SEQ ID NO: 310490 - DNA, 14 bp, Homo sapiens
agggcatctcctgt

SEQ ID NO: 310491 - DNA, 16 bp, Homo sapiens
agggcatgttgggata

SEQ ID NO: 310492 - DNA, 18 bp, Homo sapiens
agggccacactattacca

SEQ ID NO: 310493 - DNA, 14 bp, Homo sapiens
agggccagaaggag

SEQ ID NO: 310494 - DNA, 19 bp, Homo sapiens
agggccagaaggagggcag

SEQ ID NO: 310495 - DNA, 13 bp, Homo sapiens
agggccagggctc

SEQ ID NO: 310496 - DNA, 15 bp, Homo sapiens
agggccagggctctg

SEQ ID NO: 310497 - DNA, 18 bp, Homo sapiens
agggccagggctctggca

SEQ ID NO: 310498 - DNA, 12 bp, Homo sapiens
agggccagggtt

SEQ ID NO: 310499 - DNA, 13 bp, Homo sapiens
agggccagtcctg

SEQ ID NO: 310500 - DNA, 17 bp, Homo sapiens
agggccagtcctgcctg

SEQ ID NO: 310501 - DNA, 18 bp, Homo sapiens
agggccagtcctgcctgg

SEQ ID NO: 310502 - DNA, 14 bp, Homo sapiens
agggcccacctcct

SEQ ID NO: 310503 - DNA, 15 bp, Homo sapiens
agggcccacttgtat

SEQ ID NO: 310504 - DNA, 22 bp, Homo sapiens
agggcccagaggggcggggcca

SEQ ID NO: 310505 - DNA, 13 bp, Homo sapiens
agggcccagctgt

SEQ ID NO: 310506 - DNA, 14 bp, Homo sapiens
agggcccaggcctg

SEQ ID NO: 310507 - DNA, 15 bp, Homo sapiens
agggcccccggccac

SEQ ID NO: 310508 - DNA, 11 bp, Homo sapiens
agggcccctcc

SEQ ID NO: 310509 - DNA, 17 bp, Homo sapiens
agggcccctccctctgc

SEQ ID NO: 310510 - DNA, 16 bp, Homo sapiens
agggcccctctgccca

SEQ ID NO: 310511 - DNA, 21 bp, Homo sapiens
agggcccctctgcccagcttg

SEQ ID NO: 310512 - DNA, 23 bp, Homo sapiens
agggcccctctgcccagcttggg

SEQ ID NO: 310513 - DNA, 13 bp, Homo sapiens
agggccctacctg

SEQ ID NO: 310514 - DNA, 18 bp, Homo sapiens
agggccctcagaggaaag

SEQ ID NO: 310515 - DNA, 20 bp, Homo sapiens
agggccctcagaggaaaggc

SEQ ID NO: 310516 - DNA, 13 bp, Homo sapiens
agggccctgctca

SEQ ID NO: 310517 - DNA, 16 bp, Homo sapiens
agggccctgctcaggc

SEQ ID NO: 310518 - DNA, 20 bp, Homo sapiens
agggccctggggtctctgag

SEQ ID NO: 310519 - DNA, 23 bp, Homo sapiens
agggccctggggtctctgagcag

SEQ ID NO: 310520 - DNA, 14 bp, Homo sapiens
agggccgcagggcg

SEQ ID NO: 310521 - DNA, 20 bp, Homo sapiens
agggccgctcgatgcctttg

SEQ ID NO: 310522 - DNA, 14 bp, Homo sapiens
agggcctcagagac

SEQ ID NO: 310523 - DNA, 16 bp, Homo sapiens
agggcctcagagacag

SEQ ID NO: 310524 - DNA, 19 bp, Homo sapiens
agggcctcccaccagagac

SEQ ID NO: 310525 - DNA, 11 bp, Homo sapiens
agggcctgact

SEQ ID NO: 310526 - DNA, 14 bp, Homo sapiens
agggcctgactttt

SEQ ID NO: 310527 - DNA, 17 bp, Homo sapiens
agggcctgacttttaca

SEQ ID NO: 310528 - DNA, 18 bp, Homo sapiens
agggcctgacttttacag

SEQ ID NO: 310529 - DNA, 22 bp, Homo sapiens
agggcctgacttttacagcttt

SEQ ID NO: 310530 - DNA, 15 bp, Homo sapiens
agggcctggcctggt

SEQ ID NO: 310531 - DNA, 14 bp, Homo sapiens
agggcctgggggca

SEQ ID NO: 310532 - DNA, 21 bp, Homo sapiens
agggcctgggggcagtgactg

SEQ ID NO: 310533 - DNA, 12 bp, Homo sapiens
agggcctgtggg

SEQ ID NO: 310534 - DNA, 20 bp, Homo sapiens
agggcgaacgacaatagctt

SEQ ID NO: 310535 - DNA, 16 bp, Homo sapiens
agggcgaggcggggga

SEQ ID NO: 310536 - DNA, 21 bp, Homo sapiens
agggcggctaggccggccagc

SEQ ID NO: 310537 - DNA, 16 bp, Homo sapiens
agggcgggccaggaga

SEQ ID NO: 310538 - DNA, 14 bp, Homo sapiens
agggcggggtgggg

SEQ ID NO: 310539 - DNA, 16 bp, Homo sapiens
agggctaaccagttct

SEQ ID NO: 310540 - DNA, 21 bp, Homo sapiens
agggctaattctgggaaggga

SEQ ID NO: 310541 - DNA, 24 bp, Homo sapiens
agggctagtgacttgtgtcccatg

SEQ ID NO: 310542 - DNA, 21 bp, Homo sapiens
agggctatggatggggcccag

SEQ ID NO: 310543 - DNA, 18 bp, Homo sapiens
agggctccagcatccagc

SEQ ID NO: 310544 - DNA, 21 bp, Homo sapiens
agggctccagcatccagcctg

SEQ ID NO: 310545 - DNA, 23 bp, Homo sapiens
agggctccagcatccagcctgtg

SEQ ID NO: 310546 - DNA, 13 bp, Homo sapiens
agggctgagcccc

SEQ ID NO: 310547 - DNA, 16 bp, Homo sapiens
agggctgagctgagct

SEQ ID NO: 310548 - DNA, 13 bp, Homo sapiens
agggctgccacca

SEQ ID NO: 310549 - DNA, 11 bp, Homo sapiens
agggctgcctg

SEQ ID NO: 310550 - DNA, 12 bp, Homo sapiens
agggctggcccg

SEQ ID NO: 310551 - DNA, 21 bp, Homo sapiens
agggctgggcaggtcctgggg

SEQ ID NO: 310552 - DNA, 22 bp, Homo sapiens
agggctgggcaggtcctgggga

SEQ ID NO: 310553 - DNA, 12 bp, Homo sapiens
agggctgggtgt

SEQ ID NO: 310554 - DNA, 12 bp, Homo sapiens
agggctgtgggt

SEQ ID NO: 310555 - DNA, 16 bp, Homo sapiens
agggctgtgggtgggg

SEQ ID NO: 310556 - DNA, 17 bp, Homo sapiens
agggctgtgggtgggga

SEQ ID NO: 310557 - DNA, 23 bp, Homo sapiens
agggcttatctagccaaagagct

SEQ ID NO: 310558 - DNA, 20 bp, Homo sapiens
agggcttggggctgcacctc

SEQ ID NO: 310559 - DNA, 21 bp, Homo sapiens
agggcttggggctgcacctcc

SEQ ID NO: 310560 - DNA, 22 bp, Homo sapiens
agggcttggggctgcacctcct

SEQ ID NO: 310561 - DNA, 14 bp, Homo sapiens
aggggaaaatagta

SEQ ID NO: 310562 - DNA, 12 bp, Homo sapiens
aggggaagctgc

SEQ ID NO: 310563 - DNA, 16 bp, Homo sapiens
aggggacactgaacct

SEQ ID NO: 310564 - DNA, 22 bp, Homo sapiens
aggggactcagccctgaggtga

SEQ ID NO: 310565 - DNA, 20 bp, Homo sapiens
aggggactgcatgcaagctc

SEQ ID NO: 310566 - DNA, 21 bp, Homo sapiens
aggggacttggataggagctt

SEQ ID NO: 310567 - DNA, 13 bp, Homo sapiens
aggggaggcagcc

SEQ ID NO: 310568 - DNA, 12 bp, Homo sapiens
aggggaggggcc

SEQ ID NO: 310569 - DNA, 14 bp, Homo sapiens
aggggaggggccta

SEQ ID NO: 310570 - DNA, 16 bp, Homo sapiens
aggggagggtggcagg

SEQ ID NO: 310571 - DNA, 16 bp, Homo sapiens
aggggagtctgcttgt

SEQ ID NO: 310572 - DNA, 17 bp, Homo sapiens
aggggatataggagagg

SEQ ID NO: 310573 - DNA, 21 bp, Homo sapiens
aggggatctaaaaggaggaca

SEQ ID NO: 310574 - DNA, 22 bp, Homo sapiens
aggggatctaaaaggaggacag

SEQ ID NO: 310575 - DNA, 20 bp, Homo sapiens
aggggcaacgaagaaaaaaa

SEQ ID NO: 310576 - DNA, 18 bp, Homo sapiens
aggggcacactacagagc

SEQ ID NO: 310577 - DNA, 22 bp, Homo sapiens
aggggcacctatgagatggcca

SEQ ID NO: 310578 - DNA, 15 bp, Homo sapiens
aggggcagaaggagg

SEQ ID NO: 310579 - DNA, 14 bp, Homo sapiens
aggggcaggagctc

SEQ ID NO: 310580 - DNA, 21 bp, Homo sapiens
aggggcaggcctgggacccag

SEQ ID NO: 310581 - DNA, 16 bp, Homo sapiens
aggggcagtctggagg

SEQ ID NO: 310582 - DNA, 17 bp, Homo sapiens
aggggcagtctggaggg

SEQ ID NO: 310583 - DNA, 16 bp, Homo sapiens
aggggcatctgcccct

SEQ ID NO: 310584 - DNA, 19 bp, Homo sapiens
aggggcatctgcccctccc

SEQ ID NO: 310585 - DNA, 22 bp, Homo sapiens
aggggcatctgcccctccccca

SEQ ID NO: 310586 - DNA, 19 bp, Homo sapiens
aggggcatgtattggcctg

SEQ ID NO: 310587 - DNA, 15 bp, Homo sapiens
aggggccagctgccc

SEQ ID NO: 310588 - DNA, 16 bp, Homo sapiens
aggggccagctgcccc

SEQ ID NO: 310589 - DNA, 13 bp, Homo sapiens
aggggccaggcca

SEQ ID NO: 310590 - DNA, 18 bp, Homo sapiens
aggggccaggccatggcc

SEQ ID NO: 310591 - DNA, 15 bp, Homo sapiens
cactggtgggcagct

SEQ ID NO: 310592 - DNA, 17 bp, Homo sapiens
cactggtttgtttctca

SEQ ID NO: 310593 - DNA, 16 bp, Homo sapiens
cactgtaaaatgaaat

SEQ ID NO: 310594 - DNA, 16 bp, Homo sapiens
cactgtaatcttaaaa

SEQ ID NO: 310595 - DNA, 20 bp, Homo sapiens
cactgtaggtatagaagatc

SEQ ID NO: 310596 - DNA, 22 bp, Homo sapiens
cactgtatctaaaaaataactg

SEQ ID NO: 310597 - DNA, 13 bp, Homo sapiens
cactgtccctacc

SEQ ID NO: 310598 - DNA, 15 bp, Homo sapiens
cactgtccctaccac

SEQ ID NO: 310599 - DNA, 16 bp, Homo sapiens
cactgtccctaccact

SEQ ID NO: 310600 - DNA, 19 bp, Homo sapiens
cactgtccctaccactgag

SEQ ID NO: 310601 - DNA, 17 bp, Homo sapiens
cactgtcccttgcctca

SEQ ID NO: 310602 - DNA, 16 bp, Homo sapiens
cactgtccgcctctgc

SEQ ID NO: 310603 - DNA, 17 bp, Homo sapiens
cactgtccgcctctgcc

SEQ ID NO: 310604 - DNA, 18 bp, Homo sapiens
cactgtccgcctctgccc

SEQ ID NO: 310605 - DNA, 19 bp, Homo sapiens
cactgtcctgggcgccctg

SEQ ID NO: 310606 - DNA, 21 bp, Homo sapiens
cactgtcctgggcgccctgga

SEQ ID NO: 310607 - DNA, 14 bp, Homo sapiens
cactgtcctttctc

SEQ ID NO: 310608 - DNA, 12 bp, Homo sapiens
cactgtctcagt

SEQ ID NO: 310609 - DNA, 21 bp, Homo sapiens
cactgtctgttgtttacctac

SEQ ID NO: 310610 - DNA, 15 bp, Homo sapiens
cactgtgatgttggg

SEQ ID NO: 310611 - DNA, 17 bp, Homo sapiens
cactgtgcccagcccgg

SEQ ID NO: 310612 - DNA, 18 bp, Homo sapiens
cactgtgcgttttagagt

SEQ ID NO: 310613 - DNA, 20 bp, Homo sapiens
cactgtgcgttttagagtat

SEQ ID NO: 310614 - DNA, 15 bp, Homo sapiens
cactgtggaacacta

SEQ ID NO: 310615 - DNA, 15 bp, Homo sapiens
cactgtggccagagc

SEQ ID NO: 310616 - DNA, 16 bp, Homo sapiens
cactgtggccagagct

SEQ ID NO: 310617 - DNA, 20 bp, Homo sapiens
cactgtggggcaagcctgag

SEQ ID NO: 310618 - DNA, 21 bp, Homo sapiens
cactgtggggcaagcctgagt

SEQ ID NO: 310619 - DNA, 20 bp, Homo sapiens
cactgtggttgcaaaaccca

SEQ ID NO: 310620 - DNA, 18 bp, Homo sapiens
cactgtgtaaccagcagt

SEQ ID NO: 310621 - DNA, 23 bp, Homo sapiens
cactgttagctttttaaaacatt

SEQ ID NO: 310622 - DNA, 14 bp, Homo sapiens
cactgttccctctg

SEQ ID NO: 310623 - DNA, 16 bp, Homo sapiens
cactgttccctctgct

SEQ ID NO: 310624 - DNA, 17 bp, Homo sapiens
cactgttccctctgctc

SEQ ID NO: 310625 - DNA, 20 bp, Homo sapiens
cactgttccctctgctcctg

SEQ ID NO: 310626 - DNA, 16 bp, Homo sapiens
cactgttgaaaattat

SEQ ID NO: 310627 - DNA, 18 bp, Homo sapiens
cactgttgaaaattattt

SEQ ID NO: 310628 - DNA, 20 bp, Homo sapiens
cactgttgagttggacacac

SEQ ID NO: 310629 - DNA, 22 bp, Homo sapiens
cactgttgagttggacacactg

SEQ ID NO: 310630 - DNA, 14 bp, Homo sapiens
cactgtttctctgc

SEQ ID NO: 310631 - DNA, 16 bp, Homo sapiens
cacttaaaaaatgtcc

SEQ ID NO: 310632 - DNA, 22 bp, Homo sapiens
cacttaaaatcaaatttttctg

SEQ ID NO: 310633 - DNA, 22 bp, Homo sapiens
cacttaaactttgtcacttctg

SEQ ID NO: 310634 - DNA, 13 bp, Homo sapiens
cacttaatcttct

SEQ ID NO: 310635 - DNA, 20 bp, Homo sapiens
cacttaatcttctctcttga

SEQ ID NO: 310636 - DNA, 15 bp, Homo sapiens
cacttaattctgttc

SEQ ID NO: 310637 - DNA, 20 bp, Homo sapiens
cacttacaagtaatgaattt

SEQ ID NO: 310638 - DNA, 15 bp, Homo sapiens
aggggtcaagttatt

SEQ ID NO: 310639 - DNA, 17 bp, Homo sapiens
aggggtcaccttgagag

SEQ ID NO: 310640 - DNA, 13 bp, Homo sapiens
aggggtcagcagg

SEQ ID NO: 310641 - DNA, 16 bp, Homo sapiens
aggggtcagctctggc

SEQ ID NO: 310642 - DNA, 13 bp, Homo sapiens
aggggtcaggctc

SEQ ID NO: 310643 - DNA, 14 bp, Homo sapiens
aggggtcagggacc

SEQ ID NO: 310644 - DNA, 20 bp, Homo sapiens
aggggtcagggaccaaggac

SEQ ID NO: 310645 - DNA, 18 bp, Homo sapiens
aggggtcccagccacccc

SEQ ID NO: 310646 - DNA, 15 bp, Homo sapiens
aggggtcccccctca

SEQ ID NO: 310647 - DNA, 15 bp, Homo sapiens
aggggtctccctgag

SEQ ID NO: 310648 - DNA, 20 bp, Homo sapiens
aggggtctccctgagcctgc

SEQ ID NO: 310649 - DNA, 21 bp, Homo sapiens
aggggtctgtatatacatttc

SEQ ID NO: 310650 - DNA, 23 bp, Homo sapiens
aggggtgcacccactcaccaggg

SEQ ID NO: 310651 - DNA, 21 bp, Homo sapiens
aggggtgcgctcacctgcagc

SEQ ID NO: 310652 - DNA, 17 bp, Homo sapiens
aggggtgggggagaatg

SEQ ID NO: 310653 - DNA, 23 bp, Homo sapiens
aggggtgggggagaatggctctg

SEQ ID NO: 310654 - DNA, 22 bp, Homo sapiens
aggggttttcgaagctcagccc

SEQ ID NO: 310655 - DNA, 21 bp, Homo sapiens
aggggttttttggttcctttt

SEQ ID NO: 310656 - DNA, 22 bp, Homo sapiens
agggtaataaacttagaataaa

SEQ ID NO: 310657 - DNA, 14 bp, Homo sapiens
agggtacagtttgg

SEQ ID NO: 310658 - DNA, 17 bp, Homo sapiens
agggtagagcaaaggag

SEQ ID NO: 310659 - DNA, 21 bp, Homo sapiens
agggtaggaggtttggatggg

SEQ ID NO: 310660 - DNA, 17 bp, Homo sapiens
agggtaggcaaggctgc

SEQ ID NO: 310661 - DNA, 16 bp, Homo sapiens
agggtagggggcctga

SEQ ID NO: 310662 - DNA, 22 bp, Homo sapiens
agggtatccaagttggactggg

SEQ ID NO: 310663 - DNA, 21 bp, Homo sapiens
agggtatcccagacccctctc

SEQ ID NO: 310664 - DNA, 17 bp, Homo sapiens
agggtcattttcctttc

SEQ ID NO: 310665 - DNA, 20 bp, Homo sapiens
agggtcccatttctcactga

SEQ ID NO: 310666 - DNA, 19 bp, Homo sapiens
agggtccctaattctcttc

SEQ ID NO: 310667 - DNA, 22 bp, Homo sapiens
agggtccctaggtgggtcaact

SEQ ID NO: 310668 - DNA, 17 bp, Homo sapiens
agggtccgcaccagctg

SEQ ID NO: 310669 - DNA, 19 bp, Homo sapiens
agggtccgcaccagctgct

SEQ ID NO: 310670 - DNA, 19 bp, Homo sapiens
agggtcctgattctccctg

SEQ ID NO: 310671 - DNA, 22 bp, Homo sapiens
agggtcctgctatttcccaagc

SEQ ID NO: 310672 - DNA, 14 bp, Homo sapiens
agggtcctggctcc

SEQ ID NO: 310673 - DNA, 20 bp, Homo sapiens
agggtcctggctcctgaggg

SEQ ID NO: 310674 - DNA, 19 bp, Homo sapiens
agggtctcgtcaggaggtg

SEQ ID NO: 310675 - DNA, 23 bp, Homo sapiens
agggtctcgtcaggaggtgcctg

SEQ ID NO: 310676 - DNA, 13 bp, Homo sapiens
agggtctgctctt

SEQ ID NO: 310677 - DNA, 22 bp, Homo sapiens
agggtcttgggctactggcagc

SEQ ID NO: 310678 - DNA, 18 bp, Homo sapiens
agggtctttactgggaag

SEQ ID NO: 310679 - DNA, 16 bp, Homo sapiens
agggtgacatcccagg

SEQ ID NO: 310680 - DNA, 16 bp, Homo sapiens
agggtgaggcgtggga

SEQ ID NO: 310681 - DNA, 23 bp, Homo sapiens
agggtgccatccacattttaaca

SEQ ID NO: 310682 - DNA, 12 bp, Homo sapiens
agggtggagact

SEQ ID NO: 310683 - DNA, 21 bp, Homo sapiens
agggtggagactaagccctgt

SEQ ID NO: 310684 - DNA, 22 bp, Homo sapiens
agggtggaggaaggtgctgagc

SEQ ID NO: 310685 - DNA, 15 bp, Homo sapiens
agggtggcatcccag

SEQ ID NO: 310686 - DNA, 21 bp, Homo sapiens
agggtggcatcccagtggcct

SEQ ID NO: 310687 - DNA, 11 bp, Homo sapiens
agggtggccct

SEQ ID NO: 310688 - DNA, 14 bp, Homo sapiens
agggtgggcagcct

SEQ ID NO: 310689 - DNA, 12 bp, Homo sapiens
agggtgggcgtg

SEQ ID NO: 310690 - DNA, 22 bp, Homo sapiens
agggtgggcgtgacttcagact

SEQ ID NO: 310691 - DNA, 15 bp, Homo sapiens
agggtggggcttaga

SEQ ID NO: 310692 - DNA, 21 bp, Homo sapiens
agggtggggtaaggaggagaa

SEQ ID NO: 310693 - DNA, 14 bp, Homo sapiens
agggtggtgctggg

SEQ ID NO: 310694 - DNA, 23 bp, Homo sapiens
agggtggtgctgggactgagcca

SEQ ID NO: 310695 - DNA, 15 bp, Homo sapiens
agggtggttcctgtt

SEQ ID NO: 310696 - DNA, 22 bp, Homo sapiens
agggtgtcgtcctgcagtgtga

SEQ ID NO: 310697 - DNA, 13 bp, Homo sapiens
agggtgtggcttg

SEQ ID NO: 310698 - DNA, 15 bp, Homo sapiens
agggtgtggcttgga

SEQ ID NO: 310699 - DNA, 20 bp, Homo sapiens
agggtgtggcttggaacatt

SEQ ID NO: 310700 - DNA, 15 bp, Homo sapiens
agggttaaagaaagg

SEQ ID NO: 310701 - DNA, 19 bp, Homo sapiens
agggttaaagaaaggcaga

SEQ ID NO: 310702 - DNA, 13 bp, Homo sapiens
agggttataataa

SEQ ID NO: 310703 - DNA, 14 bp, Homo sapiens
agggttcaaaatgt

SEQ ID NO: 310704 - DNA, 18 bp, Homo sapiens
agggttcaaaatgtctgt

SEQ ID NO: 310705 - DNA, 22 bp, Homo sapiens
agggttcaaaatgtctgtagct

SEQ ID NO: 310706 - DNA, 12 bp, Homo sapiens
agggttccagac

SEQ ID NO: 310707 - DNA, 20 bp, Homo sapiens
agggttccagacagggtggg

SEQ ID NO: 310708 - DNA, 18 bp, Homo sapiens
agggttcctcttaggtca

SEQ ID NO: 310709 - DNA, 22 bp, Homo sapiens
agggttctagaaggggcgaggc

SEQ ID NO: 310710 - DNA, 17 bp, Homo sapiens
agggttgcttctgagtg

SEQ ID NO: 310711 - DNA, 15 bp, Homo sapiens
agggttggggagggg

SEQ ID NO: 310712 - DNA, 11 bp, Homo sapiens
agggtttctga

SEQ ID NO: 310713 - DNA, 21 bp, Homo sapiens
agggtttgtttgctgcttttg

SEQ ID NO: 310714 - DNA, 11 bp, Homo sapiens
agggttttgta

SEQ ID NO: 310715 - DNA, 14 bp, Homo sapiens
aggtaaaagagcca

SEQ ID NO: 310716 - DNA, 22 bp, Homo sapiens
aggtaaaagagccaagttcaaa

SEQ ID NO: 310717 - DNA, 20 bp, Homo sapiens
aggtaataggaagaacagta

SEQ ID NO: 310718 - DNA, 21 bp, Homo sapiens
aggtaataggaagaacagtac

SEQ ID NO: 310719 - DNA, 20 bp, Homo sapiens
aggtaccaagatcacaaata

SEQ ID NO: 310720 - DNA, 24 bp, Homo sapiens
aggtaccaagatcacaaatagtgt

SEQ ID NO: 310721 - DNA, 15 bp, Homo sapiens
aggtaccacccttca

SEQ ID NO: 310722 - DNA, 21 bp, Homo sapiens
aggtactgatcctgtttcttg

SEQ ID NO: 310723 - DNA, 22 bp, Homo sapiens
aggtagatcgcttgagcccagg

SEQ ID NO: 310724 - DNA, 16 bp, Homo sapiens
aggtagccctggccag

SEQ ID NO: 310725 - DNA, 15 bp, Homo sapiens
aggtagcgagctgct

SEQ ID NO: 310726 - DNA, 19 bp, Homo sapiens
aggtagctgaaaggggaag

SEQ ID NO: 310727 - DNA, 12 bp, Homo sapiens
cagaaaacagaa

SEQ ID NO: 310728 - DNA, 17 bp, Homo sapiens
cagaaaacagaaaaaaa

SEQ ID NO: 310729 - DNA, 13 bp, Homo sapiens
cagaaaacctcaa

SEQ ID NO: 310730 - DNA, 15 bp, Homo sapiens
cagaaaactggcagt

SEQ ID NO: 310731 - DNA, 17 bp, Homo sapiens
cagaaaagagaagaaag

SEQ ID NO: 310732 - DNA, 17 bp, Homo sapiens
cagaaaagggaagttgt

SEQ ID NO: 310733 - DNA, 21 bp, Homo sapiens
cagaaaatatgatatatatgt

SEQ ID NO: 310734 - DNA, 19 bp, Homo sapiens
cagaaaatattatgtgttt

SEQ ID NO: 310735 - DNA, 21 bp, Homo sapiens
cagaaacagggggaaaatgtt

SEQ ID NO: 310736 - DNA, 13 bp, Homo sapiens
cagaaaccagtta

SEQ ID NO: 310737 - DNA, 14 bp, Homo sapiens
cagaaaccagttat

SEQ ID NO: 310738 - DNA, 17 bp, Homo sapiens
cagaaacccccaggagg

SEQ ID NO: 310739 - DNA, 22 bp, Homo sapiens
cagaaacccccaggaggagaga

SEQ ID NO: 310740 - DNA, 20 bp, Homo sapiens
cagaaacttgtgaagtggaa

SEQ ID NO: 310741 - DNA, 15 bp, Homo sapiens
cagaaagagagaacc

SEQ ID NO: 310742 - DNA, 19 bp, Homo sapiens
cagaaagcaggagcagctg

SEQ ID NO: 310743 - DNA, 16 bp, Homo sapiens
cagaaaggatatttaa

SEQ ID NO: 310744 - DNA, 20 bp, Homo sapiens
cagaaaggttttcttctttt

SEQ ID NO: 310745 - DNA, 22 bp, Homo sapiens
cagaaatactataacatatgta

SEQ ID NO: 310746 - DNA, 16 bp, Homo sapiens
cagaaatgctgcctgc

SEQ ID NO: 310747 - DNA, 19 bp, Homo sapiens
cagaaatgctgcctgcctg

SEQ ID NO: 310748 - DNA, 20 bp, Homo sapiens
cagaaatgctgcctgcctgt

SEQ ID NO: 310749 - DNA, 21 bp, Homo sapiens
cagaaatggggaattctctaa

SEQ ID NO: 310750 - DNA, 23 bp, Homo sapiens
cagaaattagaaaccttaatatg

SEQ ID NO: 310751 - DNA, 15 bp, Homo sapiens
cagaaattcttcaat

SEQ ID NO: 310752 - DNA, 17 bp, Homo sapiens
cagaaattcttcaattt

SEQ ID NO: 310753 - DNA, 19 bp, Homo sapiens
cagaaatttttatttttct

SEQ ID NO: 310754 - DNA, 14 bp, Homo sapiens
cagaacaacaacaa

SEQ ID NO: 310755 - DNA, 13 bp, Homo sapiens
cagaacacctggc

SEQ ID NO: 310756 - DNA, 18 bp, Homo sapiens
cagaacacctggccgggt

SEQ ID NO: 310757 - DNA, 23 bp, Homo sapiens
cagaacagccctcggcctccgag

SEQ ID NO: 310758 - DNA, 13 bp, Homo sapiens
cagaacagctgaa

SEQ ID NO: 310759 - DNA, 19 bp, Homo sapiens
cagaacatgagtgctgatg

SEQ ID NO: 310760 - DNA, 13 bp, Homo sapiens
cagaacatttctc

SEQ ID NO: 310761 - DNA, 17 bp, Homo sapiens
cagaacatttctcatgt

SEQ ID NO: 310762 - DNA, 18 bp, Homo sapiens
cagaacatttctcatgtg

SEQ ID NO: 310763 - DNA, 19 bp, Homo sapiens
cagaacatttctcatgtgc

SEQ ID NO: 310764 - DNA, 16 bp, Homo sapiens
cagaaccaacgggtct

SEQ ID NO: 310765 - DNA, 21 bp, Homo sapiens
cagaaccagcactcccagggc

SEQ ID NO: 310766 - DNA, 20 bp, Homo sapiens
cagaaccagtgtctgaacca

SEQ ID NO: 310767 - DNA, 16 bp, Homo sapiens
cagaaccccaactccc

SEQ ID NO: 310768 - DNA, 17 bp, Homo sapiens
cagaaccccaactccca

SEQ ID NO: 310769 - DNA, 14 bp, Homo sapiens
cagaacctggtggc

SEQ ID NO: 310770 - DNA, 19 bp, Homo sapiens
cagaacctttgtcaacttc

SEQ ID NO: 310771 - DNA, 16 bp, Homo sapiens
cagaacgcaccccact

SEQ ID NO: 310772 - DNA, 22 bp, Homo sapiens
cagaacgcaccccactgggaga

SEQ ID NO: 310773 - DNA, 14 bp, Homo sapiens
cagaacgggcctcc

SEQ ID NO: 310774 - DNA, 18 bp, Homo sapiens
cagaacgggttctcccat

SEQ ID NO: 310775 - DNA, 16 bp, Homo sapiens
cagaacgtctctcacc

SEQ ID NO: 310776 - DNA, 15 bp, Homo sapiens
cagaactcagcctta

SEQ ID NO: 310777 - DNA, 16 bp, Homo sapiens
cagaactcagccttaa

SEQ ID NO: 310778 - DNA, 12 bp, Homo sapiens
cagaactcctgt

SEQ ID NO: 310779 - DNA, 15 bp, Homo sapiens
cagaactcgatgcac

SEQ ID NO: 310780 - DNA, 19 bp, Homo sapiens
cagaactcgatgcactgac

SEQ ID NO: 310781 - DNA, 23 bp, Homo sapiens
cagaactcgatgcactgacctgc

SEQ ID NO: 310782 - DNA, 15 bp, Homo sapiens
cagaactctcagact

SEQ ID NO: 310783 - DNA, 16 bp, Homo sapiens
cagaactgagctcctc

SEQ ID NO: 310784 - DNA, 17 bp, Homo sapiens
cagaactgagctcctct

SEQ ID NO: 310785 - DNA, 15 bp, Homo sapiens
cagaactgcccccac

SEQ ID NO: 310786 - DNA, 15 bp, Homo sapiens
cagaactgctaccat

SEQ ID NO: 310787 - DNA, 16 bp, Homo sapiens
cagaactgctaccatg

SEQ ID NO: 310788 - DNA, 17 bp, Homo sapiens
cagaactgggaaaacag

SEQ ID NO: 310789 - DNA, 18 bp, Homo sapiens
cagaagaaattatttaat

SEQ ID NO: 310790 - DNA, 23 bp, Homo sapiens
cagaagaaattatttaatatgca

SEQ ID NO: 310791 - DNA, 19 bp, Homo sapiens
cagaagaatattcaggact

SEQ ID NO: 310792 - DNA, 20 bp, Homo sapiens
cagaagaattttttttttaa

SEQ ID NO: 310793 - DNA, 18 bp, Homo sapiens
cagaagacctccctgtga

SEQ ID NO: 310794 - DNA, 20 bp, Homo sapiens
cagaagagatgggcttgttt

SEQ ID NO: 310795 - DNA, 13 bp, Homo sapiens
cagaagatagaga

SEQ ID NO: 310796 - DNA, 18 bp, Homo sapiens
cagaagcctattgtaaat

SEQ ID NO: 310797 - DNA, 16 bp, Homo sapiens
cagaagcggcctgtgc

SEQ ID NO: 310798 - DNA, 13 bp, Homo sapiens
cagaagcgtctcc

SEQ ID NO: 310799 - DNA, 16 bp, Homo sapiens
cagaagctgcagctgg

SEQ ID NO: 310800 - DNA, 14 bp, Homo sapiens
cagaagcttcagaa

SEQ ID NO: 310801 - DNA, 13 bp, Homo sapiens
cagaagcttgtat

SEQ ID NO: 310802 - DNA, 14 bp, Homo sapiens
cagaaggaggaagg

SEQ ID NO: 310803 - DNA, 22 bp, Homo sapiens
cagaaggaggaagggactggtc

SEQ ID NO: 310804 - DNA, 13 bp, Homo sapiens
cagaaggagggca

SEQ ID NO: 310805 - DNA, 15 bp, Homo sapiens
cagaaggagggcaga

SEQ ID NO: 310806 - DNA, 18 bp, Homo sapiens
cagaaggagggcagagcc

SEQ ID NO: 310807 - DNA, 15 bp, Homo sapiens
cagaaggcaaagttt

SEQ ID NO: 310808 - DNA, 18 bp, Homo sapiens
cagaaggccacaggccac

SEQ ID NO: 310809 - DNA, 14 bp, Homo sapiens
cagaagggaaacag

SEQ ID NO: 310810 - DNA, 15 bp, Homo sapiens
cagaagggaaacagt

SEQ ID NO: 310811 - DNA, 17 bp, Homo sapiens
cagaagggaattgctca

SEQ ID NO: 310812 - DNA, 18 bp, Homo sapiens
cagaagtgaatgggaaag

SEQ ID NO: 310813 - DNA, 20 bp, Homo sapiens
cagaagtgaatgggaaaggg

SEQ ID NO: 310814 - DNA, 23 bp, Homo sapiens
cagaagtgctctttgtggcagtg

SEQ ID NO: 310815 - DNA, 17 bp, Homo sapiens
cagaagtgtttcatgca

SEQ ID NO: 310816 - DNA, 13 bp, Homo sapiens
cagaagtttctac

SEQ ID NO: 310817 - DNA, 22 bp, Homo sapiens
cagaataaatgggtaacactga

SEQ ID NO: 310818 - DNA, 15 bp, Homo sapiens
cagaataatgttcta

SEQ ID NO: 310819 - DNA, 13 bp, Homo sapiens
cagaatacaattc

SEQ ID NO: 310820 - DNA, 21 bp, Homo sapiens
cagaatagatctgatggtgag

SEQ ID NO: 310821 - DNA, 20 bp, Homo sapiens
cagaatattctgtaaaccta

SEQ ID NO: 310822 - DNA, 20 bp, Homo sapiens
cagaatattgacaagctagg

SEQ ID NO: 310823 - DNA, 16 bp, Homo sapiens
cagaatcaaacctttt

SEQ ID NO: 310824 - DNA, 14 bp, Homo sapiens
cagaatcattgctt

SEQ ID NO: 310825 - DNA, 13 bp, Homo sapiens
cagaatctgctgt

SEQ ID NO: 310826 - DNA, 13 bp, Homo sapiens
cagaatggaaaaa

SEQ ID NO: 310827 - DNA, 14 bp, Homo sapiens
cagaatggaaaaaa

SEQ ID NO: 310828 - DNA, 15 bp, Homo sapiens
cagaatggaaaaaaa

SEQ ID NO: 310829 - DNA, 19 bp, Homo sapiens
cagaattagtcctcacagc

SEQ ID NO: 310830 - DNA, 17 bp, Homo sapiens
cagaattattcatagct

SEQ ID NO: 310831 - DNA, 15 bp, Homo sapiens
cagacaaaaagaaca

SEQ ID NO: 310832 - DNA, 21 bp, Homo sapiens
cagacaaagtaattcctctca

SEQ ID NO: 310833 - DNA, 19 bp, Homo sapiens
cagacaagcaacaggtttt

SEQ ID NO: 310834 - DNA, 16 bp, Homo sapiens
cagacacacaacatca

SEQ ID NO: 310835 - DNA, 11 bp, Homo sapiens
cagacacacac

SEQ ID NO: 310836 - DNA, 12 bp, Homo sapiens
cagacacacaca

SEQ ID NO: 310837 - DNA, 13 bp, Homo sapiens
cagacacacacac

SEQ ID NO: 310838 - DNA, 18 bp, Homo sapiens
cagacacacacacgcacg

SEQ ID NO: 310839 - DNA, 11 bp, Homo sapiens
cagacacagag

SEQ ID NO: 310840 - DNA, 14 bp, Homo sapiens
cagacacatgctgt

SEQ ID NO: 310841 - DNA, 23 bp, Homo sapiens
cagacaccgtttgtcccccgggg

SEQ ID NO: 310842 - DNA, 21 bp, Homo sapiens
cagacactaagttatagtata

SEQ ID NO: 310843 - DNA, 16 bp, Homo sapiens
cagacactacattacc

SEQ ID NO: 310844 - DNA, 23 bp, Homo sapiens
cagacagaagtcactcaattgtt

SEQ ID NO: 310845 - DNA, 14 bp, Homo sapiens
cagacagagtggat

SEQ ID NO: 310846 - DNA, 16 bp, Homo sapiens
cagacagggtggggct

SEQ ID NO: 310847 - DNA, 16 bp, Homo sapiens
cagacattaaataatc

SEQ ID NO: 310848 - DNA, 13 bp, Homo sapiens
cagacattgtatt

SEQ ID NO: 310849 - DNA, 19 bp, Homo sapiens
cagaccaaaataatacaac

SEQ ID NO: 310850 - DNA, 21 bp, Homo sapiens
cagaccaccagccgccccagc

SEQ ID NO: 310851 - DNA, 13 bp, Homo sapiens
cagaccagagctc

SEQ ID NO: 310852 - DNA, 17 bp, Homo sapiens
cagaccagagctgtctg

SEQ ID NO: 310853 - DNA, 22 bp, Homo sapiens
cagaccagagctgtctgaactc

SEQ ID NO: 310854 - DNA, 13 bp, Homo sapiens
cagacccagggca

SEQ ID NO: 310855 - DNA, 13 bp, Homo sapiens
cagaccccatcca

SEQ ID NO: 310856 - DNA, 20 bp, Homo sapiens
cagacccccaccccttcccc

SEQ ID NO: 310857 - DNA, 17 bp, Homo sapiens
cagacccccagcaaccc

SEQ ID NO: 310858 - DNA, 18 bp, Homo sapiens
cagacccccagcaaccct

SEQ ID NO: 310859 - DNA, 15 bp, Homo sapiens
cagacccccagtgta

SEQ ID NO: 310860 - DNA, 14 bp, Homo sapiens
cagacccctaccct

SEQ ID NO: 310861 - DNA, 13 bp, Homo sapiens
cagacccctctgg

SEQ ID NO: 310862 - DNA, 12 bp, Homo sapiens
aggtaggagacc

SEQ ID NO: 310863 - DNA, 12 bp, Homo sapiens
aggtaggccctt

SEQ ID NO: 310864 - DNA, 23 bp, Homo sapiens
aggtaggcccttgtcctgccagc

SEQ ID NO: 310865 - DNA, 14 bp, Homo sapiens
aggtaggtgtattc

SEQ ID NO: 310866 - DNA, 23 bp, Homo sapiens
aggtagtgattaactgtgaataa

SEQ ID NO: 310867 - DNA, 15 bp, Homo sapiens
aggtataaaaaataa

SEQ ID NO: 310868 - DNA, 20 bp, Homo sapiens
aggtataaaaaataagtaaa

SEQ ID NO: 310869 - DNA, 13 bp, Homo sapiens
aggtatgaataag

SEQ ID NO: 310870 - DNA, 22 bp, Homo sapiens
aggtatggaagggtttgtggct

SEQ ID NO: 310871 - DNA, 14 bp, Homo sapiens
aggtatgggacctg

SEQ ID NO: 310872 - DNA, 12 bp, Homo sapiens
aggtatttgaaa

SEQ ID NO: 310873 - DNA, 13 bp, Homo sapiens
aggtatttgaaaa

SEQ ID NO: 310874 - DNA, 17 bp, Homo sapiens
aggtattttgaatacca

SEQ ID NO: 310875 - DNA, 19 bp, Homo sapiens
aggtcaaggcctgtccctg

SEQ ID NO: 310876 - DNA, 18 bp, Homo sapiens
aggtcaagtaagaagaca

SEQ ID NO: 310877 - DNA, 22 bp, Homo sapiens
aggtcaagtaagaagacatgaa

SEQ ID NO: 310878 - DNA, 15 bp, Homo sapiens
aggtcaatgaaatat

SEQ ID NO: 310879 - DNA, 18 bp, Homo sapiens
aggtcaatgaaatatttg

SEQ ID NO: 310880 - DNA, 19 bp, Homo sapiens
aggtcaatgaaatatttgc

SEQ ID NO: 310881 - DNA, 23 bp, Homo sapiens
aggtcagatggaggttctcagag

SEQ ID NO: 310882 - DNA, 17 bp, Homo sapiens
aggtcagtacccacctg

SEQ ID NO: 310883 - DNA, 19 bp, Homo sapiens
aggtcagtacccacctgag

SEQ ID NO: 310884 - DNA, 20 bp, Homo sapiens
aggtcagtgttataaaatct

SEQ ID NO: 310885 - DNA, 13 bp, Homo sapiens
aggtcatcccggg

SEQ ID NO: 310886 - DNA, 20 bp, Homo sapiens
aggtcatcccggggccatgg

SEQ ID NO: 310887 - DNA, 23 bp, Homo sapiens
aggtcatgcattgtaatcatcat

SEQ ID NO: 310888 - DNA, 15 bp, Homo sapiens
aggtccaagggccat

SEQ ID NO: 310889 - DNA, 14 bp, Homo sapiens
aggtcccacgtctg

SEQ ID NO: 310890 - DNA, 14 bp, Homo sapiens
aggtcccaggaagt

SEQ ID NO: 310891 - DNA, 14 bp, Homo sapiens
aggtcccagtgcca

SEQ ID NO: 310892 - DNA, 13 bp, Homo sapiens
aggtcccctccac

SEQ ID NO: 310893 - DNA, 18 bp, Homo sapiens
aggtcccgaatggagtcc

SEQ ID NO: 310894 - DNA, 23 bp, Homo sapiens
aggtcccgagccccctgtccttc

SEQ ID NO: 310895 - DNA, 20 bp, Homo sapiens
aggtccgagctctgtcctct

SEQ ID NO: 310896 - DNA, 16 bp, Homo sapiens
aggtcctacagggcca

SEQ ID NO: 310897 - DNA, 17 bp, Homo sapiens
aggtcctcttaggtccc

SEQ ID NO: 310898 - DNA, 17 bp, Homo sapiens
caaatgcctctgccttg

SEQ ID NO: 310899 - DNA, 15 bp, Homo sapiens
caaatgctactcagt

SEQ ID NO: 310900 - DNA, 18 bp, Homo sapiens
caaatgctgcgcccttcc

SEQ ID NO: 310901 - DNA, 20 bp, Homo sapiens
caaatgctgtgcaaacagtg

SEQ ID NO: 310902 - DNA, 18 bp, Homo sapiens
caaatggatgtaatatag

SEQ ID NO: 310903 - DNA, 11 bp, Homo sapiens
caaatgggact

SEQ ID NO: 310904 - DNA, 17 bp, Homo sapiens
caaatgggactgatgtc

SEQ ID NO: 310905 - DNA, 21 bp, Homo sapiens
caaatgggactgatgtcatct

SEQ ID NO: 310906 - DNA, 20 bp, Homo sapiens
caaatgggggcggctggaaa

SEQ ID NO: 310907 - DNA, 23 bp, Homo sapiens
caaatggtttaacttctgcctgt

SEQ ID NO: 310908 - DNA, 23 bp, Homo sapiens
caaatgtccaagcatcagcaaga

SEQ ID NO: 310909 - DNA, 19 bp, Homo sapiens
caaatgtcctccagaagcc

SEQ ID NO: 310910 - DNA, 21 bp, Homo sapiens
caaatgtggcaattattttgg

SEQ ID NO: 310911 - DNA, 12 bp, Homo sapiens
caaatgtgtact

SEQ ID NO: 310912 - DNA, 20 bp, Homo sapiens
caaatgttttcatttacagg

SEQ ID NO: 310913 - DNA, 19 bp, Homo sapiens
caaattataaaaagccact

SEQ ID NO: 310914 - DNA, 16 bp, Homo sapiens
caaattatcaagctaa

SEQ ID NO: 310915 - DNA, 17 bp, Homo sapiens
caaattattctagtcaa

SEQ ID NO: 310916 - DNA, 20 bp, Homo sapiens
caaattatttgtgtaataga

SEQ ID NO: 310917 - DNA, 21 bp, Homo sapiens
caaattccacccctccttccc

SEQ ID NO: 310918 - DNA, 20 bp, Homo sapiens
caaattgatgggtgggctag

SEQ ID NO: 310919 - DNA, 12 bp, Homo sapiens
caaattgctgag

SEQ ID NO: 310920 - DNA, 14 bp, Homo sapiens
caaatttaaaacaa

SEQ ID NO: 310921 - DNA, 23 bp, Homo sapiens
caaatttgaatggattaaatggc

SEQ ID NO: 310922 - DNA, 19 bp, Homo sapiens
caaatttgtagggtttcta

SEQ ID NO: 310923 - DNA, 21 bp, Homo sapiens
caaattttcactgctgctcct

SEQ ID NO: 310924 - DNA, 19 bp, Homo sapiens
caaatttttctgggaagaa

SEQ ID NO: 310925 - DNA, 21 bp, Homo sapiens
caaatttttttgtatttttag

SEQ ID NO: 310926 - DNA, 13 bp, Homo sapiens
caacaaaaatttg

SEQ ID NO: 310927 - DNA, 13 bp, Homo sapiens
caacaaacactgt

SEQ ID NO: 310928 - DNA, 20 bp, Homo sapiens
caacaaagaagaaccatctt

SEQ ID NO: 310929 - DNA, 17 bp, Homo sapiens
caacaaagcacagtgtt

SEQ ID NO: 310930 - DNA, 15 bp, Homo sapiens
caacaagagtttatt

SEQ ID NO: 310931 - DNA, 14 bp, Homo sapiens
caacaagggagaga

SEQ ID NO: 310932 - DNA, 12 bp, Homo sapiens
caacaatccttt

SEQ ID NO: 310933 - DNA, 18 bp, Homo sapiens
caacaatggggtgggccc

SEQ ID NO: 310934 - DNA, 19 bp, Homo sapiens
caacaatggggtgggccca

SEQ ID NO: 310935 - DNA, 18 bp, Homo sapiens
caacaattaggtctgcat

SEQ ID NO: 310936 - DNA, 20 bp, Homo sapiens
caacaattaggtctgcattt

SEQ ID NO: 310937 - DNA, 20 bp, Homo sapiens
caacaatttaggaatgctca

SEQ ID NO: 310938 - DNA, 22 bp, Homo sapiens
caacaatttaggaatgctcaat

SEQ ID NO: 310939 - DNA, 21 bp, Homo sapiens
caacacaaggtgggcagggag

SEQ ID NO: 310940 - DNA, 13 bp, Homo sapiens
caacacacacaca

SEQ ID NO: 310941 - DNA, 14 bp, Homo sapiens
caacaccacagaca

SEQ ID NO: 310942 - DNA, 16 bp, Homo sapiens
caacaccacagacaca

SEQ ID NO: 310943 - DNA, 20 bp, Homo sapiens
caacaccacagacacacaca

SEQ ID NO: 310944 - DNA, 13 bp, Homo sapiens
caacaccacccct

SEQ ID NO: 310945 - DNA, 18 bp, Homo sapiens
caacaccccacaggaggg

SEQ ID NO: 310946 - DNA, 14 bp, Homo sapiens
caacactcttcttg

SEQ ID NO: 310947 - DNA, 15 bp, Homo sapiens
caacactcttcttga

SEQ ID NO: 310948 - DNA, 21 bp, Homo sapiens
caacactgaacctctggctag

SEQ ID NO: 310949 - DNA, 21 bp, Homo sapiens
caacactgccagaagtgtgtt

SEQ ID NO: 310950 - DNA, 22 bp, Homo sapiens
caacactgccagaagtgtgttt

SEQ ID NO: 310951 - DNA, 19 bp, Homo sapiens
caacacttcagactgcaag

SEQ ID NO: 310952 - DNA, 20 bp, Homo sapiens
caacactttgagcattttta

SEQ ID NO: 310953 - DNA, 14 bp, Homo sapiens
caacagaaaacaat

SEQ ID NO: 310954 - DNA, 21 bp, Homo sapiens
caacagagatgccatgatatc

SEQ ID NO: 310955 - DNA, 14 bp, Homo sapiens
caacagagcaagac

SEQ ID NO: 310956 - DNA, 17 bp, Homo sapiens
caacagatactggaagt

SEQ ID NO: 310957 - DNA, 17 bp, Homo sapiens
caacagatcaatttgta

SEQ ID NO: 310958 - DNA, 22 bp, Homo sapiens
caacagcctgtttgggaggctg

SEQ ID NO: 310959 - DNA, 14 bp, Homo sapiens
caacagctgatgcc

SEQ ID NO: 310960 - DNA, 12 bp, Homo sapiens
caacagcttctt

SEQ ID NO: 310961 - DNA, 22 bp, Homo sapiens
caacagcttcttgcttgtaaaa

SEQ ID NO: 310962 - DNA, 21 bp, Homo sapiens
caacaggtgctgaactgtgca

SEQ ID NO: 310963 - DNA, 22 bp, Homo sapiens
caacaggttgaggctaaaacaa

SEQ ID NO: 310964 - DNA, 15 bp, Homo sapiens
caacaggttttcctg

SEQ ID NO: 310965 - DNA, 19 bp, Homo sapiens
caacaggttttcctgaaga

SEQ ID NO: 310966 - DNA, 23 bp, Homo sapiens
caacagtacctgaaggattatta

SEQ ID NO: 310967 - DNA, 13 bp, Homo sapiens
caacagtcagcca

SEQ ID NO: 310968 - DNA, 19 bp, Homo sapiens
caacagtcagccagcttgg

SEQ ID NO: 310969 - DNA, 11 bp, Homo sapiens
caacagtgagt

SEQ ID NO: 310970 - DNA, 17 bp, Homo sapiens
caacagtttgatgctga

SEQ ID NO: 310971 - DNA, 19 bp, Homo sapiens
caacataaaacaaaaccaa

SEQ ID NO: 310972 - DNA, 16 bp, Homo sapiens
caacatcaagaaaaca

SEQ ID NO: 310973 - DNA, 12 bp, Homo sapiens
caacatcagctt

SEQ ID NO: 310974 - DNA, 23 bp, Homo sapiens
caacatgcctgccccaaacaaat

SEQ ID NO: 310975 - DNA, 17 bp, Homo sapiens
caacatgtatgtggata

SEQ ID NO: 310976 - DNA, 19 bp, Homo sapiens
caacatgtatgtggataca

SEQ ID NO: 310977 - DNA, 17 bp, Homo sapiens
caacattcaaaagcaca

SEQ ID NO: 310978 - DNA, 18 bp, Homo sapiens
caacattgccttgcattt

SEQ ID NO: 310979 - DNA, 23 bp, Homo sapiens
caacatttacagtccttcaaaat

SEQ ID NO: 310980 - DNA, 13 bp, Homo sapiens
caacatttctgcc

SEQ ID NO: 310981 - DNA, 14 bp, Homo sapiens
caaccaccgctccc

SEQ ID NO: 310982 - DNA, 17 bp, Homo sapiens
caaccaccgctccccag

SEQ ID NO: 310983 - DNA, 20 bp, Homo sapiens
caaccaccgctccccagccc

SEQ ID NO: 310984 - DNA, 21 bp, Homo sapiens
caaccaccgctccccagccca

SEQ ID NO: 310985 - DNA, 18 bp, Homo sapiens
caaccacctctggccctg

SEQ ID NO: 310986 - DNA, 19 bp, Homo sapiens
caaccactaatttgtcact

SEQ ID NO: 310987 - DNA, 23 bp, Homo sapiens
caaccactggtctgtagggattt

SEQ ID NO: 310988 - DNA, 19 bp, Homo sapiens
caaccagagccccccacaa

SEQ ID NO: 310989 - DNA, 20 bp, Homo sapiens
agcctctccccgctctggat

SEQ ID NO: 310990 - DNA, 14 bp, Homo sapiens
agcctctcccggct

SEQ ID NO: 310991 - DNA, 18 bp, Homo sapiens
agcctctcccggctgcct

SEQ ID NO: 310992 - DNA, 23 bp, Homo sapiens
agcctctccttgccccagtcctg

SEQ ID NO: 310993 - DNA, 18 bp, Homo sapiens
agcctctgccctgcctcc

SEQ ID NO: 310994 - DNA, 14 bp, Homo sapiens
agcctctgcctccc

SEQ ID NO: 310995 - DNA, 12 bp, Homo sapiens
agcctctggcca

SEQ ID NO: 310996 - DNA, 12 bp, Homo sapiens
agcctctggcta

SEQ ID NO: 310997 - DNA, 20 bp, Homo sapiens
agcctctggctagaggccag

SEQ ID NO: 310998 - DNA, 20 bp, Homo sapiens
agcctcttaaagctgcctgt

SEQ ID NO: 310999 - DNA, 15 bp, Homo sapiens
agcctcttctgaaga

SEQ ID NO: 311000 - DNA, 18 bp, Homo sapiens
agcctcttgctcagagct

SEQ ID NO: 311001 - DNA, 14 bp, Homo sapiens
agcctgagccacag

SEQ ID NO: 311002 - DNA, 16 bp, Homo sapiens
agcctgagccacagtg

SEQ ID NO: 311003 - DNA, 15 bp, Homo sapiens
agcctgagccttaga

SEQ ID NO: 311004 - DNA, 16 bp, Homo sapiens
agcctgaggcaggaga

SEQ ID NO: 311005 - DNA, 13 bp, Homo sapiens
agcctgatggcca

SEQ ID NO: 311006 - DNA, 19 bp, Homo sapiens
agcctgatggccaaggggg

SEQ ID NO: 311007 - DNA, 17 bp, Homo sapiens
agcctgcaaactcactg

SEQ ID NO: 311008 - DNA, 17 bp, Homo sapiens
agcctgcacacacctgc

SEQ ID NO: 311009 - DNA, 19 bp, Homo sapiens
agcctgcagggtggtgctg

SEQ ID NO: 311010 - DNA, 13 bp, Homo sapiens
agcctgcatctgt

SEQ ID NO: 311011 - DNA, 23 bp, Homo sapiens
agcctgccgccgtctctgtcccg

SEQ ID NO: 311012 - DNA, 15 bp, Homo sapiens
agcctgcctcccaag

SEQ ID NO: 311013 - DNA, 18 bp, Homo sapiens
agcctgcggcctgctgga

SEQ ID NO: 311014 - DNA, 16 bp, Homo sapiens
agcctgcggctgctgg

SEQ ID NO: 311015 - DNA, 21 bp, Homo sapiens
agcctgcgtggcctggggctg

SEQ ID NO: 311016 - DNA, 15 bp, Homo sapiens
agcctgctgagagcc

SEQ ID NO: 311017 - DNA, 17 bp, Homo sapiens
agcctgctgagagcccc

SEQ ID NO: 311018 - DNA, 18 bp, Homo sapiens
agcctgctgagagccccc

SEQ ID NO: 311019 - DNA, 19 bp, Homo sapiens
agcctgctgagagccccca

SEQ ID NO: 311020 - DNA, 12 bp, Homo sapiens
agcctgctgcat

SEQ ID NO: 311021 - DNA, 14 bp, Homo sapiens
agcctgcttcccac

SEQ ID NO: 311022 - DNA, 15 bp, Homo sapiens
agcctggagcccctg

SEQ ID NO: 311023 - DNA, 18 bp, Homo sapiens
agcctggagcccctgtgt

SEQ ID NO: 311024 - DNA, 20 bp, Homo sapiens
agcctggagcccctgtgtgg

SEQ ID NO: 311025 - DNA, 11 bp, Homo sapiens
agcctggaggc

SEQ ID NO: 311026 - DNA, 23 bp, Homo sapiens
agcctggatgccaaggagcccct

SEQ ID NO: 311027 - DNA, 16 bp, Homo sapiens
agcctggccacgcagc

SEQ ID NO: 311028 - DNA, 20 bp, Homo sapiens
agcctggccacgcagccagg

SEQ ID NO: 311029 - DNA, 21 bp, Homo sapiens
agcctggccacgcagccagga

SEQ ID NO: 311030 - DNA, 13 bp, Homo sapiens
agcctggcctccc

SEQ ID NO: 311031 - DNA, 18 bp, Homo sapiens
agcctggcctcccctgcg

SEQ ID NO: 311032 - DNA, 18 bp, Homo sapiens
agcctggcttttctggct

SEQ ID NO: 311033 - DNA, 16 bp, Homo sapiens
agcctgggactcccag

SEQ ID NO: 311034 - DNA, 17 bp, Homo sapiens
agcctgggactcccagt

SEQ ID NO: 311035 - DNA, 16 bp, Homo sapiens
agcctgggcaacagag

SEQ ID NO: 311036 - DNA, 20 bp, Homo sapiens
agcctgggcagaaatgtgct

SEQ ID NO: 311037 - DNA, 21 bp, Homo sapiens
agcctgggcagaaatgtgctg

SEQ ID NO: 311038 - DNA, 19 bp, Homo sapiens
agcctgggcagccaggctg

SEQ ID NO: 311039 - DNA, 16 bp, Homo sapiens
agcctggggcctggca

SEQ ID NO: 311040 - DNA, 23 bp, Homo sapiens
agcctgggtgagaatcctgcctc

SEQ ID NO: 311041 - DNA, 16 bp, Homo sapiens
agcctggtagagacta

SEQ ID NO: 311042 - DNA, 21 bp, Homo sapiens
agcctggtagagactagggaa

SEQ ID NO: 311043 - DNA, 22 bp, Homo sapiens
agcctggtagagactagggaag

SEQ ID NO: 311044 - DNA, 21 bp, Homo sapiens
agcctggtgacaggcagacac

SEQ ID NO: 311045 - DNA, 20 bp, Homo sapiens
agcctgtccccgccttccct

SEQ ID NO: 311046 - DNA, 13 bp, Homo sapiens
agcctgtcctcac

SEQ ID NO: 311047 - DNA, 22 bp, Homo sapiens
agcctgtcctggtacagcaggg

SEQ ID NO: 311048 - DNA, 16 bp, Homo sapiens
agcctgtcgtgttctc

SEQ ID NO: 311049 - DNA, 13 bp, Homo sapiens
agcctgtctctcc

SEQ ID NO: 311050 - DNA, 15 bp, Homo sapiens
agcctgtctctttcc

SEQ ID NO: 311051 - DNA, 17 bp, Homo sapiens
agcctgtctctttccac

SEQ ID NO: 311052 - DNA, 22 bp, Homo sapiens
agcctgtgaataaaaaccctgt

SEQ ID NO: 311053 - DNA, 23 bp, Homo sapiens
agcctgtgaataaaaaccctgta

SEQ ID NO: 311054 - DNA, 23 bp, Homo sapiens
agcctgtgttagtgtctgtccat

SEQ ID NO: 311055 - DNA, 14 bp, Homo sapiens
agcctgttcccctc

SEQ ID NO: 311056 - DNA, 21 bp, Homo sapiens
agcctgttgaaggactacagg

SEQ ID NO: 311057 - DNA, 23 bp, Homo sapiens
agcctgtttgggaggctggagtg

SEQ ID NO: 311058 - DNA, 19 bp, Homo sapiens
agccttaaaatgcattgaa

SEQ ID NO: 311059 - DNA, 20 bp, Homo sapiens
agccttaatggatgctcatt

SEQ ID NO: 311060 - DNA, 23 bp, Homo sapiens
agccttacggtcatgatgtctgc

SEQ ID NO: 311061 - DNA, 22 bp, Homo sapiens
agccttagcccggatgcccacc

SEQ ID NO: 311062 - DNA, 13 bp, Homo sapiens
agccttagctgcc

SEQ ID NO: 311063 - DNA, 17 bp, Homo sapiens
agccttatcaagtgtct

SEQ ID NO: 311064 - DNA, 18 bp, Homo sapiens
agccttatcaagtgtctt

SEQ ID NO: 311065 - DNA, 15 bp, Homo sapiens
agccttctgatgtct

SEQ ID NO: 311066 - DNA, 23 bp, Homo sapiens
agccttgctgccaagtcctgcct

SEQ ID NO: 311067 - DNA, 16 bp, Homo sapiens
agccttgctgtagaga

SEQ ID NO: 311068 - DNA, 17 bp, Homo sapiens
agccttgctgtagagac

SEQ ID NO: 311069 - DNA, 17 bp, Homo sapiens
agccttggctcgttctc

SEQ ID NO: 311070 - DNA, 19 bp, Homo sapiens
agccttggctcgttctctt

SEQ ID NO: 311071 - DNA, 17 bp, Homo sapiens
agccttgggcctttcag

SEQ ID NO: 311072 - DNA, 22 bp, Homo sapiens
agccttgggcctttcagtccca

SEQ ID NO: 311073 - DNA, 22 bp, Homo sapiens
agccttgggttccaaccaggca

SEQ ID NO: 311074 - DNA, 20 bp, Homo sapiens
agccttggttcatcagtgtt

SEQ ID NO: 311075 - DNA, 20 bp, Homo sapiens
agccttgtgccctgccccca

SEQ ID NO: 311076 - DNA, 21 bp, Homo sapiens
agccttgtgccctgcccccat

SEQ ID NO: 311077 - DNA, 23 bp, Homo sapiens
agcctttaatggacttatttctt

SEQ ID NO: 311078 - DNA, 22 bp, Homo sapiens
agcctttaccctcctctatttc

SEQ ID NO: 311079 - DNA, 18 bp, Homo sapiens
agcctttatctatgggag

SEQ ID NO: 311080 - DNA, 22 bp, Homo sapiens
agcctttctgtatcaagcccct

SEQ ID NO: 311081 - DNA, 13 bp, Homo sapiens
agcctttctgtgg

SEQ ID NO: 311082 - DNA, 23 bp, Homo sapiens
agcctttctgtggagagtgagaa

SEQ ID NO: 311083 - DNA, 12 bp, Homo sapiens
agcctttcttcc

SEQ ID NO: 311084 - DNA, 11 bp, Homo sapiens
agcctttgtag

SEQ ID NO: 311085 - DNA, 17 bp, Homo sapiens
agccttttattaacata

SEQ ID NO: 311086 - DNA, 13 bp, Homo sapiens
agccttttgtaac

SEQ ID NO: 311087 - DNA, 13 bp, Homo sapiens
agcgaacatcttc

SEQ ID NO: 311088 - DNA, 19 bp, Homo sapiens
agcgacggctcctccccga

SEQ ID NO: 311089 - DNA, 15 bp, Homo sapiens
agcgagcaagccggc

SEQ ID NO: 311090 - DNA, 18 bp, Homo sapiens
agcgagcaagccggcaag

SEQ ID NO: 311091 - DNA, 15 bp, Homo sapiens
agcgagcatccccca

SEQ ID NO: 311092 - DNA, 17 bp, Homo sapiens
agcgagctgctctgcta

SEQ ID NO: 311093 - DNA, 21 bp, Homo sapiens
agcgaggcagaatggtgggct

SEQ ID NO: 311094 - DNA, 16 bp, Homo sapiens
agcgagtctggagacc

SEQ ID NO: 311095 - DNA, 18 bp, Homo sapiens
agcgcacgcgcgcacaca

SEQ ID NO: 311096 - DNA, 19 bp, Homo sapiens
agcgcacgcgcgcacacac

SEQ ID NO: 311097 - DNA, 16 bp, Homo sapiens
agcgccccgcccccac

SEQ ID NO: 311098 - DNA, 17 bp, Homo sapiens
agcgccccgcccccacc

SEQ ID NO: 311099 - DNA, 19 bp, Homo sapiens
agcgcccgctgggctgagc

SEQ ID NO: 311100 - DNA, 15 bp, Homo sapiens
agcgcctcccgccgc

SEQ ID NO: 311101 - DNA, 18 bp, Homo sapiens
agcgcctcccgccgcctc

SEQ ID NO: 311102 - DNA, 20 bp, Homo sapiens
agcgcctcccgccgcctcgg

SEQ ID NO: 311103 - DNA, 13 bp, Homo sapiens
agcgcgggagaga

SEQ ID NO: 311104 - DNA, 16 bp, Homo sapiens
agcgcgtgccttcccc

SEQ ID NO: 311105 - DNA, 13 bp, Homo sapiens
agcgctccctgtc

SEQ ID NO: 311106 - DNA, 17 bp, Homo sapiens
agcgctcctctgccttg

SEQ ID NO: 311107 - DNA, 12 bp, Homo sapiens
agcgctgcccac

SEQ ID NO: 311108 - DNA, 18 bp, Homo sapiens
agcgctgcccacaccacc

SEQ ID NO: 311109 - DNA, 20 bp, Homo sapiens
agcgctggcagcgctcctgg

SEQ ID NO: 311110 - DNA, 16 bp, Homo sapiens
agcggaaaagttgtct

SEQ ID NO: 311111 - DNA, 16 bp, Homo sapiens
agcggagaaaggaagg

SEQ ID NO: 311112 - DNA, 20 bp, Homo sapiens
agcggagaaaggaagggctg

SEQ ID NO: 311113 - DNA, 21 bp, Homo sapiens
agcggagcccgatattctccc

SEQ ID NO: 311114 - DNA, 22 bp, Homo sapiens
agcggagcccgatattctccct

SEQ ID NO: 311115 - DNA, 23 bp, Homo sapiens
agcggagcccgatattctccctg

SEQ ID NO: 311116 - DNA, 19 bp, Homo sapiens
agcggagttcctaacagga

SEQ ID NO: 311117 - DNA, 14 bp, Homo sapiens
agcggcccggccca

SEQ ID NO: 311118 - DNA, 21 bp, Homo sapiens
agcggccgatgggagtctccc

SEQ ID NO: 311119 - DNA, 18 bp, Homo sapiens
agcggccgcctgtccttg

SEQ ID NO: 311120 - DNA, 22 bp, Homo sapiens
agcggctgaggacggggcagag

SEQ ID NO: 311121 - DNA, 16 bp, Homo sapiens
agcgggacctgtggct

SEQ ID NO: 311122 - DNA, 14 bp, Homo sapiens
caaccatagaactg

SEQ ID NO: 311123 - DNA, 15 bp, Homo sapiens
caaccatagaactgt

SEQ ID NO: 311124 - DNA, 19 bp, Homo sapiens
caaccattcatctttcctt

SEQ ID NO: 311125 - DNA, 22 bp, Homo sapiens
caaccattcatctttcctttgc

SEQ ID NO: 311126 - DNA, 24 bp, Homo sapiens
caacccatgcatggcctcccagcc

SEQ ID NO: 311127 - DNA, 11 bp, Homo sapiens
caacccccacc

SEQ ID NO: 311128 - DNA, 12 bp, Homo sapiens
caacccccaccc

SEQ ID NO: 311129 - DNA, 12 bp, Homo sapiens
caacccccacct

SEQ ID NO: 311130 - DNA, 13 bp, Homo sapiens
caacccccacctc

SEQ ID NO: 311131 - DNA, 18 bp, Homo sapiens
caacccccacctcccggt

SEQ ID NO: 311132 - DNA, 14 bp, Homo sapiens
caacccccctccca

SEQ ID NO: 311133 - DNA, 15 bp, Homo sapiens
caacccccctcccag

SEQ ID NO: 311134 - DNA, 16 bp, Homo sapiens
caacccccctcccaga

SEQ ID NO: 311135 - DNA, 13 bp, Homo sapiens
caaccccctcgga

SEQ ID NO: 311136 - DNA, 15 bp, Homo sapiens
caaccccctcggagc

SEQ ID NO: 311137 - DNA, 17 bp, Homo sapiens
caaccccctcggagcct

SEQ ID NO: 311138 - DNA, 19 bp, Homo sapiens
caaccccgcggtgctctgg

SEQ ID NO: 311139 - DNA, 17 bp, Homo sapiens
caaccccggggcatgga

SEQ ID NO: 311140 - DNA, 13 bp, Homo sapiens
caacccctgtacc

SEQ ID NO: 311141 - DNA, 14 bp, Homo sapiens
caacccctgtaccc

SEQ ID NO: 311142 - DNA, 22 bp, Homo sapiens
caacccctgtacccagctcctt

SEQ ID NO: 311143 - DNA, 19 bp, Homo sapiens
caacccgctgcttccaggt

SEQ ID NO: 311144 - DNA, 16 bp, Homo sapiens
caaccctacagtatat

SEQ ID NO: 311145 - DNA, 18 bp, Homo sapiens
caaccctcagagccaccc

SEQ ID NO: 311146 - DNA, 14 bp, Homo sapiens
caaccctccctcag

SEQ ID NO: 311147 - DNA, 19 bp, Homo sapiens
caaccctcctatcacctcc

SEQ ID NO: 311148 - DNA, 11 bp, Homo sapiens
caaccctgcaa

SEQ ID NO: 311149 - DNA, 22 bp, Homo sapiens
caaccctgcaaaggactgtttt

SEQ ID NO: 311150 - DNA, 15 bp, Homo sapiens
caaccctgcccctgc

SEQ ID NO: 311151 - DNA, 12 bp, Homo sapiens
caaccctgccct

SEQ ID NO: 311152 - DNA, 14 bp, Homo sapiens
caaccctgccctgc

SEQ ID NO: 311153 - DNA, 17 bp, Homo sapiens
caaccctgccctgcacc

SEQ ID NO: 311154 - DNA, 13 bp, Homo sapiens
caaccctgttgag

SEQ ID NO: 311155 - DNA, 19 bp, Homo sapiens
caacccttaccccttagcc

SEQ ID NO: 311156 - DNA, 21 bp, Homo sapiens
caacccttagagattgcccca

SEQ ID NO: 311157 - DNA, 22 bp, Homo sapiens
caaccgatgctccagccaaccc

SEQ ID NO: 311158 - DNA, 17 bp, Homo sapiens
caacctatttgactgct

SEQ ID NO: 311159 - DNA, 15 bp, Homo sapiens
caacctcactgccct

SEQ ID NO: 311160 - DNA, 23 bp, Homo sapiens
caacctcactgccctccctcggc

SEQ ID NO: 311161 - DNA, 16 bp, Homo sapiens
caacctctctgatctt

SEQ ID NO: 311162 - DNA, 15 bp, Homo sapiens
caacctctgcctccc

SEQ ID NO: 311163 - DNA, 15 bp, Homo sapiens
caacctgaaagacaa

SEQ ID NO: 311164 - DNA, 21 bp, Homo sapiens
caacctgatgccccttcccca

SEQ ID NO: 311165 - DNA, 17 bp, Homo sapiens
caacctgccacaatgtg

SEQ ID NO: 311166 - DNA, 19 bp, Homo sapiens
caacctgccacaatgtgat

SEQ ID NO: 311167 - DNA, 12 bp, Homo sapiens
caacctgcccct

SEQ ID NO: 311168 - DNA, 17 bp, Homo sapiens
caacctgcccctcccca

SEQ ID NO: 311169 - DNA, 22 bp, Homo sapiens
caacctgcccctccccagccct

SEQ ID NO: 311170 - DNA, 17 bp, Homo sapiens
caacctgcctgtgcatg

SEQ ID NO: 311171 - DNA, 23 bp, Homo sapiens
caacctgctctcctcttgccact

SEQ ID NO: 311172 - DNA, 13 bp, Homo sapiens
caacctgtaaatt

SEQ ID NO: 311173 - DNA, 16 bp, Homo sapiens
caaccttgagacagct

SEQ ID NO: 311174 - DNA, 14 bp, Homo sapiens
caacctttgtgtaa

SEQ ID NO: 311175 - DNA, 22 bp, Homo sapiens
caacgaaaagcacatccaggca

SEQ ID NO: 311176 - DNA, 13 bp, Homo sapiens
caacgaagaaaaa

SEQ ID NO: 311177 - DNA, 17 bp, Homo sapiens
caacgactactttgcta

SEQ ID NO: 311178 - DNA, 13 bp, Homo sapiens
caacgcagccctg

SEQ ID NO: 311179 - DNA, 15 bp, Homo sapiens
caacgcagccctgct

SEQ ID NO: 311180 - DNA, 24 bp, Homo sapiens
caacgccaggaatcatgaagagac

SEQ ID NO: 311181 - DNA, 14 bp, Homo sapiens
caacgggtctgtgg

SEQ ID NO: 311182 - DNA, 19 bp, Homo sapiens
caacgtcccctccgccgtg

SEQ ID NO: 311183 - DNA, 17 bp, Homo sapiens
caacgtggacctgccta

SEQ ID NO: 311184 - DNA, 12 bp, Homo sapiens
caacgtggggca

SEQ ID NO: 311185 - DNA, 14 bp, Homo sapiens
caactaaataacac

SEQ ID NO: 311186 - DNA, 15 bp, Homo sapiens
caactaacaatgcct

SEQ ID NO: 311187 - DNA, 16 bp, Homo sapiens
caactaacaatgcctt

SEQ ID NO: 311188 - DNA, 14 bp, Homo sapiens
caactaatttttga

SEQ ID NO: 311189 - DNA, 19 bp, Homo sapiens
caactatcctgacttctaa

SEQ ID NO: 311190 - DNA, 14 bp, Homo sapiens
caactatttataaa

SEQ ID NO: 311191 - DNA, 15 bp, Homo sapiens
caactatttttccaa

SEQ ID NO: 311192 - DNA, 20 bp, Homo sapiens
caactatttttccaaaataa

SEQ ID NO: 311193 - DNA, 12 bp, Homo sapiens
caactcactgtg

SEQ ID NO: 311194 - DNA, 20 bp, Homo sapiens
caactcatgaacaaaatgaa

SEQ ID NO: 311195 - DNA, 11 bp, Homo sapiens
caactccaagg

SEQ ID NO: 311196 - DNA, 15 bp, Homo sapiens
caactccaaggcaaa

SEQ ID NO: 311197 - DNA, 20 bp, Homo sapiens
caactccagccacccagcca

SEQ ID NO: 311198 - DNA, 18 bp, Homo sapiens
caactccaggaaaactgt

SEQ ID NO: 311199 - DNA, 13 bp, Homo sapiens
caactccatcaga

SEQ ID NO: 311200 - DNA, 24 bp, Homo sapiens
caactccatgaccaggccaccatc

SEQ ID NO: 311201 - DNA, 22 bp, Homo sapiens
caactccatggggttcgagact

SEQ ID NO: 311202 - DNA, 14 bp, Homo sapiens
caactcccagccac

SEQ ID NO: 311203 - DNA, 18 bp, Homo sapiens
caactccgcccagcctct

SEQ ID NO: 311204 - DNA, 12 bp, Homo sapiens
caactccttcct

SEQ ID NO: 311205 - DNA, 13 bp, Homo sapiens
caactccttcctc

SEQ ID NO: 311206 - DNA, 16 bp, Homo sapiens
caactctccactccat

SEQ ID NO: 311207 - DNA, 13 bp, Homo sapiens
caactctccccag

SEQ ID NO: 311208 - DNA, 14 bp, Homo sapiens
caactctccccagt

SEQ ID NO: 311209 - DNA, 15 bp, Homo sapiens
caactctccccagtg

SEQ ID NO: 311210 - DNA, 12 bp, Homo sapiens
caactctgcact

SEQ ID NO: 311211 - DNA, 13 bp, Homo sapiens
caactctgcactc

SEQ ID NO: 311212 - DNA, 14 bp, Homo sapiens
caactctgcactcc

SEQ ID NO: 311213 - DNA, 15 bp, Homo sapiens
caactctggccttgg

SEQ ID NO: 311214 - DNA, 22 bp, Homo sapiens
caactctggccttggttcctcc

SEQ ID NO: 311215 - DNA, 19 bp, Homo sapiens
caactcttagaggtaggtg

SEQ ID NO: 311216 - DNA, 14 bp, Homo sapiens
caactcttgtattg

SEQ ID NO: 311217 - DNA, 22 bp, Homo sapiens
caactcttgtattgctccattt

SEQ ID NO: 311218 - DNA, 14 bp, Homo sapiens
caactgaacaaaaa

SEQ ID NO: 311219 - DNA, 15 bp, Homo sapiens
caactgaagagacac

SEQ ID NO: 311220 - DNA, 16 bp, Homo sapiens
caactgaatacttgaa

SEQ ID NO: 311221 - DNA, 15 bp, Homo sapiens
caactgaccagcctc

SEQ ID NO: 311222 - DNA, 16 bp, Homo sapiens
caactgacttctgcta

SEQ ID NO: 311223 - DNA, 17 bp, Homo sapiens
caactgagccaaaaaca

SEQ ID NO: 311224 - DNA, 23 bp, Homo sapiens
caactgatcatttgcagctgctg

SEQ ID NO: 311225 - DNA, 17 bp, Homo sapiens
caactgcatcaagatgt

SEQ ID NO: 311226 - DNA, 20 bp, Homo sapiens
caactgctgtttagtgaaca

SEQ ID NO: 311227 - DNA, 14 bp, Homo sapiens
caactgctgtttta

SEQ ID NO: 311228 - DNA, 16 bp, Homo sapiens
caactgctgttttatg

SEQ ID NO: 311229 - DNA, 21 bp, Homo sapiens
caactggactatagcagggct

SEQ ID NO: 311230 - DNA, 23 bp, Homo sapiens
caactggactatagcagggctgg

SEQ ID NO: 311231 - DNA, 21 bp, Homo sapiens
caactgtctcctacctctgct

SEQ ID NO: 311232 - DNA, 12 bp, Homo sapiens
caactgtgcagc

SEQ ID NO: 311233 - DNA, 14 bp, Homo sapiens
caactgtgcagcac

SEQ ID NO: 311234 - DNA, 19 bp, Homo sapiens
caactgttggataataact

SEQ ID NO: 311235 - DNA, 22 bp, Homo sapiens
caactgtttttgaagaagggaa

SEQ ID NO: 311236 - DNA, 20 bp, Homo sapiens
caacttaaatcactgaggca

SEQ ID NO: 311237 - DNA, 15 bp, Homo sapiens
caacttaatgttctg

SEQ ID NO: 311238 - DNA, 21 bp, Homo sapiens
caacttaatgttctgaataat

SEQ ID NO: 311239 - DNA, 17 bp, Homo sapiens
caacttcagtcctggga

SEQ ID NO: 311240 - DNA, 18 bp, Homo sapiens
caacttccctgttcttta

SEQ ID NO: 311241 - DNA, 14 bp, Homo sapiens
caacttgaattaca

SEQ ID NO: 311242 - DNA, 21 bp, Homo sapiens
caacttgagatgtatgaaggc

SEQ ID NO: 311243 - DNA, 18 bp, Homo sapiens
caacttgagcatgttact

SEQ ID NO: 311244 - DNA, 19 bp, Homo sapiens
caacttggttctgcttcaa

SEQ ID NO: 311245 - DNA, 23 bp, Homo sapiens
caacttggttgtgaaccaactgc

SEQ ID NO: 311246 - DNA, 22 bp, Homo sapiens
caacttgtaaatacaccacctc

SEQ ID NO: 311247 - DNA, 17 bp, Homo sapiens
caacttgtctttttctg

SEQ ID NO: 311248 - DNA, 12 bp, Homo sapiens
caacttgtgtac

SEQ ID NO: 311249 - DNA, 24 bp, Homo sapiens
caactttagctagtatcttcaaac

SEQ ID NO: 311250 - DNA, 11 bp, Homo sapiens
caactttggaa

SEQ ID NO: 311251 - DNA, 21 bp, Homo sapiens
caactttgtggatgtcttcct

SEQ ID NO: 311252 - DNA, 22 bp, Homo sapiens
caactttgtggatgtcttcctt

SEQ ID NO: 311253 - DNA, 21 bp, Homo sapiens
caacttttagtgggtgagaaa

SEQ ID NO: 311254 - DNA, 19 bp, Homo sapiens
caacttttgaaatttaaaa

SEQ ID NO: 311255 - DNA, 22 bp, Homo sapiens
caagaaaacagcaagggagaga

SEQ ID NO: 311256 - DNA, 23 bp, Homo sapiens
caagaaaagaacctaatagcacc

SEQ ID NO: 311257 - DNA, 17 bp, Homo sapiens
agcgggagacctgtgct

SEQ ID NO: 311258 - DNA, 12 bp, Homo sapiens
agcgggcagggc

SEQ ID NO: 311259 - DNA, 15 bp, Homo sapiens
agcgggcgctgctgg

SEQ ID NO: 311260 - DNA, 21 bp, Homo sapiens
agcggggccccagggctaccc

SEQ ID NO: 311261 - DNA, 23 bp, Homo sapiens
agcgggggctaactggccccagg

SEQ ID NO: 311262 - DNA, 18 bp, Homo sapiens
agcggtggaaggagcctg

SEQ ID NO: 311263 - DNA, 14 bp, Homo sapiens
agcgtagcctctcc

SEQ ID NO: 311264 - DNA, 16 bp, Homo sapiens
agcgtccggggtggtg

SEQ ID NO: 311265 - DNA, 16 bp, Homo sapiens
agcgtctcccttggcc

SEQ ID NO: 311266 - DNA, 20 bp, Homo sapiens
agcgtgcaccgtgcagcccg

SEQ ID NO: 311267 - DNA, 20 bp, Homo sapiens
agcgtggtggacatgcacag

SEQ ID NO: 311268 - DNA, 23 bp, Homo sapiens
agcgtggtggacatgcacagcta

SEQ ID NO: 311269 - DNA, 13 bp, Homo sapiens
agcgttctggact

SEQ ID NO: 311270 - DNA, 19 bp, Homo sapiens
agcgttctggactctgccc

SEQ ID NO: 311271 - DNA, 20 bp, Homo sapiens
agcgttggaattaaaacaat

SEQ ID NO: 311272 - DNA, 23 bp, Homo sapiens
agcgtttagtttctagaggcctc

SEQ ID NO: 311273 - DNA, 18 bp, Homo sapiens
agcgtttgctgtgccagg

SEQ ID NO: 311274 - DNA, 11 bp, Homo sapiens
agctaaaagca

SEQ ID NO: 311275 - DNA, 17 bp, Homo sapiens
agctaaaagcatccctg

SEQ ID NO: 311276 - DNA, 13 bp, Homo sapiens
agctaaagaggct

SEQ ID NO: 311277 - DNA, 21 bp, Homo sapiens
agctaaagaggctgaaagagg

SEQ ID NO: 311278 - DNA, 18 bp, Homo sapiens
agctaaattacaattgtc

SEQ ID NO: 311279 - DNA, 18 bp, Homo sapiens
agctaacactggccccta

SEQ ID NO: 311280 - DNA, 19 bp, Homo sapiens
agctaacactggcccctag

SEQ ID NO: 311281 - DNA, 18 bp, Homo sapiens
agctaacattttaaataa

SEQ ID NO: 311282 - DNA, 23 bp, Homo sapiens
agctaacattttaaataaaagaa

SEQ ID NO: 311283 - DNA, 16 bp, Homo sapiens
agctaactgagagaag

SEQ ID NO: 311284 - DNA, 15 bp, Homo sapiens
agctaagcagaataa

SEQ ID NO: 311285 - DNA, 19 bp, Homo sapiens
agctaagtgaaaaggtcat

SEQ ID NO: 311286 - DNA, 14 bp, Homo sapiens
agctaataaaatat

SEQ ID NO: 311287 - DNA, 18 bp, Homo sapiens
agctaataaaatatcatt

SEQ ID NO: 311288 - DNA, 20 bp, Homo sapiens
agctaataaaatatcattca

SEQ ID NO: 311289 - DNA, 19 bp, Homo sapiens
agctaataaatctcttctt

SEQ ID NO: 311290 - DNA, 20 bp, Homo sapiens
agctaataaatctcttcttt

SEQ ID NO: 311291 - DNA, 21 bp, Homo sapiens
agctaatcagcattctcactc

SEQ ID NO: 311292 - DNA, 13 bp, Homo sapiens
agctaatctgtag

SEQ ID NO: 311293 - DNA, 14 bp, Homo sapiens
agctacaggaagca

SEQ ID NO: 311294 - DNA, 22 bp, Homo sapiens
agctacaggaagcaccccatgc

SEQ ID NO: 311295 - DNA, 24 bp, Homo sapiens
agctacattcctcagctgccaagc

SEQ ID NO: 311296 - DNA, 16 bp, Homo sapiens
agctacccacagagca

SEQ ID NO: 311297 - DNA, 13 bp, Homo sapiens
agctaccccttct

SEQ ID NO: 311298 - DNA, 16 bp, Homo sapiens
agctacggttccctgc

SEQ ID NO: 311299 - DNA, 16 bp, Homo sapiens
agctactaatgatgtt

SEQ ID NO: 311300 - DNA, 14 bp, Homo sapiens
agctactctgtcca

SEQ ID NO: 311301 - DNA, 21 bp, Homo sapiens
agctactctgtccaggccact

SEQ ID NO: 311302 - DNA, 17 bp, Homo sapiens
agctacttgggagcctg

SEQ ID NO: 311303 - DNA, 15 bp, Homo sapiens
agctagaaatatgat

SEQ ID NO: 311304 - DNA, 19 bp, Homo sapiens
agctagacaaaggcccaga

SEQ ID NO: 311305 - DNA, 16 bp, Homo sapiens
agctagactaggagac

SEQ ID NO: 311306 - DNA, 19 bp, Homo sapiens
agctagagaggggcctctg

SEQ ID NO: 311307 - DNA, 15 bp, Homo sapiens
agctagagcttcaag

SEQ ID NO: 311308 - DNA, 15 bp, Homo sapiens
agctaggactgagga

SEQ ID NO: 311309 - DNA, 14 bp, Homo sapiens
agctagttatgtga

SEQ ID NO: 311310 - DNA, 17 bp, Homo sapiens
agctagttcgtagcttt

SEQ ID NO: 311311 - DNA, 18 bp, Homo sapiens
agctagtttaaaattatt

SEQ ID NO: 311312 - DNA, 14 bp, Homo sapiens
agctataacatttg

SEQ ID NO: 311313 - DNA, 23 bp, Homo sapiens
agctatcaagtgtgctttagctt

SEQ ID NO: 311314 - DNA, 20 bp, Homo sapiens
agctatcagaagaccacaaa

SEQ ID NO: 311315 - DNA, 15 bp, Homo sapiens
agctatctaggtgga

SEQ ID NO: 311316 - DNA, 18 bp, Homo sapiens
agctatctaggtggagtt

SEQ ID NO: 311317 - DNA, 15 bp, Homo sapiens
agctatgcagggagg

SEQ ID NO: 311318 - DNA, 19 bp, Homo sapiens
agctatgggagccccaggg

SEQ ID NO: 311319 - DNA, 20 bp, Homo sapiens
agctattactgtctggtttt

SEQ ID NO: 311320 - DNA, 15 bp, Homo sapiens
agctattcacacaca

SEQ ID NO: 311321 - DNA, 20 bp, Homo sapiens
agctatttccattccagaat

SEQ ID NO: 311322 - DNA, 18 bp, Homo sapiens
agctatttcctttgcgca

SEQ ID NO: 311323 - DNA, 17 bp, Homo sapiens
agctcaaataaaaataa

SEQ ID NO: 311324 - DNA, 13 bp, Homo sapiens
agctcacccctgg

SEQ ID NO: 311325 - DNA, 16 bp, Homo sapiens
agctcacccctgggca

SEQ ID NO: 311326 - DNA, 19 bp, Homo sapiens
agctcagaggagtctggga

SEQ ID NO: 311327 - DNA, 16 bp, Homo sapiens
agctcagcacagcctc

SEQ ID NO: 311328 - DNA, 21 bp, Homo sapiens
agctcagcagttcacttccta

SEQ ID NO: 311329 - DNA, 19 bp, Homo sapiens
agctcagcccacccccctc

SEQ ID NO: 311330 - DNA, 22 bp, Homo sapiens
agctcagcccacccccctcatt

SEQ ID NO: 311331 - DNA, 13 bp, Homo sapiens
agctcaggatggc

SEQ ID NO: 311332 - DNA, 14 bp, Homo sapiens
agctcaggcgcagc

SEQ ID NO: 311333 - DNA, 15 bp, Homo sapiens
agctcaggcgcagcc

SEQ ID NO: 311334 - DNA, 16 bp, Homo sapiens
agctcaggcgcagccc

SEQ ID NO: 311335 - DNA, 16 bp, Homo sapiens
agctcaggtggggagt

SEQ ID NO: 311336 - DNA, 20 bp, Homo sapiens
agctcatagagtcccccctc

SEQ ID NO: 311337 - DNA, 13 bp, Homo sapiens
agctccaactccc

SEQ ID NO: 311338 - DNA, 14 bp, Homo sapiens
agctccaccctccc

SEQ ID NO: 311339 - DNA, 15 bp, Homo sapiens
agctccaccctcccc

SEQ ID NO: 311340 - DNA, 19 bp, Homo sapiens
agctccacggtgcgtggct

SEQ ID NO: 311341 - DNA, 18 bp, Homo sapiens
agctccactcagggctgg

SEQ ID NO: 311342 - DNA, 20 bp, Homo sapiens
agctccactcagggctggcc

SEQ ID NO: 311343 - DNA, 13 bp, Homo sapiens
agctccactctga

SEQ ID NO: 311344 - DNA, 19 bp, Homo sapiens
agctccactctgaagtccc

SEQ ID NO: 311345 - DNA, 20 bp, Homo sapiens
agctccactggcctgcccgt

SEQ ID NO: 311346 - DNA, 14 bp, Homo sapiens
agctccagaccccc

SEQ ID NO: 311347 - DNA, 13 bp, Homo sapiens
agctccaggggcc

SEQ ID NO: 311348 - DNA, 20 bp, Homo sapiens
agctccaggggcccttggga

SEQ ID NO: 311349 - DNA, 13 bp, Homo sapiens
agctccaggtgcc

SEQ ID NO: 311350 - DNA, 19 bp, Homo sapiens
agctccaggtgccctgtgg

SEQ ID NO: 311351 - DNA, 20 bp, Homo sapiens
agctccaggtgccctgtggg

SEQ ID NO: 311352 - DNA, 20 bp, Homo sapiens
agctccagtggaagaagaaa

SEQ ID NO: 311353 - DNA, 23 bp, Homo sapiens
agctccagtggaagaagaaaaca

SEQ ID NO: 311354 - DNA, 18 bp, Homo sapiens
agctccataattgcaagg

SEQ ID NO: 311355 - DNA, 19 bp, Homo sapiens
agctccataattgcaaggg

SEQ ID NO: 311356 - DNA, 16 bp, Homo sapiens
agctccatctccactc

SEQ ID NO: 311357 - DNA, 21 bp, Homo sapiens
agctccatctccactccagat

SEQ ID NO: 311358 - DNA, 21 bp, Homo sapiens
agctcccaggacgcagggaga

SEQ ID NO: 311359 - DNA, 14 bp, Homo sapiens
agctccccaccacc

SEQ ID NO: 311360 - DNA, 20 bp, Homo sapiens
agctccccaccaccccagct

SEQ ID NO: 311361 - DNA, 14 bp, Homo sapiens
agctcccccttgcc

SEQ ID NO: 311362 - DNA, 20 bp, Homo sapiens
agctcccctggagccagcag

SEQ ID NO: 311363 - DNA, 15 bp, Homo sapiens
agctccctcctccca

SEQ ID NO: 311364 - DNA, 21 bp, Homo sapiens
agctccctcctcccatctcct

SEQ ID NO: 311365 - DNA, 23 bp, Homo sapiens
agctccctcctcccatctccttc

SEQ ID NO: 311366 - DNA, 12 bp, Homo sapiens
agctcccttccc

SEQ ID NO: 311367 - DNA, 18 bp, Homo sapiens
agctcccttcccctgcct

SEQ ID NO: 311368 - DNA, 19 bp, Homo sapiens
agctcccttcccctgcctg

SEQ ID NO: 311369 - DNA, 21 bp, Homo sapiens
agctcccttcccctgcctggt

SEQ ID NO: 311370 - DNA, 16 bp, Homo sapiens
agctcccttctctgta

SEQ ID NO: 311371 - DNA, 19 bp, Homo sapiens
agctcccttttctttttcc

SEQ ID NO: 311372 - DNA, 14 bp, Homo sapiens
agctccgcctggca

SEQ ID NO: 311373 - DNA, 15 bp, Homo sapiens
agctccgcctggcac

SEQ ID NO: 311374 - DNA, 18 bp, Homo sapiens
agctccgcctggcaccca

SEQ ID NO: 311375 - DNA, 20 bp, Homo sapiens
agctccgcctggcacccact

SEQ ID NO: 311376 - DNA, 23 bp, Homo sapiens
agctcctcctcttggagctgaga

SEQ ID NO: 311377 - DNA, 14 bp, Homo sapiens
agctcctctccttg

SEQ ID NO: 311378 - DNA, 15 bp, Homo sapiens
agctcctctccttgg

SEQ ID NO: 311379 - DNA, 19 bp, Homo sapiens
agctcctctccttgggctc

SEQ ID NO: 311380 - DNA, 12 bp, Homo sapiens
agctcctctggg

SEQ ID NO: 311381 - DNA, 16 bp, Homo sapiens
agctcctgggaaggct

SEQ ID NO: 311382 - DNA, 13 bp, Homo sapiens
agctccttcatgc

SEQ ID NO: 311383 - DNA, 17 bp, Homo sapiens
agctccttcatgctttt

SEQ ID NO: 311384 - DNA, 12 bp, Homo sapiens
agctccttggag

SEQ ID NO: 311385 - DNA, 21 bp, Homo sapiens
agctccttggttccctcttcc

SEQ ID NO: 311386 - DNA, 13 bp, Homo sapiens
agctccttttgtc

SEQ ID NO: 311387 - DNA, 19 bp, Homo sapiens
agctccttttgtccccagg

SEQ ID NO: 311388 - DNA, 22 bp, Homo sapiens
agctccttttgtccccagggcc

SEQ ID NO: 311389 - DNA, 16 bp, Homo sapiens
agctctaatagagtca

SEQ ID NO: 311390 - DNA, 21 bp, Homo sapiens
agctctacacaacatgtatgt

SEQ ID NO: 311391 - DNA, 21 bp, Homo sapiens
caagaaaccaagtgggctggt

SEQ ID NO: 311392 - DNA, 22 bp, Homo sapiens
caagaaacctccatcctgccag

SEQ ID NO: 311393 - DNA, 24 bp, Homo sapiens
caagaaacctccatcctgccagga

SEQ ID NO: 311394 - DNA, 15 bp, Homo sapiens
caagaaactcacccc

SEQ ID NO: 311395 - DNA, 13 bp, Homo sapiens
caagaaagtttcc

SEQ ID NO: 311396 - DNA, 21 bp, Homo sapiens
caagaaatcgccttatgagaa

SEQ ID NO: 311397 - DNA, 17 bp, Homo sapiens
caagaaattgcctcctt

SEQ ID NO: 311398 - DNA, 16 bp, Homo sapiens
caagaactgaaaacat

SEQ ID NO: 311399 - DNA, 19 bp, Homo sapiens
caagaactgcatggaccta

SEQ ID NO: 311400 - DNA, 23 bp, Homo sapiens
caagaactgcatggacctaacat

SEQ ID NO: 311401 - DNA, 22 bp, Homo sapiens
caagaacttctcgtagatgctg

SEQ ID NO: 311402 - DNA, 18 bp, Homo sapiens
caagaagacatggagact

SEQ ID NO: 311403 - DNA, 14 bp, Homo sapiens
caagaagattctaa

SEQ ID NO: 311404 - DNA, 15 bp, Homo sapiens
caagaagattctaaa

SEQ ID NO: 311405 - DNA, 18 bp, Homo sapiens
caagaagcaattatttaa

SEQ ID NO: 311406 - DNA, 19 bp, Homo sapiens
caagaagcaattatttaaa

SEQ ID NO: 311407 - DNA, 22 bp, Homo sapiens
caagaagcaattatttaaagaa

SEQ ID NO: 311408 - DNA, 12 bp, Homo sapiens
caagaagccctc

SEQ ID NO: 311409 - DNA, 23 bp, Homo sapiens
caagaagccctccttgccacccc

SEQ ID NO: 311410 - DNA, 19 bp, Homo sapiens
caagaagtcagagaaaaca

SEQ ID NO: 311411 - DNA, 23 bp, Homo sapiens
caagaagtcagagaaaacacttt

SEQ ID NO: 311412 - DNA, 16 bp, Homo sapiens
caagaagtgaggcctg

SEQ ID NO: 311413 - DNA, 17 bp, Homo sapiens
caagaagtgaggcctgg

SEQ ID NO: 311414 - DNA, 20 bp, Homo sapiens
caagaagtgggagtgggaga

SEQ ID NO: 311415 - DNA, 12 bp, Homo sapiens
caagaataaaaa

SEQ ID NO: 311416 - DNA, 22 bp, Homo sapiens
caagaatacagaaaatgctttt

SEQ ID NO: 311417 - DNA, 18 bp, Homo sapiens
caagaatagatgctgact

SEQ ID NO: 311418 - DNA, 15 bp, Homo sapiens
aagttttcttttact

SEQ ID NO: 311419 - DNA, 20 bp, Homo sapiens
aagttttgccccatgataaa

SEQ ID NO: 311420 - DNA, 14 bp, Homo sapiens
aagtttttctctca

SEQ ID NO: 311421 - DNA, 19 bp, Homo sapiens
aataaaaaacaagaaacca

SEQ ID NO: 311422 - DNA, 15 bp, Homo sapiens
aataaaaaacatttg

SEQ ID NO: 311423 - DNA, 15 bp, Homo sapiens
aataaaaaagatccc

SEQ ID NO: 311424 - DNA, 14 bp, Homo sapiens
aataaaaaagtgag

SEQ ID NO: 311425 - DNA, 13 bp, Homo sapiens
aataaaaagtgac

SEQ ID NO: 311426 - DNA, 19 bp, Homo sapiens
aataaaaagtgacacagca

SEQ ID NO: 311427 - DNA, 21 bp, Homo sapiens
aataaaaatcaacttgtgtac

SEQ ID NO: 311428 - DNA, 13 bp, Homo sapiens
aataaaaatttgt

SEQ ID NO: 311429 - DNA, 21 bp, Homo sapiens
aataaaaatttgtttaaagtt

SEQ ID NO: 311430 - DNA, 17 bp, Homo sapiens
aataaaacataatagaa

SEQ ID NO: 311431 - DNA, 12 bp, Homo sapiens
aataaaacattc

SEQ ID NO: 311432 - DNA, 13 bp, Homo sapiens
aataaaacctttc

SEQ ID NO: 311433 - DNA, 14 bp, Homo sapiens
aataaaacctttca

SEQ ID NO: 311434 - DNA, 21 bp, Homo sapiens
aataaaacctttcaaatttca

SEQ ID NO: 311435 - DNA, 23 bp, Homo sapiens
aataaaacctttcaaatttcaca

SEQ ID NO: 311436 - DNA, 19 bp, Homo sapiens
aaaaaggttaacagtaaaa

SEQ ID NO: 311437 - DNA, 22 bp, Homo sapiens
aaaaagtacatagtgaatttta

SEQ ID NO: 311438 - DNA, 15 bp, Homo sapiens
aaaaagtcattgtaa

SEQ ID NO: 311439 - DNA, 17 bp, Homo sapiens
aaaaagtcattgtaatc

SEQ ID NO: 311440 - DNA, 20 bp, Homo sapiens
aaaaagtcttaacaacagct

SEQ ID NO: 311441 - DNA, 15 bp, Homo sapiens
aaaaagtgacacagc

SEQ ID NO: 311442 - DNA, 20 bp, Homo sapiens
aaaaagtgacacagcagctt

SEQ ID NO: 311443 - DNA, 13 bp, Homo sapiens
aaaaagttaacat

SEQ ID NO: 311444 - DNA, 19 bp, Homo sapiens
aaaaagttattatgtagct

SEQ ID NO: 311445 - DNA, 13 bp, Homo sapiens
aaaaagttttgat

SEQ ID NO: 311446 - DNA, 19 bp, Homo sapiens
aaaaataaaataagtccta

SEQ ID NO: 311447 - DNA, 22 bp, Homo sapiens
aaaaataacatctctttcatct

SEQ ID NO: 311448 - DNA, 12 bp, Homo sapiens
aaaaataatttt

SEQ ID NO: 311449 - DNA, 13 bp, Homo sapiens
aaaaatacaaaat

SEQ ID NO: 311450 - DNA, 21 bp, Homo sapiens
aaaaatagttttacattaaca

SEQ ID NO: 311451 - DNA, 20 bp, Homo sapiens
aaaaatataaacaatgttca

SEQ ID NO: 311452 - DNA, 14 bp, Homo sapiens
aaaaatataactta

SEQ ID NO: 311453 - DNA, 12 bp, Homo sapiens
aaaaatatattt

SEQ ID NO: 311454 - DNA, 21 bp, Homo sapiens
aaaaatatgtattatacatct

SEQ ID NO: 311455 - DNA, 16 bp, Homo sapiens
aaaaatctagtttttt

SEQ ID NO: 311456 - DNA, 13 bp, Homo sapiens
aaaaatcttgtgc

SEQ ID NO: 311457 - DNA, 20 bp, Homo sapiens
aaaaatcttgtgctagaata

SEQ ID NO: 311458 - DNA, 12 bp, Homo sapiens
aaaaatctttca

SEQ ID NO: 311459 - DNA, 14 bp, Homo sapiens
aaaaatctttcaga

SEQ ID NO: 311460 - DNA, 15 bp, Homo sapiens
aaaaatgaatgtcta

SEQ ID NO: 311461 - DNA, 17 bp, Homo sapiens
aaaaatggtgccttctt

SEQ ID NO: 311462 - DNA, 12 bp, Homo sapiens
aaaaatgtaaat

SEQ ID NO: 311463 - DNA, 13 bp, Homo sapiens
aaaaatgtaaata

SEQ ID NO: 311464 - DNA, 18 bp, Homo sapiens
aaaaattaaaacgaaaat

SEQ ID NO: 311465 - DNA, 19 bp, Homo sapiens
aaaaattaaaccaagcagc

SEQ ID NO: 311466 - DNA, 19 bp, Homo sapiens
aaaaattaaattctctcta

SEQ ID NO: 311467 - DNA, 23 bp, Homo sapiens
aaaaattacagcttcaccctgtc

SEQ ID NO: 311468 - DNA, 16 bp, Homo sapiens
aaaaattatctttaaa

SEQ ID NO: 311469 - DNA, 20 bp, Homo sapiens
aaaaattatctttaaaactt

SEQ ID NO: 311470 - DNA, 17 bp, Homo sapiens
aaaaattatttgccttt

SEQ ID NO: 311471 - DNA, 16 bp, Homo sapiens
aaaaattgaataatgt

SEQ ID NO: 311472 - DNA, 21 bp, Homo sapiens
aaaaattgttaatttttccta

SEQ ID NO: 311473 - DNA, 12 bp, Homo sapiens
aaaacaaaaaac

SEQ ID NO: 311474 - DNA, 20 bp, Homo sapiens
aaaacaaaaccaagccttgg

SEQ ID NO: 311475 - DNA, 15 bp, Homo sapiens
aaaacaaaatctaaa

SEQ ID NO: 311476 - DNA, 18 bp, Homo sapiens
aaaacaaaatctgaactc

SEQ ID NO: 311477 - DNA, 18 bp, Homo sapiens
aaaacaaatatttcactt

SEQ ID NO: 311478 - DNA, 15 bp, Homo sapiens
aaaacaaatcactgt

SEQ ID NO: 311479 - DNA, 12 bp, Homo sapiens
aaaacaagaaac

SEQ ID NO: 311480 - DNA, 17 bp, Homo sapiens
aaaacaagactgcctcc

SEQ ID NO: 311481 - DNA, 21 bp, Homo sapiens
aaaacaagttggctagaagaa

SEQ ID NO: 311482 - DNA, 19 bp, Homo sapiens
aaaacaatatttattgtat

SEQ ID NO: 311483 - DNA, 23 bp, Homo sapiens
aaaacaatatttattgtatttta

SEQ ID NO: 311484 - DNA, 19 bp, Homo sapiens
aaaacaatcatttgctttt

SEQ ID NO: 311485 - DNA, 15 bp, Homo sapiens
aaaacacaaatgtgt

SEQ ID NO: 311486 - DNA, 19 bp, Homo sapiens
aaaacacatacaaaagaat

SEQ ID NO: 311487 - DNA, 12 bp, Homo sapiens
aaaacacattgc

SEQ ID NO: 311488 - DNA, 21 bp, Homo sapiens
aaaacaccgcttctgcctttt

SEQ ID NO: 311489 - DNA, 17 bp, Homo sapiens
aaaacacctaagtgact

SEQ ID NO: 311490 - DNA, 15 bp, Homo sapiens
aaaacactgccctct

SEQ ID NO: 311491 - DNA, 15 bp, Homo sapiens
aaaacacttatttta

SEQ ID NO: 311492 - DNA, 21 bp, Homo sapiens
aaaacagaaaaaaaacacaca

SEQ ID NO: 311493 - DNA, 16 bp, Homo sapiens
acacaatgttattcgt

SEQ ID NO: 311494 - DNA, 22 bp, Homo sapiens
acacaatgttgcactgaaaacc

SEQ ID NO: 311495 - DNA, 13 bp, Homo sapiens
acacaattagaga

SEQ ID NO: 311496 - DNA, 19 bp, Homo sapiens
acacacaaaaaggagcggg

SEQ ID NO: 311497 - DNA, 21 bp, Homo sapiens
acacacaaaacaacagcaaca

SEQ ID NO: 311498 - DNA, 22 bp, Homo sapiens
acacacaaaatgtacccagtat

SEQ ID NO: 311499 - DNA, 14 bp, Homo sapiens
acacacaaatgcag

SEQ ID NO: 311500 - DNA, 19 bp, Homo sapiens
acacacaaatgcagacaca

SEQ ID NO: 311501 - DNA, 15 bp, Homo sapiens
acacacaacaaaaat

SEQ ID NO: 311502 - DNA, 14 bp, Homo sapiens
acacacaacaatta

SEQ ID NO: 311503 - DNA, 16 bp, Homo sapiens
acacacaacatcaaga

SEQ ID NO: 311504 - DNA, 14 bp, Homo sapiens
acacacacaaatat

SEQ ID NO: 311505 - DNA, 14 bp, Homo sapiens
acacacacaaatgc

SEQ ID NO: 311506 - DNA, 11 bp, Homo sapiens
acacacacaca

SEQ ID NO: 311507 - DNA, 12 bp, Homo sapiens
acacacacacaa

SEQ ID NO: 311508 - DNA, 15 bp, Homo sapiens
acacacacacaaatg

SEQ ID NO: 311509 - DNA, 12 bp, Homo sapiens
acacacacacac

SEQ ID NO: 311510 - DNA, 15 bp, Homo sapiens
acacacacacacaaa

SEQ ID NO: 311511 - DNA, 14 bp, Homo sapiens
acacacacacacgc

SEQ ID NO: 311512 - DNA, 14 bp, Homo sapiens
acacacacacagcc

SEQ ID NO: 311513 - DNA, 15 bp, Homo sapiens
acacacacacgcaga

SEQ ID NO: 311514 - DNA, 15 bp, Homo sapiens
acacacacagccatt

SEQ ID NO: 311515 - DNA, 22 bp, Homo sapiens
acacacacccttccccactccc

SEQ ID NO: 311516 - DNA, 21 bp, Homo sapiens
acacacacgcacgcacacaca

SEQ ID NO: 311517 - DNA, 10 bp, Homo sapiens
acacacagcc

SEQ ID NO: 311518 - DNA, 13 bp, Homo sapiens
acacacagccatt

SEQ ID NO: 311519 - DNA, 19 bp, Homo sapiens
acacacagccattcatctg

SEQ ID NO: 311520 - DNA, 14 bp, Homo sapiens
acacacagcctggc

SEQ ID NO: 311521 - DNA, 22 bp, Homo sapiens
acacacagcctggcctcccctg

SEQ ID NO: 311522 - DNA, 14 bp, Homo sapiens
acacacagcctttc

SEQ ID NO: 311523 - DNA, 20 bp, Homo sapiens
acacacagctgggcaaagcc

SEQ ID NO: 311524 - DNA, 16 bp, Homo sapiens
acacaccaggctgtgg

SEQ ID NO: 311525 - DNA, 19 bp, Homo sapiens
acacaccccacaccccagc

SEQ ID NO: 311526 - DNA, 18 bp, Homo sapiens
acacaccctccagcacag

SEQ ID NO: 311527 - DNA, 20 bp, Homo sapiens
acacacccttccccactccc

SEQ ID NO: 311528 - DNA, 15 bp, Homo sapiens
acacacctcaccaga

SEQ ID NO: 311529 - DNA, 13 bp, Homo sapiens
acacacgcacgca

SEQ ID NO: 311530 - DNA, 15 bp, Homo sapiens
acacacgcagacaca

SEQ ID NO: 311531 - DNA, 20 bp, Homo sapiens
acacacggggcacccagccc

SEQ ID NO: 311532 - DNA, 21 bp, Homo sapiens
acacacgtgtgatgtatgttg

SEQ ID NO: 311533 - DNA, 13 bp, Homo sapiens
acacactaatcga

SEQ ID NO: 311534 - DNA, 15 bp, Homo sapiens
acacactcaccattt

SEQ ID NO: 311535 - DNA, 14 bp, Homo sapiens
acacactcagtgca

SEQ ID NO: 311536 - DNA, 16 bp, Homo sapiens
acacacttttgcacat

SEQ ID NO: 311537 - DNA, 14 bp, Homo sapiens
acacactttttaag

SEQ ID NO: 311538 - DNA, 19 bp, Homo sapiens
acacactttttaagaaata

SEQ ID NO: 311539 - DNA, 12 bp, Homo sapiens
acacagactctg

SEQ ID NO: 311540 - DNA, 19 bp, Homo sapiens
acacagactctgtgagatt

SEQ ID NO: 311541 - DNA, 20 bp, Homo sapiens
acacagaggttttaaacagt

SEQ ID NO: 311542 - DNA, 21 bp, Homo sapiens
acacagaggttttaaacagtc

SEQ ID NO: 311543 - DNA, 21 bp, Homo sapiens
acacagagtggtctttctgga

SEQ ID NO: 311544 - DNA, 23 bp, Homo sapiens
acacagagtggtctttctggaga

SEQ ID NO: 311545 - DNA, 19 bp, Homo sapiens
acacagatggcacctgtgg

SEQ ID NO: 311546 - DNA, 22 bp, Homo sapiens
acacagcacctcctctctgctg

SEQ ID NO: 311547 - DNA, 21 bp, Homo sapiens
acacagcagtatgaatgatgt

SEQ ID NO: 311548 - DNA, 15 bp, Homo sapiens
acacagcatgtgcca

SEQ ID NO: 311549 - DNA, 15 bp, Homo sapiens
acacagcatgtgtat

SEQ ID NO: 311550 - DNA, 9 bp, Homo sapiens
acacagcca

SEQ ID NO: 311551 - DNA, 23 bp, Homo sapiens
acacagccattcatctgggctgg

SEQ ID NO: 311552 - DNA, 12 bp, Homo sapiens
acacagcctggc

SEQ ID NO: 311553 - DNA, 17 bp, Homo sapiens
acacagcctttctgtat

SEQ ID NO: 311554 - DNA, 17 bp, Homo sapiens
acacagctgggcaaagc

SEQ ID NO: 311555 - DNA, 14 bp, Homo sapiens
acacaggaggagaa

SEQ ID NO: 311556 - DNA, 16 bp, Homo sapiens
acacaggcccatgccc

SEQ ID NO: 311557 - DNA, 22 bp, Homo sapiens
acacaggcctggcccagccagc

SEQ ID NO: 311558 - DNA, 16 bp, Homo sapiens
acacagggctctttga

SEQ ID NO: 311559 - DNA, 16 bp, Homo sapiens
acacaggggacactga

SEQ ID NO: 311560 - DNA, 22 bp, Homo sapiens
acacagtatttattgttcccac

SEQ ID NO: 311561 - DNA, 13 bp, Homo sapiens
acacagtcatgtg

SEQ ID NO: 311562 - DNA, 14 bp, Homo sapiens
acacagttttgtct

SEQ ID NO: 311563 - DNA, 16 bp, Homo sapiens
acacataaaagtaatt

SEQ ID NO: 311564 - DNA, 17 bp, Homo sapiens
acacataaaagtaatta

SEQ ID NO: 311565 - DNA, 14 bp, Homo sapiens
acacataaagtaaa

SEQ ID NO: 311566 - DNA, 13 bp, Homo sapiens
acacataaatctg

SEQ ID NO: 311567 - DNA, 14 bp, Homo sapiens
aaaagatacatttg

SEQ ID NO: 311568 - DNA, 20 bp, Homo sapiens
aaaagataggtttgagttca

SEQ ID NO: 311569 - DNA, 10 bp, Homo sapiens
aaaagatccc

SEQ ID NO: 311570 - DNA, 22 bp, Homo sapiens
aaaagattctttaaactactga

SEQ ID NO: 311571 - DNA, 21 bp, Homo sapiens
aaaagattttcagaaaatatt

SEQ ID NO: 311572 - DNA, 14 bp, Homo sapiens
aaaagcaaagtgaa

SEQ ID NO: 311573 - DNA, 12 bp, Homo sapiens
aaaagcaagact

SEQ ID NO: 311574 - DNA, 19 bp, Homo sapiens
aaaagcatatataaaacaa

SEQ ID NO: 311575 - DNA, 11 bp, Homo sapiens
aaaagccaagc

SEQ ID NO: 311576 - DNA, 11 bp, Homo sapiens
aaaagccagat

SEQ ID NO: 311577 - DNA, 17 bp, Homo sapiens
aaaagccataacttgaa

SEQ ID NO: 311578 - DNA, 15 bp, Homo sapiens
aaaagcctaagaaaa

SEQ ID NO: 311579 - DNA, 16 bp, Homo sapiens
aaaagcctaagaaaaa

SEQ ID NO: 311580 - DNA, 23 bp, Homo sapiens
aaaagcctttcataccagtcagt

SEQ ID NO: 311581 - DNA, 19 bp, Homo sapiens
aaaagcggggttcaatgct

SEQ ID NO: 311582 - DNA, 16 bp, Homo sapiens
aaaagctgtgtctctg

SEQ ID NO: 311583 - DNA, 12 bp, Homo sapiens
aaaagctgttcc

SEQ ID NO: 311584 - DNA, 22 bp, Homo sapiens
aaaaggaaaactcaccatttca

SEQ ID NO: 311585 - DNA, 15 bp, Homo sapiens
aaaaggaagactaga

SEQ ID NO: 311586 - DNA, 21 bp, Homo sapiens
aaaaggaatgcaagagaagga

SEQ ID NO: 311587 - DNA, 19 bp, Homo sapiens
aaaaggagaactgtgctct

SEQ ID NO: 311588 - DNA, 15 bp, Homo sapiens
aaaaggagctcttct

SEQ ID NO: 311589 - DNA, 17 bp, Homo sapiens
aaaaggataggaaaaga

SEQ ID NO: 311590 - DNA, 13 bp, Homo sapiens
aaaaggcctttgg

SEQ ID NO: 311591 - DNA, 16 bp, Homo sapiens
aaaaggcctttgggat

SEQ ID NO: 311592 - DNA, 20 bp, Homo sapiens
aaaaggcggtactagttcag

SEQ ID NO: 311593 - DNA, 19 bp, Homo sapiens
aaaagggaagttgtgcctt

SEQ ID NO: 311594 - DNA, 16 bp, Homo sapiens
aaaagggagaaaaaga

SEQ ID NO: 311595 - DNA, 19 bp, Homo sapiens
aaaaggtattttgaatacc

SEQ ID NO: 311596 - DNA, 14 bp, Homo sapiens
aaaaggttaagcca

SEQ ID NO: 311597 - DNA, 22 bp, Homo sapiens
aaaagtacatagtgaattttaa

SEQ ID NO: 311598 - DNA, 17 bp, Homo sapiens
aaaagtacatttaatac

SEQ ID NO: 311599 - DNA, 21 bp, Homo sapiens
aaaagtacatttaatacagca

SEQ ID NO: 311600 - DNA, 13 bp, Homo sapiens
aaaagtatatgtt

SEQ ID NO: 311601 - DNA, 15 bp, Homo sapiens
aaaagtatatgttag

SEQ ID NO: 311602 - DNA, 15 bp, Homo sapiens
aaaagtcaaactttc

SEQ ID NO: 311603 - DNA, 14 bp, Homo sapiens
aaaagtctattttt

SEQ ID NO: 311604 - DNA, 19 bp, Homo sapiens
aaaagtcttcactctctga

SEQ ID NO: 311605 - DNA, 23 bp, Homo sapiens
aaaagtcttcactctctgaagat

SEQ ID NO: 311606 - DNA, 13 bp, Homo sapiens
aaaagtgacacag

SEQ ID NO: 311607 - DNA, 15 bp, Homo sapiens
aaaagtgacacagca

SEQ ID NO: 311608 - DNA, 12 bp, Homo sapiens
aaaagtgatgtg

SEQ ID NO: 311609 - DNA, 19 bp, Homo sapiens
aaaagtgatgtgatttatg

SEQ ID NO: 311610 - DNA, 18 bp, Homo sapiens
aaaagtggattttcctga

SEQ ID NO: 311611 - DNA, 21 bp, Homo sapiens
aaaagtgggccagtgtgggaa

SEQ ID NO: 311612 - DNA, 16 bp, Homo sapiens
aaaagtgtatagaata

SEQ ID NO: 311613 - DNA, 19 bp, Homo sapiens
aaaagtgtcctataattct

SEQ ID NO: 311614 - DNA, 22 bp, Homo sapiens
aaaagttaagctgctatagtaa

SEQ ID NO: 311615 - DNA, 15 bp, Homo sapiens
aaaagttacagaaat

SEQ ID NO: 311616 - DNA, 14 bp, Homo sapiens
aaaagttgcacatt

SEQ ID NO: 311617 - DNA, 16 bp, Homo sapiens
aaaagtttacaagtgt

SEQ ID NO: 311618 - DNA, 12 bp, Homo sapiens
aaaagtttccat

SEQ ID NO: 311619 - DNA, 23 bp, Homo sapiens
aaaagtttgtcctttaactatca

SEQ ID NO: 311620 - DNA, 21 bp, Homo sapiens
aaaataaaaaagatcccaaat

SEQ ID NO: 311621 - DNA, 17 bp, Homo sapiens
aaaataaaaagtgacac

SEQ ID NO: 311622 - DNA, 18 bp, Homo sapiens
aaaataaaatgcatttaa

SEQ ID NO: 311623 - DNA, 19 bp, Homo sapiens
aaaataaaatgcatttaaa

SEQ ID NO: 311624 - DNA, 17 bp, Homo sapiens
aaaataaatatactaat

SEQ ID NO: 311625 - DNA, 21 bp, Homo sapiens
aaaataaatatactaataaaa

SEQ ID NO: 311626 - DNA, 13 bp, Homo sapiens
aaaataaatttaa

SEQ ID NO: 311627 - DNA, 20 bp, Homo sapiens
aaaataacatattcttgctt

SEQ ID NO: 311628 - DNA, 19 bp, Homo sapiens
aaaataacatctgaaaaga

SEQ ID NO: 311629 - DNA, 20 bp, Homo sapiens
aaaataacatctgaaaagaa

SEQ ID NO: 311630 - DNA, 13 bp, Homo sapiens
aaaataaccaaaa

SEQ ID NO: 311631 - DNA, 16 bp, Homo sapiens
aaaataaccccaaaat

SEQ ID NO: 311632 - DNA, 14 bp, Homo sapiens
acacgcgtgattga

SEQ ID NO: 311633 - DNA, 20 bp, Homo sapiens
acacgctgcccaggctctgc

SEQ ID NO: 311634 - DNA, 21 bp, Homo sapiens
acacgctgcccaggctctgct

SEQ ID NO: 311635 - DNA, 13 bp, Homo sapiens
acacggcagctgt

SEQ ID NO: 311636 - DNA, 19 bp, Homo sapiens
acacgggcagcctggctcc

SEQ ID NO: 311637 - DNA, 16 bp, Homo sapiens
acacgtacttaaatga

SEQ ID NO: 311638 - DNA, 20 bp, Homo sapiens
acacgtggaggaatgctccc

SEQ ID NO: 311639 - DNA, 22 bp, Homo sapiens
acacgtggaggaatgctccccc

SEQ ID NO: 311640 - DNA, 17 bp, Homo sapiens
acacgtgtgatgtatgt

SEQ ID NO: 311641 - DNA, 18 bp, Homo sapiens
acacgtttgatttcttcc

SEQ ID NO: 311642 - DNA, 15 bp, Homo sapiens
acactaaacagacta

SEQ ID NO: 311643 - DNA, 15 bp, Homo sapiens
acactaacctgggtt

SEQ ID NO: 311644 - DNA, 19 bp, Homo sapiens
acactaagttatagtatat

SEQ ID NO: 311645 - DNA, 15 bp, Homo sapiens
acactaatacactaa

SEQ ID NO: 311646 - DNA, 22 bp, Homo sapiens
acactaatgaggaaactgcact

SEQ ID NO: 311647 - DNA, 12 bp, Homo sapiens
acactaattcct

SEQ ID NO: 311648 - DNA, 23 bp, Homo sapiens
acactaattcctttctatcctac

SEQ ID NO: 311649 - DNA, 15 bp, Homo sapiens
acactacaaatgtta

SEQ ID NO: 311650 - DNA, 14 bp, Homo sapiens
acactacacgcacc

SEQ ID NO: 311651 - DNA, 21 bp, Homo sapiens
acactacctcttttgagactt

SEQ ID NO: 311652 - DNA, 15 bp, Homo sapiens
acactagtctgtgtg

SEQ ID NO: 311653 - DNA, 20 bp, Homo sapiens
acactagtctgtgtgctgtg

SEQ ID NO: 311654 - DNA, 23 bp, Homo sapiens
acactagttttgtgccagccgtg

SEQ ID NO: 311655 - DNA, 18 bp, Homo sapiens
acactatggtatttgagt

SEQ ID NO: 311656 - DNA, 19 bp, Homo sapiens
acactatggtatttgagtg

SEQ ID NO: 311657 - DNA, 14 bp, Homo sapiens
acactcagcagccc

SEQ ID NO: 311658 - DNA, 14 bp, Homo sapiens
acactcagctgttc

SEQ ID NO: 311659 - DNA, 20 bp, Homo sapiens
acactcagctgttcagattg

SEQ ID NO: 311660 - DNA, 16 bp, Homo sapiens
acactcagttgttcaa

SEQ ID NO: 311661 - DNA, 19 bp, Homo sapiens
acactcatgcggcccagcc

SEQ ID NO: 311662 - DNA, 21 bp, Homo sapiens
acactcatgcggcccagccat

SEQ ID NO: 311663 - DNA, 16 bp, Homo sapiens
acactcgcccgcccac

SEQ ID NO: 311664 - DNA, 20 bp, Homo sapiens
acactctcctgggcccctcc

SEQ ID NO: 311665 - DNA, 12 bp, Homo sapiens
acactctttgta

SEQ ID NO: 311666 - DNA, 16 bp, Homo sapiens
acactctttgtaagag

SEQ ID NO: 311667 - DNA, 24 bp, Homo sapiens
acactgaaccttgttgatgccagc

SEQ ID NO: 311668 - DNA, 23 bp, Homo sapiens
acactgaatatttatatttcact

SEQ ID NO: 311669 - DNA, 13 bp, Homo sapiens
acactgacttgag

SEQ ID NO: 311670 - DNA, 17 bp, Homo sapiens
acactgatgggtcctgc

SEQ ID NO: 311671 - DNA, 23 bp, Homo sapiens
acactgattacttttgggagggg

SEQ ID NO: 311672 - DNA, 11 bp, Homo sapiens
acactgcagcc

SEQ ID NO: 311673 - DNA, 16 bp, Homo sapiens
acactgctaaatttac

SEQ ID NO: 311674 - DNA, 17 bp, Homo sapiens
acactgctaaatttacg

SEQ ID NO: 311675 - DNA, 18 bp, Homo sapiens
acactgctaggtgggcca

SEQ ID NO: 311676 - DNA, 23 bp, Homo sapiens
acactgctaggtgggccagcccc

SEQ ID NO: 311677 - DNA, 14 bp, Homo sapiens
acactgcttctcgg

SEQ ID NO: 311678 - DNA, 12 bp, Homo sapiens
acactggcccct

SEQ ID NO: 311679 - DNA, 16 bp, Homo sapiens
acactggcccctagaa

SEQ ID NO: 311680 - DNA, 20 bp, Homo sapiens
acactggtgggcagctgagg

SEQ ID NO: 311681 - DNA, 16 bp, Homo sapiens
acactgtatctaaaaa

SEQ ID NO: 311682 - DNA, 20 bp, Homo sapiens
acactgtatctaaaaaataa

SEQ ID NO: 311683 - DNA, 13 bp, Homo sapiens
acactgtcaagat

SEQ ID NO: 311684 - DNA, 16 bp, Homo sapiens
acactgtcaagattaa

SEQ ID NO: 311685 - DNA, 22 bp, Homo sapiens
acactgtcaagattaagttata

SEQ ID NO: 311686 - DNA, 22 bp, Homo sapiens
acactgtgcccagcccggacct

SEQ ID NO: 311687 - DNA, 23 bp, Homo sapiens
acactgtgcccagcccggacctt

SEQ ID NO: 311688 - DNA, 16 bp, Homo sapiens
acactgtggaacacta

SEQ ID NO: 311689 - DNA, 19 bp, Homo sapiens
acacttacaagtaatgaat

SEQ ID NO: 311690 - DNA, 20 bp, Homo sapiens
acacttacaagtaatgaatt

SEQ ID NO: 311691 - DNA, 18 bp, Homo sapiens
acacttacactttatgca

SEQ ID NO: 311692 - DNA, 21 bp, Homo sapiens
acacttacactttatgcacaa

SEQ ID NO: 311693 - DNA, 14 bp, Homo sapiens
acacttattgcttt

SEQ ID NO: 311694 - DNA, 20 bp, Homo sapiens
acacttattgctttgaaact

SEQ ID NO: 311695 - DNA, 14 bp, Homo sapiens
acacttattttctg

SEQ ID NO: 311696 - DNA, 13 bp, Homo sapiens
acacttcagactg

SEQ ID NO: 311697 - DNA, 18 bp, Homo sapiens
acacttcagagagctggt

SEQ ID NO: 311698 - DNA, 14 bp, Homo sapiens
acacttcctgtcca

SEQ ID NO: 311699 - DNA, 12 bp, Homo sapiens
acacttctgatc

SEQ ID NO: 311700 - DNA, 16 bp, Homo sapiens
acacttgagaggatga

SEQ ID NO: 311701 - DNA, 21 bp, Homo sapiens
acacttgagaggatgaatgta

SEQ ID NO: 311702 - DNA, 20 bp, Homo sapiens
acacttgccttcttcaccca

SEQ ID NO: 311703 - DNA, 18 bp, Homo sapiens
acacttgtgtgtgggctg

SEQ ID NO: 311704 - DNA, 22 bp, Homo sapiens
acacttgtgtgtgggctgtgag

SEQ ID NO: 311705 - DNA, 23 bp, Homo sapiens
acacttgtgtgtgggctgtgagt

SEQ ID NO: 311706 - DNA, 18 bp, Homo sapiens
acactttcactggggatc

SEQ ID NO: 311707 - DNA, 18 bp, Homo sapiens
acactttcctggataaaa

SEQ ID NO: 311708 - DNA, 17 bp, Homo sapiens
acactttgagcattttt

SEQ ID NO: 311709 - DNA, 17 bp, Homo sapiens
acactttgccaaggctc

SEQ ID NO: 311710 - DNA, 19 bp, Homo sapiens
acactttgccaaggctctc

SEQ ID NO: 311711 - DNA, 20 bp, Homo sapiens
acactttgccaaggctctcc

SEQ ID NO: 311712 - DNA, 13 bp, Homo sapiens
acacttttgcaca

SEQ ID NO: 311713 - DNA, 14 bp, Homo sapiens
acacttttgcacat

SEQ ID NO: 311714 - DNA, 14 bp, Homo sapiens
acagaaaaaaaaca

SEQ ID NO: 311715 - DNA, 18 bp, Homo sapiens
acagaaaacaacaaaaaa

SEQ ID NO: 311716 - DNA, 12 bp, Homo sapiens
acagaaaagaga

SEQ ID NO: 311717 - DNA, 13 bp, Homo sapiens
acagaaaagagaa

SEQ ID NO: 311718 - DNA, 19 bp, Homo sapiens
acagaaaagagaagaaaga

SEQ ID NO: 311719 - DNA, 20 bp, Homo sapiens
acagaaagcaaatcagacac

SEQ ID NO: 311720 - DNA, 22 bp, Homo sapiens
acagaaagcaaatcagacacaa

SEQ ID NO: 311721 - DNA, 13 bp, Homo sapiens
acagaaatactat

SEQ ID NO: 311722 - DNA, 22 bp, Homo sapiens
acagaaatggggaattctctaa

SEQ ID NO: 311723 - DNA, 14 bp, Homo sapiens
acagaacaacaaca

SEQ ID NO: 311724 - DNA, 18 bp, Homo sapiens
acagaacatttctcatgt

SEQ ID NO: 311725 - DNA, 20 bp, Homo sapiens
acagaacatttctcatgtgc

SEQ ID NO: 311726 - DNA, 23 bp, Homo sapiens
acagaacatttctcatgtgcttt

SEQ ID NO: 311727 - DNA, 19 bp, Homo sapiens
acagaaccagcactcccag

SEQ ID NO: 311728 - DNA, 18 bp, Homo sapiens
acagaactcgatgcactg

SEQ ID NO: 311729 - DNA, 21 bp, Homo sapiens
acagaagacacgtgtttttgt

SEQ ID NO: 311730 - DNA, 13 bp, Homo sapiens
acagaagcttcca

SEQ ID NO: 311731 - DNA, 21 bp, Homo sapiens
acagaatacaagccactacct

SEQ ID NO: 311732 - DNA, 21 bp, Homo sapiens
acagaatattgacaagctagg

SEQ ID NO: 311733 - DNA, 17 bp, Homo sapiens
acagacacacacacgca

SEQ ID NO: 311734 - DNA, 16 bp, Homo sapiens
acagacagacacacac

SEQ ID NO: 311735 - DNA, 21 bp, Homo sapiens
acagacagatcccatccatca

SEQ ID NO: 311736 - DNA, 13 bp, Homo sapiens
acagacatctcct

SEQ ID NO: 311737 - DNA, 21 bp, Homo sapiens
acagacatctcctcaccccag

SEQ ID NO: 311738 - DNA, 16 bp, Homo sapiens
acagacctaatgctcc

SEQ ID NO: 311739 - DNA, 21 bp, Homo sapiens
acagacctcactgctttgtag

SEQ ID NO: 311740 - DNA, 23 bp, Homo sapiens
acagacctcggctgtgtggggag

SEQ ID NO: 311741 - DNA, 16 bp, Homo sapiens
acagacgccacctggc

SEQ ID NO: 311742 - DNA, 22 bp, Homo sapiens
acagacggacgggacagcggcc

SEQ ID NO: 311743 - DNA, 18 bp, Homo sapiens
acagactggagacaatgc

SEQ ID NO: 311744 - DNA, 14 bp, Homo sapiens
acagactgttccct

SEQ ID NO: 311745 - DNA, 20 bp, Homo sapiens
acagactgttccctccaagg

SEQ ID NO: 311746 - DNA, 20 bp, Homo sapiens
acagacttctggaaggctgg

SEQ ID NO: 311747 - DNA, 18 bp, Homo sapiens
acagagaaattctgtggt

SEQ ID NO: 311748 - DNA, 21 bp, Homo sapiens
acagagaaattctgtggtggg

SEQ ID NO: 311749 - DNA, 23 bp, Homo sapiens
acagagaactagtggtggctctg

SEQ ID NO: 311750 - DNA, 22 bp, Homo sapiens
acagagattactttgctgcctt

SEQ ID NO: 311751 - DNA, 18 bp, Homo sapiens
acagagcaagtgatttat

SEQ ID NO: 311752 - DNA, 20 bp, Homo sapiens
acagagccattcccttggaa

SEQ ID NO: 311753 - DNA, 18 bp, Homo sapiens
acagaggagaaaggtgaa

SEQ ID NO: 311754 - DNA, 17 bp, Homo sapiens
acagaggagagtcccag

SEQ ID NO: 311755 - DNA, 18 bp, Homo sapiens
acagaggatgctgaagta

SEQ ID NO: 311756 - DNA, 18 bp, Homo sapiens
acagagggagaagggaga

SEQ ID NO: 311757 - DNA, 16 bp, Homo sapiens
acagagtatatatgta

SEQ ID NO: 311758 - DNA, 22 bp, Homo sapiens
acagagtatatatgtacagtta

SEQ ID NO: 311759 - DNA, 17 bp, Homo sapiens
acagagtcgatgctcaa

SEQ ID NO: 311760 - DNA, 20 bp, Homo sapiens
acagagtctgacaggaagac

SEQ ID NO: 311761 - DNA, 21 bp, Homo sapiens
acagagtggactcttccctct

SEQ ID NO: 311762 - DNA, 17 bp, Homo sapiens
acagagtggatctggag

SEQ ID NO: 311763 - DNA, 18 bp, Homo sapiens
acagagtggatctggagt

SEQ ID NO: 311764 - DNA, 19 bp, Homo sapiens
aaaataagtaacatataaa

SEQ ID NO: 311765 - DNA, 13 bp, Homo sapiens
aaaataataaatt

SEQ ID NO: 311766 - DNA, 16 bp, Homo sapiens
aaaataataaattgca

SEQ ID NO: 311767 - DNA, 15 bp, Homo sapiens
aaaataattttatga

SEQ ID NO: 311768 - DNA, 12 bp, Homo sapiens
aaaatacattta

SEQ ID NO: 311769 - DNA, 18 bp, Homo sapiens
aaaatacatttaaaactt

SEQ ID NO: 311770 - DNA, 20 bp, Homo sapiens
aaaatactattggacagaca

SEQ ID NO: 311771 - DNA, 23 bp, Homo sapiens
aaaatactgcttttgcaaacaga

SEQ ID NO: 311772 - DNA, 12 bp, Homo sapiens
aaaatacttctt

SEQ ID NO: 311773 - DNA, 15 bp, Homo sapiens
aaaatagaagctgta

SEQ ID NO: 311774 - DNA, 21 bp, Homo sapiens
aaaatagagatgagctttctt

SEQ ID NO: 311775 - DNA, 19 bp, Homo sapiens
aaaatagtaaatgctttgt

SEQ ID NO: 311776 - DNA, 22 bp, Homo sapiens
aaaatagtttaggagaaaccag

SEQ ID NO: 311777 - DNA, 15 bp, Homo sapiens
aaaatagttttacat

SEQ ID NO: 311778 - DNA, 16 bp, Homo sapiens
aaaatatatgtttggc

SEQ ID NO: 311779 - DNA, 11 bp, Homo sapiens
aaaatatattt

SEQ ID NO: 311780 - DNA, 14 bp, Homo sapiens
aaaatatatttaat

SEQ ID NO: 311781 - DNA, 16 bp, Homo sapiens
aaaatatatttaatga

SEQ ID NO: 311782 - DNA, 13 bp, Homo sapiens
aaaatatcacttt

SEQ ID NO: 311783 - DNA, 16 bp, Homo sapiens
aaaatatcactttgta

SEQ ID NO: 311784 - DNA, 14 bp, Homo sapiens
aaaatatcattcag

SEQ ID NO: 311785 - DNA, 16 bp, Homo sapiens
aaaatatcattcagca

SEQ ID NO: 311786 - DNA, 20 bp, Homo sapiens
aaaatatgggttgcatttgg

SEQ ID NO: 311787 - DNA, 18 bp, Homo sapiens
aaaatatgtgagcatgaa

SEQ ID NO: 311788 - DNA, 20 bp, Homo sapiens
aaaatattcaataagaagtc

SEQ ID NO: 311789 - DNA, 20 bp, Homo sapiens
aaaatatttctatgtaaatt

SEQ ID NO: 311790 - DNA, 19 bp, Homo sapiens
aaaatcattcaatatctga

SEQ ID NO: 311791 - DNA, 16 bp, Homo sapiens
aaaatccagcatccca

SEQ ID NO: 311792 - DNA, 12 bp, Homo sapiens
aaaatcctacca

SEQ ID NO: 311793 - DNA, 18 bp, Homo sapiens
aaaatcctaccaacctct

SEQ ID NO: 311794 - DNA, 18 bp, Homo sapiens
aaaatcctttttgtattt

SEQ ID NO: 311795 - DNA, 14 bp, Homo sapiens
aaaatctaaaacaa

SEQ ID NO: 311796 - DNA, 15 bp, Homo sapiens
aaaatctaatattaa

SEQ ID NO: 311797 - DNA, 16 bp, Homo sapiens
aaaatctgaactctca

SEQ ID NO: 311798 - DNA, 17 bp, Homo sapiens
aaaatctgaactctcaa

SEQ ID NO: 311799 - DNA, 13 bp, Homo sapiens
aaaatcttcagct

SEQ ID NO: 311800 - DNA, 16 bp, Homo sapiens
aaaatcttcagctggt

SEQ ID NO: 311801 - DNA, 13 bp, Homo sapiens
aaaatcttgtcat

SEQ ID NO: 311802 - DNA, 19 bp, Homo sapiens
aaaatcttgtcatgtgtat

SEQ ID NO: 311803 - DNA, 18 bp, Homo sapiens
aaaatcttgtgctagaat

SEQ ID NO: 311804 - DNA, 15 bp, Homo sapiens
aaaatgaagattatt

SEQ ID NO: 311805 - DNA, 23 bp, Homo sapiens
aaaatgaagattattttttatga

SEQ ID NO: 311806 - DNA, 20 bp, Homo sapiens
aaaatgaaggttaggattta

SEQ ID NO: 311807 - DNA, 13 bp, Homo sapiens
aaaatgaatgcat

SEQ ID NO: 311808 - DNA, 13 bp, Homo sapiens
aaaatgacaatga

SEQ ID NO: 311809 - DNA, 19 bp, Homo sapiens
aaaatgagcctgtaatcct

SEQ ID NO: 311810 - DNA, 19 bp, Homo sapiens
aaaatgattgtaaaatagc

SEQ ID NO: 311811 - DNA, 14 bp, Homo sapiens
aaaatgcacgtagc

SEQ ID NO: 311812 - DNA, 12 bp, Homo sapiens
aaaatgcatgat

SEQ ID NO: 311813 - DNA, 16 bp, Homo sapiens
aaaatgcatgataatg

SEQ ID NO: 311814 - DNA, 15 bp, Homo sapiens
aaaatgcatgtgatt

SEQ ID NO: 311815 - DNA, 22 bp, Homo sapiens
aaaatgccacattttgctttat

SEQ ID NO: 311816 - DNA, 13 bp, Homo sapiens
aaaatggaaagaa

SEQ ID NO: 311817 - DNA, 20 bp, Homo sapiens
aaaatggacttttgttcatg

SEQ ID NO: 311818 - DNA, 18 bp, Homo sapiens
aaaatggatgacaaagaa

SEQ ID NO: 311819 - DNA, 23 bp, Homo sapiens
aaaatggggtttgggcccctcag

SEQ ID NO: 311820 - DNA, 17 bp, Homo sapiens
aaaatggtgttttcatg

SEQ ID NO: 311821 - DNA, 23 bp, Homo sapiens
aaaatggtgttttcatgtaaata

SEQ ID NO: 311822 - DNA, 23 bp, Homo sapiens
aaaatgtaagtaaatgtctgtgg

SEQ ID NO: 311823 - DNA, 16 bp, Homo sapiens
aaaatgtagaagaaag

SEQ ID NO: 311824 - DNA, 17 bp, Homo sapiens
aaaatgtagaagaaagc

SEQ ID NO: 311825 - DNA, 21 bp, Homo sapiens
aaaatgtagggttataataat

SEQ ID NO: 311826 - DNA, 18 bp, Homo sapiens
aaaatgtgatttttctga

SEQ ID NO: 311827 - DNA, 16 bp, Homo sapiens
acagccaccacctgga

SEQ ID NO: 311828 - DNA, 22 bp, Homo sapiens
acagccacctccacccccaaga

SEQ ID NO: 311829 - DNA, 16 bp, Homo sapiens
acagccacgaggtggt

SEQ ID NO: 311830 - DNA, 12 bp, Homo sapiens
acagccagagct

SEQ ID NO: 311831 - DNA, 17 bp, Homo sapiens
acagccagagctgggtg

SEQ ID NO: 311832 - DNA, 16 bp, Homo sapiens
acagccatgtccaagt

SEQ ID NO: 311833 - DNA, 18 bp, Homo sapiens
acagccatgtccaagttc

SEQ ID NO: 311834 - DNA, 16 bp, Homo sapiens
acagccattcatctgg

SEQ ID NO: 311835 - DNA, 17 bp, Homo sapiens
acagccattcatctggg

SEQ ID NO: 311836 - DNA, 19 bp, Homo sapiens
acagccattcatctgggct

SEQ ID NO: 311837 - DNA, 23 bp, Homo sapiens
acagccattcatctgggctggca

SEQ ID NO: 311838 - DNA, 17 bp, Homo sapiens
acagcccaaccaggagg

SEQ ID NO: 311839 - DNA, 17 bp, Homo sapiens
acagcccagccacggac

SEQ ID NO: 311840 - DNA, 22 bp, Homo sapiens
acagcccgcatgcagcagcttg

SEQ ID NO: 311841 - DNA, 12 bp, Homo sapiens
acagccctggga

SEQ ID NO: 311842 - DNA, 12 bp, Homo sapiens
acagccctgtca

SEQ ID NO: 311843 - DNA, 22 bp, Homo sapiens
acagccgagtggatagatgccc

SEQ ID NO: 311844 - DNA, 19 bp, Homo sapiens
acagccgtcagccaaatgt

SEQ ID NO: 311845 - DNA, 18 bp, Homo sapiens
acagcctcacccctgcag

SEQ ID NO: 311846 - DNA, 16 bp, Homo sapiens
acagcctcccaccccc

SEQ ID NO: 311847 - DNA, 14 bp, Homo sapiens
acagcctctacagc

SEQ ID NO: 311848 - DNA, 14 bp, Homo sapiens
acagcctcttactt

SEQ ID NO: 311849 - DNA, 21 bp, Homo sapiens
acagcctgcacacacctgcct

SEQ ID NO: 311850 - DNA, 11 bp, Homo sapiens
acagcctggca

SEQ ID NO: 311851 - DNA, 15 bp, Homo sapiens
acagcctggcacagg

SEQ ID NO: 311852 - DNA, 23 bp, Homo sapiens
acagcctggcctcccctgcggag

SEQ ID NO: 311853 - DNA, 16 bp, Homo sapiens
acagcctgtcttcaga

SEQ ID NO: 311854 - DNA, 20 bp, Homo sapiens
acagcctgtcttcagatcct

SEQ ID NO: 311855 - DNA, 21 bp, Homo sapiens
acagcctgtttgggaggctgg

SEQ ID NO: 311856 - DNA, 19 bp, Homo sapiens
acagccttgggcctttcag

SEQ ID NO: 311857 - DNA, 13 bp, Homo sapiens
acagcggcccggc

SEQ ID NO: 311858 - DNA, 18 bp, Homo sapiens
acagcggcccggcccacg

SEQ ID NO: 311859 - DNA, 15 bp, Homo sapiens
acagctaacatggaa

SEQ ID NO: 311860 - DNA, 17 bp, Homo sapiens
acagctaacatggaagt

SEQ ID NO: 311861 - DNA, 20 bp, Homo sapiens
acagctaatcagcattctca

SEQ ID NO: 311862 - DNA, 17 bp, Homo sapiens
acagctaggctgagatg

SEQ ID NO: 311863 - DNA, 17 bp, Homo sapiens
acagctcacctctgaag

SEQ ID NO: 311864 - DNA, 20 bp, Homo sapiens
acagctcacctctgaaggca

SEQ ID NO: 311865 - DNA, 13 bp, Homo sapiens
acagctcaggctg

SEQ ID NO: 311866 - DNA, 14 bp, Homo sapiens
acagctccccaagt

SEQ ID NO: 311867 - DNA, 21 bp, Homo sapiens
acagctcctcctcttggagct

SEQ ID NO: 311868 - DNA, 23 bp, Homo sapiens
acagctcctcttaccgtagcctc

SEQ ID NO: 311869 - DNA, 19 bp, Homo sapiens
acagctctgtgttgccatg

SEQ ID NO: 311870 - DNA, 20 bp, Homo sapiens
acagctctgtgttgccatgt

SEQ ID NO: 311871 - DNA, 19 bp, Homo sapiens
acagctgaaagacagtaaa

SEQ ID NO: 311872 - DNA, 19 bp, Homo sapiens
acagctgagagacttttaa

SEQ ID NO: 311873 - DNA, 22 bp, Homo sapiens
acagctgaggtctcttgaggga

SEQ ID NO: 311874 - DNA, 17 bp, Homo sapiens
acagctgcagagacaga

SEQ ID NO: 311875 - DNA, 12 bp, Homo sapiens
acagctgcctgc

SEQ ID NO: 311876 - DNA, 17 bp, Homo sapiens
acagctgcttctgtgca

SEQ ID NO: 311877 - DNA, 11 bp, Homo sapiens
acagctgggca

SEQ ID NO: 311878 - DNA, 16 bp, Homo sapiens
acagctgttcctgtgt

SEQ ID NO: 311879 - DNA, 14 bp, Homo sapiens
acagctgtttaaga

SEQ ID NO: 311880 - DNA, 17 bp, Homo sapiens
acagcttcacttaaaat

SEQ ID NO: 311881 - DNA, 19 bp, Homo sapiens
acagcttcacttaaaatca

SEQ ID NO: 311882 - DNA, 19 bp, Homo sapiens
acagcttcatgcctttgta

SEQ ID NO: 311883 - DNA, 21 bp, Homo sapiens
acagcttctttactactgcaa

SEQ ID NO: 311884 - DNA, 19 bp, Homo sapiens
acagcttgttttggacttt

SEQ ID NO: 311885 - DNA, 14 bp, Homo sapiens
acagctttcccagg

SEQ ID NO: 311886 - DNA, 18 bp, Homo sapiens
acagctttcctgggtgag

SEQ ID NO: 311887 - DNA, 14 bp, Homo sapiens
acagctttctccag

SEQ ID NO: 311888 - DNA, 15 bp, Homo sapiens
acagctttctccaga

SEQ ID NO: 311889 - DNA, 22 bp, Homo sapiens
acagcttttagtacccacctga

SEQ ID NO: 311890 - DNA, 16 bp, Homo sapiens
acaggaaaaaaacttt

SEQ ID NO: 311891 - DNA, 17 bp, Homo sapiens
acaggaaagagtcacac

SEQ ID NO: 311892 - DNA, 13 bp, Homo sapiens
acaggaagactgg

SEQ ID NO: 311893 - DNA, 15 bp, Homo sapiens
acaggaagcacccca

SEQ ID NO: 311894 - DNA, 20 bp, Homo sapiens
acaggaagcaccccatgcca

SEQ ID NO: 311895 - DNA, 13 bp, Homo sapiens
acaggaaggcttg

SEQ ID NO: 311896 - DNA, 20 bp, Homo sapiens
acaggaaggtggtgcttaca

SEQ ID NO: 311897 - DNA, 14 bp, Homo sapiens
acaggagacctggc

SEQ ID NO: 311898 - DNA, 15 bp, Homo sapiens
acaggagagaaaggg

SEQ ID NO: 311899 - DNA, 19 bp, Homo sapiens
acaggagagaaaggggatg

SEQ ID NO: 311900 - DNA, 22 bp, Homo sapiens
acaggaggaactggtccaggcc

SEQ ID NO: 311901 - DNA, 22 bp, Homo sapiens
acaggagtcctttcttttgaaa

SEQ ID NO: 311902 - DNA, 19 bp, Homo sapiens
acaggatcatgtaaatgct

SEQ ID NO: 311903 - DNA, 23 bp, Homo sapiens
acaggattccagttgcgtgtctg

SEQ ID NO: 311904 - DNA, 17 bp, Homo sapiens
acaggattctcttctca

SEQ ID NO: 311905 - DNA, 20 bp, Homo sapiens
acaggcaaagaggtgctgct

SEQ ID NO: 311906 - DNA, 22 bp, Homo sapiens
acaggcaaagaggtgctgcttt

SEQ ID NO: 311907 - DNA, 21 bp, Homo sapiens
acaggcaacattacaaacaaa

SEQ ID NO: 311908 - DNA, 21 bp, Homo sapiens
acaggcaccgagaatgttgta

SEQ ID NO: 311909 - DNA, 22 bp, Homo sapiens
acaggcagcgatggtctcagaa

SEQ ID NO: 311910 - DNA, 13 bp, Homo sapiens
acaggcagtgcat

SEQ ID NO: 311911 - DNA, 17 bp, Homo sapiens
acaggcagtgcatgtga

SEQ ID NO: 311912 - DNA, 18 bp, Homo sapiens
acaggcattgcactaaaa

SEQ ID NO: 311913 - DNA, 22 bp, Homo sapiens
acaggcattgcactaaaagtga

SEQ ID NO: 311914 - DNA, 18 bp, Homo sapiens
acaggccactgcaaaccc

SEQ ID NO: 311915 - DNA, 16 bp, Homo sapiens
acaggccccttttgtg

SEQ ID NO: 311916 - DNA, 12 bp, Homo sapiens
acaggccctccc

SEQ ID NO: 311917 - DNA, 17 bp, Homo sapiens
acaggccctccctgtct

SEQ ID NO: 311918 - DNA, 22 bp, Homo sapiens
acaggcccttcctctccactgc

SEQ ID NO: 311919 - DNA, 16 bp, Homo sapiens
acaggcctggcccagc

SEQ ID NO: 311920 - DNA, 21 bp, Homo sapiens
acaggcctggcccagccagca

SEQ ID NO: 311921 - DNA, 23 bp, Homo sapiens
acaggcctggcccagccagcagg

SEQ ID NO: 311922 - DNA, 14 bp, Homo sapiens
acaggctcaatatt

SEQ ID NO: 311923 - DNA, 19 bp, Homo sapiens
acaggctgcaagctgcagg

SEQ ID NO: 311924 - DNA, 12 bp, Homo sapiens
acaggctgcccc

SEQ ID NO: 311925 - DNA, 17 bp, Homo sapiens
acagggacacagtctgg

SEQ ID NO: 311926 - DNA, 19 bp, Homo sapiens
acagggatctgtttgaaca

SEQ ID NO: 311927 - DNA, 16 bp, Homo sapiens
acagggcatctccagg

SEQ ID NO: 311928 - DNA, 15 bp, Homo sapiens
acagggccagggttg

SEQ ID NO: 311929 - DNA, 16 bp, Homo sapiens
acagggcccaggcctg

SEQ ID NO: 311930 - DNA, 19 bp, Homo sapiens
acagggcccaggcctggag

SEQ ID NO: 311931 - DNA, 13 bp, Homo sapiens
acagggcctgact

SEQ ID NO: 311932 - DNA, 12 bp, Homo sapiens
acagggctcttt

SEQ ID NO: 311933 - DNA, 23 bp, Homo sapiens
acaggggaaggaaataacattgc

SEQ ID NO: 311934 - DNA, 22 bp, Homo sapiens
acaggggaggtgatagcattgc

SEQ ID NO: 311935 - DNA, 20 bp, Homo sapiens
acaggggcaggcctgggacc

SEQ ID NO: 311936 - DNA, 19 bp, Homo sapiens
acaggggcggggcaggaat

SEQ ID NO: 311937 - DNA, 21 bp, Homo sapiens
acaggggctatcccttctcag

SEQ ID NO: 311938 - DNA, 19 bp, Homo sapiens
acaggggggtcggaagcct

SEQ ID NO: 311939 - DNA, 20 bp, Homo sapiens
acaggggggtcggaagcctg

SEQ ID NO: 311940 - DNA, 21 bp, Homo sapiens
acagggtgggatgagcctctc

SEQ ID NO: 311941 - DNA, 16 bp, Homo sapiens
acagggttcaaaatgt

SEQ ID NO: 311942 - DNA, 21 bp, Homo sapiens
acaggtcttctttaaggaaga

SEQ ID NO: 311943 - DNA, 13 bp, Homo sapiens
acaggtctttgaa

SEQ ID NO: 311944 - DNA, 16 bp, Homo sapiens
acaggttgaggctaaa

SEQ ID NO: 311945 - DNA, 22 bp, Homo sapiens
acaggttgaggctaaaacaaat

SEQ ID NO: 311946 - DNA, 15 bp, Homo sapiens
acagtaaataaattg

SEQ ID NO: 311947 - DNA, 18 bp, Homo sapiens
acagtaaataaattgttt

SEQ ID NO: 311948 - DNA, 15 bp, Homo sapiens
acagtaccatctgaa

SEQ ID NO: 311949 - DNA, 22 bp, Homo sapiens
acagtagcatactgatgagaca

SEQ ID NO: 311950 - DNA, 21 bp, Homo sapiens
acagtagctgtggggagctgg

SEQ ID NO: 311951 - DNA, 14 bp, Homo sapiens
acagtatataagct

SEQ ID NO: 311952 - DNA, 15 bp, Homo sapiens
acagtatataagctt

SEQ ID NO: 311953 - DNA, 23 bp, Homo sapiens
acagtatcactgtctttcctaga

SEQ ID NO: 311954 - DNA, 11 bp, Homo sapiens
acagtatgtgt

SEQ ID NO: 311955 - DNA, 12 bp, Homo sapiens
acagtatgtgtc

SEQ ID NO: 311956 - DNA, 14 bp, Homo sapiens
acagtatgtgtcta

SEQ ID NO: 311957 - DNA, 23 bp, Homo sapiens
aaacattcaaaaacatggccaca

SEQ ID NO: 311958 - DNA, 17 bp, Homo sapiens
aaacattcctccagcct

SEQ ID NO: 311959 - DNA, 17 bp, Homo sapiens
aaacattctttaacata

SEQ ID NO: 311960 - DNA, 20 bp, Homo sapiens
aaacattgaagtaatgaatt

SEQ ID NO: 311961 - DNA, 21 bp, Homo sapiens
aaacatttgacacataaaagt

SEQ ID NO: 311962 - DNA, 18 bp, Homo sapiens
aaacatttgtacattcct

SEQ ID NO: 311963 - DNA, 19 bp, Homo sapiens
aaacattttaaaatcaact

SEQ ID NO: 311964 - DNA, 19 bp, Homo sapiens
aaacattttgtcatataag

SEQ ID NO: 311965 - DNA, 13 bp, Homo sapiens
aaaccaaaacaga

SEQ ID NO: 311966 - DNA, 13 bp, Homo sapiens
aaaccaacaatta

SEQ ID NO: 311967 - DNA, 13 bp, Homo sapiens
aaaccaacaccat

SEQ ID NO: 311968 - DNA, 13 bp, Homo sapiens
aaaccaagtgcct

SEQ ID NO: 311969 - DNA, 23 bp, Homo sapiens
aaaccaagtgccttgagctgcct

SEQ ID NO: 311970 - DNA, 18 bp, Homo sapiens
aaaccaataaaacaagaa

SEQ ID NO: 311971 - DNA, 22 bp, Homo sapiens
aaaccagaatgattttgacata

SEQ ID NO: 311972 - DNA, 12 bp, Homo sapiens
aaaccagggagc

SEQ ID NO: 311973 - DNA, 19 bp, Homo sapiens
aaaccattataaaatcttt

SEQ ID NO: 311974 - DNA, 14 bp, Homo sapiens
aaaccattgcttca

SEQ ID NO: 311975 - DNA, 16 bp, Homo sapiens
aaaccattgcttcact

SEQ ID NO: 311976 - DNA, 17 bp, Homo sapiens
aaaccattgcttcacta

SEQ ID NO: 311977 - DNA, 21 bp, Homo sapiens
aaacccatcgtggtatgtgaa

SEQ ID NO: 311978 - DNA, 22 bp, Homo sapiens
aaacccatcgtggtatgtgaat

SEQ ID NO: 311979 - DNA, 14 bp, Homo sapiens
aaacccccaggagg

SEQ ID NO: 311980 - DNA, 21 bp, Homo sapiens
aaacccgacaacatttctgcc

SEQ ID NO: 311981 - DNA, 19 bp, Homo sapiens
aaacccggggaactggttt

SEQ ID NO: 311982 - DNA, 19 bp, Homo sapiens
aaaccctgctaaatgactt

SEQ ID NO: 311983 - DNA, 12 bp, Homo sapiens
aaaccctgggga

SEQ ID NO: 311984 - DNA, 13 bp, Homo sapiens
aaaccctggggac

SEQ ID NO: 311985 - DNA, 21 bp, Homo sapiens
aaaccctgtctctactaaaaa

SEQ ID NO: 311986 - DNA, 12 bp, Homo sapiens
aaaccctgttta

SEQ ID NO: 311987 - DNA, 19 bp, Homo sapiens
aaaccggcaacctgtaact

SEQ ID NO: 311988 - DNA, 20 bp, Homo sapiens
aaaccggcaacctgtaactg

SEQ ID NO: 311989 - DNA, 14 bp, Homo sapiens
aaaccgtaatttta

SEQ ID NO: 311990 - DNA, 16 bp, Homo sapiens
aaaccgtaattttatt

SEQ ID NO: 311991 - DNA, 19 bp, Homo sapiens
aaaccgtaattttattatt

SEQ ID NO: 311992 - DNA, 22 bp, Homo sapiens
aaacctcaaaatgtctaagata

SEQ ID NO: 311993 - DNA, 20 bp, Homo sapiens
aaacctgcatttttaaagga

SEQ ID NO: 311994 - DNA, 12 bp, Homo sapiens
aaacctgccctg

SEQ ID NO: 311995 - DNA, 12 bp, Homo sapiens
aaacctggaggg

SEQ ID NO: 311996 - DNA, 15 bp, Homo sapiens
aaacctggatgtcac

SEQ ID NO: 311997 - DNA, 17 bp, Homo sapiens
aaaccttattgtacctc

SEQ ID NO: 311998 - DNA, 17 bp, Homo sapiens
aaaccttctcaggaggt

SEQ ID NO: 311999 - DNA, 20 bp, Homo sapiens
aaaccttgctaattttctca

SEQ ID NO: 312000 - DNA, 11 bp, Homo sapiens
aaacctttcaa

SEQ ID NO: 312001 - DNA, 17 bp, Homo sapiens
aaacctttcaaatttca

SEQ ID NO: 312002 - DNA, 23 bp, Homo sapiens
aaacctttcagctggcagagtta

SEQ ID NO: 312003 - DNA, 16 bp, Homo sapiens
aaacgaaactgctcta

SEQ ID NO: 312004 - DNA, 14 bp, Homo sapiens
aaacgaaggcctct

SEQ ID NO: 312005 - DNA, 17 bp, Homo sapiens
aaacgaatataagctta

SEQ ID NO: 312006 - DNA, 16 bp, Homo sapiens
aaacgagatttgccaa

SEQ ID NO: 312007 - DNA, 12 bp, Homo sapiens
aaacgccatgtc

SEQ ID NO: 312008 - DNA, 20 bp, Homo sapiens
aaacgcctcttttccctctc

SEQ ID NO: 312009 - DNA, 22 bp, Homo sapiens
aaacgcctcttttccctctcta

SEQ ID NO: 312010 - DNA, 16 bp, Homo sapiens
aaactaaaattcaaca

SEQ ID NO: 312011 - DNA, 22 bp, Homo sapiens
aaactaaaattcaacaaatgat

SEQ ID NO: 312012 - DNA, 13 bp, Homo sapiens
aaactaaatctct

SEQ ID NO: 312013 - DNA, 17 bp, Homo sapiens
aaactaaatctctaata

SEQ ID NO: 312014 - DNA, 18 bp, Homo sapiens
aaactaaatctctaatat

SEQ ID NO: 312015 - DNA, 19 bp, Homo sapiens
aaactaaccttttatcaat

SEQ ID NO: 312016 - DNA, 17 bp, Homo sapiens
aaactacaaagctgaag

SEQ ID NO: 312017 - DNA, 19 bp, Homo sapiens
aaactaccagtgggcatgt

SEQ ID NO: 312018 - DNA, 21 bp, Homo sapiens
aaactaccagtgggcatgtat

SEQ ID NO: 312019 - DNA, 17 bp, Homo sapiens
aaactactgtacatttt

SEQ ID NO: 312020 - DNA, 16 bp, Homo sapiens
aaactatagaataaag

SEQ ID NO: 312021 - DNA, 18 bp, Homo sapiens
aaactatcggttcaagtt

SEQ ID NO: 312022 - DNA, 18 bp, Homo sapiens
aaactatgcacctataaa

SEQ ID NO: 312023 - DNA, 19 bp, Homo sapiens
aaactatttaaaattggca

SEQ ID NO: 312024 - DNA, 20 bp, Homo sapiens
aaactatttaaaattggcac

SEQ ID NO: 312025 - DNA, 20 bp, Homo sapiens
aaactatttgtctttcagga

SEQ ID NO: 312026 - DNA, 22 bp, Homo sapiens
aaactcaaaacttaacatattt

SEQ ID NO: 312027 - DNA, 20 bp, Homo sapiens
aaactcaccatttcatccat

SEQ ID NO: 312028 - DNA, 15 bp, Homo sapiens
aaactcactgctcaa

SEQ ID NO: 312029 - DNA, 17 bp, Homo sapiens
aaactcctgattttgta

SEQ ID NO: 312030 - DNA, 19 bp, Homo sapiens
aaactcctgattttgtagt

SEQ ID NO: 312031 - DNA, 12 bp, Homo sapiens
aaactcctgcct

SEQ ID NO: 312032 - DNA, 14 bp, Homo sapiens
aaactcctgcctgt

SEQ ID NO: 312033 - DNA, 22 bp, Homo sapiens
aaactcgtctgatgttttgatg

SEQ ID NO: 312034 - DNA, 21 bp, Homo sapiens
aaactctaaacattaatcaat

SEQ ID NO: 312035 - DNA, 16 bp, Homo sapiens
aaactcttcaaggcca

SEQ ID NO: 312036 - DNA, 13 bp, Homo sapiens
aaactgaaaaatc

SEQ ID NO: 312037 - DNA, 17 bp, Homo sapiens
aaactgaaaactgtaaa

SEQ ID NO: 312038 - DNA, 13 bp, Homo sapiens
aaactgaaaatct

SEQ ID NO: 312039 - DNA, 19 bp, Homo sapiens
aaactgaaaatctaatatt

SEQ ID NO: 312040 - DNA, 13 bp, Homo sapiens
aaactgaaagtgt

SEQ ID NO: 312041 - DNA, 14 bp, Homo sapiens
aaactgaaagtgtt

SEQ ID NO: 312042 - DNA, 15 bp, Homo sapiens
aaactgaaagtgttt

SEQ ID NO: 312043 - DNA, 12 bp, Homo sapiens
aaactgacttta

SEQ ID NO: 312044 - DNA, 15 bp, Homo sapiens
aaactgaggcccaga

SEQ ID NO: 312045 - DNA, 22 bp, Homo sapiens
aaactgaggcccagagagctga

SEQ ID NO: 312046 - DNA, 13 bp, Homo sapiens
aaactgatgcttt

SEQ ID NO: 312047 - DNA, 17 bp, Homo sapiens
aaactgatgctttcaga

SEQ ID NO: 312048 - DNA, 22 bp, Homo sapiens
aaactgcacagtgctgttggtg

SEQ ID NO: 312049 - DNA, 23 bp, Homo sapiens
aaactgcataagtgaaaatctta

SEQ ID NO: 312050 - DNA, 16 bp, Homo sapiens
aaactgcctgttcctt

SEQ ID NO: 312051 - DNA, 23 bp, Homo sapiens
aaactgcttttttttttccagca

SEQ ID NO: 312052 - DNA, 19 bp, Homo sapiens
aaactggctttttcccagc

SEQ ID NO: 312053 - DNA, 12 bp, Homo sapiens
aaactgtagtaa

SEQ ID NO: 312054 - DNA, 18 bp, Homo sapiens
aaactgtatcaaatctgt

SEQ ID NO: 312055 - DNA, 21 bp, Homo sapiens
aaactgtatcaaatctgtata

SEQ ID NO: 312056 - DNA, 21 bp, Homo sapiens
aaactgtatgtcttataagaa

SEQ ID NO: 312057 - DNA, 18 bp, Homo sapiens
aaactgtcctctttcaga

SEQ ID NO: 312058 - DNA, 12 bp, Homo sapiens
aaactgtgacat

SEQ ID NO: 312059 - DNA, 21 bp, Homo sapiens
aaactgtgacattccacagag

SEQ ID NO: 312060 - DNA, 10 bp, Homo sapiens
aaactgtgag

SEQ ID NO: 312061 - DNA, 20 bp, Homo sapiens
aaactgtgagataaatatca

SEQ ID NO: 312062 - DNA, 14 bp, Homo sapiens
aaactgtgcaatcc

SEQ ID NO: 312063 - DNA, 14 bp, Homo sapiens
aaactgtgtaactg

SEQ ID NO: 312064 - DNA, 20 bp, Homo sapiens
aaactgtgtaactgcccaaa

SEQ ID NO: 312065 - DNA, 19 bp, Homo sapiens
aaactgtgtggactgtgat

SEQ ID NO: 312066 - DNA, 20 bp, Homo sapiens
aaactgtgtggactgtgatg

SEQ ID NO: 312067 - DNA, 23 bp, Homo sapiens
aaactgttctctattagacttta

SEQ ID NO: 312068 - DNA, 22 bp, Homo sapiens
aaactgttgccagagatggagg

SEQ ID NO: 312069 - DNA, 17 bp, Homo sapiens
aaacttaacatatttac

SEQ ID NO: 312070 - DNA, 23 bp, Homo sapiens
aaacttacctaagtgacatttgt

SEQ ID NO: 312071 - DNA, 21 bp, Homo sapiens
aaacttacctataaattaaga

SEQ ID NO: 312072 - DNA, 22 bp, Homo sapiens
aaacttactatggtatatattt

SEQ ID NO: 312073 - DNA, 23 bp, Homo sapiens
aaacttactgtcagagaatatga

SEQ ID NO: 312074 - DNA, 21 bp, Homo sapiens
aaacttagtgcggacaagttt

SEQ ID NO: 312075 - DNA, 16 bp, Homo sapiens
aaacttagtttgtgaa

SEQ ID NO: 312076 - DNA, 21 bp, Homo sapiens
aaacttataaatcatattgat

SEQ ID NO: 312077 - DNA, 23 bp, Homo sapiens
aaacttatgctagtttattggaa

SEQ ID NO: 312078 - DNA, 14 bp, Homo sapiens
aaacttatttgagt

SEQ ID NO: 312079 - DNA, 13 bp, Homo sapiens
aaacttcaaagct

SEQ ID NO: 312080 - DNA, 16 bp, Homo sapiens
aaacttcaaagctgaa

SEQ ID NO: 312081 - DNA, 22 bp, Homo sapiens
aaacttccattctttcttcctc

SEQ ID NO: 312082 - DNA, 21 bp, Homo sapiens
aaacttccctttctgcttgtg

SEQ ID NO: 312083 - DNA, 18 bp, Homo sapiens
aaacttctgaactttgga

SEQ ID NO: 312084 - DNA, 10 bp, Homo sapiens
aaacttcttg

SEQ ID NO: 312085 - DNA, 17 bp, Homo sapiens
aaacttgagcccactcc

SEQ ID NO: 312086 - DNA, 23 bp, Homo sapiens
aaacttgtgttcaatctgtgaag

SEQ ID NO: 312087 - DNA, 22 bp, Homo sapiens
aaagcccttccatgtcgcctct

SEQ ID NO: 312088 - DNA, 14 bp, Homo sapiens
aaagcctaagaaaa

SEQ ID NO: 312089 - DNA, 21 bp, Homo sapiens
aaagcctcctgccccctgcca

SEQ ID NO: 312090 - DNA, 13 bp, Homo sapiens
aaagcctgtctct

SEQ ID NO: 312091 - DNA, 13 bp, Homo sapiens
aaagcctgttccc

SEQ ID NO: 312092 - DNA, 20 bp, Homo sapiens
aaagcctgttcccctcactg

SEQ ID NO: 312093 - DNA, 17 bp, Homo sapiens
aaagccttatcaagtgt

SEQ ID NO: 312094 - DNA, 16 bp, Homo sapiens
aaagcctttaaattgt

SEQ ID NO: 312095 - DNA, 23 bp, Homo sapiens
aaagcctttaaattgttcctctt

SEQ ID NO: 312096 - DNA, 15 bp, Homo sapiens
aaagcgaatggacca

SEQ ID NO: 312097 - DNA, 18 bp, Homo sapiens
aaagcggccgatgggagt

SEQ ID NO: 312098 - DNA, 18 bp, Homo sapiens
aaagcggggggagggttg

SEQ ID NO: 312099 - DNA, 17 bp, Homo sapiens
aaagctaaaatgatttt

SEQ ID NO: 312100 - DNA, 15 bp, Homo sapiens
aaagctgaagccgcc

SEQ ID NO: 312101 - DNA, 19 bp, Homo sapiens
aaagctgattactgtcaat

SEQ ID NO: 312102 - DNA, 20 bp, Homo sapiens
aaagctgatttccctttttt

SEQ ID NO: 312103 - DNA, 21 bp, Homo sapiens
aaagctgcctgtagttaggaa

SEQ ID NO: 312104 - DNA, 23 bp, Homo sapiens
aaagctgctgagaatctagcctc

SEQ ID NO: 312105 - DNA, 20 bp, Homo sapiens
aaagctggacaagaagctgc

SEQ ID NO: 312106 - DNA, 21 bp, Homo sapiens
aaagctggacaagaagctgct

SEQ ID NO: 312107 - DNA, 23 bp, Homo sapiens
aaagctgtggccagcttgttatt

SEQ ID NO: 312108 - DNA, 13 bp, Homo sapiens
aaagctgtgtctc

SEQ ID NO: 312109 - DNA, 18 bp, Homo sapiens
aaagctgtgtctctgtat

SEQ ID NO: 312110 - DNA, 19 bp, Homo sapiens
aaagctgtgtctctgtata

SEQ ID NO: 312111 - DNA, 17 bp, Homo sapiens
aaagctgtttctaaaca

SEQ ID NO: 312112 - DNA, 23 bp, Homo sapiens
aaagcttcctagcttatctccct

SEQ ID NO: 312113 - DNA, 21 bp, Homo sapiens
aaagcttctatcccaggaggt

SEQ ID NO: 312114 - DNA, 20 bp, Homo sapiens
aaagcttgaagatcgttagt

SEQ ID NO: 312115 - DNA, 23 bp, Homo sapiens
aaagcttgtggccccttttactt

SEQ ID NO: 312116 - DNA, 15 bp, Homo sapiens
aaagcttgttaagat

SEQ ID NO: 312117 - DNA, 14 bp, Homo sapiens
aaagctttaaaaaa

SEQ ID NO: 312118 - DNA, 13 bp, Homo sapiens
aaagctttcctgc

SEQ ID NO: 312119 - DNA, 22 bp, Homo sapiens
aaagctttcctgccccaggcct

SEQ ID NO: 312120 - DNA, 23 bp, Homo sapiens
aaagctttcctgccccaggcctg

SEQ ID NO: 312121 - DNA, 19 bp, Homo sapiens
aaagctttgaacaattgtg

SEQ ID NO: 312122 - DNA, 16 bp, Homo sapiens
aaaggaaaaacagaac

SEQ ID NO: 312123 - DNA, 21 bp, Homo sapiens
aaaggaaaaacagaacatttc

SEQ ID NO: 312124 - DNA, 18 bp, Homo sapiens
aaaggaaaatagtaatgt

SEQ ID NO: 312125 - DNA, 14 bp, Homo sapiens
aaaggaaaccaagt

SEQ ID NO: 312126 - DNA, 13 bp, Homo sapiens
aaaggaacacgtg

SEQ ID NO: 312127 - DNA, 19 bp, Homo sapiens
aaaggaatgcaagagaagg

SEQ ID NO: 312128 - DNA, 13 bp, Homo sapiens
aaaggacaaacag

SEQ ID NO: 312129 - DNA, 14 bp, Homo sapiens
aaaggacaggagga

SEQ ID NO: 312130 - DNA, 22 bp, Homo sapiens
aaaggactaacataaaatctgt

SEQ ID NO: 312131 - DNA, 22 bp, Homo sapiens
aaaggactgttttttcctgagc

SEQ ID NO: 312132 - DNA, 16 bp, Homo sapiens
aaaggagaactgtgct

SEQ ID NO: 312133 - DNA, 17 bp, Homo sapiens
aaaggagaactgtgctc

SEQ ID NO: 312134 - DNA, 16 bp, Homo sapiens
aaaggagacaaagcag

SEQ ID NO: 312135 - DNA, 17 bp, Homo sapiens
aaaggagacaaagcagg

SEQ ID NO: 312136 - DNA, 22 bp, Homo sapiens
aaaggagctcttcttgtgaaat

SEQ ID NO: 312137 - DNA, 13 bp, Homo sapiens
aaaggaggctggc

SEQ ID NO: 312138 - DNA, 14 bp, Homo sapiens
aaaggaggctggca

SEQ ID NO: 312139 - DNA, 23 bp, Homo sapiens
aaaggagtgcatggccacagcca

SEQ ID NO: 312140 - DNA, 14 bp, Homo sapiens
aaaggataggaaaa

SEQ ID NO: 312141 - DNA, 18 bp, Homo sapiens
aaaggatggcagcctcag

SEQ ID NO: 312142 - DNA, 22 bp, Homo sapiens
aaaggattttggaaaagaaaca

SEQ ID NO: 312143 - DNA, 14 bp, Homo sapiens
aaaggcagaaagga

SEQ ID NO: 312144 - DNA, 15 bp, Homo sapiens
aaaggcaggaggtgg

SEQ ID NO: 312145 - DNA, 17 bp, Homo sapiens
aaaggcagtggggctgg

SEQ ID NO: 312146 - DNA, 17 bp, Homo sapiens
aaaggcatctaagacat

SEQ ID NO: 312147 - DNA, 11 bp, Homo sapiens
aaaggcctgga

SEQ ID NO: 312148 - DNA, 20 bp, Homo sapiens
aaaggcctggaaccagggag

SEQ ID NO: 312149 - DNA, 13 bp, Homo sapiens
aaaggcctttggg

SEQ ID NO: 312150 - DNA, 13 bp, Homo sapiens
aaaggcttctcca

SEQ ID NO: 312151 - DNA, 14 bp, Homo sapiens
aaaggcttctccac

SEQ ID NO: 312152 - DNA, 20 bp, Homo sapiens
aaagggaacaggaaaagaaa

SEQ ID NO: 312153 - DNA, 14 bp, Homo sapiens
aaagggacagcatg

SEQ ID NO: 312154 - DNA, 20 bp, Homo sapiens
aaagggagcccctcctctga

SEQ ID NO: 312155 - DNA, 16 bp, Homo sapiens
aaaggggcaagaaatt

SEQ ID NO: 312156 - DNA, 23 bp, Homo sapiens
aaaggggcaagaaattcattaaa

SEQ ID NO: 312157 - DNA, 13 bp, Homo sapiens
aaaggggctgctg

SEQ ID NO: 312158 - DNA, 19 bp, Homo sapiens
aaaggggctgctggggcat

SEQ ID NO: 312159 - DNA, 13 bp, Homo sapiens
aaaggggggaggg

SEQ ID NO: 312160 - DNA, 17 bp, Homo sapiens
aaagggttctgtaaaat

SEQ ID NO: 312161 - DNA, 17 bp, Homo sapiens
aaaggtaatctgaaaca

SEQ ID NO: 312162 - DNA, 17 bp, Homo sapiens
aaaggtgaaacacacac

SEQ ID NO: 312163 - DNA, 22 bp, Homo sapiens
aaaggtgaccttgcaacttcat

SEQ ID NO: 312164 - DNA, 14 bp, Homo sapiens
aaaggtgattaaat

SEQ ID NO: 312165 - DNA, 17 bp, Homo sapiens
aaaggtgattaaatatt

SEQ ID NO: 312166 - DNA, 12 bp, Homo sapiens
aaaggtgctcaa

SEQ ID NO: 312167 - DNA, 18 bp, Homo sapiens
aaaggtggtgaggcaata

SEQ ID NO: 312168 - DNA, 13 bp, Homo sapiens
aaagtaaaattat

SEQ ID NO: 312169 - DNA, 13 bp, Homo sapiens
aaagtaaagctaa

SEQ ID NO: 312170 - DNA, 14 bp, Homo sapiens
aaagtaaggtgcag

SEQ ID NO: 312171 - DNA, 16 bp, Homo sapiens
aaagtacagaacatat

SEQ ID NO: 312172 - DNA, 18 bp, Homo sapiens
aaagtacatagtgaattt

SEQ ID NO: 312173 - DNA, 17 bp, Homo sapiens
aaagtaggtatacaaaa

SEQ ID NO: 312174 - DNA, 17 bp, Homo sapiens
aaagtatatatagaatc

SEQ ID NO: 312175 - DNA, 21 bp, Homo sapiens
aaagtatggcagtgggagact

SEQ ID NO: 312176 - DNA, 16 bp, Homo sapiens
aaagtattccacctta

SEQ ID NO: 312177 - DNA, 20 bp, Homo sapiens
aaagtattccaccttaaatt

SEQ ID NO: 312178 - DNA, 20 bp, Homo sapiens
aaagtattcttcttttctta

SEQ ID NO: 312179 - DNA, 14 bp, Homo sapiens
aaagtatttaaaga

SEQ ID NO: 312180 - DNA, 15 bp, Homo sapiens
aaagtcaaactttca

SEQ ID NO: 312181 - DNA, 12 bp, Homo sapiens
aaagtctaaagt

SEQ ID NO: 312182 - DNA, 14 bp, Homo sapiens
aaagtctcctgtat

SEQ ID NO: 312183 - DNA, 17 bp, Homo sapiens
aaagtcttcaagggctg

SEQ ID NO: 312184 - DNA, 20 bp, Homo sapiens
aaagtcttcactctctgaag

SEQ ID NO: 312185 - DNA, 18 bp, Homo sapiens
aaagtcttgaatgttgaa

SEQ ID NO: 312186 - DNA, 23 bp, Homo sapiens
aaagtcttgctgtggtctctttg

SEQ ID NO: 312187 - DNA, 19 bp, Homo sapiens
aaagtcttgtgactagtgc

SEQ ID NO: 312188 - DNA, 23 bp, Homo sapiens
aaagtcttgtgactagtgctgaa

SEQ ID NO: 312189 - DNA, 19 bp, Homo sapiens
aaagtgaaagacatttcaa

SEQ ID NO: 312190 - DNA, 17 bp, Homo sapiens
aaagtgaatttgaatga

SEQ ID NO: 312191 - DNA, 21 bp, Homo sapiens
aaagtgaatttgaatgaaaaa

SEQ ID NO: 312192 - DNA, 12 bp, Homo sapiens
aaagtgatttct

SEQ ID NO: 312193 - DNA, 18 bp, Homo sapiens
aaagtgcaattgcacaaa

SEQ ID NO: 312194 - DNA, 14 bp, Homo sapiens
aaagtgcagccctt

SEQ ID NO: 312195 - DNA, 15 bp, Homo sapiens
aaagtgcagcccttc

SEQ ID NO: 312196 - DNA, 17 bp, Homo sapiens
aaagtgcagcccttcct

SEQ ID NO: 312197 - DNA, 21 bp, Homo sapiens
aaagtgccccttaagggttga

SEQ ID NO: 312198 - DNA, 17 bp, Homo sapiens
aaagtggcaagaccaaa

SEQ ID NO: 312199 - DNA, 23 bp, Homo sapiens
aaagtggggagggacaagggatt

SEQ ID NO: 312200 - DNA, 22 bp, Homo sapiens
aaagtgggttttttagttgaat

SEQ ID NO: 312201 - DNA, 15 bp, Homo sapiens
aaagtgtaaaataga

SEQ ID NO: 312202 - DNA, 15 bp, Homo sapiens
aaagtgtatttgtta

SEQ ID NO: 312203 - DNA, 18 bp, Homo sapiens
aaagtgtgagcaaactaa

SEQ ID NO: 312204 - DNA, 14 bp, Homo sapiens
aaagtgtgctttat

SEQ ID NO: 312205 - DNA, 20 bp, Homo sapiens
aaagtgtgttgttgctttag

SEQ ID NO: 312206 - DNA, 9 bp, Homo sapiens
aaagtgttg

SEQ ID NO: 312207 - DNA, 18 bp, Homo sapiens
aaagtgtttatttttcat

SEQ ID NO: 312208 - DNA, 13 bp, Homo sapiens
aaagtgttttttc

SEQ ID NO: 312209 - DNA, 12 bp, Homo sapiens
aaagttaaaaag

SEQ ID NO: 312210 - DNA, 15 bp, Homo sapiens
aaagttaacattagg

SEQ ID NO: 312211 - DNA, 16 bp, Homo sapiens
aaagttacaaattcaa

SEQ ID NO: 312212 - DNA, 17 bp, Homo sapiens
aaagttacagaaatact

SEQ ID NO: 312213 - DNA, 22 bp, Homo sapiens
aaagttactgatcacaggacgt

SEQ ID NO: 312214 - DNA, 20 bp, Homo sapiens
aaagttagagtacagatcct

SEQ ID NO: 312215 - DNA, 21 bp, Homo sapiens
aaagttgaggggagaggaaat

SEQ ID NO: 312216 - DNA, 12 bp, Homo sapiens
aaagtttaaata

SEQ ID NO: 312217 - DNA, 17 bp, Homo sapiens
aaatatcattatagcat

SEQ ID NO: 312218 - DNA, 15 bp, Homo sapiens
aaatatcattctttg

SEQ ID NO: 312219 - DNA, 18 bp, Homo sapiens
aaatatccaaagactgta

SEQ ID NO: 312220 - DNA, 21 bp, Homo sapiens
aaatatccaaagactgtactg

SEQ ID NO: 312221 - DNA, 15 bp, Homo sapiens
aaatatctatttatc

SEQ ID NO: 312222 - DNA, 21 bp, Homo sapiens
aaatatctatttatctgtctg

SEQ ID NO: 312223 - DNA, 13 bp, Homo sapiens
aaatatctcagag

SEQ ID NO: 312224 - DNA, 24 bp, Homo sapiens
aaatatgaaatgataaagatgtca

SEQ ID NO: 312225 - DNA, 13 bp, Homo sapiens
aaatatgaaattt

SEQ ID NO: 312226 - DNA, 19 bp, Homo sapiens
aaatatgattctcctctcc

SEQ ID NO: 312227 - DNA, 12 bp, Homo sapiens
aaatatgcactt

SEQ ID NO: 312228 - DNA, 16 bp, Homo sapiens
aaatatgcatgtactt

SEQ ID NO: 312229 - DNA, 15 bp, Homo sapiens
aaatatgctaaatgt

SEQ ID NO: 312230 - DNA, 16 bp, Homo sapiens
aaatatggaacttcta

SEQ ID NO: 312231 - DNA, 13 bp, Homo sapiens
aaatattaaaaga

SEQ ID NO: 312232 - DNA, 21 bp, Homo sapiens
aaatattactgatcttacctt

SEQ ID NO: 312233 - DNA, 14 bp, Homo sapiens
aaatattagcaaag

SEQ ID NO: 312234 - DNA, 15 bp, Homo sapiens
aaatattatctttgt

SEQ ID NO: 312235 - DNA, 18 bp, Homo sapiens
aaatattatctttgtaat

SEQ ID NO: 312236 - DNA, 14 bp, Homo sapiens
aaatattatgtgtt

SEQ ID NO: 312237 - DNA, 14 bp, Homo sapiens
aaatattctatatg

SEQ ID NO: 312238 - DNA, 18 bp, Homo sapiens
aaatattctatatgaatt

SEQ ID NO: 312239 - DNA, 21 bp, Homo sapiens
aaatattcttgtccacattct

SEQ ID NO: 312240 - DNA, 22 bp, Homo sapiens
aaatattcttgtccacattcta

SEQ ID NO: 312241 - DNA, 15 bp, Homo sapiens
aaatattgcttggac

SEQ ID NO: 312242 - DNA, 17 bp, Homo sapiens
aaatattggtttgttat

SEQ ID NO: 312243 - DNA, 20 bp, Homo sapiens
aaatattgtgttgtgaatgt

SEQ ID NO: 312244 - DNA, 13 bp, Homo sapiens
aaatatttcactt

SEQ ID NO: 312245 - DNA, 19 bp, Homo sapiens
aaatatttctatgtaaatt

SEQ ID NO: 312246 - DNA, 12 bp, Homo sapiens
aaatatttttgt

SEQ ID NO: 312247 - DNA, 13 bp, Homo sapiens
aaatcaatgtcac

SEQ ID NO: 312248 - DNA, 22 bp, Homo sapiens
aaatcaattctgatacagcctt

SEQ ID NO: 312249 - DNA, 12 bp, Homo sapiens
aaatcaattttt

SEQ ID NO: 312250 - DNA, 16 bp, Homo sapiens
aaatcacacctctggg

SEQ ID NO: 312251 - DNA, 23 bp, Homo sapiens
aaatcacagatgggtattaaact

SEQ ID NO: 312252 - DNA, 14 bp, Homo sapiens
aaatcacatttcca

SEQ ID NO: 312253 - DNA, 23 bp, Homo sapiens
aaatcaccttttctaaaaagtca

SEQ ID NO: 312254 - DNA, 15 bp, Homo sapiens
aaatcactcatataa

SEQ ID NO: 312255 - DNA, 21 bp, Homo sapiens
aaatcactgaggcatttttac

SEQ ID NO: 312256 - DNA, 15 bp, Homo sapiens
aaatcactgtattta

SEQ ID NO: 312257 - DNA, 20 bp, Homo sapiens
aaatcagacacaattagaga

SEQ ID NO: 312258 - DNA, 21 bp, Homo sapiens
aaatcagacacaattagagaa

SEQ ID NO: 312259 - DNA, 20 bp, Homo sapiens
aaatcagaggagagacggtg

SEQ ID NO: 312260 - DNA, 19 bp, Homo sapiens
aaatcagcgatgtgtcacc

SEQ ID NO: 312261 - DNA, 22 bp, Homo sapiens
aaatcagtgtttaaataaagac

SEQ ID NO: 312262 - DNA, 16 bp, Homo sapiens
aaatcagttttgtgta

SEQ ID NO: 312263 - DNA, 15 bp, Homo sapiens
aaatcataatcatcc

SEQ ID NO: 312264 - DNA, 22 bp, Homo sapiens
aaatcatgcttataagcaacat

SEQ ID NO: 312265 - DNA, 22 bp, Homo sapiens
aaatcattcaaaactttcagct

SEQ ID NO: 312266 - DNA, 21 bp, Homo sapiens
aaatcattgctttgaagcagt

SEQ ID NO: 312267 - DNA, 15 bp, Homo sapiens
aaatcattgtagaaa

SEQ ID NO: 312268 - DNA, 14 bp, Homo sapiens
aaatcatttcagta

SEQ ID NO: 312269 - DNA, 22 bp, Homo sapiens
aaatcatttcatgttagtctta

SEQ ID NO: 312270 - DNA, 16 bp, Homo sapiens
aaatcattttaacttc

SEQ ID NO: 312271 - DNA, 16 bp, Homo sapiens
aaatccataccccctg

SEQ ID NO: 312272 - DNA, 19 bp, Homo sapiens
aaatccctcttcctccaaa

SEQ ID NO: 312273 - DNA, 13 bp, Homo sapiens
aaatccttccaaa

SEQ ID NO: 312274 - DNA, 17 bp, Homo sapiens
aaatccttgccttcaaa

SEQ ID NO: 312275 - DNA, 21 bp, Homo sapiens
aaatccttttaaccattttaa

SEQ ID NO: 312276 - DNA, 16 bp, Homo sapiens
aaatcgccttatgaga

SEQ ID NO: 312277 - DNA, 17 bp, Homo sapiens
aaatcgccttatgagaa

SEQ ID NO: 312278 - DNA, 22 bp, Homo sapiens
aaatcggatctggggctctggg

SEQ ID NO: 312279 - DNA, 22 bp, Homo sapiens
aaatctaaaacaaaatctgaac

SEQ ID NO: 312280 - DNA, 23 bp, Homo sapiens
aaatctaaaacaaaatctgaact

SEQ ID NO: 312281 - DNA, 19 bp, Homo sapiens
aaatctaaatgattatctt

SEQ ID NO: 312282 - DNA, 14 bp, Homo sapiens
aaatctaatctctt

SEQ ID NO: 312283 - DNA, 15 bp, Homo sapiens
aaatctactgagcca

SEQ ID NO: 312284 - DNA, 16 bp, Homo sapiens
aaatctactgagccac

SEQ ID NO: 312285 - DNA, 23 bp, Homo sapiens
aaatctagatcaattaattctta

SEQ ID NO: 312286 - DNA, 17 bp, Homo sapiens
aaatctagccagagccc

SEQ ID NO: 312287 - DNA, 19 bp, Homo sapiens
aaatctagttttttttgta

SEQ ID NO: 312288 - DNA, 23 bp, Homo sapiens
aaatctcaaatttggattgctaa

SEQ ID NO: 312289 - DNA, 16 bp, Homo sapiens
aaatctccaatccaca

SEQ ID NO: 312290 - DNA, 19 bp, Homo sapiens
aaatctctctctgttgtgt

SEQ ID NO: 312291 - DNA, 21 bp, Homo sapiens
aaatctctctctgttgtgttc

SEQ ID NO: 312292 - DNA, 21 bp, Homo sapiens
aaatctgtaagctctttgaaa

SEQ ID NO: 312293 - DNA, 16 bp, Homo sapiens
aaatctgtatatgttg

SEQ ID NO: 312294 - DNA, 19 bp, Homo sapiens
aaatctgtatatgttgtaa

SEQ ID NO: 312295 - DNA, 15 bp, Homo sapiens
aaatctgtattgcta

SEQ ID NO: 312296 - DNA, 11 bp, Homo sapiens
aaatctgtcta

SEQ ID NO: 312297 - DNA, 16 bp, Homo sapiens
aaatctgtctgattct

SEQ ID NO: 312298 - DNA, 15 bp, Homo sapiens
aaatctgttctaaca

SEQ ID NO: 312299 - DNA, 12 bp, Homo sapiens
aaatcttcagct

SEQ ID NO: 312300 - DNA, 15 bp, Homo sapiens
aaatcttgaatttct

SEQ ID NO: 312301 - DNA, 20 bp, Homo sapiens
aaatcttgtgctagaatact

SEQ ID NO: 312302 - DNA, 14 bp, Homo sapiens
aaatctttcagaat

SEQ ID NO: 312303 - DNA, 18 bp, Homo sapiens
aaatctttcagcctgctt

SEQ ID NO: 312304 - DNA, 15 bp, Homo sapiens
aaatctttccatctc

SEQ ID NO: 312305 - DNA, 22 bp, Homo sapiens
aaatctttccatctcattacag

SEQ ID NO: 312306 - DNA, 13 bp, Homo sapiens
aaatgaaaagaga

SEQ ID NO: 312307 - DNA, 14 bp, Homo sapiens
aaatgaaaagagaa

SEQ ID NO: 312308 - DNA, 15 bp, Homo sapiens
aaatgaaagcatgtg

SEQ ID NO: 312309 - DNA, 12 bp, Homo sapiens
aaatgaaatact

SEQ ID NO: 312310 - DNA, 13 bp, Homo sapiens
aaatgaaatactt

SEQ ID NO: 312311 - DNA, 22 bp, Homo sapiens
aaatgaaattactacaaaattt

SEQ ID NO: 312312 - DNA, 22 bp, Homo sapiens
aaatgaaggttaggatttaaca

SEQ ID NO: 312313 - DNA, 13 bp, Homo sapiens
aaatgaatacgaa

SEQ ID NO: 312314 - DNA, 15 bp, Homo sapiens
aaatgaatgagctct

SEQ ID NO: 312315 - DNA, 19 bp, Homo sapiens
aaatgaatgagctctctaa

SEQ ID NO: 312316 - DNA, 16 bp, Homo sapiens
aaatgaatttgactgg

SEQ ID NO: 312317 - DNA, 13 bp, Homo sapiens
aaatgaccagttt

SEQ ID NO: 312318 - DNA, 17 bp, Homo sapiens
aaatgacttttattatg

SEQ ID NO: 312319 - DNA, 20 bp, Homo sapiens
aaatgagaattttatattct

SEQ ID NO: 312320 - DNA, 15 bp, Homo sapiens
aaatgagcctgtaat

SEQ ID NO: 312321 - DNA, 13 bp, Homo sapiens
aaatgaggaagaa

SEQ ID NO: 312322 - DNA, 21 bp, Homo sapiens
aaatgagtttaaaaaaataac

SEQ ID NO: 312323 - DNA, 12 bp, Homo sapiens
aaatgatagata

SEQ ID NO: 312324 - DNA, 17 bp, Homo sapiens
aaatgatatgtctttaa

SEQ ID NO: 312325 - DNA, 16 bp, Homo sapiens
acatggtgtgtgtctc

SEQ ID NO: 312326 - DNA, 18 bp, Homo sapiens
acatggttgtgacctgag

SEQ ID NO: 312327 - DNA, 20 bp, Homo sapiens
acatgtagtagtacttgaaa

SEQ ID NO: 312328 - DNA, 13 bp, Homo sapiens
acatgtatagtga

SEQ ID NO: 312329 - DNA, 15 bp, Homo sapiens
acatgtatgtggata

SEQ ID NO: 312330 - DNA, 18 bp, Homo sapiens
acatgtatgtggatacag

SEQ ID NO: 312331 - DNA, 23 bp, Homo sapiens
acatgtcatgtaggttgtctaaa

SEQ ID NO: 312332 - DNA, 17 bp, Homo sapiens
acatgtcggagtagaaa

SEQ ID NO: 312333 - DNA, 23 bp, Homo sapiens
acatgtctttggcttcagaattg

SEQ ID NO: 312334 - DNA, 11 bp, Homo sapiens
acatgtgcaac

SEQ ID NO: 312335 - DNA, 18 bp, Homo sapiens
acatgtgcaactcttgta

SEQ ID NO: 312336 - DNA, 19 bp, Homo sapiens
acatgtgccgaatgtgcag

SEQ ID NO: 312337 - DNA, 20 bp, Homo sapiens
acatgtggaaaactcacaga

SEQ ID NO: 312338 - DNA, 18 bp, Homo sapiens
acatgtggaaagtgaatt

SEQ ID NO: 312339 - DNA, 16 bp, Homo sapiens
acatgtggggccaggt

SEQ ID NO: 312340 - DNA, 19 bp, Homo sapiens
acatgtgtcaagctgcttg

SEQ ID NO: 312341 - DNA, 20 bp, Homo sapiens
acatgtgtcaagctgcttgg

SEQ ID NO: 312342 - DNA, 16 bp, Homo sapiens
acatgttactgaccag

SEQ ID NO: 312343 - DNA, 19 bp, Homo sapiens
acatgttactgaccagcaa

SEQ ID NO: 312344 - DNA, 21 bp, Homo sapiens
acatgttatcaaatctgggta

SEQ ID NO: 312345 - DNA, 12 bp, Homo sapiens
acattaaaagaa

SEQ ID NO: 312346 - DNA, 19 bp, Homo sapiens
acattaaaagaagactgga

SEQ ID NO: 312347 - DNA, 21 bp, Homo sapiens
aatccgaccactaattgccaa

SEQ ID NO: 312348 - DNA, 16 bp, Homo sapiens
aatcctaacacattat

SEQ ID NO: 312349 - DNA, 18 bp, Homo sapiens
aatcctaccaacctctga

SEQ ID NO: 312350 - DNA, 14 bp, Homo sapiens
aatcctaccttttg

SEQ ID NO: 312351 - DNA, 17 bp, Homo sapiens
aatcctaccttttgata

SEQ ID NO: 312352 - DNA, 23 bp, Homo sapiens
aatcctaccttttgataaaatgt

SEQ ID NO: 312353 - DNA, 16 bp, Homo sapiens
aatcctagctgtgtgc

SEQ ID NO: 312354 - DNA, 15 bp, Homo sapiens
aatcctcactgggtg

SEQ ID NO: 312355 - DNA, 12 bp, Homo sapiens
aatcctccccac

SEQ ID NO: 312356 - DNA, 12 bp, Homo sapiens
aatcctgcctct

SEQ ID NO: 312357 - DNA, 13 bp, Homo sapiens
aatcctgcctctc

SEQ ID NO: 312358 - DNA, 19 bp, Homo sapiens
aatcctggccctctgtgtt

SEQ ID NO: 312359 - DNA, 16 bp, Homo sapiens
aatcctgtaggcacaa

SEQ ID NO: 312360 - DNA, 20 bp, Homo sapiens
aatcctgtcaatgtttgctt

SEQ ID NO: 312361 - DNA, 15 bp, Homo sapiens
aatcctgtcctcagc

SEQ ID NO: 312362 - DNA, 16 bp, Homo sapiens
aatcctgttacttaaa

SEQ ID NO: 312363 - DNA, 12 bp, Homo sapiens
aatccttccaaa

SEQ ID NO: 312364 - DNA, 16 bp, Homo sapiens
aatccttgccttcaaa

SEQ ID NO: 312365 - DNA, 16 bp, Homo sapiens
aatcctttctgcccac

SEQ ID NO: 312366 - DNA, 18 bp, Homo sapiens
aatcgaggaaccagagcc

SEQ ID NO: 312367 - DNA, 13 bp, Homo sapiens
aatcgattggctt

SEQ ID NO: 312368 - DNA, 16 bp, Homo sapiens
aatcgccttatgagaa

SEQ ID NO: 312369 - DNA, 17 bp, Homo sapiens
aatcgcttgaacctggg

SEQ ID NO: 312370 - DNA, 21 bp, Homo sapiens
aatcggatctggggctctggg

SEQ ID NO: 312371 - DNA, 22 bp, Homo sapiens
aatcggatctggggctctggga

SEQ ID NO: 312372 - DNA, 23 bp, Homo sapiens
aatcggatctggggctctgggat

SEQ ID NO: 312373 - DNA, 23 bp, Homo sapiens
aatcgggtccagagaccacacca

SEQ ID NO: 312374 - DNA, 15 bp, Homo sapiens
aatcggttgacccta

SEQ ID NO: 312375 - DNA, 20 bp, Homo sapiens
aatctaaaacaaaatctgaa

SEQ ID NO: 312376 - DNA, 23 bp, Homo sapiens
aatctaaaacaaaatctgaactc

SEQ ID NO: 312377 - DNA, 18 bp, Homo sapiens
aatctaaatagatacttt

SEQ ID NO: 312378 - DNA, 23 bp, Homo sapiens
aatctaaatagatacttttgata

SEQ ID NO: 312379 - DNA, 16 bp, Homo sapiens
aatctaatattaaaaa

SEQ ID NO: 312380 - DNA, 19 bp, Homo sapiens
aatctaatattaaaaatat

SEQ ID NO: 312381 - DNA, 12 bp, Homo sapiens
aatctaatctct

SEQ ID NO: 312382 - DNA, 20 bp, Homo sapiens
aatctactcttaaatataca

SEQ ID NO: 312383 - DNA, 12 bp, Homo sapiens
aatctagacata

SEQ ID NO: 312384 - DNA, 15 bp, Homo sapiens
aatctagagctatgc

SEQ ID NO: 312385 - DNA, 21 bp, Homo sapiens
aatctaggcgaggcgaagctg

SEQ ID NO: 312386 - DNA, 15 bp, Homo sapiens
aatctagtttacaga

SEQ ID NO: 312387 - DNA, 23 bp, Homo sapiens
aatctagttttttttgtaaactg

SEQ ID NO: 312388 - DNA, 12 bp, Homo sapiens
aatctatagtat

SEQ ID NO: 312389 - DNA, 19 bp, Homo sapiens
aatctattcagacaagcaa

SEQ ID NO: 312390 - DNA, 16 bp, Homo sapiens
aatctattgggttcat

SEQ ID NO: 312391 - DNA, 17 bp, Homo sapiens
aatctattgggttcatt

SEQ ID NO: 312392 - DNA, 13 bp, Homo sapiens
aatctattgtttc

SEQ ID NO: 312393 - DNA, 17 bp, Homo sapiens
aatctattgtttctcct

SEQ ID NO: 312394 - DNA, 16 bp, Homo sapiens
aatctatttattggac

SEQ ID NO: 312395 - DNA, 15 bp, Homo sapiens
aatctcaagattcta

SEQ ID NO: 312396 - DNA, 13 bp, Homo sapiens
aatctcacacagc

SEQ ID NO: 312397 - DNA, 21 bp, Homo sapiens
aatctcccagacttgtttcct

SEQ ID NO: 312398 - DNA, 17 bp, Homo sapiens
aatctcccgctgctgct

SEQ ID NO: 312399 - DNA, 15 bp, Homo sapiens
aatctcctcttttat

SEQ ID NO: 312400 - DNA, 18 bp, Homo sapiens
aatctcctcttttatctt

SEQ ID NO: 312401 - DNA, 18 bp, Homo sapiens
aatctctaaaattctagt

SEQ ID NO: 312402 - DNA, 18 bp, Homo sapiens
aatctctaaatcaagtat

SEQ ID NO: 312403 - DNA, 18 bp, Homo sapiens
aatctctcaaaatgtgcc

SEQ ID NO: 312404 - DNA, 18 bp, Homo sapiens
aatctctctctgttgtgt

SEQ ID NO: 312405 - DNA, 12 bp, Homo sapiens
aatctctgatta

SEQ ID NO: 312406 - DNA, 15 bp, Homo sapiens
aatctcttattctaa

SEQ ID NO: 312407 - DNA, 18 bp, Homo sapiens
aatctgaaacacagtcat

SEQ ID NO: 312408 - DNA, 14 bp, Homo sapiens
aatctgaactctca

SEQ ID NO: 312409 - DNA, 20 bp, Homo sapiens
aatctgagggcactctctgc

SEQ ID NO: 312410 - DNA, 19 bp, Homo sapiens
aatctgatcccataaagaa

SEQ ID NO: 312411 - DNA, 11 bp, Homo sapiens
aatctgccttc

SEQ ID NO: 312412 - DNA, 11 bp, Homo sapiens
aatctgctgtt

SEQ ID NO: 312413 - DNA, 14 bp, Homo sapiens
aatctgctttgtta

SEQ ID NO: 312414 - DNA, 16 bp, Homo sapiens
aatctgctttgttaat

SEQ ID NO: 312415 - DNA, 21 bp, Homo sapiens
aatctggaaggcccctcccag

SEQ ID NO: 312416 - DNA, 20 bp, Homo sapiens
aatctggactcctctgtcca

SEQ ID NO: 312417 - DNA, 23 bp, Homo sapiens
aatctggacttatttttggactt

SEQ ID NO: 312418 - DNA, 14 bp, Homo sapiens
aatctggctcctgt

SEQ ID NO: 312419 - DNA, 17 bp, Homo sapiens
aatctggcttctgcatt

SEQ ID NO: 312420 - DNA, 16 bp, Homo sapiens
aatctgggaagggaag

SEQ ID NO: 312421 - DNA, 20 bp, Homo sapiens
aatctgggtggtaactgcca

SEQ ID NO: 312422 - DNA, 22 bp, Homo sapiens
aatctgggtggtaactgccagc

SEQ ID NO: 312423 - DNA, 15 bp, Homo sapiens
aatctggttgtgatt

SEQ ID NO: 312424 - DNA, 18 bp, Homo sapiens
aatctgtaagctctttga

SEQ ID NO: 312425 - DNA, 11 bp, Homo sapiens
aatctgtaatt

SEQ ID NO: 312426 - DNA, 15 bp, Homo sapiens
aatctgtagaggagc

SEQ ID NO: 312427 - DNA, 19 bp, Homo sapiens
aatctgtagaggagcctgg

SEQ ID NO: 312428 - DNA, 19 bp, Homo sapiens
aatctgtagggctggacct

SEQ ID NO: 312429 - DNA, 23 bp, Homo sapiens
aatctgtatatgttgtaataaaa

SEQ ID NO: 312430 - DNA, 20 bp, Homo sapiens
aatctgtccaaaggaggctg

SEQ ID NO: 312431 - DNA, 21 bp, Homo sapiens
aatctgtccaaaggaggctgg

SEQ ID NO: 312432 - DNA, 22 bp, Homo sapiens
aatctgtctagaatcctgcttt

SEQ ID NO: 312433 - DNA, 14 bp, Homo sapiens
aatctgtctgattc

SEQ ID NO: 312434 - DNA, 18 bp, Homo sapiens
aatctgtctgattctatg

SEQ ID NO: 312435 - DNA, 16 bp, Homo sapiens
aatctgtgaattaaaa

SEQ ID NO: 312436 - DNA, 17 bp, Homo sapiens
aatcttaccagatgcta

SEQ ID NO: 312437 - DNA, 12 bp, Homo sapiens
aatcttcagctg

SEQ ID NO: 312438 - DNA, 20 bp, Homo sapiens
aatcttcagctggtggatgg

SEQ ID NO: 312439 - DNA, 20 bp, Homo sapiens
aatcttcagttttatcttta

SEQ ID NO: 312440 - DNA, 17 bp, Homo sapiens
aatcttcctctggagct

SEQ ID NO: 312441 - DNA, 14 bp, Homo sapiens
aatcttgaatttct

SEQ ID NO: 312442 - DNA, 16 bp, Homo sapiens
aatcttgctgtgaaac

SEQ ID NO: 312443 - DNA, 15 bp, Homo sapiens
aatcttgctttcttt

SEQ ID NO: 312444 - DNA, 16 bp, Homo sapiens
aatcttgtcatgtgta

SEQ ID NO: 312445 - DNA, 17 bp, Homo sapiens
aatcttgtcatgtgtat

SEQ ID NO: 312446 - DNA, 19 bp, Homo sapiens
aatcttgtcatgtgtataa

SEQ ID NO: 312447 - DNA, 14 bp, Homo sapiens
aatcttgtgctaga

SEQ ID NO: 312448 - DNA, 19 bp, Homo sapiens
aatcttgtgctagaatact

SEQ ID NO: 312449 - DNA, 22 bp, Homo sapiens
aatcttgtgctagaatactttt

SEQ ID NO: 312450 - DNA, 19 bp, Homo sapiens
aatctttattttattattc

SEQ ID NO: 312451 - DNA, 14 bp, Homo sapiens
aatctttcagaata

SEQ ID NO: 312452 - DNA, 16 bp, Homo sapiens
aatctttctatataaa

SEQ ID NO: 312453 - DNA, 17 bp, Homo sapiens
aatctttctttacctga

SEQ ID NO: 312454 - DNA, 15 bp, Homo sapiens
aatcttttgtagttt

SEQ ID NO: 312455 - DNA, 18 bp, Homo sapiens
aatctttttaaaaatgat

SEQ ID NO: 312456 - DNA, 17 bp, Homo sapiens
aatgaaaaatttaagca

SEQ ID NO: 312457 - DNA, 18 bp, Homo sapiens
aatgaaaaatttaagcat

SEQ ID NO: 312458 - DNA, 22 bp, Homo sapiens
aatgaaaaatttaagcattgtt

SEQ ID NO: 312459 - DNA, 14 bp, Homo sapiens
aatgaaaagagaat

SEQ ID NO: 312460 - DNA, 23 bp, Homo sapiens
aatgaaaatgtcagaaaccagtt

SEQ ID NO: 312461 - DNA, 15 bp, Homo sapiens
aatgaaaccttcctc

SEQ ID NO: 312462 - DNA, 22 bp, Homo sapiens
aatgaaatacttgacaacattt

SEQ ID NO: 312463 - DNA, 12 bp, Homo sapiens
aatgaaatataa

SEQ ID NO: 312464 - DNA, 21 bp, Homo sapiens
aatgaaatataaactgtgaga

SEQ ID NO: 312465 - DNA, 17 bp, Homo sapiens
aatgaacacatggcaga

SEQ ID NO: 312466 - DNA, 21 bp, Homo sapiens
aatgaactgtgacaggaagcc

SEQ ID NO: 312467 - DNA, 21 bp, Homo sapiens
aatgaagataccatcagcaaa

SEQ ID NO: 312468 - DNA, 22 bp, Homo sapiens
aatgaagattattttttatgag

SEQ ID NO: 312469 - DNA, 15 bp, Homo sapiens
aatgaagcaaacaca

SEQ ID NO: 312470 - DNA, 17 bp, Homo sapiens
aatgaagcaaacacaca

SEQ ID NO: 312471 - DNA, 13 bp, Homo sapiens
aatgaagcatgta

SEQ ID NO: 312472 - DNA, 18 bp, Homo sapiens
aatgaagggtcatttctc

SEQ ID NO: 312473 - DNA, 17 bp, Homo sapiens
aatgaaggtgtgctaca

SEQ ID NO: 312474 - DNA, 16 bp, Homo sapiens
aatgaataatttccca

SEQ ID NO: 312475 - DNA, 14 bp, Homo sapiens
aatgaatgaaacat

SEQ ID NO: 312476 - DNA, 15 bp, Homo sapiens
aatgaatgaaatata

SEQ ID NO: 312477 - DNA, 22 bp, Homo sapiens
aatgaatgaaatataaactgtg

SEQ ID NO: 312478 - DNA, 21 bp, Homo sapiens
aatgaatgtcagtgtgactga

SEQ ID NO: 312479 - DNA, 22 bp, Homo sapiens
aatgaatgtcagtgtgactgat

SEQ ID NO: 312480 - DNA, 21 bp, Homo sapiens
aatgaattctctctaaaaata

SEQ ID NO: 312481 - DNA, 23 bp, Homo sapiens
aaggtgcacattttccacggaaa

SEQ ID NO: 312482 - DNA, 20 bp, Homo sapiens
aaggtgctgttgtcattgct

SEQ ID NO: 312483 - DNA, 19 bp, Homo sapiens
aaggtgcttgggcttctgc

SEQ ID NO: 312484 - DNA, 22 bp, Homo sapiens
aaggtgcttgggcttctgcggt

SEQ ID NO: 312485 - DNA, 21 bp, Homo sapiens
aaggtggattttaaaaattgg

SEQ ID NO: 312486 - DNA, 24 bp, Homo sapiens
aaggtgggtccaggaaggcagctg

SEQ ID NO: 312487 - DNA, 15 bp, Homo sapiens
aaggttaacagtaaa

SEQ ID NO: 312488 - DNA, 14 bp, Homo sapiens
aaggttaagccata

SEQ ID NO: 312489 - DNA, 18 bp, Homo sapiens
aaggttaggatttaacag

SEQ ID NO: 312490 - DNA, 14 bp, Homo sapiens
aaggttgctgttgt

SEQ ID NO: 312491 - DNA, 15 bp, Homo sapiens
aaggttgtacatagt

SEQ ID NO: 312492 - DNA, 12 bp, Homo sapiens
aagtaaaaagaa

SEQ ID NO: 312493 - DNA, 22 bp, Homo sapiens
aagtaaaacagatttgttcatt

SEQ ID NO: 312494 - DNA, 19 bp, Homo sapiens
aagtaaatgctacctctga

SEQ ID NO: 312495 - DNA, 18 bp, Homo sapiens
aagtaaatgtctgtggcc

SEQ ID NO: 312496 - DNA, 19 bp, Homo sapiens
aagtaacctctacaggcat

SEQ ID NO: 312497 - DNA, 20 bp, Homo sapiens
aagtaacctctacaggcatt

SEQ ID NO: 312498 - DNA, 19 bp, Homo sapiens
aagtaacctgggcttaagt

SEQ ID NO: 312499 - DNA, 18 bp, Homo sapiens
aagtaagaaagtgaagca

SEQ ID NO: 312500 - DNA, 14 bp, Homo sapiens
aagtaagaagacat

SEQ ID NO: 312501 - DNA, 21 bp, Homo sapiens
aagtaagagctaagttctaag

SEQ ID NO: 312502 - DNA, 18 bp, Homo sapiens
aagtaaggtgcagttccc

SEQ ID NO: 312503 - DNA, 17 bp, Homo sapiens
aagtaagtttatccaaa

SEQ ID NO: 312504 - DNA, 16 bp, Homo sapiens
aagtaatgaattttat

SEQ ID NO: 312505 - DNA, 21 bp, Homo sapiens
aagtaatgaatttttatgata

SEQ ID NO: 312506 - DNA, 11 bp, Homo sapiens
aagtaattatc

SEQ ID NO: 312507 - DNA, 13 bp, Homo sapiens
aagtaattatcgg

SEQ ID NO: 312508 - DNA, 23 bp, Homo sapiens
aagtaattatcgggaacagtgtt

SEQ ID NO: 312509 - DNA, 16 bp, Homo sapiens
aagtaattgtgaaaaa

SEQ ID NO: 312510 - DNA, 17 bp, Homo sapiens
aagtacagaacatatcc

SEQ ID NO: 312511 - DNA, 12 bp, Homo sapiens
aagtacatttaa

SEQ ID NO: 312512 - DNA, 12 bp, Homo sapiens
aagtacctgtag

SEQ ID NO: 312513 - DNA, 13 bp, Homo sapiens
aagtacgtgttta

SEQ ID NO: 312514 - DNA, 17 bp, Homo sapiens
aagtactataatttacc

SEQ ID NO: 312515 - DNA, 15 bp, Homo sapiens
aagtactggagaaaa

SEQ ID NO: 312516 - DNA, 14 bp, Homo sapiens
aagtacttttaacg

SEQ ID NO: 312517 - DNA, 21 bp, Homo sapiens
aagtaggagacacagatggca

SEQ ID NO: 312518 - DNA, 15 bp, Homo sapiens
aagtataaatttgtg

SEQ ID NO: 312519 - DNA, 12 bp, Homo sapiens
aagtataacaaa

SEQ ID NO: 312520 - DNA, 14 bp, Homo sapiens
aagtatataaagtt

SEQ ID NO: 312521 - DNA, 11 bp, Homo sapiens
aagtatatata

SEQ ID NO: 312522 - DNA, 12 bp, Homo sapiens
aagtatcagaaa

SEQ ID NO: 312523 - DNA, 14 bp, Homo sapiens
aagtatcatgcatt

SEQ ID NO: 312524 - DNA, 13 bp, Homo sapiens
aagtatccaatta

SEQ ID NO: 312525 - DNA, 18 bp, Homo sapiens
aagtatccaattatgtga

SEQ ID NO: 312526 - DNA, 21 bp, Homo sapiens
aagtatccaattatgtgacaa

SEQ ID NO: 312527 - DNA, 18 bp, Homo sapiens
aagtatcctgcttctgat

SEQ ID NO: 312528 - DNA, 15 bp, Homo sapiens
aagtatctgtacctg

SEQ ID NO: 312529 - DNA, 19 bp, Homo sapiens
aagtatcttcgttcttgtt

SEQ ID NO: 312530 - DNA, 18 bp, Homo sapiens
aagtatggcagtgggaga

SEQ ID NO: 312531 - DNA, 22 bp, Homo sapiens
aagtatgtaaagtatgtaaaca

SEQ ID NO: 312532 - DNA, 19 bp, Homo sapiens
aagtatgtgtaaaatgtga

SEQ ID NO: 312533 - DNA, 16 bp, Homo sapiens
aagtatgttttagcat

SEQ ID NO: 312534 - DNA, 20 bp, Homo sapiens
aagtattaggggtaatatat

SEQ ID NO: 312535 - DNA, 20 bp, Homo sapiens
aagtattccaccttaaatta

SEQ ID NO: 312536 - DNA, 20 bp, Homo sapiens
aagtattccttggcccagca

SEQ ID NO: 312537 - DNA, 22 bp, Homo sapiens
aagtattccttggcccagcagc

SEQ ID NO: 312538 - DNA, 12 bp, Homo sapiens
aagtatttatat

SEQ ID NO: 312539 - DNA, 21 bp, Homo sapiens
aagtatttatatatttataac

SEQ ID NO: 312540 - DNA, 22 bp, Homo sapiens
aagtatttatatatttataact

SEQ ID NO: 312541 - DNA, 23 bp, Homo sapiens
aagtatttatatatttataactc

SEQ ID NO: 312542 - DNA, 18 bp, Homo sapiens
aagtcaaacagtgtggct

SEQ ID NO: 312543 - DNA, 13 bp, Homo sapiens
aagtcaaactact

SEQ ID NO: 312544 - DNA, 13 bp, Homo sapiens
aagtcacagctgc

SEQ ID NO: 312545 - DNA, 14 bp, Homo sapiens
aagtcacagctgca

SEQ ID NO: 312546 - DNA, 22 bp, Homo sapiens
aagtcactgcacagtgcatctc

SEQ ID NO: 312547 - DNA, 19 bp, Homo sapiens
aagtcagctttgccttcca

SEQ ID NO: 312548 - DNA, 18 bp, Homo sapiens
aagtcaggagccagcagg

SEQ ID NO: 312549 - DNA, 17 bp, Homo sapiens
aagtcagttggagaaaa

SEQ ID NO: 312550 - DNA, 18 bp, Homo sapiens
aagtcattttaactttat

SEQ ID NO: 312551 - DNA, 22 bp, Homo sapiens
aagtccaccccaattaactgaa

SEQ ID NO: 312552 - DNA, 21 bp, Homo sapiens
aagtccaggtcgggctcagct

SEQ ID NO: 312553 - DNA, 23 bp, Homo sapiens
aagtccagtgtttccacggctgg

SEQ ID NO: 312554 - DNA, 20 bp, Homo sapiens
aagtcccaccggttgcttct

SEQ ID NO: 312555 - DNA, 23 bp, Homo sapiens
aagtcccaccggttgcttctggg

SEQ ID NO: 312556 - DNA, 17 bp, Homo sapiens
aagtcccatctcacctc

SEQ ID NO: 312557 - DNA, 14 bp, Homo sapiens
aagtcccgaggcag

SEQ ID NO: 312558 - DNA, 15 bp, Homo sapiens
aagtcctaaagtgaa

SEQ ID NO: 312559 - DNA, 17 bp, Homo sapiens
aagtcctacaagctaaa

SEQ ID NO: 312560 - DNA, 19 bp, Homo sapiens
aagtcctccctctctactg

SEQ ID NO: 312561 - DNA, 19 bp, Homo sapiens
aagtcctgccaagtggttt

SEQ ID NO: 312562 - DNA, 13 bp, Homo sapiens
aagtcctgccttt

SEQ ID NO: 312563 - DNA, 14 bp, Homo sapiens
aagtcctgcctttg

SEQ ID NO: 312564 - DNA, 19 bp, Homo sapiens
aagtcctggctacatccca

SEQ ID NO: 312565 - DNA, 23 bp, Homo sapiens
aagtcctggctacatcccagcct

SEQ ID NO: 312566 - DNA, 18 bp, Homo sapiens
aagtccttacctcttccg

SEQ ID NO: 312567 - DNA, 20 bp, Homo sapiens
aagtccttcagtgagcccct

SEQ ID NO: 312568 - DNA, 15 bp, Homo sapiens
aagtcgaattaatag

SEQ ID NO: 312569 - DNA, 23 bp, Homo sapiens
aagtcgggaaattctgctgcttg

SEQ ID NO: 312570 - DNA, 21 bp, Homo sapiens
aagtctaaagtttacagtaaa

SEQ ID NO: 312571 - DNA, 17 bp, Homo sapiens
aagtctaaatatttcct

SEQ ID NO: 312572 - DNA, 21 bp, Homo sapiens
aagtctcactggctgtcagta

SEQ ID NO: 312573 - DNA, 20 bp, Homo sapiens
aagtctcgtgagaatatact

SEQ ID NO: 312574 - DNA, 14 bp, Homo sapiens
aagtctctctgtga

SEQ ID NO: 312575 - DNA, 17 bp, Homo sapiens
aagtctctctgtgaata

SEQ ID NO: 312576 - DNA, 20 bp, Homo sapiens
aagtctctctgtgaatacaa

SEQ ID NO: 312577 - DNA, 23 bp, Homo sapiens
aagtctctctgtgaatacaatta

SEQ ID NO: 312578 - DNA, 16 bp, Homo sapiens
aagtctctgctggccc

SEQ ID NO: 312579 - DNA, 18 bp, Homo sapiens
aagtctctttttcttcct

SEQ ID NO: 312580 - DNA, 17 bp, Homo sapiens
aagtctgcttaccaaaa

SEQ ID NO: 312581 - DNA, 19 bp, Homo sapiens
aagtctgcttaccaaaaca

SEQ ID NO: 312582 - DNA, 20 bp, Homo sapiens
aagtctgggatgtagaactt

SEQ ID NO: 312583 - DNA, 16 bp, Homo sapiens
aagtcttaacaacagc

SEQ ID NO: 312584 - DNA, 17 bp, Homo sapiens
aagtcttaacaacagct

SEQ ID NO: 312585 - DNA, 17 bp, Homo sapiens
aagtcttacaggaagcc

SEQ ID NO: 312586 - DNA, 12 bp, Homo sapiens
aagtcttcaggg

SEQ ID NO: 312587 - DNA, 22 bp, Homo sapiens
aagtcttccatcagcagtgatt

SEQ ID NO: 312588 - DNA, 17 bp, Homo sapiens
aagtctttgccttctct

SEQ ID NO: 312589 - DNA, 12 bp, Homo sapiens
aagtgaaaaaga

SEQ ID NO: 312590 - DNA, 14 bp, Homo sapiens
aagtgaaattaggc

SEQ ID NO: 312591 - DNA, 19 bp, Homo sapiens
aagtgaacacattgtgtca

SEQ ID NO: 312592 - DNA, 15 bp, Homo sapiens
aagtgaagaagccat

SEQ ID NO: 312593 - DNA, 14 bp, Homo sapiens
aagtgaataaaaat

SEQ ID NO: 312594 - DNA, 16 bp, Homo sapiens
aagtgaatgggaaagg

SEQ ID NO: 312595 - DNA, 14 bp, Homo sapiens
aagtgaatttgaat

SEQ ID NO: 312596 - DNA, 16 bp, Homo sapiens
aagtgaatttgaatga

SEQ ID NO: 312597 - DNA, 19 bp, Homo sapiens
aagtgaatttgaatgaaaa

SEQ ID NO: 312598 - DNA, 23 bp, Homo sapiens
aagtgaatttgaatgaaaaattt

SEQ ID NO: 312599 - DNA, 22 bp, Homo sapiens
aagtgacaagatgctctggtca

SEQ ID NO: 312600 - DNA, 20 bp, Homo sapiens
aagtgacaaggccccagaga

SEQ ID NO: 312601 - DNA, 24 bp, Homo sapiens
aagtgacacagcagcttcaccaga

SEQ ID NO: 312602 - DNA, 22 bp, Homo sapiens
aagtgactaccagaaagtgagg

SEQ ID NO: 312603 - DNA, 15 bp, Homo sapiens
aagtgactctcagcg

SEQ ID NO: 312604 - DNA, 12 bp, Homo sapiens
aagtgactgttt

SEQ ID NO: 312605 - DNA, 20 bp, Homo sapiens
aagtgacttgaatgtacaaa

SEQ ID NO: 312606 - DNA, 22 bp, Homo sapiens
aagtgacttgaatgtacaaaga

SEQ ID NO: 312607 - DNA, 23 bp, Homo sapiens
aagtgacttgaatgtacaaagat

SEQ ID NO: 312608 - DNA, 12 bp, Homo sapiens
aagtgagagagg

SEQ ID NO: 312609 - DNA, 19 bp, Homo sapiens
aagtgagcaaacctgcccc

SEQ ID NO: 312610 - DNA, 15 bp, Homo sapiens
aaggaaataacattg

SEQ ID NO: 312611 - DNA, 20 bp, Homo sapiens
aaggaaatctcctcttttgt

SEQ ID NO: 312612 - DNA, 18 bp, Homo sapiens
aaggaacacccggaaaga

SEQ ID NO: 312613 - DNA, 21 bp, Homo sapiens
aaggaacacgtgggtgagcgt

SEQ ID NO: 312614 - DNA, 21 bp, Homo sapiens
aaggaacccggtcccaggccg

SEQ ID NO: 312615 - DNA, 22 bp, Homo sapiens
aaggaacccggtcccaggccgc

SEQ ID NO: 312616 - DNA, 12 bp, Homo sapiens
aaggaagaaaaa

SEQ ID NO: 312617 - DNA, 22 bp, Homo sapiens
aaggaagatcactttgctctga

SEQ ID NO: 312618 - DNA, 21 bp, Homo sapiens
aaggaataaattgctccttga

SEQ ID NO: 312619 - DNA, 17 bp, Homo sapiens
aaggaatagccagagag

SEQ ID NO: 312620 - DNA, 21 bp, Homo sapiens
aaggaatataccacaccgagg

SEQ ID NO: 312621 - DNA, 17 bp, Homo sapiens
aaggaatctggcattct

SEQ ID NO: 312622 - DNA, 19 bp, Homo sapiens
aaggaatgcctgtgccaat

SEQ ID NO: 312623 - DNA, 21 bp, Homo sapiens
aaggaatgtagctggtttcct

SEQ ID NO: 312624 - DNA, 16 bp, Homo sapiens
aaggaattaaactaaa

SEQ ID NO: 312625 - DNA, 20 bp, Homo sapiens
aaggaattgacttcagcagg

SEQ ID NO: 312626 - DNA, 22 bp, Homo sapiens
aaggaattgacttcagcagggg

SEQ ID NO: 312627 - DNA, 17 bp, Homo sapiens
aaggacaaaaatgaact

SEQ ID NO: 312628 - DNA, 12 bp, Homo sapiens
aaggacaaacag

SEQ ID NO: 312629 - DNA, 16 bp, Homo sapiens
aaggaccagtgagaca

SEQ ID NO: 312630 - DNA, 18 bp, Homo sapiens
aaggaccagtttcttgaa

SEQ ID NO: 312631 - DNA, 18 bp, Homo sapiens
aaggacccggaggggcct

SEQ ID NO: 312632 - DNA, 21 bp, Homo sapiens
aaggacccggaggggcctggc

SEQ ID NO: 312633 - DNA, 22 bp, Homo sapiens
aaggacccggaggggcctggca

SEQ ID NO: 312634 - DNA, 16 bp, Homo sapiens
aaggaccgtttttact

SEQ ID NO: 312635 - DNA, 17 bp, Homo sapiens
aaggactaacataaaat

SEQ ID NO: 312636 - DNA, 18 bp, Homo sapiens
aaggactggattggccaa

SEQ ID NO: 312637 - DNA, 23 bp, Homo sapiens
aaggactgttttttcctgagctt

SEQ ID NO: 312638 - DNA, 12 bp, Homo sapiens
aaggacttgaaa

SEQ ID NO: 312639 - DNA, 18 bp, Homo sapiens
aaggagacaaagcaggag

SEQ ID NO: 312640 - DNA, 11 bp, Homo sapiens
aaggagaggag

SEQ ID NO: 312641 - DNA, 13 bp, Homo sapiens
aaggagaggagtg

SEQ ID NO: 312642 - DNA, 15 bp, Homo sapiens
aaggagatataaaat

SEQ ID NO: 312643 - DNA, 16 bp, Homo sapiens
aaggagatataaaatc

SEQ ID NO: 312644 - DNA, 20 bp, Homo sapiens
aaggagatgtaatgacagag

SEQ ID NO: 312645 - DNA, 12 bp, Homo sapiens
aaggagcctgcg

SEQ ID NO: 312646 - DNA, 19 bp, Homo sapiens
aaggagcctgcggctgctg

SEQ ID NO: 312647 - DNA, 15 bp, Homo sapiens
aaggagcgggcaggg

SEQ ID NO: 312648 - DNA, 12 bp, Homo sapiens
aaggaggagaaa

SEQ ID NO: 312649 - DNA, 14 bp, Homo sapiens
aaggaggctggcag

SEQ ID NO: 312650 - DNA, 21 bp, Homo sapiens
aaggagggcctcagagacagc

SEQ ID NO: 312651 - DNA, 23 bp, Homo sapiens
aaggagtgcatggccacagccac

SEQ ID NO: 312652 - DNA, 13 bp, Homo sapiens
aaggatagccttt

SEQ ID NO: 312653 - DNA, 17 bp, Homo sapiens
aaggatagcctttgtag

SEQ ID NO: 312654 - DNA, 13 bp, Homo sapiens
aaggataggaaaa

SEQ ID NO: 312655 - DNA, 20 bp, Homo sapiens
aaggatagtgcgatgtttca

SEQ ID NO: 312656 - DNA, 14 bp, Homo sapiens
aaggatgaaagaca

SEQ ID NO: 312657 - DNA, 16 bp, Homo sapiens
aaggatgaaagacaaa

SEQ ID NO: 312658 - DNA, 21 bp, Homo sapiens
aaggatgttctggctttacat

SEQ ID NO: 312659 - DNA, 22 bp, Homo sapiens
aaggattgcctttgtagttaat

SEQ ID NO: 312660 - DNA, 16 bp, Homo sapiens
aaggatttgaaaacac

SEQ ID NO: 312661 - DNA, 17 bp, Homo sapiens
aaggattttggaaaaga

SEQ ID NO: 312662 - DNA, 20 bp, Homo sapiens
aaggcaaagcacgaaatgtt

SEQ ID NO: 312663 - DNA, 20 bp, Homo sapiens
aaggcaaatctcctttgtcc

SEQ ID NO: 312664 - DNA, 17 bp, Homo sapiens
aaggcaaatgtccaagc

SEQ ID NO: 312665 - DNA, 21 bp, Homo sapiens
aaggcaactgaacaaaaaaat

SEQ ID NO: 312666 - DNA, 23 bp, Homo sapiens
aaggcaagattggaaagacagga

SEQ ID NO: 312667 - DNA, 20 bp, Homo sapiens
aaggcaagtttctagctaga

SEQ ID NO: 312668 - DNA, 14 bp, Homo sapiens
aaggcagaaaggag

SEQ ID NO: 312669 - DNA, 15 bp, Homo sapiens
aaggcagagaaaaca

SEQ ID NO: 312670 - DNA, 13 bp, Homo sapiens
aaggcagcaggcg

SEQ ID NO: 312671 - DNA, 15 bp, Homo sapiens
aaggcagctcacccc

SEQ ID NO: 312672 - DNA, 15 bp, Homo sapiens
aaggcagctctgtcg

SEQ ID NO: 312673 - DNA, 14 bp, Homo sapiens
aaggcagctgctct

SEQ ID NO: 312674 - DNA, 12 bp, Homo sapiens
aaggcagggcag

SEQ ID NO: 312675 - DNA, 16 bp, Homo sapiens
aaggcatcattttcac

SEQ ID NO: 312676 - DNA, 14 bp, Homo sapiens
aaggcatctaagac

SEQ ID NO: 312677 - DNA, 16 bp, Homo sapiens
aaggcatgctcccagc

SEQ ID NO: 312678 - DNA, 20 bp, Homo sapiens
aaggcatgctcccagcattt

SEQ ID NO: 312679 - DNA, 14 bp, Homo sapiens
aaggccaaggcctc

SEQ ID NO: 312680 - DNA, 15 bp, Homo sapiens
aaggccaaggcctca

SEQ ID NO: 312681 - DNA, 18 bp, Homo sapiens
aaggccacaggccactgc

SEQ ID NO: 312682 - DNA, 18 bp, Homo sapiens
aaggccaggggcttttgc

SEQ ID NO: 312683 - DNA, 15 bp, Homo sapiens
aaggcccaagagcag

SEQ ID NO: 312684 - DNA, 15 bp, Homo sapiens
aaggcccacaggagg

SEQ ID NO: 312685 - DNA, 20 bp, Homo sapiens
aaggcccccaaacatagccc

SEQ ID NO: 312686 - DNA, 23 bp, Homo sapiens
aaggcccccaaacatagcccctg

SEQ ID NO: 312687 - DNA, 13 bp, Homo sapiens
aaggccgcccacc

SEQ ID NO: 312688 - DNA, 14 bp, Homo sapiens
aaggccgttaggga

SEQ ID NO: 312689 - DNA, 15 bp, Homo sapiens
aaggcctcggcagaa

SEQ ID NO: 312690 - DNA, 16 bp, Homo sapiens
aaggcctcggcagaac

SEQ ID NO: 312691 - DNA, 16 bp, Homo sapiens
aaggcctcttccttgc

SEQ ID NO: 312692 - DNA, 14 bp, Homo sapiens
aaggcctcttgctg

SEQ ID NO: 312693 - DNA, 19 bp, Homo sapiens
aaggcctcttgctggtgca

SEQ ID NO: 312694 - DNA, 22 bp, Homo sapiens
aaggcctgagggaagcccaccc

SEQ ID NO: 312695 - DNA, 19 bp, Homo sapiens
aaggcctgccccccttccc

SEQ ID NO: 312696 - DNA, 13 bp, Homo sapiens
aaggcctgccctc

SEQ ID NO: 312697 - DNA, 16 bp, Homo sapiens
aaggcctgccctccca

SEQ ID NO: 312698 - DNA, 19 bp, Homo sapiens
aaggcctggaaccagggag

SEQ ID NO: 312699 - DNA, 23 bp, Homo sapiens
aaggcctgtccctggccatctct

SEQ ID NO: 312700 - DNA, 11 bp, Homo sapiens
aaggcctttgg

SEQ ID NO: 312701 - DNA, 15 bp, Homo sapiens
aaggcctttgggatt

SEQ ID NO: 312702 - DNA, 13 bp, Homo sapiens
aaggctctcaccc

SEQ ID NO: 312703 - DNA, 14 bp, Homo sapiens
aaggctctcccctc

SEQ ID NO: 312704 - DNA, 23 bp, Homo sapiens
aaggctctcccctctcgccccat

SEQ ID NO: 312705 - DNA, 23 bp, Homo sapiens
aaggctctgagcaaatgtggctc

SEQ ID NO: 312706 - DNA, 12 bp, Homo sapiens
aaggctgcctgg

SEQ ID NO: 312707 - DNA, 13 bp, Homo sapiens
aaggctgcctgga

SEQ ID NO: 312708 - DNA, 17 bp, Homo sapiens
aaggctgcctggagaaa

SEQ ID NO: 312709 - DNA, 22 bp, Homo sapiens
aaggctgcctggagaaaggatg

SEQ ID NO: 312710 - DNA, 22 bp, Homo sapiens
aaggctggccagcaaggcaggt

SEQ ID NO: 312711 - DNA, 16 bp, Homo sapiens
aaggctggctgagtgg

SEQ ID NO: 312712 - DNA, 22 bp, Homo sapiens
aaggcttccaatgtggtggcaa

SEQ ID NO: 312713 - DNA, 13 bp, Homo sapiens
aaggcttctccac

SEQ ID NO: 312714 - DNA, 12 bp, Homo sapiens
aaggcttgcagt

SEQ ID NO: 312715 - DNA, 16 bp, Homo sapiens
aaggctttcagggcct

SEQ ID NO: 312716 - DNA, 20 bp, Homo sapiens
aaggctttgccatgggcctg

SEQ ID NO: 312717 - DNA, 22 bp, Homo sapiens
aaggcttttggtctccctggga

SEQ ID NO: 312718 - DNA, 18 bp, Homo sapiens
aagggaaacagtcatttg

SEQ ID NO: 312719 - DNA, 17 bp, Homo sapiens
aagggaaagcgggcagc

SEQ ID NO: 312720 - DNA, 19 bp, Homo sapiens
aagggaaagcgggcagccc

SEQ ID NO: 312721 - DNA, 16 bp, Homo sapiens
aagggaaatatcattt

SEQ ID NO: 312722 - DNA, 21 bp, Homo sapiens
aagggaaccagccctccagag

SEQ ID NO: 312723 - DNA, 23 bp, Homo sapiens
aagggacatgtctttggcttcag

SEQ ID NO: 312724 - DNA, 14 bp, Homo sapiens
aagggactggtcca

SEQ ID NO: 312725 - DNA, 16 bp, Homo sapiens
aagggagcagagaagg

SEQ ID NO: 312726 - DNA, 17 bp, Homo sapiens
aagggatgaattgtaaa

SEQ ID NO: 312727 - DNA, 20 bp, Homo sapiens
aagggatggaaaaggaagac

SEQ ID NO: 312728 - DNA, 14 bp, Homo sapiens
aagggcagcccctc

SEQ ID NO: 312729 - DNA, 14 bp, Homo sapiens
aagggcagcttcag

SEQ ID NO: 312730 - DNA, 22 bp, Homo sapiens
aagggcaggcccaaattatcaa

SEQ ID NO: 312731 - DNA, 17 bp, Homo sapiens
aagggcatccttctgcc

SEQ ID NO: 312732 - DNA, 14 bp, Homo sapiens
aagggccagtctgg

SEQ ID NO: 312733 - DNA, 18 bp, Homo sapiens
aagggccagtctgggctg

SEQ ID NO: 312734 - DNA, 22 bp, Homo sapiens
aagggccgtgcccgcccacctc

SEQ ID NO: 312735 - DNA, 12 bp, Homo sapiens
aagggctccagc

SEQ ID NO: 312736 - DNA, 22 bp, Homo sapiens
aagggctccagcatccagcctg

SEQ ID NO: 312737 - DNA, 24 bp, Homo sapiens
aagggctccagcatccagcctgtg

SEQ ID NO: 312738 - DNA, 16 bp, Homo sapiens
aaggggaggcagccgg

SEQ ID NO: 312739 - DNA, 15 bp, Homo sapiens
aaggggccagctgcc

SEQ ID NO: 312740 - DNA, 18 bp, Homo sapiens
aaggggccccggggctgg

SEQ ID NO: 312741 - DNA, 21 bp, Homo sapiens
aaggggctgctggggcatgtg

SEQ ID NO: 312742 - DNA, 21 bp, Homo sapiens
aagggggatatgaatggagat

SEQ ID NO: 312743 - DNA, 16 bp, Homo sapiens
aagggggccttggaat

SEQ ID NO: 312744 - DNA, 18 bp, Homo sapiens
aagccagggttccagaca

SEQ ID NO: 312745 - DNA, 23 bp, Homo sapiens
aagccatatgacaatttcaaaat

SEQ ID NO: 312746 - DNA, 12 bp, Homo sapiens
aagccatattcc

SEQ ID NO: 312747 - DNA, 13 bp, Homo sapiens
aagccatattcca

SEQ ID NO: 312748 - DNA, 24 bp, Homo sapiens
aagccatcaattttaacatttgat

SEQ ID NO: 312749 - DNA, 15 bp, Homo sapiens
aagccatcgcgctcc

SEQ ID NO: 312750 - DNA, 23 bp, Homo sapiens
aagccatcttcccgcctcagcct

SEQ ID NO: 312751 - DNA, 10 bp, Homo sapiens
aagcccaccc

SEQ ID NO: 312752 - DNA, 13 bp, Homo sapiens
aagcccacccgcc

SEQ ID NO: 312753 - DNA, 21 bp, Homo sapiens
aagcccacccgccccagagac

SEQ ID NO: 312754 - DNA, 11 bp, Homo sapiens
aagcccacctg

SEQ ID NO: 312755 - DNA, 13 bp, Homo sapiens
aagcccacctggg

SEQ ID NO: 312756 - DNA, 17 bp, Homo sapiens
aagcccacctgggctgg

SEQ ID NO: 312757 - DNA, 18 bp, Homo sapiens
aagcccacctgggctggg

SEQ ID NO: 312758 - DNA, 12 bp, Homo sapiens
aagcccagcccg

SEQ ID NO: 312759 - DNA, 20 bp, Homo sapiens
aagcccaggagtctgagacc

SEQ ID NO: 312760 - DNA, 17 bp, Homo sapiens
aagcccagtagccattt

SEQ ID NO: 312761 - DNA, 18 bp, Homo sapiens
aagccccagggcctgggg

SEQ ID NO: 312762 - DNA, 18 bp, Homo sapiens
aagcccccaccttccctc

SEQ ID NO: 312763 - DNA, 13 bp, Homo sapiens
aagcccctcagcc

SEQ ID NO: 312764 - DNA, 15 bp, Homo sapiens
aagcccctcagccct

SEQ ID NO: 312765 - DNA, 21 bp, Homo sapiens
aagccctcgaaccaaggcagc

SEQ ID NO: 312766 - DNA, 13 bp, Homo sapiens
aagccctcttcag

SEQ ID NO: 312767 - DNA, 23 bp, Homo sapiens
aagccctgattgtgtatattcat

SEQ ID NO: 312768 - DNA, 20 bp, Homo sapiens
aagccctgtcgagacacttg

SEQ ID NO: 312769 - DNA, 23 bp, Homo sapiens
aagcccttccatgtcgcctctgc

SEQ ID NO: 312770 - DNA, 12 bp, Homo sapiens
aagccctttgcc

SEQ ID NO: 312771 - DNA, 14 bp, Homo sapiens
aagccgcaccacca

SEQ ID NO: 312772 - DNA, 12 bp, Homo sapiens
aagccggcggcc

SEQ ID NO: 312773 - DNA, 22 bp, Homo sapiens
aagccggttgcagagaatctgt

SEQ ID NO: 312774 - DNA, 19 bp, Homo sapiens
aagcctaagaaaaaggaaa

SEQ ID NO: 312775 - DNA, 22 bp, Homo sapiens
aagcctcagtccctccctcctg

SEQ ID NO: 312776 - DNA, 13 bp, Homo sapiens
aagcctccctcct

SEQ ID NO: 312777 - DNA, 14 bp, Homo sapiens
aagcctccctcctc

SEQ ID NO: 312778 - DNA, 15 bp, Homo sapiens
aagcctcctgctgag

SEQ ID NO: 312779 - DNA, 19 bp, Homo sapiens
aagcctctgccctgcctcc

SEQ ID NO: 312780 - DNA, 21 bp, Homo sapiens
aagcctctgccctgcctccct

SEQ ID NO: 312781 - DNA, 13 bp, Homo sapiens
aagcctctggaaa

SEQ ID NO: 312782 - DNA, 20 bp, Homo sapiens
aagcctgagtttgctttcaa

SEQ ID NO: 312783 - DNA, 21 bp, Homo sapiens
aagcctgcagctttctggaaa

SEQ ID NO: 312784 - DNA, 14 bp, Homo sapiens
aagcctgctgattt

SEQ ID NO: 312785 - DNA, 15 bp, Homo sapiens
aagcctgggccactg

SEQ ID NO: 312786 - DNA, 17 bp, Homo sapiens
aagcctgtctctttcca

SEQ ID NO: 312787 - DNA, 15 bp, Homo sapiens
aagataccatcagca

SEQ ID NO: 312788 - DNA, 15 bp, Homo sapiens
aagatacgactttat

SEQ ID NO: 312789 - DNA, 16 bp, Homo sapiens
aagatacttgatgcac

SEQ ID NO: 312790 - DNA, 22 bp, Homo sapiens
aagatagagattcccctggacc

SEQ ID NO: 312791 - DNA, 20 bp, Homo sapiens
aagatagcatcccatctcag

SEQ ID NO: 312792 - DNA, 18 bp, Homo sapiens
aagataggctctgcacag

SEQ ID NO: 312793 - DNA, 21 bp, Homo sapiens
aagataggggcacactacaga

SEQ ID NO: 312794 - DNA, 23 bp, Homo sapiens
aagataggtttgagttcaaattt

SEQ ID NO: 312795 - DNA, 15 bp, Homo sapiens
aagatcaaaataaaa

SEQ ID NO: 312796 - DNA, 21 bp, Homo sapiens
aagatcaaaataaaaagtgac

SEQ ID NO: 312797 - DNA, 23 bp, Homo sapiens
aagatccaaatgctgtgcaaaca

SEQ ID NO: 312798 - DNA, 14 bp, Homo sapiens
aagatcgttagtat

SEQ ID NO: 312799 - DNA, 17 bp, Homo sapiens
aagatcgttctctgcct

SEQ ID NO: 312800 - DNA, 18 bp, Homo sapiens
aagatctcagataaagtg

SEQ ID NO: 312801 - DNA, 15 bp, Homo sapiens
aagatcttaaatttt

SEQ ID NO: 312802 - DNA, 20 bp, Homo sapiens
aagatcttgagagctgctga

SEQ ID NO: 312803 - DNA, 17 bp, Homo sapiens
aagatgaaaatggaagt

SEQ ID NO: 312804 - DNA, 12 bp, Homo sapiens
aagatgaaattg

SEQ ID NO: 312805 - DNA, 16 bp, Homo sapiens
aagatgagaagccaaa

SEQ ID NO: 312806 - DNA, 18 bp, Homo sapiens
aagatgatctactcagaa

SEQ ID NO: 312807 - DNA, 18 bp, Homo sapiens
aagatgattttgcttttc

SEQ ID NO: 312808 - DNA, 19 bp, Homo sapiens
aagatgccaacagacacta

SEQ ID NO: 312809 - DNA, 11 bp, Homo sapiens
aagatgccctc

SEQ ID NO: 312810 - DNA, 19 bp, Homo sapiens
aagatgcctcttctacctc

SEQ ID NO: 312811 - DNA, 21 bp, Homo sapiens
aagatggattctcagatattt

SEQ ID NO: 312812 - DNA, 21 bp, Homo sapiens
aagatggatttgacacactca

SEQ ID NO: 312813 - DNA, 21 bp, Homo sapiens
aagatggcccagctccccaag

SEQ ID NO: 312814 - DNA, 21 bp, Homo sapiens
aagatggctgtgcctctgcct

SEQ ID NO: 312815 - DNA, 21 bp, Homo sapiens
aagatgggaacgcagatgatc

SEQ ID NO: 312816 - DNA, 14 bp, Homo sapiens
aagatgggtgggga

SEQ ID NO: 312817 - DNA, 17 bp, Homo sapiens
aagatggtcatattatt

SEQ ID NO: 312818 - DNA, 15 bp, Homo sapiens
aagatgtaagaagct

SEQ ID NO: 312819 - DNA, 20 bp, Homo sapiens
aagatgtactgagaggaggg

SEQ ID NO: 312820 - DNA, 20 bp, Homo sapiens
aagatgtcaaataaagcaaa

SEQ ID NO: 312821 - DNA, 21 bp, Homo sapiens
aagatgtcaaatatctcagag

SEQ ID NO: 312822 - DNA, 13 bp, Homo sapiens
aagatgtccccca

SEQ ID NO: 312823 - DNA, 19 bp, Homo sapiens
aagatgtgtcttcaatttg

SEQ ID NO: 312824 - DNA, 15 bp, Homo sapiens
aagatgttgaagaat

SEQ ID NO: 312825 - DNA, 21 bp, Homo sapiens
aagatgttgaagaatacagtt

SEQ ID NO: 312826 - DNA, 12 bp, Homo sapiens
aagatgttgttt

SEQ ID NO: 312827 - DNA, 18 bp, Homo sapiens
aagattaaaattagtgag

SEQ ID NO: 312828 - DNA, 20 bp, Homo sapiens
aagattaaattatatctgag

SEQ ID NO: 312829 - DNA, 24 bp, Homo sapiens
aagattatattataataatgttct

SEQ ID NO: 312830 - DNA, 12 bp, Homo sapiens
aagattatgtat

SEQ ID NO: 312831 - DNA, 17 bp, Homo sapiens
aagattccattttggaa

SEQ ID NO: 312832 - DNA, 18 bp, Homo sapiens
aagattccattttggaaa

SEQ ID NO: 312833 - DNA, 12 bp, Homo sapiens
aagattctctgc

SEQ ID NO: 312834 - DNA, 17 bp, Homo sapiens
aagattcttggtatttg

SEQ ID NO: 312835 - DNA, 20 bp, Homo sapiens
aagattctttaaactactga

SEQ ID NO: 312836 - DNA, 15 bp, Homo sapiens
aagattgcaaggaag

SEQ ID NO: 312837 - DNA, 20 bp, Homo sapiens
aagattggaaagacaggaag

SEQ ID NO: 312838 - DNA, 20 bp, Homo sapiens
aagattggacatggtctcct

SEQ ID NO: 312839 - DNA, 20 bp, Homo sapiens
aagaaaagaatccctgttca

SEQ ID NO: 312840 - DNA, 22 bp, Homo sapiens
aagaaaagcagacgcagcagct

SEQ ID NO: 312841 - DNA, 22 bp, Homo sapiens
aagaaaatagagatgagctttc

SEQ ID NO: 312842 - DNA, 19 bp, Homo sapiens
aagaaaatgaatttgactg

SEQ ID NO: 312843 - DNA, 15 bp, Homo sapiens
aagaaaatgtgtctg

SEQ ID NO: 312844 - DNA, 14 bp, Homo sapiens
aagaaacaatttaa

SEQ ID NO: 312845 - DNA, 21 bp, Homo sapiens
aagaaacacatcaaataaact

SEQ ID NO: 312846 - DNA, 16 bp, Homo sapiens
aagaaacaccacttaa

SEQ ID NO: 312847 - DNA, 20 bp, Homo sapiens
aagaaaccaagtgggctggt

SEQ ID NO: 312848 - DNA, 16 bp, Homo sapiens
aagaaactcaccccca

SEQ ID NO: 312849 - DNA, 14 bp, Homo sapiens
aagaaagaagcact

SEQ ID NO: 312850 - DNA, 13 bp, Homo sapiens
aagaaagactcta

SEQ ID NO: 312851 - DNA, 22 bp, Homo sapiens
aagaaagactctattctcaaag

SEQ ID NO: 312852 - DNA, 20 bp, Homo sapiens
aagaaagcacctgtttttac

SEQ ID NO: 312853 - DNA, 14 bp, Homo sapiens
aagaaagtctatgc

SEQ ID NO: 312854 - DNA, 15 bp, Homo sapiens
aagaaagtctatgct

SEQ ID NO: 312855 - DNA, 13 bp, Homo sapiens
aagaaagtttccc

SEQ ID NO: 312856 - DNA, 17 bp, Homo sapiens
aagaaatcgccttatga

SEQ ID NO: 312857 - DNA, 20 bp, Homo sapiens
aagaaatcgccttatgagaa

SEQ ID NO: 312858 - DNA, 19 bp, Homo sapiens
aagaaatgctaatgtaatc

SEQ ID NO: 312859 - DNA, 20 bp, Homo sapiens
aagaaatgctaatgtaatca

SEQ ID NO: 312860 - DNA, 19 bp, Homo sapiens
aagaaatgtgaagttttct

SEQ ID NO: 312861 - DNA, 21 bp, Homo sapiens
aagaaattagggctctaattt

SEQ ID NO: 312862 - DNA, 15 bp, Homo sapiens
aagaaattccctgga

SEQ ID NO: 312863 - DNA, 16 bp, Homo sapiens
aagaacaatagaactg

SEQ ID NO: 312864 - DNA, 17 bp, Homo sapiens
aagaacaatagaactgg

SEQ ID NO: 312865 - DNA, 19 bp, Homo sapiens
aagaacacagcatgtgcca

SEQ ID NO: 312866 - DNA, 12 bp, Homo sapiens
aagaacagcaga

SEQ ID NO: 312867 - DNA, 22 bp, Homo sapiens
aagaacaggcttggcaaagaag

SEQ ID NO: 312868 - DNA, 16 bp, Homo sapiens
aagaacagtacatttt

SEQ ID NO: 312869 - DNA, 16 bp, Homo sapiens
aagaacatagaactct

SEQ ID NO: 312870 - DNA, 12 bp, Homo sapiens
aagaaccatctt

SEQ ID NO: 312871 - DNA, 20 bp, Homo sapiens
aagaactccttattttgtat

SEQ ID NO: 312872 - DNA, 14 bp, Homo sapiens
aagaactctgggca

SEQ ID NO: 312873 - DNA, 16 bp, Homo sapiens
aagaactgaaaacata

SEQ ID NO: 312874 - DNA, 18 bp, Homo sapiens
aagaactgaaaacataaa

SEQ ID NO: 312875 - DNA, 11 bp, Homo sapiens
aagaactgcat

SEQ ID NO: 312876 - DNA, 13 bp, Homo sapiens
aagaactgcatgg

SEQ ID NO: 312877 - DNA, 15 bp, Homo sapiens
aagaactgcttgcat

SEQ ID NO: 312878 - DNA, 17 bp, Homo sapiens
aagaacttgatttgcat

SEQ ID NO: 312879 - DNA, 22 bp, Homo sapiens
aagaacttgatttgcatggatt

SEQ ID NO: 312880 - DNA, 17 bp, Homo sapiens
aagaagaccagtcacag

SEQ ID NO: 312881 - DNA, 22 bp, Homo sapiens
aagaagaccagtcacagccatt

SEQ ID NO: 312882 - DNA, 22 bp, Homo sapiens
aagaagcaattatttaaagaaa

SEQ ID NO: 312883 - DNA, 18 bp, Homo sapiens
aagaagccatcaatttta

SEQ ID NO: 312884 - DNA, 21 bp, Homo sapiens
aagaagccatcaattttaaca

SEQ ID NO: 312885 - DNA, 13 bp, Homo sapiens
aagaagccctcct

SEQ ID NO: 312886 - DNA, 16 bp, Homo sapiens
aagaaggaagacttta

SEQ ID NO: 312887 - DNA, 14 bp, Homo sapiens
aagaaggggctcga

SEQ ID NO: 312888 - DNA, 16 bp, Homo sapiens
aagaagggtaagtgct

SEQ ID NO: 312889 - DNA, 21 bp, Homo sapiens
aagaagggtccttccctctcc

SEQ ID NO: 312890 - DNA, 13 bp, Homo sapiens
aagaagtcaaatg

SEQ ID NO: 312891 - DNA, 22 bp, Homo sapiens
aagaagtcagagaaaacacttt

SEQ ID NO: 312892 - DNA, 22 bp, Homo sapiens
aagaagtgggagtgggagagga

SEQ ID NO: 312893 - DNA, 12 bp, Homo sapiens
aagaataaagtc

SEQ ID NO: 312894 - DNA, 16 bp, Homo sapiens
aagaatacagaaaatg

SEQ ID NO: 312895 - DNA, 18 bp, Homo sapiens
aagaatacagaaaatgct

SEQ ID NO: 312896 - DNA, 12 bp, Homo sapiens
aagaatattgtt

SEQ ID NO: 312897 - DNA, 15 bp, Homo sapiens
aagaatccctgttca

SEQ ID NO: 312898 - DNA, 21 bp, Homo sapiens
aagaatccctgttcattgtaa

SEQ ID NO: 312899 - DNA, 15 bp, Homo sapiens
aagaatgagaaagaa

SEQ ID NO: 312900 - DNA, 23 bp, Homo sapiens
aagaatgcagattcctgggcctg

SEQ ID NO: 312901 - DNA, 14 bp, Homo sapiens
aagaatgcattcaa

SEQ ID NO: 312902 - DNA, 19 bp, Homo sapiens
aagaatgctggttttccta

SEQ ID NO: 312903 - DNA, 12 bp, Homo sapiens
ataaactgtgag

SEQ ID NO: 312904 - DNA, 14 bp, Homo sapiens
ataaagaaataata

SEQ ID NO: 312905 - DNA, 15 bp, Homo sapiens
ataaagaacaaggta

SEQ ID NO: 312906 - DNA, 18 bp, Homo sapiens
ataaagaagaaaataacc

SEQ ID NO: 312907 - DNA, 16 bp, Homo sapiens
ataaagacttcatgtt

SEQ ID NO: 312908 - DNA, 14 bp, Homo sapiens
ataaagatgatcta

SEQ ID NO: 312909 - DNA, 23 bp, Homo sapiens
ataaagatgatctactcagaaat

SEQ ID NO: 312910 - DNA, 17 bp, Homo sapiens
ataaagatggctattat

SEQ ID NO: 312911 - DNA, 19 bp, Homo sapiens
ataaagatgtcaaatatct

SEQ ID NO: 312912 - DNA, 21 bp, Homo sapiens
ataaagatgtcaaatatctca

SEQ ID NO: 312913 - DNA, 20 bp, Homo sapiens
ataaagcataagtatacagt

SEQ ID NO: 312914 - DNA, 20 bp, Homo sapiens
ataaagccacataaccagcg

SEQ ID NO: 312915 - DNA, 17 bp, Homo sapiens
ataaagcgatatacaga

SEQ ID NO: 312916 - DNA, 13 bp, Homo sapiens
ataaagggaacat

SEQ ID NO: 312917 - DNA, 20 bp, Homo sapiens
ataaagggaacatgcagctc

SEQ ID NO: 312918 - DNA, 11 bp, Homo sapiens
ataaaggtcat

SEQ ID NO: 312919 - DNA, 17 bp, Homo sapiens
ataaagtatcatgcatt

SEQ ID NO: 312920 - DNA, 19 bp, Homo sapiens
ataaagtctgtctgcactg

SEQ ID NO: 312921 - DNA, 22 bp, Homo sapiens
ataaagtgcaattgcacaaata

SEQ ID NO: 312922 - DNA, 23 bp, Homo sapiens
ataaagtgcaattgcacaaatac

SEQ ID NO: 312923 - DNA, 22 bp, Homo sapiens
ataaagttgaagctaagattta

SEQ ID NO: 312924 - DNA, 21 bp, Homo sapiens
ataaagttttgccccatgata

SEQ ID NO: 312925 - DNA, 23 bp, Homo sapiens
ataaagttttgccccatgataaa

SEQ ID NO: 312926 - DNA, 16 bp, Homo sapiens
ataaataaagaagaaa

SEQ ID NO: 312927 - DNA, 21 bp, Homo sapiens
ataaataaagaagaaaataac

SEQ ID NO: 312928 - DNA, 22 bp, Homo sapiens
ataaataaagaagaaaataacc

SEQ ID NO: 312929 - DNA, 16 bp, Homo sapiens
ataaatactaaatatg

SEQ ID NO: 312930 - DNA, 17 bp, Homo sapiens
ataaatactaaatatga

SEQ ID NO: 312931 - DNA, 21 bp, Homo sapiens
ataaatagctatatccatgta

SEQ ID NO: 312932 - DNA, 16 bp, Homo sapiens
ataaatatactaataa

SEQ ID NO: 312933 - DNA, 18 bp, Homo sapiens
ataaatatactaataaaa

SEQ ID NO: 312934 - DNA, 22 bp, Homo sapiens
ataaatatactaataaaaaggt

SEQ ID NO: 312935 - DNA, 13 bp, Homo sapiens
ataaatatcatta

SEQ ID NO: 312936 - DNA, 16 bp, Homo sapiens
ataaatatcattatag

SEQ ID NO: 312937 - DNA, 15 bp, Homo sapiens
ataaatatctattta

SEQ ID NO: 312938 - DNA, 16 bp, Homo sapiens
ataaatatctatttat

SEQ ID NO: 312939 - DNA, 18 bp, Homo sapiens
ataaatatttttgccata

SEQ ID NO: 312940 - DNA, 21 bp, Homo sapiens
ataaatcatattgatgaaaag

SEQ ID NO: 312941 - DNA, 14 bp, Homo sapiens
ataaatcatttcag

SEQ ID NO: 312942 - DNA, 15 bp, Homo sapiens
ataaatcatttcagt

SEQ ID NO: 312943 - DNA, 16 bp, Homo sapiens
ataaatcatttcagta

SEQ ID NO: 312944 - DNA, 15 bp, Homo sapiens
ataaatccagttcta

SEQ ID NO: 312945 - DNA, 21 bp, Homo sapiens
ataaatctaaatgattatctt

SEQ ID NO: 312946 - DNA, 23 bp, Homo sapiens
ataaatctaaatgattatcttga

SEQ ID NO: 312947 - DNA, 19 bp, Homo sapiens
ataaatctgtctgattcta

SEQ ID NO: 312948 - DNA, 20 bp, Homo sapiens
ataaatctgtctgattctat

SEQ ID NO: 312949 - DNA, 14 bp, Homo sapiens
ataaatctgttgcc

SEQ ID NO: 312950 - DNA, 11 bp, Homo sapiens
ataaatgacca

SEQ ID NO: 312951 - DNA, 16 bp, Homo sapiens
ataaatggctcgtggg

SEQ ID NO: 312952 - DNA, 16 bp, Homo sapiens
ataaatggctggtttt

SEQ ID NO: 312953 - DNA, 18 bp, Homo sapiens
ataaatgggtaacactga

SEQ ID NO: 312954 - DNA, 19 bp, Homo sapiens
ataaatggtgagaattaaa

SEQ ID NO: 312955 - DNA, 22 bp, Homo sapiens
ataaatgtattcaaataccaat

SEQ ID NO: 312956 - DNA, 13 bp, Homo sapiens
ataaatgtcctaa

SEQ ID NO: 312957 - DNA, 12 bp, Homo sapiens
ataaatgtttaa

SEQ ID NO: 312958 - DNA, 19 bp, Homo sapiens
ataaattaaatatatgtat

SEQ ID NO: 312959 - DNA, 15 bp, Homo sapiens
ataaattaacattat

SEQ ID NO: 312960 - DNA, 18 bp, Homo sapiens
ataaattaacattatatt

SEQ ID NO: 312961 - DNA, 23 bp, Homo sapiens
ataaattaatacataagttaata

SEQ ID NO: 312962 - DNA, 13 bp, Homo sapiens
ataaattattact

SEQ ID NO: 312963 - DNA, 16 bp, Homo sapiens
ataaattattacttta

SEQ ID NO: 312964 - DNA, 19 bp, Homo sapiens
ataaattatttctaaaaca

SEQ ID NO: 312965 - DNA, 23 bp, Homo sapiens
ataaattccccatatttgtgttc

SEQ ID NO: 312966 - DNA, 21 bp, Homo sapiens
ataaattctataggaacatat

SEQ ID NO: 312967 - DNA, 17 bp, Homo sapiens
ataaattgaaattgtga

SEQ ID NO: 312968 - DNA, 18 bp, Homo sapiens
ataaattgcataaagcat

SEQ ID NO: 312969 - DNA, 18 bp, Homo sapiens
ataaattgctccttgaca

SEQ ID NO: 312970 - DNA, 18 bp, Homo sapiens
ataaattggctcctttcc

SEQ ID NO: 312971 - DNA, 23 bp, Homo sapiens
ataaattggctcctttcccacag

SEQ ID NO: 312972 - DNA, 21 bp, Homo sapiens
ataaattggtgataagtggaa

SEQ ID NO: 312973 - DNA, 22 bp, Homo sapiens
ataaattggtgataagtggaaa

SEQ ID NO: 312974 - DNA, 15 bp, Homo sapiens
ataaattgtttgacc

SEQ ID NO: 312975 - DNA, 16 bp, Homo sapiens
ataaatttaactttaa

SEQ ID NO: 312976 - DNA, 21 bp, Homo sapiens
ataaatttctgggatatttaa

SEQ ID NO: 312977 - DNA, 20 bp, Homo sapiens
ataaatttggttctaataga

SEQ ID NO: 312978 - DNA, 15 bp, Homo sapiens
ataaatttgtgtaat

SEQ ID NO: 312979 - DNA, 14 bp, Homo sapiens
ataacaacaattta

SEQ ID NO: 312980 - DNA, 22 bp, Homo sapiens
ataacaagccaaacattcttat

SEQ ID NO: 312981 - DNA, 14 bp, Homo sapiens
ataacaatatatga

SEQ ID NO: 312982 - DNA, 13 bp, Homo sapiens
ataacacagagag

SEQ ID NO: 312983 - DNA, 23 bp, Homo sapiens
ataacacagatattgttataaat

SEQ ID NO: 312984 - DNA, 19 bp, Homo sapiens
ataacaccaccattcacaa

SEQ ID NO: 312985 - DNA, 21 bp, Homo sapiens
ataacaggcattgcactaaaa

SEQ ID NO: 312986 - DNA, 20 bp, Homo sapiens
ataacagggtaaattattca

SEQ ID NO: 312987 - DNA, 15 bp, Homo sapiens
ataacagtatttcca

SEQ ID NO: 312988 - DNA, 20 bp, Homo sapiens
ataacatattcttgctttca

SEQ ID NO: 312989 - DNA, 13 bp, Homo sapiens
ataacatctgaaa

SEQ ID NO: 312990 - DNA, 24 bp, Homo sapiens
ataacattgcactttataaacact

SEQ ID NO: 312991 - DNA, 18 bp, Homo sapiens
ataacatttgctgaatat

SEQ ID NO: 312992 - DNA, 20 bp, Homo sapiens
ataaccaattcctcatttgt

SEQ ID NO: 312993 - DNA, 13 bp, Homo sapiens
ataaccacttaaa

SEQ ID NO: 312994 - DNA, 14 bp, Homo sapiens
ataaccagctgtaa

SEQ ID NO: 312995 - DNA, 23 bp, Homo sapiens
ataaccatcagttactggtttca

SEQ ID NO: 312996 - DNA, 18 bp, Homo sapiens
ataacctatatgatttat

SEQ ID NO: 312997 - DNA, 18 bp, Homo sapiens
ataacctctatatcttta

SEQ ID NO: 312998 - DNA, 17 bp, Homo sapiens
ataacgcaggagagaga

SEQ ID NO: 312999 - DNA, 18 bp, Homo sapiens
ataacgcaggagagagag

SEQ ID NO: 313000 - DNA, 20 bp, Homo sapiens
ataactaagcaagtatattt

SEQ ID NO: 313001 - DNA, 17 bp, Homo sapiens
ataactactgcaaaaag

SEQ ID NO: 313002 - DNA, 16 bp, Homo sapiens
ataactactgtgttcc

SEQ ID NO: 313003 - DNA, 18 bp, Homo sapiens
ataactactgtgttcctg

SEQ ID NO: 313004 - DNA, 13 bp, Homo sapiens
ataactagatctc

SEQ ID NO: 313005 - DNA, 20 bp, Homo sapiens
ataactagatggtgctgaga

SEQ ID NO: 313006 - DNA, 17 bp, Homo sapiens
ataactcatcataaaat

SEQ ID NO: 313007 - DNA, 19 bp, Homo sapiens
ataactcatcataaaataa

SEQ ID NO: 313008 - DNA, 17 bp, Homo sapiens
ataactcctcattgtaa

SEQ ID NO: 313009 - DNA, 20 bp, Homo sapiens
ataactccttcttgtagtag

SEQ ID NO: 313010 - DNA, 11 bp, Homo sapiens
ataactctgca

SEQ ID NO: 313011 - DNA, 21 bp, Homo sapiens
ataactctgcactactcctct

SEQ ID NO: 313012 - DNA, 15 bp, Homo sapiens
ataactgcagtgttc

SEQ ID NO: 313013 - DNA, 16 bp, Homo sapiens
ataactgctcttttac

SEQ ID NO: 313014 - DNA, 13 bp, Homo sapiens
ataactgtgaagt

SEQ ID NO: 313015 - DNA, 19 bp, Homo sapiens
ataacttaaaaatgtaaat

SEQ ID NO: 313016 - DNA, 17 bp, Homo sapiens
ataacttcagagaagtc

SEQ ID NO: 313017 - DNA, 17 bp, Homo sapiens
ataactttgactttctt

SEQ ID NO: 313018 - DNA, 16 bp, Homo sapiens
ataagaatgctggttt

SEQ ID NO: 313019 - DNA, 16 bp, Homo sapiens
ataagagttggctggt

SEQ ID NO: 313020 - DNA, 15 bp, Homo sapiens
ataagatgaggaaat

SEQ ID NO: 313021 - DNA, 15 bp, Homo sapiens
ataagatttttaggt

SEQ ID NO: 313022 - DNA, 15 bp, Homo sapiens
ataagcaagagagat

SEQ ID NO: 313023 - DNA, 14 bp, Homo sapiens
ataagcagaggtgg

SEQ ID NO: 313024 - DNA, 16 bp, Homo sapiens
ataagcattgaaatta

SEQ ID NO: 313025 - DNA, 18 bp, Homo sapiens
ataagcattgaaattata

SEQ ID NO: 313026 - DNA, 14 bp, Homo sapiens
ataagctctagttc

SEQ ID NO: 313027 - DNA, 22 bp, Homo sapiens
ataagctgggaaaaaagttttg

SEQ ID NO: 313028 - DNA, 15 bp, Homo sapiens
ataagcttaaaataa

SEQ ID NO: 313029 - DNA, 20 bp, Homo sapiens
ataagcttaaaataagtgaa

SEQ ID NO: 313030 - DNA, 17 bp, Homo sapiens
ataaggaagagggctga

SEQ ID NO: 313031 - DNA, 10 bp, Homo sapiens
ataaggactg

SEQ ID NO: 313032 - DNA, 19 bp, Homo sapiens
ataaggatgatacagtctc

SEQ ID NO: 313033 - DNA, 22 bp, Homo sapiens
atagcactggtttgtttctcaa

SEQ ID NO: 313034 - DNA, 12 bp, Homo sapiens
atagcagggctg

SEQ ID NO: 313035 - DNA, 23 bp, Homo sapiens
atagcatcctgattattgaatgt

SEQ ID NO: 313036 - DNA, 19 bp, Homo sapiens
atagcatctgctcttctct

SEQ ID NO: 313037 - DNA, 18 bp, Homo sapiens
atagcatttttgatttat

SEQ ID NO: 313038 - DNA, 21 bp, Homo sapiens
atagcatttttgatttatgca

SEQ ID NO: 313039 - DNA, 11 bp, Homo sapiens
atagccagaga

SEQ ID NO: 313040 - DNA, 14 bp, Homo sapiens
atagccagagagga

SEQ ID NO: 313041 - DNA, 19 bp, Homo sapiens
atagcggggccttgtctct

SEQ ID NO: 313042 - DNA, 19 bp, Homo sapiens
atagctacccacagagcaa

SEQ ID NO: 313043 - DNA, 20 bp, Homo sapiens
atagctactatatgcataaa

SEQ ID NO: 313044 - DNA, 19 bp, Homo sapiens
atagctagctatttctatg

SEQ ID NO: 313045 - DNA, 18 bp, Homo sapiens
atagctagttatgtgaga

SEQ ID NO: 313046 - DNA, 22 bp, Homo sapiens
atagctatatccatgtactgta

SEQ ID NO: 313047 - DNA, 22 bp, Homo sapiens
atagctattactgtctggtttt

SEQ ID NO: 313048 - DNA, 13 bp, Homo sapiens
atagctatttaga

SEQ ID NO: 313049 - DNA, 13 bp, Homo sapiens
atagctcagttta

SEQ ID NO: 313050 - DNA, 19 bp, Homo sapiens
atagctccttcatgctttt

SEQ ID NO: 313051 - DNA, 23 bp, Homo sapiens
atagctccttcatgcttttctca

SEQ ID NO: 313052 - DNA, 17 bp, Homo sapiens
atagctgagattcctgg

SEQ ID NO: 313053 - DNA, 21 bp, Homo sapiens
atagctgagattcctggttcg

SEQ ID NO: 313054 - DNA, 13 bp, Homo sapiens
atagctgagctgg

SEQ ID NO: 313055 - DNA, 14 bp, Homo sapiens
atagctgagctgga

SEQ ID NO: 313056 - DNA, 13 bp, Homo sapiens
atagctggggctt

SEQ ID NO: 313057 - DNA, 20 bp, Homo sapiens
atagcttcatcttgagcctg

SEQ ID NO: 313058 - DNA, 20 bp, Homo sapiens
atagcttgtatagtgtaaaa

SEQ ID NO: 313059 - DNA, 18 bp, Homo sapiens
atagctttattttttaag

SEQ ID NO: 313060 - DNA, 22 bp, Homo sapiens
atagctttattttttaagtatt

SEQ ID NO: 313061 - DNA, 14 bp, Homo sapiens
atagcttttattgt

SEQ ID NO: 313062 - DNA, 17 bp, Homo sapiens
atagcttttattgtata

SEQ ID NO: 313063 - DNA, 18 bp, Homo sapiens
atagcttttattgtataa

SEQ ID NO: 313064 - DNA, 19 bp, Homo sapiens
ataggaaaagtacatttaa

SEQ ID NO: 313065 - DNA, 20 bp, Homo sapiens
ataggaaagatttaatgtta

SEQ ID NO: 313066 - DNA, 21 bp, Homo sapiens
ataggaaagtatttttttaag

SEQ ID NO: 313067 - DNA, 15 bp, Homo sapiens
ataggaacatatgaa

SEQ ID NO: 313068 - DNA, 16 bp, Homo sapiens
ataggaacatatgaaa

SEQ ID NO: 313069 - DNA, 21 bp, Homo sapiens
ataggaacatatgaaaataca

SEQ ID NO: 313070 - DNA, 13 bp, Homo sapiens
ataggcaaggatg

SEQ ID NO: 313071 - DNA, 13 bp, Homo sapiens
ataggccatctgt

SEQ ID NO: 313072 - DNA, 17 bp, Homo sapiens
ataggccatctgtaaat

SEQ ID NO: 313073 - DNA, 21 bp, Homo sapiens
ataggcccaaggtcccctcca

SEQ ID NO: 313074 - DNA, 14 bp, Homo sapiens
ataggcctgggtgc

SEQ ID NO: 313075 - DNA, 12 bp, Homo sapiens
ataggctctgca

SEQ ID NO: 313076 - DNA, 19 bp, Homo sapiens
ataggctctgcacagatgg

SEQ ID NO: 313077 - DNA, 20 bp, Homo sapiens
atagggtccttgaaacagaa

SEQ ID NO: 313078 - DNA, 13 bp, Homo sapiens
atagggtggacag

SEQ ID NO: 313079 - DNA, 20 bp, Homo sapiens
ataggtaatcaatgaatatt

SEQ ID NO: 313080 - DNA, 14 bp, Homo sapiens
ataggtaggagacc

SEQ ID NO: 313081 - DNA, 15 bp, Homo sapiens
ataggtcactcctgg

SEQ ID NO: 313082 - DNA, 20 bp, Homo sapiens
ataggttgccaataatacac

SEQ ID NO: 313083 - DNA, 17 bp, Homo sapiens
atagtaccaatcatttt

SEQ ID NO: 313084 - DNA, 15 bp, Homo sapiens
atagtacctttgctc

SEQ ID NO: 313085 - DNA, 13 bp, Homo sapiens
atagtactattaa

SEQ ID NO: 313086 - DNA, 18 bp, Homo sapiens
atagtactctttgtagca

SEQ ID NO: 313087 - DNA, 19 bp, Homo sapiens
atagtagcagagtcattgt

SEQ ID NO: 313088 - DNA, 18 bp, Homo sapiens
atagtatagaatgaactg

SEQ ID NO: 313089 - DNA, 12 bp, Homo sapiens
atagtatatcta

SEQ ID NO: 313090 - DNA, 15 bp, Homo sapiens
atagtatatctggac

SEQ ID NO: 313091 - DNA, 16 bp, Homo sapiens
atagtatatctggaca

SEQ ID NO: 313092 - DNA, 17 bp, Homo sapiens
atagtatatctggacaa

SEQ ID NO: 313093 - DNA, 18 bp, Homo sapiens
atagtatgcagctaaaaa

SEQ ID NO: 313094 - DNA, 23 bp, Homo sapiens
atagtatttgagagttctaaatt

SEQ ID NO: 313095 - DNA, 13 bp, Homo sapiens
atagtcacctgct

SEQ ID NO: 313096 - DNA, 14 bp, Homo sapiens
atagtcacctgctg

SEQ ID NO: 313097 - DNA, 15 bp, Homo sapiens
atagtcacctgctgg

SEQ ID NO: 313098 - DNA, 16 bp, Homo sapiens
atagtcacctgctggt

SEQ ID NO: 313099 - DNA, 17 bp, Homo sapiens
atagtcatatgtgaaga

SEQ ID NO: 313100 - DNA, 14 bp, Homo sapiens
atagtcttccacaa

SEQ ID NO: 313101 - DNA, 18 bp, Homo sapiens
atagtctttttttttaag

SEQ ID NO: 313102 - DNA, 12 bp, Homo sapiens
atagtgaaaatt

SEQ ID NO: 313103 - DNA, 19 bp, Homo sapiens
atagtgaaaattttattga

SEQ ID NO: 313104 - DNA, 16 bp, Homo sapiens
atagtgccaggtggct

SEQ ID NO: 313105 - DNA, 22 bp, Homo sapiens
atagtgcctaaaattgtatgaa

SEQ ID NO: 313106 - DNA, 12 bp, Homo sapiens
atagtgcctcag

SEQ ID NO: 313107 - DNA, 22 bp, Homo sapiens
atagtgcctcagcgctgcccac

SEQ ID NO: 313108 - DNA, 18 bp, Homo sapiens
atagtgcttcttgtaata

SEQ ID NO: 313109 - DNA, 21 bp, Homo sapiens
atagtgtataccacctgtaca

SEQ ID NO: 313110 - DNA, 23 bp, Homo sapiens
atagtgtataccacctgtacata

SEQ ID NO: 313111 - DNA, 19 bp, Homo sapiens
atagtgtgctcggacacag

SEQ ID NO: 313112 - DNA, 20 bp, Homo sapiens
atagtgtgctcggacacagt

SEQ ID NO: 313113 - DNA, 15 bp, Homo sapiens
atagtgtgttctgat

SEQ ID NO: 313114 - DNA, 17 bp, Homo sapiens
atagtgtgttctgatta

SEQ ID NO: 313115 - DNA, 21 bp, Homo sapiens
atagttaattgtggctttatg

SEQ ID NO: 313116 - DNA, 18 bp, Homo sapiens
atagttattttaatacct

SEQ ID NO: 313117 - DNA, 22 bp, Homo sapiens
atagttattttaatacctttaa

SEQ ID NO: 313118 - DNA, 14 bp, Homo sapiens
atagttcaggattt

SEQ ID NO: 313119 - DNA, 15 bp, Homo sapiens
atagttctatttcta

SEQ ID NO: 313120 - DNA, 14 bp, Homo sapiens
atagttctgttaaa

SEQ ID NO: 313121 - DNA, 16 bp, Homo sapiens
atagttctgttaaata

SEQ ID NO: 313122 - DNA, 14 bp, Homo sapiens
atagttgatatgta

SEQ ID NO: 313123 - DNA, 20 bp, Homo sapiens
atagttgatatgtaacagtt

SEQ ID NO: 313124 - DNA, 19 bp, Homo sapiens
atagttgctccgcctctgc

SEQ ID NO: 313125 - DNA, 23 bp, Homo sapiens
atagttgtctttctttgctgctg

SEQ ID NO: 313126 - DNA, 13 bp, Homo sapiens
atagtttctgtaa

SEQ ID NO: 313127 - DNA, 15 bp, Homo sapiens
atagtttctgtaatt

SEQ ID NO: 313128 - DNA, 13 bp, Homo sapiens
atagtttgtacat

SEQ ID NO: 313129 - DNA, 17 bp, Homo sapiens
atagttttaaactcatt

SEQ ID NO: 313130 - DNA, 23 bp, Homo sapiens
atagttttacactctagtgccat

SEQ ID NO: 313131 - DNA, 17 bp, Homo sapiens
atagttttataaaactc

SEQ ID NO: 313132 - DNA, 21 bp, Homo sapiens
atataaaaaaattgtaaatgt

SEQ ID NO: 313133 - DNA, 19 bp, Homo sapiens
atataaaataaatatacta

SEQ ID NO: 313134 - DNA, 20 bp, Homo sapiens
atataaaataaatatactaa

SEQ ID NO: 313135 - DNA, 21 bp, Homo sapiens
atataaaataaatatactaat

SEQ ID NO: 313136 - DNA, 14 bp, Homo sapiens
atataaaatgtatt

SEQ ID NO: 313137 - DNA, 19 bp, Homo sapiens
atataaaatgtattcaagc

SEQ ID NO: 313138 - DNA, 13 bp, Homo sapiens
atataaacacata

SEQ ID NO: 313139 - DNA, 14 bp, Homo sapiens
atataaacacataa

SEQ ID NO: 313140 - DNA, 13 bp, Homo sapiens
atataaactgtga

SEQ ID NO: 313141 - DNA, 14 bp, Homo sapiens
atataaagttttgc

SEQ ID NO: 313142 - DNA, 20 bp, Homo sapiens
atataaataaagcaaatata

SEQ ID NO: 313143 - DNA, 23 bp, Homo sapiens
atataaatggctggtttttagaa

SEQ ID NO: 313144 - DNA, 18 bp, Homo sapiens
atataaatggtgagaatt

SEQ ID NO: 313145 - DNA, 21 bp, Homo sapiens
atataaatgtttatattgttt

SEQ ID NO: 313146 - DNA, 16 bp, Homo sapiens
atataacaacactaat

SEQ ID NO: 313147 - DNA, 13 bp, Homo sapiens
atataactgcctt

SEQ ID NO: 313148 - DNA, 13 bp, Homo sapiens
atataactgtaca

SEQ ID NO: 313149 - DNA, 14 bp, Homo sapiens
atataactgtacaa

SEQ ID NO: 313150 - DNA, 16 bp, Homo sapiens
atataagcttaaaata

SEQ ID NO: 313151 - DNA, 17 bp, Homo sapiens
atataagcttaaaataa

SEQ ID NO: 313152 - DNA, 19 bp, Homo sapiens
atataagcttaaaataagt

SEQ ID NO: 313153 - DNA, 21 bp, Homo sapiens
atataagcttaaaataagtga

SEQ ID NO: 313154 - DNA, 21 bp, Homo sapiens
atataagttaaagagacaaat

SEQ ID NO: 313155 - DNA, 18 bp, Homo sapiens
atataagtttattgtaaa

SEQ ID NO: 313156 - DNA, 14 bp, Homo sapiens
atataataaagtat

SEQ ID NO: 313157 - DNA, 15 bp, Homo sapiens
atataataaagtatt

SEQ ID NO: 313158 - DNA, 20 bp, Homo sapiens
atataataaagtattccacc

SEQ ID NO: 313159 - DNA, 22 bp, Homo sapiens
atataataaatatatatttatc

SEQ ID NO: 313160 - DNA, 14 bp, Homo sapiens
atataatgcaacag

SEQ ID NO: 313161 - DNA, 21 bp, Homo sapiens
atataatggcctcttaaaaat

SEQ ID NO: 313162 - DNA, 16 bp, Homo sapiens
atataatggtttactg

SEQ ID NO: 313163 - DNA, 16 bp, Homo sapiens
atatgattgaaaagaa

SEQ ID NO: 313164 - DNA, 13 bp, Homo sapiens
atatgatttatag

SEQ ID NO: 313165 - DNA, 13 bp, Homo sapiens
atatgattttata

SEQ ID NO: 313166 - DNA, 16 bp, Homo sapiens
atatgattttatttga

SEQ ID NO: 313167 - DNA, 19 bp, Homo sapiens
atatgattttatttgacaa

SEQ ID NO: 313168 - DNA, 23 bp, Homo sapiens
atatgcaaacagccctaaataaa

SEQ ID NO: 313169 - DNA, 13 bp, Homo sapiens
atatgcaatttgt

SEQ ID NO: 313170 - DNA, 17 bp, Homo sapiens
atatgcacccctggaac

SEQ ID NO: 313171 - DNA, 13 bp, Homo sapiens
atatgcactttcc

SEQ ID NO: 313172 - DNA, 19 bp, Homo sapiens
atatgcactttccctagaa

SEQ ID NO: 313173 - DNA, 20 bp, Homo sapiens
atatgcactttccctagaaa

SEQ ID NO: 313174 - DNA, 15 bp, Homo sapiens
atatgcatatatttt

SEQ ID NO: 313175 - DNA, 16 bp, Homo sapiens
atatgcatctttgaga

SEQ ID NO: 313176 - DNA, 12 bp, Homo sapiens
atatgcatgtac

SEQ ID NO: 313177 - DNA, 14 bp, Homo sapiens
atatgcatgtactt

SEQ ID NO: 313178 - DNA, 15 bp, Homo sapiens
atatgctaaatgtta

SEQ ID NO: 313179 - DNA, 17 bp, Homo sapiens
atatgctgaattgaaca

SEQ ID NO: 313180 - DNA, 18 bp, Homo sapiens
atatgctgccaaattttg

SEQ ID NO: 313181 - DNA, 14 bp, Homo sapiens
atatgcttatacac

SEQ ID NO: 313182 - DNA, 16 bp, Homo sapiens
atatgcttatacactt

SEQ ID NO: 313183 - DNA, 19 bp, Homo sapiens
atatgcttatacacttaca

SEQ ID NO: 313184 - DNA, 18 bp, Homo sapiens
atatggaacttctaatat

SEQ ID NO: 313185 - DNA, 23 bp, Homo sapiens
atatggaggattctttccccaga

SEQ ID NO: 313186 - DNA, 23 bp, Homo sapiens
atatggatatttttaatttatga

SEQ ID NO: 313187 - DNA, 16 bp, Homo sapiens
atatggcaaaaatggc

SEQ ID NO: 313188 - DNA, 15 bp, Homo sapiens
atatggcccagcctt

SEQ ID NO: 313189 - DNA, 15 bp, Homo sapiens
atatggctataaata

SEQ ID NO: 313190 - DNA, 17 bp, Homo sapiens
atatgggcattgtagtt

SEQ ID NO: 313191 - DNA, 18 bp, Homo sapiens
atatggggggccaacacc

SEQ ID NO: 313192 - DNA, 23 bp, Homo sapiens
atatggggggccaacaccaggga

SEQ ID NO: 313193 - DNA, 22 bp, Homo sapiens
atatggtactaaggagaattaa

SEQ ID NO: 313194 - DNA, 15 bp, Homo sapiens
atatggtttggtttt

SEQ ID NO: 313195 - DNA, 12 bp, Homo sapiens
atatgtacagtt

SEQ ID NO: 313196 - DNA, 15 bp, Homo sapiens
atatgtacataaatt

SEQ ID NO: 313197 - DNA, 15 bp, Homo sapiens
atatgtataatttca

SEQ ID NO: 313198 - DNA, 17 bp, Homo sapiens
atatgtataatttcaca

SEQ ID NO: 313199 - DNA, 22 bp, Homo sapiens
atatgtatctaaatgaaaagag

SEQ ID NO: 313200 - DNA, 13 bp, Homo sapiens
atatgtatgtaaa

SEQ ID NO: 313201 - DNA, 16 bp, Homo sapiens
atatgtattaatactt

SEQ ID NO: 313202 - DNA, 13 bp, Homo sapiens
atatgtattactt

SEQ ID NO: 313203 - DNA, 22 bp, Homo sapiens
atatgtcttactactttaaatc

SEQ ID NO: 313204 - DNA, 23 bp, Homo sapiens
atatgtcttactactttaaatcc

SEQ ID NO: 313205 - DNA, 15 bp, Homo sapiens
atatgtgagaacttt

SEQ ID NO: 313206 - DNA, 20 bp, Homo sapiens
atatgtgagaacttttcata

SEQ ID NO: 313207 - DNA, 20 bp, Homo sapiens
atatgtgagtgaaagtactt

SEQ ID NO: 313208 - DNA, 20 bp, Homo sapiens
atatgtggagttcatcttga

SEQ ID NO: 313209 - DNA, 19 bp, Homo sapiens
atatgtggcattcctttct

SEQ ID NO: 313210 - DNA, 22 bp, Homo sapiens
atatgtgtaatatcatttcata

SEQ ID NO: 313211 - DNA, 16 bp, Homo sapiens
atatgtgtgtgtatgt

SEQ ID NO: 313212 - DNA, 20 bp, Homo sapiens
atatgtgtgtttaaataaag

SEQ ID NO: 313213 - DNA, 15 bp, Homo sapiens
atatgttgctgaaac

SEQ ID NO: 313214 - DNA, 14 bp, Homo sapiens
atatgttgtaataa

SEQ ID NO: 313215 - DNA, 19 bp, Homo sapiens
atatgtttggctgaaatta

SEQ ID NO: 313216 - DNA, 14 bp, Homo sapiens
atatgttttgagaa

SEQ ID NO: 313217 - DNA, 23 bp, Homo sapiens
atattaaaaatatggaacttcta

SEQ ID NO: 313218 - DNA, 23 bp, Homo sapiens
atattaaaagaaagggttctgta

SEQ ID NO: 313219 - DNA, 13 bp, Homo sapiens
atattaaaatgtc

SEQ ID NO: 313220 - DNA, 19 bp, Homo sapiens
atattaaaccataagatgg

SEQ ID NO: 313221 - DNA, 18 bp, Homo sapiens
atattaaataaatgtgca

SEQ ID NO: 313222 - DNA, 13 bp, Homo sapiens
atattaaatacag

SEQ ID NO: 313223 - DNA, 20 bp, Homo sapiens
atattaaatacagacactaa

SEQ ID NO: 313224 - DNA, 13 bp, Homo sapiens
atattaagaaaca

SEQ ID NO: 313225 - DNA, 18 bp, Homo sapiens
atattaagaaacaattta

SEQ ID NO: 313226 - DNA, 14 bp, Homo sapiens
atattaatcccagc

SEQ ID NO: 313227 - DNA, 12 bp, Homo sapiens
atattaatttat

SEQ ID NO: 313228 - DNA, 21 bp, Homo sapiens
atattacattgcattcaaaat

SEQ ID NO: 313229 - DNA, 21 bp, Homo sapiens
atattaccatcttaatcttta

SEQ ID NO: 313230 - DNA, 13 bp, Homo sapiens
atattactgtctt

SEQ ID NO: 313231 - DNA, 20 bp, Homo sapiens
atattactgtctttattctt

SEQ ID NO: 313232 - DNA, 17 bp, Homo sapiens
atattactgttgcattt

SEQ ID NO: 313233 - DNA, 18 bp, Homo sapiens
atattactgtttatttct

SEQ ID NO: 313234 - DNA, 17 bp, Homo sapiens
atattactttaacatgc

SEQ ID NO: 313235 - DNA, 13 bp, Homo sapiens
atattacttttgt

SEQ ID NO: 313236 - DNA, 14 bp, Homo sapiens
atattacttttgta

SEQ ID NO: 313237 - DNA, 16 bp, Homo sapiens
atattacttttgtaaa

SEQ ID NO: 313238 - DNA, 20 bp, Homo sapiens
atattataaatccaaagtaa

SEQ ID NO: 313239 - DNA, 12 bp, Homo sapiens
atattataagat

SEQ ID NO: 313240 - DNA, 11 bp, Homo sapiens
atattataagt

SEQ ID NO: 313241 - DNA, 20 bp, Homo sapiens
atattataataatgttctct

SEQ ID NO: 313242 - DNA, 12 bp, Homo sapiens
atattatatata

SEQ ID NO: 313243 - DNA, 15 bp, Homo sapiens
atattatattgtatt

SEQ ID NO: 313244 - DNA, 13 bp, Homo sapiens
atattatctttgt

SEQ ID NO: 313245 - DNA, 13 bp, Homo sapiens
atattatgatttt

SEQ ID NO: 313246 - DNA, 13 bp, Homo sapiens
atattattatgaa

SEQ ID NO: 313247 - DNA, 16 bp, Homo sapiens
atattcaaacacacag

SEQ ID NO: 313248 - DNA, 17 bp, Homo sapiens
atattcaaacacacagt

SEQ ID NO: 313249 - DNA, 16 bp, Homo sapiens
atattcaaatcagcaa

SEQ ID NO: 313250 - DNA, 19 bp, Homo sapiens
atattcaaatcagcaagct

SEQ ID NO: 313251 - DNA, 20 bp, Homo sapiens
atattcaataaagctgctga

SEQ ID NO: 313252 - DNA, 22 bp, Homo sapiens
atattcacacctcacgctctgg

SEQ ID NO: 313253 - DNA, 22 bp, Homo sapiens
atattcatgaaagctgaaagaa

SEQ ID NO: 313254 - DNA, 17 bp, Homo sapiens
atattcattaataggaa

SEQ ID NO: 313255 - DNA, 20 bp, Homo sapiens
atattccagcagtgaaactt

SEQ ID NO: 313256 - DNA, 15 bp, Homo sapiens
atattccatgaatgt

SEQ ID NO: 313257 - DNA, 19 bp, Homo sapiens
atattccatgaatgtatca

SEQ ID NO: 313258 - DNA, 17 bp, Homo sapiens
atattcctgaatgaaat

SEQ ID NO: 313259 - DNA, 22 bp, Homo sapiens
atattcctgaatgaaatatcag

SEQ ID NO: 313260 - DNA, 21 bp, Homo sapiens
atattcctgcagcctggaggc

SEQ ID NO: 313261 - DNA, 20 bp, Homo sapiens
atattctatatgaatttaaa

SEQ ID NO: 313262 - DNA, 13 bp, Homo sapiens
atattctccctga

SEQ ID NO: 313263 - DNA, 14 bp, Homo sapiens
atattctctgatgt

SEQ ID NO: 313264 - DNA, 20 bp, Homo sapiens
atattctgataatgtattgc

SEQ ID NO: 313265 - DNA, 13 bp, Homo sapiens
atattcttataaa

SEQ ID NO: 313266 - DNA, 23 bp, Homo sapiens
atattcttgtccacattctactt

SEQ ID NO: 313267 - DNA, 13 bp, Homo sapiens
atattctttccat

SEQ ID NO: 313268 - DNA, 21 bp, Homo sapiens
atattgacaagtttaaaggct

SEQ ID NO: 313269 - DNA, 21 bp, Homo sapiens
atattgagatcagcattcaaa

SEQ ID NO: 313270 - DNA, 15 bp, Homo sapiens
atattgatatgctta

SEQ ID NO: 313271 - DNA, 14 bp, Homo sapiens
atattgatgtaact

SEQ ID NO: 313272 - DNA, 16 bp, Homo sapiens
atattgccgcactagg

SEQ ID NO: 313273 - DNA, 21 bp, Homo sapiens
atattgctgctggtaatttgt

SEQ ID NO: 313274 - DNA, 23 bp, Homo sapiens
atattgctgtatggtatatgcat

SEQ ID NO: 313275 - DNA, 20 bp, Homo sapiens
atattggtttgttattcttt

SEQ ID NO: 313276 - DNA, 13 bp, Homo sapiens
atattgtgaagta

SEQ ID NO: 313277 - DNA, 19 bp, Homo sapiens
atattgtgccaatatgtat

SEQ ID NO: 313278 - DNA, 18 bp, Homo sapiens
atattgttttctgtaaat

SEQ ID NO: 313279 - DNA, 19 bp, Homo sapiens
atattgttttctgtaaata

SEQ ID NO: 313280 - DNA, 16 bp, Homo sapiens
atattgtttttatata

SEQ ID NO: 313281 - DNA, 20 bp, Homo sapiens
atatttaaaaaaaaaatcag

SEQ ID NO: 313282 - DNA, 19 bp, Homo sapiens
atatttaaatgtaaagaca

SEQ ID NO: 313283 - DNA, 19 bp, Homo sapiens
atatttaagaaaatacaat

SEQ ID NO: 313284 - DNA, 20 bp, Homo sapiens
atatttaagaaaatacaata

SEQ ID NO: 313285 - DNA, 23 bp, Homo sapiens
atatttaagaaaatacaataaac

SEQ ID NO: 313286 - DNA, 20 bp, Homo sapiens
atatttaataggataaatta

SEQ ID NO: 313287 - DNA, 23 bp, Homo sapiens
atatttaatgataagtaaatgct

SEQ ID NO: 313288 - DNA, 17 bp, Homo sapiens
atatttaattattaact

SEQ ID NO: 313289 - DNA, 22 bp, Homo sapiens
atatttataactcatcataaaa

SEQ ID NO: 313290 - DNA, 14 bp, Homo sapiens
atatttatatttca

SEQ ID NO: 313291 - DNA, 15 bp, Homo sapiens
atatttatatttcac

SEQ ID NO: 313292 - DNA, 22 bp, Homo sapiens
atatttatgacctcaacaaaga

SEQ ID NO: 313293 - DNA, 20 bp, Homo sapiens
taaattataaggactgcatg

SEQ ID NO: 313294 - DNA, 16 bp, Homo sapiens
taaattatatctgagg

SEQ ID NO: 313295 - DNA, 16 bp, Homo sapiens
taaattatatgatatg

SEQ ID NO: 313296 - DNA, 22 bp, Homo sapiens
taaattatatgatatgcatgta

SEQ ID NO: 313297 - DNA, 17 bp, Homo sapiens
taaattatgtaatgcaa

SEQ ID NO: 313298 - DNA, 19 bp, Homo sapiens
taaattatgtaatgcaaaa

SEQ ID NO: 313299 - DNA, 13 bp, Homo sapiens
taaattattactt

SEQ ID NO: 313300 - DNA, 17 bp, Homo sapiens
taaattattactttaaa

SEQ ID NO: 313301 - DNA, 17 bp, Homo sapiens
taaattattcagttaag

SEQ ID NO: 313302 - DNA, 16 bp, Homo sapiens
taaattattgtaaact

SEQ ID NO: 313303 - DNA, 20 bp, Homo sapiens
taaattcaaccactgtaaaa

SEQ ID NO: 313304 - DNA, 23 bp, Homo sapiens
taaattcaaccactgtaaaatga

SEQ ID NO: 313305 - DNA, 21 bp, Homo sapiens
taaattcctcctgtctcctct

SEQ ID NO: 313306 - DNA, 15 bp, Homo sapiens
taaattctcagtcat

SEQ ID NO: 313307 - DNA, 19 bp, Homo sapiens
taaattctctctaacataa

SEQ ID NO: 313308 - DNA, 18 bp, Homo sapiens
taaattgcataaagcata

SEQ ID NO: 313309 - DNA, 15 bp, Homo sapiens
taaattgcatgctgc

SEQ ID NO: 313310 - DNA, 20 bp, Homo sapiens
taaattgcatgctgctttaa

SEQ ID NO: 313311 - DNA, 18 bp, Homo sapiens
taaattgcctcccttcct

SEQ ID NO: 313312 - DNA, 19 bp, Homo sapiens
taaattgcctcccttcctc

SEQ ID NO: 313313 - DNA, 17 bp, Homo sapiens
taaattggctcctttcc

SEQ ID NO: 313314 - DNA, 19 bp, Homo sapiens
taaattgtatacattttgt

SEQ ID NO: 313315 - DNA, 21 bp, Homo sapiens
taaattgttataacttcataa

SEQ ID NO: 313316 - DNA, 13 bp, Homo sapiens
taaatttaaaaca

SEQ ID NO: 313317 - DNA, 16 bp, Homo sapiens
taaatttaatatactg

SEQ ID NO: 313318 - DNA, 18 bp, Homo sapiens
taaatttcacaatataaa

SEQ ID NO: 313319 - DNA, 16 bp, Homo sapiens
taaatttgaactccat

SEQ ID NO: 313320 - DNA, 14 bp, Homo sapiens
taaatttgtactat

SEQ ID NO: 313321 - DNA, 20 bp, Homo sapiens
taaatttgtactatttaact

SEQ ID NO: 313322 - DNA, 22 bp, Homo sapiens
taaatttgttgtcatgtgtatg

SEQ ID NO: 313323 - DNA, 15 bp, Homo sapiens
taaattttaatgtaa

SEQ ID NO: 313324 - DNA, 16 bp, Homo sapiens
taaattttaatgtaaa

SEQ ID NO: 313325 - DNA, 17 bp, Homo sapiens
taaattttaatgtaaaa

SEQ ID NO: 313326 - DNA, 20 bp, Homo sapiens
taaattttaatgtaaaattc

SEQ ID NO: 313327 - DNA, 23 bp, Homo sapiens
taaattttaatgtaaaattcata

SEQ ID NO: 313328 - DNA, 11 bp, Homo sapiens
taaattttcac

SEQ ID NO: 313329 - DNA, 15 bp, Homo sapiens
taaattttcacctgt

SEQ ID NO: 313330 - DNA, 13 bp, Homo sapiens
taaatttttactt

SEQ ID NO: 313331 - DNA, 20 bp, Homo sapiens
taacaaaaaaatatatttaa

SEQ ID NO: 313332 - DNA, 17 bp, Homo sapiens
taacaaaacaagaaaga

SEQ ID NO: 313333 - DNA, 14 bp, Homo sapiens
taacaaaagatgaa

SEQ ID NO: 313334 - DNA, 12 bp, Homo sapiens
taacaaatctaa

SEQ ID NO: 313335 - DNA, 18 bp, Homo sapiens
taacaaggaatgcctgtg

SEQ ID NO: 313336 - DNA, 21 bp, Homo sapiens
taacaaggaatgcctgtgcca

SEQ ID NO: 313337 - DNA, 22 bp, Homo sapiens
taacaaggaatgcctgtgccaa

SEQ ID NO: 313338 - DNA, 16 bp, Homo sapiens
taacaagtaccaaagt

SEQ ID NO: 313339 - DNA, 21 bp, Homo sapiens
taacaagtaccaaagttttat

SEQ ID NO: 313340 - DNA, 23 bp, Homo sapiens
taacaataactactgtgttcctg

SEQ ID NO: 313341 - DNA, 20 bp, Homo sapiens
taacaatgcatgctttggaa

SEQ ID NO: 313342 - DNA, 13 bp, Homo sapiens
taacaatgccttg

SEQ ID NO: 313343 - DNA, 16 bp, Homo sapiens
taacaatgtatgtgaa

SEQ ID NO: 313344 - DNA, 13 bp, Homo sapiens
taacaatttcctt

SEQ ID NO: 313345 - DNA, 21 bp, Homo sapiens
taacaatttcctttatattta

SEQ ID NO: 313346 - DNA, 16 bp, Homo sapiens
taacaatttctgtcct

SEQ ID NO: 313347 - DNA, 22 bp, Homo sapiens
taacaatttctgtccttcagat

SEQ ID NO: 313348 - DNA, 12 bp, Homo sapiens
taacacagagag

SEQ ID NO: 313349 - DNA, 17 bp, Homo sapiens
taacacataaagtaaat

SEQ ID NO: 313350 - DNA, 17 bp, Homo sapiens
taacaccacactgacca

SEQ ID NO: 313351 - DNA, 12 bp, Homo sapiens
taacactaataa

SEQ ID NO: 313352 - DNA, 19 bp, Homo sapiens
taacactgcagccctctcc

SEQ ID NO: 313353 - DNA, 18 bp, Homo sapiens
taacactgtaatatcttt

SEQ ID NO: 313354 - DNA, 22 bp, Homo sapiens
taacagagtagttttggttttt

SEQ ID NO: 313355 - DNA, 17 bp, Homo sapiens
taacagatcctttcaaa

SEQ ID NO: 313356 - DNA, 13 bp, Homo sapiens
taacagctcagga

SEQ ID NO: 313357 - DNA, 16 bp, Homo sapiens
taacaggattagacag

SEQ ID NO: 313358 - DNA, 22 bp, Homo sapiens
taacaggctcaatattcctgaa

SEQ ID NO: 313359 - DNA, 18 bp, Homo sapiens
taacagggccttgctaat

SEQ ID NO: 313360 - DNA, 15 bp, Homo sapiens
taacaggtctttgaa

SEQ ID NO: 313361 - DNA, 21 bp, Homo sapiens
taacagtatttccacaatagg

SEQ ID NO: 313362 - DNA, 15 bp, Homo sapiens
taacagtcatttaaa

SEQ ID NO: 313363 - DNA, 18 bp, Homo sapiens
taacagtcatttaaaaaa

SEQ ID NO: 313364 - DNA, 21 bp, Homo sapiens
taacagtcctaactggtatag

SEQ ID NO: 313365 - DNA, 16 bp, Homo sapiens
taacagttttccatga

SEQ ID NO: 313366 - DNA, 21 bp, Homo sapiens
taacataaagaaacactttct

SEQ ID NO: 313367 - DNA, 16 bp, Homo sapiens
taacataatttttgtt

SEQ ID NO: 313368 - DNA, 22 bp, Homo sapiens
taacatataaattaatacataa

SEQ ID NO: 313369 - DNA, 13 bp, Homo sapiens
taacatataatat

SEQ ID NO: 313370 - DNA, 23 bp, Homo sapiens
taacatataatgttgttatttaa

SEQ ID NO: 313371 - DNA, 17 bp, Homo sapiens
taacatatgtacataaa

SEQ ID NO: 313372 - DNA, 12 bp, Homo sapiens
taacatattctt

SEQ ID NO: 313373 - DNA, 15 bp, Homo sapiens
taacatattcttgct

SEQ ID NO: 313374 - DNA, 23 bp, Homo sapiens
taacatattcttgctttcacaaa

SEQ ID NO: 313375 - DNA, 23 bp, Homo sapiens
taacatatttactaagccacaag

SEQ ID NO: 313376 - DNA, 23 bp, Homo sapiens
taacatcatcaggcttggaatga

SEQ ID NO: 313377 - DNA, 14 bp, Homo sapiens
taacatctctttca

SEQ ID NO: 313378 - DNA, 16 bp, Homo sapiens
taacatctgaaaagaa

SEQ ID NO: 313379 - DNA, 22 bp, Homo sapiens
taacatgaaaaacacggcagct

SEQ ID NO: 313380 - DNA, 20 bp, Homo sapiens
taacatgcccatattttact

SEQ ID NO: 313381 - DNA, 13 bp, Homo sapiens
taacatgctgtgt

SEQ ID NO: 313382 - DNA, 21 bp, Homo sapiens
taacatgctgtgtaagctgtg

SEQ ID NO: 313383 - DNA, 22 bp, Homo sapiens
taacatgctgtgtaagctgtgt

SEQ ID NO: 313384 - DNA, 16 bp, Homo sapiens
taacatggaagtacta

SEQ ID NO: 313385 - DNA, 12 bp, Homo sapiens
taacattattta

SEQ ID NO: 313386 - DNA, 19 bp, Homo sapiens
taacattcagtactttatg

SEQ ID NO: 313387 - DNA, 17 bp, Homo sapiens
taacattcatgagattg

SEQ ID NO: 313388 - DNA, 23 bp, Homo sapiens
taacattcctcatgaatgtaaat

SEQ ID NO: 313389 - DNA, 19 bp, Homo sapiens
taacattctatttcaactt

SEQ ID NO: 313390 - DNA, 15 bp, Homo sapiens
taacattgaccaaga

SEQ ID NO: 313391 - DNA, 19 bp, Homo sapiens
taacattgaccaagaactg

SEQ ID NO: 313392 - DNA, 18 bp, Homo sapiens
taacatttgagtcccttc

SEQ ID NO: 313393 - DNA, 13 bp, Homo sapiens
taacattttaaat

SEQ ID NO: 313394 - DNA, 21 bp, Homo sapiens
taacattttaaataaaagaaa

SEQ ID NO: 313395 - DNA, 13 bp, Homo sapiens
taaccaaagaaag

SEQ ID NO: 313396 - DNA, 15 bp, Homo sapiens
taaccaaagaaagtg

SEQ ID NO: 313397 - DNA, 17 bp, Homo sapiens
taaccaattcctcattt

SEQ ID NO: 313398 - DNA, 23 bp, Homo sapiens
taaccaccgcatatgcatgccag

SEQ ID NO: 313399 - DNA, 19 bp, Homo sapiens
taaccacttaaaaaatgtc

SEQ ID NO: 313400 - DNA, 18 bp, Homo sapiens
taaccagcagtcacaggt

SEQ ID NO: 313401 - DNA, 21 bp, Homo sapiens
taaccagtctgaagtttcatt

SEQ ID NO: 313402 - DNA, 20 bp, Homo sapiens
taaccatatgattgaaaaga

SEQ ID NO: 313403 - DNA, 22 bp, Homo sapiens
taaccatatgattgaaaagaag

SEQ ID NO: 313404 - DNA, 16 bp, Homo sapiens
taaccattgatgagca

SEQ ID NO: 313405 - DNA, 19 bp, Homo sapiens
taaccccctaagctccagg

SEQ ID NO: 313406 - DNA, 22 bp, Homo sapiens
taacccctgcctggatttcttc

SEQ ID NO: 313407 - DNA, 17 bp, Homo sapiens
taaccctccacctcctc

SEQ ID NO: 313408 - DNA, 18 bp, Homo sapiens
taaccctcccatggcacc

SEQ ID NO: 313409 - DNA, 17 bp, Homo sapiens
taaccctggcacttaag

SEQ ID NO: 313410 - DNA, 17 bp, Homo sapiens
taacctacgaccccaga

SEQ ID NO: 313411 - DNA, 14 bp, Homo sapiens
taacctcagctctg

SEQ ID NO: 313412 - DNA, 17 bp, Homo sapiens
taacctcagctctggga

SEQ ID NO: 313413 - DNA, 17 bp, Homo sapiens
taacctcaggttccaaa

SEQ ID NO: 313414 - DNA, 20 bp, Homo sapiens
taacctcagtgtcatttatg

SEQ ID NO: 313415 - DNA, 15 bp, Homo sapiens
taacctcgtgtctag

SEQ ID NO: 313416 - DNA, 14 bp, Homo sapiens
taacctgcatgcag

SEQ ID NO: 313417 - DNA, 17 bp, Homo sapiens
taacctgggcttaagtt

SEQ ID NO: 313418 - DNA, 15 bp, Homo sapiens
taacctggtgctgga

SEQ ID NO: 313419 - DNA, 19 bp, Homo sapiens
taacctgtacttcaagtta

SEQ ID NO: 313420 - DNA, 12 bp, Homo sapiens
taacctgtgaat

SEQ ID NO: 313421 - DNA, 17 bp, Homo sapiens
taaccttatcataaatt

SEQ ID NO: 313422 - DNA, 15 bp, Homo sapiens
taatggtttactgct

SEQ ID NO: 313423 - DNA, 19 bp, Homo sapiens
taatgtaatcatttatctt

SEQ ID NO: 313424 - DNA, 16 bp, Homo sapiens
taatgtacaagttttg

SEQ ID NO: 313425 - DNA, 20 bp, Homo sapiens
taatgtacagagtggcccct

SEQ ID NO: 313426 - DNA, 14 bp, Homo sapiens
taatgtagctattt

SEQ ID NO: 313427 - DNA, 16 bp, Homo sapiens
taatgtatcttattta

SEQ ID NO: 313428 - DNA, 21 bp, Homo sapiens
taatgtatcttatttatatat

SEQ ID NO: 313429 - DNA, 13 bp, Homo sapiens
taatgtcatctct

SEQ ID NO: 313430 - DNA, 13 bp, Homo sapiens
taatgtcttcatt

SEQ ID NO: 313431 - DNA, 19 bp, Homo sapiens
taatgtcttcatttcattg

SEQ ID NO: 313432 - DNA, 17 bp, Homo sapiens
taatgtgagacagcaag

SEQ ID NO: 313433 - DNA, 17 bp, Homo sapiens
taatgtgggaagaaaca

SEQ ID NO: 313434 - DNA, 15 bp, Homo sapiens
taatgttaattcagc

SEQ ID NO: 313435 - DNA, 11 bp, Homo sapiens
taatgttactg

SEQ ID NO: 313436 - DNA, 13 bp, Homo sapiens
taatgttactgat

SEQ ID NO: 313437 - DNA, 15 bp, Homo sapiens
taatgttactgatca

SEQ ID NO: 313438 - DNA, 13 bp, Homo sapiens
taatgttctctgg

SEQ ID NO: 313439 - DNA, 13 bp, Homo sapiens
taatgttgtccag

SEQ ID NO: 313440 - DNA, 21 bp, Homo sapiens
taatgtttaagatctgtttta

SEQ ID NO: 313441 - DNA, 18 bp, Homo sapiens
taatgtttccctcaagaa

SEQ ID NO: 313442 - DNA, 13 bp, Homo sapiens
taatgtttgctat

SEQ ID NO: 313443 - DNA, 12 bp, Homo sapiens
taatgttttgta

SEQ ID NO: 313444 - DNA, 16 bp, Homo sapiens
taatgtttttaaatat

SEQ ID NO: 313445 - DNA, 17 bp, Homo sapiens
taattaaaacacaacat

SEQ ID NO: 313446 - DNA, 15 bp, Homo sapiens
taattaaaacacttt

SEQ ID NO: 313447 - DNA, 22 bp, Homo sapiens
taattaaatgaaatacttgaca

SEQ ID NO: 313448 - DNA, 14 bp, Homo sapiens
taattaacatataa

SEQ ID NO: 313449 - DNA, 21 bp, Homo sapiens
taattacaacagcacgtgcag

SEQ ID NO: 313450 - DNA, 21 bp, Homo sapiens
taattacctgtcatctgggcc

SEQ ID NO: 313451 - DNA, 22 bp, Homo sapiens
taattagaaacacacttttgca

SEQ ID NO: 313452 - DNA, 18 bp, Homo sapiens
taattaggggttgctaag

SEQ ID NO: 313453 - DNA, 20 bp, Homo sapiens
taattataagctatgtcact

SEQ ID NO: 313454 - DNA, 21 bp, Homo sapiens
taattatcgggaacagtgttt

SEQ ID NO: 313455 - DNA, 13 bp, Homo sapiens
taattatgacagt

SEQ ID NO: 313456 - DNA, 21 bp, Homo sapiens
taattatgggaacaagtgtac

SEQ ID NO: 313457 - DNA, 19 bp, Homo sapiens
taattatgttattgaaaaa

SEQ ID NO: 313458 - DNA, 11 bp, Homo sapiens
taattatgttt

SEQ ID NO: 313459 - DNA, 14 bp, Homo sapiens
taattatgtttacc

SEQ ID NO: 313460 - DNA, 20 bp, Homo sapiens
taattatgtttacctcactg

SEQ ID NO: 313461 - DNA, 12 bp, Homo sapiens
taattattattc

SEQ ID NO: 313462 - DNA, 14 bp, Homo sapiens
taattattatttat

SEQ ID NO: 313463 - DNA, 17 bp, Homo sapiens
taattattatttatata

SEQ ID NO: 313464 - DNA, 13 bp, Homo sapiens
taattcaagaaaa

SEQ ID NO: 313465 - DNA, 15 bp, Homo sapiens
taattcaagctttcc

SEQ ID NO: 313466 - DNA, 20 bp, Homo sapiens
taattcaaggagaatatgat

SEQ ID NO: 313467 - DNA, 13 bp, Homo sapiens
taattcaataaaa

SEQ ID NO: 313468 - DNA, 18 bp, Homo sapiens
taattcagcactgatttc

SEQ ID NO: 313469 - DNA, 22 bp, Homo sapiens
taattcagcactgatttcacaa

SEQ ID NO: 313470 - DNA, 17 bp, Homo sapiens
taattcaggcacatgtg

SEQ ID NO: 313471 - DNA, 23 bp, Homo sapiens
taattcagggtggtaaagtatgt

SEQ ID NO: 313472 - DNA, 14 bp, Homo sapiens
taattcattaaatt

SEQ ID NO: 313473 - DNA, 16 bp, Homo sapiens
taattcattaaatttc

SEQ ID NO: 313474 - DNA, 16 bp, Homo sapiens
taattccaatatgatg

SEQ ID NO: 313475 - DNA, 18 bp, Homo sapiens
taattccaatatgatgac

SEQ ID NO: 313476 - DNA, 20 bp, Homo sapiens
taattcccattttgcaaaat

SEQ ID NO: 313477 - DNA, 15 bp, Homo sapiens
taattctaaaagaga

SEQ ID NO: 313478 - DNA, 12 bp, Homo sapiens
taattctaagtt

SEQ ID NO: 313479 - DNA, 22 bp, Homo sapiens
taattctattgaaagtttttaa

SEQ ID NO: 313480 - DNA, 15 bp, Homo sapiens
taattctgttctgat

SEQ ID NO: 313481 - DNA, 21 bp, Homo sapiens
taattctgttctgatattaat

SEQ ID NO: 313482 - DNA, 21 bp, Homo sapiens
taattcttacctcatttgcat

SEQ ID NO: 313483 - DNA, 13 bp, Homo sapiens
taattctttgata

SEQ ID NO: 313484 - DNA, 16 bp, Homo sapiens
taattctttgtttcct

SEQ ID NO: 313485 - DNA, 18 bp, Homo sapiens
taattgatcaaattcatt

SEQ ID NO: 313486 - DNA, 15 bp, Homo sapiens
taattgattaaactg

SEQ ID NO: 313487 - DNA, 16 bp, Homo sapiens
taattgattaaactgt

SEQ ID NO: 313488 - DNA, 22 bp, Homo sapiens
taattgattaaactgtatgtct

SEQ ID NO: 313489 - DNA, 22 bp, Homo sapiens
taattgcagataactttgactt

SEQ ID NO: 313490 - DNA, 11 bp, Homo sapiens
taattgccatg

SEQ ID NO: 313491 - DNA, 23 bp, Homo sapiens
taattgcttacatttttacaata

SEQ ID NO: 313492 - DNA, 23 bp, Homo sapiens
taattgcttattgttttattgta

SEQ ID NO: 313493 - DNA, 15 bp, Homo sapiens
taattggaattctgg

SEQ ID NO: 313494 - DNA, 18 bp, Homo sapiens
taattggtccgatctttg

SEQ ID NO: 313495 - DNA, 21 bp, Homo sapiens
taattgtaggtcaatgaaata

SEQ ID NO: 313496 - DNA, 14 bp, Homo sapiens
taattgtggcttta

SEQ ID NO: 313497 - DNA, 12 bp, Homo sapiens
taattgtgtaca

SEQ ID NO: 313498 - DNA, 12 bp, Homo sapiens
taattgttatac

SEQ ID NO: 313499 - DNA, 18 bp, Homo sapiens
taattgttttgcactttt

SEQ ID NO: 313500 - DNA, 14 bp, Homo sapiens
taatttaaagctgt

SEQ ID NO: 313501 - DNA, 17 bp, Homo sapiens
taatttaaagctgtttc

SEQ ID NO: 313502 - DNA, 18 bp, Homo sapiens
taatttaagccaataaat

SEQ ID NO: 313503 - DNA, 11 bp, Homo sapiens
taatttacaag

SEQ ID NO: 313504 - DNA, 17 bp, Homo sapiens
taatttacctgaagtct

SEQ ID NO: 313505 - DNA, 22 bp, Homo sapiens
taatttactttggaatgttgaa

SEQ ID NO: 313506 - DNA, 20 bp, Homo sapiens
taatttaggagttttgagaa

SEQ ID NO: 313507 - DNA, 14 bp, Homo sapiens
taatttatatttgt

SEQ ID NO: 313508 - DNA, 15 bp, Homo sapiens
taatttatcagattg

SEQ ID NO: 313509 - DNA, 14 bp, Homo sapiens
taatttatgagttt

SEQ ID NO: 313510 - DNA, 20 bp, Homo sapiens
taatttatgagtttttgata

SEQ ID NO: 313511 - DNA, 17 bp, Homo sapiens
taatttatttattaaga

SEQ ID NO: 313512 - DNA, 19 bp, Homo sapiens
taatttcaaaaatataact

SEQ ID NO: 313513 - DNA, 22 bp, Homo sapiens
taatttcattgtctctatctga

SEQ ID NO: 313514 - DNA, 17 bp, Homo sapiens
taatttccttaaagcaa

SEQ ID NO: 313515 - DNA, 17 bp, Homo sapiens
taatttctaaagataat

SEQ ID NO: 313516 - DNA, 19 bp, Homo sapiens
taatttcttactaaacatt

SEQ ID NO: 313517 - DNA, 13 bp, Homo sapiens
taatttgaatgtg

SEQ ID NO: 313518 - DNA, 20 bp, Homo sapiens
taatttgaatgtggttactt

SEQ ID NO: 313519 - DNA, 17 bp, Homo sapiens
taatttgaccagaaaat

SEQ ID NO: 313520 - DNA, 12 bp, Homo sapiens
taatttgatctt

SEQ ID NO: 313521 - DNA, 18 bp, Homo sapiens
taatttgatgaaagctga

SEQ ID NO: 313522 - DNA, 13 bp, Homo sapiens
taatttgctgctg

SEQ ID NO: 313523 - DNA, 23 bp, Homo sapiens
taattttaacaaacgcattaaga

SEQ ID NO: 313524 - DNA, 20 bp, Homo sapiens
taattttaatggctgcaaaa

SEQ ID NO: 313525 - DNA, 20 bp, Homo sapiens
taattttattattagattct

SEQ ID NO: 313526 - DNA, 16 bp, Homo sapiens
taattttcacttctgt

SEQ ID NO: 313527 - DNA, 18 bp, Homo sapiens
taattttctcaaaagcat

SEQ ID NO: 313528 - DNA, 23 bp, Homo sapiens
taattttggtccaaattctttat

SEQ ID NO: 313529 - DNA, 14 bp, Homo sapiens
taattttgtacgta

SEQ ID NO: 313530 - DNA, 17 bp, Homo sapiens
taattttgtatttttag

SEQ ID NO: 313531 - DNA, 16 bp, Homo sapiens
taatttttacagaatt

SEQ ID NO: 313532 - DNA, 22 bp, Homo sapiens
taatttttacagaattgcttgt

SEQ ID NO: 313533 - DNA, 22 bp, Homo sapiens
taatttttagatattcattaat

SEQ ID NO: 313534 - DNA, 11 bp, Homo sapiens
taatttttcct

SEQ ID NO: 313535 - DNA, 16 bp, Homo sapiens
taatttttcctatatt

SEQ ID NO: 313536 - DNA, 13 bp, Homo sapiens
taattttttacta

SEQ ID NO: 313537 - DNA, 22 bp, Homo sapiens
tacaaaaaaaatcaaaaaatta

SEQ ID NO: 313538 - DNA, 20 bp, Homo sapiens
tacaaaaaaacctttattct

SEQ ID NO: 313539 - DNA, 22 bp, Homo sapiens
tacaaaaaagtttaagattgca

SEQ ID NO: 313540 - DNA, 17 bp, Homo sapiens
tacaaaaatatattaaa

SEQ ID NO: 313541 - DNA, 13 bp, Homo sapiens
tacaaaagatgta

SEQ ID NO: 313542 - DNA, 15 bp, Homo sapiens
tacaaaataaaaaca

SEQ ID NO: 313543 - DNA, 18 bp, Homo sapiens
tacaaaataaaattatgg

SEQ ID NO: 313544 - DNA, 14 bp, Homo sapiens
tacaaaatgtgtgc

SEQ ID NO: 313545 - DNA, 14 bp, Homo sapiens
tacaaacaaaggat

SEQ ID NO: 313546 - DNA, 20 bp, Homo sapiens
tacaaacaaaggatttgaaa

SEQ ID NO: 313547 - DNA, 14 bp, Homo sapiens
tacaaacaggtgct

SEQ ID NO: 313548 - DNA, 13 bp, Homo sapiens
tacaaactgcaat

SEQ ID NO: 313549 - DNA, 20 bp, Homo sapiens
tacaaagatacttgatgcac

SEQ ID NO: 313550 - DNA, 18 bp, Homo sapiens
tacaaagtagagaagtat

SEQ ID NO: 313551 - DNA, 23 bp, Homo sapiens
tacaaatactcttaggaagagaa

SEQ ID NO: 313552 - DNA, 13 bp, Homo sapiens
tacaaattataaa

SEQ ID NO: 313553 - DNA, 15 bp, Homo sapiens
tacaaattataaaaa

SEQ ID NO: 313554 - DNA, 16 bp, Homo sapiens
tacaaatttgttattt

SEQ ID NO: 313555 - DNA, 16 bp, Homo sapiens
tacaacaatcccagca

SEQ ID NO: 313556 - DNA, 19 bp, Homo sapiens
tacaacagatattccagac

SEQ ID NO: 313557 - DNA, 22 bp, Homo sapiens
tacaacataatctagtttacag

SEQ ID NO: 313558 - DNA, 12 bp, Homo sapiens
tacaaccagagc

SEQ ID NO: 313559 - DNA, 15 bp, Homo sapiens
tacaaccagagcccc

SEQ ID NO: 313560 - DNA, 16 bp, Homo sapiens
tacaaccagagccccc

SEQ ID NO: 313561 - DNA, 21 bp, Homo sapiens
tacaaccagagccccccacaa

SEQ ID NO: 313562 - DNA, 20 bp, Homo sapiens
tacaacctccaccttccagg

SEQ ID NO: 313563 - DNA, 18 bp, Homo sapiens
tacaacttaaataataaa

SEQ ID NO: 313564 - DNA, 21 bp, Homo sapiens
tacaagacggggagtgagact

SEQ ID NO: 313565 - DNA, 23 bp, Homo sapiens
tacaagacggggagtgagactcc

SEQ ID NO: 313566 - DNA, 20 bp, Homo sapiens
tacaagagcagcctgtggca

SEQ ID NO: 313567 - DNA, 22 bp, Homo sapiens
tacaagccactaccttctgacc

SEQ ID NO: 313568 - DNA, 17 bp, Homo sapiens
tacaaggcaggcctttc

SEQ ID NO: 313569 - DNA, 16 bp, Homo sapiens
tacaagtaatgaattt

SEQ ID NO: 313570 - DNA, 22 bp, Homo sapiens
tacaagtaatgaattttatgtg

SEQ ID NO: 313571 - DNA, 20 bp, Homo sapiens
tacaagtgctcagttccaat

SEQ ID NO: 313572 - DNA, 18 bp, Homo sapiens
tacaagttgatcatgcag

SEQ ID NO: 313573 - DNA, 19 bp, Homo sapiens
tacaagttgatcatgcagg

SEQ ID NO: 313574 - DNA, 13 bp, Homo sapiens
tacaagtttcaga

SEQ ID NO: 313575 - DNA, 18 bp, Homo sapiens
tacaagtttcagacaggg

SEQ ID NO: 313576 - DNA, 14 bp, Homo sapiens
tacaagtttcagta

SEQ ID NO: 313577 - DNA, 15 bp, Homo sapiens
tacaagtttcagtaa

SEQ ID NO: 313578 - DNA, 21 bp, Homo sapiens
tacaagtttcagtaatagctg

SEQ ID NO: 313579 - DNA, 15 bp, Homo sapiens
tacaagttttgtata

SEQ ID NO: 313580 - DNA, 21 bp, Homo sapiens
tacaataaaactttgctgcca

SEQ ID NO: 313581 - DNA, 16 bp, Homo sapiens
tacaataaataatctg

SEQ ID NO: 313582 - DNA, 21 bp, Homo sapiens
tacaataccgtaacaatgttt

SEQ ID NO: 313583 - DNA, 20 bp, Homo sapiens
tacaatcaaaggaaaatagt

SEQ ID NO: 313584 - DNA, 15 bp, Homo sapiens
tacaatcagctgctt

SEQ ID NO: 313585 - DNA, 16 bp, Homo sapiens
tacaatcagctgcttt

SEQ ID NO: 313586 - DNA, 20 bp, Homo sapiens
tacaatcagctgctttgtta

SEQ ID NO: 313587 - DNA, 14 bp, Homo sapiens
tacaatgtttcaga

SEQ ID NO: 313588 - DNA, 22 bp, Homo sapiens
tacaattaaaggtcctgccctc

SEQ ID NO: 313589 - DNA, 19 bp, Homo sapiens
tacaattactaaattgtat

SEQ ID NO: 313590 - DNA, 18 bp, Homo sapiens
tacaattctacattgtca

SEQ ID NO: 313591 - DNA, 15 bp, Homo sapiens
tacaattgcactgct

SEQ ID NO: 313592 - DNA, 21 bp, Homo sapiens
tacaattgtaaaactgaggca

SEQ ID NO: 313593 - DNA, 17 bp, Homo sapiens
tacaattttcatcccac

SEQ ID NO: 313594 - DNA, 15 bp, Homo sapiens
tacacaaaaagaaag

SEQ ID NO: 313595 - DNA, 16 bp, Homo sapiens
tacacaatgaattctt

SEQ ID NO: 313596 - DNA, 21 bp, Homo sapiens
tacacaatggttttcttgtgt

SEQ ID NO: 313597 - DNA, 23 bp, Homo sapiens
tacacaatggttttcttgtgtgt

SEQ ID NO: 313598 - DNA, 10 bp, Homo sapiens
tacacacacg

SEQ ID NO: 313599 - DNA, 20 bp, Homo sapiens
tacacaccctccagcacaga

SEQ ID NO: 313600 - DNA, 23 bp, Homo sapiens
tacacaccctccagcacagactg

SEQ ID NO: 313601 - DNA, 19 bp, Homo sapiens
tacacacgtgtgatgtatg

SEQ ID NO: 313602 - DNA, 18 bp, Homo sapiens
tacacagcagtatgaatg

SEQ ID NO: 313603 - DNA, 18 bp, Homo sapiens
tacaccacctcactcctg

SEQ ID NO: 313604 - DNA, 18 bp, Homo sapiens
tacaccatagtttacaat

SEQ ID NO: 313605 - DNA, 13 bp, Homo sapiens
tacacccaatttt

SEQ ID NO: 313606 - DNA, 14 bp, Homo sapiens
tacacccatgcaca

SEQ ID NO: 313607 - DNA, 17 bp, Homo sapiens
tacaccgggcctggaga

SEQ ID NO: 313608 - DNA, 16 bp, Homo sapiens
tacactacaaatgtta

SEQ ID NO: 313609 - DNA, 14 bp, Homo sapiens
tacactcctgctgt

SEQ ID NO: 313610 - DNA, 18 bp, Homo sapiens
tacactctcctgggcccc

SEQ ID NO: 313611 - DNA, 13 bp, Homo sapiens
tacactgtatcta

SEQ ID NO: 313612 - DNA, 17 bp, Homo sapiens
tacactgtatctaaaaa

SEQ ID NO: 313613 - DNA, 23 bp, Homo sapiens
tacactgtatctaaaaaataact

SEQ ID NO: 313614 - DNA, 22 bp, Homo sapiens
tacacttacaagtaatgaattt

SEQ ID NO: 313615 - DNA, 16 bp, Homo sapiens
tacacttacactttat

SEQ ID NO: 313616 - DNA, 14 bp, Homo sapiens
tacacttggagccc

SEQ ID NO: 313617 - DNA, 16 bp, Homo sapiens
tacacttggtgtactg

SEQ ID NO: 313618 - DNA, 19 bp, Homo sapiens
tacagaaatactataacat

SEQ ID NO: 313619 - DNA, 22 bp, Homo sapiens
tacagaaatactataacatatg

SEQ ID NO: 313620 - DNA, 18 bp, Homo sapiens
tacagaaccagcactccc

SEQ ID NO: 313621 - DNA, 20 bp, Homo sapiens
tacagaaccagcactcccag

SEQ ID NO: 313622 - DNA, 22 bp, Homo sapiens
tacagaaccagcactcccaggg

SEQ ID NO: 313623 - DNA, 23 bp, Homo sapiens
tacagaaccagcactcccagggc

SEQ ID NO: 313624 - DNA, 18 bp, Homo sapiens
tacagaatcattgcttat

SEQ ID NO: 313625 - DNA, 19 bp, Homo sapiens
tacagacaaagcgtggtgg

SEQ ID NO: 313626 - DNA, 14 bp, Homo sapiens
tacagacactaagt

SEQ ID NO: 313627 - DNA, 18 bp, Homo sapiens
tacagacactaagttata

SEQ ID NO: 313628 - DNA, 14 bp, Homo sapiens
tacagacagaatat

SEQ ID NO: 313629 - DNA, 16 bp, Homo sapiens
tacagacctaatatca

SEQ ID NO: 313630 - DNA, 20 bp, Homo sapiens
tacagacctaatatcatttt

SEQ ID NO: 313631 - DNA, 22 bp, Homo sapiens
tacagacctaatatcattttat

SEQ ID NO: 313632 - DNA, 15 bp, Homo sapiens
tacagagaaaatcaa

SEQ ID NO: 313633 - DNA, 20 bp, Homo sapiens
tacagagaaaatcaaagcag

SEQ ID NO: 313634 - DNA, 21 bp, Homo sapiens
tacagagaaaatcaaagcagt

SEQ ID NO: 313635 - DNA, 17 bp, Homo sapiens
tacagagaggagaaaca

SEQ ID NO: 313636 - DNA, 18 bp, Homo sapiens
tacagagaggagaaacac

SEQ ID NO: 313637 - DNA, 22 bp, Homo sapiens
tacagagaggagaaacacatct

SEQ ID NO: 313638 - DNA, 22 bp, Homo sapiens
tacagagaggtcaagcccagga

SEQ ID NO: 313639 - DNA, 23 bp, Homo sapiens
tacagagcagacagttaagagaa

SEQ ID NO: 313640 - DNA, 22 bp, Homo sapiens
tacagagcagctccccaggagc

SEQ ID NO: 313641 - DNA, 17 bp, Homo sapiens
tacagagtctgacagga

SEQ ID NO: 313642 - DNA, 21 bp, Homo sapiens
tacagagtctgacaggaagac

SEQ ID NO: 313643 - DNA, 13 bp, Homo sapiens
tacagataacatt

SEQ ID NO: 313644 - DNA, 15 bp, Homo sapiens
tacagatccgcatgt

SEQ ID NO: 313645 - DNA, 19 bp, Homo sapiens
tacagatccgcatgtgtct

SEQ ID NO: 313646 - DNA, 19 bp, Homo sapiens
tacagatcctctggggttt

SEQ ID NO: 313647 - DNA, 14 bp, Homo sapiens
tacagatgaaaatt

SEQ ID NO: 313648 - DNA, 13 bp, Homo sapiens
tacagattttaga

SEQ ID NO: 313649 - DNA, 14 bp, Homo sapiens
tacagcactactct

SEQ ID NO: 313650 - DNA, 23 bp, Homo sapiens
tacagcactacttacttagagat

SEQ ID NO: 313651 - DNA, 13 bp, Homo sapiens
tacagcactttga

SEQ ID NO: 313652 - DNA, 19 bp, Homo sapiens
tacagcaggatgtgcctgt

SEQ ID NO: 313653 - DNA, 20 bp, Homo sapiens
tacagcatcaatagaaagtc

SEQ ID NO: 313654 - DNA, 19 bp, Homo sapiens
tacagcccctttttcatat

SEQ ID NO: 313655 - DNA, 15 bp, Homo sapiens
tacagctatttctca

SEQ ID NO: 313656 - DNA, 11 bp, Homo sapiens
tacagctcccc

SEQ ID NO: 313657 - DNA, 14 bp, Homo sapiens
tacagctcttggca

SEQ ID NO: 313658 - DNA, 13 bp, Homo sapiens
tacagcttttctc

SEQ ID NO: 313659 - DNA, 18 bp, Homo sapiens
tacagcttttctcttttt

SEQ ID NO: 313660 - DNA, 20 bp, Homo sapiens
tacaggaaaatcccttctag

SEQ ID NO: 313661 - DNA, 18 bp, Homo sapiens
tacaggaaattgcaaaga

SEQ ID NO: 313662 - DNA, 13 bp, Homo sapiens
tacaggaagtact

SEQ ID NO: 313663 - DNA, 14 bp, Homo sapiens
tacaggaagtactg

SEQ ID NO: 313664 - DNA, 19 bp, Homo sapiens
tacaggcaccgagaatgtt

SEQ ID NO: 313665 - DNA, 20 bp, Homo sapiens
tacaggcaccgagaatgttg

SEQ ID NO: 313666 - DNA, 16 bp, Homo sapiens
tacagggaactgggaa

SEQ ID NO: 313667 - DNA, 16 bp, Homo sapiens
tacaggtcttctttaa

SEQ ID NO: 313668 - DNA, 17 bp, Homo sapiens
tacaggtgcccaccacc

SEQ ID NO: 313669 - DNA, 22 bp, Homo sapiens
tacaggtgtgtgccatcatgcc

SEQ ID NO: 313670 - DNA, 22 bp, Homo sapiens
tacagtagctgtggggagctgg

SEQ ID NO: 313671 - DNA, 14 bp, Homo sapiens
tacagtatgtgtct

SEQ ID NO: 313672 - DNA, 22 bp, Homo sapiens
tacagtcccagcacatttcctc

SEQ ID NO: 313673 - DNA, 15 bp, Homo sapiens
tacagtctcaatttt

SEQ ID NO: 313674 - DNA, 20 bp, Homo sapiens
tacagtctcaattttgtatt

SEQ ID NO: 313675 - DNA, 13 bp, Homo sapiens
tacagtgatatgg

SEQ ID NO: 313676 - DNA, 14 bp, Homo sapiens
tacagtgcagacag

SEQ ID NO: 313677 - DNA, 16 bp, Homo sapiens
tacagtgcagacaggc

SEQ ID NO: 313678 - DNA, 13 bp, Homo sapiens
tacagtgctttat

SEQ ID NO: 313679 - DNA, 16 bp, Homo sapiens
tacagtggattgctca

SEQ ID NO: 313680 - DNA, 13 bp, Homo sapiens
tacagtggttcta

SEQ ID NO: 313681 - DNA, 23 bp, Homo sapiens
tacagtgtctgtgccatggattt

SEQ ID NO: 313682 - DNA, 16 bp, Homo sapiens
acagcctgaaggaatt

SEQ ID NO: 313683 - DNA, 12 bp, Homo sapiens
acagcctggcac

SEQ ID NO: 313684 - DNA, 14 bp, Homo sapiens
acagcctggcacag

SEQ ID NO: 313685 - DNA, 22 bp, Homo sapiens
acagcctggcctcccctgcgga

SEQ ID NO: 313686 - DNA, 16 bp, Homo sapiens
acagccttagctgcca

SEQ ID NO: 313687 - DNA, 21 bp, Homo sapiens
acagccttagctgccagtgct

SEQ ID NO: 313688 - DNA, 12 bp, Homo sapiens
acagccttgggc

SEQ ID NO: 313689 - DNA, 22 bp, Homo sapiens
acagcgacagaaaacctcaagg

SEQ ID NO: 313690 - DNA, 23 bp, Homo sapiens
acagcgacagaaaacctcaaggg

SEQ ID NO: 313691 - DNA, 16 bp, Homo sapiens
acagcggcccggccca

SEQ ID NO: 313692 - DNA, 21 bp, Homo sapiens
acagcggcccggcccacgcag

SEQ ID NO: 313693 - DNA, 20 bp, Homo sapiens
acagcgggagacctgtgcta

SEQ ID NO: 313694 - DNA, 22 bp, Homo sapiens
acagctaatcagcattctcact

SEQ ID NO: 313695 - DNA, 15 bp, Homo sapiens
acagctacctgagac

SEQ ID NO: 313696 - DNA, 18 bp, Homo sapiens
acagctactaacctggag

SEQ ID NO: 313697 - DNA, 20 bp, Homo sapiens
acagctactaacctggagac

SEQ ID NO: 313698 - DNA, 20 bp, Homo sapiens
acagctaggctgagatgcac

SEQ ID NO: 313699 - DNA, 23 bp, Homo sapiens
acagctaggttaataggaggaca

SEQ ID NO: 313700 - DNA, 14 bp, Homo sapiens
acagctatctagat

SEQ ID NO: 313701 - DNA, 20 bp, Homo sapiens
acagctatctagatagctga

SEQ ID NO: 313702 - DNA, 17 bp, Homo sapiens
acagctatgggagcccc

SEQ ID NO: 313703 - DNA, 21 bp, Homo sapiens
acagctatgggagccccaggg

SEQ ID NO: 313704 - DNA, 21 bp, Homo sapiens
acagctcaggatctcttagca

SEQ ID NO: 313705 - DNA, 23 bp, Homo sapiens
acagctcctcctcttggagctga

SEQ ID NO: 313706 - DNA, 18 bp, Homo sapiens
acagctctcactggccag

SEQ ID NO: 313707 - DNA, 17 bp, Homo sapiens
acagctctgtgttgcca

SEQ ID NO: 313708 - DNA, 12 bp, Homo sapiens
acagctcttgtt

SEQ ID NO: 313709 - DNA, 16 bp, Homo sapiens
acagctgaggtctctt

SEQ ID NO: 313710 - DNA, 12 bp, Homo sapiens
acagctgcagct

SEQ ID NO: 313711 - DNA, 13 bp, Homo sapiens
acagctgcagctg

SEQ ID NO: 313712 - DNA, 16 bp, Homo sapiens
acagctgcagctgggc

SEQ ID NO: 313713 - DNA, 17 bp, Homo sapiens
acagctgcaggtgccca

SEQ ID NO: 313714 - DNA, 11 bp, Homo sapiens
acagctgctgg

SEQ ID NO: 313715 - DNA, 16 bp, Homo sapiens
acagctgctggccagg

SEQ ID NO: 313716 - DNA, 16 bp, Homo sapiens
acagctgctgtgccag

SEQ ID NO: 313717 - DNA, 13 bp, Homo sapiens
acagctgcttctg

SEQ ID NO: 313718 - DNA, 21 bp, Homo sapiens
acagctgtgctgtaacacaag

SEQ ID NO: 313719 - DNA, 13 bp, Homo sapiens
acagctgttcctg

SEQ ID NO: 313720 - DNA, 17 bp, Homo sapiens
acagctgtttaagatgg

SEQ ID NO: 313721 - DNA, 17 bp, Homo sapiens
acagcttcatgcctttg

SEQ ID NO: 313722 - DNA, 21 bp, Homo sapiens
acagcttcttgcttgtaaaaa

SEQ ID NO: 313723 - DNA, 18 bp, Homo sapiens
acagcttgaggaaagagc

SEQ ID NO: 313724 - DNA, 18 bp, Homo sapiens
acagcttgatgctgtttc

SEQ ID NO: 313725 - DNA, 15 bp, Homo sapiens
acagctttcaagtgc

SEQ ID NO: 313726 - DNA, 20 bp, Homo sapiens
acagctttcatgattagcaa

SEQ ID NO: 313727 - DNA, 14 bp, Homo sapiens
acagctttcctggg

SEQ ID NO: 313728 - DNA, 17 bp, Homo sapiens
acagctttcctgggtga

SEQ ID NO: 313729 - DNA, 16 bp, Homo sapiens
acagctttctccagaa

SEQ ID NO: 313730 - DNA, 14 bp, Homo sapiens
acaggaaaaaaact

SEQ ID NO: 313731 - DNA, 14 bp, Homo sapiens
acaggaacacccag

SEQ ID NO: 313732 - DNA, 20 bp, Homo sapiens
acaggaacacccagccccag

SEQ ID NO: 313733 - DNA, 23 bp, Homo sapiens
acaggaagcccaaggcagtgttc

SEQ ID NO: 313734 - DNA, 14 bp, Homo sapiens
acaggaagcctctc

SEQ ID NO: 313735 - DNA, 13 bp, Homo sapiens
acaggaagtactg

SEQ ID NO: 313736 - DNA, 14 bp, Homo sapiens
acaggactctgcct

SEQ ID NO: 313737 - DNA, 16 bp, Homo sapiens
acaggactctgcctcc

SEQ ID NO: 313738 - DNA, 15 bp, Homo sapiens
acaggaggaactggt

SEQ ID NO: 313739 - DNA, 18 bp, Homo sapiens
acaggaggaactggtcca

SEQ ID NO: 313740 - DNA, 18 bp, Homo sapiens
acaggaggaggagatggc

SEQ ID NO: 313741 - DNA, 23 bp, Homo sapiens
acaggatctgaactttgtttcca

SEQ ID NO: 313742 - DNA, 14 bp, Homo sapiens
acaggattattgga

SEQ ID NO: 313743 - DNA, 13 bp, Homo sapiens
acaggattgtctg

SEQ ID NO: 313744 - DNA, 15 bp, Homo sapiens
acaggcaacattaca

SEQ ID NO: 313745 - DNA, 16 bp, Homo sapiens
acaggcaacattacaa

SEQ ID NO: 313746 - DNA, 14 bp, Homo sapiens
acaggcaccgagaa

SEQ ID NO: 313747 - DNA, 17 bp, Homo sapiens
acaggcaccgagaatgt

SEQ ID NO: 313748 - DNA, 19 bp, Homo sapiens
acaggcagacacatgctgt

SEQ ID NO: 313749 - DNA, 21 bp, Homo sapiens
acaggcagctggatgagactt

SEQ ID NO: 313750 - DNA, 12 bp, Homo sapiens
acaggcagtgca

SEQ ID NO: 313751 - DNA, 15 bp, Homo sapiens
acaggcagtgcatgt

SEQ ID NO: 313752 - DNA, 18 bp, Homo sapiens
acaggcagtgcatgtgaa

SEQ ID NO: 313753 - DNA, 18 bp, Homo sapiens
acaggccacacgctgccc

SEQ ID NO: 313754 - DNA, 19 bp, Homo sapiens
acaggccacacgctgccca

SEQ ID NO: 313755 - DNA, 24 bp, Homo sapiens
acaggccactgcaaaccctgctgc

SEQ ID NO: 313756 - DNA, 19 bp, Homo sapiens
acaggccacttgctcagac

SEQ ID NO: 313757 - DNA, 13 bp, Homo sapiens
acaggcccagtgg

SEQ ID NO: 313758 - DNA, 16 bp, Homo sapiens
acaggcccatgccctc

SEQ ID NO: 313759 - DNA, 14 bp, Homo sapiens
acaggcctggccca

SEQ ID NO: 313760 - DNA, 18 bp, Homo sapiens
acaggcctggcccagcca

SEQ ID NO: 313761 - DNA, 19 bp, Homo sapiens
acaggcgctccaggccact

SEQ ID NO: 313762 - DNA, 18 bp, Homo sapiens
acaggctactctcctcgg

SEQ ID NO: 313763 - DNA, 19 bp, Homo sapiens
acaggctcttagcagcttc

SEQ ID NO: 313764 - DNA, 14 bp, Homo sapiens
acagggaaaatata

SEQ ID NO: 313765 - DNA, 16 bp, Homo sapiens
acagggaactgggaag

SEQ ID NO: 313766 - DNA, 23 bp, Homo sapiens
acagggaactgggaagatgctgg

SEQ ID NO: 313767 - DNA, 20 bp, Homo sapiens
acagggacacagtctggtgc

SEQ ID NO: 313768 - DNA, 13 bp, Homo sapiens
acagggccagggt

SEQ ID NO: 313769 - DNA, 15 bp, Homo sapiens
acagggcccaggcct

SEQ ID NO: 313770 - DNA, 18 bp, Homo sapiens
acagggcccaggcctgga

SEQ ID NO: 313771 - DNA, 22 bp, Homo sapiens
acaggggaaggaaataacattg

SEQ ID NO: 313772 - DNA, 14 bp, Homo sapiens
acaggggcaggcct

SEQ ID NO: 313773 - DNA, 20 bp, Homo sapiens
acaggggctatcccttctca

SEQ ID NO: 313774 - DNA, 16 bp, Homo sapiens
acaggggggtcggaag

SEQ ID NO: 313775 - DNA, 22 bp, Homo sapiens
acaggggggtcggaagcctgtc

SEQ ID NO: 313776 - DNA, 23 bp, Homo sapiens
acaggggggtcggaagcctgtcc

SEQ ID NO: 313777 - DNA, 15 bp, Homo sapiens
acagggtctgctctt

SEQ ID NO: 313778 - DNA, 24 bp, Homo sapiens
acagggtctgctctttctctgcca

SEQ ID NO: 313779 - DNA, 19 bp, Homo sapiens
acagggtgggatgagcctc

SEQ ID NO: 313780 - DNA, 20 bp, Homo sapiens
acagggtgggatgagcctct

SEQ ID NO: 313781 - DNA, 16 bp, Homo sapiens
acagggtgttggaaga

SEQ ID NO: 313782 - DNA, 13 bp, Homo sapiens
acagggttttgta

SEQ ID NO: 313783 - DNA, 19 bp, Homo sapiens
acaggtctgggagaggcag

SEQ ID NO: 313784 - DNA, 15 bp, Homo sapiens
acaggtcttctttaa

SEQ ID NO: 313785 - DNA, 17 bp, Homo sapiens
agctaggaaaggcagaa

SEQ ID NO: 313786 - DNA, 17 bp, Homo sapiens
agctaggactgaggagt

SEQ ID NO: 313787 - DNA, 16 bp, Homo sapiens
agctaggctgagatgc

SEQ ID NO: 313788 - DNA, 17 bp, Homo sapiens
agctaggctgagatgca

SEQ ID NO: 313789 - DNA, 14 bp, Homo sapiens
agctagttaataat

SEQ ID NO: 313790 - DNA, 18 bp, Homo sapiens
agctagttcgtagctttc

SEQ ID NO: 313791 - DNA, 17 bp, Homo sapiens
agctagtttaaaattat

SEQ ID NO: 313792 - DNA, 22 bp, Homo sapiens
agctagtttaaaattattaaaa

SEQ ID NO: 313793 - DNA, 12 bp, Homo sapiens
agctataaatag

SEQ ID NO: 313794 - DNA, 17 bp, Homo sapiens
agctataacaactctat

SEQ ID NO: 313795 - DNA, 19 bp, Homo sapiens
agctataacaactctattt

SEQ ID NO: 313796 - DNA, 15 bp, Homo sapiens
agctataacatttgc

SEQ ID NO: 313797 - DNA, 21 bp, Homo sapiens
agctataacatttgctgaata

SEQ ID NO: 313798 - DNA, 16 bp, Homo sapiens
agctatatatgaataa

SEQ ID NO: 313799 - DNA, 14 bp, Homo sapiens
agctatatccatgt

SEQ ID NO: 313800 - DNA, 16 bp, Homo sapiens
agctatcagtgttctt

SEQ ID NO: 313801 - DNA, 18 bp, Homo sapiens
agctatccggacagagca

SEQ ID NO: 313802 - DNA, 23 bp, Homo sapiens
agctatcctaaatttgaaatagt

SEQ ID NO: 313803 - DNA, 18 bp, Homo sapiens
agctatctatatggaatt

SEQ ID NO: 313804 - DNA, 17 bp, Homo sapiens
agctatgagaataactt

SEQ ID NO: 313805 - DNA, 15 bp, Homo sapiens
agctatgagagatgt

SEQ ID NO: 313806 - DNA, 14 bp, Homo sapiens
agctatgcacacca

SEQ ID NO: 313807 - DNA, 17 bp, Homo sapiens
agctatgcacaccaaat

SEQ ID NO: 313808 - DNA, 22 bp, Homo sapiens
agctatgtcactaccctcctgt

SEQ ID NO: 313809 - DNA, 15 bp, Homo sapiens
agctattaagaaaat

SEQ ID NO: 313810 - DNA, 21 bp, Homo sapiens
agctattactgtctggtttta

SEQ ID NO: 313811 - DNA, 11 bp, Homo sapiens
agctattcttt

SEQ ID NO: 313812 - DNA, 19 bp, Homo sapiens
agctgagtcggctgggcag

SEQ ID NO: 313813 - DNA, 22 bp, Homo sapiens
agctgagtcggctgggcagggc

SEQ ID NO: 313814 - DNA, 20 bp, Homo sapiens
agctgagttacttgtctgag

SEQ ID NO: 313815 - DNA, 22 bp, Homo sapiens
agctgagttacttgtctgaggc

SEQ ID NO: 313816 - DNA, 22 bp, Homo sapiens
agctgatgaaactcctgatttt

SEQ ID NO: 313817 - DNA, 15 bp, Homo sapiens
agctgatgatgtctc

SEQ ID NO: 313818 - DNA, 20 bp, Homo sapiens
agctgatgatgtctcttgta

SEQ ID NO: 313819 - DNA, 23 bp, Homo sapiens
agctgatgatgtctcttgtagaa

SEQ ID NO: 313820 - DNA, 22 bp, Homo sapiens
agctgatgccctataacccctg

SEQ ID NO: 313821 - DNA, 21 bp, Homo sapiens
agctgattactgtcaataaac

SEQ ID NO: 313822 - DNA, 14 bp, Homo sapiens
agctgatttccagg

SEQ ID NO: 313823 - DNA, 20 bp, Homo sapiens
agctgatttccaggcccctg

SEQ ID NO: 313824 - DNA, 21 bp, Homo sapiens
agctgatttccaggcccctga

SEQ ID NO: 313825 - DNA, 18 bp, Homo sapiens
agctgatttccctttttt

SEQ ID NO: 313826 - DNA, 14 bp, Homo sapiens
agctgattttaaca

SEQ ID NO: 313827 - DNA, 16 bp, Homo sapiens
agctgattttaacaat

SEQ ID NO: 313828 - DNA, 20 bp, Homo sapiens
agctgcacattcctggcccc

SEQ ID NO: 313829 - DNA, 15 bp, Homo sapiens
agctgcagagacaga

SEQ ID NO: 313830 - DNA, 21 bp, Homo sapiens
agctgcagcgcctcctggaca

SEQ ID NO: 313831 - DNA, 13 bp, Homo sapiens
agctgcagcttgg

SEQ ID NO: 313832 - DNA, 14 bp, Homo sapiens
agctgcagcttggg

SEQ ID NO: 313833 - DNA, 17 bp, Homo sapiens
agctgcaggtgcccatt

SEQ ID NO: 313834 - DNA, 18 bp, Homo sapiens
agctgcatacagtttgca

SEQ ID NO: 313835 - DNA, 15 bp, Homo sapiens
agctgccaagtaaat

SEQ ID NO: 313836 - DNA, 17 bp, Homo sapiens
agctgccatccagggat

SEQ ID NO: 313837 - DNA, 23 bp, Homo sapiens
agctgcccacaagccataaacca

SEQ ID NO: 313838 - DNA, 18 bp, Homo sapiens
agctgcctctgacagcag

SEQ ID NO: 313839 - DNA, 21 bp, Homo sapiens
agctgcctctgacagcagcct

SEQ ID NO: 313840 - DNA, 15 bp, Homo sapiens
agctgcctgtagtta

SEQ ID NO: 313841 - DNA, 23 bp, Homo sapiens
agctgcctgtagttaggaaataa

SEQ ID NO: 313842 - DNA, 18 bp, Homo sapiens
agctgcgggtctgaagga

SEQ ID NO: 313843 - DNA, 10 bp, Homo sapiens
agctgctcag

SEQ ID NO: 313844 - DNA, 13 bp, Homo sapiens
agctgctcccctc

SEQ ID NO: 313845 - DNA, 19 bp, Homo sapiens
agctgctcccctccctcct

SEQ ID NO: 313846 - DNA, 14 bp, Homo sapiens
agctgctctattgt

SEQ ID NO: 313847 - DNA, 17 bp, Homo sapiens
agctgctctgcccagag

SEQ ID NO: 313848 - DNA, 21 bp, Homo sapiens
agctgctctgcccagagctgg

SEQ ID NO: 313849 - DNA, 19 bp, Homo sapiens
agctgctcttagtgcccgc

SEQ ID NO: 313850 - DNA, 20 bp, Homo sapiens
agctgctcttagtgcccgcc

SEQ ID NO: 313851 - DNA, 21 bp, Homo sapiens
agctgctcttagtgcccgcct

SEQ ID NO: 313852 - DNA, 22 bp, Homo sapiens
agctgctcttgcatctgggcca

SEQ ID NO: 313853 - DNA, 12 bp, Homo sapiens
agctgctggcca

SEQ ID NO: 313854 - DNA, 14 bp, Homo sapiens
agctgctggccagg

SEQ ID NO: 313855 - DNA, 16 bp, Homo sapiens
agctgctggttttggt

SEQ ID NO: 313856 - DNA, 13 bp, Homo sapiens
agctgctgtgcca

SEQ ID NO: 313857 - DNA, 14 bp, Homo sapiens
agctgctgtgccag

SEQ ID NO: 313858 - DNA, 14 bp, Homo sapiens
agctgcttccagtt

SEQ ID NO: 313859 - DNA, 12 bp, Homo sapiens
agctggaaggca

SEQ ID NO: 313860 - DNA, 16 bp, Homo sapiens
agctggaaggcagggc

SEQ ID NO: 313861 - DNA, 17 bp, Homo sapiens
agctggaaggcagggca

SEQ ID NO: 313862 - DNA, 21 bp, Homo sapiens
agctggaaggcagggcagagg

SEQ ID NO: 313863 - DNA, 18 bp, Homo sapiens
agctggacaagaagctgc

SEQ ID NO: 313864 - DNA, 19 bp, Homo sapiens
agctggacaagaagctgct

SEQ ID NO: 313865 - DNA, 17 bp, Homo sapiens
agctggagaaatatggt

SEQ ID NO: 313866 - DNA, 16 bp, Homo sapiens
agctggagtgctgctt

SEQ ID NO: 313867 - DNA, 22 bp, Homo sapiens
agctggagtgctgcttgtgcct

SEQ ID NO: 313868 - DNA, 13 bp, Homo sapiens
agctggcaggaca

SEQ ID NO: 313869 - DNA, 15 bp, Homo sapiens
agctggcaggagggt

SEQ ID NO: 313870 - DNA, 23 bp, Homo sapiens
agctggccgggttggaggcctca

SEQ ID NO: 313871 - DNA, 23 bp, Homo sapiens
agctggcggaacctggctgcgaa

SEQ ID NO: 313872 - DNA, 15 bp, Homo sapiens
agctggcgtctgtct

SEQ ID NO: 313873 - DNA, 15 bp, Homo sapiens
agctggctggcaggt

SEQ ID NO: 313874 - DNA, 16 bp, Homo sapiens
agctggctggcaggtg

SEQ ID NO: 313875 - DNA, 20 bp, Homo sapiens
agctgggaaaaaagttttga

SEQ ID NO: 313876 - DNA, 15 bp, Homo sapiens
agctgggacccctcc

SEQ ID NO: 313877 - DNA, 14 bp, Homo sapiens
agctgggagccggg

SEQ ID NO: 313878 - DNA, 15 bp, Homo sapiens
agctgggagccgggc

SEQ ID NO: 313879 - DNA, 15 bp, Homo sapiens
agctgggagtagcat

SEQ ID NO: 313880 - DNA, 17 bp, Homo sapiens
agctgggattacaggtg

SEQ ID NO: 313881 - DNA, 13 bp, Homo sapiens
agctgggatttga

SEQ ID NO: 313882 - DNA, 20 bp, Homo sapiens
agctgggccccatgctctgc

SEQ ID NO: 313883 - DNA, 22 bp, Homo sapiens
agctgggccccatgctctgccc

SEQ ID NO: 313884 - DNA, 14 bp, Homo sapiens
agctgggctctgcc

SEQ ID NO: 313885 - DNA, 23 bp, Homo sapiens
agctggggacagctttcctgggt

SEQ ID NO: 313886 - DNA, 16 bp, Homo sapiens
agctggggagcagctg

SEQ ID NO: 313887 - DNA, 18 bp, Homo sapiens
agctggggcccctcggct

SEQ ID NO: 313888 - DNA, 19 bp, Homo sapiens
agctgggtaccaggccacc

SEQ ID NO: 313889 - DNA, 15 bp, Homo sapiens
agctgggtggcctgt

SEQ ID NO: 313890 - DNA, 20 bp, Homo sapiens
agctgggtggggacagtgat

SEQ ID NO: 313891 - DNA, 17 bp, Homo sapiens
agctgggttttcctagt

SEQ ID NO: 313892 - DNA, 15 bp, Homo sapiens
agctggtagttagta

SEQ ID NO: 313893 - DNA, 18 bp, Homo sapiens
agctggtgcattacagag

SEQ ID NO: 313894 - DNA, 19 bp, Homo sapiens
agctggtgcattacagaga

SEQ ID NO: 313895 - DNA, 20 bp, Homo sapiens
agctggtgcattacagagag

SEQ ID NO: 313896 - DNA, 22 bp, Homo sapiens
agctggtgcattacagagagga

SEQ ID NO: 313897 - DNA, 12 bp, Homo sapiens
agctggtggatg

SEQ ID NO: 313898 - DNA, 20 bp, Homo sapiens
agctggtggatggtgacttt

SEQ ID NO: 313899 - DNA, 19 bp, Homo sapiens
agctggtggctgtgtactt

SEQ ID NO: 313900 - DNA, 15 bp, Homo sapiens
agctggtggtgcagc

SEQ ID NO: 313901 - DNA, 21 bp, Homo sapiens
agctggtgtcactctgcctct

SEQ ID NO: 313902 - DNA, 17 bp, Homo sapiens
agctgtaaatacatgtg

SEQ ID NO: 313903 - DNA, 20 bp, Homo sapiens
agctgtaaatacatgtgtgg

SEQ ID NO: 313904 - DNA, 18 bp, Homo sapiens
agctgtaagaagagactg

SEQ ID NO: 313905 - DNA, 14 bp, Homo sapiens
agctgtactcagag

SEQ ID NO: 313906 - DNA, 16 bp, Homo sapiens
agctgtactgagttct

SEQ ID NO: 313907 - DNA, 19 bp, Homo sapiens
agctgtacttcgtcttcta

SEQ ID NO: 313908 - DNA, 15 bp, Homo sapiens
agctgtagccatggc

SEQ ID NO: 313909 - DNA, 21 bp, Homo sapiens
agctgtagccatggctcaggc

SEQ ID NO: 313910 - DNA, 17 bp, Homo sapiens
agctgtagctcccgagc

SEQ ID NO: 313911 - DNA, 23 bp, Homo sapiens
agctgtatatttgaaactgctaa

SEQ ID NO: 313912 - DNA, 16 bp, Homo sapiens
agctgtcctctcagaa

SEQ ID NO: 313913 - DNA, 19 bp, Homo sapiens
agctgtctggtgatcactt

SEQ ID NO: 313914 - DNA, 11 bp, Homo sapiens
agctgtcttgt

SEQ ID NO: 313915 - DNA, 23 bp, Homo sapiens
agctgtgaaatgtgcaagagtat

SEQ ID NO: 313916 - DNA, 14 bp, Homo sapiens
agctgtgaggacag

SEQ ID NO: 313917 - DNA, 13 bp, Homo sapiens
agctgtgcagtgg

SEQ ID NO: 313918 - DNA, 23 bp, Homo sapiens
agctgtgtcctagttcttgaaca

SEQ ID NO: 313919 - DNA, 11 bp, Homo sapiens
agctgtgtctc

SEQ ID NO: 313920 - DNA, 16 bp, Homo sapiens
agctgtgtgttttcaa

SEQ ID NO: 313921 - DNA, 21 bp, Homo sapiens
agctgtgttttgtctgagcct

SEQ ID NO: 313922 - DNA, 23 bp, Homo sapiens
agctgtgttttgtctgagcctct

SEQ ID NO: 313923 - DNA, 16 bp, Homo sapiens
agctgttactttcttt

SEQ ID NO: 313924 - DNA, 14 bp, Homo sapiens
agctgttatcttgt

SEQ ID NO: 313925 - DNA, 19 bp, Homo sapiens
agctgttcaacaagagtaa

SEQ ID NO: 313926 - DNA, 21 bp, Homo sapiens
acatcatttctttttgggaga

SEQ ID NO: 313927 - DNA, 19 bp, Homo sapiens
acatccaggcaatggccta

SEQ ID NO: 313928 - DNA, 18 bp, Homo sapiens
acatccatgtttgtaaaa

SEQ ID NO: 313929 - DNA, 16 bp, Homo sapiens
acatcccaataaagtc

SEQ ID NO: 313930 - DNA, 13 bp, Homo sapiens
acatcccagcagc

SEQ ID NO: 313931 - DNA, 15 bp, Homo sapiens
acatcccaggagggg

SEQ ID NO: 313932 - DNA, 23 bp, Homo sapiens
acatccccaccctcccctctcct

SEQ ID NO: 313933 - DNA, 15 bp, Homo sapiens
acatcccggcctctt

SEQ ID NO: 313934 - DNA, 18 bp, Homo sapiens
acatcccggcctcttcca

SEQ ID NO: 313935 - DNA, 14 bp, Homo sapiens
acatcctcaaaaga

SEQ ID NO: 313936 - DNA, 14 bp, Homo sapiens
acatcctccgtcca

SEQ ID NO: 313937 - DNA, 21 bp, Homo sapiens
acatcctgacctcctggactg

SEQ ID NO: 313938 - DNA, 14 bp, Homo sapiens
acatcgccctccac

SEQ ID NO: 313939 - DNA, 21 bp, Homo sapiens
acatcggttcaggaggagaca

SEQ ID NO: 313940 - DNA, 22 bp, Homo sapiens
acatcgttcgatttaagccatc

SEQ ID NO: 313941 - DNA, 18 bp, Homo sapiens
acatctaaattgatcatt

SEQ ID NO: 313942 - DNA, 18 bp, Homo sapiens
agcttagattttctgtaa

SEQ ID NO: 313943 - DNA, 19 bp, Homo sapiens
agcttagattttctgtaaa

SEQ ID NO: 313944 - DNA, 15 bp, Homo sapiens
agcttagccttgtgc

SEQ ID NO: 313945 - DNA, 15 bp, Homo sapiens
agcttagtgtataca

SEQ ID NO: 313946 - DNA, 17 bp, Homo sapiens
agcttatctccctgctt

SEQ ID NO: 313947 - DNA, 18 bp, Homo sapiens
agcttatctccctgcttc

SEQ ID NO: 313948 - DNA, 14 bp, Homo sapiens
agcttattggccac

SEQ ID NO: 313949 - DNA, 20 bp, Homo sapiens
agcttattggccactgggtc

SEQ ID NO: 313950 - DNA, 19 bp, Homo sapiens
agcttatttagcacatttt

SEQ ID NO: 313951 - DNA, 15 bp, Homo sapiens
agcttatttctaact

SEQ ID NO: 313952 - DNA, 16 bp, Homo sapiens
agcttcaaaacagaac

SEQ ID NO: 313953 - DNA, 16 bp, Homo sapiens
agcttcaagtctgtgc

SEQ ID NO: 313954 - DNA, 17 bp, Homo sapiens
agcttcaagtctgtgcc

SEQ ID NO: 313955 - DNA, 15 bp, Homo sapiens
agcttcaccagagca

SEQ ID NO: 313956 - DNA, 14 bp, Homo sapiens
agcttcagggctgg

SEQ ID NO: 313957 - DNA, 17 bp, Homo sapiens
agcttcagggctgggca

SEQ ID NO: 313958 - DNA, 18 bp, Homo sapiens
agcttcagtctctgcagt

SEQ ID NO: 313959 - DNA, 17 bp, Homo sapiens
agcttcatataccagca

SEQ ID NO: 313960 - DNA, 22 bp, Homo sapiens
agcttcatgcctttgtaagtta

SEQ ID NO: 313961 - DNA, 13 bp, Homo sapiens
agcttcatttgtg

SEQ ID NO: 313962 - DNA, 18 bp, Homo sapiens
agcttccacctgtccctc

SEQ ID NO: 313963 - DNA, 15 bp, Homo sapiens
agcttccagctctaa

SEQ ID NO: 313964 - DNA, 15 bp, Homo sapiens
agcttcccaacaata

SEQ ID NO: 313965 - DNA, 13 bp, Homo sapiens
agcttcctccaga

SEQ ID NO: 313966 - DNA, 18 bp, Homo sapiens
agcttcctgtttctaagt

SEQ ID NO: 313967 - DNA, 23 bp, Homo sapiens
agcttcctttgtttttttttcct

SEQ ID NO: 313968 - DNA, 19 bp, Homo sapiens
agcttcggagggcccctgc

SEQ ID NO: 313969 - DNA, 20 bp, Homo sapiens
agcttcggagggcccctgcg

SEQ ID NO: 313970 - DNA, 18 bp, Homo sapiens
agcttctatcccaggagg

SEQ ID NO: 313971 - DNA, 15 bp, Homo sapiens
agcttctgacctcag

SEQ ID NO: 313972 - DNA, 17 bp, Homo sapiens
agcttctgacctcagca

SEQ ID NO: 313973 - DNA, 16 bp, Homo sapiens
agcttctggtactctc

SEQ ID NO: 313974 - DNA, 20 bp, Homo sapiens
agcttctggtactctcctag

SEQ ID NO: 313975 - DNA, 20 bp, Homo sapiens
agcttcttaatataactgcc

SEQ ID NO: 313976 - DNA, 20 bp, Homo sapiens
agcttcttgctgccaggccc

SEQ ID NO: 313977 - DNA, 22 bp, Homo sapiens
agcttgaatgtccccattctat

SEQ ID NO: 313978 - DNA, 12 bp, Homo sapiens
agcttgagcctc

SEQ ID NO: 313979 - DNA, 13 bp, Homo sapiens
agcttgagcctcc

SEQ ID NO: 313980 - DNA, 14 bp, Homo sapiens
agcttgagcctccc

SEQ ID NO: 313981 - DNA, 22 bp, Homo sapiens
agcttgagctcccctggagcca

SEQ ID NO: 313982 - DNA, 16 bp, Homo sapiens
agcttgctgcacccca

SEQ ID NO: 313983 - DNA, 16 bp, Homo sapiens
agcttgctgccctagg

SEQ ID NO: 313984 - DNA, 20 bp, Homo sapiens
agcttgctgccctaggctcc

SEQ ID NO: 313985 - DNA, 20 bp, Homo sapiens
agcttgcttcattgggctgt

SEQ ID NO: 313986 - DNA, 22 bp, Homo sapiens
agcttgggagagcccctggggc

SEQ ID NO: 313987 - DNA, 17 bp, Homo sapiens
agcttgggcccagctgg

SEQ ID NO: 313988 - DNA, 19 bp, Homo sapiens
agcttgggcccagctgggc

SEQ ID NO: 313989 - DNA, 20 bp, Homo sapiens
agcttgggcccagctgggct

SEQ ID NO: 313990 - DNA, 16 bp, Homo sapiens
agcttggttcctgccc

SEQ ID NO: 313991 - DNA, 21 bp, Homo sapiens
agcttgtatagtgtaaaataa

SEQ ID NO: 313992 - DNA, 16 bp, Homo sapiens
agcttgtattatcagt

SEQ ID NO: 313993 - DNA, 23 bp, Homo sapiens
agcttgtggccccttttactttt

SEQ ID NO: 313994 - DNA, 15 bp, Homo sapiens
agcttgtttccctgc

SEQ ID NO: 313995 - DNA, 12 bp, Homo sapiens
agcttgtttcta

SEQ ID NO: 313996 - DNA, 13 bp, Homo sapiens
agcttgtttctat

SEQ ID NO: 313997 - DNA, 23 bp, Homo sapiens
agcttgttttggactttgttaca

SEQ ID NO: 313998 - DNA, 16 bp, Homo sapiens
agctttaaaaaataaa

SEQ ID NO: 313999 - DNA, 15 bp, Homo sapiens
agctttacatgcaat

SEQ ID NO: 314000 - DNA, 13 bp, Homo sapiens
agctttacatttt

SEQ ID NO: 314001 - DNA, 20 bp, Homo sapiens
agctttaccctcaggcatag

SEQ ID NO: 314002 - DNA, 22 bp, Homo sapiens
agctttattttttaagtattta

SEQ ID NO: 314003 - DNA, 17 bp, Homo sapiens
agctttcaagtgccttt

SEQ ID NO: 314004 - DNA, 13 bp, Homo sapiens
agctttcagagcc

SEQ ID NO: 314005 - DNA, 17 bp, Homo sapiens
agctttcagagccagtg

SEQ ID NO: 314006 - DNA, 12 bp, Homo sapiens
agctttcccagg

SEQ ID NO: 314007 - DNA, 19 bp, Homo sapiens
agctttccctggctcaggg

SEQ ID NO: 314008 - DNA, 21 bp, Homo sapiens
agctttccggggaggagcctt

SEQ ID NO: 314009 - DNA, 13 bp, Homo sapiens
agctttcctgccc

SEQ ID NO: 314010 - DNA, 13 bp, Homo sapiens
agctttcctgggt

SEQ ID NO: 314011 - DNA, 15 bp, Homo sapiens
agctttcctgggtga

SEQ ID NO: 314012 - DNA, 13 bp, Homo sapiens
agctttctccttt

SEQ ID NO: 314013 - DNA, 19 bp, Homo sapiens
agctttctctgcttcagct

SEQ ID NO: 314014 - DNA, 21 bp, Homo sapiens
agctttctctgcttcagcttg

SEQ ID NO: 314015 - DNA, 16 bp, Homo sapiens
agctttctgatactta

SEQ ID NO: 314016 - DNA, 20 bp, Homo sapiens
agctttctgtccttttggca

SEQ ID NO: 314017 - DNA, 22 bp, Homo sapiens
agctttctgtccttttggcact

SEQ ID NO: 314018 - DNA, 12 bp, Homo sapiens
agctttcttttt

SEQ ID NO: 314019 - DNA, 16 bp, Homo sapiens
agctttgaacaattgt

SEQ ID NO: 314020 - DNA, 21 bp, Homo sapiens
agctttgcagccaaggtgcta

SEQ ID NO: 314021 - DNA, 12 bp, Homo sapiens
agctttggacac

SEQ ID NO: 314022 - DNA, 14 bp, Homo sapiens
agctttggacacac

SEQ ID NO: 314023 - DNA, 21 bp, Homo sapiens
agctttggacacacacagctt

SEQ ID NO: 314024 - DNA, 21 bp, Homo sapiens
agctttggacgcacacagctt

SEQ ID NO: 314025 - DNA, 18 bp, Homo sapiens
agcttttaataaaattga

SEQ ID NO: 314026 - DNA, 19 bp, Homo sapiens
agcttttaataaaattgac

SEQ ID NO: 314027 - DNA, 17 bp, Homo sapiens
agcttttagtacccacc

SEQ ID NO: 314028 - DNA, 19 bp, Homo sapiens
agcttttattgtataaact

SEQ ID NO: 314029 - DNA, 16 bp, Homo sapiens
agcttttcatggaagt

SEQ ID NO: 314030 - DNA, 13 bp, Homo sapiens
agcttttcctttc

SEQ ID NO: 314031 - DNA, 12 bp, Homo sapiens
agcttttgatgt

SEQ ID NO: 314032 - DNA, 17 bp, Homo sapiens
agcttttgttctagact

SEQ ID NO: 314033 - DNA, 23 bp, Homo sapiens
agcttttgttctagacttcccca

SEQ ID NO: 314034 - DNA, 17 bp, Homo sapiens
agctttttaaaacatta

SEQ ID NO: 314035 - DNA, 14 bp, Homo sapiens
agctttttgtatta

SEQ ID NO: 314036 - DNA, 13 bp, Homo sapiens
aggaaaaaaactt

SEQ ID NO: 314037 - DNA, 14 bp, Homo sapiens
aggaaaaaaacttt

SEQ ID NO: 314038 - DNA, 20 bp, Homo sapiens
aggaaaaacagaacatttct

SEQ ID NO: 314039 - DNA, 16 bp, Homo sapiens
aggaaaaacctgtggg

SEQ ID NO: 314040 - DNA, 23 bp, Homo sapiens
aggaaaactgaatccatctttgt

SEQ ID NO: 314041 - DNA, 23 bp, Homo sapiens
aggaaaagagtatcaaaggcaga

SEQ ID NO: 314042 - DNA, 14 bp, Homo sapiens
aggaaaaggctggc

SEQ ID NO: 314043 - DNA, 15 bp, Homo sapiens
aggaaacagaaaaga

SEQ ID NO: 314044 - DNA, 21 bp, Homo sapiens
aggaaactcacctgctggccc

SEQ ID NO: 314045 - DNA, 22 bp, Homo sapiens
aggaaactcacctgctggcccc

SEQ ID NO: 314046 - DNA, 20 bp, Homo sapiens
aggaaactcctgacagtctt

SEQ ID NO: 314047 - DNA, 17 bp, Homo sapiens
aggaaactgaggcccag

SEQ ID NO: 314048 - DNA, 13 bp, Homo sapiens
aggaaagaggctc

SEQ ID NO: 314049 - DNA, 16 bp, Homo sapiens
aggaaagaggctctgg

SEQ ID NO: 314050 - DNA, 20 bp, Homo sapiens
aggaaagatcccaagtcaaa

SEQ ID NO: 314051 - DNA, 16 bp, Homo sapiens
aggaaagcaataaatg

SEQ ID NO: 314052 - DNA, 19 bp, Homo sapiens
aggaaagcaataaatgaat

SEQ ID NO: 314053 - DNA, 20 bp, Homo sapiens
aggaaagcaccgcagcatgt

SEQ ID NO: 314054 - DNA, 21 bp, Homo sapiens
aggaaagcaccgcagcatgtg

SEQ ID NO: 314055 - DNA, 16 bp, Homo sapiens
aggaaagcgtttggaa

SEQ ID NO: 314056 - DNA, 12 bp, Homo sapiens
aggaaaggcaga

SEQ ID NO: 314057 - DNA, 13 bp, Homo sapiens
aggaaaggtagcc

SEQ ID NO: 314058 - DNA, 21 bp, Homo sapiens
aggaaataaaacctttcaaat

SEQ ID NO: 314059 - DNA, 15 bp, Homo sapiens
aggaaataacattgc

SEQ ID NO: 314060 - DNA, 17 bp, Homo sapiens
aggaaataacattgcac

SEQ ID NO: 314061 - DNA, 18 bp, Homo sapiens
aggaaatagtgttctttt

SEQ ID NO: 314062 - DNA, 15 bp, Homo sapiens
aggaaatccagcccc

SEQ ID NO: 314063 - DNA, 16 bp, Homo sapiens
aggaaatccagcccca

SEQ ID NO: 314064 - DNA, 17 bp, Homo sapiens
acattgccttgcatttg

SEQ ID NO: 314065 - DNA, 21 bp, Homo sapiens
acattgctagcgagccgcctc

SEQ ID NO: 314066 - DNA, 17 bp, Homo sapiens
acattgtaaatagtatt

SEQ ID NO: 314067 - DNA, 19 bp, Homo sapiens
acattgtaaatagtatttg

SEQ ID NO: 314068 - DNA, 21 bp, Homo sapiens
acattgtataggccatctgta

SEQ ID NO: 314069 - DNA, 22 bp, Homo sapiens
acattgtataggccatctgtaa

SEQ ID NO: 314070 - DNA, 23 bp, Homo sapiens
acattgtataggccatctgtaaa

SEQ ID NO: 314071 - DNA, 12 bp, Homo sapiens
acattgtcaata

SEQ ID NO: 314072 - DNA, 21 bp, Homo sapiens
accaccactgtccctaccact

SEQ ID NO: 314073 - DNA, 16 bp, Homo sapiens
accaccagatgagaag

SEQ ID NO: 314074 - DNA, 18 bp, Homo sapiens
accaccagatgagaagtt

SEQ ID NO: 314075 - DNA, 16 bp, Homo sapiens
accaccagccccagca

SEQ ID NO: 314076 - DNA, 22 bp, Homo sapiens
accaccccagctgctcccctcc

SEQ ID NO: 314077 - DNA, 18 bp, Homo sapiens
accacccctccctctgct

SEQ ID NO: 314078 - DNA, 19 bp, Homo sapiens
accacccctccctctgctc

SEQ ID NO: 314079 - DNA, 21 bp, Homo sapiens
accacccctccctctgctctc

SEQ ID NO: 314080 - DNA, 23 bp, Homo sapiens
accaccctatcatcagttaggat

SEQ ID NO: 314081 - DNA, 22 bp, Homo sapiens
accaccgcatatgcatgccagg

SEQ ID NO: 314082 - DNA, 23 bp, Homo sapiens
accaccgccctcctcgctgtgcc

SEQ ID NO: 314083 - DNA, 14 bp, Homo sapiens
accaccgctcccca

SEQ ID NO: 314084 - DNA, 21 bp, Homo sapiens
accaccgctccccagcccagg

SEQ ID NO: 314085 - DNA, 23 bp, Homo sapiens
accaccgctccccagcccagggt

SEQ ID NO: 314086 - DNA, 16 bp, Homo sapiens
accacctcactcctgt

SEQ ID NO: 314087 - DNA, 23 bp, Homo sapiens
accacctctcaatattcaataaa

SEQ ID NO: 314088 - DNA, 15 bp, Homo sapiens
accacctctctgtct

SEQ ID NO: 314089 - DNA, 19 bp, Homo sapiens
accaccttctgtccccagc

SEQ ID NO: 314090 - DNA, 20 bp, Homo sapiens
accaccttctgtccccagcc

SEQ ID NO: 314091 - DNA, 12 bp, Homo sapiens
accaccttgcca

SEQ ID NO: 314092 - DNA, 17 bp, Homo sapiens
accaccttttattacat

SEQ ID NO: 314093 - DNA, 20 bp, Homo sapiens
accacggacgtttccatcag

SEQ ID NO: 314094 - DNA, 13 bp, Homo sapiens
accacgtctgcca

SEQ ID NO: 314095 - DNA, 14 bp, Homo sapiens
accacgtctgccag

SEQ ID NO: 314096 - DNA, 18 bp, Homo sapiens
accacgtctgccaggccc

SEQ ID NO: 314097 - DNA, 23 bp, Homo sapiens
accacgtctgccaggcccatctc

SEQ ID NO: 314098 - DNA, 17 bp, Homo sapiens
accactaaccatcccca

SEQ ID NO: 314099 - DNA, 22 bp, Homo sapiens
accactaatgcttgccaagaaa

SEQ ID NO: 314100 - DNA, 15 bp, Homo sapiens
accactatgaagcta

SEQ ID NO: 314101 - DNA, 18 bp, Homo sapiens
accactatgcaaagaact

SEQ ID NO: 314102 - DNA, 20 bp, Homo sapiens
accactcaaattaatctttc

SEQ ID NO: 314103 - DNA, 15 bp, Homo sapiens
accactgagcccttg

SEQ ID NO: 314104 - DNA, 13 bp, Homo sapiens
accactgccctgc

SEQ ID NO: 314105 - DNA, 14 bp, Homo sapiens
accactgccctgcc

SEQ ID NO: 314106 - DNA, 19 bp, Homo sapiens
accactgccctgcctgccc

SEQ ID NO: 314107 - DNA, 22 bp, Homo sapiens
accactgccctgcctgcccact

SEQ ID NO: 314108 - DNA, 14 bp, Homo sapiens
accactgctaataa

SEQ ID NO: 314109 - DNA, 17 bp, Homo sapiens
accactgctaataaatg

SEQ ID NO: 314110 - DNA, 18 bp, Homo sapiens
accactgctaataaatga

SEQ ID NO: 314111 - DNA, 19 bp, Homo sapiens
accactgtaaaatgaaatt

SEQ ID NO: 314112 - DNA, 22 bp, Homo sapiens
accactgtccctaccactgagc

SEQ ID NO: 314113 - DNA, 15 bp, Homo sapiens
accacttaatcttct

SEQ ID NO: 314114 - DNA, 14 bp, Homo sapiens
accacttatttcta

SEQ ID NO: 314115 - DNA, 16 bp, Homo sapiens
accacttatttctaaa

SEQ ID NO: 314116 - DNA, 13 bp, Homo sapiens
accacttcattct

SEQ ID NO: 314117 - DNA, 14 bp, Homo sapiens
accacttgtcacta

SEQ ID NO: 314118 - DNA, 20 bp, Homo sapiens
accacttgtcactacaaaaa

SEQ ID NO: 314119 - DNA, 22 bp, Homo sapiens
accactttccttttctattcct

SEQ ID NO: 314120 - DNA, 13 bp, Homo sapiens
accactttttgca

SEQ ID NO: 314121 - DNA, 14 bp, Homo sapiens
accactttttgcag

SEQ ID NO: 314122 - DNA, 18 bp, Homo sapiens
accactttttgcagcttt

SEQ ID NO: 314123 - DNA, 19 bp, Homo sapiens
accagaaaatatgatatat

SEQ ID NO: 314124 - DNA, 16 bp, Homo sapiens
accagaacgcacccca

SEQ ID NO: 314125 - DNA, 13 bp, Homo sapiens
accagaagtttct

SEQ ID NO: 314126 - DNA, 23 bp, Homo sapiens
accagaattagtcctcacagcct

SEQ ID NO: 314127 - DNA, 13 bp, Homo sapiens
accagactgcagg

SEQ ID NO: 314128 - DNA, 16 bp, Homo sapiens
accagactgcaggttg

SEQ ID NO: 314129 - DNA, 21 bp, Homo sapiens
accagactttggctcccgctt

SEQ ID NO: 314130 - DNA, 13 bp, Homo sapiens
accagagagaaag

SEQ ID NO: 314131 - DNA, 13 bp, Homo sapiens
accagagccatgg

SEQ ID NO: 314132 - DNA, 15 bp, Homo sapiens
accagagccccccac

SEQ ID NO: 314133 - DNA, 21 bp, Homo sapiens
accagagcctatggaaagggt

SEQ ID NO: 314134 - DNA, 17 bp, Homo sapiens
accagagctctggagcc

SEQ ID NO: 314135 - DNA, 18 bp, Homo sapiens
accagagctctggagcca

SEQ ID NO: 314136 - DNA, 15 bp, Homo sapiens
accagagctgtctga

SEQ ID NO: 314137 - DNA, 11 bp, Homo sapiens
accagatgcta

SEQ ID NO: 314138 - DNA, 14 bp, Homo sapiens
accagatgctactg

SEQ ID NO: 314139 - DNA, 20 bp, Homo sapiens
accagatgctgaaagagaaa

SEQ ID NO: 314140 - DNA, 18 bp, Homo sapiens
accagcaggtgtggtggc

SEQ ID NO: 314141 - DNA, 17 bp, Homo sapiens
accagcagtcacaggtc

SEQ ID NO: 314142 - DNA, 14 bp, Homo sapiens
accagccagcgcag

SEQ ID NO: 314143 - DNA, 13 bp, Homo sapiens
accagccccagca

SEQ ID NO: 314144 - DNA, 13 bp, Homo sapiens
accagccccctgg

SEQ ID NO: 314145 - DNA, 16 bp, Homo sapiens
accagccccctggatg

SEQ ID NO: 314146 - DNA, 17 bp, Homo sapiens
accagccccctggatgg

SEQ ID NO: 314147 - DNA, 21 bp, Homo sapiens
accagccccctggatgggcat

SEQ ID NO: 314148 - DNA, 15 bp, Homo sapiens
accagcccggcctgc

SEQ ID NO: 314149 - DNA, 17 bp, Homo sapiens
accagccctccagagca

SEQ ID NO: 314150 - DNA, 21 bp, Homo sapiens
accagccctgctgcttcctaa

SEQ ID NO: 314151 - DNA, 15 bp, Homo sapiens
accagccctggggct

SEQ ID NO: 314152 - DNA, 18 bp, Homo sapiens
accagccctggggctggg

SEQ ID NO: 314153 - DNA, 15 bp, Homo sapiens
accagcccttccctg

SEQ ID NO: 314154 - DNA, 14 bp, Homo sapiens
accagcctccatgc

SEQ ID NO: 314155 - DNA, 21 bp, Homo sapiens
accagcctccatgctgcctcc

SEQ ID NO: 314156 - DNA, 13 bp, Homo sapiens
accagcctgagcc

SEQ ID NO: 314157 - DNA, 15 bp, Homo sapiens
accagcctgagccac

SEQ ID NO: 314158 - DNA, 23 bp, Homo sapiens
accagcctgagccacagtggggc

SEQ ID NO: 314159 - DNA, 13 bp, Homo sapiens
accagcctttctt

SEQ ID NO: 314160 - DNA, 14 bp, Homo sapiens
accagcctttcttc

SEQ ID NO: 314161 - DNA, 14 bp, Homo sapiens
accagcgcccgctg

SEQ ID NO: 314162 - DNA, 15 bp, Homo sapiens
accagcgcccgctgg

SEQ ID NO: 314163 - DNA, 23 bp, Homo sapiens
accagcgcccgctgggctgagcc

SEQ ID NO: 314164 - DNA, 18 bp, Homo sapiens
accagctattggaacaga

SEQ ID NO: 314165 - DNA, 15 bp, Homo sapiens
accagctcagccccg

SEQ ID NO: 314166 - DNA, 21 bp, Homo sapiens
accagctcagccccggccact

SEQ ID NO: 314167 - DNA, 18 bp, Homo sapiens
accagctccactggcctg

SEQ ID NO: 314168 - DNA, 11 bp, Homo sapiens
accagctccca

SEQ ID NO: 314169 - DNA, 19 bp, Homo sapiens
accagctcccaacagaggc

SEQ ID NO: 314170 - DNA, 17 bp, Homo sapiens
accagctctgtggcctg

SEQ ID NO: 314171 - DNA, 18 bp, Homo sapiens
accagctctgtggcctgt

SEQ ID NO: 314172 - DNA, 23 bp, Homo sapiens
accagctctgtggcctgtgtcca

SEQ ID NO: 314173 - DNA, 13 bp, Homo sapiens
accagctgctctg

SEQ ID NO: 314174 - DNA, 18 bp, Homo sapiens
accagctgctctgcccct

SEQ ID NO: 314175 - DNA, 19 bp, Homo sapiens
accagctgctctgcccctt

SEQ ID NO: 314176 - DNA, 17 bp, Homo sapiens
accaggaacctcttcag

SEQ ID NO: 314177 - DNA, 14 bp, Homo sapiens
accaggactccctc

SEQ ID NO: 314178 - DNA, 12 bp, Homo sapiens
accaggagccag

SEQ ID NO: 314179 - DNA, 13 bp, Homo sapiens
accaggagccagg

SEQ ID NO: 314180 - DNA, 21 bp, Homo sapiens
accaggagctagcccagtccc

SEQ ID NO: 314181 - DNA, 19 bp, Homo sapiens
accaggaggggtctgcctc

SEQ ID NO: 314182 - DNA, 20 bp, Homo sapiens
accaggaggggtctgcctcc

SEQ ID NO: 314183 - DNA, 11 bp, Homo sapiens
accaggccacc

SEQ ID NO: 314184 - DNA, 14 bp, Homo sapiens
accagggactgcag

SEQ ID NO: 314185 - DNA, 14 bp, Homo sapiens
accagggaggagag

SEQ ID NO: 314186 - DNA, 16 bp, Homo sapiens
accagggaggagagga

SEQ ID NO: 314187 - DNA, 20 bp, Homo sapiens
accagggtccgcaccagctg

SEQ ID NO: 314188 - DNA, 14 bp, Homo sapiens
accaggtcctgtga

SEQ ID NO: 314189 - DNA, 19 bp, Homo sapiens
accaggtcctgtgagcaaa

SEQ ID NO: 314190 - DNA, 17 bp, Homo sapiens
accaggtcttgacctga

SEQ ID NO: 314191 - DNA, 19 bp, Homo sapiens
accaggtgttaaaaaccat

SEQ ID NO: 314192 - DNA, 23 bp, Homo sapiens
accaggtgttctacactcatctt

SEQ ID NO: 314193 - DNA, 18 bp, Homo sapiens
accagtagtcacctctgg

SEQ ID NO: 314194 - DNA, 16 bp, Homo sapiens
accagtataaaattac

SEQ ID NO: 314195 - DNA, 20 bp, Homo sapiens
accagtatcgctcatagatc

SEQ ID NO: 314196 - DNA, 14 bp, Homo sapiens
accagtcacagcca

SEQ ID NO: 314197 - DNA, 18 bp, Homo sapiens
accagtcgccctctgtgc

SEQ ID NO: 314198 - DNA, 19 bp, Homo sapiens
accagtcgccctctgtgcc

SEQ ID NO: 314199 - DNA, 12 bp, Homo sapiens
accagtctgtct

SEQ ID NO: 314200 - DNA, 15 bp, Homo sapiens
accagtgagacagcc

SEQ ID NO: 314201 - DNA, 23 bp, Homo sapiens
accagtgcccaaagtctgtgtga

SEQ ID NO: 314202 - DNA, 14 bp, Homo sapiens
accagtgtactgct

SEQ ID NO: 314203 - DNA, 23 bp, Homo sapiens
aggaggaggcaattgggatggcg

SEQ ID NO: 314204 - DNA, 15 bp, Homo sapiens
aggaggatgctgtgc

SEQ ID NO: 314205 - DNA, 14 bp, Homo sapiens
aggaggcagaacca

SEQ ID NO: 314206 - DNA, 22 bp, Homo sapiens
aggaggcagaataagaaaacaa

SEQ ID NO: 314207 - DNA, 16 bp, Homo sapiens
aggaggcagccccctc

SEQ ID NO: 314208 - DNA, 20 bp, Homo sapiens
aggaggcagccccctccaca

SEQ ID NO: 314209 - DNA, 18 bp, Homo sapiens
aggaggcagtggcttgga

SEQ ID NO: 314210 - DNA, 17 bp, Homo sapiens
aggaggcagtttttgtt

SEQ ID NO: 314211 - DNA, 18 bp, Homo sapiens
aggaggcccctggcccag

SEQ ID NO: 314212 - DNA, 20 bp, Homo sapiens
aggaggcggcagctcttctg

SEQ ID NO: 314213 - DNA, 16 bp, Homo sapiens
aggaggctggaggaag

SEQ ID NO: 314214 - DNA, 16 bp, Homo sapiens
acccattcactacagg

SEQ ID NO: 314215 - DNA, 19 bp, Homo sapiens
acccattcccccatgtggc

SEQ ID NO: 314216 - DNA, 21 bp, Homo sapiens
acccattgtctcattgccagt

SEQ ID NO: 314217 - DNA, 20 bp, Homo sapiens
acccatttgccatgctgcta

SEQ ID NO: 314218 - DNA, 16 bp, Homo sapiens
accccaaaccccagcc

SEQ ID NO: 314219 - DNA, 18 bp, Homo sapiens
accccaaaccccagcccc

SEQ ID NO: 314220 - DNA, 15 bp, Homo sapiens
accccaaacttccag

SEQ ID NO: 314221 - DNA, 16 bp, Homo sapiens
accccaaacttccagg

SEQ ID NO: 314222 - DNA, 15 bp, Homo sapiens
accccaaagcccctt

SEQ ID NO: 314223 - DNA, 16 bp, Homo sapiens
accccaaagccccttg

SEQ ID NO: 314224 - DNA, 18 bp, Homo sapiens
accccaaagccccttgct

SEQ ID NO: 314225 - DNA, 18 bp, Homo sapiens
accccaaagctttcctgc

SEQ ID NO: 314226 - DNA, 15 bp, Homo sapiens
accccaactcccagc

SEQ ID NO: 314227 - DNA, 14 bp, Homo sapiens
accccaactctccc

SEQ ID NO: 314228 - DNA, 22 bp, Homo sapiens
accccaagtccacctgcctatc

SEQ ID NO: 314229 - DNA, 15 bp, Homo sapiens
accccaattaactga

SEQ ID NO: 314230 - DNA, 20 bp, Homo sapiens
accccaattaactgaagcaa

SEQ ID NO: 314231 - DNA, 22 bp, Homo sapiens
accccacaccaggccgtcctcc

SEQ ID NO: 314232 - DNA, 15 bp, Homo sapiens
accccacaccccagc

SEQ ID NO: 314233 - DNA, 17 bp, Homo sapiens
accccacaccccagccc

SEQ ID NO: 314234 - DNA, 21 bp, Homo sapiens
accccacacttgttccagctc

SEQ ID NO: 314235 - DNA, 20 bp, Homo sapiens
accccaccacacacaccctt

SEQ ID NO: 314236 - DNA, 11 bp, Homo sapiens
accccacccaa

SEQ ID NO: 314237 - DNA, 13 bp, Homo sapiens
accccacccttcc

SEQ ID NO: 314238 - DNA, 19 bp, Homo sapiens
accccacccttcccctcct

SEQ ID NO: 314239 - DNA, 19 bp, Homo sapiens
accccacctcatgcctggc

SEQ ID NO: 314240 - DNA, 22 bp, Homo sapiens
accccacctcatgcctggcccc

SEQ ID NO: 314241 - DNA, 22 bp, Homo sapiens
accccaccttgccaagctttct

SEQ ID NO: 314242 - DNA, 21 bp, Homo sapiens
accccacctttattccttcat

SEQ ID NO: 314243 - DNA, 17 bp, Homo sapiens
accccacttatgctgct

SEQ ID NO: 314244 - DNA, 20 bp, Homo sapiens
accccagagggaccagctgg

SEQ ID NO: 314245 - DNA, 22 bp, Homo sapiens
accccagagggaccagctgggg

SEQ ID NO: 314246 - DNA, 21 bp, Homo sapiens
accccagcattccagctctgc

SEQ ID NO: 314247 - DNA, 12 bp, Homo sapiens
accccagcccac

SEQ ID NO: 314248 - DNA, 16 bp, Homo sapiens
accccagcccaccctg

SEQ ID NO: 314249 - DNA, 21 bp, Homo sapiens
accccagcccaccctgctcct

SEQ ID NO: 314250 - DNA, 13 bp, Homo sapiens
accccagccccaa

SEQ ID NO: 314251 - DNA, 15 bp, Homo sapiens
accccagcctgacct

SEQ ID NO: 314252 - DNA, 22 bp, Homo sapiens
accccagcctggccacgcagcc

SEQ ID NO: 314253 - DNA, 11 bp, Homo sapiens
accccagctcc

SEQ ID NO: 314254 - DNA, 22 bp, Homo sapiens
accccaggccataccaggtgct

SEQ ID NO: 314255 - DNA, 16 bp, Homo sapiens
accccaggttttctgc

SEQ ID NO: 314256 - DNA, 19 bp, Homo sapiens
accccagtgcctgtctgga

SEQ ID NO: 314257 - DNA, 13 bp, Homo sapiens
accccatctgctg

SEQ ID NO: 314258 - DNA, 14 bp, Homo sapiens
accccatctgctga

SEQ ID NO: 314259 - DNA, 19 bp, Homo sapiens
acccccaaagacctgcctg

SEQ ID NO: 314260 - DNA, 20 bp, Homo sapiens
acccccaagaaacctccatc

SEQ ID NO: 314261 - DNA, 22 bp, Homo sapiens
acccccaattaaacccagaacc

SEQ ID NO: 314262 - DNA, 13 bp, Homo sapiens
acccccaccacta

SEQ ID NO: 314263 - DNA, 19 bp, Homo sapiens
acccccaccactcttgact

SEQ ID NO: 314264 - DNA, 13 bp, Homo sapiens
acccccacccacc

SEQ ID NO: 314265 - DNA, 21 bp, Homo sapiens
acccccacccacctccaccca

SEQ ID NO: 314266 - DNA, 17 bp, Homo sapiens
acccccaccccacactt

SEQ ID NO: 314267 - DNA, 12 bp, Homo sapiens
acccccacccct

SEQ ID NO: 314268 - DNA, 18 bp, Homo sapiens
acccccacccctgtaccc

SEQ ID NO: 314269 - DNA, 23 bp, Homo sapiens
acccccacccctgtacccagcca

SEQ ID NO: 314270 - DNA, 20 bp, Homo sapiens
acccccacccgttaatttaa

SEQ ID NO: 314271 - DNA, 12 bp, Homo sapiens
acccccaccctt

SEQ ID NO: 314272 - DNA, 14 bp, Homo sapiens
acccccacctcccg

SEQ ID NO: 314273 - DNA, 16 bp, Homo sapiens
acccccagcctccccc

SEQ ID NO: 314274 - DNA, 13 bp, Homo sapiens
acccccaggagga

SEQ ID NO: 314275 - DNA, 16 bp, Homo sapiens
acccccaggaggagag

SEQ ID NO: 314276 - DNA, 14 bp, Homo sapiens
acccccatgctgcc

SEQ ID NO: 314277 - DNA, 19 bp, Homo sapiens
acccccatgctgccttcag

SEQ ID NO: 314278 - DNA, 21 bp, Homo sapiens
acccccatgctgccttcaggg

SEQ ID NO: 314279 - DNA, 15 bp, Homo sapiens
accccccactccctg

SEQ ID NO: 314280 - DNA, 13 bp, Homo sapiens
acccccctgagag

SEQ ID NO: 314281 - DNA, 20 bp, Homo sapiens
acccccgccacggccaccct

SEQ ID NO: 314282 - DNA, 19 bp, Homo sapiens
acccccggcctccaggctg

SEQ ID NO: 314283 - DNA, 20 bp, Homo sapiens
acccccggcctccaggctgg

SEQ ID NO: 314284 - DNA, 16 bp, Homo sapiens
acccccgggtgcctgt

SEQ ID NO: 314285 - DNA, 22 bp, Homo sapiens
accccctccctggcctgttctg

SEQ ID NO: 314286 - DNA, 19 bp, Homo sapiens
accccctctttgtgtactt

SEQ ID NO: 314287 - DNA, 17 bp, Homo sapiens
accccctgccccagaga

SEQ ID NO: 314288 - DNA, 18 bp, Homo sapiens
accccctgccccagagaa

SEQ ID NO: 314289 - DNA, 19 bp, Homo sapiens
accccctgccccagagaag

SEQ ID NO: 314290 - DNA, 21 bp, Homo sapiens
accccctgtcccattctagat

SEQ ID NO: 314291 - DNA, 14 bp, Homo sapiens
acccccttctctgc

SEQ ID NO: 314292 - DNA, 16 bp, Homo sapiens
acccccttctctgctc

SEQ ID NO: 314293 - DNA, 16 bp, Homo sapiens
acccccttgtctgctg

SEQ ID NO: 314294 - DNA, 13 bp, Homo sapiens
accccctttgctg

SEQ ID NO: 314295 - DNA, 15 bp, Homo sapiens
accccgcggtgctct

SEQ ID NO: 314296 - DNA, 17 bp, Homo sapiens
accccgcggtgctctgg

SEQ ID NO: 314297 - DNA, 21 bp, Homo sapiens
accccgctgcctggcgggcag

SEQ ID NO: 314298 - DNA, 17 bp, Homo sapiens
accccggcaggccctgc

SEQ ID NO: 314299 - DNA, 18 bp, Homo sapiens
accccggcaggccctgca

SEQ ID NO: 314300 - DNA, 19 bp, Homo sapiens
accccggctccccctgcca

SEQ ID NO: 314301 - DNA, 15 bp, Homo sapiens
accccgggctctctg

SEQ ID NO: 314302 - DNA, 18 bp, Homo sapiens
accccgggctctctgctg

SEQ ID NO: 314303 - DNA, 18 bp, Homo sapiens
accccgtcccggccccgc

SEQ ID NO: 314304 - DNA, 15 bp, Homo sapiens
accccgtctctacta

SEQ ID NO: 314305 - DNA, 13 bp, Homo sapiens
accccgtctgccc

SEQ ID NO: 314306 - DNA, 14 bp, Homo sapiens
accccgtctgcccc

SEQ ID NO: 314307 - DNA, 16 bp, Homo sapiens
accccgtctgcccctt

SEQ ID NO: 314308 - DNA, 22 bp, Homo sapiens
acccctaaagagatactttgat

SEQ ID NO: 314309 - DNA, 16 bp, Homo sapiens
acccctcaagccagga

SEQ ID NO: 314310 - DNA, 18 bp, Homo sapiens
acccctcaagccaggaga

SEQ ID NO: 314311 - DNA, 20 bp, Homo sapiens
acccctcaagccaggagacc

SEQ ID NO: 314312 - DNA, 16 bp, Homo sapiens
acccctcaccttgcaa

SEQ ID NO: 314313 - DNA, 22 bp, Homo sapiens
acccctcaccttgcaacacaca

SEQ ID NO: 314314 - DNA, 23 bp, Homo sapiens
acccctcaccttgcaacacacag

SEQ ID NO: 314315 - DNA, 18 bp, Homo sapiens
acccctcagcgctccctg

SEQ ID NO: 314316 - DNA, 18 bp, Homo sapiens
acccctccctctgctctc

SEQ ID NO: 314317 - DNA, 11 bp, Homo sapiens
acccctccctt

SEQ ID NO: 314318 - DNA, 16 bp, Homo sapiens
acccctccttccctgg

SEQ ID NO: 314319 - DNA, 22 bp, Homo sapiens
acccctccttccctggtccaga

SEQ ID NO: 314320 - DNA, 18 bp, Homo sapiens
acccctcttcccccttcc

SEQ ID NO: 314321 - DNA, 19 bp, Homo sapiens
acccctcttcccccttccc

SEQ ID NO: 314322 - DNA, 22 bp, Homo sapiens
acccctcttcccccttcccctg

SEQ ID NO: 314323 - DNA, 12 bp, Homo sapiens
acccctgcaggc

SEQ ID NO: 314324 - DNA, 21 bp, Homo sapiens
acccctgctcccagcctgctg

SEQ ID NO: 314325 - DNA, 22 bp, Homo sapiens
acccctgctcccattcctccct

SEQ ID NO: 314326 - DNA, 21 bp, Homo sapiens
acccctgctgccgccactggc

SEQ ID NO: 314327 - DNA, 11 bp, Homo sapiens
acccctggctg

SEQ ID NO: 314328 - DNA, 13 bp, Homo sapiens
acccctggctggt

SEQ ID NO: 314329 - DNA, 11 bp, Homo sapiens
acccctgggca

SEQ ID NO: 314330 - DNA, 10 bp, Homo sapiens
acccctgtac

SEQ ID NO: 314331 - DNA, 19 bp, Homo sapiens
acccctgtacccagccacc

SEQ ID NO: 314332 - DNA, 21 bp, Homo sapiens
acccctgtctgcgccgctgtg

SEQ ID NO: 314333 - DNA, 21 bp, Homo sapiens
acccttctactttttccttcc

SEQ ID NO: 314334 - DNA, 17 bp, Homo sapiens
acccttctcccctgccc

SEQ ID NO: 314335 - DNA, 15 bp, Homo sapiens
acccttctgctttct

SEQ ID NO: 314336 - DNA, 20 bp, Homo sapiens
acccttgagacctggaacca

SEQ ID NO: 314337 - DNA, 12 bp, Homo sapiens
acccttggcctg

SEQ ID NO: 314338 - DNA, 16 bp, Homo sapiens
acccttggtagagttt

SEQ ID NO: 314339 - DNA, 18 bp, Homo sapiens
acccttggtagagtttat

SEQ ID NO: 314340 - DNA, 20 bp, Homo sapiens
accctttcctcctttatcac

SEQ ID NO: 314341 - DNA, 21 bp, Homo sapiens
accctttcttgacaaaaccta

SEQ ID NO: 314342 - DNA, 23 bp, Homo sapiens
accctttgctgtgaggctgtcct

SEQ ID NO: 314343 - DNA, 23 bp, Homo sapiens
accctttggggggggcccgcctg

SEQ ID NO: 314344 - DNA, 14 bp, Homo sapiens
acccttttggcccc

SEQ ID NO: 314345 - DNA, 17 bp, Homo sapiens
accgagcaaagatcaaa

SEQ ID NO: 314346 - DNA, 11 bp, Homo sapiens
accgagccagc

SEQ ID NO: 314347 - DNA, 12 bp, Homo sapiens
accgagccagca

SEQ ID NO: 314348 - DNA, 17 bp, Homo sapiens
accgaggctggagctgg

SEQ ID NO: 314349 - DNA, 18 bp, Homo sapiens
accgaggctggagctggc

SEQ ID NO: 314350 - DNA, 16 bp, Homo sapiens
accgagtatctgtaac

SEQ ID NO: 314351 - DNA, 17 bp, Homo sapiens
accgagtctcttctcca

SEQ ID NO: 314352 - DNA, 21 bp, Homo sapiens
accgagtctcttctccactgg

SEQ ID NO: 314353 - DNA, 17 bp, Homo sapiens
accgatggagcccccag

SEQ ID NO: 314354 - DNA, 21 bp, Homo sapiens
accgatggtcccaggaagcag

SEQ ID NO: 314355 - DNA, 15 bp, Homo sapiens
accgcaatatgggag

SEQ ID NO: 314356 - DNA, 17 bp, Homo sapiens
aggcagccccctccaca

SEQ ID NO: 314357 - DNA, 13 bp, Homo sapiens
aggcagcctccag

SEQ ID NO: 314358 - DNA, 14 bp, Homo sapiens
aggcagcctccaga

SEQ ID NO: 314359 - DNA, 16 bp, Homo sapiens
aggcagcctccagagc

SEQ ID NO: 314360 - DNA, 18 bp, Homo sapiens
aggcagcctccagagcca

SEQ ID NO: 314361 - DNA, 19 bp, Homo sapiens
aggcagcctccagagccag

SEQ ID NO: 314362 - DNA, 12 bp, Homo sapiens
aggcagcctgcc

SEQ ID NO: 314363 - DNA, 16 bp, Homo sapiens
aggcagctcacccctg

SEQ ID NO: 314364 - DNA, 21 bp, Homo sapiens
aggcagctcacccctgggcag

SEQ ID NO: 314365 - DNA, 22 bp, Homo sapiens
aggcagctcacccctgggcagg

SEQ ID NO: 314366 - DNA, 14 bp, Homo sapiens
aggcagctcccagg

SEQ ID NO: 314367 - DNA, 17 bp, Homo sapiens
aggcagctgaaaagtaa

SEQ ID NO: 314368 - DNA, 18 bp, Homo sapiens
aggcagctgaaaagtaaa

SEQ ID NO: 314369 - DNA, 13 bp, Homo sapiens
aggcagctgctct

SEQ ID NO: 314370 - DNA, 18 bp, Homo sapiens
aggcagctggatgagact

SEQ ID NO: 314371 - DNA, 22 bp, Homo sapiens
aggcagctggatgagacttcca

SEQ ID NO: 314372 - DNA, 17 bp, Homo sapiens
aggcaggaagggcagga

SEQ ID NO: 314373 - DNA, 17 bp, Homo sapiens
aggcaggaagtcaggag

SEQ ID NO: 314374 - DNA, 19 bp, Homo sapiens
aggcaggaagtcaggagcc

SEQ ID NO: 314375 - DNA, 20 bp, Homo sapiens
aggcaggaagtcaggagcca

SEQ ID NO: 314376 - DNA, 24 bp, Homo sapiens
aggcaggaagtcaggagccagcag

SEQ ID NO: 314377 - DNA, 19 bp, Homo sapiens
aggcaggaggccattccag

SEQ ID NO: 314378 - DNA, 17 bp, Homo sapiens
aggcaggaggtgggtga

SEQ ID NO: 314379 - DNA, 13 bp, Homo sapiens
aggcaggcacctg

SEQ ID NO: 314380 - DNA, 21 bp, Homo sapiens
aggcaggccaaggccttctcc

SEQ ID NO: 314381 - DNA, 21 bp, Homo sapiens
aggcagggagggaaacccggg

SEQ ID NO: 314382 - DNA, 14 bp, Homo sapiens
aggcagggcagagg

SEQ ID NO: 314383 - DNA, 12 bp, Homo sapiens
aggcagggccct

SEQ ID NO: 314384 - DNA, 14 bp, Homo sapiens
aggcagggccctgg

SEQ ID NO: 314385 - DNA, 15 bp, Homo sapiens
aggcaggggagtctg

SEQ ID NO: 314386 - DNA, 18 bp, Homo sapiens
aggcaggggagtctgctt

SEQ ID NO: 314387 - DNA, 21 bp, Homo sapiens
aggcaggggctctgcttcctc

SEQ ID NO: 314388 - DNA, 22 bp, Homo sapiens
aggcagtatggcggaggccatg

SEQ ID NO: 314389 - DNA, 13 bp, Homo sapiens
aggcagtccagag

SEQ ID NO: 314390 - DNA, 15 bp, Homo sapiens
aggcagtctgaaccc

SEQ ID NO: 314391 - DNA, 14 bp, Homo sapiens
aggcagtctttgct

SEQ ID NO: 314392 - DNA, 19 bp, Homo sapiens
aggcagtgcatgtgaagca

SEQ ID NO: 314393 - DNA, 16 bp, Homo sapiens
aggcagtggggctggg

SEQ ID NO: 314394 - DNA, 21 bp, Homo sapiens
aggcagttagagatgcctccc

SEQ ID NO: 314395 - DNA, 15 bp, Homo sapiens
aggcagtttttgttc

SEQ ID NO: 314396 - DNA, 17 bp, Homo sapiens
aggcatactctccagga

SEQ ID NO: 314397 - DNA, 13 bp, Homo sapiens
aggcataggcctg

SEQ ID NO: 314398 - DNA, 21 bp, Homo sapiens
aggcatctgtaagaagtagag

SEQ ID NO: 314399 - DNA, 14 bp, Homo sapiens
aggcatgaccctgg

SEQ ID NO: 314400 - DNA, 11 bp, Homo sapiens
aggcatgagct

SEQ ID NO: 314401 - DNA, 14 bp, Homo sapiens
aggcatgcctgtgt

SEQ ID NO: 314402 - DNA, 15 bp, Homo sapiens
aggcatgcctgtgtg

SEQ ID NO: 314403 - DNA, 20 bp, Homo sapiens
aggcatgcgaatgagctggg

SEQ ID NO: 314404 - DNA, 23 bp, Homo sapiens
aggcatgctcccagcatttgtcc

SEQ ID NO: 314405 - DNA, 14 bp, Homo sapiens
aggcatgctggcct

SEQ ID NO: 314406 - DNA, 16 bp, Homo sapiens
aggcatggcccagcct

SEQ ID NO: 314407 - DNA, 20 bp, Homo sapiens
aggcatttctatcacatatt

SEQ ID NO: 314408 - DNA, 20 bp, Homo sapiens
aggcatttgtaaatattaaa

SEQ ID NO: 314409 - DNA, 23 bp, Homo sapiens
aggcatttttactactattctgt

SEQ ID NO: 314410 - DNA, 13 bp, Homo sapiens
aggccaaaaaaat

SEQ ID NO: 314411 - DNA, 17 bp, Homo sapiens
aggccaagcctgcagct

SEQ ID NO: 314412 - DNA, 17 bp, Homo sapiens
aggccaaggtgggcgga

SEQ ID NO: 314413 - DNA, 15 bp, Homo sapiens
aggccaagtgcaggc

SEQ ID NO: 314414 - DNA, 21 bp, Homo sapiens
aggccaagtgcaggctggcac

SEQ ID NO: 314415 - DNA, 16 bp, Homo sapiens
aggccacaggccactg

SEQ ID NO: 314416 - DNA, 17 bp, Homo sapiens
aggccacaggccactgc

SEQ ID NO: 314417 - DNA, 13 bp, Homo sapiens
aggccaccccaaa

SEQ ID NO: 314418 - DNA, 23 bp, Homo sapiens
aggccaccccctatcctctgagt

SEQ ID NO: 314419 - DNA, 20 bp, Homo sapiens
aggccacctccaaggactct

SEQ ID NO: 314420 - DNA, 14 bp, Homo sapiens
aggccacctgcccc

SEQ ID NO: 314421 - DNA, 17 bp, Homo sapiens
aggccacctgccccctt

SEQ ID NO: 314422 - DNA, 21 bp, Homo sapiens
aggccacctgcccccttctcc

SEQ ID NO: 314423 - DNA, 16 bp, Homo sapiens
aggccacgctcctctg

SEQ ID NO: 314424 - DNA, 16 bp, Homo sapiens
aggccacgggggaggc

SEQ ID NO: 314425 - DNA, 19 bp, Homo sapiens
aggccacgtatagtcctag

SEQ ID NO: 314426 - DNA, 22 bp, Homo sapiens
aggccacgtatagtcctagctg

SEQ ID NO: 314427 - DNA, 21 bp, Homo sapiens
aggccactgcaaaccctgctg

SEQ ID NO: 314428 - DNA, 14 bp, Homo sapiens
aggccactgtggcc

SEQ ID NO: 314429 - DNA, 15 bp, Homo sapiens
aggccactgtggcca

SEQ ID NO: 314430 - DNA, 21 bp, Homo sapiens
aggccactgtggccagagctg

SEQ ID NO: 314431 - DNA, 22 bp, Homo sapiens
aggccactgtggccagagctgg

SEQ ID NO: 314432 - DNA, 14 bp, Homo sapiens
aggccacttgctca

SEQ ID NO: 314433 - DNA, 17 bp, Homo sapiens
aggccagccccacccag

SEQ ID NO: 314434 - DNA, 21 bp, Homo sapiens
aggccagccccacccaggagg

SEQ ID NO: 314435 - DNA, 22 bp, Homo sapiens
aggccagccctccctggctgtg

SEQ ID NO: 314436 - DNA, 16 bp, Homo sapiens
aggccagccctggttc

SEQ ID NO: 314437 - DNA, 17 bp, Homo sapiens
aggccagccctggttct

SEQ ID NO: 314438 - DNA, 22 bp, Homo sapiens
aggccagcgaggcgaggctgcc

SEQ ID NO: 314439 - DNA, 20 bp, Homo sapiens
aggccagctccttttctgtg

SEQ ID NO: 314440 - DNA, 20 bp, Homo sapiens
aggccagctgtggttttctt

SEQ ID NO: 314441 - DNA, 23 bp, Homo sapiens
aggccaggcatggcccagcctgg

SEQ ID NO: 314442 - DNA, 17 bp, Homo sapiens
aggccaggccctcctgc

SEQ ID NO: 314443 - DNA, 21 bp, Homo sapiens
aggccaggccctcctgctggc

SEQ ID NO: 314444 - DNA, 10 bp, Homo sapiens
aggccaggtc

SEQ ID NO: 314445 - DNA, 16 bp, Homo sapiens
aggccaggtccctgga

SEQ ID NO: 314446 - DNA, 15 bp, Homo sapiens
aggccagtgagctgt

SEQ ID NO: 314447 - DNA, 21 bp, Homo sapiens
aggccagtggacagagggaga

SEQ ID NO: 314448 - DNA, 19 bp, Homo sapiens
aggccatgattcgcccaaa

SEQ ID NO: 314449 - DNA, 21 bp, Homo sapiens
aggccatgattcgcccaaagc

SEQ ID NO: 314450 - DNA, 16 bp, Homo sapiens
aggccatgtgagccac

SEQ ID NO: 314451 - DNA, 22 bp, Homo sapiens
aggcccacctaccttcaaagct

SEQ ID NO: 314452 - DNA, 23 bp, Homo sapiens
aggcccacctaccttcaaagctg

SEQ ID NO: 314453 - DNA, 13 bp, Homo sapiens
aggcccagcagac

SEQ ID NO: 314454 - DNA, 15 bp, Homo sapiens
aggcccagcagagcc

SEQ ID NO: 314455 - DNA, 13 bp, Homo sapiens
aggcccagctggg

SEQ ID NO: 314456 - DNA, 24 bp, Homo sapiens
aggcccagctggggcccctcggct

SEQ ID NO: 314457 - DNA, 21 bp, Homo sapiens
aggcccaggatatttctgaga

SEQ ID NO: 314458 - DNA, 12 bp, Homo sapiens
aggcccatctca

SEQ ID NO: 314459 - DNA, 20 bp, Homo sapiens
aggcccatctcaggtgccac

SEQ ID NO: 314460 - DNA, 22 bp, Homo sapiens
aggcccatctcaggtgccactc

SEQ ID NO: 314461 - DNA, 13 bp, Homo sapiens
aggccccagagac

SEQ ID NO: 314462 - DNA, 14 bp, Homo sapiens
aggccccagagact

SEQ ID NO: 314463 - DNA, 22 bp, Homo sapiens
aggcgtgggatccagagagaag

SEQ ID NO: 314464 - DNA, 14 bp, Homo sapiens
aggcgttggtgcca

SEQ ID NO: 314465 - DNA, 19 bp, Homo sapiens
aggctaaaaacattttaaa

SEQ ID NO: 314466 - DNA, 21 bp, Homo sapiens
aggctaagatgagatttgcca

SEQ ID NO: 314467 - DNA, 15 bp, Homo sapiens
aggctaatcaatacc

SEQ ID NO: 314468 - DNA, 22 bp, Homo sapiens
aggctaatcaatacccttggca

SEQ ID NO: 314469 - DNA, 13 bp, Homo sapiens
aggctacttttca

SEQ ID NO: 314470 - DNA, 21 bp, Homo sapiens
aggctagaatggaaaactgcc

SEQ ID NO: 314471 - DNA, 22 bp, Homo sapiens
aggctagtccggacccacctca

SEQ ID NO: 314472 - DNA, 19 bp, Homo sapiens
aggctattcctaggcctca

SEQ ID NO: 314473 - DNA, 14 bp, Homo sapiens
aggctatttgttca

SEQ ID NO: 314474 - DNA, 23 bp, Homo sapiens
aggctccaccttaactgtgctca

SEQ ID NO: 314475 - DNA, 14 bp, Homo sapiens
aggctccaggctga

SEQ ID NO: 314476 - DNA, 18 bp, Homo sapiens
aggctccaggctgactgg

SEQ ID NO: 314477 - DNA, 18 bp, Homo sapiens
aggctcccaatcagcttt

SEQ ID NO: 314478 - DNA, 20 bp, Homo sapiens
aggctcccagacccagggca

SEQ ID NO: 314479 - DNA, 18 bp, Homo sapiens
aggctccccgcctccact

SEQ ID NO: 314480 - DNA, 23 bp, Homo sapiens
aggctccgggctttcccccaggc

SEQ ID NO: 314481 - DNA, 21 bp, Homo sapiens
aggctcctccttgcccagact

SEQ ID NO: 314482 - DNA, 12 bp, Homo sapiens
aggctcctggag

SEQ ID NO: 314483 - DNA, 14 bp, Homo sapiens
aggctcctggagcc

SEQ ID NO: 314484 - DNA, 23 bp, Homo sapiens
aggctctaattctctaggaaagt

SEQ ID NO: 314485 - DNA, 15 bp, Homo sapiens
aggctctcaccccca

SEQ ID NO: 314486 - DNA, 21 bp, Homo sapiens
aggctctccctctctgcacct

SEQ ID NO: 314487 - DNA, 20 bp, Homo sapiens
aggctctgaaagctgcttct

SEQ ID NO: 314488 - DNA, 19 bp, Homo sapiens
aggctctgacccagtgaga

SEQ ID NO: 314489 - DNA, 19 bp, Homo sapiens
aggctctgaggggatgcaa

SEQ ID NO: 314490 - DNA, 13 bp, Homo sapiens
aggctctgcacag

SEQ ID NO: 314491 - DNA, 17 bp, Homo sapiens
aggctctgctgacttct

SEQ ID NO: 314492 - DNA, 19 bp, Homo sapiens
aggctctgggctcagggct

SEQ ID NO: 314493 - DNA, 23 bp, Homo sapiens
aggctctgggctcagggctggag

SEQ ID NO: 314494 - DNA, 19 bp, Homo sapiens
aggctcttagcagcttcca

SEQ ID NO: 314495 - DNA, 16 bp, Homo sapiens
aggctcttcctggacc

SEQ ID NO: 314496 - DNA, 19 bp, Homo sapiens
acctcgcggcgcagcccct

SEQ ID NO: 314497 - DNA, 20 bp, Homo sapiens
acctcgcggcgcagcccctg

SEQ ID NO: 314498 - DNA, 20 bp, Homo sapiens
acctcggctgtgtggggagg

SEQ ID NO: 314499 - DNA, 19 bp, Homo sapiens
acctcggcttgtgggctgg

SEQ ID NO: 314500 - DNA, 21 bp, Homo sapiens
acctcggcttgtgggctggtg

SEQ ID NO: 314501 - DNA, 23 bp, Homo sapiens
acctcgtgtctagtagaacaatg

SEQ ID NO: 314502 - DNA, 18 bp, Homo sapiens
acctctaacaccacactg

SEQ ID NO: 314503 - DNA, 20 bp, Homo sapiens
acctctaacaccacactgac

SEQ ID NO: 314504 - DNA, 19 bp, Homo sapiens
acctctagccttaaggggg

SEQ ID NO: 314505 - DNA, 18 bp, Homo sapiens
acctctaggcctcagtgt

SEQ ID NO: 314506 - DNA, 20 bp, Homo sapiens
acctctcaatattcaataaa

SEQ ID NO: 314507 - DNA, 14 bp, Homo sapiens
acctctcagatccc

SEQ ID NO: 314508 - DNA, 23 bp, Homo sapiens
acctctccaagtctctctgtgaa

SEQ ID NO: 314509 - DNA, 16 bp, Homo sapiens
acctctccagcctcag

SEQ ID NO: 314510 - DNA, 22 bp, Homo sapiens
acctctccagcctcagctctca

SEQ ID NO: 314511 - DNA, 12 bp, Homo sapiens
acctctccctca

SEQ ID NO: 314512 - DNA, 15 bp, Homo sapiens
acctctctctgctcc

SEQ ID NO: 314513 - DNA, 18 bp, Homo sapiens
acctctctctgctcctca

SEQ ID NO: 314514 - DNA, 19 bp, Homo sapiens
acctctctctgctcctcac

SEQ ID NO: 314515 - DNA, 12 bp, Homo sapiens
acctctgaggac

SEQ ID NO: 314516 - DNA, 13 bp, Homo sapiens
acctctgatacct

SEQ ID NO: 314517 - DNA, 15 bp, Homo sapiens
acctctgatacctca

SEQ ID NO: 314518 - DNA, 15 bp, Homo sapiens
acctctgctgcccac

SEQ ID NO: 314519 - DNA, 16 bp, Homo sapiens
acctctgctgcccacg

SEQ ID NO: 314520 - DNA, 23 bp, Homo sapiens
acctctgctgcccacggccaccc

SEQ ID NO: 314521 - DNA, 23 bp, Homo sapiens
acctctggccaaatatgcacttt

SEQ ID NO: 314522 - DNA, 10 bp, Homo sapiens
acctctgggc

SEQ ID NO: 314523 - DNA, 14 bp, Homo sapiens
acctctgggccctg

SEQ ID NO: 314524 - DNA, 22 bp, Homo sapiens
acctctgggccctgcaggaggc

SEQ ID NO: 314525 - DNA, 11 bp, Homo sapiens
acctctgggct

SEQ ID NO: 314526 - DNA, 13 bp, Homo sapiens
acctctgggcttc

SEQ ID NO: 314527 - DNA, 14 bp, Homo sapiens
acctcttccaggaa

SEQ ID NO: 314528 - DNA, 20 bp, Homo sapiens
acctcttccaggaagcacag

SEQ ID NO: 314529 - DNA, 22 bp, Homo sapiens
acctcttccaggaagcacaggc

SEQ ID NO: 314530 - DNA, 22 bp, Homo sapiens
acctcttccccagaaaggagac

SEQ ID NO: 314531 - DNA, 15 bp, Homo sapiens
acctcttgtgctgag

SEQ ID NO: 314532 - DNA, 20 bp, Homo sapiens
acctcttttgagactttgcc

SEQ ID NO: 314533 - DNA, 15 bp, Homo sapiens
acctgaaaaaaagtt

SEQ ID NO: 314534 - DNA, 14 bp, Homo sapiens
acctgaaacacttt

SEQ ID NO: 314535 - DNA, 15 bp, Homo sapiens
acctgaactctgcaa

SEQ ID NO: 314536 - DNA, 16 bp, Homo sapiens
acctgaactctgcaac

SEQ ID NO: 314537 - DNA, 18 bp, Homo sapiens
acctgaagagcgctcctc

SEQ ID NO: 314538 - DNA, 19 bp, Homo sapiens
acctgaaggattattaagc

SEQ ID NO: 314539 - DNA, 23 bp, Homo sapiens
acctgaagggtgacatcccagga

SEQ ID NO: 314540 - DNA, 20 bp, Homo sapiens
acctgaatgcttctgagagc

SEQ ID NO: 314541 - DNA, 22 bp, Homo sapiens
acctgacagatgtcagccgagc

SEQ ID NO: 314542 - DNA, 19 bp, Homo sapiens
acctgacgtagctgcaaag

SEQ ID NO: 314543 - DNA, 17 bp, Homo sapiens
acctgactcaggcatca

SEQ ID NO: 314544 - DNA, 22 bp, Homo sapiens
acctgactcgtctgactgtgtg

SEQ ID NO: 314545 - DNA, 15 bp, Homo sapiens
acctgagacgggcat

SEQ ID NO: 314546 - DNA, 22 bp, Homo sapiens
acctgagactgtcggagaggct

SEQ ID NO: 314547 - DNA, 15 bp, Homo sapiens
acctgagctccccac

SEQ ID NO: 314548 - DNA, 18 bp, Homo sapiens
acctgagctgccatccag

SEQ ID NO: 314549 - DNA, 23 bp, Homo sapiens
acctgagctttggacgcacacag

SEQ ID NO: 314550 - DNA, 15 bp, Homo sapiens
acctgaggcccagca

SEQ ID NO: 314551 - DNA, 21 bp, Homo sapiens
acctgaggcccagcagagccg

SEQ ID NO: 314552 - DNA, 16 bp, Homo sapiens
acctgataagggagag

SEQ ID NO: 314553 - DNA, 19 bp, Homo sapiens
acctgataagggagaggga

SEQ ID NO: 314554 - DNA, 22 bp, Homo sapiens
acctgataagggagagggaaat

SEQ ID NO: 314555 - DNA, 21 bp, Homo sapiens
acctgatggcacttagctatc

SEQ ID NO: 314556 - DNA, 14 bp, Homo sapiens
acctgattttcaaa

SEQ ID NO: 314557 - DNA, 22 bp, Homo sapiens
acctgcaagccccagggcctgg

SEQ ID NO: 314558 - DNA, 17 bp, Homo sapiens
acctgcagttcctgagt

SEQ ID NO: 314559 - DNA, 15 bp, Homo sapiens
acctgcatatctcta

SEQ ID NO: 314560 - DNA, 13 bp, Homo sapiens
acctgcatattgt

SEQ ID NO: 314561 - DNA, 18 bp, Homo sapiens
acctgcatcagcctctgg

SEQ ID NO: 314562 - DNA, 22 bp, Homo sapiens
acctgcatcagcctctggccag

SEQ ID NO: 314563 - DNA, 14 bp, Homo sapiens
acctgcatgcagca

SEQ ID NO: 314564 - DNA, 15 bp, Homo sapiens
acctgcatgcagcaa

SEQ ID NO: 314565 - DNA, 23 bp, Homo sapiens
acctgcatgcagcaacacccaag

SEQ ID NO: 314566 - DNA, 14 bp, Homo sapiens
acctgccacaatgt

SEQ ID NO: 314567 - DNA, 19 bp, Homo sapiens
acctgccactaggctgggt

SEQ ID NO: 314568 - DNA, 18 bp, Homo sapiens
acctgccagggcccgacc

SEQ ID NO: 314569 - DNA, 10 bp, Homo sapiens
acctgcccag

SEQ ID NO: 314570 - DNA, 22 bp, Homo sapiens
acctgcccagatcccagaagga

SEQ ID NO: 314571 - DNA, 14 bp, Homo sapiens
acctgccccatccc

SEQ ID NO: 314572 - DNA, 19 bp, Homo sapiens
acctgcccccttctcccac

SEQ ID NO: 314573 - DNA, 22 bp, Homo sapiens
acctgcccccttctcccacact

SEQ ID NO: 314574 - DNA, 16 bp, Homo sapiens
acctgccctgccctgc

SEQ ID NO: 314575 - DNA, 20 bp, Homo sapiens
acctgccctgccctgccacc

SEQ ID NO: 314576 - DNA, 16 bp, Homo sapiens
acctgccctgcctgag

SEQ ID NO: 314577 - DNA, 17 bp, Homo sapiens
acctgccctgcctgagg

SEQ ID NO: 314578 - DNA, 14 bp, Homo sapiens
acctgcctcctgcc

SEQ ID NO: 314579 - DNA, 23 bp, Homo sapiens
acctgcctctgaactgctgctgg

SEQ ID NO: 314580 - DNA, 15 bp, Homo sapiens
acctgcctgtgtgct

SEQ ID NO: 314581 - DNA, 20 bp, Homo sapiens
acctgcctgtgtgctccgga

SEQ ID NO: 314582 - DNA, 14 bp, Homo sapiens
acctgcgcctggct

SEQ ID NO: 314583 - DNA, 16 bp, Homo sapiens
acctgcgcctggctct

SEQ ID NO: 314584 - DNA, 22 bp, Homo sapiens
acctgcgcctggctctgtcacc

SEQ ID NO: 314585 - DNA, 16 bp, Homo sapiens
acctgctccgccagga

SEQ ID NO: 314586 - DNA, 17 bp, Homo sapiens
acctgctgaggcacaga

SEQ ID NO: 314587 - DNA, 15 bp, Homo sapiens
acctgctggcccctc

SEQ ID NO: 314588 - DNA, 18 bp, Homo sapiens
acctgcttcacagtactt

SEQ ID NO: 314589 - DNA, 19 bp, Homo sapiens
acctgcttgtgttgggccc

SEQ ID NO: 314590 - DNA, 23 bp, Homo sapiens
acctgcttgtgttgggccccagg

SEQ ID NO: 314591 - DNA, 17 bp, Homo sapiens
acctggaagagctgggt

SEQ ID NO: 314592 - DNA, 16 bp, Homo sapiens
acctggaccaaagctg

SEQ ID NO: 314593 - DNA, 15 bp, Homo sapiens
acctggagactgtcc

SEQ ID NO: 314594 - DNA, 18 bp, Homo sapiens
acctggagggttgatata

SEQ ID NO: 314595 - DNA, 13 bp, Homo sapiens
acctggcacacca

SEQ ID NO: 314596 - DNA, 22 bp, Homo sapiens
acctggcacaccagaagtgcca

SEQ ID NO: 314597 - DNA, 23 bp, Homo sapiens
acctggcacaccagaagtgccat

SEQ ID NO: 314598 - DNA, 21 bp, Homo sapiens
acctggcacagaaagggcagc

SEQ ID NO: 314599 - DNA, 23 bp, Homo sapiens
acctggccgggtcaccctgtgac

SEQ ID NO: 314600 - DNA, 13 bp, Homo sapiens
acctggcctgctg

SEQ ID NO: 314601 - DNA, 16 bp, Homo sapiens
acctggcttcccagga

SEQ ID NO: 314602 - DNA, 20 bp, Homo sapiens
acctggcttcccaggaccct

SEQ ID NO: 314603 - DNA, 16 bp, Homo sapiens
acctggcttttacttt

SEQ ID NO: 314604 - DNA, 21 bp, Homo sapiens
acctggcttttactttattaa

SEQ ID NO: 314605 - DNA, 17 bp, Homo sapiens
acctgggaaaggaccca

SEQ ID NO: 314606 - DNA, 17 bp, Homo sapiens
acctgggagatgctggg

SEQ ID NO: 314607 - DNA, 22 bp, Homo sapiens
acctgggcaagtgaggcaagag

SEQ ID NO: 314608 - DNA, 18 bp, Homo sapiens
acctgggcacctggggag

SEQ ID NO: 314609 - DNA, 18 bp, Homo sapiens
acctgggctttctggaat

SEQ ID NO: 314610 - DNA, 24 bp, Homo sapiens
acctggggagtgggacagagtctg

SEQ ID NO: 314611 - DNA, 14 bp, Homo sapiens
acctgggtgctctg

SEQ ID NO: 314612 - DNA, 17 bp, Homo sapiens
acctgggttccctttcc

SEQ ID NO: 314613 - DNA, 23 bp, Homo sapiens
acctggtcacaggactctgcctc

SEQ ID NO: 314614 - DNA, 13 bp, Homo sapiens
acctggtgctgga

SEQ ID NO: 314615 - DNA, 15 bp, Homo sapiens
acctgtaaaacttta

SEQ ID NO: 314616 - DNA, 16 bp, Homo sapiens
acctgtaaaactttat

SEQ ID NO: 314617 - DNA, 20 bp, Homo sapiens
acctgtaaaactttatttta

SEQ ID NO: 314618 - DNA, 12 bp, Homo sapiens
acctgtaaatta

SEQ ID NO: 314619 - DNA, 11 bp, Homo sapiens
acctgtaactg

SEQ ID NO: 314620 - DNA, 15 bp, Homo sapiens
acctgtaacttttgt

SEQ ID NO: 314621 - DNA, 20 bp, Homo sapiens
acctgtaacttttgtaaata

SEQ ID NO: 314622 - DNA, 20 bp, Homo sapiens
acctgtaatagcctcacctt

SEQ ID NO: 314623 - DNA, 11 bp, Homo sapiens
acctgtaatca

SEQ ID NO: 314624 - DNA, 15 bp, Homo sapiens
acctgtaatcccagc

SEQ ID NO: 314625 - DNA, 20 bp, Homo sapiens
acctgtagtgagaaactgat

SEQ ID NO: 314626 - DNA, 22 bp, Homo sapiens
acctgtcaatgatacagtccct

SEQ ID NO: 314627 - DNA, 17 bp, Homo sapiens
acctgtcatctgggcca

SEQ ID NO: 314628 - DNA, 11 bp, Homo sapiens
acctgtccaat

SEQ ID NO: 314629 - DNA, 20 bp, Homo sapiens
aggctcttcctggacctgag

SEQ ID NO: 314630 - DNA, 17 bp, Homo sapiens
aggctgaaaagtgcttt

SEQ ID NO: 314631 - DNA, 23 bp, Homo sapiens
aggctgacactgacatttcactt

SEQ ID NO: 314632 - DNA, 22 bp, Homo sapiens
aggctgactcttactaaccacc

SEQ ID NO: 314633 - DNA, 14 bp, Homo sapiens
aggctgactggggg

SEQ ID NO: 314634 - DNA, 23 bp, Homo sapiens
aggctgactgggggcctctgcct

SEQ ID NO: 314635 - DNA, 19 bp, Homo sapiens
aggctgagacgcaaggatc

SEQ ID NO: 314636 - DNA, 17 bp, Homo sapiens
aggctgagactgcagag

SEQ ID NO: 314637 - DNA, 16 bp, Homo sapiens
aggctgagatgcacca

SEQ ID NO: 314638 - DNA, 14 bp, Homo sapiens
aggctgagcaggac

SEQ ID NO: 314639 - DNA, 11 bp, Homo sapiens
aggctgaggac

SEQ ID NO: 314640 - DNA, 18 bp, Homo sapiens
aggctgaggcaagagaat

SEQ ID NO: 314641 - DNA, 14 bp, Homo sapiens
aggctgaggcctgg

SEQ ID NO: 314642 - DNA, 17 bp, Homo sapiens
aggctgagttttctctt

SEQ ID NO: 314643 - DNA, 14 bp, Homo sapiens
aggctgcaagctgc

SEQ ID NO: 314644 - DNA, 17 bp, Homo sapiens
aggctgcaagctgcagg

SEQ ID NO: 314645 - DNA, 15 bp, Homo sapiens
aggctgcactgcagt

SEQ ID NO: 314646 - DNA, 19 bp, Homo sapiens
aggctgcactgcagtgatg

SEQ ID NO: 314647 - DNA, 14 bp, Homo sapiens
aggctgccccaccc

SEQ ID NO: 314648 - DNA, 17 bp, Homo sapiens
aggctgccccacccctc

SEQ ID NO: 314649 - DNA, 15 bp, Homo sapiens
aggctgccggctgca

SEQ ID NO: 314650 - DNA, 24 bp, Homo sapiens
aggctgcctctgggtgagtggctg

SEQ ID NO: 314651 - DNA, 11 bp, Homo sapiens
aggctgcctgg

SEQ ID NO: 314652 - DNA, 17 bp, Homo sapiens
aggctgcctggagaaag

SEQ ID NO: 314653 - DNA, 15 bp, Homo sapiens
aggctgcgcctgccc

SEQ ID NO: 314654 - DNA, 16 bp, Homo sapiens
aggctgcgcctgcccg

SEQ ID NO: 314655 - DNA, 15 bp, Homo sapiens
aggctgctgtaaagt

SEQ ID NO: 314656 - DNA, 13 bp, Homo sapiens
aggctgcttggga

SEQ ID NO: 314657 - DNA, 14 bp, Homo sapiens
aggctggagctggc

SEQ ID NO: 314658 - DNA, 20 bp, Homo sapiens
aggctggagtgcagtggcac

SEQ ID NO: 314659 - DNA, 20 bp, Homo sapiens
aggctggagtgcagtggcgt

SEQ ID NO: 314660 - DNA, 19 bp, Homo sapiens
aggctggcaccgccttctc

SEQ ID NO: 314661 - DNA, 16 bp, Homo sapiens
aggctggcagctctcc

SEQ ID NO: 314662 - DNA, 15 bp, Homo sapiens
aggctggcaggtatg

SEQ ID NO: 314663 - DNA, 14 bp, Homo sapiens
aggctggcctcaga

SEQ ID NO: 314664 - DNA, 11 bp, Homo sapiens
aggctggctga

SEQ ID NO: 314665 - DNA, 20 bp, Homo sapiens
aggctggctgaaaatcacta

SEQ ID NO: 314666 - DNA, 13 bp, Homo sapiens
aggctgggcccag

SEQ ID NO: 314667 - DNA, 18 bp, Homo sapiens
aggctgggcccagaggca

SEQ ID NO: 314668 - DNA, 12 bp, Homo sapiens
aggctggggcct

SEQ ID NO: 314669 - DNA, 14 bp, Homo sapiens
aggctggggcctgg

SEQ ID NO: 314670 - DNA, 15 bp, Homo sapiens
aggctggggcctggc

SEQ ID NO: 314671 - DNA, 17 bp, Homo sapiens
aggctggggcctggcct

SEQ ID NO: 314672 - DNA, 20 bp, Homo sapiens
aggctgggtaatgtgaaggc

SEQ ID NO: 314673 - DNA, 16 bp, Homo sapiens
aggctgggtgcccaca

SEQ ID NO: 314674 - DNA, 22 bp, Homo sapiens
aggctggtctcaaactcctgac

SEQ ID NO: 314675 - DNA, 23 bp, Homo sapiens
aggctgtattttcttttatatct

SEQ ID NO: 314676 - DNA, 12 bp, Homo sapiens
aggctgtcaatt

SEQ ID NO: 314677 - DNA, 18 bp, Homo sapiens
aggctgtcagcgcctcaa

SEQ ID NO: 314678 - DNA, 12 bp, Homo sapiens
aggctgtctggg

SEQ ID NO: 314679 - DNA, 16 bp, Homo sapiens
aggctgtctggggcct

SEQ ID NO: 314680 - DNA, 16 bp, Homo sapiens
aggctgtttttgggtg

SEQ ID NO: 314681 - DNA, 20 bp, Homo sapiens
aggcttaagagagagagcct

SEQ ID NO: 314682 - DNA, 15 bp, Homo sapiens
aggcttccaatgtgg

SEQ ID NO: 314683 - DNA, 15 bp, Homo sapiens
aggcttccaggctct

SEQ ID NO: 314684 - DNA, 18 bp, Homo sapiens
aggcttccaggctcttcc

SEQ ID NO: 314685 - DNA, 21 bp, Homo sapiens
aggcttcccaaaccaagtgcc

SEQ ID NO: 314686 - DNA, 22 bp, Homo sapiens
aggcttcccaaaccaagtgcct

SEQ ID NO: 314687 - DNA, 21 bp, Homo sapiens
aggcttctatgtccaacagag

SEQ ID NO: 314688 - DNA, 12 bp, Homo sapiens
aggcttctccac

SEQ ID NO: 314689 - DNA, 17 bp, Homo sapiens
aggcttggaatgaattc

SEQ ID NO: 314690 - DNA, 15 bp, Homo sapiens
aggcttgggcccagt

SEQ ID NO: 314691 - DNA, 18 bp, Homo sapiens
aggcttgggcccagtagc

SEQ ID NO: 314692 - DNA, 18 bp, Homo sapiens
aggcttgtcagagctggg

SEQ ID NO: 314693 - DNA, 20 bp, Homo sapiens
aggcttgtcagagctgggag

SEQ ID NO: 314694 - DNA, 19 bp, Homo sapiens
aggctttaagctccagctt

SEQ ID NO: 314695 - DNA, 21 bp, Homo sapiens
aggctttgccatgggcctgct

SEQ ID NO: 314696 - DNA, 17 bp, Homo sapiens
aggcttttttccagact

SEQ ID NO: 314697 - DNA, 19 bp, Homo sapiens
agggaaacccggggaactg

SEQ ID NO: 314698 - DNA, 13 bp, Homo sapiens
agggaaagcgggc

SEQ ID NO: 314699 - DNA, 16 bp, Homo sapiens
agggaaatccaactcc

SEQ ID NO: 314700 - DNA, 19 bp, Homo sapiens
agggaaatgctgttggtga

SEQ ID NO: 314701 - DNA, 17 bp, Homo sapiens
agggaaattcacactgt

SEQ ID NO: 314702 - DNA, 23 bp, Homo sapiens
agggaaattcacactgtgcgttt

SEQ ID NO: 314703 - DNA, 14 bp, Homo sapiens
agggaacaggaaaa

SEQ ID NO: 314704 - DNA, 13 bp, Homo sapiens
agggaacatgcag

SEQ ID NO: 314705 - DNA, 16 bp, Homo sapiens
agggaacatgcagctc

SEQ ID NO: 314706 - DNA, 18 bp, Homo sapiens
agggaaccagccctccag

SEQ ID NO: 314707 - DNA, 21 bp, Homo sapiens
agggaactgggaagatgctgg

SEQ ID NO: 314708 - DNA, 23 bp, Homo sapiens
agggaactgggaagatgctggcc

SEQ ID NO: 314709 - DNA, 19 bp, Homo sapiens
agggaagcccacccgcccc

SEQ ID NO: 314710 - DNA, 16 bp, Homo sapiens
agggaagctggccgag

SEQ ID NO: 314711 - DNA, 17 bp, Homo sapiens
agggaaggccacctgca

SEQ ID NO: 314712 - DNA, 20 bp, Homo sapiens
agggaaggggaggcagccgg

SEQ ID NO: 314713 - DNA, 21 bp, Homo sapiens
agggaaggggaggcagccggc

SEQ ID NO: 314714 - DNA, 17 bp, Homo sapiens
agggaatgttccctgca

SEQ ID NO: 314715 - DNA, 18 bp, Homo sapiens
agggaatgttccctgcac

SEQ ID NO: 314716 - DNA, 23 bp, Homo sapiens
agggaatgttccctgcaccctgg

SEQ ID NO: 314717 - DNA, 14 bp, Homo sapiens
agggaattctcttg

SEQ ID NO: 314718 - DNA, 18 bp, Homo sapiens
agggaattgaggtctgct

SEQ ID NO: 314719 - DNA, 12 bp, Homo sapiens
agggaattgctc

SEQ ID NO: 314720 - DNA, 21 bp, Homo sapiens
agggacaagggattctgggaa

SEQ ID NO: 314721 - DNA, 21 bp, Homo sapiens
agggacagcccactgagaagt

SEQ ID NO: 314722 - DNA, 22 bp, Homo sapiens
agggctctgatattccatgaat

SEQ ID NO: 314723 - DNA, 22 bp, Homo sapiens
agggctctggcaggtggccagg

SEQ ID NO: 314724 - DNA, 18 bp, Homo sapiens
agggctgaataaagggaa

SEQ ID NO: 314725 - DNA, 14 bp, Homo sapiens
agggctgagcccct

SEQ ID NO: 314726 - DNA, 18 bp, Homo sapiens
agggctgagcccctcctc

SEQ ID NO: 314727 - DNA, 17 bp, Homo sapiens
agggctgagctgagctt

SEQ ID NO: 314728 - DNA, 22 bp, Homo sapiens
agggctggacctatgtcctaag

SEQ ID NO: 314729 - DNA, 21 bp, Homo sapiens
agggctggagacttcctctgg

SEQ ID NO: 314730 - DNA, 21 bp, Homo sapiens
agggctgggcactcctcccct

SEQ ID NO: 314731 - DNA, 17 bp, Homo sapiens
agggctgggctctgtct

SEQ ID NO: 314732 - DNA, 16 bp, Homo sapiens
agggctggtctctgct

SEQ ID NO: 314733 - DNA, 20 bp, Homo sapiens
agggctgtagacttactttc

SEQ ID NO: 314734 - DNA, 12 bp, Homo sapiens
agggctgtcctt

SEQ ID NO: 314735 - DNA, 15 bp, Homo sapiens
agggctgtggctggg

SEQ ID NO: 314736 - DNA, 18 bp, Homo sapiens
agggctgtggctgggtgg

SEQ ID NO: 314737 - DNA, 18 bp, Homo sapiens
agggcttacctgtacact

SEQ ID NO: 314738 - DNA, 20 bp, Homo sapiens
agggcttatctagccaaaga

SEQ ID NO: 314739 - DNA, 16 bp, Homo sapiens
agggcttcagatattt

SEQ ID NO: 314740 - DNA, 15 bp, Homo sapiens
aggggacagatcttg

SEQ ID NO: 314741 - DNA, 21 bp, Homo sapiens
aggggacagatcttgagcaag

SEQ ID NO: 314742 - DNA, 14 bp, Homo sapiens
aggggacgctggta

SEQ ID NO: 314743 - DNA, 23 bp, Homo sapiens
aggggacgctggtagagatggag

SEQ ID NO: 314744 - DNA, 19 bp, Homo sapiens
aggggacgctttgaaggaa

SEQ ID NO: 314745 - DNA, 12 bp, Homo sapiens
aggggactgcat

SEQ ID NO: 314746 - DNA, 19 bp, Homo sapiens
aggggactgcatgcaagct

SEQ ID NO: 314747 - DNA, 18 bp, Homo sapiens
aggggactgggggactgg

SEQ ID NO: 314748 - DNA, 16 bp, Homo sapiens
aggggagaaactgaaa

SEQ ID NO: 314749 - DNA, 22 bp, Homo sapiens
aggggagaaactgaaagtgttt

SEQ ID NO: 314750 - DNA, 17 bp, Homo sapiens
aggggagaggaagcaca

SEQ ID NO: 314751 - DNA, 17 bp, Homo sapiens
aggggaggacctctggg

SEQ ID NO: 314752 - DNA, 13 bp, Homo sapiens
aggggaggagggc

SEQ ID NO: 314753 - DNA, 14 bp, Homo sapiens
aggggaggagggcg

SEQ ID NO: 314754 - DNA, 11 bp, Homo sapiens
aggggaggctg

SEQ ID NO: 314755 - DNA, 12 bp, Homo sapiens
aggggaggctga

SEQ ID NO: 314756 - DNA, 15 bp, Homo sapiens
aggggaggggcctag

SEQ ID NO: 314757 - DNA, 22 bp, Homo sapiens
aggggaggggcctagggagccg

SEQ ID NO: 314758 - DNA, 12 bp, Homo sapiens
aggggaggtggc

SEQ ID NO: 314759 - DNA, 20 bp, Homo sapiens
aggggatctaaaaggaggac

SEQ ID NO: 314760 - DNA, 23 bp, Homo sapiens
aggggatctaaaaggaggacagg

SEQ ID NO: 314761 - DNA, 18 bp, Homo sapiens
aggggcaacgaagaaaaa

SEQ ID NO: 314762 - DNA, 19 bp, Homo sapiens
aggggcaacgaagaaaaaa

SEQ ID NO: 314763 - DNA, 16 bp, Homo sapiens
aggggcacaccactgc

SEQ ID NO: 314764 - DNA, 19 bp, Homo sapiens
aggggcacaccactgccct

SEQ ID NO: 314765 - DNA, 22 bp, Homo sapiens
aggggcacactacagagcagct

SEQ ID NO: 314766 - DNA, 22 bp, Homo sapiens
aggggcacacttccccttggga

SEQ ID NO: 314767 - DNA, 18 bp, Homo sapiens
aggggcagaaggaggaag

SEQ ID NO: 314768 - DNA, 17 bp, Homo sapiens
aggggcaggagctcaga

SEQ ID NO: 314769 - DNA, 14 bp, Homo sapiens
aggggcaggcctgg

SEQ ID NO: 314770 - DNA, 15 bp, Homo sapiens
aggggcaggcctggg

SEQ ID NO: 314771 - DNA, 13 bp, Homo sapiens
acctgtcccacct

SEQ ID NO: 314772 - DNA, 15 bp, Homo sapiens
acctgtcccacctca

SEQ ID NO: 314773 - DNA, 11 bp, Homo sapiens
acctgtctgtc

SEQ ID NO: 314774 - DNA, 19 bp, Homo sapiens
acctgtcttccaaggagac

SEQ ID NO: 314775 - DNA, 18 bp, Homo sapiens
acctgtgacaaaggatga

SEQ ID NO: 314776 - DNA, 14 bp, Homo sapiens
acctgtgaccagca

SEQ ID NO: 314777 - DNA, 23 bp, Homo sapiens
acctgtgaccagcactgtctcag

SEQ ID NO: 314778 - DNA, 19 bp, Homo sapiens
acctgtgagtttaaagcaa

SEQ ID NO: 314779 - DNA, 16 bp, Homo sapiens
acctgtgctacctcta

SEQ ID NO: 314780 - DNA, 13 bp, Homo sapiens
acctgtgctgctg

SEQ ID NO: 314781 - DNA, 14 bp, Homo sapiens
acctgtgctgctgc

SEQ ID NO: 314782 - DNA, 20 bp, Homo sapiens
acctgtggataaaacattag

SEQ ID NO: 314783 - DNA, 22 bp, Homo sapiens
acctgtggccagagcacctcag

SEQ ID NO: 314784 - DNA, 19 bp, Homo sapiens
acctgtggcctctcagtca

SEQ ID NO: 314785 - DNA, 15 bp, Homo sapiens
acctgtggctctaca

SEQ ID NO: 314786 - DNA, 11 bp, Homo sapiens
acctgtgtctc

SEQ ID NO: 314787 - DNA, 21 bp, Homo sapiens
acctgtgtgtctccataaaag

SEQ ID NO: 314788 - DNA, 18 bp, Homo sapiens
acctgtgtgttcttttga

SEQ ID NO: 314789 - DNA, 19 bp, Homo sapiens
acctgtgtgttcttttgat

SEQ ID NO: 314790 - DNA, 15 bp, Homo sapiens
acctgttatgccaaa

SEQ ID NO: 314791 - DNA, 21 bp, Homo sapiens
acctgttatgccaaacagttg

SEQ ID NO: 314792 - DNA, 18 bp, Homo sapiens
acctgttcagtgtcccgg

SEQ ID NO: 314793 - DNA, 22 bp, Homo sapiens
acctgttcagtgtcccgggccc

SEQ ID NO: 314794 - DNA, 14 bp, Homo sapiens
acctgttttcttca

SEQ ID NO: 314795 - DNA, 16 bp, Homo sapiens
accttaaattaaacaa

SEQ ID NO: 314796 - DNA, 19 bp, Homo sapiens
accttaaattaaacaattt

SEQ ID NO: 314797 - DNA, 14 bp, Homo sapiens
accttacaaccaca

SEQ ID NO: 314798 - DNA, 20 bp, Homo sapiens
accttacaaccacatttctg

SEQ ID NO: 314799 - DNA, 15 bp, Homo sapiens
accttaccaactttc

SEQ ID NO: 314800 - DNA, 18 bp, Homo sapiens
accttaccaactttctgt

SEQ ID NO: 314801 - DNA, 19 bp, Homo sapiens
accttaccaactttctgta

SEQ ID NO: 314802 - DNA, 16 bp, Homo sapiens
accttaccctactggc

SEQ ID NO: 314803 - DNA, 18 bp, Homo sapiens
accttagaaatcattgta

SEQ ID NO: 314804 - DNA, 13 bp, Homo sapiens
accttagcgttct

SEQ ID NO: 314805 - DNA, 19 bp, Homo sapiens
accttagctccctcccgca

SEQ ID NO: 314806 - DNA, 20 bp, Homo sapiens
accttagctccctcccgcac

SEQ ID NO: 314807 - DNA, 11 bp, Homo sapiens
accttatctgt

SEQ ID NO: 314808 - DNA, 20 bp, Homo sapiens
accttattagctaaaaatat

SEQ ID NO: 314809 - DNA, 20 bp, Homo sapiens
accttattgtacctctctta

SEQ ID NO: 314810 - DNA, 15 bp, Homo sapiens
accttcagatcctac

SEQ ID NO: 314811 - DNA, 18 bp, Homo sapiens
accttcagatcctacccc

SEQ ID NO: 314812 - DNA, 19 bp, Homo sapiens
accttcatgcttactattt

SEQ ID NO: 314813 - DNA, 17 bp, Homo sapiens
accttccctagttcttt

SEQ ID NO: 314814 - DNA, 19 bp, Homo sapiens
accttccctctcaccatcc

SEQ ID NO: 314815 - DNA, 12 bp, Homo sapiens
accttcctcact

SEQ ID NO: 314816 - DNA, 16 bp, Homo sapiens
accttcctcacttcca

SEQ ID NO: 314817 - DNA, 17 bp, Homo sapiens
accttcctcacttccat

SEQ ID NO: 314818 - DNA, 16 bp, Homo sapiens
accttcctctggggct

SEQ ID NO: 314819 - DNA, 18 bp, Homo sapiens
accttcctgactgggaag

SEQ ID NO: 314820 - DNA, 12 bp, Homo sapiens
accttcctgggc

SEQ ID NO: 314821 - DNA, 20 bp, Homo sapiens
accttcctgggcagcccaga

SEQ ID NO: 314822 - DNA, 23 bp, Homo sapiens
accttcctgggcagcccagagag

SEQ ID NO: 314823 - DNA, 15 bp, Homo sapiens
accttcctttgtctt

SEQ ID NO: 314824 - DNA, 17 bp, Homo sapiens
accttctagaattataa

SEQ ID NO: 314825 - DNA, 16 bp, Homo sapiens
accttctgacctcccc

SEQ ID NO: 314826 - DNA, 15 bp, Homo sapiens
accttctgtggctca

SEQ ID NO: 314827 - DNA, 16 bp, Homo sapiens
accttcttggcttctg

SEQ ID NO: 314828 - DNA, 18 bp, Homo sapiens
accttgaactcctgggct

SEQ ID NO: 314829 - DNA, 20 bp, Homo sapiens
accttgagaccaagccggtg

SEQ ID NO: 314830 - DNA, 23 bp, Homo sapiens
accttgagaccctcttctctggg

SEQ ID NO: 314831 - DNA, 15 bp, Homo sapiens
accttgcaacacaca

SEQ ID NO: 314832 - DNA, 17 bp, Homo sapiens
accttgcaacacacaga

SEQ ID NO: 314833 - DNA, 21 bp, Homo sapiens
accttgcattttagctaattt

SEQ ID NO: 314834 - DNA, 19 bp, Homo sapiens
accttgccaagctttcttc

SEQ ID NO: 314835 - DNA, 18 bp, Homo sapiens
accttgcctcccctcctc

SEQ ID NO: 314836 - DNA, 20 bp, Homo sapiens
accttgctaattttctcaaa

SEQ ID NO: 314837 - DNA, 14 bp, Homo sapiens
accttggagagctc

SEQ ID NO: 314838 - DNA, 23 bp, Homo sapiens
accttggcgcgcagcccgggaga

SEQ ID NO: 314839 - DNA, 19 bp, Homo sapiens
accttggcgtgtgtccctg

SEQ ID NO: 314840 - DNA, 21 bp, Homo sapiens
accttggcgtgtgtccctgtg

SEQ ID NO: 314841 - DNA, 22 bp, Homo sapiens
accttgtacagaaccagcactc

SEQ ID NO: 314842 - DNA, 22 bp, Homo sapiens
accttgtcatgtaccatcaata

SEQ ID NO: 314843 - DNA, 17 bp, Homo sapiens
accttgtgtgagtgtga

SEQ ID NO: 314844 - DNA, 20 bp, Homo sapiens
accttgttgatgccagctgt

SEQ ID NO: 314845 - DNA, 18 bp, Homo sapiens
accttgttgttgttaaat

SEQ ID NO: 314846 - DNA, 12 bp, Homo sapiens
accttgtttgtt

SEQ ID NO: 314847 - DNA, 15 bp, Homo sapiens
accttgtttgtttta

SEQ ID NO: 314848 - DNA, 14 bp, Homo sapiens
acctttaaaataat

SEQ ID NO: 314849 - DNA, 15 bp, Homo sapiens
acctttatccctgct

SEQ ID NO: 314850 - DNA, 21 bp, Homo sapiens
acctttattaatgaactgtga

SEQ ID NO: 314851 - DNA, 14 bp, Homo sapiens
acctttatttatta

SEQ ID NO: 314852 - DNA, 23 bp, Homo sapiens
acctttatttattaaacttcagc

SEQ ID NO: 314853 - DNA, 16 bp, Homo sapiens
acctttcagctgtgaa

SEQ ID NO: 314854 - DNA, 18 bp, Homo sapiens
acctttcatgtgcctgaa

SEQ ID NO: 314855 - DNA, 17 bp, Homo sapiens
acctttcccacagtctc

SEQ ID NO: 314856 - DNA, 22 bp, Homo sapiens
acctttctaacccactaagtaa

SEQ ID NO: 314857 - DNA, 19 bp, Homo sapiens
acctttcttcactgcagat

SEQ ID NO: 314858 - DNA, 17 bp, Homo sapiens
acctttcttcttgtgtc

SEQ ID NO: 314859 - DNA, 18 bp, Homo sapiens
acctttggcttaattcca

SEQ ID NO: 314860 - DNA, 17 bp, Homo sapiens
acctttgtccaggcctg

SEQ ID NO: 314861 - DNA, 17 bp, Homo sapiens
accttttaaaaaaataa

SEQ ID NO: 314862 - DNA, 22 bp, Homo sapiens
accttttaaaaaaataatataa

SEQ ID NO: 314863 - DNA, 14 bp, Homo sapiens
accttttataccag

SEQ ID NO: 314864 - DNA, 19 bp, Homo sapiens
accttttgaagtagtttgt

SEQ ID NO: 314865 - DNA, 16 bp, Homo sapiens
accttttggcctttgt

SEQ ID NO: 314866 - DNA, 17 bp, Homo sapiens
accttttggcctttgta

SEQ ID NO: 314867 - DNA, 22 bp, Homo sapiens
accttttggcctttgtaagaca

SEQ ID NO: 314868 - DNA, 13 bp, Homo sapiens
acctttttgtaaa

SEQ ID NO: 314869 - DNA, 15 bp, Homo sapiens
acctttttgtaaata

SEQ ID NO: 314870 - DNA, 17 bp, Homo sapiens
acctttttgtaaatact

SEQ ID NO: 314871 - DNA, 15 bp, Homo sapiens
acctttttttctctc

SEQ ID NO: 314872 - DNA, 18 bp, Homo sapiens
acctttttttctctccta

SEQ ID NO: 314873 - DNA, 14 bp, Homo sapiens
acgaaactgctcta

SEQ ID NO: 314874 - DNA, 13 bp, Homo sapiens
acgaaatgttatt

SEQ ID NO: 314875 - DNA, 18 bp, Homo sapiens
acgaacatggcatgtgaa

SEQ ID NO: 314876 - DNA, 12 bp, Homo sapiens
acgaagccttaa

SEQ ID NO: 314877 - DNA, 23 bp, Homo sapiens
acgaagccttaagccataggccc

SEQ ID NO: 314878 - DNA, 22 bp, Homo sapiens
acgaaggggccccggggctggc

SEQ ID NO: 314879 - DNA, 22 bp, Homo sapiens
acgaatataagcttaaaataag

SEQ ID NO: 314880 - DNA, 20 bp, Homo sapiens
acgaattttaaaacatggca

SEQ ID NO: 314881 - DNA, 19 bp, Homo sapiens
acgacttatatatttgaaa

SEQ ID NO: 314882 - DNA, 23 bp, Homo sapiens
acgacttcttcggaggtggcagc

SEQ ID NO: 314883 - DNA, 16 bp, Homo sapiens
acgagatcttccttcc

SEQ ID NO: 314884 - DNA, 19 bp, Homo sapiens
acgagcactggccagagag

SEQ ID NO: 314885 - DNA, 22 bp, Homo sapiens
acgaggaaaagaacaaacaaaa

SEQ ID NO: 314886 - DNA, 15 bp, Homo sapiens
acgaggccttcagaa

SEQ ID NO: 314887 - DNA, 14 bp, Homo sapiens
acgaggctgggcca

SEQ ID NO: 314888 - DNA, 17 bp, Homo sapiens
acgaggctgggccaagc

SEQ ID NO: 314889 - DNA, 12 bp, Homo sapiens
acgagtcacctg

SEQ ID NO: 314890 - DNA, 13 bp, Homo sapiens
acgagtcacctgc

SEQ ID NO: 314891 - DNA, 17 bp, Homo sapiens
acgagtcacctgcaagc

SEQ ID NO: 314892 - DNA, 16 bp, Homo sapiens
acgagtcaccttccag

SEQ ID NO: 314893 - DNA, 17 bp, Homo sapiens
acgagtgggaaggactt

SEQ ID NO: 314894 - DNA, 22 bp, Homo sapiens
acgatgttaaaacaaattaaaa

SEQ ID NO: 314895 - DNA, 18 bp, Homo sapiens
acgatttagaaagaagcc

SEQ ID NO: 314896 - DNA, 18 bp, Homo sapiens
acgcaaaaccactttcct

SEQ ID NO: 314897 - DNA, 20 bp, Homo sapiens
acgcaagggcatcaggcact

SEQ ID NO: 314898 - DNA, 21 bp, Homo sapiens
acgcaagggcatcaggcactg

SEQ ID NO: 314899 - DNA, 14 bp, Homo sapiens
acgcacacacacaa

SEQ ID NO: 314900 - DNA, 18 bp, Homo sapiens
acgcacacacacacacag

SEQ ID NO: 314901 - DNA, 19 bp, Homo sapiens
acgcacacacacacacagg

SEQ ID NO: 314902 - DNA, 20 bp, Homo sapiens
acgcacacacacacacagga

SEQ ID NO: 314903 - DNA, 21 bp, Homo sapiens
acgcacacacacacacaggag

SEQ ID NO: 314904 - DNA, 18 bp, Homo sapiens
aggggcaggcctgggacc

SEQ ID NO: 314905 - DNA, 22 bp, Homo sapiens
aggggcaggcctgggacccagc

SEQ ID NO: 314906 - DNA, 18 bp, Homo sapiens
aggggcagtctggagggg

SEQ ID NO: 314907 - DNA, 21 bp, Homo sapiens
aggggcatccaaggcaaacaa

SEQ ID NO: 314908 - DNA, 18 bp, Homo sapiens
aggggcatggccagcagc

SEQ ID NO: 314909 - DNA, 21 bp, Homo sapiens
aggggcatgtattggcctgga

SEQ ID NO: 314910 - DNA, 14 bp, Homo sapiens
aggggccactgggc

SEQ ID NO: 314911 - DNA, 20 bp, Homo sapiens
aggggccagatgacacccta

SEQ ID NO: 314912 - DNA, 12 bp, Homo sapiens
aggggccaggcc

SEQ ID NO: 314913 - DNA, 21 bp, Homo sapiens
aggggcccaggctcccctgcc

SEQ ID NO: 314914 - DNA, 20 bp, Homo sapiens
aggggccccagatctgcctg

SEQ ID NO: 314915 - DNA, 21 bp, Homo sapiens
aggggcccgagcagaagcagg

SEQ ID NO: 314916 - DNA, 23 bp, Homo sapiens
aggggcccttgggacagccagag

SEQ ID NO: 314917 - DNA, 23 bp, Homo sapiens
aggggcctctgaaatttcccaca

SEQ ID NO: 314918 - DNA, 14 bp, Homo sapiens
aggggcctctggct

SEQ ID NO: 314919 - DNA, 22 bp, Homo sapiens
aggggcctctggctgcctggcc

SEQ ID NO: 314920 - DNA, 18 bp, Homo sapiens
aggggcctggcagccgtg

SEQ ID NO: 314921 - DNA, 23 bp, Homo sapiens
aggggcctggcagccgtgccttc

SEQ ID NO: 314922 - DNA, 18 bp, Homo sapiens
aggggcggcaggagggag

SEQ ID NO: 314923 - DNA, 15 bp, Homo sapiens
aggggcggggccagg

SEQ ID NO: 314924 - DNA, 22 bp, Homo sapiens
aggggctaaaggggagaaactg

SEQ ID NO: 314925 - DNA, 21 bp, Homo sapiens
aggggctcgagtgcccctgca

SEQ ID NO: 314926 - DNA, 22 bp, Homo sapiens
aggggctcgagtgcccctgcag

SEQ ID NO: 314927 - DNA, 16 bp, Homo sapiens
aggggctgcatcctca

SEQ ID NO: 314928 - DNA, 21 bp, Homo sapiens
aggggctgcatcctcagcccc

SEQ ID NO: 314929 - DNA, 16 bp, Homo sapiens
aggggctgggcagagg

SEQ ID NO: 314930 - DNA, 10 bp, Homo sapiens
aggggctggt

SEQ ID NO: 314931 - DNA, 21 bp, Homo sapiens
aggggctgtggccgtctcctc

SEQ ID NO: 314932 - DNA, 17 bp, Homo sapiens
aggggcttccctctgct

SEQ ID NO: 314933 - DNA, 19 bp, Homo sapiens
aggggcttccctctgctcc

SEQ ID NO: 314934 - DNA, 15 bp, Homo sapiens
aggggcttggagcag

SEQ ID NO: 314935 - DNA, 20 bp, Homo sapiens
aggggcttggagcagagacg

SEQ ID NO: 314936 - DNA, 17 bp, Homo sapiens
agggggatatgaatgga

SEQ ID NO: 314937 - DNA, 15 bp, Homo sapiens
agggggccaggtgca

SEQ ID NO: 314938 - DNA, 19 bp, Homo sapiens
agggggcctgcaggcccca

SEQ ID NO: 314939 - DNA, 18 bp, Homo sapiens
agggggcgctcaggaccc

SEQ ID NO: 314940 - DNA, 22 bp, Homo sapiens
agggggcgctcaggacccaggc

SEQ ID NO: 314941 - DNA, 18 bp, Homo sapiens
agggggctattccctgga

SEQ ID NO: 314942 - DNA, 17 bp, Homo sapiens
aggggggaagatcaggt

SEQ ID NO: 314943 - DNA, 12 bp, Homo sapiens
aggggggagggg

SEQ ID NO: 314944 - DNA, 20 bp, Homo sapiens
aggggggtcggaagcctgtc

SEQ ID NO: 314945 - DNA, 22 bp, Homo sapiens
aggggggtcggaagcctgtcct

SEQ ID NO: 314946 - DNA, 19 bp, Homo sapiens
aggggggttgggttccaga

SEQ ID NO: 314947 - DNA, 21 bp, Homo sapiens
aggggggttgggttccagaca

SEQ ID NO: 314948 - DNA, 14 bp, Homo sapiens
agggggttacaaac

SEQ ID NO: 314949 - DNA, 12 bp, Homo sapiens
aggggtaaatat

SEQ ID NO: 314950 - DNA, 19 bp, Homo sapiens
aggggtaatatattgctgc

SEQ ID NO: 314951 - DNA, 20 bp, Homo sapiens
aggggtcagcagagcttcag

SEQ ID NO: 314952 - DNA, 15 bp, Homo sapiens
aggggtcagctctgg

SEQ ID NO: 314953 - DNA, 15 bp, Homo sapiens
aggggtcaggctcca

SEQ ID NO: 314954 - DNA, 14 bp, Homo sapiens
aggggtctccctga

SEQ ID NO: 314955 - DNA, 21 bp, Homo sapiens
aggggtctccctgagcctgcc

SEQ ID NO: 314956 - DNA, 23 bp, Homo sapiens
aggggtctccctgagcctgcccc

SEQ ID NO: 314957 - DNA, 18 bp, Homo sapiens
aggggtggtcctgactca

SEQ ID NO: 314958 - DNA, 17 bp, Homo sapiens
aggggttccagcttccc

SEQ ID NO: 314959 - DNA, 20 bp, Homo sapiens
aggggttcgagaccagtctg

SEQ ID NO: 314960 - DNA, 18 bp, Homo sapiens
aggggttgcagtgagcgg

SEQ ID NO: 314961 - DNA, 21 bp, Homo sapiens
aggggttttcgaagctcagcc

SEQ ID NO: 314962 - DNA, 17 bp, Homo sapiens
agggtaaattattcagt

SEQ ID NO: 314963 - DNA, 17 bp, Homo sapiens
agggtagtctggtttct

SEQ ID NO: 314964 - DNA, 20 bp, Homo sapiens
agggtatccaagttggactg

SEQ ID NO: 314965 - DNA, 16 bp, Homo sapiens
agggtatcccagaccc

SEQ ID NO: 314966 - DNA, 16 bp, Homo sapiens
agggtatgggaagcca

SEQ ID NO: 314967 - DNA, 17 bp, Homo sapiens
agggtatgggaagccat

SEQ ID NO: 314968 - DNA, 20 bp, Homo sapiens
agggtcaacatcttttacat

SEQ ID NO: 314969 - DNA, 15 bp, Homo sapiens
agggtcagtgccaag

SEQ ID NO: 314970 - DNA, 16 bp, Homo sapiens
agggtccgcaccagct

SEQ ID NO: 314971 - DNA, 23 bp, Homo sapiens
agggtccgcaccagctgctctgc

SEQ ID NO: 314972 - DNA, 16 bp, Homo sapiens
agggtcctggctcctg

SEQ ID NO: 314973 - DNA, 17 bp, Homo sapiens
agggtcctggctcctga

SEQ ID NO: 314974 - DNA, 19 bp, Homo sapiens
agggtcctggctcctgagg

SEQ ID NO: 314975 - DNA, 14 bp, Homo sapiens
agggtcctgtgcct

SEQ ID NO: 314976 - DNA, 22 bp, Homo sapiens
agggtctcgtcaggaggtgcct

SEQ ID NO: 314977 - DNA, 17 bp, Homo sapiens
agggtctgctctttctc

SEQ ID NO: 314978 - DNA, 23 bp, Homo sapiens
agggtctgctctttctctgccag

SEQ ID NO: 314979 - DNA, 15 bp, Homo sapiens
agggtcttccctacc

SEQ ID NO: 314980 - DNA, 17 bp, Homo sapiens
agggtcttccctacctc

SEQ ID NO: 314981 - DNA, 14 bp, Homo sapiens
agggtcttgggcta

SEQ ID NO: 314982 - DNA, 18 bp, Homo sapiens
agggtcttgggctactgg

SEQ ID NO: 314983 - DNA, 23 bp, Homo sapiens
agggtcttgggctactggcagct

SEQ ID NO: 314984 - DNA, 20 bp, Homo sapiens
agggtcttgggggtcagggg

SEQ ID NO: 314985 - DNA, 15 bp, Homo sapiens
agggtgagcagggcc

SEQ ID NO: 314986 - DNA, 23 bp, Homo sapiens
agggtgagcagggccctcagagg

SEQ ID NO: 314987 - DNA, 23 bp, Homo sapiens
agggtgaggcgtgggatccagag

SEQ ID NO: 314988 - DNA, 18 bp, Homo sapiens
agggtgcaggcgcgcacc

SEQ ID NO: 314989 - DNA, 21 bp, Homo sapiens
agggtgccatccacattttaa

SEQ ID NO: 314990 - DNA, 19 bp, Homo sapiens
agggtgctccctcctcagt

SEQ ID NO: 314991 - DNA, 16 bp, Homo sapiens
agggtggacagaagct

SEQ ID NO: 314992 - DNA, 14 bp, Homo sapiens
agggtggcccttgc

SEQ ID NO: 314993 - DNA, 18 bp, Homo sapiens
agggtggcccttgcagtt

SEQ ID NO: 314994 - DNA, 20 bp, Homo sapiens
agggtgggccccagccgtgg

SEQ ID NO: 314995 - DNA, 18 bp, Homo sapiens
agggtgggctctgaccca

SEQ ID NO: 314996 - DNA, 12 bp, Homo sapiens
agggtggggggt

SEQ ID NO: 314997 - DNA, 20 bp, Homo sapiens
agggtggggtaaggaggaga

SEQ ID NO: 314998 - DNA, 16 bp, Homo sapiens
agggtggtgctgggac

SEQ ID NO: 314999 - DNA, 14 bp, Homo sapiens
agggtggttcctgt

SEQ ID NO: 315000 - DNA, 16 bp, Homo sapiens
agggtggttcctgttc

SEQ ID NO: 315001 - DNA, 16 bp, Homo sapiens
agggtgtgagggatgg

SEQ ID NO: 315002 - DNA, 15 bp, Homo sapiens
agggtgtgccctcac

SEQ ID NO: 315003 - DNA, 14 bp, Homo sapiens
agggtgtggcttgg

SEQ ID NO: 315004 - DNA, 19 bp, Homo sapiens
agggtgtgggtcagggagg

SEQ ID NO: 315005 - DNA, 20 bp, Homo sapiens
agggtgtgggtcagggaggg

SEQ ID NO: 315006 - DNA, 17 bp, Homo sapiens
agggttcccccagccct

SEQ ID NO: 315007 - DNA, 21 bp, Homo sapiens
agggttcctgtagacctaggg

SEQ ID NO: 315008 - DNA, 23 bp, Homo sapiens
agggttcctgtagacctagggag

SEQ ID NO: 315009 - DNA, 13 bp, Homo sapiens
agggttctagaag

SEQ ID NO: 315010 - DNA, 14 bp, Homo sapiens
agggttctagaagg

SEQ ID NO: 315011 - DNA, 15 bp, Homo sapiens
agggttctagaaggg

SEQ ID NO: 315012 - DNA, 17 bp, Homo sapiens
agggttctcctctcccc

SEQ ID NO: 315013 - DNA, 21 bp, Homo sapiens
agggttgagttacttcctatc

SEQ ID NO: 315014 - DNA, 15 bp, Homo sapiens
agggttgctggagcc

SEQ ID NO: 315015 - DNA, 17 bp, Homo sapiens
agggttgctggagcctg

SEQ ID NO: 315016 - DNA, 19 bp, Homo sapiens
agggttgcttctgagtggt

SEQ ID NO: 315017 - DNA, 15 bp, Homo sapiens
agggttgggcccaga

SEQ ID NO: 315018 - DNA, 15 bp, Homo sapiens
agggtttatcttttg

SEQ ID NO: 315019 - DNA, 14 bp, Homo sapiens
agggtttgtggctg

SEQ ID NO: 315020 - DNA, 17 bp, Homo sapiens
agggttttatctctgtc

SEQ ID NO: 315021 - DNA, 14 bp, Homo sapiens
agggttttccaatg

SEQ ID NO: 315022 - DNA, 15 bp, Homo sapiens
agggttttggcctgc

SEQ ID NO: 315023 - DNA, 20 bp, Homo sapiens
aggtaaaagagccaagttca

SEQ ID NO: 315024 - DNA, 16 bp, Homo sapiens
aggtaaactgatgctt

SEQ ID NO: 315025 - DNA, 19 bp, Homo sapiens
aggtaaactgatgctttca

SEQ ID NO: 315026 - DNA, 15 bp, Homo sapiens
aggtaatctgaaaca

SEQ ID NO: 315027 - DNA, 17 bp, Homo sapiens
aggtaatctgaaacaca

SEQ ID NO: 315028 - DNA, 19 bp, Homo sapiens
aggtaatttcttgtgcctc

SEQ ID NO: 315029 - DNA, 22 bp, Homo sapiens
aggtaccagcaatatgtaaata

SEQ ID NO: 315030 - DNA, 17 bp, Homo sapiens
aggtacggtgagactct

SEQ ID NO: 315031 - DNA, 20 bp, Homo sapiens
aggtacttcctcctgatggc

SEQ ID NO: 315032 - DNA, 17 bp, Homo sapiens
aggtagagtttgatcat

SEQ ID NO: 315033 - DNA, 21 bp, Homo sapiens
aggtagccctggccagaggct

SEQ ID NO: 315034 - DNA, 17 bp, Homo sapiens
aggtagcgagctgctct

SEQ ID NO: 315035 - DNA, 19 bp, Homo sapiens
aggtagcgagctgctctgc

SEQ ID NO: 315036 - DNA, 18 bp, Homo sapiens
aggtagctacacagcatc

SEQ ID NO: 315037 - DNA, 22 bp, Homo sapiens
acgcacacgtacttaaatgaaa

SEQ ID NO: 315038 - DNA, 14 bp, Homo sapiens
acgcaccttgctgc

SEQ ID NO: 315039 - DNA, 15 bp, Homo sapiens
acgcacgcacacaca

SEQ ID NO: 315040 - DNA, 16 bp, Homo sapiens
acgcacgcacacacac

SEQ ID NO: 315041 - DNA, 17 bp, Homo sapiens
acgcactccatgagcac

SEQ ID NO: 315042 - DNA, 12 bp, Homo sapiens
acgcagacacac

SEQ ID NO: 315043 - DNA, 13 bp, Homo sapiens
acgcagacacaca

SEQ ID NO: 315044 - DNA, 14 bp, Homo sapiens
acgcagagccccgg

SEQ ID NO: 315045 - DNA, 18 bp, Homo sapiens
acgcagagccccggagca

SEQ ID NO: 315046 - DNA, 15 bp, Homo sapiens
acgcagatgatccat

SEQ ID NO: 315047 - DNA, 21 bp, Homo sapiens
acgcagcagctgggacccctc

SEQ ID NO: 315048 - DNA, 23 bp, Homo sapiens
acgcagccctgctttgggctgcc

SEQ ID NO: 315049 - DNA, 14 bp, Homo sapiens
acgcaggagagaga

SEQ ID NO: 315050 - DNA, 20 bp, Homo sapiens
acgcagggagaccctgggag

SEQ ID NO: 315051 - DNA, 16 bp, Homo sapiens
acgcattaagaggttt

SEQ ID NO: 315052 - DNA, 15 bp, Homo sapiens
acgccagtctcccag

SEQ ID NO: 315053 - DNA, 22 bp, Homo sapiens
acgccagtctcccaggccccct

SEQ ID NO: 315054 - DNA, 15 bp, Homo sapiens
acgccattctcctgc

SEQ ID NO: 315055 - DNA, 20 bp, Homo sapiens
acgccccgtgtctggatgca

SEQ ID NO: 315056 - DNA, 17 bp, Homo sapiens
acgccctccctctccca

SEQ ID NO: 315057 - DNA, 12 bp, Homo sapiens
acgccctgggga

SEQ ID NO: 315058 - DNA, 22 bp, Homo sapiens
acgccctggggagtgagcttgg

SEQ ID NO: 315059 - DNA, 15 bp, Homo sapiens
acgccggggctggcc

SEQ ID NO: 315060 - DNA, 11 bp, Homo sapiens
acgcctggctc

SEQ ID NO: 315061 - DNA, 19 bp, Homo sapiens
acgcctggctccaggctcc

SEQ ID NO: 315062 - DNA, 19 bp, Homo sapiens
acgcctgtaatcccagcac

SEQ ID NO: 315063 - DNA, 15 bp, Homo sapiens
acgcgtcttcctgag

SEQ ID NO: 315064 - DNA, 15 bp, Homo sapiens
acgcgtgtgtgcctg

SEQ ID NO: 315065 - DNA, 12 bp, Homo sapiens
acgcgtgttctg

SEQ ID NO: 315066 - DNA, 14 bp, Homo sapiens
acgctcatcttgca

SEQ ID NO: 315067 - DNA, 17 bp, Homo sapiens
acgctcccctgagaggt

SEQ ID NO: 315068 - DNA, 14 bp, Homo sapiens
acgctcctctgccc

SEQ ID NO: 315069 - DNA, 23 bp, Homo sapiens
acgctcctctgcccttcctttcc

SEQ ID NO: 315070 - DNA, 13 bp, Homo sapiens
acgctcctgccct

SEQ ID NO: 315071 - DNA, 12 bp, Homo sapiens
acgctctctgtc

SEQ ID NO: 315072 - DNA, 20 bp, Homo sapiens
acgctctctgtctggctgta

SEQ ID NO: 315073 - DNA, 16 bp, Homo sapiens
acgctctggtgcagtc

SEQ ID NO: 315074 - DNA, 18 bp, Homo sapiens
acgctgcccaggctctgc

SEQ ID NO: 315075 - DNA, 20 bp, Homo sapiens
acgctgcccaggctctgctg

SEQ ID NO: 315076 - DNA, 23 bp, Homo sapiens
acgctgcccaggctctgctgact

SEQ ID NO: 315077 - DNA, 11 bp, Homo sapiens
acgctggctcc

SEQ ID NO: 315078 - DNA, 18 bp, Homo sapiens
acgctggctccccaaagg

SEQ ID NO: 315079 - DNA, 15 bp, Homo sapiens
acgctgggacacaga

SEQ ID NO: 315080 - DNA, 11 bp, Homo sapiens
acgctgtctcc

SEQ ID NO: 315081 - DNA, 12 bp, Homo sapiens
acgctgtctcca

SEQ ID NO: 315082 - DNA, 15 bp, Homo sapiens
acgctgtctccagac

SEQ ID NO: 315083 - DNA, 20 bp, Homo sapiens
acgctgtctccagaccccca

SEQ ID NO: 315084 - DNA, 15 bp, Homo sapiens
acgctgtgggcaggt

SEQ ID NO: 315085 - DNA, 21 bp, Homo sapiens
acgcttgacaggacagcatgg

SEQ ID NO: 315086 - DNA, 15 bp, Homo sapiens
acgcttgctcatttt

SEQ ID NO: 315087 - DNA, 19 bp, Homo sapiens
acgctttcatgaccactgg

SEQ ID NO: 315088 - DNA, 22 bp, Homo sapiens
acgctttgctgctaccgccctg

SEQ ID NO: 315089 - DNA, 14 bp, Homo sapiens
acggaaacagaact

SEQ ID NO: 315090 - DNA, 17 bp, Homo sapiens
acggaacgttggacttt

SEQ ID NO: 315091 - DNA, 19 bp, Homo sapiens
acggaaggacctatgtttg

SEQ ID NO: 315092 - DNA, 20 bp, Homo sapiens
acggacatccaggcgtggga

SEQ ID NO: 315093 - DNA, 21 bp, Homo sapiens
acggacgggacagcggcccgg

SEQ ID NO: 315094 - DNA, 21 bp, Homo sapiens
acggactcccgggccacgccc

SEQ ID NO: 315095 - DNA, 16 bp, Homo sapiens
acggactctttgctgt

SEQ ID NO: 315096 - DNA, 10 bp, Homo sapiens
acggaggctc

SEQ ID NO: 315097 - DNA, 16 bp, Homo sapiens
acggatgattggatta

SEQ ID NO: 315098 - DNA, 16 bp, Homo sapiens
acggcactgtggcctt

SEQ ID NO: 315099 - DNA, 19 bp, Homo sapiens
acggcaggtggcctaaggc

SEQ ID NO: 315100 - DNA, 20 bp, Homo sapiens
acggcagtcacactgctggg

SEQ ID NO: 315101 - DNA, 22 bp, Homo sapiens
acggcatgtgaattctgtgaag

SEQ ID NO: 315102 - DNA, 11 bp, Homo sapiens
acggccaccct

SEQ ID NO: 315103 - DNA, 19 bp, Homo sapiens
acggccccgcccctgcccc

SEQ ID NO: 315104 - DNA, 19 bp, Homo sapiens
acggcccgccgtgcctgca

SEQ ID NO: 315105 - DNA, 12 bp, Homo sapiens
acggccctgcaa

SEQ ID NO: 315106 - DNA, 21 bp, Homo sapiens
acggccgtccctgacttccca

SEQ ID NO: 315107 - DNA, 13 bp, Homo sapiens
acggcctctgggg

SEQ ID NO: 315108 - DNA, 18 bp, Homo sapiens
acggcctgatgctccctc

SEQ ID NO: 315109 - DNA, 20 bp, Homo sapiens
acggcctgatgctccctccc

SEQ ID NO: 315110 - DNA, 13 bp, Homo sapiens
acggcctgggagg

SEQ ID NO: 315111 - DNA, 18 bp, Homo sapiens
acggccttcgacctggac

SEQ ID NO: 315112 - DNA, 16 bp, Homo sapiens
acggcgcccccagtgt

SEQ ID NO: 315113 - DNA, 17 bp, Homo sapiens
acggctaagaggctgct

SEQ ID NO: 315114 - DNA, 23 bp, Homo sapiens
acggctccgagggcggccaggga

SEQ ID NO: 315115 - DNA, 21 bp, Homo sapiens
acggctctcgtccctctgctc

SEQ ID NO: 315116 - DNA, 14 bp, Homo sapiens
acggctgtgtattt

SEQ ID NO: 315117 - DNA, 20 bp, Homo sapiens
acggctgtgtatttctgtag

SEQ ID NO: 315118 - DNA, 19 bp, Homo sapiens
acgggaagcaacctcccaa

SEQ ID NO: 315119 - DNA, 15 bp, Homo sapiens
acgggaccgggccgc

SEQ ID NO: 315120 - DNA, 12 bp, Homo sapiens
acgggagagcgc

SEQ ID NO: 315121 - DNA, 20 bp, Homo sapiens
acgggagggtaaggctgtgg

SEQ ID NO: 315122 - DNA, 15 bp, Homo sapiens
acgggcaaagaaaac

SEQ ID NO: 315123 - DNA, 23 bp, Homo sapiens
acggggaggccaagtgcaggctg

SEQ ID NO: 315124 - DNA, 21 bp, Homo sapiens
acgggggaggccgaggcaggg

SEQ ID NO: 315125 - DNA, 18 bp, Homo sapiens
acggtcatgatgtctgca

SEQ ID NO: 315126 - DNA, 18 bp, Homo sapiens
acggtgatattgtgcatg

SEQ ID NO: 315127 - DNA, 20 bp, Homo sapiens
acggtgatattgtgcatgca

SEQ ID NO: 315128 - DNA, 19 bp, Homo sapiens
acggtgcgtggctgtggca

SEQ ID NO: 315129 - DNA, 18 bp, Homo sapiens
acggtgggcatttgtgag

SEQ ID NO: 315130 - DNA, 18 bp, Homo sapiens
acggtggtgcatgcctgt

SEQ ID NO: 315131 - DNA, 23 bp, Homo sapiens
acggttccctgcctaggagctgg

SEQ ID NO: 315132 - DNA, 16 bp, Homo sapiens
acgtaattcaatttct

SEQ ID NO: 315133 - DNA, 19 bp, Homo sapiens
acgtaatttgttatatcag

SEQ ID NO: 315134 - DNA, 17 bp, Homo sapiens
acgtagctgaggccgga

SEQ ID NO: 315135 - DNA, 16 bp, Homo sapiens
acgtagctgcaaagga

SEQ ID NO: 315136 - DNA, 20 bp, Homo sapiens
acgtagctgcaaaggacaga

SEQ ID NO: 315137 - DNA, 19 bp, Homo sapiens
acgtataaatatgaaatga

SEQ ID NO: 315138 - DNA, 17 bp, Homo sapiens
acgtatcacctttccca

SEQ ID NO: 315139 - DNA, 19 bp, Homo sapiens
acgtatgaatgatatcttt

SEQ ID NO: 315140 - DNA, 21 bp, Homo sapiens
acgtatgtatttcattgctgt

SEQ ID NO: 315141 - DNA, 14 bp, Homo sapiens
acgtccatctctct

SEQ ID NO: 315142 - DNA, 19 bp, Homo sapiens
acgtccatctctctccctt

SEQ ID NO: 315143 - DNA, 23 bp, Homo sapiens
acgtcccctccgccgtgccggcg

SEQ ID NO: 315144 - DNA, 20 bp, Homo sapiens
acgtcctcgaattctcagac

SEQ ID NO: 315145 - DNA, 22 bp, Homo sapiens
acgtctgaccctctccacccca

SEQ ID NO: 315146 - DNA, 13 bp, Homo sapiens
acgtctgccaggc

SEQ ID NO: 315147 - DNA, 20 bp, Homo sapiens
acgtctgccaggcccatctc

SEQ ID NO: 315148 - DNA, 17 bp, Homo sapiens
acgtctggccaggcact

SEQ ID NO: 315149 - DNA, 18 bp, Homo sapiens
acgtctggtgttctcaat

SEQ ID NO: 315150 - DNA, 13 bp, Homo sapiens
acgtctgtcttca

SEQ ID NO: 315151 - DNA, 19 bp, Homo sapiens
acgtgaacgttttaataat

SEQ ID NO: 315152 - DNA, 17 bp, Homo sapiens
acgtgaagataccataa

SEQ ID NO: 315153 - DNA, 17 bp, Homo sapiens
acgtgacagtgcctggg

SEQ ID NO: 315154 - DNA, 18 bp, Homo sapiens
acgtgaccaattgccctg

SEQ ID NO: 315155 - DNA, 19 bp, Homo sapiens
acgtgaccaattgccctgc

SEQ ID NO: 315156 - DNA, 20 bp, Homo sapiens
acgtgaccaattgccctgcc

SEQ ID NO: 315157 - DNA, 22 bp, Homo sapiens
acgtgaccaattgccctgccag

SEQ ID NO: 315158 - DNA, 16 bp, Homo sapiens
acgtgagagaatctgc

SEQ ID NO: 315159 - DNA, 11 bp, Homo sapiens
acgtgagtcct

SEQ ID NO: 315160 - DNA, 21 bp, Homo sapiens
acgtgccattgtctttcctcc

SEQ ID NO: 315161 - DNA, 15 bp, Homo sapiens
acgtggactctgtgc

SEQ ID NO: 315162 - DNA, 18 bp, Homo sapiens
acgtggactctgtgctca

SEQ ID NO: 315163 - DNA, 18 bp, Homo sapiens
acgtggactggggtagga

SEQ ID NO: 315164 - DNA, 16 bp, Homo sapiens
acgtggcacctcctca

SEQ ID NO: 315165 - DNA, 14 bp, Homo sapiens
acgtgggagaggca

SEQ ID NO: 315166 - DNA, 17 bp, Homo sapiens
acgtgggagaggcagaa

SEQ ID NO: 315167 - DNA, 14 bp, Homo sapiens
acgtggggcagcac

SEQ ID NO: 315168 - DNA, 19 bp, Homo sapiens
acgtggggcagcacagaga

SEQ ID NO: 315169 - DNA, 20 bp, Homo sapiens
acgtgggtacccaggctggt

SEQ ID NO: 315170 - DNA, 19 bp, Homo sapiens
acgtggttcagagactggc

SEQ ID NO: 315171 - DNA, 20 bp, Homo sapiens
aggtaggcccttgtcctgcc

SEQ ID NO: 315172 - DNA, 16 bp, Homo sapiens
aggtataaaaaataag

SEQ ID NO: 315173 - DNA, 18 bp, Homo sapiens
aggtataaaaaataagta

SEQ ID NO: 315174 - DNA, 21 bp, Homo sapiens
aggtataaaaaataagtaaag

SEQ ID NO: 315175 - DNA, 21 bp, Homo sapiens
aggtatcacacactttctgac

SEQ ID NO: 315176 - DNA, 19 bp, Homo sapiens
aggtattgattgaaaaaag

SEQ ID NO: 315177 - DNA, 22 bp, Homo sapiens
aggtattgattgaaaaaagaga

SEQ ID NO: 315178 - DNA, 22 bp, Homo sapiens
aggtattggagggaaaaaacaa

SEQ ID NO: 315179 - DNA, 14 bp, Homo sapiens
aggtattttgaata

SEQ ID NO: 315180 - DNA, 18 bp, Homo sapiens
aggtcaagcccaggagga

SEQ ID NO: 315181 - DNA, 21 bp, Homo sapiens
aggtcaagttcatagtttctg

SEQ ID NO: 315182 - DNA, 23 bp, Homo sapiens
aggtcaagttcatagtttctgta

SEQ ID NO: 315183 - DNA, 17 bp, Homo sapiens
aggtcacatagctggga

SEQ ID NO: 315184 - DNA, 15 bp, Homo sapiens
aggtcaccctttgct

SEQ ID NO: 315185 - DNA, 18 bp, Homo sapiens
aggtcagaagagggagag

SEQ ID NO: 315186 - DNA, 15 bp, Homo sapiens
aggtcaggagttcct

SEQ ID NO: 315187 - DNA, 14 bp, Homo sapiens
aggtcaggccctgg

SEQ ID NO: 315188 - DNA, 16 bp, Homo sapiens
aggtcaggccctggaa

SEQ ID NO: 315189 - DNA, 22 bp, Homo sapiens
aggtcatactatctactctcct

SEQ ID NO: 315190 - DNA, 14 bp, Homo sapiens
aggtccaagggcca

SEQ ID NO: 315191 - DNA, 18 bp, Homo sapiens
aggtccaagggccatact

SEQ ID NO: 315192 - DNA, 16 bp, Homo sapiens
aggtccactccctgct

SEQ ID NO: 315193 - DNA, 12 bp, Homo sapiens
aggtcccaaggc

SEQ ID NO: 315194 - DNA, 16 bp, Homo sapiens
aggtcccaaggcaagg

SEQ ID NO: 315195 - DNA, 18 bp, Homo sapiens
aggtcccacgtctggcca

SEQ ID NO: 315196 - DNA, 22 bp, Homo sapiens
aggtcccctccacatcccagca

SEQ ID NO: 315197 - DNA, 20 bp, Homo sapiens
aggtcccgagccccctgtcc

SEQ ID NO: 315198 - DNA, 22 bp, Homo sapiens
aggtcccgagccccctgtcctt

SEQ ID NO: 315199 - DNA, 15 bp, Homo sapiens
aggtccctggaccag

SEQ ID NO: 315200 - DNA, 20 bp, Homo sapiens
aggtccctggaccagcctcc

SEQ ID NO: 315201 - DNA, 21 bp, Homo sapiens
aggtcctctacttaatgagat

SEQ ID NO: 315202 - DNA, 12 bp, Homo sapiens
aggtcctctcag

SEQ ID NO: 315203 - DNA, 11 bp, Homo sapiens
aggtcctctta

SEQ ID NO: 315204 - DNA, 20 bp, Homo sapiens
aggtcctcttaggtcccggg

SEQ ID NO: 315205 - DNA, 14 bp, Homo sapiens
aggtcctgctgtgg

SEQ ID NO: 315206 - DNA, 17 bp, Homo sapiens
aggtcctggggaggctg

SEQ ID NO: 315207 - DNA, 15 bp, Homo sapiens
aggtcctttccttct

SEQ ID NO: 315208 - DNA, 21 bp, Homo sapiens
aggtcgaccccaaagcccctt

SEQ ID NO: 315209 - DNA, 13 bp, Homo sapiens
aggtcgggctcag

SEQ ID NO: 315210 - DNA, 21 bp, Homo sapiens
aggtctattggccaacaatcc

SEQ ID NO: 315211 - DNA, 14 bp, Homo sapiens
aggtctccacccct

SEQ ID NO: 315212 - DNA, 19 bp, Homo sapiens
aggtctccacccctcaagc

SEQ ID NO: 315213 - DNA, 21 bp, Homo sapiens
aggtctccccatgtgcctgca

SEQ ID NO: 315214 - DNA, 19 bp, Homo sapiens
aggtctcctcagggtgggg

SEQ ID NO: 315215 - DNA, 20 bp, Homo sapiens
aggtctcctcagggtggggg

SEQ ID NO: 315216 - DNA, 21 bp, Homo sapiens
aggtctgaaatggaggtcctt

SEQ ID NO: 315217 - DNA, 22 bp, Homo sapiens
aggtctgcacacataacacaca

SEQ ID NO: 315218 - DNA, 23 bp, Homo sapiens
aggtctgcacacataacacacat

SEQ ID NO: 315219 - DNA, 14 bp, Homo sapiens
aggtctgcaggcca

SEQ ID NO: 315220 - DNA, 22 bp, Homo sapiens
aggtctgcaggccaccagctgc

SEQ ID NO: 315221 - DNA, 18 bp, Homo sapiens
aggtctgcattttctcag

SEQ ID NO: 315222 - DNA, 14 bp, Homo sapiens
aggtctgctcggcc

SEQ ID NO: 315223 - DNA, 18 bp, Homo sapiens
aggtctgggagaggcaga

SEQ ID NO: 315224 - DNA, 17 bp, Homo sapiens
aggtcttcttgtgtcct

SEQ ID NO: 315225 - DNA, 18 bp, Homo sapiens
aggtcttcttgtgtcctg

SEQ ID NO: 315226 - DNA, 15 bp, Homo sapiens
aggtcttttgacatg

SEQ ID NO: 315227 - DNA, 19 bp, Homo sapiens
aggtcttttgacatgtgga

SEQ ID NO: 315228 - DNA, 16 bp, Homo sapiens
aggtgaaagggagcta

SEQ ID NO: 315229 - DNA, 21 bp, Homo sapiens
aggtgaaagggagctatcagg

SEQ ID NO: 315230 - DNA, 21 bp, Homo sapiens
aggtgaccccatctctgctgc

SEQ ID NO: 315231 - DNA, 15 bp, Homo sapiens
aggtgacccttctgt

SEQ ID NO: 315232 - DNA, 23 bp, Homo sapiens
aggtgacccttctgtctgtaaga

SEQ ID NO: 315233 - DNA, 16 bp, Homo sapiens
aggtgagaccacctct

SEQ ID NO: 315234 - DNA, 15 bp, Homo sapiens
aggtgagggatgcca

SEQ ID NO: 315235 - DNA, 18 bp, Homo sapiens
aggtgagtgtgagggcag

SEQ ID NO: 315236 - DNA, 19 bp, Homo sapiens
aggtgagtgtgagggcagc

SEQ ID NO: 315237 - DNA, 16 bp, Homo sapiens
aggtgatagcattgct

SEQ ID NO: 315238 - DNA, 18 bp, Homo sapiens
aggtgatagcattgcttt

SEQ ID NO: 315239 - DNA, 16 bp, Homo sapiens
aggtgataggaaaact

SEQ ID NO: 315240 - DNA, 15 bp, Homo sapiens
aggtgataggcaagg

SEQ ID NO: 315241 - DNA, 19 bp, Homo sapiens
aggtgatatccattctttc

SEQ ID NO: 315242 - DNA, 20 bp, Homo sapiens
aggtgatgtttccagctgcc

SEQ ID NO: 315243 - DNA, 21 bp, Homo sapiens
aggtgatgtttccagctgcca

SEQ ID NO: 315244 - DNA, 15 bp, Homo sapiens
aggtgattaaatatt

SEQ ID NO: 315245 - DNA, 15 bp, Homo sapiens
aggtgccaccaataa

SEQ ID NO: 315246 - DNA, 22 bp, Homo sapiens
aggtgccaccaataaaaatcct

SEQ ID NO: 315247 - DNA, 17 bp, Homo sapiens
aggtgccactccctgag

SEQ ID NO: 315248 - DNA, 19 bp, Homo sapiens
aggtgccactccctgagct

SEQ ID NO: 315249 - DNA, 20 bp, Homo sapiens
aggtgccactccctgagctt

SEQ ID NO: 315250 - DNA, 15 bp, Homo sapiens
aggtgcccaccacca

SEQ ID NO: 315251 - DNA, 13 bp, Homo sapiens
aggtgcccagtct

SEQ ID NO: 315252 - DNA, 14 bp, Homo sapiens
aggtgccctgtggg

SEQ ID NO: 315253 - DNA, 17 bp, Homo sapiens
aggtgccgtgagcaggc

SEQ ID NO: 315254 - DNA, 19 bp, Homo sapiens
aggtgccgtgagcaggctt

SEQ ID NO: 315255 - DNA, 18 bp, Homo sapiens
aggtgcggaccggagcgg

SEQ ID NO: 315256 - DNA, 16 bp, Homo sapiens
aggtgctaaaaggaat

SEQ ID NO: 315257 - DNA, 17 bp, Homo sapiens
aggtgctagggtgcctg

SEQ ID NO: 315258 - DNA, 19 bp, Homo sapiens
aggtgctagggtgcctgct

SEQ ID NO: 315259 - DNA, 15 bp, Homo sapiens
aggtgctcaaagatg

SEQ ID NO: 315260 - DNA, 17 bp, Homo sapiens
aggtgctcaataaatat

SEQ ID NO: 315261 - DNA, 18 bp, Homo sapiens
aggtgctgaactgtgcat

SEQ ID NO: 315262 - DNA, 19 bp, Homo sapiens
aggtgctgctttgcttctt

SEQ ID NO: 315263 - DNA, 14 bp, Homo sapiens
aggtgctggaggca

SEQ ID NO: 315264 - DNA, 20 bp, Homo sapiens
aggtgctggaggcagactcg

SEQ ID NO: 315265 - DNA, 13 bp, Homo sapiens
aggtgctggcctc

SEQ ID NO: 315266 - DNA, 13 bp, Homo sapiens
aggtgctgggagg

SEQ ID NO: 315267 - DNA, 19 bp, Homo sapiens
aggtgctgttgtcattgct

SEQ ID NO: 315268 - DNA, 17 bp, Homo sapiens
aggtgcttgggcttctg

SEQ ID NO: 315269 - DNA, 20 bp, Homo sapiens
aggtgcttgggcttctgcgg

SEQ ID NO: 315270 - DNA, 13 bp, Homo sapiens
aggtggaaaatga

SEQ ID NO: 315271 - DNA, 16 bp, Homo sapiens
aggtggaacaggagga

SEQ ID NO: 315272 - DNA, 17 bp, Homo sapiens
aggtggaacaggaggaa

SEQ ID NO: 315273 - DNA, 20 bp, Homo sapiens
aggtggaacaggaggaactg

SEQ ID NO: 315274 - DNA, 17 bp, Homo sapiens
aggtggccacagcagga

SEQ ID NO: 315275 - DNA, 17 bp, Homo sapiens
aggtggccagggctcca

SEQ ID NO: 315276 - DNA, 23 bp, Homo sapiens
aggtggctctggaatgacatgtg

SEQ ID NO: 315277 - DNA, 16 bp, Homo sapiens
aggtgggaggcccctg

SEQ ID NO: 315278 - DNA, 23 bp, Homo sapiens
aggtgggatatccctatgctgcc

SEQ ID NO: 315279 - DNA, 17 bp, Homo sapiens
aggtgggcatgccaccc

SEQ ID NO: 315280 - DNA, 22 bp, Homo sapiens
aggtgggcatgccaccctcaca

SEQ ID NO: 315281 - DNA, 17 bp, Homo sapiens
aggtgggccagcccctc

SEQ ID NO: 315282 - DNA, 22 bp, Homo sapiens
aggtgggccagcccctcccacc

SEQ ID NO: 315283 - DNA, 22 bp, Homo sapiens
aggtgggccttgctacctcaag

SEQ ID NO: 315284 - DNA, 18 bp, Homo sapiens
aggtggggaagagagcct

SEQ ID NO: 315285 - DNA, 21 bp, Homo sapiens
aggtggggaagagagcctgcc

SEQ ID NO: 315286 - DNA, 22 bp, Homo sapiens
aggtggggaagagagcctgccc

SEQ ID NO: 315287 - DNA, 23 bp, Homo sapiens
aggtggggagggggtttgggggc

SEQ ID NO: 315288 - DNA, 14 bp, Homo sapiens
aggtgggggatgct

SEQ ID NO: 315289 - DNA, 15 bp, Homo sapiens
aggtgggggatgctg

SEQ ID NO: 315290 - DNA, 16 bp, Homo sapiens
aggtgggggatgctga

SEQ ID NO: 315291 - DNA, 20 bp, Homo sapiens
aggtgggggatgctgaggag

SEQ ID NO: 315292 - DNA, 18 bp, Homo sapiens
aggtgggggtcggcgcct

SEQ ID NO: 315293 - DNA, 22 bp, Homo sapiens
aggtgggtcaactccaaggcaa

SEQ ID NO: 315294 - DNA, 18 bp, Homo sapiens
aggtgggtccaggaaggc

SEQ ID NO: 315295 - DNA, 14 bp, Homo sapiens
aggtgggtcttgga

SEQ ID NO: 315296 - DNA, 23 bp, Homo sapiens
aggtggtagctctgagccctcct

SEQ ID NO: 315297 - DNA, 14 bp, Homo sapiens
aggtggtctgaatg

SEQ ID NO: 315298 - DNA, 16 bp, Homo sapiens
aggtggtctgaatgtt

SEQ ID NO: 315299 - DNA, 20 bp, Homo sapiens
aggtggtctgaatgttctga

SEQ ID NO: 315300 - DNA, 21 bp, Homo sapiens
aggtggtcttggagaggaggt

SEQ ID NO: 315301 - DNA, 22 bp, Homo sapiens
aggtggtcttggagaggaggtg

SEQ ID NO: 315302 - DNA, 16 bp, Homo sapiens
aggtggtgtccttctt

SEQ ID NO: 315303 - DNA, 20 bp, Homo sapiens
aggtggtgtccttcttcctc

SEQ ID NO: 315304 - DNA, 17 bp, Homo sapiens
aggtgtcaccctgcaga

SEQ ID NO: 315305 - DNA, 17 bp, Homo sapiens
aggtgtcatttccatta

SEQ ID NO: 315306 - DNA, 21 bp, Homo sapiens
aggtgtccccaacgtcccctc

SEQ ID NO: 315307 - DNA, 17 bp, Homo sapiens
aggtgtccccagcccac

SEQ ID NO: 315308 - DNA, 19 bp, Homo sapiens
aggtgtccccagcccactg

SEQ ID NO: 315309 - DNA, 17 bp, Homo sapiens
aggtgttaaaaaccatt

SEQ ID NO: 315310 - DNA, 17 bp, Homo sapiens
aggtgttctacactcat

SEQ ID NO: 315311 - DNA, 17 bp, Homo sapiens
aggtgttgggacctgct

SEQ ID NO: 315312 - DNA, 17 bp, Homo sapiens
aggtgtttaaagagagg

SEQ ID NO: 315313 - DNA, 18 bp, Homo sapiens
aggtgtttaaagagaggt

SEQ ID NO: 315314 - DNA, 23 bp, Homo sapiens
aggtgtttaacggcactgtggcc

SEQ ID NO: 315315 - DNA, 19 bp, Homo sapiens
aggttaaggggatctaaaa

SEQ ID NO: 315316 - DNA, 20 bp, Homo sapiens
aggttaaggtgggtccagga

SEQ ID NO: 315317 - DNA, 22 bp, Homo sapiens
aggttaattccaattatatgag

SEQ ID NO: 315318 - DNA, 16 bp, Homo sapiens
aggttatctgcctggc

SEQ ID NO: 315319 - DNA, 18 bp, Homo sapiens
aggttccagaacagccct

SEQ ID NO: 315320 - DNA, 18 bp, Homo sapiens
aggttctcagagccaagt

SEQ ID NO: 315321 - DNA, 19 bp, Homo sapiens
aggttctcagcaagtgtac

SEQ ID NO: 315322 - DNA, 20 bp, Homo sapiens
aggttctggtaacctgtggt

SEQ ID NO: 315323 - DNA, 13 bp, Homo sapiens
aggttcttgctgc

SEQ ID NO: 315324 - DNA, 18 bp, Homo sapiens
aggttgaggatgcactgg

SEQ ID NO: 315325 - DNA, 23 bp, Homo sapiens
aggttgaggatgcactggcctgt

SEQ ID NO: 315326 - DNA, 14 bp, Homo sapiens
aggttgattctcat

SEQ ID NO: 315327 - DNA, 13 bp, Homo sapiens
aggttgcagctgc

SEQ ID NO: 315328 - DNA, 12 bp, Homo sapiens
aggttgcctgaa

SEQ ID NO: 315329 - DNA, 16 bp, Homo sapiens
aggttggaactgctgc

SEQ ID NO: 315330 - DNA, 18 bp, Homo sapiens
aggttggaactgctgcca

SEQ ID NO: 315331 - DNA, 19 bp, Homo sapiens
aggttggaactgctgccat

SEQ ID NO: 315332 - DNA, 15 bp, Homo sapiens
aggttggaggcccta

SEQ ID NO: 315333 - DNA, 16 bp, Homo sapiens
aggttggcaccccagc

SEQ ID NO: 315334 - DNA, 13 bp, Homo sapiens
aggttggtgactg

SEQ ID NO: 315335 - DNA, 16 bp, Homo sapiens
aggttgtctgaagtca

SEQ ID NO: 315336 - DNA, 20 bp, Homo sapiens
aggttgtttttaaaaccact

SEQ ID NO: 315337 - DNA, 21 bp, Homo sapiens
aggttgtttttaaaaccacta

SEQ ID NO: 315338 - DNA, 22 bp, Homo sapiens
aggtttagaatcaagtctgtga

SEQ ID NO: 315339 - DNA, 14 bp, Homo sapiens
aggtttagagatta

SEQ ID NO: 315340 - DNA, 16 bp, Homo sapiens
aggtttgtcatcagat

SEQ ID NO: 315341 - DNA, 13 bp, Homo sapiens
aggtttgtttgtg

SEQ ID NO: 315342 - DNA, 21 bp, Homo sapiens
aggtttgtttgtgtgaaagga

SEQ ID NO: 315343 - DNA, 22 bp, Homo sapiens
agtaaaaacactacctcttttg

SEQ ID NO: 315344 - DNA, 11 bp, Homo sapiens
agtaaaaagaa

SEQ ID NO: 315345 - DNA, 13 bp, Homo sapiens
agtaaaaagaaca

SEQ ID NO: 315346 - DNA, 13 bp, Homo sapiens
agtaaaaatttct

SEQ ID NO: 315347 - DNA, 17 bp, Homo sapiens
agtaaaaatttcttcca

SEQ ID NO: 315348 - DNA, 23 bp, Homo sapiens
agtaaaaatttcttccacgtaat

SEQ ID NO: 315349 - DNA, 13 bp, Homo sapiens
agtaaagataaaa

SEQ ID NO: 315350 - DNA, 14 bp, Homo sapiens
agtaaagctaaaat

SEQ ID NO: 315351 - DNA, 23 bp, Homo sapiens
agtaaagctagacaaaggcccag

SEQ ID NO: 315352 - DNA, 12 bp, Homo sapiens
agtaaataaact

SEQ ID NO: 315353 - DNA, 14 bp, Homo sapiens
agtaaataaactct

SEQ ID NO: 315354 - DNA, 15 bp, Homo sapiens
agtaaataaactctt

SEQ ID NO: 315355 - DNA, 14 bp, Homo sapiens
agtaaataaattgt

SEQ ID NO: 315356 - DNA, 14 bp, Homo sapiens
agtaaataatgaaa

SEQ ID NO: 315357 - DNA, 20 bp, Homo sapiens
agtaaatattatgattttat

SEQ ID NO: 315358 - DNA, 17 bp, Homo sapiens
agtaaatattgtcacaa

SEQ ID NO: 315359 - DNA, 17 bp, Homo sapiens
agtaaatctaaattaac

SEQ ID NO: 315360 - DNA, 18 bp, Homo sapiens
agtaaatgctacctctga

SEQ ID NO: 315361 - DNA, 11 bp, Homo sapiens
agtaacatata

SEQ ID NO: 315362 - DNA, 14 bp, Homo sapiens
agtaacatataaat

SEQ ID NO: 315363 - DNA, 22 bp, Homo sapiens
agtaacatataaattaatacat

SEQ ID NO: 315364 - DNA, 20 bp, Homo sapiens
agtaaccaggccccagcctc

SEQ ID NO: 315365 - DNA, 14 bp, Homo sapiens
agtaaccatttaat

SEQ ID NO: 315366 - DNA, 19 bp, Homo sapiens
agtaagaccggaagctcct

SEQ ID NO: 315367 - DNA, 21 bp, Homo sapiens
agtaagaccggaagctcctgg

SEQ ID NO: 315368 - DNA, 12 bp, Homo sapiens
agtaagagctgg

SEQ ID NO: 315369 - DNA, 17 bp, Homo sapiens
agtaagcctccctcctc

SEQ ID NO: 315370 - DNA, 17 bp, Homo sapiens
agtaagtataacaaact

SEQ ID NO: 315371 - DNA, 15 bp, Homo sapiens
agtaagtatcttcgt

SEQ ID NO: 315372 - DNA, 23 bp, Homo sapiens
agtaagtggagcatttggaagga

SEQ ID NO: 315373 - DNA, 14 bp, Homo sapiens
agtaagttctgaaa

SEQ ID NO: 315374 - DNA, 17 bp, Homo sapiens
agtaataaaacatcttt

SEQ ID NO: 315375 - DNA, 16 bp, Homo sapiens
agtaataaactgtgtt

SEQ ID NO: 315376 - DNA, 17 bp, Homo sapiens
agtaataaactgtgttt

SEQ ID NO: 315377 - DNA, 13 bp, Homo sapiens
agtaatagctgaa

SEQ ID NO: 315378 - DNA, 21 bp, Homo sapiens
agtaatagctgaacctgttca

SEQ ID NO: 315379 - DNA, 17 bp, Homo sapiens
agtaatcccgccaccta

SEQ ID NO: 315380 - DNA, 19 bp, Homo sapiens
agtaatcccgccacctatc

SEQ ID NO: 315381 - DNA, 22 bp, Homo sapiens
agtaatgaattttatgtgacta

SEQ ID NO: 315382 - DNA, 16 bp, Homo sapiens
agtaatgatatttatt

SEQ ID NO: 315383 - DNA, 15 bp, Homo sapiens
agtaatgcagacatt

SEQ ID NO: 315384 - DNA, 15 bp, Homo sapiens
agtaattcaagaaaa

SEQ ID NO: 315385 - DNA, 19 bp, Homo sapiens
agtaattcaagaaaacaac

SEQ ID NO: 315386 - DNA, 14 bp, Homo sapiens
agtaattctttgat

SEQ ID NO: 315387 - DNA, 14 bp, Homo sapiens
agtaatttaaatgc

SEQ ID NO: 315388 - DNA, 13 bp, Homo sapiens
agtaattttctga

SEQ ID NO: 315389 - DNA, 14 bp, Homo sapiens
agtacaaattataa

SEQ ID NO: 315390 - DNA, 17 bp, Homo sapiens
agtacaaattataaaaa

SEQ ID NO: 315391 - DNA, 14 bp, Homo sapiens
agtacagagtgcag

SEQ ID NO: 315392 - DNA, 12 bp, Homo sapiens
agtacagctatt

SEQ ID NO: 315393 - DNA, 15 bp, Homo sapiens
agtacagtcccagca

SEQ ID NO: 315394 - DNA, 17 bp, Homo sapiens
agtacagtcccagcaca

SEQ ID NO: 315395 - DNA, 19 bp, Homo sapiens
agtacagtggttctacaat

SEQ ID NO: 315396 - DNA, 21 bp, Homo sapiens
agtacagtggttctacaatct

SEQ ID NO: 315397 - DNA, 14 bp, Homo sapiens
agtacatatggtag

SEQ ID NO: 315398 - DNA, 18 bp, Homo sapiens
agtacatatggtagacaa

SEQ ID NO: 315399 - DNA, 20 bp, Homo sapiens
agtacatatggtagacaatt

SEQ ID NO: 315400 - DNA, 17 bp, Homo sapiens
agtacatattaggaaaa

SEQ ID NO: 315401 - DNA, 15 bp, Homo sapiens
agtacatcacccagt

SEQ ID NO: 315402 - DNA, 16 bp, Homo sapiens
agtacatcacccagtg

SEQ ID NO: 315403 - DNA, 20 bp, Homo sapiens
agtacatggaagaagtatat

SEQ ID NO: 315404 - DNA, 21 bp, Homo sapiens
agtacatttaatacagcagtg

SEQ ID NO: 315405 - DNA, 19 bp, Homo sapiens
agtacatttggagacacaa

SEQ ID NO: 315406 - DNA, 18 bp, Homo sapiens
agtaccaaagttttatca

SEQ ID NO: 315407 - DNA, 21 bp, Homo sapiens
agtaccaaatccacaagccat

SEQ ID NO: 315408 - DNA, 14 bp, Homo sapiens
agtaccaatgctgt

SEQ ID NO: 315409 - DNA, 14 bp, Homo sapiens
agtaccagcgctct

SEQ ID NO: 315410 - DNA, 14 bp, Homo sapiens
agtaccatcccact

SEQ ID NO: 315411 - DNA, 18 bp, Homo sapiens
agtaccatcccactgata

SEQ ID NO: 315412 - DNA, 15 bp, Homo sapiens
agtaccatctgaata

SEQ ID NO: 315413 - DNA, 16 bp, Homo sapiens
agtacccacctgagct

SEQ ID NO: 315414 - DNA, 19 bp, Homo sapiens
agtacccccctgagagcat

SEQ ID NO: 315415 - DNA, 13 bp, Homo sapiens
agtacctccaagc

SEQ ID NO: 315416 - DNA, 15 bp, Homo sapiens
agtacctgctgcccc

SEQ ID NO: 315417 - DNA, 13 bp, Homo sapiens
agtacctttgctc

SEQ ID NO: 315418 - DNA, 14 bp, Homo sapiens
agtacctttgctct

SEQ ID NO: 315419 - DNA, 13 bp, Homo sapiens
agtacgttattgt

SEQ ID NO: 315420 - DNA, 20 bp, Homo sapiens
agtactaaaactagataact

SEQ ID NO: 315421 - DNA, 21 bp, Homo sapiens
agtactaagacccacaaactg

SEQ ID NO: 315422 - DNA, 14 bp, Homo sapiens
agtactatatctgt

SEQ ID NO: 315423 - DNA, 21 bp, Homo sapiens
agtactatgtattaccagccc

SEQ ID NO: 315424 - DNA, 12 bp, Homo sapiens
agtactcacttt

SEQ ID NO: 315425 - DNA, 17 bp, Homo sapiens
agtactcaggccactcc

SEQ ID NO: 315426 - DNA, 21 bp, Homo sapiens
agtactcctgcaaaattttat

SEQ ID NO: 315427 - DNA, 19 bp, Homo sapiens
agtactccttaagaacaca

SEQ ID NO: 315428 - DNA, 16 bp, Homo sapiens
agtactctctgctcta

SEQ ID NO: 315429 - DNA, 15 bp, Homo sapiens
agtactggagaaaat

SEQ ID NO: 315430 - DNA, 13 bp, Homo sapiens
agtacttccctca

SEQ ID NO: 315431 - DNA, 16 bp, Homo sapiens
agtacttccctcaggc

SEQ ID NO: 315432 - DNA, 19 bp, Homo sapiens
agtacttgaaatctaggat

SEQ ID NO: 315433 - DNA, 13 bp, Homo sapiens
agtacttgctcaa

SEQ ID NO: 315434 - DNA, 23 bp, Homo sapiens
agtactttatgaaaaaaatatat

SEQ ID NO: 315435 - DNA, 11 bp, Homo sapiens
agtactttgtg

SEQ ID NO: 315436 - DNA, 13 bp, Homo sapiens
agtactttgtgct

SEQ ID NO: 315437 - DNA, 14 bp, Homo sapiens
agtacttttaacgt

SEQ ID NO: 315438 - DNA, 18 bp, Homo sapiens
agtagaaataatatgcat

SEQ ID NO: 315439 - DNA, 12 bp, Homo sapiens
acgtgtgaggat

SEQ ID NO: 315440 - DNA, 13 bp, Homo sapiens
acgtgtgatgtat

SEQ ID NO: 315441 - DNA, 12 bp, Homo sapiens
acgtgtgtggtc

SEQ ID NO: 315442 - DNA, 18 bp, Homo sapiens
acgtgtttacttggtgag

SEQ ID NO: 315443 - DNA, 12 bp, Homo sapiens
acgttaaaagac

SEQ ID NO: 315444 - DNA, 14 bp, Homo sapiens
acgttcacccctcc

SEQ ID NO: 315445 - DNA, 20 bp, Homo sapiens
acgttgatctcctggtagca

SEQ ID NO: 315446 - DNA, 19 bp, Homo sapiens
acgttgctttttcactgtt

SEQ ID NO: 315447 - DNA, 21 bp, Homo sapiens
acgttggacttttcgttaaca

SEQ ID NO: 315448 - DNA, 18 bp, Homo sapiens
acgtttagtaactgtttt

SEQ ID NO: 315449 - DNA, 18 bp, Homo sapiens
acgtttgacaccagggcc

SEQ ID NO: 315450 - DNA, 20 bp, Homo sapiens
acgtttttaatataaagcct

SEQ ID NO: 315451 - DNA, 15 bp, Homo sapiens
actaaaaataagaaa

SEQ ID NO: 315452 - DNA, 14 bp, Homo sapiens
actaaaaatacaaa

SEQ ID NO: 315453 - DNA, 14 bp, Homo sapiens
actaaaactagata

SEQ ID NO: 315454 - DNA, 21 bp, Homo sapiens
actaaaagtgatgtgatttat

SEQ ID NO: 315455 - DNA, 19 bp, Homo sapiens
actaaaattcaacaaatga

SEQ ID NO: 315456 - DNA, 20 bp, Homo sapiens
actaaaattcaacaaatgat

SEQ ID NO: 315457 - DNA, 13 bp, Homo sapiens
actaaacattttg

SEQ ID NO: 315458 - DNA, 21 bp, Homo sapiens
actaaagaatagtgcctcagc

SEQ ID NO: 315459 - DNA, 14 bp, Homo sapiens
actaaagagagaat

SEQ ID NO: 315460 - DNA, 16 bp, Homo sapiens
actaaagagagaatgt

SEQ ID NO: 315461 - DNA, 19 bp, Homo sapiens
actaaagatatcagagctc

SEQ ID NO: 315462 - DNA, 21 bp, Homo sapiens
actaaagatatcagagctctt

SEQ ID NO: 315463 - DNA, 22 bp, Homo sapiens
actaaagatatcagagctctta

SEQ ID NO: 315464 - DNA, 21 bp, Homo sapiens
actaaagcacttcttttccaa

SEQ ID NO: 315465 - DNA, 11 bp, Homo sapiens
actaaagcagt

SEQ ID NO: 315466 - DNA, 12 bp, Homo sapiens
actaaagcagtg

SEQ ID NO: 315467 - DNA, 15 bp, Homo sapiens
actaaagcagtgttt

SEQ ID NO: 315468 - DNA, 20 bp, Homo sapiens
actaaagcatcacacagtgg

SEQ ID NO: 315469 - DNA, 13 bp, Homo sapiens
actaaagccaagg

SEQ ID NO: 315470 - DNA, 17 bp, Homo sapiens
actaaatctctaatatg

SEQ ID NO: 315471 - DNA, 14 bp, Homo sapiens
actaaatctgtaag

SEQ ID NO: 315472 - DNA, 18 bp, Homo sapiens
actaaatctgtaagctct

SEQ ID NO: 315473 - DNA, 18 bp, Homo sapiens
actaaattgtatacattt

SEQ ID NO: 315474 - DNA, 21 bp, Homo sapiens
actaacataaagaaacacttt

SEQ ID NO: 315475 - DNA, 15 bp, Homo sapiens
actaacatataatgt

SEQ ID NO: 315476 - DNA, 17 bp, Homo sapiens
actaaccatccccaact

SEQ ID NO: 315477 - DNA, 15 bp, Homo sapiens
actaagaaacacatc

SEQ ID NO: 315478 - DNA, 18 bp, Homo sapiens
actaagatgaaattgcca

SEQ ID NO: 315479 - DNA, 18 bp, Homo sapiens
actaagccacaagaaatt

SEQ ID NO: 315480 - DNA, 14 bp, Homo sapiens
actaagccaggagg

SEQ ID NO: 315481 - DNA, 15 bp, Homo sapiens
actaagccaggaggc

SEQ ID NO: 315482 - DNA, 23 bp, Homo sapiens
actaagccctcgaaccaaggcag

SEQ ID NO: 315483 - DNA, 18 bp, Homo sapiens
actaagccctgtcgagac

SEQ ID NO: 315484 - DNA, 18 bp, Homo sapiens
actaagctttctcctttg

SEQ ID NO: 315485 - DNA, 23 bp, Homo sapiens
actaagtaacctctacaggcatt

SEQ ID NO: 315486 - DNA, 20 bp, Homo sapiens
actaagttttgtgtgtatat

SEQ ID NO: 315487 - DNA, 12 bp, Homo sapiens
actaataaaaag

SEQ ID NO: 315488 - DNA, 13 bp, Homo sapiens
actaataaaaagg

SEQ ID NO: 315489 - DNA, 18 bp, Homo sapiens
actaataaagtctgtctg

SEQ ID NO: 315490 - DNA, 17 bp, Homo sapiens
actaatagagtacttaa

SEQ ID NO: 315491 - DNA, 22 bp, Homo sapiens
actaatagagtacttaatatac

SEQ ID NO: 315492 - DNA, 15 bp, Homo sapiens
actaatatgggcatt

SEQ ID NO: 315493 - DNA, 19 bp, Homo sapiens
actaatcgaactatgaact

SEQ ID NO: 315494 - DNA, 19 bp, Homo sapiens
actaatctgggaagggaag

SEQ ID NO: 315495 - DNA, 21 bp, Homo sapiens
actaatgaatgcaaaaagata

SEQ ID NO: 315496 - DNA, 21 bp, Homo sapiens
actaatgcttgccaagaaatc

SEQ ID NO: 315497 - DNA, 19 bp, Homo sapiens
actaatgttagaattgatt

SEQ ID NO: 315498 - DNA, 21 bp, Homo sapiens
actaatgttagaattgatttc

SEQ ID NO: 315499 - DNA, 16 bp, Homo sapiens
actaattaaaaaatag

SEQ ID NO: 315500 - DNA, 15 bp, Homo sapiens
actaattaacatata

SEQ ID NO: 315501 - DNA, 18 bp, Homo sapiens
actaattataatgcaaat

SEQ ID NO: 315502 - DNA, 13 bp, Homo sapiens
actaatttattgc

SEQ ID NO: 315503 - DNA, 20 bp, Homo sapiens
actaattttgtatttttagt

SEQ ID NO: 315504 - DNA, 22 bp, Homo sapiens
actacagaaagcaaatcagaca

SEQ ID NO: 315505 - DNA, 23 bp, Homo sapiens
actacagaaagcaaatcagacac

SEQ ID NO: 315506 - DNA, 18 bp, Homo sapiens
actacagacattaaataa

SEQ ID NO: 315507 - DNA, 18 bp, Homo sapiens
actacagagcagctcccc

SEQ ID NO: 315508 - DNA, 20 bp, Homo sapiens
actacagagcagctccccag

SEQ ID NO: 315509 - DNA, 23 bp, Homo sapiens
actacagagtctgacaggaagac

SEQ ID NO: 315510 - DNA, 16 bp, Homo sapiens
actacataaactgact

SEQ ID NO: 315511 - DNA, 23 bp, Homo sapiens
actacataaactgactttatcct

SEQ ID NO: 315512 - DNA, 22 bp, Homo sapiens
actacataattaaattttaatg

SEQ ID NO: 315513 - DNA, 23 bp, Homo sapiens
actacataattaaattttaatgt

SEQ ID NO: 315514 - DNA, 18 bp, Homo sapiens
actacatgtggtttatag

SEQ ID NO: 315515 - DNA, 14 bp, Homo sapiens
actaccaagtgacc

SEQ ID NO: 315516 - DNA, 18 bp, Homo sapiens
actaccacttatttctaa

SEQ ID NO: 315517 - DNA, 18 bp, Homo sapiens
actaccagtgggcatgta

SEQ ID NO: 315518 - DNA, 20 bp, Homo sapiens
actacccgagcccagctaca

SEQ ID NO: 315519 - DNA, 13 bp, Homo sapiens
actactaaagtgc

SEQ ID NO: 315520 - DNA, 14 bp, Homo sapiens
actactaagaataa

SEQ ID NO: 315521 - DNA, 21 bp, Homo sapiens
actactagtttttacttttat

SEQ ID NO: 315522 - DNA, 15 bp, Homo sapiens
actactattctgtta

SEQ ID NO: 315523 - DNA, 14 bp, Homo sapiens
actactcctctgca

SEQ ID NO: 315524 - DNA, 19 bp, Homo sapiens
actactcctctgcagtgcc

SEQ ID NO: 315525 - DNA, 11 bp, Homo sapiens
actactctcca

SEQ ID NO: 315526 - DNA, 16 bp, Homo sapiens
actactgaactgttac

SEQ ID NO: 315527 - DNA, 15 bp, Homo sapiens
actactgtgttcctg

SEQ ID NO: 315528 - DNA, 16 bp, Homo sapiens
actactgtgttcctgg

SEQ ID NO: 315529 - DNA, 21 bp, Homo sapiens
actactgtgttcctggcaata

SEQ ID NO: 315530 - DNA, 11 bp, Homo sapiens
actactttctt

SEQ ID NO: 315531 - DNA, 13 bp, Homo sapiens
actactttgctac

SEQ ID NO: 315532 - DNA, 15 bp, Homo sapiens
actagaatttattca

SEQ ID NO: 315533 - DNA, 15 bp, Homo sapiens
actagacaaataact

SEQ ID NO: 315534 - DNA, 21 bp, Homo sapiens
actagagtctgaacagctgta

SEQ ID NO: 315535 - DNA, 19 bp, Homo sapiens
actagataacttaaataat

SEQ ID NO: 315536 - DNA, 23 bp, Homo sapiens
actagatctcctatttttcagaa

SEQ ID NO: 315537 - DNA, 17 bp, Homo sapiens
actagatctcctgtaat

SEQ ID NO: 315538 - DNA, 12 bp, Homo sapiens
actagccctctt

SEQ ID NO: 315539 - DNA, 23 bp, Homo sapiens
actagccctctttctctctgtgt

SEQ ID NO: 315540 - DNA, 18 bp, Homo sapiens
actaggagaccagaagtg

SEQ ID NO: 315541 - DNA, 23 bp, Homo sapiens
actaggcatttgtaaatattaaa

SEQ ID NO: 315542 - DNA, 14 bp, Homo sapiens
actaggctgggtgc

SEQ ID NO: 315543 - DNA, 19 bp, Homo sapiens
actaggctgggtgcccaca

SEQ ID NO: 315544 - DNA, 20 bp, Homo sapiens
actaggctgggtgcccacag

SEQ ID NO: 315545 - DNA, 23 bp, Homo sapiens
actaggctgggtgcccacagccc

SEQ ID NO: 315546 - DNA, 22 bp, Homo sapiens
actaggggatataggagaggaa

SEQ ID NO: 315547 - DNA, 17 bp, Homo sapiens
actagggttttggcctg

SEQ ID NO: 315548 - DNA, 15 bp, Homo sapiens
actaggtgtccccaa

SEQ ID NO: 315549 - DNA, 14 bp, Homo sapiens
actagtaaagacat

SEQ ID NO: 315550 - DNA, 16 bp, Homo sapiens
actagtaaagacatag

SEQ ID NO: 315551 - DNA, 13 bp, Homo sapiens
actagtacaaatt

SEQ ID NO: 315552 - DNA, 20 bp, Homo sapiens
actagtacaaattataaaaa

SEQ ID NO: 315553 - DNA, 23 bp, Homo sapiens
actagtaccttcagatcctaccc

SEQ ID NO: 315554 - DNA, 21 bp, Homo sapiens
actagtcaagagaagtacaga

SEQ ID NO: 315555 - DNA, 14 bp, Homo sapiens
actagtctgtgtgc

SEQ ID NO: 315556 - DNA, 23 bp, Homo sapiens
actagtgacaagctcctggtctt

SEQ ID NO: 315557 - DNA, 14 bp, Homo sapiens
actagtgctgaagc

SEQ ID NO: 315558 - DNA, 16 bp, Homo sapiens
actagtgtttctgcag

SEQ ID NO: 315559 - DNA, 13 bp, Homo sapiens
actataaatatat

SEQ ID NO: 315560 - DNA, 15 bp, Homo sapiens
actataaatatattg

SEQ ID NO: 315561 - DNA, 13 bp, Homo sapiens
actataacaaaat

SEQ ID NO: 315562 - DNA, 14 bp, Homo sapiens
actatagccatttg

SEQ ID NO: 315563 - DNA, 18 bp, Homo sapiens
actataggcttcttcctt

SEQ ID NO: 315564 - DNA, 20 bp, Homo sapiens
actatagtttaaaacacatt

SEQ ID NO: 315565 - DNA, 16 bp, Homo sapiens
actatatagagatgtt

SEQ ID NO: 315566 - DNA, 11 bp, Homo sapiens
actatatgcat

SEQ ID NO: 315567 - DNA, 17 bp, Homo sapiens
actatatgcataaacaa

SEQ ID NO: 315568 - DNA, 16 bp, Homo sapiens
actatatgtatatctt

SEQ ID NO: 315569 - DNA, 18 bp, Homo sapiens
actatccatgcaccaaac

SEQ ID NO: 315570 - DNA, 13 bp, Homo sapiens
actatcctggctt

SEQ ID NO: 315571 - DNA, 14 bp, Homo sapiens
actatgaaacgaat

SEQ ID NO: 315572 - DNA, 16 bp, Homo sapiens
actatgaaacgaatat

SEQ ID NO: 315573 - DNA, 20 bp, Homo sapiens
agtagaagatttgatgctgg

SEQ ID NO: 315574 - DNA, 19 bp, Homo sapiens
agtagaagcctgcagcggc

SEQ ID NO: 315575 - DNA, 24 bp, Homo sapiens
agtagacagcaataactcggtgtg

SEQ ID NO: 315576 - DNA, 16 bp, Homo sapiens
agtagacccctggctg

SEQ ID NO: 315577 - DNA, 18 bp, Homo sapiens
agtagacctgattttcaa

SEQ ID NO: 315578 - DNA, 21 bp, Homo sapiens
agtagacctgattttcaaaat

SEQ ID NO: 315579 - DNA, 16 bp, Homo sapiens
agtagacgaacagctg

SEQ ID NO: 315580 - DNA, 17 bp, Homo sapiens
agtagacgaacagctga

SEQ ID NO: 315581 - DNA, 12 bp, Homo sapiens
agtagagaagta

SEQ ID NO: 315582 - DNA, 21 bp, Homo sapiens
agtagagaagtatccaattat

SEQ ID NO: 315583 - DNA, 19 bp, Homo sapiens
agtagagatggggaaagaa

SEQ ID NO: 315584 - DNA, 18 bp, Homo sapiens
agtagcaccctggattga

SEQ ID NO: 315585 - DNA, 13 bp, Homo sapiens
agtagcaggccca

SEQ ID NO: 315586 - DNA, 20 bp, Homo sapiens
agtagcatgttgagccaggc

SEQ ID NO: 315587 - DNA, 17 bp, Homo sapiens
agtagccctttctgtgt

SEQ ID NO: 315588 - DNA, 15 bp, Homo sapiens
agtagctctcctgac

SEQ ID NO: 315589 - DNA, 13 bp, Homo sapiens
agtagctgggatg

SEQ ID NO: 315590 - DNA, 21 bp, Homo sapiens
agtagctgggattacaggtgt

SEQ ID NO: 315591 - DNA, 13 bp, Homo sapiens
agtagctgtgggg

SEQ ID NO: 315592 - DNA, 14 bp, Homo sapiens
agtagctttccaca

SEQ ID NO: 315593 - DNA, 16 bp, Homo sapiens
agtaggctaaaaacat

SEQ ID NO: 315594 - DNA, 18 bp, Homo sapiens
agtaggctgtattttctt

SEQ ID NO: 315595 - DNA, 18 bp, Homo sapiens
agtagggtagaaggaaag

SEQ ID NO: 315596 - DNA, 13 bp, Homo sapiens
agtaggtccaagg

SEQ ID NO: 315597 - DNA, 15 bp, Homo sapiens
agtaggtctgcacac

SEQ ID NO: 315598 - DNA, 23 bp, Homo sapiens
agtaggtctgcacacataacaca

SEQ ID NO: 315599 - DNA, 20 bp, Homo sapiens
agtagtaaaattagaaaaaa

SEQ ID NO: 315600 - DNA, 16 bp, Homo sapiens
agtagtgcctgtgatc

SEQ ID NO: 315601 - DNA, 21 bp, Homo sapiens
agtagttgatgaccaatctct

SEQ ID NO: 315602 - DNA, 19 bp, Homo sapiens
agtataaattcgctgtgag

SEQ ID NO: 315603 - DNA, 23 bp, Homo sapiens
agtataaatttgtgtaatattac

SEQ ID NO: 315604 - DNA, 14 bp, Homo sapiens
agtatactgtgtgg

SEQ ID NO: 315605 - DNA, 13 bp, Homo sapiens
agtatataagctg

SEQ ID NO: 315606 - DNA, 16 bp, Homo sapiens
agtatatatgtacagt

SEQ ID NO: 315607 - DNA, 13 bp, Homo sapiens
agtatatctggac

SEQ ID NO: 315608 - DNA, 22 bp, Homo sapiens
agtatatctggacaagccaact

SEQ ID NO: 315609 - DNA, 18 bp, Homo sapiens
agtatatttatataatta

SEQ ID NO: 315610 - DNA, 19 bp, Homo sapiens
agtatatttatataattat

SEQ ID NO: 315611 - DNA, 19 bp, Homo sapiens
agtatattttcttttcctc

SEQ ID NO: 315612 - DNA, 14 bp, Homo sapiens
agtatcaaggctgc

SEQ ID NO: 315613 - DNA, 15 bp, Homo sapiens
agtatcaaggctgcc

SEQ ID NO: 315614 - DNA, 18 bp, Homo sapiens
agtatcaaggctgcctgg

SEQ ID NO: 315615 - DNA, 23 bp, Homo sapiens
agtatcaaggctgcctggagaaa

SEQ ID NO: 315616 - DNA, 13 bp, Homo sapiens
agtatccaattat

SEQ ID NO: 315617 - DNA, 17 bp, Homo sapiens
agtatccaattatgtga

SEQ ID NO: 315618 - DNA, 20 bp, Homo sapiens
agtatccaattatgtgacaa

SEQ ID NO: 315619 - DNA, 16 bp, Homo sapiens
agtatccatgcatgtg

SEQ ID NO: 315620 - DNA, 19 bp, Homo sapiens
agtatctgtaacccttgaa

SEQ ID NO: 315621 - DNA, 14 bp, Homo sapiens
agtatctgtacctg

SEQ ID NO: 315622 - DNA, 17 bp, Homo sapiens
agtatctgtacctgccc

SEQ ID NO: 315623 - DNA, 19 bp, Homo sapiens
agtatcttacctgtaaagt

SEQ ID NO: 315624 - DNA, 21 bp, Homo sapiens
agtatcttacctgtaaagtct

SEQ ID NO: 315625 - DNA, 24 bp, Homo sapiens
agtatcttcaaactttcactttga

SEQ ID NO: 315626 - DNA, 12 bp, Homo sapiens
agtatcttgaag

SEQ ID NO: 315627 - DNA, 15 bp, Homo sapiens
agtatcttgaagact

SEQ ID NO: 315628 - DNA, 21 bp, Homo sapiens
agtatgaatgatgttttagaa

SEQ ID NO: 315629 - DNA, 13 bp, Homo sapiens
agtatgagaaata

SEQ ID NO: 315630 - DNA, 16 bp, Homo sapiens
agtatgcaagaagaat

SEQ ID NO: 315631 - DNA, 19 bp, Homo sapiens
agtatgcaagaagaatata

SEQ ID NO: 315632 - DNA, 17 bp, Homo sapiens
agtatggcagtgggaga

SEQ ID NO: 315633 - DNA, 11 bp, Homo sapiens
agtatgggcta

SEQ ID NO: 315634 - DNA, 12 bp, Homo sapiens
agtatgggctac

SEQ ID NO: 315635 - DNA, 14 bp, Homo sapiens
agtatgtgatatct

SEQ ID NO: 315636 - DNA, 17 bp, Homo sapiens
agtatgtgatatctgaa

SEQ ID NO: 315637 - DNA, 22 bp, Homo sapiens
agtatgtgtctagcaaagccac

SEQ ID NO: 315638 - DNA, 16 bp, Homo sapiens
agtatgttttagcatg

SEQ ID NO: 315639 - DNA, 20 bp, Homo sapiens
agtatgttttagcatgtgtt

SEQ ID NO: 315640 - DNA, 17 bp, Homo sapiens
agtattaaactctcctt

SEQ ID NO: 315641 - DNA, 15 bp, Homo sapiens
agtattaaagggggg

SEQ ID NO: 315642 - DNA, 20 bp, Homo sapiens
agtattaaaggggggagggg

SEQ ID NO: 315643 - DNA, 13 bp, Homo sapiens
agtattaactatt

SEQ ID NO: 315644 - DNA, 19 bp, Homo sapiens
agtattccattgtgtgagt

SEQ ID NO: 315645 - DNA, 22 bp, Homo sapiens
agtattccatttttactaaagc

SEQ ID NO: 315646 - DNA, 20 bp, Homo sapiens
agtattccctttttaaatga

SEQ ID NO: 315647 - DNA, 21 bp, Homo sapiens
agtattccctttttaaatgag

SEQ ID NO: 315648 - DNA, 20 bp, Homo sapiens
agtattgaaaacttcaaagc

SEQ ID NO: 315649 - DNA, 21 bp, Homo sapiens
agtattgaaaacttcaaagct

SEQ ID NO: 315650 - DNA, 18 bp, Homo sapiens
agtattgagacactgtca

SEQ ID NO: 315651 - DNA, 20 bp, Homo sapiens
agtattgagacactgtcaag

SEQ ID NO: 315652 - DNA, 22 bp, Homo sapiens
agtattgttcttgtaaaactgt

SEQ ID NO: 315653 - DNA, 13 bp, Homo sapiens
agtatttatatat

SEQ ID NO: 315654 - DNA, 23 bp, Homo sapiens
agtatttatatatttataactca

SEQ ID NO: 315655 - DNA, 21 bp, Homo sapiens
agtatttgctgtttgtccagt

SEQ ID NO: 315656 - DNA, 22 bp, Homo sapiens
agtattttacctagcatttcaa

SEQ ID NO: 315657 - DNA, 15 bp, Homo sapiens
agtatttttgtctct

SEQ ID NO: 315658 - DNA, 19 bp, Homo sapiens
agtcaaaacacttgtaatt

SEQ ID NO: 315659 - DNA, 21 bp, Homo sapiens
agtcaaacaagttgtgccttt

SEQ ID NO: 315660 - DNA, 17 bp, Homo sapiens
agtcaaagacgctgagt

SEQ ID NO: 315661 - DNA, 15 bp, Homo sapiens
agtcaacactcttct

SEQ ID NO: 315662 - DNA, 14 bp, Homo sapiens
agtcaacagtgaaa

SEQ ID NO: 315663 - DNA, 22 bp, Homo sapiens
agtcaagattcccggctggact

SEQ ID NO: 315664 - DNA, 16 bp, Homo sapiens
agtcaaggtgctcaat

SEQ ID NO: 315665 - DNA, 15 bp, Homo sapiens
agtcaagtgtgcctg

SEQ ID NO: 315666 - DNA, 16 bp, Homo sapiens
agtcaatcaaacaggg

SEQ ID NO: 315667 - DNA, 16 bp, Homo sapiens
agtcaatcatttctca

SEQ ID NO: 315668 - DNA, 17 bp, Homo sapiens
agtcaatcatttctcac

SEQ ID NO: 315669 - DNA, 15 bp, Homo sapiens
agtcaatgtgcagtg

SEQ ID NO: 315670 - DNA, 16 bp, Homo sapiens
agtcacactgctggga

SEQ ID NO: 315671 - DNA, 11 bp, Homo sapiens
agtcacagctg

SEQ ID NO: 315672 - DNA, 20 bp, Homo sapiens
agtcacagctgcagctgggc

SEQ ID NO: 315673 - DNA, 21 bp, Homo sapiens
agtcacagctgcagctgggcc

SEQ ID NO: 315674 - DNA, 22 bp, Homo sapiens
agtcacagctgcagctgggccc

SEQ ID NO: 315675 - DNA, 23 bp, Homo sapiens
agtcacagctgcagctgggcccc

SEQ ID NO: 315676 - DNA, 23 bp, Homo sapiens
agtcacatatcaagtcccgaggc

SEQ ID NO: 315677 - DNA, 14 bp, Homo sapiens
agtcacctgcaagc

SEQ ID NO: 315678 - DNA, 15 bp, Homo sapiens
agtcacctgcaagcc

SEQ ID NO: 315679 - DNA, 17 bp, Homo sapiens
agtcacctgcaagcccc

SEQ ID NO: 315680 - DNA, 18 bp, Homo sapiens
agtcacctgcaagcccca

SEQ ID NO: 315681 - DNA, 17 bp, Homo sapiens
agtcacctgctggttgt

SEQ ID NO: 315682 - DNA, 20 bp, Homo sapiens
agtcaccttccaggacccct

SEQ ID NO: 315683 - DNA, 17 bp, Homo sapiens
agtcactaaatttctca

SEQ ID NO: 315684 - DNA, 17 bp, Homo sapiens
agtcactcaattgtttt

SEQ ID NO: 315685 - DNA, 13 bp, Homo sapiens
agtcagagaaaac

SEQ ID NO: 315686 - DNA, 15 bp, Homo sapiens
agtcagagaaaacac

SEQ ID NO: 315687 - DNA, 16 bp, Homo sapiens
agtcagagaaaacact

SEQ ID NO: 315688 - DNA, 18 bp, Homo sapiens
agtcagagaaaacacttt

SEQ ID NO: 315689 - DNA, 21 bp, Homo sapiens
agtcagagaaaacactttcct

SEQ ID NO: 315690 - DNA, 11 bp, Homo sapiens
agtcagagccc

SEQ ID NO: 315691 - DNA, 22 bp, Homo sapiens
agtcagagccctggctgggttc

SEQ ID NO: 315692 - DNA, 11 bp, Homo sapiens
agtcagatgag

SEQ ID NO: 315693 - DNA, 20 bp, Homo sapiens
agtcagatgagcaaggacat

SEQ ID NO: 315694 - DNA, 21 bp, Homo sapiens
agtcagatggatgtagataca

SEQ ID NO: 315695 - DNA, 19 bp, Homo sapiens
agtcagcccgaatgcctgt

SEQ ID NO: 315696 - DNA, 20 bp, Homo sapiens
agtcaggaagcctcctgctg

SEQ ID NO: 315697 - DNA, 14 bp, Homo sapiens
agtcaggagccagc

SEQ ID NO: 315698 - DNA, 15 bp, Homo sapiens
agtcaggagccagca

SEQ ID NO: 315699 - DNA, 17 bp, Homo sapiens
agtcaggagccagcagg

SEQ ID NO: 315700 - DNA, 17 bp, Homo sapiens
agtcagggagccctggg

SEQ ID NO: 315701 - DNA, 14 bp, Homo sapiens
agtcagggcccaga

SEQ ID NO: 315702 - DNA, 15 bp, Homo sapiens
agtcagggcccagag

SEQ ID NO: 315703 - DNA, 16 bp, Homo sapiens
agtcagggcccagagg

SEQ ID NO: 315704 - DNA, 14 bp, Homo sapiens
agtcagtaggagag

SEQ ID NO: 315705 - DNA, 21 bp, Homo sapiens
agtcagtaggtccaagggcca

SEQ ID NO: 315706 - DNA, 23 bp, Homo sapiens
agtcagttcccggagcacagccc

SEQ ID NO: 315707 - DNA, 19 bp, Homo sapiens
actatgaaacgaatataag

SEQ ID NO: 315708 - DNA, 16 bp, Homo sapiens
actatgaaataaaaaa

SEQ ID NO: 315709 - DNA, 16 bp, Homo sapiens
actatggctgtatttt

SEQ ID NO: 315710 - DNA, 20 bp, Homo sapiens
actatggtatatattttgaa

SEQ ID NO: 315711 - DNA, 15 bp, Homo sapiens
actatggtatttgag

SEQ ID NO: 315712 - DNA, 22 bp, Homo sapiens
actatggttcccaataaaagtg

SEQ ID NO: 315713 - DNA, 16 bp, Homo sapiens
actatgtgtcatgatt

SEQ ID NO: 315714 - DNA, 18 bp, Homo sapiens
actatgtgtcatgatttc

SEQ ID NO: 315715 - DNA, 20 bp, Homo sapiens
actattaagcagtaaaaact

SEQ ID NO: 315716 - DNA, 14 bp, Homo sapiens
actattagagaaac

SEQ ID NO: 315717 - DNA, 11 bp, Homo sapiens
actattattat

SEQ ID NO: 315718 - DNA, 12 bp, Homo sapiens
actattattgtt

SEQ ID NO: 315719 - DNA, 14 bp, Homo sapiens
actattccctttga

SEQ ID NO: 315720 - DNA, 17 bp, Homo sapiens
actattcttaagcactt

SEQ ID NO: 315721 - DNA, 17 bp, Homo sapiens
actattcttgatgtaaa

SEQ ID NO: 315722 - DNA, 19 bp, Homo sapiens
actattcttgatgtaaaat

SEQ ID NO: 315723 - DNA, 13 bp, Homo sapiens
actattggacaga

SEQ ID NO: 315724 - DNA, 17 bp, Homo sapiens
actatttaaaattggca

SEQ ID NO: 315725 - DNA, 18 bp, Homo sapiens
actatttaaaattggcac

SEQ ID NO: 315726 - DNA, 14 bp, Homo sapiens
actatttaaactta

SEQ ID NO: 315727 - DNA, 21 bp, Homo sapiens
actatttaaacttataaatca

SEQ ID NO: 315728 - DNA, 12 bp, Homo sapiens
actatttaactg

SEQ ID NO: 315729 - DNA, 18 bp, Homo sapiens
actatttaacttgagggt

SEQ ID NO: 315730 - DNA, 18 bp, Homo sapiens
actatttgtctttcagga

SEQ ID NO: 315731 - DNA, 17 bp, Homo sapiens
actatttttttgttgct

SEQ ID NO: 315732 - DNA, 19 bp, Homo sapiens
actatttttttgttgctgt

SEQ ID NO: 315733 - DNA, 17 bp, Homo sapiens
actcaacatgttactga

SEQ ID NO: 315734 - DNA, 20 bp, Homo sapiens
actcaacatgttactgacca

SEQ ID NO: 315735 - DNA, 21 bp, Homo sapiens
actcaacatgttactgaccag

SEQ ID NO: 315736 - DNA, 19 bp, Homo sapiens
actcaagcaggtttcttgc

SEQ ID NO: 315737 - DNA, 12 bp, Homo sapiens
actcaaggaatg

SEQ ID NO: 315738 - DNA, 22 bp, Homo sapiens
actcaagtgtctcagtccacct

SEQ ID NO: 315739 - DNA, 23 bp, Homo sapiens
actcaagtgtctcagtccacctg

SEQ ID NO: 315740 - DNA, 13 bp, Homo sapiens
actcacaaatgat

SEQ ID NO: 315741 - DNA, 16 bp, Homo sapiens
actcacagagacacag

SEQ ID NO: 315742 - DNA, 18 bp, Homo sapiens
actcacagagacacaggg

SEQ ID NO: 315743 - DNA, 14 bp, Homo sapiens
actcaccaaaatat

SEQ ID NO: 315744 - DNA, 13 bp, Homo sapiens
actcaccagggtc

SEQ ID NO: 315745 - DNA, 13 bp, Homo sapiens
actcaccatttca

SEQ ID NO: 315746 - DNA, 18 bp, Homo sapiens
actcacccccaaggggca

SEQ ID NO: 315747 - DNA, 17 bp, Homo sapiens
actcacctaatgtttat

SEQ ID NO: 315748 - DNA, 23 bp, Homo sapiens
actcacctaatgtttatgagcca

SEQ ID NO: 315749 - DNA, 14 bp, Homo sapiens
actcactccagccc

SEQ ID NO: 315750 - DNA, 11 bp, Homo sapiens
actcactgcat

SEQ ID NO: 315751 - DNA, 13 bp, Homo sapiens
actcactgtgctc

SEQ ID NO: 315752 - DNA, 14 bp, Homo sapiens
actcagaaattttt

SEQ ID NO: 315753 - DNA, 19 bp, Homo sapiens
actcagacaggaaagggaa

SEQ ID NO: 315754 - DNA, 15 bp, Homo sapiens
actcagagcagagca

SEQ ID NO: 315755 - DNA, 22 bp, Homo sapiens
actcagatgtctctggcgtgtg

SEQ ID NO: 315756 - DNA, 14 bp, Homo sapiens
actcagccctgagg

SEQ ID NO: 315757 - DNA, 15 bp, Homo sapiens
actcagccctgaggt

SEQ ID NO: 315758 - DNA, 20 bp, Homo sapiens
actcagctattaagaaaatc

SEQ ID NO: 315759 - DNA, 20 bp, Homo sapiens
actcagcttggttcctgccc

SEQ ID NO: 315760 - DNA, 13 bp, Homo sapiens
actcaggattctc

SEQ ID NO: 315761 - DNA, 19 bp, Homo sapiens
actcaggcctgccaatgcc

SEQ ID NO: 315762 - DNA, 20 bp, Homo sapiens
actcagggctggcccgggga

SEQ ID NO: 315763 - DNA, 22 bp, Homo sapiens
actcaggttccagaacagccct

SEQ ID NO: 315764 - DNA, 23 bp, Homo sapiens
actcaggttccagaacagccctc

SEQ ID NO: 315765 - DNA, 14 bp, Homo sapiens
actcagtcccccac

SEQ ID NO: 315766 - DNA, 23 bp, Homo sapiens
actcagtcccccaccacactgaa

SEQ ID NO: 315767 - DNA, 20 bp, Homo sapiens
actcagtgttgactgtaggc

SEQ ID NO: 315768 - DNA, 22 bp, Homo sapiens
actcagttaaaatgtctgtttc

SEQ ID NO: 315769 - DNA, 15 bp, Homo sapiens
actcagtttgtcaga

SEQ ID NO: 315770 - DNA, 15 bp, Homo sapiens
actcagttttaacta

SEQ ID NO: 315771 - DNA, 22 bp, Homo sapiens
actcagttttaactagaattta

SEQ ID NO: 315772 - DNA, 16 bp, Homo sapiens
actcatcataaaataa

SEQ ID NO: 315773 - DNA, 14 bp, Homo sapiens
actcatgaacaaaa

SEQ ID NO: 315774 - DNA, 15 bp, Homo sapiens
actcatgaacaaaat

SEQ ID NO: 315775 - DNA, 15 bp, Homo sapiens
actcatgcggcccag

SEQ ID NO: 315776 - DNA, 13 bp, Homo sapiens
actcatggcaggc

SEQ ID NO: 315777 - DNA, 22 bp, Homo sapiens
actcatggtgaggcttaacaat

SEQ ID NO: 315778 - DNA, 14 bp, Homo sapiens
actcatgttaattg

SEQ ID NO: 315779 - DNA, 17 bp, Homo sapiens
actcattaatttctctc

SEQ ID NO: 315780 - DNA, 17 bp, Homo sapiens
actcattcacatttcaa

SEQ ID NO: 315781 - DNA, 18 bp, Homo sapiens
actccaaggcaaatgtcc

SEQ ID NO: 315782 - DNA, 15 bp, Homo sapiens
actccacctccaccc

SEQ ID NO: 315783 - DNA, 14 bp, Homo sapiens
actccactctcctt

SEQ ID NO: 315784 - DNA, 15 bp, Homo sapiens
actccagacccctgg

SEQ ID NO: 315785 - DNA, 18 bp, Homo sapiens
actccagacccctggctt

SEQ ID NO: 315786 - DNA, 16 bp, Homo sapiens
actccagagtctgagc

SEQ ID NO: 315787 - DNA, 20 bp, Homo sapiens
actccagccacccagccagg

SEQ ID NO: 315788 - DNA, 14 bp, Homo sapiens
actccagcccaaca

SEQ ID NO: 315789 - DNA, 13 bp, Homo sapiens
actccagcctggg

SEQ ID NO: 315790 - DNA, 16 bp, Homo sapiens
actccagcctgggtga

SEQ ID NO: 315791 - DNA, 18 bp, Homo sapiens
actccaggaaaactgttt

SEQ ID NO: 315792 - DNA, 14 bp, Homo sapiens
actccaggccagct

SEQ ID NO: 315793 - DNA, 15 bp, Homo sapiens
actccaggggcacct

SEQ ID NO: 315794 - DNA, 19 bp, Homo sapiens
actccagggttaaagaaag

SEQ ID NO: 315795 - DNA, 20 bp, Homo sapiens
actccagggttaaagaaagg

SEQ ID NO: 315796 - DNA, 21 bp, Homo sapiens
actccaggttcgtatagaaaa

SEQ ID NO: 315797 - DNA, 23 bp, Homo sapiens
actccaggttcgtatagaaaaag

SEQ ID NO: 315798 - DNA, 22 bp, Homo sapiens
actccagtttgcccaccacaac

SEQ ID NO: 315799 - DNA, 14 bp, Homo sapiens
actccatacagcct

SEQ ID NO: 315800 - DNA, 16 bp, Homo sapiens
actccatacagcctct

SEQ ID NO: 315801 - DNA, 11 bp, Homo sapiens
actccatcttg

SEQ ID NO: 315802 - DNA, 23 bp, Homo sapiens
actccatgaccaggccaccatct

SEQ ID NO: 315803 - DNA, 14 bp, Homo sapiens
actccatgagaagc

SEQ ID NO: 315804 - DNA, 17 bp, Homo sapiens
actccatgagaagccgt

SEQ ID NO: 315805 - DNA, 17 bp, Homo sapiens
actccatgagcacccca

SEQ ID NO: 315806 - DNA, 12 bp, Homo sapiens
actccatgccta

SEQ ID NO: 315807 - DNA, 16 bp, Homo sapiens
actccatgcctattta

SEQ ID NO: 315808 - DNA, 22 bp, Homo sapiens
actccatgcctatttactggaa

SEQ ID NO: 315809 - DNA, 14 bp, Homo sapiens
actccatggccacc

SEQ ID NO: 315810 - DNA, 20 bp, Homo sapiens
actccatggggttcgagact

SEQ ID NO: 315811 - DNA, 22 bp, Homo sapiens
actcccaagaacagcaggccca

SEQ ID NO: 315812 - DNA, 15 bp, Homo sapiens
actcccagccaccac

SEQ ID NO: 315813 - DNA, 20 bp, Homo sapiens
actcccagccaccaccactg

SEQ ID NO: 315814 - DNA, 14 bp, Homo sapiens
actcccaggacctg

SEQ ID NO: 315815 - DNA, 22 bp, Homo sapiens
actcccaggacctggagacagg

SEQ ID NO: 315816 - DNA, 14 bp, Homo sapiens
actcccagggcccg

SEQ ID NO: 315817 - DNA, 17 bp, Homo sapiens
actcccagggcccgagc

SEQ ID NO: 315818 - DNA, 19 bp, Homo sapiens
actcccagggcccgagcgc

SEQ ID NO: 315819 - DNA, 22 bp, Homo sapiens
actcccagtccaaatgtcctcc

SEQ ID NO: 315820 - DNA, 15 bp, Homo sapiens
actccccagccccac

SEQ ID NO: 315821 - DNA, 13 bp, Homo sapiens
actcccccacctg

SEQ ID NO: 315822 - DNA, 16 bp, Homo sapiens
actcccccagccctca

SEQ ID NO: 315823 - DNA, 20 bp, Homo sapiens
actccccgcccgccctcctc

SEQ ID NO: 315824 - DNA, 21 bp, Homo sapiens
actccccgcccgccctcctct

SEQ ID NO: 315825 - DNA, 22 bp, Homo sapiens
actccccgcccgccctcctctg

SEQ ID NO: 315826 - DNA, 16 bp, Homo sapiens
actcccgggccacgcc

SEQ ID NO: 315827 - DNA, 18 bp, Homo sapiens
actccctaaagccctctt

SEQ ID NO: 315828 - DNA, 18 bp, Homo sapiens
actccctagttacccacc

SEQ ID NO: 315829 - DNA, 16 bp, Homo sapiens
actccctccatgtggc

SEQ ID NO: 315830 - DNA, 15 bp, Homo sapiens
actccctccccaccc

SEQ ID NO: 315831 - DNA, 13 bp, Homo sapiens
actccctcctcac

SEQ ID NO: 315832 - DNA, 15 bp, Homo sapiens
actccctcctcacct

SEQ ID NO: 315833 - DNA, 12 bp, Homo sapiens
actccctgagct

SEQ ID NO: 315834 - DNA, 21 bp, Homo sapiens
actccctggatgtgtggggca

SEQ ID NO: 315835 - DNA, 12 bp, Homo sapiens
actccctgtcca

SEQ ID NO: 315836 - DNA, 15 bp, Homo sapiens
actcccttcctggcc

SEQ ID NO: 315837 - DNA, 17 bp, Homo sapiens
actcccttcctggcctc

SEQ ID NO: 315838 - DNA, 20 bp, Homo sapiens
actccctttgtggactttat

SEQ ID NO: 315839 - DNA, 15 bp, Homo sapiens
actccgcccagcctc

SEQ ID NO: 315840 - DNA, 22 bp, Homo sapiens
actccggattccggccctggct

SEQ ID NO: 315841 - DNA, 20 bp, Homo sapiens
actccgggaccattgacctc

SEQ ID NO: 315842 - DNA, 14 bp, Homo sapiens
agtcagtttgcagt

SEQ ID NO: 315843 - DNA, 20 bp, Homo sapiens
agtcagttttttatctgggt

SEQ ID NO: 315844 - DNA, 21 bp, Homo sapiens
agtcataatcattagggggaa

SEQ ID NO: 315845 - DNA, 14 bp, Homo sapiens
agtcatatgtgaag

SEQ ID NO: 315846 - DNA, 16 bp, Homo sapiens
agtcatatgtgaagac

SEQ ID NO: 315847 - DNA, 16 bp, Homo sapiens
agtcatcaaaaagagt

SEQ ID NO: 315848 - DNA, 13 bp, Homo sapiens
agtcatcatctca

SEQ ID NO: 315849 - DNA, 19 bp, Homo sapiens
agtcatctccatcagctgt

SEQ ID NO: 315850 - DNA, 13 bp, Homo sapiens
agtcatctttgag

SEQ ID NO: 315851 - DNA, 13 bp, Homo sapiens
agtcatgaagctc

SEQ ID NO: 315852 - DNA, 18 bp, Homo sapiens
agtcatgaagctcagttt

SEQ ID NO: 315853 - DNA, 19 bp, Homo sapiens
agtcatgaagctcagtttg

SEQ ID NO: 315854 - DNA, 18 bp, Homo sapiens
agtcatgacatttctcaa

SEQ ID NO: 315855 - DNA, 19 bp, Homo sapiens
agtcatgacatttctcaaa

SEQ ID NO: 315856 - DNA, 20 bp, Homo sapiens
agtcatgggaacgcagcctc

SEQ ID NO: 315857 - DNA, 22 bp, Homo sapiens
agtcatgggaacgcagcctcca

SEQ ID NO: 315858 - DNA, 19 bp, Homo sapiens
agtcattaaaatggaagtg

SEQ ID NO: 315859 - DNA, 20 bp, Homo sapiens
agtcattgggttttatcagt

SEQ ID NO: 315860 - DNA, 18 bp, Homo sapiens
agtcattgtcgctcagca

SEQ ID NO: 315861 - DNA, 19 bp, Homo sapiens
agtcattttaactttatca

SEQ ID NO: 315862 - DNA, 13 bp, Homo sapiens
agtccaaaatcat

SEQ ID NO: 315863 - DNA, 14 bp, Homo sapiens
agtccaaaatcatt

SEQ ID NO: 315864 - DNA, 19 bp, Homo sapiens
agtccaaatgtcctccaga

SEQ ID NO: 315865 - DNA, 15 bp, Homo sapiens
agtccaataaattat

SEQ ID NO: 315866 - DNA, 22 bp, Homo sapiens
agtccacctgcctatccatcct

SEQ ID NO: 315867 - DNA, 15 bp, Homo sapiens
agtccactctgagtc

SEQ ID NO: 315868 - DNA, 20 bp, Homo sapiens
agtccactggggagtgctgg

SEQ ID NO: 315869 - DNA, 13 bp, Homo sapiens
agtccagacctgg

SEQ ID NO: 315870 - DNA, 20 bp, Homo sapiens
agtccagacctgggccctgg

SEQ ID NO: 315871 - DNA, 13 bp, Homo sapiens
agtccagctcccc

SEQ ID NO: 315872 - DNA, 20 bp, Homo sapiens
agtccagctccttaaactga

SEQ ID NO: 315873 - DNA, 14 bp, Homo sapiens
agtccaggagcccc

SEQ ID NO: 315874 - DNA, 19 bp, Homo sapiens
agtccaggccatggaggca

SEQ ID NO: 315875 - DNA, 23 bp, Homo sapiens
agtccaggtcgggctcagctctg

SEQ ID NO: 315876 - DNA, 20 bp, Homo sapiens
agtccagtgtttccacggct

SEQ ID NO: 315877 - DNA, 17 bp, Homo sapiens
agtcccagacaaggaga

SEQ ID NO: 315878 - DNA, 20 bp, Homo sapiens
agtcccagctacttgggagc

SEQ ID NO: 315879 - DNA, 21 bp, Homo sapiens
agtcccagctacttgggagcc

SEQ ID NO: 315880 - DNA, 13 bp, Homo sapiens
agtccccagccct

SEQ ID NO: 315881 - DNA, 20 bp, Homo sapiens
agtccccagcccttctgcct

SEQ ID NO: 315882 - DNA, 19 bp, Homo sapiens
agtcccccaccacactgaa

SEQ ID NO: 315883 - DNA, 20 bp, Homo sapiens
agtcccccctcccacctcca

SEQ ID NO: 315884 - DNA, 16 bp, Homo sapiens
agtccccctgccccag

SEQ ID NO: 315885 - DNA, 18 bp, Homo sapiens
agtccccgtgccccgcct

SEQ ID NO: 315886 - DNA, 23 bp, Homo sapiens
agtccccgtgccccgcctccccg

SEQ ID NO: 315887 - DNA, 21 bp, Homo sapiens
agtcccctccccggccctacc

SEQ ID NO: 315888 - DNA, 15 bp, Homo sapiens
agtcccgaggcagca

SEQ ID NO: 315889 - DNA, 23 bp, Homo sapiens
agtcccggcaaccagatttcagt

SEQ ID NO: 315890 - DNA, 22 bp, Homo sapiens
agtccctccctcctggctcaca

SEQ ID NO: 315891 - DNA, 14 bp, Homo sapiens
agtcccttccaggc

SEQ ID NO: 315892 - DNA, 23 bp, Homo sapiens
cagttggtgattttagatttctt

SEQ ID NO: 315893 - DNA, 17 bp, Homo sapiens
cagttggttttgcatgt

SEQ ID NO: 315894 - DNA, 20 bp, Homo sapiens
cagttgtaccactgctaata

SEQ ID NO: 315895 - DNA, 14 bp, Homo sapiens
cagttgtatagttt

SEQ ID NO: 315896 - DNA, 14 bp, Homo sapiens
cagttgtatttaat

SEQ ID NO: 315897 - DNA, 16 bp, Homo sapiens
cagttgtcagttgtga

SEQ ID NO: 315898 - DNA, 17 bp, Homo sapiens
cagttgttagtgtgtct

SEQ ID NO: 315899 - DNA, 14 bp, Homo sapiens
cagttgttatttag

SEQ ID NO: 315900 - DNA, 14 bp, Homo sapiens
cagttgttggcctc

SEQ ID NO: 315901 - DNA, 15 bp, Homo sapiens
cagttgttggcctcc

SEQ ID NO: 315902 - DNA, 13 bp, Homo sapiens
cagttgttttccc

SEQ ID NO: 315903 - DNA, 17 bp, Homo sapiens
cagtttaggacccaagg

SEQ ID NO: 315904 - DNA, 13 bp, Homo sapiens
cagtttagtgctt

SEQ ID NO: 315905 - DNA, 20 bp, Homo sapiens
cagtttatgcagtgctgctt

SEQ ID NO: 315906 - DNA, 22 bp, Homo sapiens
cagtttcaggtgtttagttgca

SEQ ID NO: 315907 - DNA, 23 bp, Homo sapiens
cagtttcccaaaaaccccagtgt

SEQ ID NO: 315908 - DNA, 12 bp, Homo sapiens
cagtttctgttg

SEQ ID NO: 315909 - DNA, 15 bp, Homo sapiens
cagtttgagacagga

SEQ ID NO: 315910 - DNA, 19 bp, Homo sapiens
cagtttggaagtgttaact

SEQ ID NO: 315911 - DNA, 19 bp, Homo sapiens
cagtttggctgtaatttaa

SEQ ID NO: 315912 - DNA, 20 bp, Homo sapiens
cagtttggctgtaatttaat

SEQ ID NO: 315913 - DNA, 18 bp, Homo sapiens
cagtttgtgaagtgattg

SEQ ID NO: 315914 - DNA, 15 bp, Homo sapiens
cagttttccatgaaa

SEQ ID NO: 315915 - DNA, 16 bp, Homo sapiens
cagttttgatacaaac

SEQ ID NO: 315916 - DNA, 16 bp, Homo sapiens
cagttttgtcttcgta

SEQ ID NO: 315917 - DNA, 11 bp, Homo sapiens
cagttttgtgt

SEQ ID NO: 315918 - DNA, 18 bp, Homo sapiens
cagttttgtgtacagtat

SEQ ID NO: 315919 - DNA, 19 bp, Homo sapiens
cagttttgtgtacagtatg

SEQ ID NO: 315920 - DNA, 19 bp, Homo sapiens
cagtttttgctgattgcta

SEQ ID NO: 315921 - DNA, 17 bp, Homo sapiens
cagtttttgtttttact

SEQ ID NO: 315922 - DNA, 16 bp, Homo sapiens
cagttttttatgctaa

SEQ ID NO: 315923 - DNA, 18 bp, Homo sapiens
cagttttttgccactgca

SEQ ID NO: 315924 - DNA, 20 bp, Homo sapiens
cagttttttgccactgcaaa

SEQ ID NO: 315925 - DNA, 14 bp, Homo sapiens
cataaaaagttaaa

SEQ ID NO: 315926 - DNA, 18 bp, Homo sapiens
cataaaaagttaaaaaaa

SEQ ID NO: 315927 - DNA, 16 bp, Homo sapiens
cataaaaataaccaaa

SEQ ID NO: 315928 - DNA, 20 bp, Homo sapiens
cataaaaatccctcttcctc

SEQ ID NO: 315929 - DNA, 15 bp, Homo sapiens
cataaaacaaaacca

SEQ ID NO: 315930 - DNA, 23 bp, Homo sapiens
cataaaacaaaaccaagccttgg

SEQ ID NO: 315931 - DNA, 22 bp, Homo sapiens
cataaaagagtggaactatcca

SEQ ID NO: 315932 - DNA, 20 bp, Homo sapiens
cataaaataaagtatatata

SEQ ID NO: 315933 - DNA, 14 bp, Homo sapiens
cataaaatctgtga

SEQ ID NO: 315934 - DNA, 16 bp, Homo sapiens
cataaagaaacacttt

SEQ ID NO: 315935 - DNA, 18 bp, Homo sapiens
cataaagcataagtatac

SEQ ID NO: 315936 - DNA, 14 bp, Homo sapiens
cataaagtgtaatt

SEQ ID NO: 315937 - DNA, 18 bp, Homo sapiens
cataaatctgtctgattc

SEQ ID NO: 315938 - DNA, 14 bp, Homo sapiens
cataaattatttct

SEQ ID NO: 315939 - DNA, 15 bp, Homo sapiens
cataaattggctcct

SEQ ID NO: 315940 - DNA, 19 bp, Homo sapiens
cataaattggctcctttcc

SEQ ID NO: 315941 - DNA, 16 bp, Homo sapiens
cataaatttgttgtca

SEQ ID NO: 315942 - DNA, 17 bp, Homo sapiens
cataacagggtaaatta

SEQ ID NO: 315943 - DNA, 13 bp, Homo sapiens
cataaccactgct

SEQ ID NO: 315944 - DNA, 19 bp, Homo sapiens
cataacctctatatcttta

SEQ ID NO: 315945 - DNA, 16 bp, Homo sapiens
cataactacagagtct

SEQ ID NO: 315946 - DNA, 15 bp, Homo sapiens
cataagaccgtgtcc

SEQ ID NO: 315947 - DNA, 17 bp, Homo sapiens
cataagaccgtgtccca

SEQ ID NO: 315948 - DNA, 13 bp, Homo sapiens
cataagatattct

SEQ ID NO: 315949 - DNA, 16 bp, Homo sapiens
cataagatattcttta

SEQ ID NO: 315950 - DNA, 21 bp, Homo sapiens
cataagatattctttacaaac

SEQ ID NO: 315951 - DNA, 23 bp, Homo sapiens
cataagcctccatttagttcttt

SEQ ID NO: 315952 - DNA, 22 bp, Homo sapiens
cataaggcatatacaaataaac

SEQ ID NO: 315953 - DNA, 21 bp, Homo sapiens
cataaggcctgccctcccatg

SEQ ID NO: 315954 - DNA, 16 bp, Homo sapiens
cataagtaattcaaga

SEQ ID NO: 315955 - DNA, 22 bp, Homo sapiens
cataagtaattcaagaaaacaa

SEQ ID NO: 315956 - DNA, 20 bp, Homo sapiens
cataatacattccatcacag

SEQ ID NO: 315957 - DNA, 16 bp, Homo sapiens
cataatactaatttat

SEQ ID NO: 315958 - DNA, 12 bp, Homo sapiens
cataatagaatt

SEQ ID NO: 315959 - DNA, 15 bp, Homo sapiens
cataatagaatttcc

SEQ ID NO: 315960 - DNA, 18 bp, Homo sapiens
cataatagttagccctca

SEQ ID NO: 315961 - DNA, 17 bp, Homo sapiens
cataatatcttgaagaa

SEQ ID NO: 315962 - DNA, 19 bp, Homo sapiens
cataatatcttgaagaata

SEQ ID NO: 315963 - DNA, 21 bp, Homo sapiens
cataatcatccttttttaaaa

SEQ ID NO: 315964 - DNA, 21 bp, Homo sapiens
cataatctagtttacagaaaa

SEQ ID NO: 315965 - DNA, 21 bp, Homo sapiens
cataatctggactcctctgtc

SEQ ID NO: 315966 - DNA, 23 bp, Homo sapiens
cataatctggactcctctgtcca

SEQ ID NO: 315967 - DNA, 21 bp, Homo sapiens
cataatgcactggggtaccac

SEQ ID NO: 315968 - DNA, 15 bp, Homo sapiens
cataatgtataaaga

SEQ ID NO: 315969 - DNA, 17 bp, Homo sapiens
cataatgttacattatt

SEQ ID NO: 315970 - DNA, 13 bp, Homo sapiens
cataattaaattt

SEQ ID NO: 315971 - DNA, 17 bp, Homo sapiens
cataattaaattttaat

SEQ ID NO: 315972 - DNA, 22 bp, Homo sapiens
cataattatgggaacaagtgta

SEQ ID NO: 315973 - DNA, 21 bp, Homo sapiens
cataattctaagttatttact

SEQ ID NO: 315974 - DNA, 12 bp, Homo sapiens
catacagcacta

SEQ ID NO: 315975 - DNA, 14 bp, Homo sapiens
catacagcctctac

SEQ ID NO: 315976 - DNA, 21 bp, Homo sapiens
catacatcagttattcattct

SEQ ID NO: 315977 - DNA, 16 bp, Homo sapiens
cataccacaataaaaa

SEQ ID NO: 315978 - DNA, 22 bp, Homo sapiens
cataccaggccgccccagcctc

SEQ ID NO: 315979 - DNA, 11 bp, Homo sapiens
cataccaggtg

SEQ ID NO: 315980 - DNA, 17 bp, Homo sapiens
cataccccctgccccag

SEQ ID NO: 315981 - DNA, 19 bp, Homo sapiens
cataccccctgccccagag

SEQ ID NO: 315982 - DNA, 21 bp, Homo sapiens
cataccccctgccccagagaa

SEQ ID NO: 315983 - DNA, 13 bp, Homo sapiens
cataccctccccc

SEQ ID NO: 315984 - DNA, 18 bp, Homo sapiens
cataccgtttggtgtctg

SEQ ID NO: 315985 - DNA, 13 bp, Homo sapiens
catactctccagg

SEQ ID NO: 315986 - DNA, 15 bp, Homo sapiens
catactctccaggat

SEQ ID NO: 315987 - DNA, 15 bp, Homo sapiens
catactctgtctccc

SEQ ID NO: 315988 - DNA, 22 bp, Homo sapiens
catactctgtgtaatctctgat

SEQ ID NO: 315989 - DNA, 13 bp, Homo sapiens
catactctgttgc

SEQ ID NO: 315990 - DNA, 21 bp, Homo sapiens
catactctgttgcctcctctc

SEQ ID NO: 315991 - DNA, 20 bp, Homo sapiens
catactgatgagacaacaca

SEQ ID NO: 315992 - DNA, 22 bp, Homo sapiens
catactgatgagacaacacaca

SEQ ID NO: 315993 - DNA, 16 bp, Homo sapiens
catactgcatgtaagc

SEQ ID NO: 315994 - DNA, 19 bp, Homo sapiens
catactgtaaggaaatgtt

SEQ ID NO: 315995 - DNA, 17 bp, Homo sapiens
catactgtcatataatg

SEQ ID NO: 315996 - DNA, 12 bp, Homo sapiens
catactttctct

SEQ ID NO: 315997 - DNA, 23 bp, Homo sapiens
catagaactgtcccacaaaatat

SEQ ID NO: 315998 - DNA, 18 bp, Homo sapiens
catagaatagcatgttgt

SEQ ID NO: 315999 - DNA, 12 bp, Homo sapiens
catagacacagt

SEQ ID NO: 316000 - DNA, 17 bp, Homo sapiens
catagagatatttaaaa

SEQ ID NO: 316001 - DNA, 15 bp, Homo sapiens
catagagtttaacac

SEQ ID NO: 316002 - DNA, 16 bp, Homo sapiens
catagattcacctgta

SEQ ID NO: 316003 - DNA, 17 bp, Homo sapiens
catagattcacctgtaa

SEQ ID NO: 316004 - DNA, 23 bp, Homo sapiens
catagattcacctgtaaaacttt

SEQ ID NO: 316005 - DNA, 15 bp, Homo sapiens
catagcatcctgatt

SEQ ID NO: 316006 - DNA, 15 bp, Homo sapiens
catagcattaactaa

SEQ ID NO: 316007 - DNA, 18 bp, Homo sapiens
catagccctcctgagcac

SEQ ID NO: 316008 - DNA, 16 bp, Homo sapiens
catagctatcaagtgt

SEQ ID NO: 316009 - DNA, 20 bp, Homo sapiens
catagctatcaagtgtgctt

SEQ ID NO: 316010 - DNA, 14 bp, Homo sapiens
catagctccttgga

SEQ ID NO: 316011 - DNA, 16 bp, Homo sapiens
catagctccttggagc

SEQ ID NO: 316012 - DNA, 21 bp, Homo sapiens
catagctccttggagcaggca

SEQ ID NO: 316013 - DNA, 13 bp, Homo sapiens
catagctctattt

SEQ ID NO: 316014 - DNA, 22 bp, Homo sapiens
catagcttacaagccagctgga

SEQ ID NO: 316015 - DNA, 13 bp, Homo sapiens
catagcttccatg

SEQ ID NO: 316016 - DNA, 19 bp, Homo sapiens
cataggaaaagtacattta

SEQ ID NO: 316017 - DNA, 15 bp, Homo sapiens
cataggaacatgtag

SEQ ID NO: 316018 - DNA, 18 bp, Homo sapiens
cataggaacatgtagttt

SEQ ID NO: 316019 - DNA, 17 bp, Homo sapiens
cataggacatactgcat

SEQ ID NO: 316020 - DNA, 20 bp, Homo sapiens
cataggacatactgcatgta

SEQ ID NO: 316021 - DNA, 22 bp, Homo sapiens
cataggattaagttcgaggtgg

SEQ ID NO: 316022 - DNA, 17 bp, Homo sapiens
catcatctctgcctttg

SEQ ID NO: 316023 - DNA, 18 bp, Homo sapiens
catcatctctgcctttga

SEQ ID NO: 316024 - DNA, 16 bp, Homo sapiens
catcatgaattttaca

SEQ ID NO: 316025 - DNA, 19 bp, Homo sapiens
catcatgagccgttgctaa

SEQ ID NO: 316026 - DNA, 21 bp, Homo sapiens
catcatgagccgttgctaatg

SEQ ID NO: 316027 - DNA, 14 bp, Homo sapiens
catcattgcactct

SEQ ID NO: 316028 - DNA, 12 bp, Homo sapiens
catcattggata

SEQ ID NO: 316029 - DNA, 18 bp, Homo sapiens
catcattggataaatttg

SEQ ID NO: 316030 - DNA, 20 bp, Homo sapiens
catcattggataaatttgaa

SEQ ID NO: 316031 - DNA, 13 bp, Homo sapiens
catcattgtatat

SEQ ID NO: 316032 - DNA, 14 bp, Homo sapiens
catcattgtatata

SEQ ID NO: 316033 - DNA, 15 bp, Homo sapiens
catcattgtatatat

SEQ ID NO: 316034 - DNA, 19 bp, Homo sapiens
catcattgtatatatgtgt

SEQ ID NO: 316035 - DNA, 12 bp, Homo sapiens
catcatttctgt

SEQ ID NO: 316036 - DNA, 21 bp, Homo sapiens
catcattttcacctccatttc

SEQ ID NO: 316037 - DNA, 22 bp, Homo sapiens
catcattttcacctccatttct

SEQ ID NO: 316038 - DNA, 15 bp, Homo sapiens
catccaaacatgtat

SEQ ID NO: 316039 - DNA, 13 bp, Homo sapiens
catccaaatctag

SEQ ID NO: 316040 - DNA, 19 bp, Homo sapiens
catccaacatttcctcagg

SEQ ID NO: 316041 - DNA, 17 bp, Homo sapiens
catccaaggcaaacaat

SEQ ID NO: 316042 - DNA, 14 bp, Homo sapiens
catccaatcctcac

SEQ ID NO: 316043 - DNA, 21 bp, Homo sapiens
catccaatcctcactgggtgg

SEQ ID NO: 316044 - DNA, 21 bp, Homo sapiens
catccacacaacaccaggact

SEQ ID NO: 316045 - DNA, 20 bp, Homo sapiens
catccaccccggctccccct

SEQ ID NO: 316046 - DNA, 18 bp, Homo sapiens
catccactctaccctccc

SEQ ID NO: 316047 - DNA, 22 bp, Homo sapiens
catccactctaccctcccaccc

SEQ ID NO: 316048 - DNA, 15 bp, Homo sapiens
catccagcatgtgtg

SEQ ID NO: 316049 - DNA, 22 bp, Homo sapiens
catccagcatgtgtgtgtctct

SEQ ID NO: 316050 - DNA, 14 bp, Homo sapiens
catccagcctgtgt

SEQ ID NO: 316051 - DNA, 16 bp, Homo sapiens
catccaggcctgaggc

SEQ ID NO: 316052 - DNA, 23 bp, Homo sapiens
catccagtggggtctcagtccag

SEQ ID NO: 316053 - DNA, 16 bp, Homo sapiens
catccatagacacagt

SEQ ID NO: 316054 - DNA, 20 bp, Homo sapiens
catccatagtgcactagcat

SEQ ID NO: 316055 - DNA, 14 bp, Homo sapiens
catccatatttctt

SEQ ID NO: 316056 - DNA, 21 bp, Homo sapiens
catccatatttctttttcttg

SEQ ID NO: 316057 - DNA, 22 bp, Homo sapiens
catccatctccagggagcaaga

SEQ ID NO: 316058 - DNA, 22 bp, Homo sapiens
catccatgcggagtccattatt

SEQ ID NO: 316059 - DNA, 13 bp, Homo sapiens
catccattctccc

SEQ ID NO: 316060 - DNA, 20 bp, Homo sapiens
catcccaaacccttcagtgc

SEQ ID NO: 316061 - DNA, 17 bp, Homo sapiens
catcccaataaagtcct

SEQ ID NO: 316062 - DNA, 19 bp, Homo sapiens
catcccacgcactccatga

SEQ ID NO: 316063 - DNA, 17 bp, Homo sapiens
catcccactccctttcc

SEQ ID NO: 316064 - DNA, 19 bp, Homo sapiens
catcccactggatctggct

SEQ ID NO: 316065 - DNA, 17 bp, Homo sapiens
catcccagcacctgcca

SEQ ID NO: 316066 - DNA, 12 bp, Homo sapiens
catcccagcctg

SEQ ID NO: 316067 - DNA, 13 bp, Homo sapiens
catcccagtggcc

SEQ ID NO: 316068 - DNA, 23 bp, Homo sapiens
catcccagtggcctcaaccctcc

SEQ ID NO: 316069 - DNA, 13 bp, Homo sapiens
catccccaccagc

SEQ ID NO: 316070 - DNA, 16 bp, Homo sapiens
catccccaccagctcg

SEQ ID NO: 316071 - DNA, 24 bp, Homo sapiens
catccccaccctcccctctcctga

SEQ ID NO: 316072 - DNA, 15 bp, Homo sapiens
catccccaccttcca

SEQ ID NO: 316073 - DNA, 12 bp, Homo sapiens
catccccagggg

SEQ ID NO: 316074 - DNA, 18 bp, Homo sapiens
catccccaggggtcccag

SEQ ID NO: 316075 - DNA, 16 bp, Homo sapiens
catccccatcctccag

SEQ ID NO: 316076 - DNA, 17 bp, Homo sapiens
catccccatcctccagc

SEQ ID NO: 316077 - DNA, 17 bp, Homo sapiens
catcccctcgtcctgtc

SEQ ID NO: 316078 - DNA, 21 bp, Homo sapiens
catcccctcgtcctgtcccag

SEQ ID NO: 316079 - DNA, 23 bp, Homo sapiens
catcccgacatggacccggagct

SEQ ID NO: 316080 - DNA, 14 bp, Homo sapiens
catcccggcctctt

SEQ ID NO: 316081 - DNA, 18 bp, Homo sapiens
catcccggcctcttccac

SEQ ID NO: 316082 - DNA, 17 bp, Homo sapiens
catcccggggccatgga

SEQ ID NO: 316083 - DNA, 20 bp, Homo sapiens
catcccggggccatggaagc

SEQ ID NO: 316084 - DNA, 22 bp, Homo sapiens
catcccggggccatggaagctg

SEQ ID NO: 316085 - DNA, 20 bp, Homo sapiens
catcccgtgcaaaacatgct

SEQ ID NO: 316086 - DNA, 16 bp, Homo sapiens
catccctaagaattcc

SEQ ID NO: 316087 - DNA, 17 bp, Homo sapiens
catccctaagaattccc

SEQ ID NO: 316088 - DNA, 22 bp, Homo sapiens
catccctaccccctaagagcca

SEQ ID NO: 316089 - DNA, 13 bp, Homo sapiens
catccctccaccc

SEQ ID NO: 316090 - DNA, 16 bp, Homo sapiens
catccctccaccccag

SEQ ID NO: 316091 - DNA, 23 bp, Homo sapiens
catccctccaccccagtccccgg

SEQ ID NO: 316092 - DNA, 18 bp, Homo sapiens
catccctgaggagccagg

SEQ ID NO: 316093 - DNA, 19 bp, Homo sapiens
catccctgcttgcccgctc

SEQ ID NO: 316094 - DNA, 22 bp, Homo sapiens
catccctgcttgcccgctccca

SEQ ID NO: 316095 - DNA, 20 bp, Homo sapiens
catccctgggggccttgggt

SEQ ID NO: 316096 - DNA, 17 bp, Homo sapiens
catcccttggcccctct

SEQ ID NO: 316097 - DNA, 20 bp, Homo sapiens
catcccttggcccctctctg

SEQ ID NO: 316098 - DNA, 15 bp, Homo sapiens
catccgcctctgagc

SEQ ID NO: 316099 - DNA, 17 bp, Homo sapiens
catccgcctctgagcca

SEQ ID NO: 316100 - DNA, 19 bp, Homo sapiens
catccgcctctgagccagg

SEQ ID NO: 316101 - DNA, 20 bp, Homo sapiens
catccgcctctgagccagga

SEQ ID NO: 316102 - DNA, 19 bp, Homo sapiens
catcctaaaagccacccca

SEQ ID NO: 316103 - DNA, 15 bp, Homo sapiens
catcctaccaatgca

SEQ ID NO: 316104 - DNA, 14 bp, Homo sapiens
catcctactcctac

SEQ ID NO: 316105 - DNA, 21 bp, Homo sapiens
catcctactcctacctggtca

SEQ ID NO: 316106 - DNA, 15 bp, Homo sapiens
catcctcaaaagaaa

SEQ ID NO: 316107 - DNA, 11 bp, Homo sapiens
catcctcagca

SEQ ID NO: 316108 - DNA, 14 bp, Homo sapiens
catcctcagcaagt

SEQ ID NO: 316109 - DNA, 13 bp, Homo sapiens
catcctcagcccc

SEQ ID NO: 316110 - DNA, 19 bp, Homo sapiens
catcctcagccccagggcc

SEQ ID NO: 316111 - DNA, 14 bp, Homo sapiens
catcctccagcttc

SEQ ID NO: 316112 - DNA, 18 bp, Homo sapiens
catcctccagggggcctg

SEQ ID NO: 316113 - DNA, 21 bp, Homo sapiens
catcctccccttccctgcaaa

SEQ ID NO: 316114 - DNA, 15 bp, Homo sapiens
catcctcctggaccc

SEQ ID NO: 316115 - DNA, 15 bp, Homo sapiens
catcctcttctgctt

SEQ ID NO: 316116 - DNA, 14 bp, Homo sapiens
catcctgattattg

SEQ ID NO: 316117 - DNA, 13 bp, Homo sapiens
catcctgccagga

SEQ ID NO: 316118 - DNA, 16 bp, Homo sapiens
catcctgccaggagca

SEQ ID NO: 316119 - DNA, 14 bp, Homo sapiens
catcctgcttctct

SEQ ID NO: 316120 - DNA, 12 bp, Homo sapiens
catcctggcccc

SEQ ID NO: 316121 - DNA, 15 bp, Homo sapiens
catcctggcccctcc

SEQ ID NO: 316122 - DNA, 17 bp, Homo sapiens
catcctggcctcctttt

SEQ ID NO: 316123 - DNA, 14 bp, Homo sapiens
catcctgtacaagt

SEQ ID NO: 316124 - DNA, 12 bp, Homo sapiens
catcctgtgtcc

SEQ ID NO: 316125 - DNA, 15 bp, Homo sapiens
catcctgtgtcccct

SEQ ID NO: 316126 - DNA, 17 bp, Homo sapiens
catccttcccgcagcac

SEQ ID NO: 316127 - DNA, 14 bp, Homo sapiens
catccttgaggacc

SEQ ID NO: 316128 - DNA, 21 bp, Homo sapiens
catccttgaggacctccacct

SEQ ID NO: 316129 - DNA, 20 bp, Homo sapiens
catccttttttctcttctgt

SEQ ID NO: 316130 - DNA, 12 bp, Homo sapiens
catcgcaggagt

SEQ ID NO: 316131 - DNA, 23 bp, Homo sapiens
catcgcaggagtctctgccaccc

SEQ ID NO: 316132 - DNA, 14 bp, Homo sapiens
catcgctggaaaac

SEQ ID NO: 316133 - DNA, 22 bp, Homo sapiens
catcgctgtccaagtgtttctt

SEQ ID NO: 316134 - DNA, 23 bp, Homo sapiens
catcgcttctttttcaaaactag

SEQ ID NO: 316135 - DNA, 13 bp, Homo sapiens
catcgggctgagg

SEQ ID NO: 316136 - DNA, 22 bp, Homo sapiens
catcggtgaaactaacagataa

SEQ ID NO: 316137 - DNA, 17 bp, Homo sapiens
catcggtgtccatttat

SEQ ID NO: 316138 - DNA, 18 bp, Homo sapiens
catcggtgtccatttata

SEQ ID NO: 316139 - DNA, 16 bp, Homo sapiens
catcggttcaggagga

SEQ ID NO: 316140 - DNA, 19 bp, Homo sapiens
catcgtgacccttcagggc

SEQ ID NO: 316141 - DNA, 21 bp, Homo sapiens
catcgtgacccttcagggcca

SEQ ID NO: 316142 - DNA, 17 bp, Homo sapiens
catcgtggtatgtgaat

SEQ ID NO: 316143 - DNA, 17 bp, Homo sapiens
catcgttttctttgctg

SEQ ID NO: 316144 - DNA, 19 bp, Homo sapiens
catcgttttctttgctgtg

SEQ ID NO: 316145 - DNA, 22 bp, Homo sapiens
catcgttttctttgctgtgcca

SEQ ID NO: 316146 - DNA, 23 bp, Homo sapiens
catctaatagcgggttactttca

SEQ ID NO: 316147 - DNA, 17 bp, Homo sapiens
catctaatgcttgttta

SEQ ID NO: 316148 - DNA, 22 bp, Homo sapiens
catctacacagcagtatgaatg

SEQ ID NO: 316149 - DNA, 15 bp, Homo sapiens
catctagcacagctg

SEQ ID NO: 316150 - DNA, 17 bp, Homo sapiens
catctagttaagtcgct

SEQ ID NO: 316151 - DNA, 22 bp, Homo sapiens
catctagttaagtcgctgaaca

SEQ ID NO: 316152 - DNA, 23 bp, Homo sapiens
catctattttctcagaatctatt

SEQ ID NO: 316153 - DNA, 17 bp, Homo sapiens
catctcactttaataat

SEQ ID NO: 316154 - DNA, 12 bp, Homo sapiens
catctcagaaga

SEQ ID NO: 316155 - DNA, 18 bp, Homo sapiens
catctcagaccctttagc

SEQ ID NO: 316156 - DNA, 16 bp, Homo sapiens
catctcagcctcctga

SEQ ID NO: 316157 - DNA, 23 bp, Homo sapiens
catctcagcctcctgagcctgtg

SEQ ID NO: 316158 - DNA, 17 bp, Homo sapiens
catctcaggccacctgc

SEQ ID NO: 316159 - DNA, 20 bp, Homo sapiens
catctcaggccacctgcccc

SEQ ID NO: 316160 - DNA, 15 bp, Homo sapiens
catctcaggtgccac

SEQ ID NO: 316161 - DNA, 19 bp, Homo sapiens
catctcaggtgccactccc

SEQ ID NO: 316162 - DNA, 21 bp, Homo sapiens
catctcaggtgccactccctg

SEQ ID NO: 316163 - DNA, 22 bp, Homo sapiens
catctcattcaaaccccaccct

SEQ ID NO: 316164 - DNA, 14 bp, Homo sapiens
catctccagggagt

SEQ ID NO: 316165 - DNA, 17 bp, Homo sapiens
catctccagggagtccc

SEQ ID NO: 316166 - DNA, 19 bp, Homo sapiens
catctccagggagtcccct

SEQ ID NO: 316167 - DNA, 20 bp, Homo sapiens
catctccagtatcctgctgg

SEQ ID NO: 316168 - DNA, 15 bp, Homo sapiens
catctccatcagctg

SEQ ID NO: 316169 - DNA, 18 bp, Homo sapiens
catctccccaggcctcca

SEQ ID NO: 316170 - DNA, 22 bp, Homo sapiens
catctccccaggcctccagcct

SEQ ID NO: 316171 - DNA, 22 bp, Homo sapiens
catctccctcgaacccacactg

SEQ ID NO: 316172 - DNA, 15 bp, Homo sapiens
catctcccttccacc

SEQ ID NO: 316173 - DNA, 17 bp, Homo sapiens
catctcccttccacctc

SEQ ID NO: 316174 - DNA, 23 bp, Homo sapiens
catctcctcccatggccttccct

SEQ ID NO: 316175 - DNA, 23 bp, Homo sapiens
catctccttcccccagcccaata

SEQ ID NO: 316176 - DNA, 15 bp, Homo sapiens
catctcgagccccct

SEQ ID NO: 316177 - DNA, 18 bp, Homo sapiens
catctcgagccccctgga

SEQ ID NO: 316178 - DNA, 23 bp, Homo sapiens
catctctaacagctcaggatctc

SEQ ID NO: 316179 - DNA, 21 bp, Homo sapiens
catctctccccatatataaat

SEQ ID NO: 316180 - DNA, 12 bp, Homo sapiens
catctctccctc

SEQ ID NO: 316181 - DNA, 15 bp, Homo sapiens
catctctccctcccc

SEQ ID NO: 316182 - DNA, 12 bp, Homo sapiens
catctctgcaaa

SEQ ID NO: 316183 - DNA, 15 bp, Homo sapiens
catctctgcctttga

SEQ ID NO: 316184 - DNA, 17 bp, Homo sapiens
catctctgctgaacatt

SEQ ID NO: 316185 - DNA, 13 bp, Homo sapiens
catctctgctgct

SEQ ID NO: 316186 - DNA, 22 bp, Homo sapiens
catctctgctgcttctgggcct

SEQ ID NO: 316187 - DNA, 13 bp, Homo sapiens
catctctgcttga

SEQ ID NO: 316188 - DNA, 21 bp, Homo sapiens
catctctgcttgagtcaggtt

SEQ ID NO: 316189 - DNA, 17 bp, Homo sapiens
catctctgtaaaaagca

SEQ ID NO: 316190 - DNA, 13 bp, Homo sapiens
catctgaaaagaa

SEQ ID NO: 316191 - DNA, 20 bp, Homo sapiens
catctgagaaggccctgtgc

SEQ ID NO: 316192 - DNA, 13 bp, Homo sapiens
catctgaggagtc

SEQ ID NO: 316193 - DNA, 18 bp, Homo sapiens
catctgagtccagctccc

SEQ ID NO: 316194 - DNA, 24 bp, Homo sapiens
catctgatattcaaacacacagta

SEQ ID NO: 316195 - DNA, 17 bp, Homo sapiens
catctgcaatatgaatt

SEQ ID NO: 316196 - DNA, 18 bp, Homo sapiens
catctgcaccgacgcctg

SEQ ID NO: 316197 - DNA, 19 bp, Homo sapiens
catctgcattttcacccca

SEQ ID NO: 316198 - DNA, 20 bp, Homo sapiens
catctgcattttcaccccac

SEQ ID NO: 316199 - DNA, 16 bp, Homo sapiens
catctgcccctccccc

SEQ ID NO: 316200 - DNA, 18 bp, Homo sapiens
catctgcccctcccccaa

SEQ ID NO: 316201 - DNA, 16 bp, Homo sapiens
catctgccttgctgca

SEQ ID NO: 316202 - DNA, 13 bp, Homo sapiens
catctgctcttct

SEQ ID NO: 316203 - DNA, 14 bp, Homo sapiens
catctgctcttctc

SEQ ID NO: 316204 - DNA, 18 bp, Homo sapiens
catctgctgagctctgac

SEQ ID NO: 316205 - DNA, 22 bp, Homo sapiens
catctgcttacaattccctgct

SEQ ID NO: 316206 - DNA, 12 bp, Homo sapiens
catctggcctgg

SEQ ID NO: 316207 - DNA, 13 bp, Homo sapiens
catctggcctggc

SEQ ID NO: 316208 - DNA, 16 bp, Homo sapiens
catctggcctggcctg

SEQ ID NO: 316209 - DNA, 11 bp, Homo sapiens
catctggggat

SEQ ID NO: 316210 - DNA, 15 bp, Homo sapiens
catctgtaccctgct

SEQ ID NO: 316211 - DNA, 17 bp, Homo sapiens
catctgtaccctgcttc

SEQ ID NO: 316212 - DNA, 11 bp, Homo sapiens
catctgtcagc

SEQ ID NO: 316213 - DNA, 18 bp, Homo sapiens
catctgtcccactgggac

SEQ ID NO: 316214 - DNA, 19 bp, Homo sapiens
catctgtggaaatgacagc

SEQ ID NO: 316215 - DNA, 17 bp, Homo sapiens
catctgttatcctgcta

SEQ ID NO: 316216 - DNA, 20 bp, Homo sapiens
catctgttgttttgttttaa

SEQ ID NO: 316217 - DNA, 15 bp, Homo sapiens
catctgtttgataca

SEQ ID NO: 316218 - DNA, 15 bp, Homo sapiens
catcttaatctttat

SEQ ID NO: 316219 - DNA, 16 bp, Homo sapiens
catcttcactgcaatt

SEQ ID NO: 316220 - DNA, 21 bp, Homo sapiens
catcttcacttctaaatgcat

SEQ ID NO: 316221 - DNA, 13 bp, Homo sapiens
catcttcatataa

SEQ ID NO: 316222 - DNA, 21 bp, Homo sapiens
catcttcccgcctcagcctct

SEQ ID NO: 316223 - DNA, 15 bp, Homo sapiens
catcttcctgctgct

SEQ ID NO: 316224 - DNA, 21 bp, Homo sapiens
catcttgaattgtaaggaatg

SEQ ID NO: 316225 - DNA, 12 bp, Homo sapiens
catcttggaaat

SEQ ID NO: 316226 - DNA, 18 bp, Homo sapiens
catcttggtagttctgtg

SEQ ID NO: 316227 - DNA, 14 bp, Homo sapiens
catcttgtcttttc

SEQ ID NO: 316228 - DNA, 16 bp, Homo sapiens
catctttatcattaaa

SEQ ID NO: 316229 - DNA, 17 bp, Homo sapiens
catctttattaacctca

SEQ ID NO: 316230 - DNA, 20 bp, Homo sapiens
catctttcctccaaactcct

SEQ ID NO: 316231 - DNA, 15 bp, Homo sapiens
catctttgccttggg

SEQ ID NO: 316232 - DNA, 13 bp, Homo sapiens
catcttttacatt

SEQ ID NO: 316233 - DNA, 17 bp, Homo sapiens
catcttttgggaagcca

SEQ ID NO: 316234 - DNA, 21 bp, Homo sapiens
catgaaaaacacggcagctgt

SEQ ID NO: 316235 - DNA, 12 bp, Homo sapiens
catgaaaaagca

SEQ ID NO: 316236 - DNA, 13 bp, Homo sapiens
catgaaaaagcag

SEQ ID NO: 316237 - DNA, 13 bp, Homo sapiens
catgaaaacgttt

SEQ ID NO: 316238 - DNA, 22 bp, Homo sapiens
catgaaaacgttttattgtgtt

SEQ ID NO: 316239 - DNA, 13 bp, Homo sapiens
catgaaaagtgct

SEQ ID NO: 316240 - DNA, 21 bp, Homo sapiens
catgaaaatcctaccaacctc

SEQ ID NO: 316241 - DNA, 17 bp, Homo sapiens
catgaaaatgtgtgttt

SEQ ID NO: 316242 - DNA, 13 bp, Homo sapiens
catgaaacaaagc

SEQ ID NO: 316243 - DNA, 13 bp, Homo sapiens
catgaaatgccct

SEQ ID NO: 316244 - DNA, 12 bp, Homo sapiens
catgaagaagct

SEQ ID NO: 316245 - DNA, 12 bp, Homo sapiens
catgaagacaga

SEQ ID NO: 316246 - DNA, 14 bp, Homo sapiens
catgaagattttct

SEQ ID NO: 316247 - DNA, 18 bp, Homo sapiens
catgaagattttctttct

SEQ ID NO: 316248 - DNA, 14 bp, Homo sapiens
catgaagccttgct

SEQ ID NO: 316249 - DNA, 20 bp, Homo sapiens
catgaaggtctacctgaaaa

SEQ ID NO: 316250 - DNA, 19 bp, Homo sapiens
catgaagtaaattgaaagc

SEQ ID NO: 316251 - DNA, 14 bp, Homo sapiens
catgaagtgaaaat

SEQ ID NO: 316252 - DNA, 23 bp, Homo sapiens
ctgggcttggggtgtggggtggg

SEQ ID NO: 316253 - DNA, 17 bp, Homo sapiens
ctggggaagaggccttg

SEQ ID NO: 316254 - DNA, 11 bp, Homo sapiens
ctggggaagga

SEQ ID NO: 316255 - DNA, 12 bp, Homo sapiens
ctggggaaggac

SEQ ID NO: 316256 - DNA, 16 bp, Homo sapiens
ctggggaaggaccaac

SEQ ID NO: 316257 - DNA, 24 bp, Homo sapiens
ctggggaagggaaccagccctcca

SEQ ID NO: 316258 - DNA, 19 bp, Homo sapiens
ctggggacagctttcctgg

SEQ ID NO: 316259 - DNA, 20 bp, Homo sapiens
ctggggacagctttcctggg

SEQ ID NO: 316260 - DNA, 21 bp, Homo sapiens
ctggggacagctttcctgggt

SEQ ID NO: 316261 - DNA, 18 bp, Homo sapiens
ctggggaccaggagctag

SEQ ID NO: 316262 - DNA, 11 bp, Homo sapiens
ctggggaccat

SEQ ID NO: 316263 - DNA, 19 bp, Homo sapiens
ctggggaggctgagactgc

SEQ ID NO: 316264 - DNA, 21 bp, Homo sapiens
ctggggatcccgtgctggaag

SEQ ID NO: 316265 - DNA, 23 bp, Homo sapiens
ctggggatggagaatgccagccc

SEQ ID NO: 316266 - DNA, 18 bp, Homo sapiens
ctggggcatgtgtgcctg

SEQ ID NO: 316267 - DNA, 21 bp, Homo sapiens
ctggggcatgtgtgcctgtgg

SEQ ID NO: 316268 - DNA, 23 bp, Homo sapiens
ctggggcatgtgtgcctgtggca

SEQ ID NO: 316269 - DNA, 17 bp, Homo sapiens
ctggggccccgctggga

SEQ ID NO: 316270 - DNA, 18 bp, Homo sapiens
ctggggccggagcctttg

SEQ ID NO: 316271 - DNA, 18 bp, Homo sapiens
ctggggcctggcagggag

SEQ ID NO: 316272 - DNA, 14 bp, Homo sapiens
ctggggcctggcct

SEQ ID NO: 316273 - DNA, 15 bp, Homo sapiens
ctggggcctggccta

SEQ ID NO: 316274 - DNA, 21 bp, Homo sapiens
ctggggctcacggggcctcca

SEQ ID NO: 316275 - DNA, 22 bp, Homo sapiens
ctggggctcacggggcctccaa

SEQ ID NO: 316276 - DNA, 14 bp, Homo sapiens
ctggggctcccttc

SEQ ID NO: 316277 - DNA, 19 bp, Homo sapiens
ctggggctcctttctccag

SEQ ID NO: 316278 - DNA, 20 bp, Homo sapiens
ctggggctgagtgcagaggc

SEQ ID NO: 316279 - DNA, 14 bp, Homo sapiens
ctggggctgccgtg

SEQ ID NO: 316280 - DNA, 22 bp, Homo sapiens
ctggggcttcaccagtctgtct

SEQ ID NO: 316281 - DNA, 18 bp, Homo sapiens
ctgggggaacagatgcta

SEQ ID NO: 316282 - DNA, 17 bp, Homo sapiens
cttggggccagactggc

SEQ ID NO: 316283 - DNA, 20 bp, Homo sapiens
cttggggccagactggctgc

SEQ ID NO: 316284 - DNA, 12 bp, Homo sapiens
cttggggcctgg

SEQ ID NO: 316285 - DNA, 14 bp, Homo sapiens
cttggggcctggcg

SEQ ID NO: 316286 - DNA, 16 bp, Homo sapiens
cttggggcctggcgtg

SEQ ID NO: 316287 - DNA, 14 bp, Homo sapiens
cttggggcctggct

SEQ ID NO: 316288 - DNA, 17 bp, Homo sapiens
cttggggcctggcttgc

SEQ ID NO: 316289 - DNA, 20 bp, Homo sapiens
cttggggctcgccccaccca

SEQ ID NO: 316290 - DNA, 22 bp, Homo sapiens
cttggggctcgccccacccagg

SEQ ID NO: 316291 - DNA, 20 bp, Homo sapiens
cttgggggaggccaccccaa

SEQ ID NO: 316292 - DNA, 16 bp, Homo sapiens
cttgggggcagagcag

SEQ ID NO: 316293 - DNA, 14 bp, Homo sapiens
cttggggtactctt

SEQ ID NO: 316294 - DNA, 21 bp, Homo sapiens
cttggggtactcttgatgtga

SEQ ID NO: 316295 - DNA, 19 bp, Homo sapiens
cttggggtagagaggacag

SEQ ID NO: 316296 - DNA, 22 bp, Homo sapiens
cttggggtcaggaacagtggct

SEQ ID NO: 316297 - DNA, 23 bp, Homo sapiens
cttgggttcaagtgattctcctg

SEQ ID NO: 316298 - DNA, 13 bp, Homo sapiens
cttgggttccttt

SEQ ID NO: 316299 - DNA, 14 bp, Homo sapiens
cttgggttcctttt

SEQ ID NO: 316300 - DNA, 23 bp, Homo sapiens
cttggtactactagatgtcttta

SEQ ID NO: 316301 - DNA, 22 bp, Homo sapiens
cttggtagaagcccttctacct

SEQ ID NO: 316302 - DNA, 16 bp, Homo sapiens
cttggtatttggatat

SEQ ID NO: 316303 - DNA, 23 bp, Homo sapiens
cttggtatttttcagagatttat

SEQ ID NO: 316304 - DNA, 13 bp, Homo sapiens
cttggtgccctga

SEQ ID NO: 316305 - DNA, 22 bp, Homo sapiens
cttggtgcggtaggtgctggcc

SEQ ID NO: 316306 - DNA, 13 bp, Homo sapiens
cttggtgctgctt

SEQ ID NO: 316307 - DNA, 14 bp, Homo sapiens
cttggtgctgcttt

SEQ ID NO: 316308 - DNA, 18 bp, Homo sapiens
cttggtgctgctttggct

SEQ ID NO: 316309 - DNA, 21 bp, Homo sapiens
cttggtggggctcgtggcctt

SEQ ID NO: 316310 - DNA, 21 bp, Homo sapiens
cttggtgtcctttccctccac

SEQ ID NO: 316311 - DNA, 16 bp, Homo sapiens
cttggttccctcttcc

SEQ ID NO: 316312 - DNA, 22 bp, Homo sapiens
cttggttccctcttccctggtc

SEQ ID NO: 316313 - DNA, 13 bp, Homo sapiens
cttggttcctcca

SEQ ID NO: 316314 - DNA, 20 bp, Homo sapiens
cttggttgtgaaccaactgc

SEQ ID NO: 316315 - DNA, 16 bp, Homo sapiens
cttggtttttggctct

SEQ ID NO: 316316 - DNA, 14 bp, Homo sapiens
cttgtaaaactgtg

SEQ ID NO: 316317 - DNA, 15 bp, Homo sapiens
cttgtaaaactgtga

SEQ ID NO: 316318 - DNA, 19 bp, Homo sapiens
cttgtaaaactgtgacatt

SEQ ID NO: 316319 - DNA, 15 bp, Homo sapiens
cttgtaaatacacca

SEQ ID NO: 316320 - DNA, 20 bp, Homo sapiens
cttgtaacaactaattataa

SEQ ID NO: 316321 - DNA, 13 bp, Homo sapiens
cttgtaattctaa

SEQ ID NO: 316322 - DNA, 17 bp, Homo sapiens
cttgtactaagccagga

SEQ ID NO: 316323 - DNA, 21 bp, Homo sapiens
cttgtagctggactgcaatat

SEQ ID NO: 316324 - DNA, 22 bp, Homo sapiens
cttgtagtttagtgtggttttc

SEQ ID NO: 316325 - DNA, 15 bp, Homo sapiens
cttgtatgctgccca

SEQ ID NO: 316326 - DNA, 18 bp, Homo sapiens
cttgtattgctccatttt

SEQ ID NO: 316327 - DNA, 22 bp, Homo sapiens
cttgtattttcttcccatttgt

SEQ ID NO: 316328 - DNA, 14 bp, Homo sapiens
cttgtcacaataaa

SEQ ID NO: 316329 - DNA, 13 bp, Homo sapiens
cttgtcagagctg

SEQ ID NO: 316330 - DNA, 15 bp, Homo sapiens
cttgtcagagctggg

SEQ ID NO: 316331 - DNA, 20 bp, Homo sapiens
cttgtcatcttttagagtaa

SEQ ID NO: 316332 - DNA, 12 bp, Homo sapiens
cttgtcatgtgt

SEQ ID NO: 316333 - DNA, 15 bp, Homo sapiens
cttgtcatgtgtata

SEQ ID NO: 316334 - DNA, 17 bp, Homo sapiens
cttgtcatgtgtataaa

SEQ ID NO: 316335 - DNA, 20 bp, Homo sapiens
cttgtccctctcactcccca

SEQ ID NO: 316336 - DNA, 14 bp, Homo sapiens
cttgtccctttccc

SEQ ID NO: 316337 - DNA, 17 bp, Homo sapiens
cttgtcctgccagctgc

SEQ ID NO: 316338 - DNA, 23 bp, Homo sapiens
cttgtctaaccccaggttttctg

SEQ ID NO: 316339 - DNA, 14 bp, Homo sapiens
cttgtctctgggct

SEQ ID NO: 316340 - DNA, 13 bp, Homo sapiens
cttgtctgaggcc

SEQ ID NO: 316341 - DNA, 15 bp, Homo sapiens
cttgtgactagtgct

SEQ ID NO: 316342 - DNA, 17 bp, Homo sapiens
cttgtgactagtgctga

SEQ ID NO: 316343 - DNA, 20 bp, Homo sapiens
cttgtgactagtgctgaagc

SEQ ID NO: 316344 - DNA, 22 bp, Homo sapiens
cttgtgactagtgctgaagctt

SEQ ID NO: 316345 - DNA, 14 bp, Homo sapiens
cttgtgatttccat

SEQ ID NO: 316346 - DNA, 15 bp, Homo sapiens
cttgtgcagtgttga

SEQ ID NO: 316347 - DNA, 19 bp, Homo sapiens
cttgtgccctgcctccacc

SEQ ID NO: 316348 - DNA, 12 bp, Homo sapiens
cttgtgcctccc

SEQ ID NO: 316349 - DNA, 14 bp, Homo sapiens
cttgtgcctccctt

SEQ ID NO: 316350 - DNA, 18 bp, Homo sapiens
cttgtgcctcccttccca

SEQ ID NO: 316351 - DNA, 17 bp, Homo sapiens
cttgtgctcacgctccc

SEQ ID NO: 316352 - DNA, 23 bp, Homo sapiens
cttgtgctcacgctcccccgcag

SEQ ID NO: 316353 - DNA, 11 bp, Homo sapiens
cttgtgctgag

SEQ ID NO: 316354 - DNA, 20 bp, Homo sapiens
cttgtgcttttcctatttgt

SEQ ID NO: 316355 - DNA, 16 bp, Homo sapiens
cttgtggataagggag

SEQ ID NO: 316356 - DNA, 18 bp, Homo sapiens
taatgctccttgttccta

SEQ ID NO: 316357 - DNA, 15 bp, Homo sapiens
taatgcttatgtgtt

SEQ ID NO: 316358 - DNA, 15 bp, Homo sapiens
taatgcttgtacagt

SEQ ID NO: 316359 - DNA, 12 bp, Homo sapiens
taatggaggcca

SEQ ID NO: 316360 - DNA, 13 bp, Homo sapiens
taatggaggccaa

SEQ ID NO: 316361 - DNA, 17 bp, Homo sapiens
taatggctagtactgta

SEQ ID NO: 316362 - DNA, 18 bp, Homo sapiens
taatggctagtactgtat

SEQ ID NO: 316363 - DNA, 23 bp, Homo sapiens
taatggctcatcaacaatcacaa

SEQ ID NO: 316364 - DNA, 14 bp, Homo sapiens
taatggtgttttaa

SEQ ID NO: 316365 - DNA, 18 bp, Homo sapiens
taatgtaacttaattata

SEQ ID NO: 316366 - DNA, 19 bp, Homo sapiens
taatgtaacttaattataa

SEQ ID NO: 316367 - DNA, 18 bp, Homo sapiens
taatgtacaagttttgta

SEQ ID NO: 316368 - DNA, 21 bp, Homo sapiens
taatgtacaagttttgtataa

SEQ ID NO: 316369 - DNA, 15 bp, Homo sapiens
taatgtacatctggc

SEQ ID NO: 316370 - DNA, 14 bp, Homo sapiens
taatgtaggactgt

SEQ ID NO: 316371 - DNA, 16 bp, Homo sapiens
taatgtaggactgtat

SEQ ID NO: 316372 - DNA, 19 bp, Homo sapiens
taatgtagttctttgttcc

SEQ ID NO: 316373 - DNA, 19 bp, Homo sapiens
taatgtctgtataaataat

SEQ ID NO: 316374 - DNA, 17 bp, Homo sapiens
taatgtcttcatttcat

SEQ ID NO: 316375 - DNA, 18 bp, Homo sapiens
taatgtggaaggtcatca

SEQ ID NO: 316376 - DNA, 18 bp, Homo sapiens
taatgtgtatttactgta

SEQ ID NO: 316377 - DNA, 21 bp, Homo sapiens
taatgtgtatttactgtacta

SEQ ID NO: 316378 - DNA, 22 bp, Homo sapiens
taatgttagaattgatttccaa

SEQ ID NO: 316379 - DNA, 22 bp, Homo sapiens
taatgttctgaataatttctta

SEQ ID NO: 316380 - DNA, 16 bp, Homo sapiens
taatgtttatgagcca

SEQ ID NO: 316381 - DNA, 11 bp, Homo sapiens
taatgtttcct

SEQ ID NO: 316382 - DNA, 19 bp, Homo sapiens
taatgtttcttaaatggaa

SEQ ID NO: 316383 - DNA, 14 bp, Homo sapiens
taattaaaaaatag

SEQ ID NO: 316384 - DNA, 15 bp, Homo sapiens
taattaaaataagaa

SEQ ID NO: 316385 - DNA, 23 bp, Homo sapiens
taattaaattttgagttctacat

SEQ ID NO: 316386 - DNA, 13 bp, Homo sapiens
taattaatttcag

SEQ ID NO: 316387 - DNA, 14 bp, Homo sapiens
taattaatttcagt

SEQ ID NO: 316388 - DNA, 17 bp, Homo sapiens
taattagaaaatatagt

SEQ ID NO: 316389 - DNA, 14 bp, Homo sapiens
taattataatgcaa

SEQ ID NO: 316390 - DNA, 16 bp, Homo sapiens
taattataatgcaaat

SEQ ID NO: 316391 - DNA, 22 bp, Homo sapiens
taattatcacaatgtactatat

SEQ ID NO: 316392 - DNA, 23 bp, Homo sapiens
taattatcacaatgtactatatg

SEQ ID NO: 316393 - DNA, 17 bp, Homo sapiens
taattatcggaagcagt

SEQ ID NO: 316394 - DNA, 19 bp, Homo sapiens
taattatcggaagcagtgc

SEQ ID NO: 316395 - DNA, 21 bp, Homo sapiens
taattatcggaagcagtgcct

SEQ ID NO: 316396 - DNA, 18 bp, Homo sapiens
taattatcgggaacagtg

SEQ ID NO: 316397 - DNA, 18 bp, Homo sapiens
taattatctgtgatggat

SEQ ID NO: 316398 - DNA, 21 bp, Homo sapiens
taattatgacagttatactgt

SEQ ID NO: 316399 - DNA, 14 bp, Homo sapiens
taattatgttattg

SEQ ID NO: 316400 - DNA, 14 bp, Homo sapiens
taattcaactctgt

SEQ ID NO: 316401 - DNA, 17 bp, Homo sapiens
taattcaaggagaatat

SEQ ID NO: 316402 - DNA, 15 bp, Homo sapiens
taattcaatgctttc

SEQ ID NO: 316403 - DNA, 13 bp, Homo sapiens
taattcaatttct

SEQ ID NO: 316404 - DNA, 23 bp, Homo sapiens
taattcagagtggtttcattgcc

SEQ ID NO: 316405 - DNA, 14 bp, Homo sapiens
taattcagatggat

SEQ ID NO: 316406 - DNA, 21 bp, Homo sapiens
taattcagattaggacacagt

SEQ ID NO: 316407 - DNA, 21 bp, Homo sapiens
taattcagcactgatttcaca

SEQ ID NO: 316408 - DNA, 17 bp, Homo sapiens
taattcatacctccctc

SEQ ID NO: 316409 - DNA, 19 bp, Homo sapiens
taattccaatatgatgact

SEQ ID NO: 316410 - DNA, 20 bp, Homo sapiens
taattccaatatgatgactc

SEQ ID NO: 316411 - DNA, 18 bp, Homo sapiens
taattcccattttgcaaa

SEQ ID NO: 316412 - DNA, 15 bp, Homo sapiens
tacacttacaagtaa

SEQ ID NO: 316413 - DNA, 13 bp, Homo sapiens
tacacttggagcc

SEQ ID NO: 316414 - DNA, 17 bp, Homo sapiens
tacacttggtgtactgg

SEQ ID NO: 316415 - DNA, 15 bp, Homo sapiens
tacacttgtaaataa

SEQ ID NO: 316416 - DNA, 16 bp, Homo sapiens
tacagaaagcaaatca

SEQ ID NO: 316417 - DNA, 11 bp, Homo sapiens
tacagaatcat

SEQ ID NO: 316418 - DNA, 14 bp, Homo sapiens
tacagacaaagcgt

SEQ ID NO: 316419 - DNA, 11 bp, Homo sapiens
tacagacacta

SEQ ID NO: 316420 - DNA, 19 bp, Homo sapiens
tacagacactaagttatag

SEQ ID NO: 316421 - DNA, 20 bp, Homo sapiens
tacagagaggagaaacacat

SEQ ID NO: 316422 - DNA, 18 bp, Homo sapiens
tacagaggattctgtctt

SEQ ID NO: 316423 - DNA, 18 bp, Homo sapiens
tacagataaggaaactga

SEQ ID NO: 316424 - DNA, 20 bp, Homo sapiens
tacagataaggaaactgagg

SEQ ID NO: 316425 - DNA, 20 bp, Homo sapiens
tacagataatttattttgta

SEQ ID NO: 316426 - DNA, 21 bp, Homo sapiens
tacagataatttattttgtat

SEQ ID NO: 316427 - DNA, 16 bp, Homo sapiens
tacagatccgcatgtg

SEQ ID NO: 316428 - DNA, 20 bp, Homo sapiens
tacagatccgcatgtgtctg

SEQ ID NO: 316429 - DNA, 13 bp, Homo sapiens
tacagatgaaaat

SEQ ID NO: 316430 - DNA, 14 bp, Homo sapiens
tacagatttagttt

SEQ ID NO: 316431 - DNA, 16 bp, Homo sapiens
tacagatttagtttac

SEQ ID NO: 316432 - DNA, 17 bp, Homo sapiens
tacagcactactctgtg

SEQ ID NO: 316433 - DNA, 19 bp, Homo sapiens
tacagcactactctgtgcc

SEQ ID NO: 316434 - DNA, 18 bp, Homo sapiens
tacagcaggatgtgcctg

SEQ ID NO: 316435 - DNA, 11 bp, Homo sapiens
tacagcagggt

SEQ ID NO: 316436 - DNA, 21 bp, Homo sapiens
tacagcagggtcttgctgtaa

SEQ ID NO: 316437 - DNA, 13 bp, Homo sapiens
tacagcctgcaca

SEQ ID NO: 316438 - DNA, 14 bp, Homo sapiens
tacagcctgcacac

SEQ ID NO: 316439 - DNA, 21 bp, Homo sapiens
tacagcctggtttttaagtac

SEQ ID NO: 316440 - DNA, 18 bp, Homo sapiens
tacagccttcactggaga

SEQ ID NO: 316441 - DNA, 19 bp, Homo sapiens
tacagccttcactggagac

SEQ ID NO: 316442 - DNA, 20 bp, Homo sapiens
tacagctgaaagacagtaaa

SEQ ID NO: 316443 - DNA, 13 bp, Homo sapiens
tacagctgcctgc

SEQ ID NO: 316444 - DNA, 18 bp, Homo sapiens
tacagctttcatgattag

SEQ ID NO: 316445 - DNA, 21 bp, Homo sapiens
tacaggaagcaccccatgcca

SEQ ID NO: 316446 - DNA, 22 bp, Homo sapiens
tacaggaagtactggagaaaat

SEQ ID NO: 316447 - DNA, 14 bp, Homo sapiens
tacaggatcatgta

SEQ ID NO: 316448 - DNA, 22 bp, Homo sapiens
tacaggatggttactgaggacc

SEQ ID NO: 316449 - DNA, 14 bp, Homo sapiens
tacaggcaccgaga

SEQ ID NO: 316450 - DNA, 18 bp, Homo sapiens
tacaggcctttcaggaag

SEQ ID NO: 316451 - DNA, 24 bp, Homo sapiens
tacagggaactgggaagatgctgg

SEQ ID NO: 316452 - DNA, 21 bp, Homo sapiens
tacagggcatgcattttgcag

SEQ ID NO: 316453 - DNA, 15 bp, Homo sapiens
tacaggggaggctga

SEQ ID NO: 316454 - DNA, 17 bp, Homo sapiens
tacaggtattttcatca

SEQ ID NO: 316455 - DNA, 15 bp, Homo sapiens
tacagtaaataaatt

SEQ ID NO: 316456 - DNA, 18 bp, Homo sapiens
tacagtaaataaattgtt

SEQ ID NO: 316457 - DNA, 20 bp, Homo sapiens
tacagtagctgtggggagct

SEQ ID NO: 316458 - DNA, 16 bp, Homo sapiens
tacagtatataagctt

SEQ ID NO: 316459 - DNA, 17 bp, Homo sapiens
tacagtatataagcttt

SEQ ID NO: 316460 - DNA, 17 bp, Homo sapiens
tacagtatgtgtctagc

SEQ ID NO: 316461 - DNA, 13 bp, Homo sapiens
tacagtattctgt

SEQ ID NO: 316462 - DNA, 13 bp, Homo sapiens
tacagtcattatt

SEQ ID NO: 316463 - DNA, 17 bp, Homo sapiens
tacagtctcaattttgt

SEQ ID NO: 316464 - DNA, 18 bp, Homo sapiens
tacagtctcaattttgta

SEQ ID NO: 316465 - DNA, 22 bp, Homo sapiens
tacagtctcaattttgtattta

SEQ ID NO: 316466 - DNA, 13 bp, Homo sapiens
tacagtctgtcat

SEQ ID NO: 316467 - DNA, 16 bp, Homo sapiens
tacagtctgtcatgaa

SEQ ID NO: 316468 - DNA, 19 bp, Homo sapiens
tacagtgaaattttggtga

SEQ ID NO: 316469 - DNA, 17 bp, Homo sapiens
tacagtgaggagggtgg

SEQ ID NO: 316470 - DNA, 12 bp, Homo sapiens
tacagtgcctgt

SEQ ID NO: 316471 - DNA, 16 bp, Homo sapiens
tacagtgtatctcgaa

SEQ ID NO: 316472 - DNA, 23 bp, Homo sapiens
tacagttaggcaccagaagaaca

SEQ ID NO: 316473 - DNA, 14 bp, Homo sapiens
tacagttatacata

SEQ ID NO: 316474 - DNA, 17 bp, Homo sapiens
tacagttatacatacct

SEQ ID NO: 316475 - DNA, 12 bp, Homo sapiens
tacagttcagtt

SEQ ID NO: 316476 - DNA, 15 bp, Homo sapiens
tacagttcataaatt

SEQ ID NO: 316477 - DNA, 18 bp, Homo sapiens
tacagttcttcgggaaga

SEQ ID NO: 316478 - DNA, 15 bp, Homo sapiens
tacagttgactggct

SEQ ID NO: 316479 - DNA, 16 bp, Homo sapiens
tacagttgactggctt

SEQ ID NO: 316480 - DNA, 22 bp, Homo sapiens
tacagttgactggctttcctct

SEQ ID NO: 316481 - DNA, 18 bp, Homo sapiens
tacagttgttggcctccg

SEQ ID NO: 316482 - DNA, 16 bp, Homo sapiens
tacagttttaaagaat

SEQ ID NO: 316483 - DNA, 22 bp, Homo sapiens
tacataaattgcataaagcata

SEQ ID NO: 316484 - DNA, 15 bp, Homo sapiens
tacataacaggcatt

SEQ ID NO: 316485 - DNA, 19 bp, Homo sapiens
tacataacagggtaaatta

SEQ ID NO: 316486 - DNA, 23 bp, Homo sapiens
tacataacagggtaaattattca

SEQ ID NO: 316487 - DNA, 16 bp, Homo sapiens
tacataagtaattcaa

SEQ ID NO: 316488 - DNA, 17 bp, Homo sapiens
tacataagtaattcaag

SEQ ID NO: 316489 - DNA, 20 bp, Homo sapiens
tacataatgttagtagcact

SEQ ID NO: 316490 - DNA, 22 bp, Homo sapiens
tacataattttttattcaagtt

SEQ ID NO: 316491 - DNA, 14 bp, Homo sapiens
tacatacattgtat

SEQ ID NO: 316492 - DNA, 19 bp, Homo sapiens
tacatacctctctctatat

SEQ ID NO: 316493 - DNA, 23 bp, Homo sapiens
tacatacctctctctatatatac

SEQ ID NO: 316494 - DNA, 12 bp, Homo sapiens
tacatagtcttt

SEQ ID NO: 316495 - DNA, 14 bp, Homo sapiens
tacatagtgaattt

SEQ ID NO: 316496 - DNA, 19 bp, Homo sapiens
tacatagttttaaactcat

SEQ ID NO: 316497 - DNA, 21 bp, Homo sapiens
tacatagttttaaactcattt

SEQ ID NO: 316498 - DNA, 22 bp, Homo sapiens
ctttccacatttgtcacagaaa

SEQ ID NO: 316499 - DNA, 20 bp, Homo sapiens
ctttccaccccctccctggc

SEQ ID NO: 316500 - DNA, 23 bp, Homo sapiens
ctttccaccccctccctggcctg

SEQ ID NO: 316501 - DNA, 19 bp, Homo sapiens
ctttccagaaggccacagg

SEQ ID NO: 316502 - DNA, 14 bp, Homo sapiens
ctttccagccgtgt

SEQ ID NO: 316503 - DNA, 14 bp, Homo sapiens
ctttccagggtctt

SEQ ID NO: 316504 - DNA, 12 bp, Homo sapiens
ctttccatgaca

SEQ ID NO: 316505 - DNA, 12 bp, Homo sapiens
ctttccatgcag

SEQ ID NO: 316506 - DNA, 21 bp, Homo sapiens
ctttcccaacacttcagactg

SEQ ID NO: 316507 - DNA, 13 bp, Homo sapiens
ctttcccacagtc

SEQ ID NO: 316508 - DNA, 23 bp, Homo sapiens
ctttcccacagtctctccctggg

SEQ ID NO: 316509 - DNA, 21 bp, Homo sapiens
ctttcccatcaccccttcccc

SEQ ID NO: 316510 - DNA, 15 bp, Homo sapiens
ctttcccatcttaaa

SEQ ID NO: 316511 - DNA, 21 bp, Homo sapiens
ctttcccatttcgtgtaatat

SEQ ID NO: 316512 - DNA, 11 bp, Homo sapiens
ctttccccaga

SEQ ID NO: 316513 - DNA, 13 bp, Homo sapiens
ctttccccagagg

SEQ ID NO: 316514 - DNA, 15 bp, Homo sapiens
ctttccctagaaagc

SEQ ID NO: 316515 - DNA, 15 bp, Homo sapiens
ctttccctgcatccc

SEQ ID NO: 316516 - DNA, 20 bp, Homo sapiens
ctttccctggagtcagtttt

SEQ ID NO: 316517 - DNA, 16 bp, Homo sapiens
ctttccctggctcagg

SEQ ID NO: 316518 - DNA, 20 bp, Homo sapiens
ctttcctagatggcagtcac

SEQ ID NO: 316519 - DNA, 21 bp, Homo sapiens
ctttcctagatggcagtcact

SEQ ID NO: 316520 - DNA, 20 bp, Homo sapiens
ctttcctattttcttttcca

SEQ ID NO: 316521 - DNA, 22 bp, Homo sapiens
ctttcctccaaactcctgcctg

SEQ ID NO: 316522 - DNA, 23 bp, Homo sapiens
ctttcctccaaactcctgcctgt

SEQ ID NO: 316523 - DNA, 16 bp, Homo sapiens
ctttcctcccttcttt

SEQ ID NO: 316524 - DNA, 14 bp, Homo sapiens
ctttcctccttcca

SEQ ID NO: 316525 - DNA, 17 bp, Homo sapiens
ctttcctcctttatcac

SEQ ID NO: 316526 - DNA, 23 bp, Homo sapiens
ctttcctgccataaaagctatga

SEQ ID NO: 316527 - DNA, 19 bp, Homo sapiens
ctttcctgccccaggcctg

SEQ ID NO: 316528 - DNA, 17 bp, Homo sapiens
ctttcctgggtgagttt

SEQ ID NO: 316529 - DNA, 12 bp, Homo sapiens
ctttcctgtgcc

SEQ ID NO: 316530 - DNA, 16 bp, Homo sapiens
ctttcctgtgccaacc

SEQ ID NO: 316531 - DNA, 15 bp, Homo sapiens
ctttccttccatccc

SEQ ID NO: 316532 - DNA, 22 bp, Homo sapiens
ctttccttcggaatccagtgct

SEQ ID NO: 316533 - DNA, 14 bp, Homo sapiens
ctttccttgccttc

SEQ ID NO: 316534 - DNA, 19 bp, Homo sapiens
ctttcctttcatcctcagc

SEQ ID NO: 316535 - DNA, 17 bp, Homo sapiens
ctttcgttggttgtttc

SEQ ID NO: 316536 - DNA, 18 bp, Homo sapiens
ctttcgttggttgtttct

SEQ ID NO: 316537 - DNA, 22 bp, Homo sapiens
ctttcgttggttgtttctctga

SEQ ID NO: 316538 - DNA, 23 bp, Homo sapiens
ctttcgttggttgtttctctgag

SEQ ID NO: 316539 - DNA, 15 bp, Homo sapiens
ctttctaatgtagct

SEQ ID NO: 316540 - DNA, 17 bp, Homo sapiens
ctttctaatgtgtgaat

SEQ ID NO: 316541 - DNA, 20 bp, Homo sapiens
ctttctacatgactgggcct

SEQ ID NO: 316542 - DNA, 23 bp, Homo sapiens
ctttgggggattcaaatgcatga

SEQ ID NO: 316543 - DNA, 17 bp, Homo sapiens
ctttgggtttcttgttt

SEQ ID NO: 316544 - DNA, 19 bp, Homo sapiens
ctttggtctccatttttcc

SEQ ID NO: 316545 - DNA, 15 bp, Homo sapiens
ctttggtctcttgct

SEQ ID NO: 316546 - DNA, 17 bp, Homo sapiens
ctttggtctcttgcttg

SEQ ID NO: 316547 - DNA, 16 bp, Homo sapiens
ctttggtcttcttcca

SEQ ID NO: 316548 - DNA, 17 bp, Homo sapiens
ctttggttggaacttta

SEQ ID NO: 316549 - DNA, 14 bp, Homo sapiens
ctttggttttacta

SEQ ID NO: 316550 - DNA, 11 bp, Homo sapiens
ctttgtaagac

SEQ ID NO: 316551 - DNA, 16 bp, Homo sapiens
ctttgtaagacacaca

SEQ ID NO: 316552 - DNA, 20 bp, Homo sapiens
ctttgtaagacacacagcct

SEQ ID NO: 316553 - DNA, 21 bp, Homo sapiens
ctttgtaagacacacagcctt

SEQ ID NO: 316554 - DNA, 23 bp, Homo sapiens
ctttgtaagacacacagcctttc

SEQ ID NO: 316555 - DNA, 22 bp, Homo sapiens
ctttgtaagtaaactgccctgt

SEQ ID NO: 316556 - DNA, 19 bp, Homo sapiens
ctttgtaatgcttgtacag

SEQ ID NO: 316557 - DNA, 20 bp, Homo sapiens
ctttgtaattatttttaata

SEQ ID NO: 316558 - DNA, 23 bp, Homo sapiens
ctttgtagatgtattttcaataa

SEQ ID NO: 316559 - DNA, 20 bp, Homo sapiens
ctttgtagttaatgtactct

SEQ ID NO: 316560 - DNA, 15 bp, Homo sapiens
ctttgtatcttaaat

SEQ ID NO: 316561 - DNA, 17 bp, Homo sapiens
ctttgtatcttaaatct

SEQ ID NO: 316562 - DNA, 23 bp, Homo sapiens
ctttgtatgatgaaaagaatgtg

SEQ ID NO: 316563 - DNA, 16 bp, Homo sapiens
ctttgtcaatgctcta

SEQ ID NO: 316564 - DNA, 13 bp, Homo sapiens
ctttgtcacttct

SEQ ID NO: 316565 - DNA, 21 bp, Homo sapiens
ctttgtcacttctgctgtaca

SEQ ID NO: 316566 - DNA, 15 bp, Homo sapiens
ctttgtcccacagct

SEQ ID NO: 316567 - DNA, 17 bp, Homo sapiens
ctttgtcttttttttca

SEQ ID NO: 316568 - DNA, 12 bp, Homo sapiens
ctttgtgcaaaa

SEQ ID NO: 316569 - DNA, 17 bp, Homo sapiens
ctttgtgcaaaagcagg

SEQ ID NO: 316570 - DNA, 11 bp, Homo sapiens
ctttgtgctga

SEQ ID NO: 316571 - DNA, 20 bp, Homo sapiens
ctttgtggatgtcttccttg

SEQ ID NO: 316572 - DNA, 22 bp, Homo sapiens
ctttgtggcagtggccaggcag

SEQ ID NO: 316573 - DNA, 21 bp, Homo sapiens
ctttgtggggcttggcgtgga

SEQ ID NO: 316574 - DNA, 13 bp, Homo sapiens
ctttgtgtctttt

SEQ ID NO: 316575 - DNA, 15 bp, Homo sapiens
ctttgtgtcttttgt

SEQ ID NO: 316576 - DNA, 15 bp, Homo sapiens
ctttgtgtgattgaa

SEQ ID NO: 316577 - DNA, 13 bp, Homo sapiens
ctttgtgtgctgt

SEQ ID NO: 316578 - DNA, 13 bp, Homo sapiens
ctttgttacactg

SEQ ID NO: 316579 - DNA, 16 bp, Homo sapiens
ctttgttaccttaaaa

SEQ ID NO: 316580 - DNA, 15 bp, Homo sapiens
ctttgttcctgcttt

SEQ ID NO: 316581 - DNA, 22 bp, Homo sapiens
ctttgttcctgctttctctttc

SEQ ID NO: 316582 - DNA, 18 bp, Homo sapiens
ctttgttctaaagatgga

SEQ ID NO: 316583 - DNA, 20 bp, Homo sapiens
ctttgttctttaggagattt

SEQ ID NO: 316584 - DNA, 16 bp, Homo sapiens
ctttgttgcccaggct

SEQ ID NO: 316585 - DNA, 23 bp, Homo sapiens
ctttgtttacatgagttcaaata

SEQ ID NO: 316586 - DNA, 23 bp, Homo sapiens
ctttgtttatgaagaaagatact

SEQ ID NO: 316587 - DNA, 17 bp, Homo sapiens
ctttgtttcaaccaagt

SEQ ID NO: 316588 - DNA, 22 bp, Homo sapiens
ctttgtttccagaaattcttca

SEQ ID NO: 316589 - DNA, 11 bp, Homo sapiens
ctttgttttgt

SEQ ID NO: 316590 - DNA, 19 bp, Homo sapiens
ctttgttttgttttaagga

SEQ ID NO: 316591 - DNA, 16 bp, Homo sapiens
ctttgtttttccatgt

SEQ ID NO: 316592 - DNA, 23 bp, Homo sapiens
ctttgtttttccatgtgttttgc

SEQ ID NO: 316593 - DNA, 16 bp, Homo sapiens
ctttgtttttttttcc

SEQ ID NO: 316594 - DNA, 23 bp, Homo sapiens
ctttgtttttttttcctgtcctt

SEQ ID NO: 316595 - DNA, 15 bp, Homo sapiens
cttttaaattctttt

SEQ ID NO: 316596 - DNA, 20 bp, Homo sapiens
cttttaacgtatgtatttca

SEQ ID NO: 316597 - DNA, 14 bp, Homo sapiens
cttttaactgccgc

SEQ ID NO: 316598 - DNA, 13 bp, Homo sapiens
cttttaagaaaca

SEQ ID NO: 316599 - DNA, 14 bp, Homo sapiens
cttttaatcagaca

SEQ ID NO: 316600 - DNA, 14 bp, Homo sapiens
cttttacagctttt

SEQ ID NO: 316601 - DNA, 15 bp, Homo sapiens
cttttactaagcact

SEQ ID NO: 316602 - DNA, 21 bp, Homo sapiens
cttttactgtggaggtggctg

SEQ ID NO: 316603 - DNA, 23 bp, Homo sapiens
cttttactgtggaggtggctggt

SEQ ID NO: 316604 - DNA, 13 bp, Homo sapiens
cttttacttgttc

SEQ ID NO: 316605 - DNA, 17 bp, Homo sapiens
cttttactttttatgaa

SEQ ID NO: 316606 - DNA, 18 bp, Homo sapiens
cttttacttttttatagc

SEQ ID NO: 316607 - DNA, 22 bp, Homo sapiens
cttttagttttagttgcagaaa

SEQ ID NO: 316608 - DNA, 13 bp, Homo sapiens
cttttataaatta

SEQ ID NO: 316609 - DNA, 14 bp, Homo sapiens
cttttataaattaa

SEQ ID NO: 316610 - DNA, 15 bp, Homo sapiens
cttttataaattaaa

SEQ ID NO: 316611 - DNA, 18 bp, Homo sapiens
cttttataagatttaatt

SEQ ID NO: 316612 - DNA, 12 bp, Homo sapiens
cttttatagcta

SEQ ID NO: 316613 - DNA, 12 bp, Homo sapiens
cttttatatata

SEQ ID NO: 316614 - DNA, 13 bp, Homo sapiens
cttttatatataa

SEQ ID NO: 316615 - DNA, 20 bp, Homo sapiens
cttttatatataaaataaat

SEQ ID NO: 316616 - DNA, 21 bp, Homo sapiens
cttttatatataaaataaata

SEQ ID NO: 316617 - DNA, 22 bp, Homo sapiens
cttttatatataaaataaatat

SEQ ID NO: 316618 - DNA, 13 bp, Homo sapiens
cttttatatctgt

SEQ ID NO: 316619 - DNA, 15 bp, Homo sapiens
cttttatatggccca

SEQ ID NO: 316620 - DNA, 20 bp, Homo sapiens
cttttatatggcccagcctt

SEQ ID NO: 316621 - DNA, 17 bp, Homo sapiens
cttttatctatttgaga

SEQ ID NO: 316622 - DNA, 15 bp, Homo sapiens
cttttatctcacaaa

SEQ ID NO: 316623 - DNA, 16 bp, Homo sapiens
cttttatgtttgtaca

SEQ ID NO: 316624 - DNA, 23 bp, Homo sapiens
cttttatgtttgtacacaacacc

SEQ ID NO: 316625 - DNA, 12 bp, Homo sapiens
cttttatttcat

SEQ ID NO: 316626 - DNA, 23 bp, Homo sapiens
cttttatttcattcatatcctcc

SEQ ID NO: 316627 - DNA, 21 bp, Homo sapiens
cttttatttgcaacatttaca

SEQ ID NO: 316628 - DNA, 17 bp, Homo sapiens
cttttattttttaagtt

SEQ ID NO: 316629 - DNA, 19 bp, Homo sapiens
cttttattttttaagttca

SEQ ID NO: 316630 - DNA, 18 bp, Homo sapiens
cttttcactgctggctgc

SEQ ID NO: 316631 - DNA, 15 bp, Homo sapiens
cttttcacttgtctt

SEQ ID NO: 316632 - DNA, 20 bp, Homo sapiens
cttttcacttgtcttgctct

SEQ ID NO: 316633 - DNA, 22 bp, Homo sapiens
cttttcagccaatttgtctcct

SEQ ID NO: 316634 - DNA, 22 bp, Homo sapiens
cttttcatttaggtgaggaagc

SEQ ID NO: 316635 - DNA, 19 bp, Homo sapiens
cttttcatttatcaagcag

SEQ ID NO: 316636 - DNA, 16 bp, Homo sapiens
cttttccatctaaaat

SEQ ID NO: 316637 - DNA, 18 bp, Homo sapiens
cttttcccctcattgcat

SEQ ID NO: 316638 - DNA, 17 bp, Homo sapiens
taccctcccaccagaac

SEQ ID NO: 316639 - DNA, 12 bp, Homo sapiens
taccctccctcg

SEQ ID NO: 316640 - DNA, 17 bp, Homo sapiens
taccctcctgtaaaata

SEQ ID NO: 316641 - DNA, 12 bp, Homo sapiens
taccctcttatt

SEQ ID NO: 316642 - DNA, 14 bp, Homo sapiens
taccctgcttccca

SEQ ID NO: 316643 - DNA, 19 bp, Homo sapiens
tacccttccacctcctaga

SEQ ID NO: 316644 - DNA, 15 bp, Homo sapiens
taccgagtatctgta

SEQ ID NO: 316645 - DNA, 16 bp, Homo sapiens
taccgatggtcccagg

SEQ ID NO: 316646 - DNA, 15 bp, Homo sapiens
taccgccctgggctg

SEQ ID NO: 316647 - DNA, 20 bp, Homo sapiens
taccgtaacaatgtttgtca

SEQ ID NO: 316648 - DNA, 14 bp, Homo sapiens
taccgtagcttttt

SEQ ID NO: 316649 - DNA, 15 bp, Homo sapiens
taccgttcacttccc

SEQ ID NO: 316650 - DNA, 17 bp, Homo sapiens
taccgtttggtgtctga

SEQ ID NO: 316651 - DNA, 20 bp, Homo sapiens
taccgtttggtgtctgatgt

SEQ ID NO: 316652 - DNA, 14 bp, Homo sapiens
tacctaaacagata

SEQ ID NO: 316653 - DNA, 15 bp, Homo sapiens
tacctaattagagca

SEQ ID NO: 316654 - DNA, 18 bp, Homo sapiens
tacctacaaaatgagatt

SEQ ID NO: 316655 - DNA, 16 bp, Homo sapiens
tacctagatttacagc

SEQ ID NO: 316656 - DNA, 19 bp, Homo sapiens
tacctataaagtaaagcta

SEQ ID NO: 316657 - DNA, 21 bp, Homo sapiens
tacctataaatggacttgctt

SEQ ID NO: 316658 - DNA, 23 bp, Homo sapiens
tacctatataataaagctactga

SEQ ID NO: 316659 - DNA, 16 bp, Homo sapiens
tacctcaacctgtaaa

SEQ ID NO: 316660 - DNA, 17 bp, Homo sapiens
tacctcaacctgtaaat

SEQ ID NO: 316661 - DNA, 19 bp, Homo sapiens
tacctcaacctgtaaatta

SEQ ID NO: 316662 - DNA, 22 bp, Homo sapiens
tacctcaacctgtaaattattt

SEQ ID NO: 316663 - DNA, 15 bp, Homo sapiens
tacctcaggcaggaa

SEQ ID NO: 316664 - DNA, 15 bp, Homo sapiens
tacctcatttgcatc

SEQ ID NO: 316665 - DNA, 15 bp, Homo sapiens
tacctccattaaatg

SEQ ID NO: 316666 - DNA, 15 bp, Homo sapiens
tacctctaacaccac

SEQ ID NO: 316667 - DNA, 15 bp, Homo sapiens
tacctctctctgctc

SEQ ID NO: 316668 - DNA, 16 bp, Homo sapiens
tacctctctctgctcc

SEQ ID NO: 316669 - DNA, 17 bp, Homo sapiens
tacctcttccaggaagc

SEQ ID NO: 316670 - DNA, 19 bp, Homo sapiens
tacctgaacacttattgct

SEQ ID NO: 316671 - DNA, 14 bp, Homo sapiens
tacctgaagtcttt

SEQ ID NO: 316672 - DNA, 19 bp, Homo sapiens
tagagatgtttttaaaagt

SEQ ID NO: 316673 - DNA, 23 bp, Homo sapiens
tagagatgtttttaaaagtttca

SEQ ID NO: 316674 - DNA, 13 bp, Homo sapiens
tagagattcttag

SEQ ID NO: 316675 - DNA, 23 bp, Homo sapiens
tagagcagggattaacctctgca

SEQ ID NO: 316676 - DNA, 16 bp, Homo sapiens
tagagcatctgtccca

SEQ ID NO: 316677 - DNA, 16 bp, Homo sapiens
tagagcctgcatctgt

SEQ ID NO: 316678 - DNA, 17 bp, Homo sapiens
tagagcctgcatctgtc

SEQ ID NO: 316679 - DNA, 22 bp, Homo sapiens
tagagcctttgatcttcaggat

SEQ ID NO: 316680 - DNA, 22 bp, Homo sapiens
tagagcggagaaaggaagggct

SEQ ID NO: 316681 - DNA, 17 bp, Homo sapiens
tagagctaccaattgtt

SEQ ID NO: 316682 - DNA, 17 bp, Homo sapiens
tagagctatgcacacca

SEQ ID NO: 316683 - DNA, 15 bp, Homo sapiens
tagagctgatccaga

SEQ ID NO: 316684 - DNA, 18 bp, Homo sapiens
tagagctgggtggcctgt

SEQ ID NO: 316685 - DNA, 23 bp, Homo sapiens
tagaggcaacagtgttctgagcc

SEQ ID NO: 316686 - DNA, 23 bp, Homo sapiens
tagaggcctgaggatgagctgga

SEQ ID NO: 316687 - DNA, 23 bp, Homo sapiens
tagaggtaccagcaatatgtaaa

SEQ ID NO: 316688 - DNA, 14 bp, Homo sapiens
tagaggtgggcagc

SEQ ID NO: 316689 - DNA, 19 bp, Homo sapiens
tagaggtgggcagctgggc

SEQ ID NO: 316690 - DNA, 20 bp, Homo sapiens
tagaggtgggcagctgggcc

SEQ ID NO: 316691 - DNA, 15 bp, Homo sapiens
tagagtacttaatat

SEQ ID NO: 316692 - DNA, 19 bp, Homo sapiens
tagagtagaagatttgatg

SEQ ID NO: 316693 - DNA, 18 bp, Homo sapiens
tagagtatgcaagaagaa

SEQ ID NO: 316694 - DNA, 22 bp, Homo sapiens
tagagtcacagctttcccaggt

SEQ ID NO: 316695 - DNA, 14 bp, Homo sapiens
tagagtcctcactc

SEQ ID NO: 316696 - DNA, 19 bp, Homo sapiens
tagagtggtctatttctcc

SEQ ID NO: 316697 - DNA, 12 bp, Homo sapiens
tagagtttaaca

SEQ ID NO: 316698 - DNA, 15 bp, Homo sapiens
tagagtttgatcata

SEQ ID NO: 316699 - DNA, 18 bp, Homo sapiens
tagataactgctctttta

SEQ ID NO: 316700 - DNA, 20 bp, Homo sapiens
tagataactgctcttttact

SEQ ID NO: 316701 - DNA, 13 bp, Homo sapiens
tagataacttaaa

SEQ ID NO: 316702 - DNA, 14 bp, Homo sapiens
tagataattatcca

SEQ ID NO: 316703 - DNA, 14 bp, Homo sapiens
tagatacaatcagc

SEQ ID NO: 316704 - DNA, 23 bp, Homo sapiens
tagatacagatccgcatgtgtct

SEQ ID NO: 316705 - DNA, 19 bp, Homo sapiens
tagataccattttgaaata

SEQ ID NO: 316706 - DNA, 20 bp, Homo sapiens
tagataccattttgaaatat

SEQ ID NO: 316707 - DNA, 13 bp, Homo sapiens
tagatacttttga

SEQ ID NO: 316708 - DNA, 14 bp, Homo sapiens
tagatacttttgat

SEQ ID NO: 316709 - DNA, 12 bp, Homo sapiens
tagatagaaata

SEQ ID NO: 316710 - DNA, 14 bp, Homo sapiens
tagctccttcatgc

SEQ ID NO: 316711 - DNA, 15 bp, Homo sapiens
tagctccttgaagac

SEQ ID NO: 316712 - DNA, 14 bp, Homo sapiens
tagctctacacaac

SEQ ID NO: 316713 - DNA, 20 bp, Homo sapiens
tagctctgagccctccttct

SEQ ID NO: 316714 - DNA, 13 bp, Homo sapiens
tagctctttcctt

SEQ ID NO: 316715 - DNA, 20 bp, Homo sapiens
tagctgataaagaaaccttt

SEQ ID NO: 316716 - DNA, 17 bp, Homo sapiens
tagctgcaaaggacaga

SEQ ID NO: 316717 - DNA, 22 bp, Homo sapiens
tagctgccaaaaagaacaccca

SEQ ID NO: 316718 - DNA, 15 bp, Homo sapiens
tagctggcaggacac

SEQ ID NO: 316719 - DNA, 19 bp, Homo sapiens
tagctgggatttgaactga

SEQ ID NO: 316720 - DNA, 19 bp, Homo sapiens
tagctggggcttcaccagt

SEQ ID NO: 316721 - DNA, 19 bp, Homo sapiens
tagctgtaaatacatgtgt

SEQ ID NO: 316722 - DNA, 16 bp, Homo sapiens
tagctgtatatttgaa

SEQ ID NO: 316723 - DNA, 17 bp, Homo sapiens
tagctgtggggagctgg

SEQ ID NO: 316724 - DNA, 18 bp, Homo sapiens
tagctgtggggagctggt

SEQ ID NO: 316725 - DNA, 16 bp, Homo sapiens
tagctgttgagctgtt

SEQ ID NO: 316726 - DNA, 17 bp, Homo sapiens
tagctgttgagctgttt

SEQ ID NO: 316727 - DNA, 17 bp, Homo sapiens
tagcttaaaaaaaggaa

SEQ ID NO: 316728 - DNA, 18 bp, Homo sapiens
tagcttatctccctgctt

SEQ ID NO: 316729 - DNA, 16 bp, Homo sapiens
tagcttcctccagagg

SEQ ID NO: 316730 - DNA, 14 bp, Homo sapiens
tagcttggcatggt

SEQ ID NO: 316731 - DNA, 16 bp, Homo sapiens
tagcttggcatggtgg

SEQ ID NO: 316732 - DNA, 19 bp, Homo sapiens
tagcttgtatagtgtaaaa

SEQ ID NO: 316733 - DNA, 21 bp, Homo sapiens
tagctttaatcaatcatgccc

SEQ ID NO: 316734 - DNA, 14 bp, Homo sapiens
tagctttacatttt

SEQ ID NO: 316735 - DNA, 18 bp, Homo sapiens
tagctttattttttaagt

SEQ ID NO: 316736 - DNA, 19 bp, Homo sapiens
tagctttcccaaataaact

SEQ ID NO: 316737 - DNA, 20 bp, Homo sapiens
taggaaaagctgttcccatg

SEQ ID NO: 316738 - DNA, 17 bp, Homo sapiens
taggaaaagtacattta

SEQ ID NO: 316739 - DNA, 13 bp, Homo sapiens
taggaaacagaaa

SEQ ID NO: 316740 - DNA, 14 bp, Homo sapiens
taggaaacagaaaa

SEQ ID NO: 316741 - DNA, 16 bp, Homo sapiens
taggaaacagaaaaga

SEQ ID NO: 316742 - DNA, 19 bp, Homo sapiens
taggaaacagaaaagagaa

SEQ ID NO: 316743 - DNA, 23 bp, Homo sapiens
taggaaagcaccgcagcatgtgg

SEQ ID NO: 316744 - DNA, 22 bp, Homo sapiens
taggaacagagtatatatgtac

SEQ ID NO: 316745 - DNA, 19 bp, Homo sapiens
taggaacccggcatgccga

SEQ ID NO: 316746 - DNA, 14 bp, Homo sapiens
taggaagaacagta

SEQ ID NO: 316747 - DNA, 21 bp, Homo sapiens
taggaagtgtaacagctgagg

SEQ ID NO: 316748 - DNA, 23 bp, Homo sapiens
taggaatagcatgtcactaaagc

SEQ ID NO: 316749 - DNA, 22 bp, Homo sapiens
taggaatatacatagtctttgt

SEQ ID NO: 316750 - DNA, 14 bp, Homo sapiens
taggaatgctcaat

SEQ ID NO: 316751 - DNA, 18 bp, Homo sapiens
taggaattcatcttttga

SEQ ID NO: 316752 - DNA, 12 bp, Homo sapiens
taggacacagtg

SEQ ID NO: 316753 - DNA, 21 bp, Homo sapiens
taggacacctgtggtatcttt

SEQ ID NO: 316754 - DNA, 20 bp, Homo sapiens
taggacataaattagaggtc

SEQ ID NO: 316755 - DNA, 18 bp, Homo sapiens
taggacatactgcatgta

SEQ ID NO: 316756 - DNA, 17 bp, Homo sapiens
taggacatctctgtaaa

SEQ ID NO: 316757 - DNA, 22 bp, Homo sapiens
taggacatctctgtaaaaagca

SEQ ID NO: 316758 - DNA, 22 bp, Homo sapiens
taggacccaaggtggtcttgga

SEQ ID NO: 316759 - DNA, 13 bp, Homo sapiens
taggactatataa

SEQ ID NO: 316760 - DNA, 14 bp, Homo sapiens
taggactatataaa

SEQ ID NO: 316761 - DNA, 18 bp, Homo sapiens
taggactcaggcctgcca

SEQ ID NO: 316762 - DNA, 20 bp, Homo sapiens
taggactcaggcctgccaat

SEQ ID NO: 316763 - DNA, 13 bp, Homo sapiens
taggactgaggag

SEQ ID NO: 316764 - DNA, 12 bp, Homo sapiens
taggagacagtc

SEQ ID NO: 316765 - DNA, 13 bp, Homo sapiens
taggagacttgta

SEQ ID NO: 316766 - DNA, 16 bp, Homo sapiens
taggagagactggcca

SEQ ID NO: 316767 - DNA, 22 bp, Homo sapiens
taggagataccaggttgaaaga

SEQ ID NO: 316768 - DNA, 12 bp, Homo sapiens
taggagatgtca

SEQ ID NO: 316769 - DNA, 21 bp, Homo sapiens
taggagctggctggcaggtgt

SEQ ID NO: 316770 - DNA, 17 bp, Homo sapiens
taggagcttccagatgg

SEQ ID NO: 316771 - DNA, 20 bp, Homo sapiens
taggaggaccagagctactg

SEQ ID NO: 316772 - DNA, 17 bp, Homo sapiens
taggaggatgctgtgcc

SEQ ID NO: 316773 - DNA, 15 bp, Homo sapiens
taggataggaactgg

SEQ ID NO: 316774 - DNA, 18 bp, Homo sapiens
taggatggatagaaggaa

SEQ ID NO: 316775 - DNA, 19 bp, Homo sapiens
taggcaaagttttccattt

SEQ ID NO: 316776 - DNA, 21 bp, Homo sapiens
taggcagagcccgcccacctg

SEQ ID NO: 316777 - DNA, 13 bp, Homo sapiens
taggcagcagctt

SEQ ID NO: 316778 - DNA, 16 bp, Homo sapiens
taggcagcctctctgc

SEQ ID NO: 316779 - DNA, 12 bp, Homo sapiens
taggcagcctgc

SEQ ID NO: 316780 - DNA, 15 bp, Homo sapiens
taggcagggatttga

SEQ ID NO: 316781 - DNA, 16 bp, Homo sapiens
taggcatactctccag

SEQ ID NO: 316782 - DNA, 17 bp, Homo sapiens
taggcatactctccagg

SEQ ID NO: 316783 - DNA, 13 bp, Homo sapiens
taggcatttgtaa

SEQ ID NO: 316784 - DNA, 21 bp, Homo sapiens
taggcatttgtaaatattaaa

SEQ ID NO: 316785 - DNA, 21 bp, Homo sapiens
taggccatctgtaaatatccc

SEQ ID NO: 316786 - DNA, 21 bp, Homo sapiens
taggcccccaaattgccttca

SEQ ID NO: 316787 - DNA, 18 bp, Homo sapiens
taggcccgggcccctggc

SEQ ID NO: 316788 - DNA, 20 bp, Homo sapiens
taggcccgggcccctggcac

SEQ ID NO: 316789 - DNA, 19 bp, Homo sapiens
taggcccttgtcctgccag

SEQ ID NO: 316790 - DNA, 20 bp, Homo sapiens
taggcccttgtcctgccagc

SEQ ID NO: 316791 - DNA, 15 bp, Homo sapiens
atcctccatttttgt

SEQ ID NO: 316792 - DNA, 11 bp, Homo sapiens
atcctcccctt

SEQ ID NO: 316793 - DNA, 22 bp, Homo sapiens
atcctccctacttccaagaaaa

SEQ ID NO: 316794 - DNA, 23 bp, Homo sapiens
atcctccctacttccaagaaaaa

SEQ ID NO: 316795 - DNA, 23 bp, Homo sapiens
atcctccgccctttttgtcctag

SEQ ID NO: 316796 - DNA, 16 bp, Homo sapiens
atcctccgtccagccg

SEQ ID NO: 316797 - DNA, 19 bp, Homo sapiens
atcctctacggttatttcc

SEQ ID NO: 316798 - DNA, 22 bp, Homo sapiens
atcctctacggttatttcctgc

SEQ ID NO: 316799 - DNA, 16 bp, Homo sapiens
atcctcttgctatata

SEQ ID NO: 316800 - DNA, 22 bp, Homo sapiens
atcctcttgctatataaataaa

SEQ ID NO: 316801 - DNA, 17 bp, Homo sapiens
atcctctttgagtgaag

SEQ ID NO: 316802 - DNA, 14 bp, Homo sapiens
atcctgaacaagaa

SEQ ID NO: 316803 - DNA, 15 bp, Homo sapiens
atcctgaacaagaaa

SEQ ID NO: 316804 - DNA, 15 bp, Homo sapiens
atcctgcaccctctg

SEQ ID NO: 316805 - DNA, 16 bp, Homo sapiens
atcctgcagcctcctc

SEQ ID NO: 316806 - DNA, 17 bp, Homo sapiens
atcctgcagcctcctcc

SEQ ID NO: 316807 - DNA, 20 bp, Homo sapiens
atcctgcagcctcctcctga

SEQ ID NO: 316808 - DNA, 19 bp, Homo sapiens
atcctgctacactcatccg

SEQ ID NO: 316809 - DNA, 15 bp, Homo sapiens
atcctgctagctgta

SEQ ID NO: 316810 - DNA, 11 bp, Homo sapiens
atcctgctgcc

SEQ ID NO: 316811 - DNA, 13 bp, Homo sapiens
atcctgcttctct

SEQ ID NO: 316812 - DNA, 19 bp, Homo sapiens
atcctgcttctcttttcct

SEQ ID NO: 316813 - DNA, 11 bp, Homo sapiens
atcctggagcc

SEQ ID NO: 316814 - DNA, 15 bp, Homo sapiens
atcctggagcccctg

SEQ ID NO: 316815 - DNA, 15 bp, Homo sapiens
atcctggagttctgg

SEQ ID NO: 316816 - DNA, 17 bp, Homo sapiens
atcctggcaagtgaccc

SEQ ID NO: 316817 - DNA, 15 bp, Homo sapiens
atcctggcctccttt

SEQ ID NO: 316818 - DNA, 18 bp, Homo sapiens
atcctggctctgtggctt

SEQ ID NO: 316819 - DNA, 19 bp, Homo sapiens
atcctggctctgtggcttg

SEQ ID NO: 316820 - DNA, 16 bp, Homo sapiens
atcctgggcatcccca

SEQ ID NO: 316821 - DNA, 23 bp, Homo sapiens
atcctgggcatccccagccccct

SEQ ID NO: 316822 - DNA, 24 bp, Homo sapiens
atcctgggcatccccagccccctg

SEQ ID NO: 316823 - DNA, 20 bp, Homo sapiens
atcctggggcattaaaaaaa

SEQ ID NO: 316824 - DNA, 12 bp, Homo sapiens
atcctgggtgat

SEQ ID NO: 316825 - DNA, 16 bp, Homo sapiens
atcctggtgtctagtt

SEQ ID NO: 316826 - DNA, 17 bp, Homo sapiens
atcctgtacaagtgctc

SEQ ID NO: 316827 - DNA, 20 bp, Homo sapiens
atcctgtacaagtgctcagt

SEQ ID NO: 316828 - DNA, 22 bp, Homo sapiens
atcctgtgtggagagggaatgt

SEQ ID NO: 316829 - DNA, 22 bp, Homo sapiens
atcctgtgtgtctttttttact

SEQ ID NO: 316830 - DNA, 22 bp, Homo sapiens
atccttccaaagaattcttata

SEQ ID NO: 316831 - DNA, 22 bp, Homo sapiens
atccttcccaacgtactcctca

SEQ ID NO: 316832 - DNA, 14 bp, Homo sapiens
atccttcccagcag

SEQ ID NO: 316833 - DNA, 21 bp, Homo sapiens
atccttcccgcagcaccagcc

SEQ ID NO: 316834 - DNA, 18 bp, Homo sapiens
atccttctaactaaacta

SEQ ID NO: 316835 - DNA, 20 bp, Homo sapiens
atccttctaactaaactaaa

SEQ ID NO: 316836 - DNA, 15 bp, Homo sapiens
atccttggagagcag

SEQ ID NO: 316837 - DNA, 16 bp, Homo sapiens
atccttggcaccaaag

SEQ ID NO: 316838 - DNA, 17 bp, Homo sapiens
agaaggcgaggagagtg

SEQ ID NO: 316839 - DNA, 14 bp, Homo sapiens
agaagggaaacagt

SEQ ID NO: 316840 - DNA, 15 bp, Homo sapiens
agaagggaaacagtc

SEQ ID NO: 316841 - DNA, 20 bp, Homo sapiens
agaagggccagtcctgcctg

SEQ ID NO: 316842 - DNA, 19 bp, Homo sapiens
agaaggtgggggttggctg

SEQ ID NO: 316843 - DNA, 22 bp, Homo sapiens
agaaggtgggggttggctgggt

SEQ ID NO: 316844 - DNA, 14 bp, Homo sapiens
agaagtaagcagag

SEQ ID NO: 316845 - DNA, 14 bp, Homo sapiens
agaagtacagaatg

SEQ ID NO: 316846 - DNA, 14 bp, Homo sapiens
agaagtactttgtg

SEQ ID NO: 316847 - DNA, 18 bp, Homo sapiens
agaagtactttgtgctga

SEQ ID NO: 316848 - DNA, 17 bp, Homo sapiens
agaagtatccaattatg

SEQ ID NO: 316849 - DNA, 23 bp, Homo sapiens
agaagtatccaattatgtgacaa

SEQ ID NO: 316850 - DNA, 15 bp, Homo sapiens
agaagtcaaatgaat

SEQ ID NO: 316851 - DNA, 17 bp, Homo sapiens
agaagtcaaatgaatga

SEQ ID NO: 316852 - DNA, 20 bp, Homo sapiens
agaagtcagagaaaacactt

SEQ ID NO: 316853 - DNA, 22 bp, Homo sapiens
agaagtccatgagttgagtggg

SEQ ID NO: 316854 - DNA, 20 bp, Homo sapiens
agaagtctcttaattctgat

SEQ ID NO: 316855 - DNA, 16 bp, Homo sapiens
agaagtgttgattgcc

SEQ ID NO: 316856 - DNA, 15 bp, Homo sapiens
agaagttaagcagcc

SEQ ID NO: 316857 - DNA, 20 bp, Homo sapiens
agaagttccacttaacacat

SEQ ID NO: 316858 - DNA, 20 bp, Homo sapiens
agaagttgttagtgatttgc

SEQ ID NO: 316859 - DNA, 22 bp, Homo sapiens
agaagttgttagtgatttgcta

SEQ ID NO: 316860 - DNA, 15 bp, Homo sapiens
agaagtttagatttt

SEQ ID NO: 316861 - DNA, 18 bp, Homo sapiens
agaagtttagattttaat

SEQ ID NO: 316862 - DNA, 19 bp, Homo sapiens
agaagtttgggctaacatt

SEQ ID NO: 316863 - DNA, 13 bp, Homo sapiens
agaataaaattgt

SEQ ID NO: 316864 - DNA, 20 bp, Homo sapiens
agaataaataaagaagaaaa

SEQ ID NO: 316865 - DNA, 21 bp, Homo sapiens
agaataagagaaagaaaatga

SEQ ID NO: 316866 - DNA, 20 bp, Homo sapiens
agaataatgacgtattgtga

SEQ ID NO: 316867 - DNA, 17 bp, Homo sapiens
agaataatgtgttaaac

SEQ ID NO: 316868 - DNA, 14 bp, Homo sapiens
agaataatgttcta

SEQ ID NO: 316869 - DNA, 16 bp, Homo sapiens
agaataatgttctatt

SEQ ID NO: 316870 - DNA, 14 bp, Homo sapiens
agaataattgtgta

SEQ ID NO: 316871 - DNA, 19 bp, Homo sapiens
agaatacaattcagtttta

SEQ ID NO: 316872 - DNA, 18 bp, Homo sapiens
agaatacagtaagctgct

SEQ ID NO: 316873 - DNA, 21 bp, Homo sapiens
agaatacattttatatctgga

SEQ ID NO: 316874 - DNA, 19 bp, Homo sapiens
agaatacttttttctagtt

SEQ ID NO: 316875 - DNA, 18 bp, Homo sapiens
agaatagatcagtatttc

SEQ ID NO: 316876 - DNA, 20 bp, Homo sapiens
agaatagatctgatggtgag

SEQ ID NO: 316877 - DNA, 16 bp, Homo sapiens
agaatagatgctgact

SEQ ID NO: 316878 - DNA, 15 bp, Homo sapiens
agaatagcatgttgt

SEQ ID NO: 316879 - DNA, 17 bp, Homo sapiens
agaatagggagacaatc

SEQ ID NO: 316880 - DNA, 12 bp, Homo sapiens
agaatagtctct

SEQ ID NO: 316881 - DNA, 20 bp, Homo sapiens
agaatagttaaattggcttg

SEQ ID NO: 316882 - DNA, 17 bp, Homo sapiens
agaatataaacacataa

SEQ ID NO: 316883 - DNA, 17 bp, Homo sapiens
agaatataattatcgga

SEQ ID NO: 316884 - DNA, 17 bp, Homo sapiens
agaatatactgtcttgt

SEQ ID NO: 316885 - DNA, 13 bp, Homo sapiens
agaatattataaa

SEQ ID NO: 316886 - DNA, 15 bp, Homo sapiens
agaatattataaaaa

SEQ ID NO: 316887 - DNA, 13 bp, Homo sapiens
agaatattcagga

SEQ ID NO: 316888 - DNA, 15 bp, Homo sapiens
agaatattcaggact

SEQ ID NO: 316889 - DNA, 19 bp, Homo sapiens
agaatatttattacctctg

SEQ ID NO: 316890 - DNA, 14 bp, Homo sapiens
agaatcaagtctgt

SEQ ID NO: 316891 - DNA, 16 bp, Homo sapiens
agaatcaagtctgtga

SEQ ID NO: 316892 - DNA, 17 bp, Homo sapiens
agaatcattatttatta

SEQ ID NO: 316893 - DNA, 15 bp, Homo sapiens
agaatccctgttcat

SEQ ID NO: 316894 - DNA, 20 bp, Homo sapiens
agaatcctcagttggaatca

SEQ ID NO: 316895 - DNA, 21 bp, Homo sapiens
agaatcctcagttggaatcat

SEQ ID NO: 316896 - DNA, 15 bp, Homo sapiens
agaatcctgcctctc

SEQ ID NO: 316897 - DNA, 21 bp, Homo sapiens
agaatcctgcctctccccaaa

SEQ ID NO: 316898 - DNA, 21 bp, Homo sapiens
agaatcggcatgtatacttaa

SEQ ID NO: 316899 - DNA, 16 bp, Homo sapiens
agaatctggctcctgt

SEQ ID NO: 316900 - DNA, 13 bp, Homo sapiens
agaatgagaaaga

SEQ ID NO: 316901 - DNA, 14 bp, Homo sapiens
agaatgagaaagaa

SEQ ID NO: 316902 - DNA, 14 bp, Homo sapiens
agaatgagagagtg

SEQ ID NO: 316903 - DNA, 17 bp, Homo sapiens
agaatgagagagtgtgg

SEQ ID NO: 316904 - DNA, 13 bp, Homo sapiens
agaatgaggagga

SEQ ID NO: 316905 - DNA, 20 bp, Homo sapiens
agaatgcagattcctgggcc

SEQ ID NO: 316906 - DNA, 22 bp, Homo sapiens
agaatgcagattcctgggcctg

SEQ ID NO: 316907 - DNA, 14 bp, Homo sapiens
agaatgccagccca

SEQ ID NO: 316908 - DNA, 15 bp, Homo sapiens
agaatgccagcccaa

SEQ ID NO: 316909 - DNA, 22 bp, Homo sapiens
agaatgccatatttttgagggc

SEQ ID NO: 316910 - DNA, 13 bp, Homo sapiens
agaatgctggttt

SEQ ID NO: 316911 - DNA, 18 bp, Homo sapiens
agaatgctggttttccta

SEQ ID NO: 316912 - DNA, 13 bp, Homo sapiens
agaatggtgggct

SEQ ID NO: 316913 - DNA, 17 bp, Homo sapiens
agaatggtgtgtttccc

SEQ ID NO: 316914 - DNA, 21 bp, Homo sapiens
agaatgtcatttgctaatgaa

SEQ ID NO: 316915 - DNA, 18 bp, Homo sapiens
agaatgttgtattcagtg

SEQ ID NO: 316916 - DNA, 12 bp, Homo sapiens
agaattaaaata

SEQ ID NO: 316917 - DNA, 13 bp, Homo sapiens
agaattaaaataa

SEQ ID NO: 316918 - DNA, 17 bp, Homo sapiens
agaattaatgacaacaa

SEQ ID NO: 316919 - DNA, 18 bp, Homo sapiens
agaattatacagacctaa

SEQ ID NO: 316920 - DNA, 16 bp, Homo sapiens
agaattatttttgtgt

SEQ ID NO: 316921 - DNA, 14 bp, Homo sapiens
agaattcagctgcc

SEQ ID NO: 316922 - DNA, 16 bp, Homo sapiens
agaattcagctgcccc

SEQ ID NO: 316923 - DNA, 21 bp, Homo sapiens
agaattccttttataagattt

SEQ ID NO: 316924 - DNA, 21 bp, Homo sapiens
agaattctaagattgtacata

SEQ ID NO: 316925 - DNA, 23 bp, Homo sapiens
agaattgtgcaaatggaagacaa

SEQ ID NO: 316926 - DNA, 19 bp, Homo sapiens
agaatttagggagaaatgt

SEQ ID NO: 316927 - DNA, 22 bp, Homo sapiens
agaatttagggagaaatgttgt

SEQ ID NO: 316928 - DNA, 16 bp, Homo sapiens
agaatttcaatttgtt

SEQ ID NO: 316929 - DNA, 17 bp, Homo sapiens
agaatttcccaaagcag

SEQ ID NO: 316930 - DNA, 18 bp, Homo sapiens
agaatttcccaaagcagt

SEQ ID NO: 316931 - DNA, 16 bp, Homo sapiens
agaatttgaaaggaaa

SEQ ID NO: 316932 - DNA, 17 bp, Homo sapiens
agaatttgaaaggaaaa

SEQ ID NO: 316933 - DNA, 13 bp, Homo sapiens
agaattttaaaaa

SEQ ID NO: 316934 - DNA, 21 bp, Homo sapiens
agaattttaaaaaagatggat

SEQ ID NO: 316935 - DNA, 22 bp, Homo sapiens
agaattttaaaaaagatggatt

SEQ ID NO: 316936 - DNA, 16 bp, Homo sapiens
agaattttaagtgctt

SEQ ID NO: 316937 - DNA, 22 bp, Homo sapiens
agaattttaagtgctttgtaat

SEQ ID NO: 316938 - DNA, 17 bp, Homo sapiens
agaattttttttttaag

SEQ ID NO: 316939 - DNA, 23 bp, Homo sapiens
agaattttttttttaagatatgt

SEQ ID NO: 316940 - DNA, 15 bp, Homo sapiens
agacaaaaagaacaa

SEQ ID NO: 316941 - DNA, 20 bp, Homo sapiens
agacaaaattttagtccaaa

SEQ ID NO: 316942 - DNA, 10 bp, Homo sapiens
agacaaacac

SEQ ID NO: 316943 - DNA, 16 bp, Homo sapiens
agacaaagaaggaaaa

SEQ ID NO: 316944 - DNA, 17 bp, Homo sapiens
agacaaaggcccagaaa

SEQ ID NO: 316945 - DNA, 13 bp, Homo sapiens
agacaaaggcctt

SEQ ID NO: 316946 - DNA, 15 bp, Homo sapiens
agacaaatgggactg

SEQ ID NO: 316947 - DNA, 22 bp, Homo sapiens
agacaaatgggactgatgtcat

SEQ ID NO: 316948 - DNA, 14 bp, Homo sapiens
agacaaccctgcaa

SEQ ID NO: 316949 - DNA, 12 bp, Homo sapiens
agacaagccctg

SEQ ID NO: 316950 - DNA, 18 bp, Homo sapiens
agacaagccctggcaaca

SEQ ID NO: 316951 - DNA, 18 bp, Homo sapiens
agacaagtctagtggaac

SEQ ID NO: 316952 - DNA, 15 bp, Homo sapiens
agacaataaaacatt

SEQ ID NO: 316953 - DNA, 17 bp, Homo sapiens
agacaatctaaaaaata

SEQ ID NO: 316954 - DNA, 16 bp, Homo sapiens
agacaatgcagatgcc

SEQ ID NO: 316955 - DNA, 14 bp, Homo sapiens
agacaatgtggaat

SEQ ID NO: 316956 - DNA, 12 bp, Homo sapiens
agacaattacaa

SEQ ID NO: 316957 - DNA, 16 bp, Homo sapiens
agacaatttgccttag

SEQ ID NO: 316958 - DNA, 19 bp, Homo sapiens
agacacaactatttttcca

SEQ ID NO: 316959 - DNA, 20 bp, Homo sapiens
agacacacaacatcaagaaa

SEQ ID NO: 316960 - DNA, 11 bp, Homo sapiens
agacacacaca

SEQ ID NO: 316961 - DNA, 12 bp, Homo sapiens
agacacacacac

SEQ ID NO: 316962 - DNA, 20 bp, Homo sapiens
agacacacacacacacacaa

SEQ ID NO: 316963 - DNA, 22 bp, Homo sapiens
agacacacacacgcacgcacac

SEQ ID NO: 316964 - DNA, 20 bp, Homo sapiens
agacacacagcctttctgta

SEQ ID NO: 316965 - DNA, 21 bp, Homo sapiens
agacacacagcctttctgtat

SEQ ID NO: 316966 - DNA, 12 bp, Homo sapiens
agacacacagga

SEQ ID NO: 316967 - DNA, 18 bp, Homo sapiens
agacacacgcacacacac

SEQ ID NO: 316968 - DNA, 22 bp, Homo sapiens
agacacagatggcacctgtggc

SEQ ID NO: 316969 - DNA, 19 bp, Homo sapiens
agacacagtattgacttct

SEQ ID NO: 316970 - DNA, 17 bp, Homo sapiens
agacacatccagcaatt

SEQ ID NO: 316971 - DNA, 19 bp, Homo sapiens
agacaccctaactcttgct

SEQ ID NO: 316972 - DNA, 18 bp, Homo sapiens
atcctttaactctgcgga

SEQ ID NO: 316973 - DNA, 20 bp, Homo sapiens
atcctttcaaaagaagagtt

SEQ ID NO: 316974 - DNA, 22 bp, Homo sapiens
atcctttcaaaagaagagtttt

SEQ ID NO: 316975 - DNA, 19 bp, Homo sapiens
atccttttaaccattttaa

SEQ ID NO: 316976 - DNA, 18 bp, Homo sapiens
atccttttatctcacaaa

SEQ ID NO: 316977 - DNA, 15 bp, Homo sapiens
atccttttttctctt

SEQ ID NO: 316978 - DNA, 19 bp, Homo sapiens
atccttttttctcttctgt

SEQ ID NO: 316979 - DNA, 23 bp, Homo sapiens
atccttttttctcttctgtccat

SEQ ID NO: 316980 - DNA, 14 bp, Homo sapiens
atcgatatgaaaaa

SEQ ID NO: 316981 - DNA, 20 bp, Homo sapiens
atcgatgttaaacgtcacag

SEQ ID NO: 316982 - DNA, 20 bp, Homo sapiens
atcgcgccagtacattccaa

SEQ ID NO: 316983 - DNA, 21 bp, Homo sapiens
atcgctgtccaagtgtttctt

SEQ ID NO: 316984 - DNA, 15 bp, Homo sapiens
atcgcttgagcccag

SEQ ID NO: 316985 - DNA, 16 bp, Homo sapiens
atcgcttgagcccagg

SEQ ID NO: 316986 - DNA, 13 bp, Homo sapiens
atcggagacagtg

SEQ ID NO: 316987 - DNA, 15 bp, Homo sapiens
atcgggaacagtgtt

SEQ ID NO: 316988 - DNA, 17 bp, Homo sapiens
atcgggaacagtgtttc

SEQ ID NO: 316989 - DNA, 17 bp, Homo sapiens
atcgggagcagtgtctt

SEQ ID NO: 316990 - DNA, 18 bp, Homo sapiens
atcgggagcagtgtcttc

SEQ ID NO: 316991 - DNA, 14 bp, Homo sapiens
atcggggccagagg

SEQ ID NO: 316992 - DNA, 22 bp, Homo sapiens
atcgggtccagagaccacacca

SEQ ID NO: 316993 - DNA, 14 bp, Homo sapiens
atcggtcctgtctc

SEQ ID NO: 316994 - DNA, 13 bp, Homo sapiens
atcggttgaccct

SEQ ID NO: 316995 - DNA, 16 bp, Homo sapiens
atcgtgacccttcagg

SEQ ID NO: 316996 - DNA, 20 bp, Homo sapiens
atcgtgacccttcagggcca

SEQ ID NO: 316997 - DNA, 16 bp, Homo sapiens
atcgtggtatgtgaat

SEQ ID NO: 316998 - DNA, 20 bp, Homo sapiens
atcgttttctttgctgtgcc

SEQ ID NO: 316999 - DNA, 21 bp, Homo sapiens
atcgttttctttgctgtgcca

SEQ ID NO: 317000 - DNA, 13 bp, Homo sapiens
atctaaaaaataa

SEQ ID NO: 317001 - DNA, 15 bp, Homo sapiens
atctaaaaaataact

SEQ ID NO: 317002 - DNA, 13 bp, Homo sapiens
atctaaaacaaaa

SEQ ID NO: 317003 - DNA, 23 bp, Homo sapiens
atctaaagtgtgttgttgcttta

SEQ ID NO: 317004 - DNA, 15 bp, Homo sapiens
atctaaccctcccat

SEQ ID NO: 317005 - DNA, 22 bp, Homo sapiens
atctaaccctcccatggcacct

SEQ ID NO: 317006 - DNA, 16 bp, Homo sapiens
atctaagcctttccat

SEQ ID NO: 317007 - DNA, 18 bp, Homo sapiens
atctaagcctttccataa

SEQ ID NO: 317008 - DNA, 21 bp, Homo sapiens
atctaatagcgggttactttc

SEQ ID NO: 317009 - DNA, 14 bp, Homo sapiens
atctaatattaaaa

SEQ ID NO: 317010 - DNA, 23 bp, Homo sapiens
atctaatgcttgtttatgatatt

SEQ ID NO: 317011 - DNA, 17 bp, Homo sapiens
atctaattcagatggat

SEQ ID NO: 317012 - DNA, 21 bp, Homo sapiens
atctacctcactattcaagta

SEQ ID NO: 317013 - DNA, 15 bp, Homo sapiens
atctacctgctcctt

SEQ ID NO: 317014 - DNA, 18 bp, Homo sapiens
atctacctgtgtgtatgt

SEQ ID NO: 317015 - DNA, 15 bp, Homo sapiens
atctacgatgttaaa

SEQ ID NO: 317016 - DNA, 22 bp, Homo sapiens
atctactcttaaatatacaact

SEQ ID NO: 317017 - DNA, 14 bp, Homo sapiens
atctactgagccac

SEQ ID NO: 317018 - DNA, 13 bp, Homo sapiens
atctacttttttt

SEQ ID NO: 317019 - DNA, 17 bp, Homo sapiens
atctagaaagaaaagac

SEQ ID NO: 317020 - DNA, 14 bp, Homo sapiens
atctagatagctga

SEQ ID NO: 317021 - DNA, 13 bp, Homo sapiens
atctagatttcta

SEQ ID NO: 317022 - DNA, 18 bp, Homo sapiens
atctagccaaagagctct

SEQ ID NO: 317023 - DNA, 14 bp, Homo sapiens
atctagccaggcct

SEQ ID NO: 317024 - DNA, 22 bp, Homo sapiens
atctagctccataattgcaagg

SEQ ID NO: 317025 - DNA, 21 bp, Homo sapiens
atctaggtggagttgaaagag

SEQ ID NO: 317026 - DNA, 18 bp, Homo sapiens
atctaggtttaactcaga

SEQ ID NO: 317027 - DNA, 22 bp, Homo sapiens
atctagtaggtctgcacacata

SEQ ID NO: 317028 - DNA, 14 bp, Homo sapiens
atctagtgcagctg

SEQ ID NO: 317029 - DNA, 19 bp, Homo sapiens
atctagtgcagctgatttt

SEQ ID NO: 317030 - DNA, 16 bp, Homo sapiens
atctagtggtctgatt

SEQ ID NO: 317031 - DNA, 18 bp, Homo sapiens
atctagttaagtcgctga

SEQ ID NO: 317032 - DNA, 19 bp, Homo sapiens
atctagttaagtcgctgaa

SEQ ID NO: 317033 - DNA, 22 bp, Homo sapiens
atctagttaagtcgctgaacaa

SEQ ID NO: 317034 - DNA, 16 bp, Homo sapiens
atctagtttacagaaa

SEQ ID NO: 317035 - DNA, 17 bp, Homo sapiens
atctagtttacagaaaa

SEQ ID NO: 317036 - DNA, 18 bp, Homo sapiens
atctagttttttttgtaa

SEQ ID NO: 317037 - DNA, 18 bp, Homo sapiens
atctatagtatagaatga

SEQ ID NO: 317038 - DNA, 20 bp, Homo sapiens
atctatatagtacctttgct

SEQ ID NO: 317039 - DNA, 21 bp, Homo sapiens
atctatatagtacctttgctc

SEQ ID NO: 317040 - DNA, 17 bp, Homo sapiens
atctatcgagtttgcaa

SEQ ID NO: 317041 - DNA, 21 bp, Homo sapiens
atctatgggagattaaaacca

SEQ ID NO: 317042 - DNA, 16 bp, Homo sapiens
atctattactctgaca

SEQ ID NO: 317043 - DNA, 19 bp, Homo sapiens
atctattactctgacataa

SEQ ID NO: 317044 - DNA, 15 bp, Homo sapiens
atctattcagacaag

SEQ ID NO: 317045 - DNA, 17 bp, Homo sapiens
atctattcagacaagca

SEQ ID NO: 317046 - DNA, 21 bp, Homo sapiens
atctattcagacaagcaacag

SEQ ID NO: 317047 - DNA, 22 bp, Homo sapiens
atctattcagacaagcaacagg

SEQ ID NO: 317048 - DNA, 19 bp, Homo sapiens
atctattgcagatatttga

SEQ ID NO: 317049 - DNA, 16 bp, Homo sapiens
atctattgggttcatt

SEQ ID NO: 317050 - DNA, 18 bp, Homo sapiens
atctatttatctgtctga

SEQ ID NO: 317051 - DNA, 14 bp, Homo sapiens
agaccctgagactc

SEQ ID NO: 317052 - DNA, 18 bp, Homo sapiens
agaccctgagactccaga

SEQ ID NO: 317053 - DNA, 14 bp, Homo sapiens
agaccctgcctgag

SEQ ID NO: 317054 - DNA, 12 bp, Homo sapiens
agaccctgggag

SEQ ID NO: 317055 - DNA, 13 bp, Homo sapiens
agaccctgggaga

SEQ ID NO: 317056 - DNA, 15 bp, Homo sapiens
agacccttgaagatg

SEQ ID NO: 317057 - DNA, 19 bp, Homo sapiens
agacccttttgggtttctg

SEQ ID NO: 317058 - DNA, 19 bp, Homo sapiens
agaccgagtgtggagctgc

SEQ ID NO: 317059 - DNA, 14 bp, Homo sapiens
agaccgatccttcc

SEQ ID NO: 317060 - DNA, 13 bp, Homo sapiens
agaccgcagaggg

SEQ ID NO: 317061 - DNA, 16 bp, Homo sapiens
agaccgcagagggaag

SEQ ID NO: 317062 - DNA, 12 bp, Homo sapiens
agaccggaagct

SEQ ID NO: 317063 - DNA, 22 bp, Homo sapiens
agaccggccgcatgtctgcatg

SEQ ID NO: 317064 - DNA, 23 bp, Homo sapiens
agaccgtcgggggctgaggggca

SEQ ID NO: 317065 - DNA, 19 bp, Homo sapiens
agaccgtgatttggaagag

SEQ ID NO: 317066 - DNA, 22 bp, Homo sapiens
agaccgtgtcccaaggagctga

SEQ ID NO: 317067 - DNA, 14 bp, Homo sapiens
agacctaatatcat

SEQ ID NO: 317068 - DNA, 16 bp, Homo sapiens
agacctaatatcattt

SEQ ID NO: 317069 - DNA, 15 bp, Homo sapiens
agacctaatgctcct

SEQ ID NO: 317070 - DNA, 21 bp, Homo sapiens
agacctacattccctctcctg

SEQ ID NO: 317071 - DNA, 15 bp, Homo sapiens
agacctcatcaggat

SEQ ID NO: 317072 - DNA, 17 bp, Homo sapiens
agacctcatcaggatga

SEQ ID NO: 317073 - DNA, 19 bp, Homo sapiens
agacctcatcaggatgaac

SEQ ID NO: 317074 - DNA, 20 bp, Homo sapiens
agacctccctgtgagagagt

SEQ ID NO: 317075 - DNA, 20 bp, Homo sapiens
agacctcggctgtgtgggga

SEQ ID NO: 317076 - DNA, 13 bp, Homo sapiens
agacctctgatcc

SEQ ID NO: 317077 - DNA, 13 bp, Homo sapiens
agacctgcctgtg

SEQ ID NO: 317078 - DNA, 13 bp, Homo sapiens
agacctgggccct

SEQ ID NO: 317079 - DNA, 14 bp, Homo sapiens
agacctgtcttcca

SEQ ID NO: 317080 - DNA, 18 bp, Homo sapiens
agacctgtcttccaagga

SEQ ID NO: 317081 - DNA, 22 bp, Homo sapiens
agaccttacaaccacatttctg

SEQ ID NO: 317082 - DNA, 19 bp, Homo sapiens
agaccttctccaaatgaga

SEQ ID NO: 317083 - DNA, 21 bp, Homo sapiens
agaccttcttccacagcaaat

SEQ ID NO: 317084 - DNA, 18 bp, Homo sapiens
agacgaggtgtcttcctt

SEQ ID NO: 317085 - DNA, 17 bp, Homo sapiens
agacgcaccttgctgca

SEQ ID NO: 317086 - DNA, 12 bp, Homo sapiens
agacgcccctcc

SEQ ID NO: 317087 - DNA, 20 bp, Homo sapiens
agacggacgggacagcggcc

SEQ ID NO: 317088 - DNA, 14 bp, Homo sapiens
agacggatggaagg

SEQ ID NO: 317089 - DNA, 15 bp, Homo sapiens
agacggatggaagga

SEQ ID NO: 317090 - DNA, 16 bp, Homo sapiens
agacggatggaaggag

SEQ ID NO: 317091 - DNA, 16 bp, Homo sapiens
agacggcacccaccca

SEQ ID NO: 317092 - DNA, 14 bp, Homo sapiens
agacggcagcccca

SEQ ID NO: 317093 - DNA, 15 bp, Homo sapiens
agacggggagtgaga

SEQ ID NO: 317094 - DNA, 21 bp, Homo sapiens
agacgtccacccgtttccaag

SEQ ID NO: 317095 - DNA, 14 bp, Homo sapiens
agacgtcctggaat

SEQ ID NO: 317096 - DNA, 23 bp, Homo sapiens
agactaagccctgtcgagacact

SEQ ID NO: 317097 - DNA, 18 bp, Homo sapiens
agactactggcctctgtg

SEQ ID NO: 317098 - DNA, 15 bp, Homo sapiens
agactagacaaataa

SEQ ID NO: 317099 - DNA, 17 bp, Homo sapiens
agactagacaaataact

SEQ ID NO: 317100 - DNA, 19 bp, Homo sapiens
agactagcagctagcaagg

SEQ ID NO: 317101 - DNA, 18 bp, Homo sapiens
agactaggatagcttcat

SEQ ID NO: 317102 - DNA, 15 bp, Homo sapiens
agactagtgctttac

SEQ ID NO: 317103 - DNA, 22 bp, Homo sapiens
agactagtttgttattaatcca

SEQ ID NO: 317104 - DNA, 19 bp, Homo sapiens
agactatttaaacttataa

SEQ ID NO: 317105 - DNA, 22 bp, Homo sapiens
agactatttaaacttataaatc

SEQ ID NO: 317106 - DNA, 13 bp, Homo sapiens
agactcaggttcc

SEQ ID NO: 317107 - DNA, 15 bp, Homo sapiens
agactcagtttgtca

SEQ ID NO: 317108 - DNA, 15 bp, Homo sapiens
agactcccaggagtt

SEQ ID NO: 317109 - DNA, 18 bp, Homo sapiens
agactcctgattgctctg

SEQ ID NO: 317110 - DNA, 21 bp, Homo sapiens
agactcctttcctgcatcttt

SEQ ID NO: 317111 - DNA, 16 bp, Homo sapiens
atctctcaggagcaca

SEQ ID NO: 317112 - DNA, 18 bp, Homo sapiens
atctctcaggagcacagg

SEQ ID NO: 317113 - DNA, 23 bp, Homo sapiens
atctctccctcccctgccatttt

SEQ ID NO: 317114 - DNA, 15 bp, Homo sapiens
atctctcccttcttt

SEQ ID NO: 317115 - DNA, 19 bp, Homo sapiens
atctctcccttctttacct

SEQ ID NO: 317116 - DNA, 22 bp, Homo sapiens
atctctcgtgattgataagaac

SEQ ID NO: 317117 - DNA, 17 bp, Homo sapiens
atctctctctgttgtgt

SEQ ID NO: 317118 - DNA, 11 bp, Homo sapiens
atctctcttcc

SEQ ID NO: 317119 - DNA, 16 bp, Homo sapiens
atctctgaacttcagc

SEQ ID NO: 317120 - DNA, 16 bp, Homo sapiens
atctctgaagcatgtt

SEQ ID NO: 317121 - DNA, 18 bp, Homo sapiens
atctctgattaaatttaa

SEQ ID NO: 317122 - DNA, 20 bp, Homo sapiens
atctctgattaaatttaata

SEQ ID NO: 317123 - DNA, 20 bp, Homo sapiens
atctctgcaccctggggcct

SEQ ID NO: 317124 - DNA, 14 bp, Homo sapiens
atctctgcctttga

SEQ ID NO: 317125 - DNA, 16 bp, Homo sapiens
atctctgctgaacatt

SEQ ID NO: 317126 - DNA, 18 bp, Homo sapiens
atctctgctgcttctggg

SEQ ID NO: 317127 - DNA, 21 bp, Homo sapiens
atctctgctttgtttccttct

SEQ ID NO: 317128 - DNA, 15 bp, Homo sapiens
atctctggaaaaata

SEQ ID NO: 317129 - DNA, 17 bp, Homo sapiens
atctctggaaaaataag

SEQ ID NO: 317130 - DNA, 19 bp, Homo sapiens
atctctgtaaaccacttgt

SEQ ID NO: 317131 - DNA, 21 bp, Homo sapiens
atctctgtgactcgcttagct

SEQ ID NO: 317132 - DNA, 18 bp, Homo sapiens
atctcttagcattttaat

SEQ ID NO: 317133 - DNA, 13 bp, Homo sapiens
atctctttctctc

SEQ ID NO: 317134 - DNA, 19 bp, Homo sapiens
atctgaaaagaaatgctaa

SEQ ID NO: 317135 - DNA, 19 bp, Homo sapiens
atctgaacacatactagaa

SEQ ID NO: 317136 - DNA, 14 bp, Homo sapiens
atctgaactctcaa

SEQ ID NO: 317137 - DNA, 18 bp, Homo sapiens
atctgaactttgtttcca

SEQ ID NO: 317138 - DNA, 20 bp, Homo sapiens
atctgaactttgtttccaga

SEQ ID NO: 317139 - DNA, 15 bp, Homo sapiens
atctgaaggagattt

SEQ ID NO: 317140 - DNA, 17 bp, Homo sapiens
atctgaatacctctttg

SEQ ID NO: 317141 - DNA, 14 bp, Homo sapiens
atctgacaaagtca

SEQ ID NO: 317142 - DNA, 20 bp, Homo sapiens
atctgacatgattccttcct

SEQ ID NO: 317143 - DNA, 13 bp, Homo sapiens
atctgagccctcc

SEQ ID NO: 317144 - DNA, 20 bp, Homo sapiens
atctgagccctccctcttcc

SEQ ID NO: 317145 - DNA, 23 bp, Homo sapiens
atctgagccctccctcttcccag

SEQ ID NO: 317146 - DNA, 14 bp, Homo sapiens
atctgaggagtcca

SEQ ID NO: 317147 - DNA, 21 bp, Homo sapiens
atctgagggcactctctgcca

SEQ ID NO: 317148 - DNA, 16 bp, Homo sapiens
atctgagtccagctcc

SEQ ID NO: 317149 - DNA, 21 bp, Homo sapiens
atctgagtccagctcccccca

SEQ ID NO: 317150 - DNA, 20 bp, Homo sapiens
atctgatattcaaacacaca

SEQ ID NO: 317151 - DNA, 21 bp, Homo sapiens
atctgatcacccccctgctta

SEQ ID NO: 317152 - DNA, 20 bp, Homo sapiens
atctgatcccataaagaaag

SEQ ID NO: 317153 - DNA, 17 bp, Homo sapiens
atctgatggtgagctgg

SEQ ID NO: 317154 - DNA, 23 bp, Homo sapiens
atctgattgagtcagtgtttgct

SEQ ID NO: 317155 - DNA, 18 bp, Homo sapiens
atctgattggacattttc

SEQ ID NO: 317156 - DNA, 15 bp, Homo sapiens
atctgcaaatagttt

SEQ ID NO: 317157 - DNA, 18 bp, Homo sapiens
atctgcaaatagtttcaa

SEQ ID NO: 317158 - DNA, 21 bp, Homo sapiens
atctgcaccgacgcctgcccc

SEQ ID NO: 317159 - DNA, 21 bp, Homo sapiens
atctgcatgtaaaatcttcag

SEQ ID NO: 317160 - DNA, 22 bp, Homo sapiens
atctgcatgtaaaatcttcagc

SEQ ID NO: 317161 - DNA, 16 bp, Homo sapiens
atctgcatttagcaca

SEQ ID NO: 317162 - DNA, 14 bp, Homo sapiens
atctgcatttataa

SEQ ID NO: 317163 - DNA, 20 bp, Homo sapiens
atctgcatttataaatgtgt

SEQ ID NO: 317164 - DNA, 21 bp, Homo sapiens
atctgcatttataaatgtgtg

SEQ ID NO: 317165 - DNA, 22 bp, Homo sapiens
atctgcatttataaatgtgtgg

SEQ ID NO: 317166 - DNA, 24 bp, Homo sapiens
atctgcatttataaatgtgtggtg

SEQ ID NO: 317167 - DNA, 19 bp, Homo sapiens
atctgcattttcaccccac

SEQ ID NO: 317168 - DNA, 12 bp, Homo sapiens
atctgcccctcc

SEQ ID NO: 317169 - DNA, 15 bp, Homo sapiens
atctgcccctccccc

SEQ ID NO: 317170 - DNA, 16 bp, Homo sapiens
atctgcccctccccca

SEQ ID NO: 317171 - DNA, 18 bp, Homo sapiens
atctgccctcagatgaaa

SEQ ID NO: 317172 - DNA, 21 bp, Homo sapiens
atctgcctcccctgtggaaat

SEQ ID NO: 317173 - DNA, 12 bp, Homo sapiens
atctgcctggcc

SEQ ID NO: 317174 - DNA, 14 bp, Homo sapiens
atctgcctggcctg

SEQ ID NO: 317175 - DNA, 15 bp, Homo sapiens
atctgcctggcctgg

SEQ ID NO: 317176 - DNA, 17 bp, Homo sapiens
atctgcctggcctggct

SEQ ID NO: 317177 - DNA, 18 bp, Homo sapiens
atctgcctggcctggctc

SEQ ID NO: 317178 - DNA, 19 bp, Homo sapiens
atctgcctggcctggctcc

SEQ ID NO: 317179 - DNA, 20 bp, Homo sapiens
atctgctgacagatgttcca

SEQ ID NO: 317180 - DNA, 21 bp, Homo sapiens
atctgctgacagatgttccat

SEQ ID NO: 317181 - DNA, 19 bp, Homo sapiens
agagaaaacttatttgagt

SEQ ID NO: 317182 - DNA, 20 bp, Homo sapiens
agagaaaacttatttgagtg

SEQ ID NO: 317183 - DNA, 14 bp, Homo sapiens
agagaaatcacagg

SEQ ID NO: 317184 - DNA, 14 bp, Homo sapiens
agagaaatgaggaa

SEQ ID NO: 317185 - DNA, 21 bp, Homo sapiens
agagaacaatcactattctta

SEQ ID NO: 317186 - DNA, 14 bp, Homo sapiens
agagaagaaagaag

SEQ ID NO: 317187 - DNA, 22 bp, Homo sapiens
agagaagccttttccataaagt

SEQ ID NO: 317188 - DNA, 16 bp, Homo sapiens
agagaaggaaaagact

SEQ ID NO: 317189 - DNA, 22 bp, Homo sapiens
agagaaggagatgtaatgacag

SEQ ID NO: 317190 - DNA, 13 bp, Homo sapiens
agagaaggcctct

SEQ ID NO: 317191 - DNA, 18 bp, Homo sapiens
agagaaggcctggtcagc

SEQ ID NO: 317192 - DNA, 15 bp, Homo sapiens
agagaagtaagcaga

SEQ ID NO: 317193 - DNA, 15 bp, Homo sapiens
agagaagtgcccctg

SEQ ID NO: 317194 - DNA, 17 bp, Homo sapiens
agagaagtgcccctgct

SEQ ID NO: 317195 - DNA, 18 bp, Homo sapiens
agagaagtgcccctgctg

SEQ ID NO: 317196 - DNA, 13 bp, Homo sapiens
agagaataaagac

SEQ ID NO: 317197 - DNA, 17 bp, Homo sapiens
agagaatgagagagtgt

SEQ ID NO: 317198 - DNA, 19 bp, Homo sapiens
agagaatgagagagtgtgg

SEQ ID NO: 317199 - DNA, 19 bp, Homo sapiens
agagaattacttatattca

SEQ ID NO: 317200 - DNA, 16 bp, Homo sapiens
agagaattagattata

SEQ ID NO: 317201 - DNA, 13 bp, Homo sapiens
agagacaaatagt

SEQ ID NO: 317202 - DNA, 16 bp, Homo sapiens
agagacaagaagcaaa

SEQ ID NO: 317203 - DNA, 17 bp, Homo sapiens
agagacaataaaacatt

SEQ ID NO: 317204 - DNA, 18 bp, Homo sapiens
agagacaataaaacattc

SEQ ID NO: 317205 - DNA, 19 bp, Homo sapiens
agagacagacttgagaact

SEQ ID NO: 317206 - DNA, 13 bp, Homo sapiens
agagacagagagg

SEQ ID NO: 317207 - DNA, 20 bp, Homo sapiens
agagacagttgggtgagaac

SEQ ID NO: 317208 - DNA, 14 bp, Homo sapiens
agagaccagccttt

SEQ ID NO: 317209 - DNA, 14 bp, Homo sapiens
agagaccatctcct

SEQ ID NO: 317210 - DNA, 14 bp, Homo sapiens
agagacccccgtgc

SEQ ID NO: 317211 - DNA, 22 bp, Homo sapiens
agagaccctcactgctggggag

SEQ ID NO: 317212 - DNA, 13 bp, Homo sapiens
agagaccctgcca

SEQ ID NO: 317213 - DNA, 13 bp, Homo sapiens
agagacctcatca

SEQ ID NO: 317214 - DNA, 16 bp, Homo sapiens
agagacctcatcagga

SEQ ID NO: 317215 - DNA, 13 bp, Homo sapiens
agagacggcagcc

SEQ ID NO: 317216 - DNA, 14 bp, Homo sapiens
agagacggcagccc

SEQ ID NO: 317217 - DNA, 15 bp, Homo sapiens
agagacggcagcccc

SEQ ID NO: 317218 - DNA, 15 bp, Homo sapiens
agagactagacaaat

SEQ ID NO: 317219 - DNA, 18 bp, Homo sapiens
agagactagacaaataac

SEQ ID NO: 317220 - DNA, 17 bp, Homo sapiens
agagactgaaagcagca

SEQ ID NO: 317221 - DNA, 15 bp, Homo sapiens
agagactgcccaccc

SEQ ID NO: 317222 - DNA, 21 bp, Homo sapiens
agagactgcccaccctgggcc

SEQ ID NO: 317223 - DNA, 14 bp, Homo sapiens
agagactggcagcc

SEQ ID NO: 317224 - DNA, 13 bp, Homo sapiens
agagactggccag

SEQ ID NO: 317225 - DNA, 22 bp, Homo sapiens
agagactgtagattgcttctgt

SEQ ID NO: 317226 - DNA, 23 bp, Homo sapiens
agagactgtgaggcggcagctgg

SEQ ID NO: 317227 - DNA, 16 bp, Homo sapiens
agagacttaaaggaca

SEQ ID NO: 317228 - DNA, 19 bp, Homo sapiens
agagacttaaaggacagga

SEQ ID NO: 317229 - DNA, 15 bp, Homo sapiens
agagagaaaaagaga

SEQ ID NO: 317230 - DNA, 16 bp, Homo sapiens
agagagaaaaagagag

SEQ ID NO: 317231 - DNA, 17 bp, Homo sapiens
agagagaaaaagagaga

SEQ ID NO: 317232 - DNA, 18 bp, Homo sapiens
agagagaaaaagagagag

SEQ ID NO: 317233 - DNA, 19 bp, Homo sapiens
agagagaaaaagagagagc

SEQ ID NO: 317234 - DNA, 19 bp, Homo sapiens
agagagaaaacttatttga

SEQ ID NO: 317235 - DNA, 13 bp, Homo sapiens
agagagaaagaat

SEQ ID NO: 317236 - DNA, 14 bp, Homo sapiens
agagagaaagaatg

SEQ ID NO: 317237 - DNA, 19 bp, Homo sapiens
agagagaatcagacctggg

SEQ ID NO: 317238 - DNA, 21 bp, Homo sapiens
agagagaatctcaagattcta

SEQ ID NO: 317239 - DNA, 15 bp, Homo sapiens
agagagaccctgcca

SEQ ID NO: 317240 - DNA, 14 bp, Homo sapiens
agagagagaaagaa

SEQ ID NO: 317241 - DNA, 15 bp, Homo sapiens
agagagagaaccttt

SEQ ID NO: 317242 - DNA, 13 bp, Homo sapiens
agagagagaagtg

SEQ ID NO: 317243 - DNA, 13 bp, Homo sapiens
agagagagagaaa

SEQ ID NO: 317244 - DNA, 14 bp, Homo sapiens
agagagagagaaag

SEQ ID NO: 317245 - DNA, 23 bp, Homo sapiens
agagagagccttaatggatgctc

SEQ ID NO: 317246 - DNA, 23 bp, Homo sapiens
agagagagcgcgggagagagtga

SEQ ID NO: 317247 - DNA, 16 bp, Homo sapiens
agagagagtgagagca

SEQ ID NO: 317248 - DNA, 16 bp, Homo sapiens
agagagatgctgctcc

SEQ ID NO: 317249 - DNA, 18 bp, Homo sapiens
atcttagaacagatggct

SEQ ID NO: 317250 - DNA, 12 bp, Homo sapiens
atcttatttata

SEQ ID NO: 317251 - DNA, 14 bp, Homo sapiens
atcttatttatata

SEQ ID NO: 317252 - DNA, 17 bp, Homo sapiens
atcttatttatatatga

SEQ ID NO: 317253 - DNA, 18 bp, Homo sapiens
atcttcactgaatatcat

SEQ ID NO: 317254 - DNA, 23 bp, Homo sapiens
atcttcacttctaaatgcatatc

SEQ ID NO: 317255 - DNA, 14 bp, Homo sapiens
atcttcatataaac

SEQ ID NO: 317256 - DNA, 21 bp, Homo sapiens
atcttccccaacgaaaagcac

SEQ ID NO: 317257 - DNA, 18 bp, Homo sapiens
atcttcccgcctcagcct

SEQ ID NO: 317258 - DNA, 19 bp, Homo sapiens
atcttcccgcctcagcctc

SEQ ID NO: 317259 - DNA, 23 bp, Homo sapiens
atcttccctttcctcccttctga

SEQ ID NO: 317260 - DNA, 21 bp, Homo sapiens
atcttcctagtgggccacccc

SEQ ID NO: 317261 - DNA, 13 bp, Homo sapiens
atcttcctgctgc

SEQ ID NO: 317262 - DNA, 18 bp, Homo sapiens
atcttcgttcttgttagt

SEQ ID NO: 317263 - DNA, 23 bp, Homo sapiens
atcttctctcttgattgattttt

SEQ ID NO: 317264 - DNA, 19 bp, Homo sapiens
atcttctctttttccagaa

SEQ ID NO: 317265 - DNA, 19 bp, Homo sapiens
atcttctgaaatgaaacaa

SEQ ID NO: 317266 - DNA, 18 bp, Homo sapiens
atcttctggtgcatgttc

SEQ ID NO: 317267 - DNA, 20 bp, Homo sapiens
atcttctggtgcatgttctt

SEQ ID NO: 317268 - DNA, 21 bp, Homo sapiens
atcttctggtgcatgttcttt

SEQ ID NO: 317269 - DNA, 11 bp, Homo sapiens
atcttctgttt

SEQ ID NO: 317270 - DNA, 14 bp, Homo sapiens
atcttctgtttttc

SEQ ID NO: 317271 - DNA, 19 bp, Homo sapiens
atcttctgtttttctcaaa

SEQ ID NO: 317272 - DNA, 20 bp, Homo sapiens
atcttctgtttttctcaaat

SEQ ID NO: 317273 - DNA, 14 bp, Homo sapiens
atcttgaagaatat

SEQ ID NO: 317274 - DNA, 17 bp, Homo sapiens
atcttgaagaatattgt

SEQ ID NO: 317275 - DNA, 16 bp, Homo sapiens
atcttgaagggcccag

SEQ ID NO: 317276 - DNA, 15 bp, Homo sapiens
atcttgaatttctgc

SEQ ID NO: 317277 - DNA, 17 bp, Homo sapiens
atcttgacattcaaggc

SEQ ID NO: 317278 - DNA, 13 bp, Homo sapiens
atcttgagagctg

SEQ ID NO: 317279 - DNA, 17 bp, Homo sapiens
atcttgagagctgctga

SEQ ID NO: 317280 - DNA, 24 bp, Homo sapiens
atcttgcaccccaaagctttcctg

SEQ ID NO: 317281 - DNA, 14 bp, Homo sapiens
atcttgctgtgaaa

SEQ ID NO: 317282 - DNA, 23 bp, Homo sapiens
atcttgctttctttgtttggctg

SEQ ID NO: 317283 - DNA, 23 bp, Homo sapiens
atcttgctttttttcaccaatat

SEQ ID NO: 317284 - DNA, 17 bp, Homo sapiens
atcttggaaatcattgt

SEQ ID NO: 317285 - DNA, 14 bp, Homo sapiens
atcttggactgaca

SEQ ID NO: 317286 - DNA, 19 bp, Homo sapiens
atcttggagacaattacaa

SEQ ID NO: 317287 - DNA, 19 bp, Homo sapiens
atcttggtagttctgtgcc

SEQ ID NO: 317288 - DNA, 16 bp, Homo sapiens
atcttgtcatgtgtat

SEQ ID NO: 317289 - DNA, 17 bp, Homo sapiens
atcttgtcatgtgtata

SEQ ID NO: 317290 - DNA, 16 bp, Homo sapiens
atctttaaataaatgt

SEQ ID NO: 317291 - DNA, 16 bp, Homo sapiens
atctttaaatgatgta

SEQ ID NO: 317292 - DNA, 14 bp, Homo sapiens
atctttaattgtat

SEQ ID NO: 317293 - DNA, 22 bp, Homo sapiens
atctttacataattcagagtgg

SEQ ID NO: 317294 - DNA, 15 bp, Homo sapiens
atctttattaacctc

SEQ ID NO: 317295 - DNA, 20 bp, Homo sapiens
atctttattaacctcagcat

SEQ ID NO: 317296 - DNA, 18 bp, Homo sapiens
atctttcagcctgcttct

SEQ ID NO: 317297 - DNA, 14 bp, Homo sapiens
atctttcagttatt

SEQ ID NO: 317298 - DNA, 12 bp, Homo sapiens
atctttccaaat

SEQ ID NO: 317299 - DNA, 22 bp, Homo sapiens
atctttcctccaaactcctgcc

SEQ ID NO: 317300 - DNA, 19 bp, Homo sapiens
atctttcctttgctctgga

SEQ ID NO: 317301 - DNA, 21 bp, Homo sapiens
atctttcgttggttgtttctc

SEQ ID NO: 317302 - DNA, 22 bp, Homo sapiens
atctttctatataaaatgtatt

SEQ ID NO: 317303 - DNA, 13 bp, Homo sapiens
atctttctgcaga

SEQ ID NO: 317304 - DNA, 14 bp, Homo sapiens
atctttctttacct

SEQ ID NO: 317305 - DNA, 20 bp, Homo sapiens
atctttctttacctgagacc

SEQ ID NO: 317306 - DNA, 22 bp, Homo sapiens
atctttgagataatttaaccct

SEQ ID NO: 317307 - DNA, 20 bp, Homo sapiens
atctttgcaagaaagtcaga

SEQ ID NO: 317308 - DNA, 14 bp, Homo sapiens
atctttgccttggg

SEQ ID NO: 317309 - DNA, 15 bp, Homo sapiens
atctttgctgaagaa

SEQ ID NO: 317310 - DNA, 11 bp, Homo sapiens
atcttttacat

SEQ ID NO: 317311 - DNA, 13 bp, Homo sapiens
atcttttactgtg

SEQ ID NO: 317312 - DNA, 22 bp, Homo sapiens
agagcaggctggcagctctcca

SEQ ID NO: 317313 - DNA, 23 bp, Homo sapiens
agagcaggctggcagctctccag

SEQ ID NO: 317314 - DNA, 13 bp, Homo sapiens
agagcagggcaag

SEQ ID NO: 317315 - DNA, 17 bp, Homo sapiens
agagcaggtctgcaggc

SEQ ID NO: 317316 - DNA, 18 bp, Homo sapiens
agagcaggtctgcaggcc

SEQ ID NO: 317317 - DNA, 20 bp, Homo sapiens
agagcaggtctgcaggccac

SEQ ID NO: 317318 - DNA, 21 bp, Homo sapiens
agagcaggtctgcaggccacc

SEQ ID NO: 317319 - DNA, 16 bp, Homo sapiens
agagcagtgattctct

SEQ ID NO: 317320 - DNA, 20 bp, Homo sapiens
agagcagttaacatctgaag

SEQ ID NO: 317321 - DNA, 22 bp, Homo sapiens
agagcatcgtgacccttcaggg

SEQ ID NO: 317322 - DNA, 17 bp, Homo sapiens
agagcatctgctctgag

SEQ ID NO: 317323 - DNA, 14 bp, Homo sapiens
agagcatctgtccc

SEQ ID NO: 317324 - DNA, 22 bp, Homo sapiens
agagcatctgtcccactgggac

SEQ ID NO: 317325 - DNA, 19 bp, Homo sapiens
agagcatgtgggggaaggc

SEQ ID NO: 317326 - DNA, 19 bp, Homo sapiens
agagcattattcctggtca

SEQ ID NO: 317327 - DNA, 14 bp, Homo sapiens
agagcattctgggg

SEQ ID NO: 317328 - DNA, 20 bp, Homo sapiens
agagcattctggggtggggc

SEQ ID NO: 317329 - DNA, 20 bp, Homo sapiens
agagccaacctcggcttgtg

SEQ ID NO: 317330 - DNA, 10 bp, Homo sapiens
agagccacaa

SEQ ID NO: 317331 - DNA, 23 bp, Homo sapiens
agagccacaggccccttttgtgg

SEQ ID NO: 317332 - DNA, 16 bp, Homo sapiens
agagccactacctttg

SEQ ID NO: 317333 - DNA, 17 bp, Homo sapiens
agagccagcctgggact

SEQ ID NO: 317334 - DNA, 20 bp, Homo sapiens
agagccaggattcaaccctg

SEQ ID NO: 317335 - DNA, 10 bp, Homo sapiens
agagccaggg

SEQ ID NO: 317336 - DNA, 13 bp, Homo sapiens
agagccatgggcc

SEQ ID NO: 317337 - DNA, 15 bp, Homo sapiens
agagccatgggcctg

SEQ ID NO: 317338 - DNA, 19 bp, Homo sapiens
agagccatgggcctgggcc

SEQ ID NO: 317339 - DNA, 22 bp, Homo sapiens
agagcccacatggccgggccct

SEQ ID NO: 317340 - DNA, 13 bp, Homo sapiens
agagccccagctg

SEQ ID NO: 317341 - DNA, 14 bp, Homo sapiens
agagcccccaccag

SEQ ID NO: 317342 - DNA, 18 bp, Homo sapiens
agagcccccaccagcagc

SEQ ID NO: 317343 - DNA, 16 bp, Homo sapiens
agagccccccacaatg

SEQ ID NO: 317344 - DNA, 22 bp, Homo sapiens
agagccccgcaaaacccactga

SEQ ID NO: 317345 - DNA, 16 bp, Homo sapiens
agagcccctggggcct

SEQ ID NO: 317346 - DNA, 19 bp, Homo sapiens
agagcccctggggcctaga

SEQ ID NO: 317347 - DNA, 16 bp, Homo sapiens
agagcccgcttttgtt

SEQ ID NO: 317348 - DNA, 16 bp, Homo sapiens
agagccctgccctgca

SEQ ID NO: 317349 - DNA, 22 bp, Homo sapiens
agagccctggacacccctgctc

SEQ ID NO: 317350 - DNA, 16 bp, Homo sapiens
agagccctggctgggt

SEQ ID NO: 317351 - DNA, 18 bp, Homo sapiens
agagcccttcactgccat

SEQ ID NO: 317352 - DNA, 16 bp, Homo sapiens
agagcctatggaaagg

SEQ ID NO: 317353 - DNA, 13 bp, Homo sapiens
agagcctgtcccc

SEQ ID NO: 317354 - DNA, 15 bp, Homo sapiens
agagcctgtccccgc

SEQ ID NO: 317355 - DNA, 16 bp, Homo sapiens
agagcctgtccccgcc

SEQ ID NO: 317356 - DNA, 17 bp, Homo sapiens
agagcctgtccccgcct

SEQ ID NO: 317357 - DNA, 18 bp, Homo sapiens
agagcctgtccccgcctt

SEQ ID NO: 317358 - DNA, 22 bp, Homo sapiens
agagcctgtccccgccttccct

SEQ ID NO: 317359 - DNA, 21 bp, Homo sapiens
agagccttaatggatgctcat

SEQ ID NO: 317360 - DNA, 18 bp, Homo sapiens
agagcctttgatcttcag

SEQ ID NO: 317361 - DNA, 18 bp, Homo sapiens
agagcgagactctgtctc

SEQ ID NO: 317362 - DNA, 15 bp, Homo sapiens
agagcgccacccgcc

SEQ ID NO: 317363 - DNA, 16 bp, Homo sapiens
agagcgcgggagagag

SEQ ID NO: 317364 - DNA, 17 bp, Homo sapiens
agagcgcgggagagagt

SEQ ID NO: 317365 - DNA, 14 bp, Homo sapiens
agagcgctggcctc

SEQ ID NO: 317366 - DNA, 15 bp, Homo sapiens
agagcgctggcctct

SEQ ID NO: 317367 - DNA, 16 bp, Homo sapiens
agagcgctggcctctt

SEQ ID NO: 317368 - DNA, 12 bp, Homo sapiens
agagcggaggag

SEQ ID NO: 317369 - DNA, 13 bp, Homo sapiens
agagcggctgccc

SEQ ID NO: 317370 - DNA, 17 bp, Homo sapiens
agagcgtccttccccct

SEQ ID NO: 317371 - DNA, 14 bp, Homo sapiens
agagctaataaatc

SEQ ID NO: 317372 - DNA, 20 bp, Homo sapiens
agagctacactcgccttctg

SEQ ID NO: 317373 - DNA, 16 bp, Homo sapiens
agagctatgcacacca

SEQ ID NO: 317374 - DNA, 12 bp, Homo sapiens
agagctcagagg

SEQ ID NO: 317375 - DNA, 16 bp, Homo sapiens
agagctcagcacagcc

SEQ ID NO: 317376 - DNA, 18 bp, Homo sapiens
agagctcagcacagcctc

SEQ ID NO: 317377 - DNA, 22 bp, Homo sapiens
agagctcagcacagcctcaccc

SEQ ID NO: 317378 - DNA, 17 bp, Homo sapiens
agagctcaggagaaggc

SEQ ID NO: 317379 - DNA, 18 bp, Homo sapiens
agagctcaggagaaggcc

SEQ ID NO: 317380 - DNA, 15 bp, Homo sapiens
agagctccacagaag

SEQ ID NO: 317381 - DNA, 12 bp, Homo sapiens
agagctcccagg

SEQ ID NO: 317382 - DNA, 18 bp, Homo sapiens
agagctcccaggacgcag

SEQ ID NO: 317383 - DNA, 18 bp, Homo sapiens
agagctctggagccacct

SEQ ID NO: 317384 - DNA, 19 bp, Homo sapiens
agagctctggagccacctg

SEQ ID NO: 317385 - DNA, 18 bp, Homo sapiens
agagctcttagtttttaa

SEQ ID NO: 317386 - DNA, 23 bp, Homo sapiens
atgaaggtgtgctacagaaaata

SEQ ID NO: 317387 - DNA, 14 bp, Homo sapiens
atgaagtaagttct

SEQ ID NO: 317388 - DNA, 21 bp, Homo sapiens
atgaataattatgtttacctc

SEQ ID NO: 317389 - DNA, 23 bp, Homo sapiens
atgaataattatgtttacctcac

SEQ ID NO: 317390 - DNA, 23 bp, Homo sapiens
atgaataattgaggttaggaacc

SEQ ID NO: 317391 - DNA, 21 bp, Homo sapiens
atgaatacagggcatgcattt

SEQ ID NO: 317392 - DNA, 23 bp, Homo sapiens
atgaatatatttaagcaacatct

SEQ ID NO: 317393 - DNA, 17 bp, Homo sapiens
atgaatattgaagtttc

SEQ ID NO: 317394 - DNA, 12 bp, Homo sapiens
atgaatatttat

SEQ ID NO: 317395 - DNA, 15 bp, Homo sapiens
atgaatatttataac

SEQ ID NO: 317396 - DNA, 18 bp, Homo sapiens
atgaatatttataacagc

SEQ ID NO: 317397 - DNA, 19 bp, Homo sapiens
atgaatcagtatgaagaca

SEQ ID NO: 317398 - DNA, 24 bp, Homo sapiens
atgaatctgtctcccagttatgaa

SEQ ID NO: 317399 - DNA, 12 bp, Homo sapiens
atgaatgaaata

SEQ ID NO: 317400 - DNA, 15 bp, Homo sapiens
atgaatgaaatataa

SEQ ID NO: 317401 - DNA, 23 bp, Homo sapiens
atgaatgaaatataaactgtgag

SEQ ID NO: 317402 - DNA, 22 bp, Homo sapiens
atgaatgaggaacaatcacaaa

SEQ ID NO: 317403 - DNA, 13 bp, Homo sapiens
atgaatgcagtat

SEQ ID NO: 317404 - DNA, 14 bp, Homo sapiens
atgaatgcagtata

SEQ ID NO: 317405 - DNA, 13 bp, Homo sapiens
atgaatgtaaatt

SEQ ID NO: 317406 - DNA, 16 bp, Homo sapiens
atgaatgtaaatttgt

SEQ ID NO: 317407 - DNA, 13 bp, Homo sapiens
atgaatgtatcag

SEQ ID NO: 317408 - DNA, 15 bp, Homo sapiens
atgaatgtatcagga

SEQ ID NO: 317409 - DNA, 19 bp, Homo sapiens
atgaatgtatgtgcactgt

SEQ ID NO: 317410 - DNA, 16 bp, Homo sapiens
atgaatgtcagtgtga

SEQ ID NO: 317411 - DNA, 20 bp, Homo sapiens
atgaatgtcagtgtgactga

SEQ ID NO: 317412 - DNA, 11 bp, Homo sapiens
atgaatgttta

SEQ ID NO: 317413 - DNA, 13 bp, Homo sapiens
atgaattaaattt

SEQ ID NO: 317414 - DNA, 20 bp, Homo sapiens
atgaattagaagaaaatgga

SEQ ID NO: 317415 - DNA, 22 bp, Homo sapiens
atgaattcaacctcagccctga

SEQ ID NO: 317416 - DNA, 19 bp, Homo sapiens
atgaattcaagaaaggaaa

SEQ ID NO: 317417 - DNA, 18 bp, Homo sapiens
atgaattctctctaaaaa

SEQ ID NO: 317418 - DNA, 17 bp, Homo sapiens
atgaattgaatgctcta

SEQ ID NO: 317419 - DNA, 13 bp, Homo sapiens
atgaattgcattt

SEQ ID NO: 317420 - DNA, 23 bp, Homo sapiens
atgaatttaaatataattctgta

SEQ ID NO: 317421 - DNA, 15 bp, Homo sapiens
atgaattttaaaagc

SEQ ID NO: 317422 - DNA, 21 bp, Homo sapiens
atgaattttaaaagcatatat

SEQ ID NO: 317423 - DNA, 18 bp, Homo sapiens
atgaattttcaagtaatt

SEQ ID NO: 317424 - DNA, 19 bp, Homo sapiens
atgacaacagaagcttcag

SEQ ID NO: 317425 - DNA, 23 bp, Homo sapiens
atgacaacctgtgtgagagaatt

SEQ ID NO: 317426 - DNA, 14 bp, Homo sapiens
atgacaacttctaa

SEQ ID NO: 317427 - DNA, 18 bp, Homo sapiens
atgacaagccccaggcag

SEQ ID NO: 317428 - DNA, 23 bp, Homo sapiens
atgacaataaattttatctcagt

SEQ ID NO: 317429 - DNA, 14 bp, Homo sapiens
atgacaatgatgat

SEQ ID NO: 317430 - DNA, 19 bp, Homo sapiens
atgacaatttcaaaatgca

SEQ ID NO: 317431 - DNA, 22 bp, Homo sapiens
atgacaatttcaaaatgcatgt

SEQ ID NO: 317432 - DNA, 22 bp, Homo sapiens
atgacacataaatctgtctgat

SEQ ID NO: 317433 - DNA, 23 bp, Homo sapiens
atgacagctactaacctggagac

SEQ ID NO: 317434 - DNA, 21 bp, Homo sapiens
atgacaggcgcctgccatcat

SEQ ID NO: 317435 - DNA, 16 bp, Homo sapiens
atgacagggagctggg

SEQ ID NO: 317436 - DNA, 16 bp, Homo sapiens
atgacaggtaaattaa

SEQ ID NO: 317437 - DNA, 17 bp, Homo sapiens
atgacagtagcatactg

SEQ ID NO: 317438 - DNA, 24 bp, Homo sapiens
atgacatcttcaaagcttgaagat

SEQ ID NO: 317439 - DNA, 13 bp, Homo sapiens
atgacatgtgtca

SEQ ID NO: 317440 - DNA, 23 bp, Homo sapiens
atgaccaatattatactaagaaa

SEQ ID NO: 317441 - DNA, 15 bp, Homo sapiens
atgaccaatctctgt

SEQ ID NO: 317442 - DNA, 16 bp, Homo sapiens
ctgggcagagcctgtc

SEQ ID NO: 317443 - DNA, 17 bp, Homo sapiens
ctgggcagagcctgtcc

SEQ ID NO: 317444 - DNA, 18 bp, Homo sapiens
ctgggcagagcctgtccc

SEQ ID NO: 317445 - DNA, 23 bp, Homo sapiens
ctgggcagaggggagaggaagca

SEQ ID NO: 317446 - DNA, 16 bp, Homo sapiens
ctgggcagccaggctg

SEQ ID NO: 317447 - DNA, 18 bp, Homo sapiens
ctgggcagccaggctgcc

SEQ ID NO: 317448 - DNA, 15 bp, Homo sapiens
ctgggcagcccagag

SEQ ID NO: 317449 - DNA, 16 bp, Homo sapiens
ctgggcagcccagaga

SEQ ID NO: 317450 - DNA, 12 bp, Homo sapiens
ctgggcagctgt

SEQ ID NO: 317451 - DNA, 20 bp, Homo sapiens
ctgggcaggcggtccccatc

SEQ ID NO: 317452 - DNA, 12 bp, Homo sapiens
ctgggcagggcc

SEQ ID NO: 317453 - DNA, 21 bp, Homo sapiens
ctgggcagtgcccaccatgca

SEQ ID NO: 317454 - DNA, 17 bp, Homo sapiens
ctgggcatccccagccc

SEQ ID NO: 317455 - DNA, 20 bp, Homo sapiens
ctgggcatccccagccccct

SEQ ID NO: 317456 - DNA, 22 bp, Homo sapiens
ctgggcatccccagccccctgg

SEQ ID NO: 317457 - DNA, 11 bp, Homo sapiens
ctgggcatggt

SEQ ID NO: 317458 - DNA, 21 bp, Homo sapiens
ctgggcatggtaccagccctg

SEQ ID NO: 317459 - DNA, 13 bp, Homo sapiens
ctgggcatgtttg

SEQ ID NO: 317460 - DNA, 14 bp, Homo sapiens
ctgggccacccttc

SEQ ID NO: 317461 - DNA, 18 bp, Homo sapiens
ctgggccacccttcacgc

SEQ ID NO: 317462 - DNA, 21 bp, Homo sapiens
ctgggccagggtctcgtcagg

SEQ ID NO: 317463 - DNA, 23 bp, Homo sapiens
ctgggcccagaaggttgtgatga

SEQ ID NO: 317464 - DNA, 12 bp, Homo sapiens
ctgggcccagag

SEQ ID NO: 317465 - DNA, 12 bp, Homo sapiens
ctgggcccagcc

SEQ ID NO: 317466 - DNA, 20 bp, Homo sapiens
ctgggcccaggcagcacctg

SEQ ID NO: 317467 - DNA, 13 bp, Homo sapiens
ctgggcccagggg

SEQ ID NO: 317468 - DNA, 15 bp, Homo sapiens
ctgggccccatgctc

SEQ ID NO: 317469 - DNA, 16 bp, Homo sapiens
ctgggccccatgctct

SEQ ID NO: 317470 - DNA, 22 bp, Homo sapiens
ctgggccccatgctctgcccca

SEQ ID NO: 317471 - DNA, 18 bp, Homo sapiens
ctgggccccccagctcag

SEQ ID NO: 317472 - DNA, 20 bp, Homo sapiens
ctgggccccccagctcaggg

SEQ ID NO: 317473 - DNA, 20 bp, Homo sapiens
ctgggcccctccctacctca

SEQ ID NO: 317474 - DNA, 19 bp, Homo sapiens
ctgggcccgggcaggccag

SEQ ID NO: 317475 - DNA, 16 bp, Homo sapiens
ctgggccggcagcctg

SEQ ID NO: 317476 - DNA, 17 bp, Homo sapiens
ctgggccggcagcctgg

SEQ ID NO: 317477 - DNA, 19 bp, Homo sapiens
ctgggccggcagcctggtt

SEQ ID NO: 317478 - DNA, 15 bp, Homo sapiens
ctgggcctcattcta

SEQ ID NO: 317479 - DNA, 21 bp, Homo sapiens
ctgggcctcccatagtgctgg

SEQ ID NO: 317480 - DNA, 21 bp, Homo sapiens
ctgggcctcccgtccgtccgc

SEQ ID NO: 317481 - DNA, 17 bp, Homo sapiens
ctgggcctgatggagag

SEQ ID NO: 317482 - DNA, 18 bp, Homo sapiens
ctgggcctgatggagagg

SEQ ID NO: 317483 - DNA, 22 bp, Homo sapiens
ctgggcctgatggagaggagaa

SEQ ID NO: 317484 - DNA, 11 bp, Homo sapiens
ctgggcctgct

SEQ ID NO: 317485 - DNA, 12 bp, Homo sapiens
ctgggcctgctt

SEQ ID NO: 317486 - DNA, 19 bp, Homo sapiens
ctgggcctgcttttccagg

SEQ ID NO: 317487 - DNA, 14 bp, Homo sapiens
ctgggcctgtcccc

SEQ ID NO: 317488 - DNA, 12 bp, Homo sapiens
ctgggcctgtct

SEQ ID NO: 317489 - DNA, 16 bp, Homo sapiens
ctgggcctgtctcaga

SEQ ID NO: 317490 - DNA, 16 bp, Homo sapiens
ctgggcctgtgcagca

SEQ ID NO: 317491 - DNA, 17 bp, Homo sapiens
ctgggcctgtgcagcag

SEQ ID NO: 317492 - DNA, 14 bp, Homo sapiens
ctgggccttctcag

SEQ ID NO: 317493 - DNA, 17 bp, Homo sapiens
ctgggccttctcagctc

SEQ ID NO: 317494 - DNA, 20 bp, Homo sapiens
ctgggccttctcagctctcc

SEQ ID NO: 317495 - DNA, 23 bp, Homo sapiens
ctgggccttgtgtgctggcttcc

SEQ ID NO: 317496 - DNA, 21 bp, Homo sapiens
ctgggcctttcctgtgccaac

SEQ ID NO: 317497 - DNA, 17 bp, Homo sapiens
ctgggcctttgtttcct

SEQ ID NO: 317498 - DNA, 15 bp, Homo sapiens
ctgggcgccctggaa

SEQ ID NO: 317499 - DNA, 20 bp, Homo sapiens
ctgggcgcggtggctcacgc

SEQ ID NO: 317500 - DNA, 22 bp, Homo sapiens
ctgggcgcggtggctcacgcct

SEQ ID NO: 317501 - DNA, 13 bp, Homo sapiens
ctgggctcaagca

SEQ ID NO: 317502 - DNA, 15 bp, Homo sapiens
ctgggctcagggctg

SEQ ID NO: 317503 - DNA, 16 bp, Homo sapiens
ctgggctcagggctgg

SEQ ID NO: 317504 - DNA, 21 bp, Homo sapiens
ctgggctcagggctggagtgc

SEQ ID NO: 317505 - DNA, 17 bp, Homo sapiens
ctgggctctgtcttcct

SEQ ID NO: 317506 - DNA, 15 bp, Homo sapiens
ctgggctgagcccct

SEQ ID NO: 317507 - DNA, 17 bp, Homo sapiens
ctgggctgagcccctac

SEQ ID NO: 317508 - DNA, 18 bp, Homo sapiens
ctgggctgagcccctacc

SEQ ID NO: 317509 - DNA, 22 bp, Homo sapiens
ctgggctgagcctactgtctcc

SEQ ID NO: 317510 - DNA, 20 bp, Homo sapiens
ctgggctgccatgtgaagag

SEQ ID NO: 317511 - DNA, 21 bp, Homo sapiens
ctgggctggactggaggtggg

SEQ ID NO: 317512 - DNA, 15 bp, Homo sapiens
ctgggctggccagtt

SEQ ID NO: 317513 - DNA, 16 bp, Homo sapiens
ctgggctgggagaagg

SEQ ID NO: 317514 - DNA, 19 bp, Homo sapiens
ctgggcttggggcttccta

SEQ ID NO: 317515 - DNA, 21 bp, Homo sapiens
ccagaaccccaactcccagcc

SEQ ID NO: 317516 - DNA, 17 bp, Homo sapiens
ccagaacgggcctcccc

SEQ ID NO: 317517 - DNA, 20 bp, Homo sapiens
ccagaacgtagtgagccttg

SEQ ID NO: 317518 - DNA, 16 bp, Homo sapiens
ccagaactgcccccac

SEQ ID NO: 317519 - DNA, 17 bp, Homo sapiens
ccagaactgcccccact

SEQ ID NO: 317520 - DNA, 18 bp, Homo sapiens
ccagaactgcccccactg

SEQ ID NO: 317521 - DNA, 14 bp, Homo sapiens
ccagaagaaattat

SEQ ID NO: 317522 - DNA, 20 bp, Homo sapiens
ccagaagaatattcaggact

SEQ ID NO: 317523 - DNA, 23 bp, Homo sapiens
ccagaagatgtattcagagccac

SEQ ID NO: 317524 - DNA, 19 bp, Homo sapiens
ccagaagcctctggctaga

SEQ ID NO: 317525 - DNA, 19 bp, Homo sapiens
ccagaagctcaaggctgca

SEQ ID NO: 317526 - DNA, 16 bp, Homo sapiens
ccagaaggagggcaga

SEQ ID NO: 317527 - DNA, 18 bp, Homo sapiens
ccagaaggagggcagagc

SEQ ID NO: 317528 - DNA, 18 bp, Homo sapiens
ccagaaggccacaggcca

SEQ ID NO: 317529 - DNA, 15 bp, Homo sapiens
ccagaagggggccat

SEQ ID NO: 317530 - DNA, 20 bp, Homo sapiens
ccagaagtgaatgggaaagg

SEQ ID NO: 317531 - DNA, 23 bp, Homo sapiens
ccagaatctgctgttgccatagc

SEQ ID NO: 317532 - DNA, 12 bp, Homo sapiens
ccagaatgtaag

SEQ ID NO: 317533 - DNA, 16 bp, Homo sapiens
ccagaatgtaagaaaa

SEQ ID NO: 317534 - DNA, 20 bp, Homo sapiens
ccagaattagtcctcacagc

SEQ ID NO: 317535 - DNA, 21 bp, Homo sapiens
ccagaatttcccaaagcagtg

SEQ ID NO: 317536 - DNA, 14 bp, Homo sapiens
ccagacaaggagag

SEQ ID NO: 317537 - DNA, 16 bp, Homo sapiens
ccagacaaggagagcg

SEQ ID NO: 317538 - DNA, 18 bp, Homo sapiens
ccagacaaggagagcgga

SEQ ID NO: 317539 - DNA, 22 bp, Homo sapiens
ccagacaaggagagcggaggag

SEQ ID NO: 317540 - DNA, 19 bp, Homo sapiens
ccagacaccacagacgcca

SEQ ID NO: 317541 - DNA, 18 bp, Homo sapiens
ccagacagacatctctgc

SEQ ID NO: 317542 - DNA, 13 bp, Homo sapiens
ccagacaggccct

SEQ ID NO: 317543 - DNA, 18 bp, Homo sapiens
ccagacaggccctccctg

SEQ ID NO: 317544 - DNA, 17 bp, Homo sapiens
ccagacagggtggggct

SEQ ID NO: 317545 - DNA, 17 bp, Homo sapiens
ccagaccagagctctgg

SEQ ID NO: 317546 - DNA, 13 bp, Homo sapiens
ccagacccagggc

SEQ ID NO: 317547 - DNA, 18 bp, Homo sapiens
ccagacccagggcagtgt

SEQ ID NO: 317548 - DNA, 14 bp, Homo sapiens
ccagaccccagggc

SEQ ID NO: 317549 - DNA, 15 bp, Homo sapiens
ccagacccccacccc

SEQ ID NO: 317550 - DNA, 16 bp, Homo sapiens
ccagacccccacccct

SEQ ID NO: 317551 - DNA, 19 bp, Homo sapiens
ccagacccccaccccttcc

SEQ ID NO: 317552 - DNA, 22 bp, Homo sapiens
ccagacccccaccccttcccca

SEQ ID NO: 317553 - DNA, 14 bp, Homo sapiens
ccagacccccagca

SEQ ID NO: 317554 - DNA, 20 bp, Homo sapiens
ccagacccctaccctttccc

SEQ ID NO: 317555 - DNA, 21 bp, Homo sapiens
ccagacccctaccctttccca

SEQ ID NO: 317556 - DNA, 19 bp, Homo sapiens
ccagacccctctggccagg

SEQ ID NO: 317557 - DNA, 20 bp, Homo sapiens
ccagacccctctggccagga

SEQ ID NO: 317558 - DNA, 17 bp, Homo sapiens
ccagacccctggctttt

SEQ ID NO: 317559 - DNA, 16 bp, Homo sapiens
ccagaccctgcctgag

SEQ ID NO: 317560 - DNA, 15 bp, Homo sapiens
ccagacctgagctcc

SEQ ID NO: 317561 - DNA, 15 bp, Homo sapiens
ccagacctgggccct

SEQ ID NO: 317562 - DNA, 17 bp, Homo sapiens
ccagacctgggccctgg

SEQ ID NO: 317563 - DNA, 14 bp, Homo sapiens
ccagactcaggttc

SEQ ID NO: 317564 - DNA, 17 bp, Homo sapiens
ccagactcgagagggct

SEQ ID NO: 317565 - DNA, 12 bp, Homo sapiens
ccagactggctg

SEQ ID NO: 317566 - DNA, 18 bp, Homo sapiens
ccagactggctgcacagc

SEQ ID NO: 317567 - DNA, 21 bp, Homo sapiens
ccagactggctgcacagccca

SEQ ID NO: 317568 - DNA, 18 bp, Homo sapiens
ccagactgtaagatgttg

SEQ ID NO: 317569 - DNA, 19 bp, Homo sapiens
ccagacttcgctattccca

SEQ ID NO: 317570 - DNA, 21 bp, Homo sapiens
ccagacttcgctattcccagg

SEQ ID NO: 317571 - DNA, 16 bp, Homo sapiens
ccagactttctacacc

SEQ ID NO: 317572 - DNA, 23 bp, Homo sapiens
ccagagaaatgaaagtcagttta

SEQ ID NO: 317573 - DNA, 12 bp, Homo sapiens
ccagagaagcct

SEQ ID NO: 317574 - DNA, 15 bp, Homo sapiens
ccagagactcagagg

SEQ ID NO: 317575 - DNA, 13 bp, Homo sapiens
ccagagactgccc

SEQ ID NO: 317576 - DNA, 14 bp, Homo sapiens
ccagagactgccca

SEQ ID NO: 317577 - DNA, 18 bp, Homo sapiens
ccagagactgcccaccct

SEQ ID NO: 317578 - DNA, 18 bp, Homo sapiens
ccagagactgggatggga

SEQ ID NO: 317579 - DNA, 11 bp, Homo sapiens
ccagagagaaa

SEQ ID NO: 317580 - DNA, 12 bp, Homo sapiens
ccagagagaaaa

SEQ ID NO: 317581 - DNA, 16 bp, Homo sapiens
ccagagagaaaaagag

SEQ ID NO: 317582 - DNA, 17 bp, Homo sapiens
ccagagagaaaaagaga

SEQ ID NO: 317583 - DNA, 21 bp, Homo sapiens
ccagagagaaaaagagagagc

SEQ ID NO: 317584 - DNA, 12 bp, Homo sapiens
ccagagagaagc

SEQ ID NO: 317585 - DNA, 18 bp, Homo sapiens
ccagagagagaagtgccc

SEQ ID NO: 317586 - DNA, 19 bp, Homo sapiens
ccagagagagaagtgcccc

SEQ ID NO: 317587 - DNA, 20 bp, Homo sapiens
ccagagagagaagtgcccct

SEQ ID NO: 317588 - DNA, 18 bp, Homo sapiens
tttgtaatgtatcttatt

SEQ ID NO: 317589 - DNA, 14 bp, Homo sapiens
tttgtacattcctg

SEQ ID NO: 317590 - DNA, 23 bp, Homo sapiens
tttgtacattcctgatactgggt

SEQ ID NO: 317591 - DNA, 22 bp, Homo sapiens
tttgtactttgtttttccatgt

SEQ ID NO: 317592 - DNA, 18 bp, Homo sapiens
tttgtagatgtattttca

SEQ ID NO: 317593 - DNA, 19 bp, Homo sapiens
tttgtaggggtcaaagaaa

SEQ ID NO: 317594 - DNA, 23 bp, Homo sapiens
tttgtaggggtcaaagaaatgct

SEQ ID NO: 317595 - DNA, 16 bp, Homo sapiens
tttgtagggtttctag

SEQ ID NO: 317596 - DNA, 17 bp, Homo sapiens
tttgtagtagttgatga

SEQ ID NO: 317597 - DNA, 12 bp, Homo sapiens
tttgtatcctcc

SEQ ID NO: 317598 - DNA, 21 bp, Homo sapiens
tttgtatctctgaagcatgtt

SEQ ID NO: 317599 - DNA, 20 bp, Homo sapiens
tttgtatctttaaagacttg

SEQ ID NO: 317600 - DNA, 21 bp, Homo sapiens
tttgtatctttaaagacttga

SEQ ID NO: 317601 - DNA, 13 bp, Homo sapiens
tttgtatgatgta

SEQ ID NO: 317602 - DNA, 22 bp, Homo sapiens
tttgtatgttgtgaagatgttt

SEQ ID NO: 317603 - DNA, 21 bp, Homo sapiens
tttgtattctttactaaagat

SEQ ID NO: 317604 - DNA, 23 bp, Homo sapiens
tttgtatttaatgatttttgtgt

SEQ ID NO: 317605 - DNA, 18 bp, Homo sapiens
tttgtatttatattagag

SEQ ID NO: 317606 - DNA, 20 bp, Homo sapiens
tttgtatttcttttatatat

SEQ ID NO: 317607 - DNA, 14 bp, Homo sapiens
tttgtatttttgaa

SEQ ID NO: 317608 - DNA, 18 bp, Homo sapiens
tttgtatttttgaataaa

SEQ ID NO: 317609 - DNA, 23 bp, Homo sapiens
tttgtcaaactgtagaaatgatg

SEQ ID NO: 317610 - DNA, 17 bp, Homo sapiens
tttgtcaatgacagttt

SEQ ID NO: 317611 - DNA, 14 bp, Homo sapiens
tttgtcagacttta

SEQ ID NO: 317612 - DNA, 23 bp, Homo sapiens
tttgtcagtgtagatcaactcat

SEQ ID NO: 317613 - DNA, 14 bp, Homo sapiens
tttgtccaggcctg

SEQ ID NO: 317614 - DNA, 14 bp, Homo sapiens
tttgtcccccaact

SEQ ID NO: 317615 - DNA, 18 bp, Homo sapiens
tttgtcccccaacttgag

SEQ ID NO: 317616 - DNA, 12 bp, Homo sapiens
tttgtcccctca

SEQ ID NO: 317617 - DNA, 17 bp, Homo sapiens
tttgtcccctcacctcc

SEQ ID NO: 317618 - DNA, 21 bp, Homo sapiens
tttgtcctttgagaaagaaat

SEQ ID NO: 317619 - DNA, 17 bp, Homo sapiens
tttgtctacgtttagtt

SEQ ID NO: 317620 - DNA, 21 bp, Homo sapiens
tttgtctcattttgtatgtat

SEQ ID NO: 317621 - DNA, 23 bp, Homo sapiens
tttgtctcattttgtatgtatgt

SEQ ID NO: 317622 - DNA, 19 bp, Homo sapiens
tttgtctcttagaaatact

SEQ ID NO: 317623 - DNA, 20 bp, Homo sapiens
tttgtctgatattggtgtga

SEQ ID NO: 317624 - DNA, 16 bp, Homo sapiens
tttgtctggctgtggc

SEQ ID NO: 317625 - DNA, 19 bp, Homo sapiens
tttgtctgtgtgctgtaac

SEQ ID NO: 317626 - DNA, 19 bp, Homo sapiens
tttgtcttatatatatttc

SEQ ID NO: 317627 - DNA, 13 bp, Homo sapiens
tttgtcttcaact

SEQ ID NO: 317628 - DNA, 16 bp, Homo sapiens
tttgtctttttccttt

SEQ ID NO: 317629 - DNA, 18 bp, Homo sapiens
tttgtgaagtgattgaca

SEQ ID NO: 317630 - DNA, 18 bp, Homo sapiens
tttgtgagccaaagagaa

SEQ ID NO: 317631 - DNA, 18 bp, Homo sapiens
tttgtgagccttgctgcc

SEQ ID NO: 317632 - DNA, 22 bp, Homo sapiens
tttgtgagccttgctgccaagt

SEQ ID NO: 317633 - DNA, 13 bp, Homo sapiens
tttgtgagtattc

SEQ ID NO: 317634 - DNA, 18 bp, Homo sapiens
tttgtgatgatgctgtga

SEQ ID NO: 317635 - DNA, 21 bp, Homo sapiens
tttgtgcatgtatattactga

SEQ ID NO: 317636 - DNA, 15 bp, Homo sapiens
tttgtgctctttcct

SEQ ID NO: 317637 - DNA, 16 bp, Homo sapiens
tttgtgctctttcctg

SEQ ID NO: 317638 - DNA, 16 bp, Homo sapiens
tttgtgcttgttcttc

SEQ ID NO: 317639 - DNA, 12 bp, Homo sapiens
tttgtggacttt

SEQ ID NO: 317640 - DNA, 14 bp, Homo sapiens
tttgtggatgtctt

SEQ ID NO: 317641 - DNA, 18 bp, Homo sapiens
tttgtggcagtggccagg

SEQ ID NO: 317642 - DNA, 20 bp, Homo sapiens
tttgtggggcttggcgtgga

SEQ ID NO: 317643 - DNA, 21 bp, Homo sapiens
tttgtgtacagtatgtgtcta

SEQ ID NO: 317644 - DNA, 15 bp, Homo sapiens
tttgtgtattctgtg

SEQ ID NO: 317645 - DNA, 22 bp, Homo sapiens
tttgtgtattctgtggattcta

SEQ ID NO: 317646 - DNA, 23 bp, Homo sapiens
tttgtgtattctgtggattctat

SEQ ID NO: 317647 - DNA, 20 bp, Homo sapiens
tttgtgtctgcctgcctcat

SEQ ID NO: 317648 - DNA, 13 bp, Homo sapiens
tttgtgtgattga

SEQ ID NO: 317649 - DNA, 21 bp, Homo sapiens
tttgtgttcctctttgcatga

SEQ ID NO: 317650 - DNA, 12 bp, Homo sapiens
tttgtgttctgt

SEQ ID NO: 317651 - DNA, 21 bp, Homo sapiens
tttgtgttgttggaaaaagtc

SEQ ID NO: 317652 - DNA, 17 bp, Homo sapiens
tttgttaataaagtgca

SEQ ID NO: 317653 - DNA, 13 bp, Homo sapiens
tttgttaccttta

SEQ ID NO: 317654 - DNA, 16 bp, Homo sapiens
tttgttatacttcaaa

SEQ ID NO: 317655 - DNA, 17 bp, Homo sapiens
tttgttatagaatactt

SEQ ID NO: 317656 - DNA, 19 bp, Homo sapiens
tttgttatagaatactttt

SEQ ID NO: 317657 - DNA, 15 bp, Homo sapiens
tttgttattaatcca

SEQ ID NO: 317658 - DNA, 20 bp, Homo sapiens
tttgttattttcagtatttt

SEQ ID NO: 317659 - DNA, 19 bp, Homo sapiens
tttgttcatcctattgttg

SEQ ID NO: 317660 - DNA, 13 bp, Homo sapiens
tttgttctagact

SEQ ID NO: 317661 - DNA, 22 bp, Homo sapiens
tttgttgcacagtccctcctgt

SEQ ID NO: 317662 - DNA, 12 bp, Homo sapiens
tttgttgtaaaa

SEQ ID NO: 317663 - DNA, 14 bp, Homo sapiens
tttgttgtcatgtg

SEQ ID NO: 317664 - DNA, 12 bp, Homo sapiens
tttgttgtttat

SEQ ID NO: 317665 - DNA, 13 bp, Homo sapiens
tttgtttaaagaa

SEQ ID NO: 317666 - DNA, 16 bp, Homo sapiens
tttgtttctgaaaatt

SEQ ID NO: 317667 - DNA, 14 bp, Homo sapiens
tttgtttgttttgt

SEQ ID NO: 317668 - DNA, 20 bp, Homo sapiens
tttgttttaaggaagaaaaa

SEQ ID NO: 317669 - DNA, 19 bp, Homo sapiens
tttgttttcccacacatat

SEQ ID NO: 317670 - DNA, 11 bp, Homo sapiens
tttgttttctt

SEQ ID NO: 317671 - DNA, 13 bp, Homo sapiens
tttgtttttaatt

SEQ ID NO: 317672 - DNA, 16 bp, Homo sapiens
ttttaaaaaataacat

SEQ ID NO: 317673 - DNA, 21 bp, Homo sapiens
ttttaaaaaataacatattct

SEQ ID NO: 317674 - DNA, 17 bp, Homo sapiens
ttttaaaaaggcctttg

SEQ ID NO: 317675 - DNA, 19 bp, Homo sapiens
ttttaaaaagttgcacatt

SEQ ID NO: 317676 - DNA, 20 bp, Homo sapiens
ttttaaaaattggaaactga

SEQ ID NO: 317677 - DNA, 20 bp, Homo sapiens
ttttaaaaattgttaatttt

SEQ ID NO: 317678 - DNA, 12 bp, Homo sapiens
ttttaaaaccac

SEQ ID NO: 317679 - DNA, 16 bp, Homo sapiens
ttttaaaagactttga

SEQ ID NO: 317680 - DNA, 13 bp, Homo sapiens
ttttaaaagcata

SEQ ID NO: 317681 - DNA, 23 bp, Homo sapiens
ttttaaaagcatatataaaacaa

SEQ ID NO: 317682 - DNA, 21 bp, Homo sapiens
ttttaaaaggtattttgaata

SEQ ID NO: 317683 - DNA, 18 bp, Homo sapiens
ttttaaaagtttcaatgt

SEQ ID NO: 317684 - DNA, 22 bp, Homo sapiens
ttttaaaagtttcaatgtgatt

SEQ ID NO: 317685 - DNA, 11 bp, Homo sapiens
ttttaaaatca

SEQ ID NO: 317686 - DNA, 16 bp, Homo sapiens
ttttaaacaaaataga

SEQ ID NO: 317687 - DNA, 20 bp, Homo sapiens
ttttaaagaaaatgtgtctg

SEQ ID NO: 317688 - DNA, 16 bp, Homo sapiens
ttttaaagaagtctct

SEQ ID NO: 317689 - DNA, 17 bp, Homo sapiens
ttttaaataaaagtgat

SEQ ID NO: 317690 - DNA, 15 bp, Homo sapiens
ttttaaatcatttca

SEQ ID NO: 317691 - DNA, 17 bp, Homo sapiens
ttttaaatctgaaggtt

SEQ ID NO: 317692 - DNA, 12 bp, Homo sapiens
ttttaaatgggt

SEQ ID NO: 317693 - DNA, 19 bp, Homo sapiens
ttttaaattataaggactg

SEQ ID NO: 317694 - DNA, 21 bp, Homo sapiens
ttttaaattataaggactgca

SEQ ID NO: 317695 - DNA, 16 bp, Homo sapiens
ttttaacaaaagcaag

SEQ ID NO: 317696 - DNA, 19 bp, Homo sapiens
ttttaactgaaaatgtaaa

SEQ ID NO: 317697 - DNA, 19 bp, Homo sapiens
ttttaagaaaaacatgtca

SEQ ID NO: 317698 - DNA, 23 bp, Homo sapiens
ttttaagacttaatctttgctga

SEQ ID NO: 317699 - DNA, 12 bp, Homo sapiens
ttttaaggaaaa

SEQ ID NO: 317700 - DNA, 20 bp, Homo sapiens
ttttaagggtttgtggaaaa

SEQ ID NO: 317701 - DNA, 17 bp, Homo sapiens
ttttaagtgctttgtaa

SEQ ID NO: 317702 - DNA, 14 bp, Homo sapiens
ttttaagtgtttcg

SEQ ID NO: 317703 - DNA, 14 bp, Homo sapiens
ttttaagttgctga

SEQ ID NO: 317704 - DNA, 13 bp, Homo sapiens
ttttaataaaagt

SEQ ID NO: 317705 - DNA, 13 bp, Homo sapiens
ttttaatatacta

SEQ ID NO: 317706 - DNA, 15 bp, Homo sapiens
ttttaatattactgt

SEQ ID NO: 317707 - DNA, 17 bp, Homo sapiens
ttttaattattattctt

SEQ ID NO: 317708 - DNA, 23 bp, Homo sapiens
ttttaattattatttatatatgt

SEQ ID NO: 317709 - DNA, 19 bp, Homo sapiens
ttttaattccaatatgatg

SEQ ID NO: 317710 - DNA, 23 bp, Homo sapiens
ttttaatttatgagtttttgata

SEQ ID NO: 317711 - DNA, 12 bp, Homo sapiens
ttttacaaataa

SEQ ID NO: 317712 - DNA, 21 bp, Homo sapiens
ttttacaaataaagatggcta

SEQ ID NO: 317713 - DNA, 19 bp, Homo sapiens
ttttacagataaggaaact

SEQ ID NO: 317714 - DNA, 13 bp, Homo sapiens
tttttttctagct

SEQ ID NO: 317715 - DNA, 13 bp, Homo sapiens
tttttttgctggt

SEQ ID NO: 317716 - DNA, 10 bp, Homo sapiens
tttttttggc

SEQ ID NO: 317717 - DNA, 14 bp, Homo sapiens
tttttttgtatttc

SEQ ID NO: 317718 - DNA, 17 bp, Homo sapiens
ggcccttggggcctggc

SEQ ID NO: 317719 - DNA, 20 bp, Homo sapiens
ggcccttggggcctggcttg

SEQ ID NO: 317720 - DNA, 21 bp, Homo sapiens
ggcccttggggcctggcttgc

SEQ ID NO: 317721 - DNA, 17 bp, Homo sapiens
ggcccttgtcctgccag

SEQ ID NO: 317722 - DNA, 19 bp, Homo sapiens
ggcccttgtcctgccagct

SEQ ID NO: 317723 - DNA, 14 bp, Homo sapiens
ggcccttttctggc

SEQ ID NO: 317724 - DNA, 22 bp, Homo sapiens
ggcccttttctggctcctgtgt

SEQ ID NO: 317725 - DNA, 18 bp, Homo sapiens
ggccgaaccccccactcc

SEQ ID NO: 317726 - DNA, 19 bp, Homo sapiens
ggccgaaccccccactccc

SEQ ID NO: 317727 - DNA, 22 bp, Homo sapiens
ggccgaaccccccactccctgc

SEQ ID NO: 317728 - DNA, 12 bp, Homo sapiens
ggccgaggcagg

SEQ ID NO: 317729 - DNA, 22 bp, Homo sapiens
ggccgaggcaggggctgggcag

SEQ ID NO: 317730 - DNA, 17 bp, Homo sapiens
ggccgagggaaatgctg

SEQ ID NO: 317731 - DNA, 14 bp, Homo sapiens
ggccgaggggccag

SEQ ID NO: 317732 - DNA, 16 bp, Homo sapiens
ggccgagggtcctggc

SEQ ID NO: 317733 - DNA, 15 bp, Homo sapiens
ggccgatgagctggt

SEQ ID NO: 317734 - DNA, 20 bp, Homo sapiens
ggccgatgggagtctccctc

SEQ ID NO: 317735 - DNA, 21 bp, Homo sapiens
ggccgcacctaaagcagccag

SEQ ID NO: 317736 - DNA, 19 bp, Homo sapiens
ggccgcagggcgctccggc

SEQ ID NO: 317737 - DNA, 20 bp, Homo sapiens
ggccgcagggcgctccggca

SEQ ID NO: 317738 - DNA, 22 bp, Homo sapiens
ggccgcagggcgctccggcaga

SEQ ID NO: 317739 - DNA, 13 bp, Homo sapiens
ggccgcatggccc

SEQ ID NO: 317740 - DNA, 20 bp, Homo sapiens
ggccgcatggcccctccagg

SEQ ID NO: 317741 - DNA, 19 bp, Homo sapiens
ggccgcccagacaccacag

SEQ ID NO: 317742 - DNA, 19 bp, Homo sapiens
ggccgccccgccccagagc

SEQ ID NO: 317743 - DNA, 22 bp, Homo sapiens
ggccgccccgccccagagctcc

SEQ ID NO: 317744 - DNA, 13 bp, Homo sapiens
ggccgcctcctcc

SEQ ID NO: 317745 - DNA, 20 bp, Homo sapiens
ggccgcctcctccagactcg

SEQ ID NO: 317746 - DNA, 15 bp, Homo sapiens
ggccgcctggcaggt

SEQ ID NO: 317747 - DNA, 14 bp, Homo sapiens
ggccgcctgtcctt

SEQ ID NO: 317748 - DNA, 17 bp, Homo sapiens
ggccgctagaggcctga

SEQ ID NO: 317749 - DNA, 16 bp, Homo sapiens
ggccgctagatgggca

SEQ ID NO: 317750 - DNA, 19 bp, Homo sapiens
ggccgctagatgggcatgg

SEQ ID NO: 317751 - DNA, 18 bp, Homo sapiens
ggccgctcgatgcctttg

SEQ ID NO: 317752 - DNA, 18 bp, Homo sapiens
ggccggagaacatctgcc

SEQ ID NO: 317753 - DNA, 15 bp, Homo sapiens
ggccggccccaggct

SEQ ID NO: 317754 - DNA, 14 bp, Homo sapiens
ggccgggcacagct

SEQ ID NO: 317755 - DNA, 14 bp, Homo sapiens
ggccgggctgctgc

SEQ ID NO: 317756 - DNA, 15 bp, Homo sapiens
ggccgggctgctgct

SEQ ID NO: 317757 - DNA, 15 bp, Homo sapiens
ggccgggctggcttc

SEQ ID NO: 317758 - DNA, 21 bp, Homo sapiens
ggccgggctttccagaaggcc

SEQ ID NO: 317759 - DNA, 15 bp, Homo sapiens
ggccggggcccctca

SEQ ID NO: 317760 - DNA, 15 bp, Homo sapiens
ggccgggggtggggg

SEQ ID NO: 317761 - DNA, 20 bp, Homo sapiens
ggccgggttggaggcctcac

SEQ ID NO: 317762 - DNA, 15 bp, Homo sapiens
ggccggtgtggccct

SEQ ID NO: 317763 - DNA, 17 bp, Homo sapiens
ggccgtcacgctttcat

SEQ ID NO: 317764 - DNA, 12 bp, Homo sapiens
ggccgtccctga

SEQ ID NO: 317765 - DNA, 21 bp, Homo sapiens
ggccgtccctgacttcccagc

SEQ ID NO: 317766 - DNA, 14 bp, Homo sapiens
ggccgtcctcccgg

SEQ ID NO: 317767 - DNA, 22 bp, Homo sapiens
ggccgttccccttggcttcctc

SEQ ID NO: 317768 - DNA, 16 bp, Homo sapiens
ggcctagcccaccctg

SEQ ID NO: 317769 - DNA, 17 bp, Homo sapiens
ggcctagcccaccctgc

SEQ ID NO: 317770 - DNA, 15 bp, Homo sapiens
ggcctagtcagccac

SEQ ID NO: 317771 - DNA, 14 bp, Homo sapiens
ggcctagtggcttc

SEQ ID NO: 317772 - DNA, 18 bp, Homo sapiens
ggcctatgccacctgcag

SEQ ID NO: 317773 - DNA, 19 bp, Homo sapiens
ggcctatgccacctgcagc

SEQ ID NO: 317774 - DNA, 19 bp, Homo sapiens
ggcctattatattaaaata

SEQ ID NO: 317775 - DNA, 19 bp, Homo sapiens
ggcctcaaccctccctcag

SEQ ID NO: 317776 - DNA, 23 bp, Homo sapiens
ggcctcaaccctccctcagcccc

SEQ ID NO: 317777 - DNA, 16 bp, Homo sapiens
ggcctcacccagaagg

SEQ ID NO: 317778 - DNA, 17 bp, Homo sapiens
ggcctcacccagaagga

SEQ ID NO: 317779 - DNA, 16 bp, Homo sapiens
ggcctcacctggcttc

SEQ ID NO: 317780 - DNA, 13 bp, Homo sapiens
ggcctcactggct

SEQ ID NO: 317781 - DNA, 15 bp, Homo sapiens
ggcctcactggctgg

SEQ ID NO: 317782 - DNA, 19 bp, Homo sapiens
ggcctcactggctggggca

SEQ ID NO: 317783 - DNA, 13 bp, Homo sapiens
ggcctcagagaca

SEQ ID NO: 317784 - DNA, 15 bp, Homo sapiens
ggcctcagagacagc

SEQ ID NO: 317785 - DNA, 15 bp, Homo sapiens
ggcctcagccagctg

SEQ ID NO: 317786 - DNA, 13 bp, Homo sapiens
ggcctcagctgcc

SEQ ID NO: 317787 - DNA, 15 bp, Homo sapiens
ggcctcagctgcctc

SEQ ID NO: 317788 - DNA, 16 bp, Homo sapiens
ggcctcagctgcctca

SEQ ID NO: 317789 - DNA, 17 bp, Homo sapiens
ggcctcagctgcctcac

SEQ ID NO: 317790 - DNA, 12 bp, Homo sapiens
ggcctcaggaga

SEQ ID NO: 317791 - DNA, 13 bp, Homo sapiens
ggcctcatccctc

SEQ ID NO: 317792 - DNA, 14 bp, Homo sapiens
ggcctcatccctcg

SEQ ID NO: 317793 - DNA, 22 bp, Homo sapiens
ggcctccagccctctcactgtg

SEQ ID NO: 317794 - DNA, 21 bp, Homo sapiens
ggcctccagcctctcccggct

SEQ ID NO: 317795 - DNA, 23 bp, Homo sapiens
ggcctccagcctctcccggctgc

SEQ ID NO: 317796 - DNA, 15 bp, Homo sapiens
ggcctccaggctggg

SEQ ID NO: 317797 - DNA, 18 bp, Homo sapiens
ggcctcccaaagtgctgg

SEQ ID NO: 317798 - DNA, 13 bp, Homo sapiens
ggcctcccagcca

SEQ ID NO: 317799 - DNA, 17 bp, Homo sapiens
ggcctcccagccacccg

SEQ ID NO: 317800 - DNA, 17 bp, Homo sapiens
ggcctcccccagccagg

SEQ ID NO: 317801 - DNA, 22 bp, Homo sapiens
ggcctccccgggggtccccgga

SEQ ID NO: 317802 - DNA, 22 bp, Homo sapiens
ggcctcccgcatgctgcctgcc

SEQ ID NO: 317803 - DNA, 17 bp, Homo sapiens
ggcctcccttgggctgg

SEQ ID NO: 317804 - DNA, 21 bp, Homo sapiens
ggcctcctctaacaggggctg

SEQ ID NO: 317805 - DNA, 23 bp, Homo sapiens
ggcctcctctaacaggggctggt

SEQ ID NO: 317806 - DNA, 14 bp, Homo sapiens
ggcctcctcttcac

SEQ ID NO: 317807 - DNA, 22 bp, Homo sapiens
ggcctcctcttcaccccggcag

SEQ ID NO: 317808 - DNA, 17 bp, Homo sapiens
ggcctcctgggaaggag

SEQ ID NO: 317809 - DNA, 23 bp, Homo sapiens
ggcctctgccccgtctcatgagg

SEQ ID NO: 317810 - DNA, 15 bp, Homo sapiens
ggcctctggctgcct

SEQ ID NO: 317811 - DNA, 18 bp, Homo sapiens
ggcctctggtgttcctgg

SEQ ID NO: 317812 - DNA, 16 bp, Homo sapiens
ggcctcttgagcagtg

SEQ ID NO: 317813 - DNA, 23 bp, Homo sapiens
ggcctgaaagaggctgaggcctg

SEQ ID NO: 317814 - DNA, 24 bp, Homo sapiens
ggcctgaaatgtttccaggcatga

SEQ ID NO: 317815 - DNA, 14 bp, Homo sapiens
ggcctgagaagagt

SEQ ID NO: 317816 - DNA, 12 bp, Homo sapiens
ggcctgagctgg

SEQ ID NO: 317817 - DNA, 13 bp, Homo sapiens
ggcctgaggatga

SEQ ID NO: 317818 - DNA, 18 bp, Homo sapiens
ggcctgagggaagcccac

SEQ ID NO: 317819 - DNA, 20 bp, Homo sapiens
ggcctgagggaagcccaccc

SEQ ID NO: 317820 - DNA, 23 bp, Homo sapiens
ggcctgagggaagcccacccgcc

SEQ ID NO: 317821 - DNA, 15 bp, Homo sapiens
ggcctgatgctccct

SEQ ID NO: 317822 - DNA, 22 bp, Homo sapiens
ggcctgatgctccctcccctgc

SEQ ID NO: 317823 - DNA, 14 bp, Homo sapiens
ggcctgcagcccag

SEQ ID NO: 317824 - DNA, 19 bp, Homo sapiens
ggcctgcaggccccagcca

SEQ ID NO: 317825 - DNA, 20 bp, Homo sapiens
ggcctgcaggccccagccaa

SEQ ID NO: 317826 - DNA, 18 bp, Homo sapiens
ggcctgccaatgccacag

SEQ ID NO: 317827 - DNA, 19 bp, Homo sapiens
ggcctgccaatgccacagc

SEQ ID NO: 317828 - DNA, 21 bp, Homo sapiens
ggcctgcccaatgctttggga

SEQ ID NO: 317829 - DNA, 11 bp, Homo sapiens
ggcctgccctc

SEQ ID NO: 317830 - DNA, 13 bp, Homo sapiens
ggcctgccctccc

SEQ ID NO: 317831 - DNA, 19 bp, Homo sapiens
ggcctgcgcctgcacctgc

SEQ ID NO: 317832 - DNA, 21 bp, Homo sapiens
ggcctgctgggaaccccgcag

SEQ ID NO: 317833 - DNA, 12 bp, Homo sapiens
ggcctgctgtgg

SEQ ID NO: 317834 - DNA, 21 bp, Homo sapiens
ggcctgcttttccaggatcct

SEQ ID NO: 317835 - DNA, 16 bp, Homo sapiens
ggcctggacctgcctc

SEQ ID NO: 317836 - DNA, 21 bp, Homo sapiens
ggcctggacctgcctcctgcc

SEQ ID NO: 317837 - DNA, 18 bp, Homo sapiens
ggcctggactttcctgca

SEQ ID NO: 317838 - DNA, 19 bp, Homo sapiens
ggcctggaggtggggttgg

SEQ ID NO: 317839 - DNA, 21 bp, Homo sapiens
ggcctggcagggaggtcaggc

SEQ ID NO: 317840 - DNA, 14 bp, Homo sapiens
ggcctggccacctc

SEQ ID NO: 317841 - DNA, 17 bp, Homo sapiens
ggcctggccacctctct

SEQ ID NO: 317842 - DNA, 16 bp, Homo sapiens
ggcctggccaggagct

SEQ ID NO: 317843 - DNA, 18 bp, Homo sapiens
ggcctggccaggagctct

SEQ ID NO: 317844 - DNA, 23 bp, Homo sapiens
ggcctggccaggagctcttcagg

SEQ ID NO: 317845 - DNA, 13 bp, Homo sapiens
ggcctggcccagc

SEQ ID NO: 317846 - DNA, 14 bp, Homo sapiens
ggcctggcccagcc

SEQ ID NO: 317847 - DNA, 15 bp, Homo sapiens
ggcctggcccagcca

SEQ ID NO: 317848 - DNA, 19 bp, Homo sapiens
ggcctggcccagccagcag

SEQ ID NO: 317849 - DNA, 20 bp, Homo sapiens
ggcctggcccagccagcagg

SEQ ID NO: 317850 - DNA, 16 bp, Homo sapiens
ggcctggcctatttaa

SEQ ID NO: 317851 - DNA, 17 bp, Homo sapiens
ggcctggcctatttaag

SEQ ID NO: 317852 - DNA, 17 bp, Homo sapiens
ggcctggcctgagctgg

SEQ ID NO: 317853 - DNA, 13 bp, Homo sapiens
ggcctggcctggc

SEQ ID NO: 317854 - DNA, 18 bp, Homo sapiens
ggcctggcctggccctgc

SEQ ID NO: 317855 - DNA, 13 bp, Homo sapiens
ggcctggctccgc

SEQ ID NO: 317856 - DNA, 18 bp, Homo sapiens
ggcctggctccgctgtgt

SEQ ID NO: 317857 - DNA, 20 bp, Homo sapiens
ggcctggcttgctccagggt

SEQ ID NO: 317858 - DNA, 15 bp, Homo sapiens
ggcctgggacccagc

SEQ ID NO: 317859 - DNA, 20 bp, Homo sapiens
ggcctgggacccagctactc

SEQ ID NO: 317860 - DNA, 15 bp, Homo sapiens
ggcctgggagggtgg

SEQ ID NO: 317861 - DNA, 17 bp, Homo sapiens
ggcctgggctaggggac

SEQ ID NO: 317862 - DNA, 17 bp, Homo sapiens
ggcctggggccgggctg

SEQ ID NO: 317863 - DNA, 16 bp, Homo sapiens
ggcctggggctccttt

SEQ ID NO: 317864 - DNA, 18 bp, Homo sapiens
ggcctggggctcctttct

SEQ ID NO: 317865 - DNA, 23 bp, Homo sapiens
ggcctggggctcctttctccagc

SEQ ID NO: 317866 - DNA, 16 bp, Homo sapiens
ggcctgggtctccctg

SEQ ID NO: 317867 - DNA, 23 bp, Homo sapiens
ggcctgggtggatcggcctcctc

SEQ ID NO: 317868 - DNA, 14 bp, Homo sapiens
ggcctggtcagcag

SEQ ID NO: 317869 - DNA, 15 bp, Homo sapiens
ggcctgtcagagctt

SEQ ID NO: 317870 - DNA, 22 bp, Homo sapiens
ggcctgtccacctgtgctgctg

SEQ ID NO: 317871 - DNA, 13 bp, Homo sapiens
ggcctgtccccca

SEQ ID NO: 317872 - DNA, 17 bp, Homo sapiens
ggcctgtcccccaaggt

SEQ ID NO: 317873 - DNA, 14 bp, Homo sapiens
ggcctgtccctggc

SEQ ID NO: 317874 - DNA, 13 bp, Homo sapiens
ggcctgtctcaga

SEQ ID NO: 317875 - DNA, 18 bp, Homo sapiens
ggcctgtctcatccccag

SEQ ID NO: 317876 - DNA, 20 bp, Homo sapiens
ggcctgtctcatccccaggg

SEQ ID NO: 317877 - DNA, 14 bp, Homo sapiens
ggcctgtgcagcag

SEQ ID NO: 317878 - DNA, 15 bp, Homo sapiens
ggcctgtgcagcagc

SEQ ID NO: 317879 - DNA, 18 bp, Homo sapiens
ggcctgtgcagcagccca

SEQ ID NO: 317880 - DNA, 20 bp, Homo sapiens
ggcctgtgcagcagcccagc

SEQ ID NO: 317881 - DNA, 20 bp, Homo sapiens
ggcctgtgtccagcagctgc

SEQ ID NO: 317882 - DNA, 22 bp, Homo sapiens
ggcctgtgtccagcagctgcgg

SEQ ID NO: 317883 - DNA, 23 bp, Homo sapiens
ggcctgtgtgttgccaggcaggc

SEQ ID NO: 317884 - DNA, 16 bp, Homo sapiens
ggcctgttctgtagga

SEQ ID NO: 317885 - DNA, 15 bp, Homo sapiens
ggcctgttgcccttt

SEQ ID NO: 317886 - DNA, 21 bp, Homo sapiens
ggcctgtttctgcagcccttg

SEQ ID NO: 317887 - DNA, 19 bp, Homo sapiens
ggccttccccttttgcctg

SEQ ID NO: 317888 - DNA, 22 bp, Homo sapiens
ggccttccccttttgcctggct

SEQ ID NO: 317889 - DNA, 14 bp, Homo sapiens
ggccttctcagctc

SEQ ID NO: 317890 - DNA, 14 bp, Homo sapiens
ggccttgctgtcat

SEQ ID NO: 317891 - DNA, 14 bp, Homo sapiens
ggccttggccttgg

SEQ ID NO: 317892 - DNA, 20 bp, Homo sapiens
ggccttggccttggggccag

SEQ ID NO: 317893 - DNA, 16 bp, Homo sapiens
ggccttgtctcttcct

SEQ ID NO: 317894 - DNA, 20 bp, Homo sapiens
ggccttgtggataagggaga

SEQ ID NO: 317895 - DNA, 20 bp, Homo sapiens
ggccttgtgtgctggcttcc

SEQ ID NO: 317896 - DNA, 12 bp, Homo sapiens
ggcctttcctct

SEQ ID NO: 317897 - DNA, 14 bp, Homo sapiens
ggcctttcctctct

SEQ ID NO: 317898 - DNA, 19 bp, Homo sapiens
ggcctttgagcccacaaag

SEQ ID NO: 317899 - DNA, 23 bp, Homo sapiens
ggcctttgagcccacaaagcctt

SEQ ID NO: 317900 - DNA, 13 bp, Homo sapiens
ggcgaagatggtc

SEQ ID NO: 317901 - DNA, 21 bp, Homo sapiens
ggcgaagctgagcgggtctag

SEQ ID NO: 317902 - DNA, 14 bp, Homo sapiens
ggcgagccaggcaa

SEQ ID NO: 317903 - DNA, 15 bp, Homo sapiens
ggcgaggcagaggac

SEQ ID NO: 317904 - DNA, 15 bp, Homo sapiens
ggcgaggcgaagctg

SEQ ID NO: 317905 - DNA, 20 bp, Homo sapiens
ggcgaggcgggggagcctgg

SEQ ID NO: 317906 - DNA, 20 bp, Homo sapiens
ggcgaggctgcctctgggtg

SEQ ID NO: 317907 - DNA, 21 bp, Homo sapiens
ggcgaggggagggtggcaggt

SEQ ID NO: 317908 - DNA, 18 bp, Homo sapiens
ggcgatccacctgtctca

SEQ ID NO: 317909 - DNA, 23 bp, Homo sapiens
ggcgatgcactcgcactgcaaat

SEQ ID NO: 317910 - DNA, 14 bp, Homo sapiens
ggcgatgccacgct

SEQ ID NO: 317911 - DNA, 19 bp, Homo sapiens
ggcgcacccggcagccccc

SEQ ID NO: 317912 - DNA, 19 bp, Homo sapiens
ggcgcagccctagtgggag

SEQ ID NO: 317913 - DNA, 17 bp, Homo sapiens
ggcgcagtgcctctggt

SEQ ID NO: 317914 - DNA, 21 bp, Homo sapiens
ggcgcatgtgtgtatcaccct

SEQ ID NO: 317915 - DNA, 20 bp, Homo sapiens
ggcgcccattcgtctgtccc

SEQ ID NO: 317916 - DNA, 14 bp, Homo sapiens
ggcgcccccagtgt

SEQ ID NO: 317917 - DNA, 13 bp, Homo sapiens
ggcgcccctgcca

SEQ ID NO: 317918 - DNA, 22 bp, Homo sapiens
ggcgcccctgccacctccctga

SEQ ID NO: 317919 - DNA, 13 bp, Homo sapiens
ggcgcccctgggg

SEQ ID NO: 317920 - DNA, 16 bp, Homo sapiens
ggcgccctggaagccg

SEQ ID NO: 317921 - DNA, 17 bp, Homo sapiens
ggcgcctgcgctcctct

SEQ ID NO: 317922 - DNA, 20 bp, Homo sapiens
ggcgccttctacctgcagga

SEQ ID NO: 317923 - DNA, 20 bp, Homo sapiens
ggcgcgcaccgcccaacccc

SEQ ID NO: 317924 - DNA, 15 bp, Homo sapiens
ggcgcgggaggcacc

SEQ ID NO: 317925 - DNA, 18 bp, Homo sapiens
ggcgcgggaggcaccagc

SEQ ID NO: 317926 - DNA, 20 bp, Homo sapiens
ggcgctccggcagaggcagg

SEQ ID NO: 317927 - DNA, 12 bp, Homo sapiens
ggcgctgcaggt

SEQ ID NO: 317928 - DNA, 13 bp, Homo sapiens
ggcgctgctggga

SEQ ID NO: 317929 - DNA, 15 bp, Homo sapiens
ggcgctgctgggagc

SEQ ID NO: 317930 - DNA, 19 bp, Homo sapiens
ggcgctttctcctgtgccc

SEQ ID NO: 317931 - DNA, 14 bp, Homo sapiens
ggcggaggccatgg

SEQ ID NO: 317932 - DNA, 15 bp, Homo sapiens
ggcggaggggcttgg

SEQ ID NO: 317933 - DNA, 15 bp, Homo sapiens
ggcggcagccccact

SEQ ID NO: 317934 - DNA, 13 bp, Homo sapiens
ggcggccagggac

SEQ ID NO: 317935 - DNA, 18 bp, Homo sapiens
ggcggcccaagcccgact

SEQ ID NO: 317936 - DNA, 16 bp, Homo sapiens
ggcggcgcagagggaa

SEQ ID NO: 317937 - DNA, 22 bp, Homo sapiens
ggcggctaggccggccagctcc

SEQ ID NO: 317938 - DNA, 20 bp, Homo sapiens
ggcggctggaaagaggagaa

SEQ ID NO: 317939 - DNA, 13 bp, Homo sapiens
ggcgggcagcccc

SEQ ID NO: 317940 - DNA, 18 bp, Homo sapiens
ggcgggcagcccctgctg

SEQ ID NO: 317941 - DNA, 17 bp, Homo sapiens
ggcgggccaaggactgc

SEQ ID NO: 317942 - DNA, 13 bp, Homo sapiens
ggcgggccaggag

SEQ ID NO: 317943 - DNA, 13 bp, Homo sapiens
ggcggggccagga

SEQ ID NO: 317944 - DNA, 15 bp, Homo sapiens
ggcgggggagcctgg

SEQ ID NO: 317945 - DNA, 22 bp, Homo sapiens
ggcgggtatgaagtgtggggcg

SEQ ID NO: 317946 - DNA, 15 bp, Homo sapiens
ggcggtatccagagg

SEQ ID NO: 317947 - DNA, 17 bp, Homo sapiens
ggcggtatccagaggtg

SEQ ID NO: 317948 - DNA, 21 bp, Homo sapiens
ggcggtatccagaggtgaggg

SEQ ID NO: 317949 - DNA, 20 bp, Homo sapiens
ggcggtccccatccccacca

SEQ ID NO: 317950 - DNA, 18 bp, Homo sapiens
ggcggtgatcagcagaga

SEQ ID NO: 317951 - DNA, 17 bp, Homo sapiens
ggcgtaatgggcctgcc

SEQ ID NO: 317952 - DNA, 18 bp, Homo sapiens
ggcgtaatgggcctgccc

SEQ ID NO: 317953 - DNA, 14 bp, Homo sapiens
ggcgtagggccagg

SEQ ID NO: 317954 - DNA, 21 bp, Homo sapiens
ggcgtagggccagggctctgg

SEQ ID NO: 317955 - DNA, 15 bp, Homo sapiens
ggcgtctgtcttcaa

SEQ ID NO: 317956 - DNA, 15 bp, Homo sapiens
ggcgtggagcaggcg

SEQ ID NO: 317957 - DNA, 19 bp, Homo sapiens
ggcgtggagccagggagcg

SEQ ID NO: 317958 - DNA, 17 bp, Homo sapiens
ggcgtgggatccagaga

SEQ ID NO: 317959 - DNA, 18 bp, Homo sapiens
ggcgttagtgggcaggtg

SEQ ID NO: 317960 - DNA, 20 bp, Homo sapiens
ggcgttagtgggcaggtggc

SEQ ID NO: 317961 - DNA, 16 bp, Homo sapiens
ggcgttgtgggcaggc

SEQ ID NO: 317962 - DNA, 20 bp, Homo sapiens
ggctaaagaagacacacagc

SEQ ID NO: 317963 - DNA, 18 bp, Homo sapiens
ggctaaaggggagaaact

SEQ ID NO: 317964 - DNA, 20 bp, Homo sapiens
ggctaaaggggagaaactga

SEQ ID NO: 317965 - DNA, 19 bp, Homo sapiens
ggctaacatttaggagaag

SEQ ID NO: 317966 - DNA, 24 bp, Homo sapiens
ggctaaccagttctctttgtaagg

SEQ ID NO: 317967 - DNA, 13 bp, Homo sapiens
ggctaactggccc

SEQ ID NO: 317968 - DNA, 14 bp, Homo sapiens
ggctaagaggctgc

SEQ ID NO: 317969 - DNA, 15 bp, Homo sapiens
ggctaagatgagatt

SEQ ID NO: 317970 - DNA, 16 bp, Homo sapiens
ggctaaggcaccagcc

SEQ ID NO: 317971 - DNA, 16 bp, Homo sapiens
ggctaatcaataccct

SEQ ID NO: 317972 - DNA, 20 bp, Homo sapiens
gcctactgtctccttcccac

SEQ ID NO: 317973 - DNA, 21 bp, Homo sapiens
gcctagacttcccaacagcct

SEQ ID NO: 317974 - DNA, 17 bp, Homo sapiens
gcctagcactcacatgc

SEQ ID NO: 317975 - DNA, 16 bp, Homo sapiens
gcctagcccaccctgc

SEQ ID NO: 317976 - DNA, 18 bp, Homo sapiens
gcctaggagctggctggc

SEQ ID NO: 317977 - DNA, 12 bp, Homo sapiens
gcctagggagcc

SEQ ID NO: 317978 - DNA, 17 bp, Homo sapiens
gcctaggggtcagggac

SEQ ID NO: 317979 - DNA, 20 bp, Homo sapiens
gcctagggtcttgggggtca

SEQ ID NO: 317980 - DNA, 22 bp, Homo sapiens
gcctagggttgcttgggccact

SEQ ID NO: 317981 - DNA, 14 bp, Homo sapiens
gcctagtaggagct

SEQ ID NO: 317982 - DNA, 22 bp, Homo sapiens
gcctagtcagccacatgggaaa

SEQ ID NO: 317983 - DNA, 16 bp, Homo sapiens
gcctagtggggagggg

SEQ ID NO: 317984 - DNA, 20 bp, Homo sapiens
gcctagtggggaggggcctg

SEQ ID NO: 317985 - DNA, 21 bp, Homo sapiens
gcctagtggggaggggcctgg

SEQ ID NO: 317986 - DNA, 20 bp, Homo sapiens
gcctataatcccagcatgtt

SEQ ID NO: 317987 - DNA, 19 bp, Homo sapiens
gcctatccatcctgcgagc

SEQ ID NO: 317988 - DNA, 16 bp, Homo sapiens
gcctatgccacctgca

SEQ ID NO: 317989 - DNA, 18 bp, Homo sapiens
gcctatgccacctgcagc

SEQ ID NO: 317990 - DNA, 17 bp, Homo sapiens
gcctatttactggaaac

SEQ ID NO: 317991 - DNA, 19 bp, Homo sapiens
gcctcaaacagccacgagg

SEQ ID NO: 317992 - DNA, 19 bp, Homo sapiens
gcctcaaccctccctcagc

SEQ ID NO: 317993 - DNA, 19 bp, Homo sapiens
gcctcaagcaaggaagcag

SEQ ID NO: 317994 - DNA, 23 bp, Homo sapiens
gcctcaagcaaggaagcagagca

SEQ ID NO: 317995 - DNA, 18 bp, Homo sapiens
gcctcaagccatcttccc

SEQ ID NO: 317996 - DNA, 15 bp, Homo sapiens
gcctcacatctccct

SEQ ID NO: 317997 - DNA, 13 bp, Homo sapiens
gcctcacccagaa

SEQ ID NO: 317998 - DNA, 14 bp, Homo sapiens
gcctcacccagaag

SEQ ID NO: 317999 - DNA, 14 bp, Homo sapiens
gcctcacccctgca

SEQ ID NO: 318000 - DNA, 14 bp, Homo sapiens
gcctcaccctgctt

SEQ ID NO: 318001 - DNA, 15 bp, Homo sapiens
gcctcaccctgcttg

SEQ ID NO: 318002 - DNA, 22 bp, Homo sapiens
gcctcacctggcttcccaggac

SEQ ID NO: 318003 - DNA, 16 bp, Homo sapiens
gcctcactccaggaag

SEQ ID NO: 318004 - DNA, 13 bp, Homo sapiens
gcctcactggctg

SEQ ID NO: 318005 - DNA, 15 bp, Homo sapiens
gcctcactggctggg

SEQ ID NO: 318006 - DNA, 17 bp, Homo sapiens
gcctcagccagctgccc

SEQ ID NO: 318007 - DNA, 16 bp, Homo sapiens
gcctcagccattcact

SEQ ID NO: 318008 - DNA, 16 bp, Homo sapiens
gcctcagcctcctgag

SEQ ID NO: 318009 - DNA, 15 bp, Homo sapiens
ccttgctgccaagtc

SEQ ID NO: 318010 - DNA, 24 bp, Homo sapiens
ccttgctgccaagtcctgcctttg

SEQ ID NO: 318011 - DNA, 17 bp, Homo sapiens
ccttgctggaaaaccca

SEQ ID NO: 318012 - DNA, 20 bp, Homo sapiens
ccttgctgtagagacttccg

SEQ ID NO: 318013 - DNA, 11 bp, Homo sapiens
ccttgctgtca

SEQ ID NO: 318014 - DNA, 15 bp, Homo sapiens
ccttgctttgggctt

SEQ ID NO: 318015 - DNA, 23 bp, Homo sapiens
ccttggaaacctgccctgcctga

SEQ ID NO: 318016 - DNA, 20 bp, Homo sapiens
ccttggacggggacacggcc

SEQ ID NO: 318017 - DNA, 15 bp, Homo sapiens
ccttggagagcagct

SEQ ID NO: 318018 - DNA, 16 bp, Homo sapiens
ccttggagagctcagg

SEQ ID NO: 318019 - DNA, 20 bp, Homo sapiens
ccttggaggatcgtggccaa

SEQ ID NO: 318020 - DNA, 16 bp, Homo sapiens
ccttggcacccccatg

SEQ ID NO: 318021 - DNA, 19 bp, Homo sapiens
ccttggcacccccatgctg

SEQ ID NO: 318022 - DNA, 22 bp, Homo sapiens
ccttggcacccccatgctgcct

SEQ ID NO: 318023 - DNA, 17 bp, Homo sapiens
ccttggcactgatgggc

SEQ ID NO: 318024 - DNA, 14 bp, Homo sapiens
ccttggcccagcag

SEQ ID NO: 318025 - DNA, 23 bp, Homo sapiens
ccttggcccagcagcggcccaga

SEQ ID NO: 318026 - DNA, 14 bp, Homo sapiens
ccttggcccctctc

SEQ ID NO: 318027 - DNA, 15 bp, Homo sapiens
ccttggcccctctct

SEQ ID NO: 318028 - DNA, 23 bp, Homo sapiens
ccttggccgcacctaaagcagcc

SEQ ID NO: 318029 - DNA, 20 bp, Homo sapiens
ccttggcctagcccaccctg

SEQ ID NO: 318030 - DNA, 16 bp, Homo sapiens
ccttggcctagtcaga

SEQ ID NO: 318031 - DNA, 13 bp, Homo sapiens
ccttggcctcaga

SEQ ID NO: 318032 - DNA, 18 bp, Homo sapiens
ccttggcctgacctggca

SEQ ID NO: 318033 - DNA, 14 bp, Homo sapiens
ccttggcctgtcca

SEQ ID NO: 318034 - DNA, 21 bp, Homo sapiens
ccttggccttggggccagact

SEQ ID NO: 318035 - DNA, 19 bp, Homo sapiens
ccttggcgtgtgtccctgt

SEQ ID NO: 318036 - DNA, 22 bp, Homo sapiens
ccttggcgtgtgtccctgtggt

SEQ ID NO: 318037 - DNA, 18 bp, Homo sapiens
ccttgggcatccacccag

SEQ ID NO: 318038 - DNA, 24 bp, Homo sapiens
ccttgggcatccacccagtgctgc

SEQ ID NO: 318039 - DNA, 16 bp, Homo sapiens
ccttgggcctttcagt

SEQ ID NO: 318040 - DNA, 13 bp, Homo sapiens
ccttgggctcctg

SEQ ID NO: 318041 - DNA, 20 bp, Homo sapiens
ccttgggctcctggctgcca

SEQ ID NO: 318042 - DNA, 14 bp, Homo sapiens
ccttgggctgctcc

SEQ ID NO: 318043 - DNA, 14 bp, Homo sapiens
ccttggggccagac

SEQ ID NO: 318044 - DNA, 21 bp, Homo sapiens
ccttggggccagactggctgc

SEQ ID NO: 318045 - DNA, 23 bp, Homo sapiens
ccttggggccagactggctgcac

SEQ ID NO: 318046 - DNA, 13 bp, Homo sapiens
ccttggggcctgg

SEQ ID NO: 318047 - DNA, 17 bp, Homo sapiens
ccttggggcctggcttg

SEQ ID NO: 318048 - DNA, 23 bp, Homo sapiens
ccttgggggttcagggaactgct

SEQ ID NO: 318049 - DNA, 23 bp, Homo sapiens
ccttggtctaacttttgtgtgaa

SEQ ID NO: 318050 - DNA, 15 bp, Homo sapiens
ccttggttcctccag

SEQ ID NO: 318051 - DNA, 16 bp, Homo sapiens
ccttgtacagtgtctg

SEQ ID NO: 318052 - DNA, 22 bp, Homo sapiens
ccttgtacagtgtctgtgccat

SEQ ID NO: 318053 - DNA, 13 bp, Homo sapiens
ccttgtcctgcca

SEQ ID NO: 318054 - DNA, 14 bp, Homo sapiens
ccttgtcctgccag

SEQ ID NO: 318055 - DNA, 17 bp, Homo sapiens
ccttgtcctgccagctg

SEQ ID NO: 318056 - DNA, 19 bp, Homo sapiens
ccttgtcctgccagctgcc

SEQ ID NO: 318057 - DNA, 18 bp, Homo sapiens
ccttgtctctactaaaaa

SEQ ID NO: 318058 - DNA, 12 bp, Homo sapiens
ccttgtctgctg

SEQ ID NO: 318059 - DNA, 14 bp, Homo sapiens
ccttgtctgctgct

SEQ ID NO: 318060 - DNA, 19 bp, Homo sapiens
ccttgtctttactgacaag

SEQ ID NO: 318061 - DNA, 15 bp, Homo sapiens
ggacggggcagagct

SEQ ID NO: 318062 - DNA, 16 bp, Homo sapiens
ggacggggcagagctg

SEQ ID NO: 318063 - DNA, 22 bp, Homo sapiens
ggacgtcctgccacctggggca

SEQ ID NO: 318064 - DNA, 14 bp, Homo sapiens
ggacgttaggcccg

SEQ ID NO: 318065 - DNA, 19 bp, Homo sapiens
ggactaacataaaatctgt

SEQ ID NO: 318066 - DNA, 21 bp, Homo sapiens
ggactaacataaaatctgtga

SEQ ID NO: 318067 - DNA, 18 bp, Homo sapiens
ggactagaaaaacttggg

SEQ ID NO: 318068 - DNA, 20 bp, Homo sapiens
ggactaggacctgagcctgg

SEQ ID NO: 318069 - DNA, 13 bp, Homo sapiens
ggactcagccctg

SEQ ID NO: 318070 - DNA, 13 bp, Homo sapiens
ggactcccagtga

SEQ ID NO: 318071 - DNA, 14 bp, Homo sapiens
ggactcctctgtcc

SEQ ID NO: 318072 - DNA, 13 bp, Homo sapiens
ggactctcaggga

SEQ ID NO: 318073 - DNA, 18 bp, Homo sapiens
ggactctcctcctcccct

SEQ ID NO: 318074 - DNA, 14 bp, Homo sapiens
ggactctgccccaa

SEQ ID NO: 318075 - DNA, 21 bp, Homo sapiens
ggactctgccccttctgtttc

SEQ ID NO: 318076 - DNA, 11 bp, Homo sapiens
ggactctgcct

SEQ ID NO: 318077 - DNA, 16 bp, Homo sapiens
ggactctgccttccag

SEQ ID NO: 318078 - DNA, 15 bp, Homo sapiens
ggactctgcttggct

SEQ ID NO: 318079 - DNA, 21 bp, Homo sapiens
ggactctgcttggctgtcccc

SEQ ID NO: 318080 - DNA, 18 bp, Homo sapiens
ggactcttgctctttcta

SEQ ID NO: 318081 - DNA, 13 bp, Homo sapiens
ggactctttgctg

SEQ ID NO: 318082 - DNA, 19 bp, Homo sapiens
ggactgaagcctgcaggag

SEQ ID NO: 318083 - DNA, 20 bp, Homo sapiens
ggactgacctgcccctgccg

SEQ ID NO: 318084 - DNA, 18 bp, Homo sapiens
ggactgagccagtcccag

SEQ ID NO: 318085 - DNA, 11 bp, Homo sapiens
ggactgcacaa

SEQ ID NO: 318086 - DNA, 14 bp, Homo sapiens
ggactgcacaaaag

SEQ ID NO: 318087 - DNA, 15 bp, Homo sapiens
ggactgcatgcaagc

SEQ ID NO: 318088 - DNA, 20 bp, Homo sapiens
ggactgcatgcaagctcagg

SEQ ID NO: 318089 - DNA, 21 bp, Homo sapiens
ggactgccagtccccctgccc

SEQ ID NO: 318090 - DNA, 18 bp, Homo sapiens
ggactgccccgtgcagac

SEQ ID NO: 318091 - DNA, 12 bp, Homo sapiens
ggactgcctctg

SEQ ID NO: 318092 - DNA, 22 bp, Homo sapiens
ggactgcctctgccacactctg

SEQ ID NO: 318093 - DNA, 19 bp, Homo sapiens
ggactggaggtgggcatgc

SEQ ID NO: 318094 - DNA, 21 bp, Homo sapiens
ggactggctttgtcccacagc

SEQ ID NO: 318095 - DNA, 15 bp, Homo sapiens
ggactggtccaggca

SEQ ID NO: 318096 - DNA, 13 bp, Homo sapiens
ggactgtacctgt

SEQ ID NO: 318097 - DNA, 23 bp, Homo sapiens
ggactgtacctgtaggaaacaga

SEQ ID NO: 318098 - DNA, 14 bp, Homo sapiens
ggactgtatttctg

SEQ ID NO: 318099 - DNA, 11 bp, Homo sapiens
ggactgtccta

SEQ ID NO: 318100 - DNA, 18 bp, Homo sapiens
ggactgtcctaggtgacc

SEQ ID NO: 318101 - DNA, 20 bp, Homo sapiens
ggactgtctttcagatacat

SEQ ID NO: 318102 - DNA, 11 bp, Homo sapiens
ggactgtggcc

SEQ ID NO: 318103 - DNA, 12 bp, Homo sapiens
ggactgtggcct

SEQ ID NO: 318104 - DNA, 23 bp, Homo sapiens
ggactgttgacatccaagcttcc

SEQ ID NO: 318105 - DNA, 23 bp, Homo sapiens
ggactgttttttcctgagcttgg

SEQ ID NO: 318106 - DNA, 19 bp, Homo sapiens
ggacttaacggctccagga

SEQ ID NO: 318107 - DNA, 22 bp, Homo sapiens
ggacttaagacaaatgggactg

SEQ ID NO: 318108 - DNA, 24 bp, Homo sapiens
ggacttatttttggacttagtgca

SEQ ID NO: 318109 - DNA, 15 bp, Homo sapiens
ggacttcctggggcc

SEQ ID NO: 318110 - DNA, 15 bp, Homo sapiens
ggacttgaaatcaaa

SEQ ID NO: 318111 - DNA, 15 bp, Homo sapiens
ggacttgtaggaatc

SEQ ID NO: 318112 - DNA, 22 bp, Homo sapiens
ggacttgtaggaatctgccttc

SEQ ID NO: 318113 - DNA, 21 bp, Homo sapiens
ggacttgtgcctcttgggaga

SEQ ID NO: 318114 - DNA, 23 bp, Homo sapiens
ggacttgtgcctcttgggagacg

SEQ ID NO: 318115 - DNA, 11 bp, Homo sapiens
ggactttattt

SEQ ID NO: 318116 - DNA, 16 bp, Homo sapiens
ggactttatttaattt

SEQ ID NO: 318117 - DNA, 22 bp, Homo sapiens
ggactttatttaatttcataaa

SEQ ID NO: 318118 - DNA, 22 bp, Homo sapiens
ggactttcaaaattaaatctgt

SEQ ID NO: 318119 - DNA, 23 bp, Homo sapiens
ggactttcttttcgccgtggctg

SEQ ID NO: 318120 - DNA, 22 bp, Homo sapiens
ggactttgcagccggcacaggg

SEQ ID NO: 318121 - DNA, 18 bp, Homo sapiens
ggacttttcgttaacatt

SEQ ID NO: 318122 - DNA, 19 bp, Homo sapiens
ggacttttgcagcttcctt

SEQ ID NO: 318123 - DNA, 20 bp, Homo sapiens
ggacttttgcagcttccttc

SEQ ID NO: 318124 - DNA, 18 bp, Homo sapiens
ggacttttgttcatggga

SEQ ID NO: 318125 - DNA, 18 bp, Homo sapiens
ggagaaaaagaaacacaa

SEQ ID NO: 318126 - DNA, 18 bp, Homo sapiens
ggagaaaacagccactga

SEQ ID NO: 318127 - DNA, 13 bp, Homo sapiens
ggagaaaagccag

SEQ ID NO: 318128 - DNA, 16 bp, Homo sapiens
ggagaaaatgaagaaa

SEQ ID NO: 318129 - DNA, 21 bp, Homo sapiens
ggagaaaggtgaaacacacac

SEQ ID NO: 318130 - DNA, 14 bp, Homo sapiens
ggagaacatctgcc

SEQ ID NO: 318131 - DNA, 21 bp, Homo sapiens
ggagaacatctgccttgctgc

SEQ ID NO: 318132 - DNA, 13 bp, Homo sapiens
ggagaactgtgct

SEQ ID NO: 318133 - DNA, 14 bp, Homo sapiens
ggagaactgtgctc

SEQ ID NO: 318134 - DNA, 16 bp, Homo sapiens
ggagaactgtgctctc

SEQ ID NO: 318135 - DNA, 13 bp, Homo sapiens
ggagaagagccct

SEQ ID NO: 318136 - DNA, 14 bp, Homo sapiens
ggagaagagccctg

SEQ ID NO: 318137 - DNA, 13 bp, Homo sapiens
ggagaagcatgaa

SEQ ID NO: 318138 - DNA, 14 bp, Homo sapiens
ggagaaggaaaagg

SEQ ID NO: 318139 - DNA, 21 bp, Homo sapiens
cctttgcctgtagagccagcc

SEQ ID NO: 318140 - DNA, 14 bp, Homo sapiens
cctttgctccaccc

SEQ ID NO: 318141 - DNA, 18 bp, Homo sapiens
cctttgggatcagcctcc

SEQ ID NO: 318142 - DNA, 23 bp, Homo sapiens
cctttgggcctctgcttctctca

SEQ ID NO: 318143 - DNA, 22 bp, Homo sapiens
cctttggtcctaagtccctgcc

SEQ ID NO: 318144 - DNA, 14 bp, Homo sapiens
cctttgtaagttat

SEQ ID NO: 318145 - DNA, 16 bp, Homo sapiens
cctttgtcaacttcag

SEQ ID NO: 318146 - DNA, 17 bp, Homo sapiens
cctttgtcaacttcagt

SEQ ID NO: 318147 - DNA, 19 bp, Homo sapiens
cctttgtcatcattgtata

SEQ ID NO: 318148 - DNA, 21 bp, Homo sapiens
cctttgtcttttttttcatcc

SEQ ID NO: 318149 - DNA, 17 bp, Homo sapiens
cctttgtggactttatt

SEQ ID NO: 318150 - DNA, 15 bp, Homo sapiens
cctttgttgctgtct

SEQ ID NO: 318151 - DNA, 17 bp, Homo sapiens
ccttttaaatggcatga

SEQ ID NO: 318152 - DNA, 19 bp, Homo sapiens
ccttttataccagagacct

SEQ ID NO: 318153 - DNA, 20 bp, Homo sapiens
ccttttctggtgttacacat

SEQ ID NO: 318154 - DNA, 15 bp, Homo sapiens
ccttttgacacagtt

SEQ ID NO: 318155 - DNA, 16 bp, Homo sapiens
ccttttgacacagttg

SEQ ID NO: 318156 - DNA, 18 bp, Homo sapiens
ccttttgataaaatgttc

SEQ ID NO: 318157 - DNA, 12 bp, Homo sapiens
ccttttgccaat

SEQ ID NO: 318158 - DNA, 15 bp, Homo sapiens
ccttttgcctggctg

SEQ ID NO: 318159 - DNA, 16 bp, Homo sapiens
ccttttgcctggctgt

SEQ ID NO: 318160 - DNA, 12 bp, Homo sapiens
ccttttggcccc

SEQ ID NO: 318161 - DNA, 15 bp, Homo sapiens
ccttttggcctttgt

SEQ ID NO: 318162 - DNA, 17 bp, Homo sapiens
ccttttgtatcctccat

SEQ ID NO: 318163 - DNA, 12 bp, Homo sapiens
ccttttgtatct

SEQ ID NO: 318164 - DNA, 15 bp, Homo sapiens
ccttttgtccccagg

SEQ ID NO: 318165 - DNA, 17 bp, Homo sapiens
ccttttgtccccagggc

SEQ ID NO: 318166 - DNA, 20 bp, Homo sapiens
ccttttgtgggtttctctgt

SEQ ID NO: 318167 - DNA, 21 bp, Homo sapiens
ccttttgtgtgatgcgccttg

SEQ ID NO: 318168 - DNA, 15 bp, Homo sapiens
cctttttactcccct

SEQ ID NO: 318169 - DNA, 23 bp, Homo sapiens
cctttttactccccttgagctga

SEQ ID NO: 318170 - DNA, 17 bp, Homo sapiens
cctttttatattttata

SEQ ID NO: 318171 - DNA, 15 bp, Homo sapiens
cctttttcacgttta

SEQ ID NO: 318172 - DNA, 22 bp, Homo sapiens
cctttttcatatgttgctcagt

SEQ ID NO: 318173 - DNA, 23 bp, Homo sapiens
cctttttgagtaattttctgatg

SEQ ID NO: 318174 - DNA, 14 bp, Homo sapiens
cctttttgtaaata

SEQ ID NO: 318175 - DNA, 18 bp, Homo sapiens
ccttttttatcatttcta

SEQ ID NO: 318176 - DNA, 12 bp, Homo sapiens
ccttttttctct

SEQ ID NO: 318177 - DNA, 20 bp, Homo sapiens
ccttttttctcttctgtcca

SEQ ID NO: 318178 - DNA, 16 bp, Homo sapiens
cctttttttctctcct

SEQ ID NO: 318179 - DNA, 15 bp, Homo sapiens
cctttttttttgaaa

SEQ ID NO: 318180 - DNA, 18 bp, Homo sapiens
cgaaaacagatgagaaga

SEQ ID NO: 318181 - DNA, 21 bp, Homo sapiens
cgaaaacagatgagaagacta

SEQ ID NO: 318182 - DNA, 21 bp, Homo sapiens
cgaaagaacagtccattgaaa

SEQ ID NO: 318183 - DNA, 16 bp, Homo sapiens
cgaacatcttcatata

SEQ ID NO: 318184 - DNA, 20 bp, Homo sapiens
cgaacccacactgcaacagg

SEQ ID NO: 318185 - DNA, 16 bp, Homo sapiens
cgaaccccccactccc

SEQ ID NO: 318186 - DNA, 19 bp, Homo sapiens
cgaaccccccactccctgc

SEQ ID NO: 318187 - DNA, 13 bp, Homo sapiens
cgaactggcgcct

SEQ ID NO: 318188 - DNA, 15 bp, Homo sapiens
cgaagaaagactcct

SEQ ID NO: 318189 - DNA, 16 bp, Homo sapiens
cgaagaccttctgaag

SEQ ID NO: 318190 - DNA, 21 bp, Homo sapiens
cgaagagggaatggatgggga

SEQ ID NO: 318191 - DNA, 13 bp, Homo sapiens
cgaagctcagccc

SEQ ID NO: 318192 - DNA, 16 bp, Homo sapiens
cgaagtcttccatcag

SEQ ID NO: 318193 - DNA, 17 bp, Homo sapiens
cgaagtctttgccttct

SEQ ID NO: 318194 - DNA, 19 bp, Homo sapiens
cgaagtctttgccttctct

SEQ ID NO: 318195 - DNA, 22 bp, Homo sapiens
cgaatataagcttaaaataagt

SEQ ID NO: 318196 - DNA, 18 bp, Homo sapiens
cgaatcagctatttactg

SEQ ID NO: 318197 - DNA, 14 bp, Homo sapiens
cgaatctacagaac

SEQ ID NO: 318198 - DNA, 13 bp, Homo sapiens
cgaatgtgcaggt

SEQ ID NO: 318199 - DNA, 16 bp, Homo sapiens
cgaattaatagctttt

SEQ ID NO: 318200 - DNA, 12 bp, Homo sapiens
ggagaggggggc

SEQ ID NO: 318201 - DNA, 17 bp, Homo sapiens
ggagaggggtgcaccca

SEQ ID NO: 318202 - DNA, 19 bp, Homo sapiens
ggagaggggtgcacccact

SEQ ID NO: 318203 - DNA, 19 bp, Homo sapiens
ggagagtacccccctgaga

SEQ ID NO: 318204 - DNA, 21 bp, Homo sapiens
ggagagtcccctgaaggtctg

SEQ ID NO: 318205 - DNA, 21 bp, Homo sapiens
ggagagtggttgttgccaact

SEQ ID NO: 318206 - DNA, 23 bp, Homo sapiens
ggagatccgccctgggctctggg

SEQ ID NO: 318207 - DNA, 13 bp, Homo sapiens
ggagatgatgtga

SEQ ID NO: 318208 - DNA, 16 bp, Homo sapiens
ggagatggagaaaatg

SEQ ID NO: 318209 - DNA, 19 bp, Homo sapiens
ggagatggaggaaagtgat

SEQ ID NO: 318210 - DNA, 18 bp, Homo sapiens
ggagatgggccttttgga

SEQ ID NO: 318211 - DNA, 15 bp, Homo sapiens
ggagatggtcagtgt

SEQ ID NO: 318212 - DNA, 16 bp, Homo sapiens
ggagatgtagcaaaac

SEQ ID NO: 318213 - DNA, 13 bp, Homo sapiens
ggagatgtcttcg

SEQ ID NO: 318214 - DNA, 22 bp, Homo sapiens
ggagattaaaaccagagagaaa

SEQ ID NO: 318215 - DNA, 15 bp, Homo sapiens
ggagattgctctggg

SEQ ID NO: 318216 - DNA, 16 bp, Homo sapiens
ggagattttccttcct

SEQ ID NO: 318217 - DNA, 18 bp, Homo sapiens
ggagcaaaaggcagctca

SEQ ID NO: 318218 - DNA, 13 bp, Homo sapiens
ggagcaagccttc

SEQ ID NO: 318219 - DNA, 16 bp, Homo sapiens
ggagcaatgggactgg

SEQ ID NO: 318220 - DNA, 14 bp, Homo sapiens
ggagcacagccctg

SEQ ID NO: 318221 - DNA, 14 bp, Homo sapiens
ggagcacaggcagc

SEQ ID NO: 318222 - DNA, 15 bp, Homo sapiens
ggagcacaggcagct

SEQ ID NO: 318223 - DNA, 20 bp, Homo sapiens
ggagcacccccagcctcccc

SEQ ID NO: 318224 - DNA, 21 bp, Homo sapiens
ggagcacccccagcctccccc

SEQ ID NO: 318225 - DNA, 14 bp, Homo sapiens
ggagcacgtggaga

SEQ ID NO: 318226 - DNA, 13 bp, Homo sapiens
ggagcactggagt

SEQ ID NO: 318227 - DNA, 20 bp, Homo sapiens
ggagcacttgcgtcctgcag

SEQ ID NO: 318228 - DNA, 16 bp, Homo sapiens
ggagcagagaaggcca

SEQ ID NO: 318229 - DNA, 19 bp, Homo sapiens
ggagcagagacggcagccc

SEQ ID NO: 318230 - DNA, 12 bp, Homo sapiens
ggagcagctggg

SEQ ID NO: 318231 - DNA, 21 bp, Homo sapiens
ggagcagctgggcactgggcc

SEQ ID NO: 318232 - DNA, 18 bp, Homo sapiens
ggagcaggaagcaaggcc

SEQ ID NO: 318233 - DNA, 13 bp, Homo sapiens
ggagcatcccagg

SEQ ID NO: 318234 - DNA, 15 bp, Homo sapiens
ggagcattctgcctg

SEQ ID NO: 318235 - DNA, 21 bp, Homo sapiens
ggagccaatactgagtgcctg

SEQ ID NO: 318236 - DNA, 16 bp, Homo sapiens
ggagccaatggagact

SEQ ID NO: 318237 - DNA, 19 bp, Homo sapiens
ggagccaatggtgagggct

SEQ ID NO: 318238 - DNA, 20 bp, Homo sapiens
ggagccaatggtgagggctg

SEQ ID NO: 318239 - DNA, 15 bp, Homo sapiens
ggagccacaggcaga

SEQ ID NO: 318240 - DNA, 13 bp, Homo sapiens
ggagccacctggg

SEQ ID NO: 318241 - DNA, 15 bp, Homo sapiens
ggagccacctgggct

SEQ ID NO: 318242 - DNA, 12 bp, Homo sapiens
ggagccagggta

SEQ ID NO: 318243 - DNA, 13 bp, Homo sapiens
ggagcccagcaca

SEQ ID NO: 318244 - DNA, 14 bp, Homo sapiens
ggagccccagccag

SEQ ID NO: 318245 - DNA, 18 bp, Homo sapiens
ggagccccagccagccct

SEQ ID NO: 318246 - DNA, 20 bp, Homo sapiens
ggagccccagccagcccttc

SEQ ID NO: 318247 - DNA, 14 bp, Homo sapiens
ggagcccccagata

SEQ ID NO: 318248 - DNA, 15 bp, Homo sapiens
ggagcccccagatag

SEQ ID NO: 318249 - DNA, 23 bp, Homo sapiens
ggagcccccagatagagctgggt

SEQ ID NO: 318250 - DNA, 19 bp, Homo sapiens
ggagcccgatattctccct

SEQ ID NO: 318251 - DNA, 22 bp, Homo sapiens
ggagccctgaccttggctgact

SEQ ID NO: 318252 - DNA, 14 bp, Homo sapiens
ggagcctcagactc

SEQ ID NO: 318253 - DNA, 22 bp, Homo sapiens
ggagcctcgcccctccagtgtt

SEQ ID NO: 318254 - DNA, 18 bp, Homo sapiens
ggagcctgaggcaggaga

SEQ ID NO: 318255 - DNA, 21 bp, Homo sapiens
ggagcctgagtcagggcccag

SEQ ID NO: 318256 - DNA, 22 bp, Homo sapiens
ggagcctgagtcagggcccaga

SEQ ID NO: 318257 - DNA, 13 bp, Homo sapiens
ggagcctgcaggg

SEQ ID NO: 318258 - DNA, 15 bp, Homo sapiens
ggagcctgcggctgc

SEQ ID NO: 318259 - DNA, 16 bp, Homo sapiens
ggagcctgcggctgct

SEQ ID NO: 318260 - DNA, 21 bp, Homo sapiens
ggagcctgcgtggcctggggc

SEQ ID NO: 318261 - DNA, 17 bp, Homo sapiens
ggagcgcggcagccctg

SEQ ID NO: 318262 - DNA, 16 bp, Homo sapiens
ggagcgggacctgtgg

SEQ ID NO: 318263 - DNA, 13 bp, Homo sapiens
ggagcgggcaggg

SEQ ID NO: 318264 - DNA, 14 bp, Homo sapiens
ggagcgggcagggc

SEQ ID NO: 318265 - DNA, 22 bp, Homo sapiens
ggagcgggggctaactggcccc

SEQ ID NO: 318266 - DNA, 19 bp, Homo sapiens
ggagctaacactggcccct

SEQ ID NO: 318267 - DNA, 15 bp, Homo sapiens
ggagctagcccagtc

SEQ ID NO: 318268 - DNA, 18 bp, Homo sapiens
ggagctcaggtggggagt

SEQ ID NO: 318269 - DNA, 19 bp, Homo sapiens
ggagctcaggtggggagtc

SEQ ID NO: 318270 - DNA, 12 bp, Homo sapiens
ggagctcctggg

SEQ ID NO: 318271 - DNA, 23 bp, Homo sapiens
ggagctcttcttgtgaaatgtct

SEQ ID NO: 318272 - DNA, 16 bp, Homo sapiens
ggagctgaaagggagc

SEQ ID NO: 318273 - DNA, 20 bp, Homo sapiens
ggagctgaaagggagcccct

SEQ ID NO: 318274 - DNA, 18 bp, Homo sapiens
ggagctgagtcacctcct

SEQ ID NO: 318275 - DNA, 20 bp, Homo sapiens
ggagctgatttccaggcccc

SEQ ID NO: 318276 - DNA, 22 bp, Homo sapiens
ggagctgatttccaggcccctg

SEQ ID NO: 318277 - DNA, 20 bp, Homo sapiens
ggagctgcatggacgcctgg

SEQ ID NO: 318278 - DNA, 22 bp, Homo sapiens
ggagctgcatggacgcctggct

SEQ ID NO: 318279 - DNA, 23 bp, Homo sapiens
ggagctgcatggacgcctggctc

SEQ ID NO: 318280 - DNA, 15 bp, Homo sapiens
ggagctgctggcttg

SEQ ID NO: 318281 - DNA, 15 bp, Homo sapiens
ggagctggctggcag

SEQ ID NO: 318282 - DNA, 12 bp, Homo sapiens
ggagctggtggg

SEQ ID NO: 318283 - DNA, 13 bp, Homo sapiens
ggagcttccagat

SEQ ID NO: 318284 - DNA, 18 bp, Homo sapiens
ggaggaactggtccaggc

SEQ ID NO: 318285 - DNA, 18 bp, Homo sapiens
ggaggaagcccagtagcc

SEQ ID NO: 318286 - DNA, 14 bp, Homo sapiens
ggaggaagcttggg

SEQ ID NO: 318287 - DNA, 15 bp, Homo sapiens
ggaggaagggactgg

SEQ ID NO: 318288 - DNA, 16 bp, Homo sapiens
ggaggaagggactggt

SEQ ID NO: 318289 - DNA, 22 bp, Homo sapiens
ggaggaatcgaggaaccagagc

SEQ ID NO: 318290 - DNA, 15 bp, Homo sapiens
ggaggaatgctcccc

SEQ ID NO: 318291 - DNA, 17 bp, Homo sapiens
ggaggaattgggacctg

SEQ ID NO: 318292 - DNA, 15 bp, Homo sapiens
ggaggaatttctgag

SEQ ID NO: 318293 - DNA, 11 bp, Homo sapiens
ggaggacagaa

SEQ ID NO: 318294 - DNA, 13 bp, Homo sapiens
ggaggacagggag

SEQ ID NO: 318295 - DNA, 15 bp, Homo sapiens
ggaggacctctgggc

SEQ ID NO: 318296 - DNA, 18 bp, Homo sapiens
ggaggacctggggggggc

SEQ ID NO: 318297 - DNA, 21 bp, Homo sapiens
ggaggactgccccgtgcagac

SEQ ID NO: 318298 - DNA, 23 bp, Homo sapiens
ggaggagacagtcaggaagcctc

SEQ ID NO: 318299 - DNA, 16 bp, Homo sapiens
ggaggagagagatgct

SEQ ID NO: 318300 - DNA, 19 bp, Homo sapiens
ggaggagcacccccagcct

SEQ ID NO: 318301 - DNA, 20 bp, Homo sapiens
ggaggagcacccccagcctc

SEQ ID NO: 318302 - DNA, 14 bp, Homo sapiens
ggaggaggatccgg

SEQ ID NO: 318303 - DNA, 23 bp, Homo sapiens
ggaggcaagagactgggagccac

SEQ ID NO: 318304 - DNA, 16 bp, Homo sapiens
ggaggcacacagctgc

SEQ ID NO: 318305 - DNA, 21 bp, Homo sapiens
ggaggcaccagctctgtggcc

SEQ ID NO: 318306 - DNA, 16 bp, Homo sapiens
ggaggcagaaccagct

SEQ ID NO: 318307 - DNA, 15 bp, Homo sapiens
ggaggcagccccctc

SEQ ID NO: 318308 - DNA, 15 bp, Homo sapiens
ggaggccaagcctgc

SEQ ID NO: 318309 - DNA, 19 bp, Homo sapiens
ggaggccaagcctgcagct

SEQ ID NO: 318310 - DNA, 19 bp, Homo sapiens
ggaggccaaggtgggcgga

SEQ ID NO: 318311 - DNA, 23 bp, Homo sapiens
ggaggccaccccaaaccccagcc

SEQ ID NO: 318312 - DNA, 16 bp, Homo sapiens
ggaggccacgggggag

SEQ ID NO: 318313 - DNA, 17 bp, Homo sapiens
ggaggccacgggggagg

SEQ ID NO: 318314 - DNA, 11 bp, Homo sapiens
ggaggccaggc

SEQ ID NO: 318315 - DNA, 21 bp, Homo sapiens
ggaggccaggccctcctgctg

SEQ ID NO: 318316 - DNA, 23 bp, Homo sapiens
ggaggcccctggcccagcggccc

SEQ ID NO: 318317 - DNA, 18 bp, Homo sapiens
ggaggcccttttctggct

SEQ ID NO: 318318 - DNA, 23 bp, Homo sapiens
ggaggcccttttctggctcctgt

SEQ ID NO: 318319 - DNA, 17 bp, Homo sapiens
ggaggccgaggcacgag

SEQ ID NO: 318320 - DNA, 15 bp, Homo sapiens
ggaggccgaggcagg

SEQ ID NO: 318321 - DNA, 16 bp, Homo sapiens
ggaggccgaggcaggg

SEQ ID NO: 318322 - DNA, 17 bp, Homo sapiens
ggaggcctcaccctgct

SEQ ID NO: 318323 - DNA, 15 bp, Homo sapiens
ggaggcctggtctgg

SEQ ID NO: 318324 - DNA, 12 bp, Homo sapiens
ggaggcgcccac

SEQ ID NO: 318325 - DNA, 15 bp, Homo sapiens
ggaggcgcccacctg

SEQ ID NO: 318326 - DNA, 17 bp, Homo sapiens
ggaggcgcccacctgcc

SEQ ID NO: 318327 - DNA, 16 bp, Homo sapiens
ggaggcgtgcccccct

SEQ ID NO: 318328 - DNA, 16 bp, Homo sapiens
ggaggctatgtggagt

SEQ ID NO: 318329 - DNA, 13 bp, Homo sapiens
ggaggctcccaga

SEQ ID NO: 318330 - DNA, 16 bp, Homo sapiens
ggaggctcccagaccc

SEQ ID NO: 318331 - DNA, 14 bp, Homo sapiens
ggaggctgagactg

SEQ ID NO: 318332 - DNA, 20 bp, Homo sapiens
ggaggctgagactgcagagg

SEQ ID NO: 318333 - DNA, 12 bp, Homo sapiens
ggaggctgagat

SEQ ID NO: 318334 - DNA, 19 bp, Homo sapiens
ggaggctgaggtgggcaga

SEQ ID NO: 318335 - DNA, 16 bp, Homo sapiens
cgacaacatttctgcc

SEQ ID NO: 318336 - DNA, 21 bp, Homo sapiens
cgacaaccgatgctccagcca

SEQ ID NO: 318337 - DNA, 12 bp, Homo sapiens
cgacaagtgctg

SEQ ID NO: 318338 - DNA, 22 bp, Homo sapiens
cgacaatgtcgagtatattatt

SEQ ID NO: 318339 - DNA, 23 bp, Homo sapiens
cgacaatgtcgagtatattatta

SEQ ID NO: 318340 - DNA, 13 bp, Homo sapiens
cgacacagcgacg

SEQ ID NO: 318341 - DNA, 16 bp, Homo sapiens
cgacagtggctctcca

SEQ ID NO: 318342 - DNA, 12 bp, Homo sapiens
cgaccacctgcc

SEQ ID NO: 318343 - DNA, 14 bp, Homo sapiens
cgaccacctgccca

SEQ ID NO: 318344 - DNA, 15 bp, Homo sapiens
cgaccctttctctga

SEQ ID NO: 318345 - DNA, 15 bp, Homo sapiens
cgaccgaggctggag

SEQ ID NO: 318346 - DNA, 18 bp, Homo sapiens
cgacctaccaccccactg

SEQ ID NO: 318347 - DNA, 21 bp, Homo sapiens
cgacgctcccctgagaggttt

SEQ ID NO: 318348 - DNA, 20 bp, Homo sapiens
cgactctgctgctcatggga

SEQ ID NO: 318349 - DNA, 13 bp, Homo sapiens
cgactcttcctgc

SEQ ID NO: 318350 - DNA, 15 bp, Homo sapiens
cgactcttcctgcaa

SEQ ID NO: 318351 - DNA, 16 bp, Homo sapiens
cgactgtgaaagtatg

SEQ ID NO: 318352 - DNA, 17 bp, Homo sapiens
cgactgtgacctgtggg

SEQ ID NO: 318353 - DNA, 13 bp, Homo sapiens
cgactttattttc

SEQ ID NO: 318354 - DNA, 13 bp, Homo sapiens
cgagaagctctcg

SEQ ID NO: 318355 - DNA, 16 bp, Homo sapiens
cgagacaccctaactc

SEQ ID NO: 318356 - DNA, 14 bp, Homo sapiens
cgagacacttgcct

SEQ ID NO: 318357 - DNA, 16 bp, Homo sapiens
cgagaccatcctggcc

SEQ ID NO: 318358 - DNA, 18 bp, Homo sapiens
cgagaccatcctggcccc

SEQ ID NO: 318359 - DNA, 22 bp, Homo sapiens
cgagagaggcgcgtctgcccca

SEQ ID NO: 318360 - DNA, 12 bp, Homo sapiens
cgagagctctta

SEQ ID NO: 318361 - DNA, 20 bp, Homo sapiens
cgagagctcttagtttttaa

SEQ ID NO: 318362 - DNA, 16 bp, Homo sapiens
cgagagggctgagccc

SEQ ID NO: 318363 - DNA, 17 bp, Homo sapiens
cgagagggctgagcccc

SEQ ID NO: 318364 - DNA, 16 bp, Homo sapiens
cgagatcggggtagaa

SEQ ID NO: 318365 - DNA, 12 bp, Homo sapiens
cgagcacccacg

SEQ ID NO: 318366 - DNA, 19 bp, Homo sapiens
cgagcactggccagagagg

SEQ ID NO: 318367 - DNA, 21 bp, Homo sapiens
cgagcactggccagagagggc

SEQ ID NO: 318368 - DNA, 15 bp, Homo sapiens
cgagcagtcctgcct

SEQ ID NO: 318369 - DNA, 18 bp, Homo sapiens
cgagccatgatgtggagt

SEQ ID NO: 318370 - DNA, 14 bp, Homo sapiens
cgagcccagctaca

SEQ ID NO: 318371 - DNA, 15 bp, Homo sapiens
cgagccccctgtcct

SEQ ID NO: 318372 - DNA, 17 bp, Homo sapiens
cgagccccctgtccttc

SEQ ID NO: 318373 - DNA, 16 bp, Homo sapiens
cgagccctacttccag

SEQ ID NO: 318374 - DNA, 14 bp, Homo sapiens
cgagcccttagcct

SEQ ID NO: 318375 - DNA, 19 bp, Homo sapiens
cgagcccttagccttgctg

SEQ ID NO: 318376 - DNA, 15 bp, Homo sapiens
cgagcgacggctcct

SEQ ID NO: 318377 - DNA, 22 bp, Homo sapiens
cgagcgacggctcctccccgat

SEQ ID NO: 318378 - DNA, 22 bp, Homo sapiens
cgagctactctcttgccagcat

SEQ ID NO: 318379 - DNA, 22 bp, Homo sapiens
cgagctcgtgtatcctggggct

SEQ ID NO: 318380 - DNA, 15 bp, Homo sapiens
cgagctctcctgggc

SEQ ID NO: 318381 - DNA, 23 bp, Homo sapiens
cgagctctcctgggccagggtct

SEQ ID NO: 318382 - DNA, 23 bp, Homo sapiens
cgagctgggggccatgagctcca

SEQ ID NO: 318383 - DNA, 14 bp, Homo sapiens
cgagctggtgcatt

SEQ ID NO: 318384 - DNA, 22 bp, Homo sapiens
cgaggaaacgaaacccactcta

SEQ ID NO: 318385 - DNA, 14 bp, Homo sapiens
cgaggaaccagagc

SEQ ID NO: 318386 - DNA, 17 bp, Homo sapiens
cgaggagccaggcaact

SEQ ID NO: 318387 - DNA, 19 bp, Homo sapiens
cgaggcaccggcgctgcag

SEQ ID NO: 318388 - DNA, 20 bp, Homo sapiens
cgaggcaccggcgctgcagg

SEQ ID NO: 318389 - DNA, 21 bp, Homo sapiens
cgaggcaccggcgctgcaggt

SEQ ID NO: 318390 - DNA, 17 bp, Homo sapiens
cgaggcagaatggtggg

SEQ ID NO: 318391 - DNA, 19 bp, Homo sapiens
cgaggcagcaacaggacca

SEQ ID NO: 318392 - DNA, 20 bp, Homo sapiens
cgaggcgaggctgcctctgg

SEQ ID NO: 318393 - DNA, 15 bp, Homo sapiens
cgaggcgatgccacg

SEQ ID NO: 318394 - DNA, 21 bp, Homo sapiens
cgaggcgggggagcctggagc

SEQ ID NO: 318395 - DNA, 22 bp, Homo sapiens
cgaggcgggggatcctggagcc

SEQ ID NO: 318396 - DNA, 21 bp, Homo sapiens
cgaggctccccgcctccactc

SEQ ID NO: 318397 - DNA, 13 bp, Homo sapiens
cgaggctgcctct

SEQ ID NO: 318398 - DNA, 16 bp, Homo sapiens
cgaggctgcctctggg

SEQ ID NO: 318399 - DNA, 18 bp, Homo sapiens
cgaggctgcctctgggtg

SEQ ID NO: 318400 - DNA, 17 bp, Homo sapiens
cgcccacctctgctgcc

SEQ ID NO: 318401 - DNA, 11 bp, Homo sapiens
cgcccacctgc

SEQ ID NO: 318402 - DNA, 15 bp, Homo sapiens
cgcccacctgcatca

SEQ ID NO: 318403 - DNA, 17 bp, Homo sapiens
cgcccacctgcccagtt

SEQ ID NO: 318404 - DNA, 12 bp, Homo sapiens
cgcccactgtcc

SEQ ID NO: 318405 - DNA, 19 bp, Homo sapiens
cgcccactgtcctgggcgc

SEQ ID NO: 318406 - DNA, 20 bp, Homo sapiens
cgcccactgtcctgggcgcc

SEQ ID NO: 318407 - DNA, 13 bp, Homo sapiens
cgcccatgtgtga

SEQ ID NO: 318408 - DNA, 23 bp, Homo sapiens
cgcccattcgtctgtcccagagc

SEQ ID NO: 318409 - DNA, 13 bp, Homo sapiens
cgccccagagact

SEQ ID NO: 318410 - DNA, 16 bp, Homo sapiens
cgccccagagactgcc

SEQ ID NO: 318411 - DNA, 18 bp, Homo sapiens
cgccccagagactgccca

SEQ ID NO: 318412 - DNA, 20 bp, Homo sapiens
cgccccagagactgcccacc

SEQ ID NO: 318413 - DNA, 12 bp, Homo sapiens
cgccccagcctc

SEQ ID NO: 318414 - DNA, 22 bp, Homo sapiens
cgccccatccctgcttgcccgc

SEQ ID NO: 318415 - DNA, 20 bp, Homo sapiens
cgcccccacaccccatctct

SEQ ID NO: 318416 - DNA, 13 bp, Homo sapiens
cgcccccacccct

SEQ ID NO: 318417 - DNA, 21 bp, Homo sapiens
cgccccccagagccagggctg

SEQ ID NO: 318418 - DNA, 18 bp, Homo sapiens
cgcccccgccctcgctcc

SEQ ID NO: 318419 - DNA, 13 bp, Homo sapiens
cgccccgccccca

SEQ ID NO: 318420 - DNA, 21 bp, Homo sapiens
cgccccgtgtccccccaggtg

SEQ ID NO: 318421 - DNA, 14 bp, Homo sapiens
cgcccctccagtgt

SEQ ID NO: 318422 - DNA, 14 bp, Homo sapiens
cgcccctcccaagc

SEQ ID NO: 318423 - DNA, 13 bp, Homo sapiens
cgcccctcctcgg

SEQ ID NO: 318424 - DNA, 14 bp, Homo sapiens
cgcccctcctcggg

SEQ ID NO: 318425 - DNA, 12 bp, Homo sapiens
cgcccctggggt

SEQ ID NO: 318426 - DNA, 13 bp, Homo sapiens
cgcccctggggtg

SEQ ID NO: 318427 - DNA, 13 bp, Homo sapiens
cgccccttccccc

SEQ ID NO: 318428 - DNA, 17 bp, Homo sapiens
cgcccgactagcaggca

SEQ ID NO: 318429 - DNA, 14 bp, Homo sapiens
cgcccgcccactgt

SEQ ID NO: 318430 - DNA, 21 bp, Homo sapiens
cgcccgcccactgtcctgggc

SEQ ID NO: 318431 - DNA, 17 bp, Homo sapiens
cgcccgcccccgccctc

SEQ ID NO: 318432 - DNA, 23 bp, Homo sapiens
cgcccgcccccgccctcgctccg

SEQ ID NO: 318433 - DNA, 16 bp, Homo sapiens
cgcccgccctcctctg

SEQ ID NO: 318434 - DNA, 17 bp, Homo sapiens
cgcccgggcccagagga

SEQ ID NO: 318435 - DNA, 14 bp, Homo sapiens
cgcccggggagttt

SEQ ID NO: 318436 - DNA, 23 bp, Homo sapiens
cgcccggggagtttccgcggcgg

SEQ ID NO: 318437 - DNA, 11 bp, Homo sapiens
cgccctccctc

SEQ ID NO: 318438 - DNA, 17 bp, Homo sapiens
cgccctcctcgctgtgc

SEQ ID NO: 318439 - DNA, 18 bp, Homo sapiens
cgccctcctcgctgtgcc

SEQ ID NO: 318440 - DNA, 11 bp, Homo sapiens
cgccctcctct

SEQ ID NO: 318441 - DNA, 13 bp, Homo sapiens
cgccctcctctgc

SEQ ID NO: 318442 - DNA, 19 bp, Homo sapiens
cgccctcctctgccccctc

SEQ ID NO: 318443 - DNA, 15 bp, Homo sapiens
cgccctctgtgccta

SEQ ID NO: 318444 - DNA, 16 bp, Homo sapiens
cgccctctgtgcctaa

SEQ ID NO: 318445 - DNA, 19 bp, Homo sapiens
cgccctcttcccctctaat

SEQ ID NO: 318446 - DNA, 13 bp, Homo sapiens
cgccctggaagcc

SEQ ID NO: 318447 - DNA, 16 bp, Homo sapiens
cgccctggaagccggc

SEQ ID NO: 318448 - DNA, 21 bp, Homo sapiens
cgccctgggctggactggagg

SEQ ID NO: 318449 - DNA, 15 bp, Homo sapiens
cgcccttgtgccctg

SEQ ID NO: 318450 - DNA, 18 bp, Homo sapiens
cgccgctgtgctgttgtc

SEQ ID NO: 318451 - DNA, 15 bp, Homo sapiens
cgccggggctggccc

SEQ ID NO: 318452 - DNA, 22 bp, Homo sapiens
cgccggggctggccctgccctc

SEQ ID NO: 318453 - DNA, 19 bp, Homo sapiens
cgccggttggccggctggc

SEQ ID NO: 318454 - DNA, 19 bp, Homo sapiens
cgccgtccctctgccttgc

SEQ ID NO: 318455 - DNA, 22 bp, Homo sapiens
cgccgtgccggcggcagcccca

SEQ ID NO: 318456 - DNA, 13 bp, Homo sapiens
cgccgtggagcat

SEQ ID NO: 318457 - DNA, 11 bp, Homo sapiens
cgcctcccagc

SEQ ID NO: 318458 - DNA, 14 bp, Homo sapiens
cgcctcccgccgcc

SEQ ID NO: 318459 - DNA, 15 bp, Homo sapiens
cgcctcccgccgcct

SEQ ID NO: 318460 - DNA, 21 bp, Homo sapiens
cgcctcgggccgcctcctcca

SEQ ID NO: 318461 - DNA, 22 bp, Homo sapiens
cgcctcgggccgcctcctccag

SEQ ID NO: 318462 - DNA, 13 bp, Homo sapiens
cgcctctgagcca

SEQ ID NO: 318463 - DNA, 14 bp, Homo sapiens
cgcctctgagccag

SEQ ID NO: 318464 - DNA, 21 bp, Homo sapiens
cgcctctgagccaggagcctc

SEQ ID NO: 318465 - DNA, 20 bp, Homo sapiens
cgcctctgcccgcagagccc

SEQ ID NO: 318466 - DNA, 13 bp, Homo sapiens
cgcctctgctggc

SEQ ID NO: 318467 - DNA, 20 bp, Homo sapiens
cgcctcttttccctctctag

SEQ ID NO: 318468 - DNA, 14 bp, Homo sapiens
cgcctgcacctgcg

SEQ ID NO: 318469 - DNA, 15 bp, Homo sapiens
cgcctgcacctgcgc

SEQ ID NO: 318470 - DNA, 17 bp, Homo sapiens
cgcctgccctccccaga

SEQ ID NO: 318471 - DNA, 15 bp, Homo sapiens
cgcctgcgctcctct

SEQ ID NO: 318472 - DNA, 16 bp, Homo sapiens
cgcctgcgctcctctg

SEQ ID NO: 318473 - DNA, 21 bp, Homo sapiens
cgcctgcggactccatggccc

SEQ ID NO: 318474 - DNA, 13 bp, Homo sapiens
cgcctgcttcaca

SEQ ID NO: 318475 - DNA, 18 bp, Homo sapiens
cgcctgcttcacacccct

SEQ ID NO: 318476 - DNA, 11 bp, Homo sapiens
cgcctggcaga

SEQ ID NO: 318477 - DNA, 20 bp, Homo sapiens
cgcctggcagaactgagctc

SEQ ID NO: 318478 - DNA, 18 bp, Homo sapiens
ggatggagaatgccagcc

SEQ ID NO: 318479 - DNA, 23 bp, Homo sapiens
ggatggcgtgtcccctgcctgtg

SEQ ID NO: 318480 - DNA, 18 bp, Homo sapiens
ggatgggaacactggtgg

SEQ ID NO: 318481 - DNA, 12 bp, Homo sapiens
ggatgggcacag

SEQ ID NO: 318482 - DNA, 15 bp, Homo sapiens
ggatgggcacaggct

SEQ ID NO: 318483 - DNA, 16 bp, Homo sapiens
ggatgggcacaggctg

SEQ ID NO: 318484 - DNA, 23 bp, Homo sapiens
ggatgggccacccaccagggctc

SEQ ID NO: 318485 - DNA, 19 bp, Homo sapiens
ggatggggcatgtggccaa

SEQ ID NO: 318486 - DNA, 18 bp, Homo sapiens
ggatggggcccaggggct

SEQ ID NO: 318487 - DNA, 18 bp, Homo sapiens
ggatggggttgggctctg

SEQ ID NO: 318488 - DNA, 23 bp, Homo sapiens
ggatggtactagggggaagtgac

SEQ ID NO: 318489 - DNA, 15 bp, Homo sapiens
ggatgtaaccaagct

SEQ ID NO: 318490 - DNA, 21 bp, Homo sapiens
ggatgtaatatagggtttgtt

SEQ ID NO: 318491 - DNA, 11 bp, Homo sapiens
ggatgtagaac

SEQ ID NO: 318492 - DNA, 13 bp, Homo sapiens
ggatgtagaactt

SEQ ID NO: 318493 - DNA, 12 bp, Homo sapiens
ggatgtagcatg

SEQ ID NO: 318494 - DNA, 16 bp, Homo sapiens
ggatgtcaccaagaag

SEQ ID NO: 318495 - DNA, 22 bp, Homo sapiens
ggatgtcaccaagaaggggctc

SEQ ID NO: 318496 - DNA, 17 bp, Homo sapiens
ggatgtcccctgtccca

SEQ ID NO: 318497 - DNA, 20 bp, Homo sapiens
ggatgtcccctgtcccacca

SEQ ID NO: 318498 - DNA, 13 bp, Homo sapiens
ggatgtcttcctt

SEQ ID NO: 318499 - DNA, 13 bp, Homo sapiens
ggatgtgtaaatg

SEQ ID NO: 318500 - DNA, 17 bp, Homo sapiens
ggatgtgtggggcatgg

SEQ ID NO: 318501 - DNA, 14 bp, Homo sapiens
ggattaaatggcac

SEQ ID NO: 318502 - DNA, 18 bp, Homo sapiens
ggattaaatggcacctgt

SEQ ID NO: 318503 - DNA, 20 bp, Homo sapiens
ggattaaatggcacctgtat

SEQ ID NO: 318504 - DNA, 15 bp, Homo sapiens
ggattaacctctgca

SEQ ID NO: 318505 - DNA, 16 bp, Homo sapiens
ggattaacctctgcac

SEQ ID NO: 318506 - DNA, 17 bp, Homo sapiens
ggattaacctctgcact

SEQ ID NO: 318507 - DNA, 22 bp, Homo sapiens
ggattagctagactaggagacc

SEQ ID NO: 318508 - DNA, 15 bp, Homo sapiens
ggattattcatttaa

SEQ ID NO: 318509 - DNA, 15 bp, Homo sapiens
ggattcaaatgcatg

SEQ ID NO: 318510 - DNA, 12 bp, Homo sapiens
ggattcacttct

SEQ ID NO: 318511 - DNA, 12 bp, Homo sapiens
ggattcaggaat

SEQ ID NO: 318512 - DNA, 14 bp, Homo sapiens
ggattcaggctgct

SEQ ID NO: 318513 - DNA, 15 bp, Homo sapiens
ggattcaggctgctt

SEQ ID NO: 318514 - DNA, 17 bp, Homo sapiens
ggattccggccctggct

SEQ ID NO: 318515 - DNA, 19 bp, Homo sapiens
ggattccggccctggctgg

SEQ ID NO: 318516 - DNA, 22 bp, Homo sapiens
ggattccggccctggctgggga

SEQ ID NO: 318517 - DNA, 23 bp, Homo sapiens
ggattctaaacagatgtccctga

SEQ ID NO: 318518 - DNA, 20 bp, Homo sapiens
ggattctttgacatttggtg

SEQ ID NO: 318519 - DNA, 16 bp, Homo sapiens
ggattgaagccctcca

SEQ ID NO: 318520 - DNA, 14 bp, Homo sapiens
ggattgaggatgaa

SEQ ID NO: 318521 - DNA, 20 bp, Homo sapiens
ggattgatcggagcctcctc

SEQ ID NO: 318522 - DNA, 17 bp, Homo sapiens
ggattgcacgtggcctc

SEQ ID NO: 318523 - DNA, 22 bp, Homo sapiens
ggattggccaaacatcagacct

SEQ ID NO: 318524 - DNA, 18 bp, Homo sapiens
ggattgggggctggtgcc

SEQ ID NO: 318525 - DNA, 15 bp, Homo sapiens
ggattggtaccagag

SEQ ID NO: 318526 - DNA, 18 bp, Homo sapiens
ggattggtaccagagcct

SEQ ID NO: 318527 - DNA, 19 bp, Homo sapiens
ggattgtccacaaatgtcc

SEQ ID NO: 318528 - DNA, 15 bp, Homo sapiens
ggatttcgtttttct

SEQ ID NO: 318529 - DNA, 17 bp, Homo sapiens
ggatttgaactgagccg

SEQ ID NO: 318530 - DNA, 14 bp, Homo sapiens
ggatttgccccttc

SEQ ID NO: 318531 - DNA, 22 bp, Homo sapiens
ggatttgccccttcccatctct

SEQ ID NO: 318532 - DNA, 23 bp, Homo sapiens
gatgattaaacacctgacacatc

SEQ ID NO: 318533 - DNA, 18 bp, Homo sapiens
gatgatttttaagtacaa

SEQ ID NO: 318534 - DNA, 18 bp, Homo sapiens
gatgcaaggaccaggact

SEQ ID NO: 318535 - DNA, 13 bp, Homo sapiens
gatgcaagtcact

SEQ ID NO: 318536 - DNA, 21 bp, Homo sapiens
gatgcaagtgtttctgttctg

SEQ ID NO: 318537 - DNA, 15 bp, Homo sapiens
gatgcacagatgcca

SEQ ID NO: 318538 - DNA, 19 bp, Homo sapiens
gatgcaccaagtacagcct

SEQ ID NO: 318539 - DNA, 20 bp, Homo sapiens
gatgcacggtttctgttctg

SEQ ID NO: 318540 - DNA, 18 bp, Homo sapiens
gatgcactcgcactgcaa

SEQ ID NO: 318541 - DNA, 23 bp, Homo sapiens
gatgcacttattttttaatgtga

SEQ ID NO: 318542 - DNA, 20 bp, Homo sapiens
gatccacccacctcagcctc

SEQ ID NO: 318543 - DNA, 21 bp, Homo sapiens
gatccacccacctcagcctcc

SEQ ID NO: 318544 - DNA, 19 bp, Homo sapiens
gatccagctgtgtgttttc

SEQ ID NO: 318545 - DNA, 16 bp, Homo sapiens
gatccagggactgaag

SEQ ID NO: 318546 - DNA, 13 bp, Homo sapiens
gatcccactggcg

SEQ ID NO: 318547 - DNA, 20 bp, Homo sapiens
gatcccataaagaaagtgag

SEQ ID NO: 318548 - DNA, 20 bp, Homo sapiens
gatcccatccatcagctccc

SEQ ID NO: 318549 - DNA, 21 bp, Homo sapiens
gatcccatccatcagctccct

SEQ ID NO: 318550 - DNA, 18 bp, Homo sapiens
gatccccgacagtggctc

SEQ ID NO: 318551 - DNA, 22 bp, Homo sapiens
gatccccggggctggggcccag

SEQ ID NO: 318552 - DNA, 21 bp, Homo sapiens
gatcccctctgtctacaaata

SEQ ID NO: 318553 - DNA, 13 bp, Homo sapiens
gatcccctttggt

SEQ ID NO: 318554 - DNA, 20 bp, Homo sapiens
gatccctcggtcagcaccgt

SEQ ID NO: 318555 - DNA, 20 bp, Homo sapiens
gatccctgtgttgtctctag

SEQ ID NO: 318556 - DNA, 24 bp, Homo sapiens
gatccctgtgttgtctctagagca

SEQ ID NO: 318557 - DNA, 19 bp, Homo sapiens
gatccgagcgacggctcct

SEQ ID NO: 318558 - DNA, 14 bp, Homo sapiens
gatccgcatgtgtc

SEQ ID NO: 318559 - DNA, 18 bp, Homo sapiens
gatccgcatgtgtctgta

SEQ ID NO: 318560 - DNA, 19 bp, Homo sapiens
gatccgcatgtgtctgtat

SEQ ID NO: 318561 - DNA, 20 bp, Homo sapiens
gatccgcatgtgtctgtatt

SEQ ID NO: 318562 - DNA, 20 bp, Homo sapiens
gatccgcctacctcagcctc

SEQ ID NO: 318563 - DNA, 15 bp, Homo sapiens
gatccgctgccacca

SEQ ID NO: 318564 - DNA, 15 bp, Homo sapiens
gatcctccatttttg

SEQ ID NO: 318565 - DNA, 16 bp, Homo sapiens
gatcctccctcatggc

SEQ ID NO: 318566 - DNA, 13 bp, Homo sapiens
gatcctctatttt

SEQ ID NO: 318567 - DNA, 22 bp, Homo sapiens
gatcctgcaccccagcattcca

SEQ ID NO: 318568 - DNA, 13 bp, Homo sapiens
gatcctgctgccg

SEQ ID NO: 318569 - DNA, 21 bp, Homo sapiens
gatccttcacaggcagtgcat

SEQ ID NO: 318570 - DNA, 22 bp, Homo sapiens
gatccttcacaggcagtgcatg

SEQ ID NO: 318571 - DNA, 17 bp, Homo sapiens
gatcgcttgagcccagg

SEQ ID NO: 318572 - DNA, 21 bp, Homo sapiens
gatcgtggccaacgtggacct

SEQ ID NO: 318573 - DNA, 20 bp, Homo sapiens
gatctacttcatagctcctt

SEQ ID NO: 318574 - DNA, 13 bp, Homo sapiens
gatctagccatgg

SEQ ID NO: 318575 - DNA, 14 bp, Homo sapiens
gatctagccatggc

SEQ ID NO: 318576 - DNA, 15 bp, Homo sapiens
gatctagccatggct

SEQ ID NO: 318577 - DNA, 16 bp, Homo sapiens
gatctagccatggctg

SEQ ID NO: 318578 - DNA, 13 bp, Homo sapiens
gatctaggtcttg

SEQ ID NO: 318579 - DNA, 19 bp, Homo sapiens
gatctaggtttaactcaga

SEQ ID NO: 318580 - DNA, 22 bp, Homo sapiens
gatctagttctcaatcactgct

SEQ ID NO: 318581 - DNA, 17 bp, Homo sapiens
gatctattactctgaca

SEQ ID NO: 318582 - DNA, 21 bp, Homo sapiens
gatctattactctgacataaa

SEQ ID NO: 318583 - DNA, 22 bp, Homo sapiens
gatctattactctgacataaac

SEQ ID NO: 318584 - DNA, 20 bp, Homo sapiens
gatctcagataaagtgacca

SEQ ID NO: 318585 - DNA, 21 bp, Homo sapiens
gatctcagataaagtgaccag

SEQ ID NO: 318586 - DNA, 21 bp, Homo sapiens
gatctcattcagtattaaagg

SEQ ID NO: 318587 - DNA, 14 bp, Homo sapiens
gatctccaaagctt

SEQ ID NO: 318588 - DNA, 12 bp, Homo sapiens
gatctccaggcc

SEQ ID NO: 318589 - DNA, 18 bp, Homo sapiens
gatctccaggcccagcct

SEQ ID NO: 318590 - DNA, 19 bp, Homo sapiens
gatctccaggcccagcctg

SEQ ID NO: 318591 - DNA, 17 bp, Homo sapiens
gatctccatatgttaca

SEQ ID NO: 318592 - DNA, 13 bp, Homo sapiens
gatctcctgacct

SEQ ID NO: 318593 - DNA, 14 bp, Homo sapiens
gatctccttgccct

SEQ ID NO: 318594 - DNA, 17 bp, Homo sapiens
gatctctcaggagcaca

SEQ ID NO: 318595 - DNA, 20 bp, Homo sapiens
gatctctcaggagcacaggc

SEQ ID NO: 318596 - DNA, 16 bp, Homo sapiens
gatctgaattaaataa

SEQ ID NO: 318597 - DNA, 23 bp, Homo sapiens
gatctgagccctccctcttccca

SEQ ID NO: 318598 - DNA, 19 bp, Homo sapiens
gatctgatggtgagctggg

SEQ ID NO: 318599 - DNA, 11 bp, Homo sapiens
gatctgcctgg

SEQ ID NO: 318600 - DNA, 16 bp, Homo sapiens
gatctgcctgggcctg

SEQ ID NO: 318601 - DNA, 16 bp, Homo sapiens
gatctgctccatgcag

SEQ ID NO: 318602 - DNA, 17 bp, Homo sapiens
gatctgctccatgcaga

SEQ ID NO: 318603 - DNA, 14 bp, Homo sapiens
gatctggggaagga

SEQ ID NO: 318604 - DNA, 16 bp, Homo sapiens
gatctggtgcgtgtgg

SEQ ID NO: 318605 - DNA, 21 bp, Homo sapiens
gatctggtgcgtgtggccctg

SEQ ID NO: 318606 - DNA, 23 bp, Homo sapiens
gatctggtgcgtgtggccctgtg

SEQ ID NO: 318607 - DNA, 19 bp, Homo sapiens
gatctgtgcccagagatgg

SEQ ID NO: 318608 - DNA, 13 bp, Homo sapiens
gatcttaaatttt

SEQ ID NO: 318609 - DNA, 19 bp, Homo sapiens
gatcttaaattttgtgata

SEQ ID NO: 318610 - DNA, 16 bp, Homo sapiens
gatcttcaatggcttt

SEQ ID NO: 318611 - DNA, 13 bp, Homo sapiens
gatcttctccctc

SEQ ID NO: 318612 - DNA, 19 bp, Homo sapiens
gatcttctttataattcta

SEQ ID NO: 318613 - DNA, 14 bp, Homo sapiens
gatcttgagagctg

SEQ ID NO: 318614 - DNA, 16 bp, Homo sapiens
gatcttgagagctgct

SEQ ID NO: 318615 - DNA, 22 bp, Homo sapiens
gatcttgagcaaggcaagaagt

SEQ ID NO: 318616 - DNA, 20 bp, Homo sapiens
gatcttggagacaattacaa

SEQ ID NO: 318617 - DNA, 19 bp, Homo sapiens
gatcttggcttactgcagc

SEQ ID NO: 318618 - DNA, 14 bp, Homo sapiens
gatcttgtgctcag

SEQ ID NO: 318619 - DNA, 17 bp, Homo sapiens
gatcttgtgctcagcat

SEQ ID NO: 318620 - DNA, 22 bp, Homo sapiens
gatctttcgttggttgtttctc

SEQ ID NO: 318621 - DNA, 22 bp, Homo sapiens
gatgaaaaaaagggaaaacaaa

SEQ ID NO: 318622 - DNA, 15 bp, Homo sapiens
gatgaaaaaataaca

SEQ ID NO: 318623 - DNA, 13 bp, Homo sapiens
gatgaaaagattt

SEQ ID NO: 318624 - DNA, 13 bp, Homo sapiens
gatgaaaataaaa

SEQ ID NO: 318625 - DNA, 17 bp, Homo sapiens
gatgaaaataaaataaa

SEQ ID NO: 318626 - DNA, 17 bp, Homo sapiens
gatgaaaccgtccctga

SEQ ID NO: 318627 - DNA, 15 bp, Homo sapiens
gatgaaagacaaaga

SEQ ID NO: 318628 - DNA, 18 bp, Homo sapiens
gatgaaataactccttct

SEQ ID NO: 318629 - DNA, 18 bp, Homo sapiens
gatgaactgagaaggtca

SEQ ID NO: 318630 - DNA, 14 bp, Homo sapiens
gatgaatatgagct

SEQ ID NO: 318631 - DNA, 15 bp, Homo sapiens
gatgaatgccgtgga

SEQ ID NO: 318632 - DNA, 16 bp, Homo sapiens
gatgaatgccgtggat

SEQ ID NO: 318633 - DNA, 16 bp, Homo sapiens
gatgaattaaatttaa

SEQ ID NO: 318634 - DNA, 14 bp, Homo sapiens
gatgaattatgata

SEQ ID NO: 318635 - DNA, 12 bp, Homo sapiens
gatgacaaagaa

SEQ ID NO: 318636 - DNA, 15 bp, Homo sapiens
gatgacaaagaaaat

SEQ ID NO: 318637 - DNA, 17 bp, Homo sapiens
gatgaccaatctctgtg

SEQ ID NO: 318638 - DNA, 12 bp, Homo sapiens
gatgacccctcc

SEQ ID NO: 318639 - DNA, 19 bp, Homo sapiens
gatgacccggggcagctgg

SEQ ID NO: 318640 - DNA, 20 bp, Homo sapiens
gatgacccggggcagctggc

SEQ ID NO: 318641 - DNA, 13 bp, Homo sapiens
gatgagaaaaaac

SEQ ID NO: 318642 - DNA, 19 bp, Homo sapiens
gatgagaagttaagcagcc

SEQ ID NO: 318643 - DNA, 20 bp, Homo sapiens
gatgagaattcagctgcccc

SEQ ID NO: 318644 - DNA, 17 bp, Homo sapiens
gatgagacaacacacac

SEQ ID NO: 318645 - DNA, 23 bp, Homo sapiens
gatgagacttccaaacctgacag

SEQ ID NO: 318646 - DNA, 20 bp, Homo sapiens
gatgagattggcatggcttt

SEQ ID NO: 318647 - DNA, 14 bp, Homo sapiens
gatgagctggtttg

SEQ ID NO: 318648 - DNA, 16 bp, Homo sapiens
gatgagctttcttttt

SEQ ID NO: 318649 - DNA, 19 bp, Homo sapiens
gatgaggtgctgggaggga

SEQ ID NO: 318650 - DNA, 20 bp, Homo sapiens
gatgatcaaaacctgtgcca

SEQ ID NO: 318651 - DNA, 20 bp, Homo sapiens
gatgatcagctgtttgtcat

SEQ ID NO: 318652 - DNA, 13 bp, Homo sapiens
gatgatcgtgcct

SEQ ID NO: 318653 - DNA, 15 bp, Homo sapiens
gatgatctactcaga

SEQ ID NO: 318654 - DNA, 19 bp, Homo sapiens
gatgatctcttaggaagcc

SEQ ID NO: 318655 - DNA, 23 bp, Homo sapiens
gatgatgataatgatgatgacga

SEQ ID NO: 318656 - DNA, 14 bp, Homo sapiens
gatgatgtctcttg

SEQ ID NO: 318657 - DNA, 14 bp, Homo sapiens
gacccctcaccttg

SEQ ID NO: 318658 - DNA, 23 bp, Homo sapiens
gacccctcccttgctcagtgcct

SEQ ID NO: 318659 - DNA, 19 bp, Homo sapiens
gacccctgctcccagcctg

SEQ ID NO: 318660 - DNA, 22 bp, Homo sapiens
gacccctgctcccagcctgctg

SEQ ID NO: 318661 - DNA, 20 bp, Homo sapiens
gaccccttcctgtctggccc

SEQ ID NO: 318662 - DNA, 21 bp, Homo sapiens
gaccccttcctgtctggccca

SEQ ID NO: 318663 - DNA, 13 bp, Homo sapiens
gacccgccaggtc

SEQ ID NO: 318664 - DNA, 14 bp, Homo sapiens
gacccgccaggtca

SEQ ID NO: 318665 - DNA, 14 bp, Homo sapiens
gacccggaggccac

SEQ ID NO: 318666 - DNA, 19 bp, Homo sapiens
gacccggaggggcctggca

SEQ ID NO: 318667 - DNA, 22 bp, Homo sapiens
gacccggcccccgccctctgcc

SEQ ID NO: 318668 - DNA, 17 bp, Homo sapiens
gacccgggaccacagct

SEQ ID NO: 318669 - DNA, 17 bp, Homo sapiens
gaccctaacccggaggg

SEQ ID NO: 318670 - DNA, 11 bp, Homo sapiens
gaccctccctt

SEQ ID NO: 318671 - DNA, 19 bp, Homo sapiens
gaccctcggcctctacttt

SEQ ID NO: 318672 - DNA, 18 bp, Homo sapiens
gaccctcggggcaggaag

SEQ ID NO: 318673 - DNA, 20 bp, Homo sapiens
gaccctctgaccctagctct

SEQ ID NO: 318674 - DNA, 22 bp, Homo sapiens
gaccctcttctctgggcccaga

SEQ ID NO: 318675 - DNA, 20 bp, Homo sapiens
gaccctgagggtttccacct

SEQ ID NO: 318676 - DNA, 15 bp, Homo sapiens
gaccctgcagagatg

SEQ ID NO: 318677 - DNA, 23 bp, Homo sapiens
gaccctgcctgagcccaggagct

SEQ ID NO: 318678 - DNA, 11 bp, Homo sapiens
gaccctggaat

SEQ ID NO: 318679 - DNA, 23 bp, Homo sapiens
gaccctggaattcagcaccctgg

SEQ ID NO: 318680 - DNA, 12 bp, Homo sapiens
gaccctgggaga

SEQ ID NO: 318681 - DNA, 16 bp, Homo sapiens
ccagctactctgtcca

SEQ ID NO: 318682 - DNA, 18 bp, Homo sapiens
ccagctactctgtccagg

SEQ ID NO: 318683 - DNA, 20 bp, Homo sapiens
ccagctactctgtccaggcc

SEQ ID NO: 318684 - DNA, 21 bp, Homo sapiens
ccagctactctgtccaggcca

SEQ ID NO: 318685 - DNA, 21 bp, Homo sapiens
ccagctacttgggagcctgag

SEQ ID NO: 318686 - DNA, 17 bp, Homo sapiens
ccagctcagcagttcac

SEQ ID NO: 318687 - DNA, 20 bp, Homo sapiens
ccagctcagccccggccact

SEQ ID NO: 318688 - DNA, 22 bp, Homo sapiens
ccagctcagccccggccactcc

SEQ ID NO: 318689 - DNA, 13 bp, Homo sapiens
ccagctccacagg

SEQ ID NO: 318690 - DNA, 15 bp, Homo sapiens
ccagctccactcagg

SEQ ID NO: 318691 - DNA, 23 bp, Homo sapiens
ccagctccactcagggctggccc

SEQ ID NO: 318692 - DNA, 21 bp, Homo sapiens
ccagctccaggggcccttggg

SEQ ID NO: 318693 - DNA, 21 bp, Homo sapiens
ccagctcccaacagaggcctc

SEQ ID NO: 318694 - DNA, 21 bp, Homo sapiens
ccagctccctagactgcatcc

SEQ ID NO: 318695 - DNA, 17 bp, Homo sapiens
ccagctccttttctgtg

SEQ ID NO: 318696 - DNA, 22 bp, Homo sapiens
ccagctctagacaaccctgcaa

SEQ ID NO: 318697 - DNA, 16 bp, Homo sapiens
ccagctctcccctgcg

SEQ ID NO: 318698 - DNA, 22 bp, Homo sapiens
ccagctctcccctgcgcaggcc

SEQ ID NO: 318699 - DNA, 16 bp, Homo sapiens
ccagctctgtggcctg

SEQ ID NO: 318700 - DNA, 17 bp, Homo sapiens
ccagctctgtggcctgt

SEQ ID NO: 318701 - DNA, 18 bp, Homo sapiens
ccagctctgtggcctgtg

SEQ ID NO: 318702 - DNA, 19 bp, Homo sapiens
ccagctcttctccccaggt

SEQ ID NO: 318703 - DNA, 13 bp, Homo sapiens
ccagctgcccctc

SEQ ID NO: 318704 - DNA, 13 bp, Homo sapiens
ccagctgccttcc

SEQ ID NO: 318705 - DNA, 14 bp, Homo sapiens
ccagctgccttcct

SEQ ID NO: 318706 - DNA, 16 bp, Homo sapiens
ccagctgctcccctcc

SEQ ID NO: 318707 - DNA, 17 bp, Homo sapiens
ccagctgctcccctccc

SEQ ID NO: 318708 - DNA, 19 bp, Homo sapiens
ccagctgctcccctccctc

SEQ ID NO: 318709 - DNA, 16 bp, Homo sapiens
ccagctgctcctcgca

SEQ ID NO: 318710 - DNA, 20 bp, Homo sapiens
ccagctgctcctcgcagttc

SEQ ID NO: 318711 - DNA, 15 bp, Homo sapiens
ccagctgctctgccc

SEQ ID NO: 318712 - DNA, 16 bp, Homo sapiens
ccagctgctctgccca

SEQ ID NO: 318713 - DNA, 20 bp, Homo sapiens
ccagctgctctgcccagagc

SEQ ID NO: 318714 - DNA, 22 bp, Homo sapiens
ccagctgctctgcccagagctg

SEQ ID NO: 318715 - DNA, 21 bp, Homo sapiens
ccagctgctctgccccttggg

SEQ ID NO: 318716 - DNA, 12 bp, Homo sapiens
ccagctgctgga

SEQ ID NO: 318717 - DNA, 15 bp, Homo sapiens
ccagctgctgtcagg

SEQ ID NO: 318718 - DNA, 14 bp, Homo sapiens
ccagctggcagcgc

SEQ ID NO: 318719 - DNA, 14 bp, Homo sapiens
ccagctggctgggt

SEQ ID NO: 318720 - DNA, 22 bp, Homo sapiens
ccagctggctgggtcgcccctc

SEQ ID NO: 318721 - DNA, 11 bp, Homo sapiens
ccagctgggct

SEQ ID NO: 318722 - DNA, 23 bp, Homo sapiens
ccagctgggctctgccaccctac

SEQ ID NO: 318723 - DNA, 12 bp, Homo sapiens
ccagctgggctg

SEQ ID NO: 318724 - DNA, 13 bp, Homo sapiens
ccagctgggctgt

SEQ ID NO: 318725 - DNA, 20 bp, Homo sapiens
ccagctggggcccctcggct

SEQ ID NO: 318726 - DNA, 21 bp, Homo sapiens
ccagctggggcccctcggcta

SEQ ID NO: 318727 - DNA, 17 bp, Homo sapiens
ccagctggggggcaggg

SEQ ID NO: 318728 - DNA, 20 bp, Homo sapiens
ccagctggggggcagggggg

SEQ ID NO: 318729 - DNA, 14 bp, Homo sapiens
ccagctgtagccat

SEQ ID NO: 318730 - DNA, 16 bp, Homo sapiens
ccagctgtagccatgg

SEQ ID NO: 318731 - DNA, 17 bp, Homo sapiens
ccagctgtagccatggc

SEQ ID NO: 318732 - DNA, 18 bp, Homo sapiens
ccagctgtagccatggct

SEQ ID NO: 318733 - DNA, 21 bp, Homo sapiens
ccagctgtagccatggctcag

SEQ ID NO: 318734 - DNA, 22 bp, Homo sapiens
ccagctgtagccatggctcagg

SEQ ID NO: 318735 - DNA, 19 bp, Homo sapiens
ccagctgtgactgagggcc

SEQ ID NO: 318736 - DNA, 22 bp, Homo sapiens
ccagctgtgggtacagagaggt

SEQ ID NO: 318737 - DNA, 19 bp, Homo sapiens
ccagctgtgttcacactgt

SEQ ID NO: 318738 - DNA, 15 bp, Homo sapiens
ccagcttcctggtgt

SEQ ID NO: 318739 - DNA, 15 bp, Homo sapiens
ccagcttcgtgctgg

SEQ ID NO: 318740 - DNA, 20 bp, Homo sapiens
ccagcttcgtgctggaggaa

SEQ ID NO: 318741 - DNA, 21 bp, Homo sapiens
ccagcttctggtactctccta

SEQ ID NO: 318742 - DNA, 19 bp, Homo sapiens
ccagcttgggcccagctgg

SEQ ID NO: 318743 - DNA, 21 bp, Homo sapiens
ccagcttgggcccagctgggc

SEQ ID NO: 318744 - DNA, 16 bp, Homo sapiens
ccagcttgttatttat

SEQ ID NO: 318745 - DNA, 22 bp, Homo sapiens
ccagctttaagggttgtgagcc

SEQ ID NO: 318746 - DNA, 16 bp, Homo sapiens
ccagcttttcctccct

SEQ ID NO: 318747 - DNA, 18 bp, Homo sapiens
ccagcttttcttgccagc

SEQ ID NO: 318748 - DNA, 20 bp, Homo sapiens
ccagcttttcttgccagctc

SEQ ID NO: 318749 - DNA, 17 bp, Homo sapiens
ccaggaagaaggcccgg

SEQ ID NO: 318750 - DNA, 13 bp, Homo sapiens
ccaggaagcacag

SEQ ID NO: 318751 - DNA, 15 bp, Homo sapiens
ccaggaagcacaggc

SEQ ID NO: 318752 - DNA, 19 bp, Homo sapiens
ccaggaagcacaggccagg

SEQ ID NO: 318753 - DNA, 15 bp, Homo sapiens
ccaggaagcagggag

SEQ ID NO: 318754 - DNA, 12 bp, Homo sapiens
ccaggaaggcag

SEQ ID NO: 318755 - DNA, 15 bp, Homo sapiens
ccaggaaggcagctg

SEQ ID NO: 318756 - DNA, 17 bp, Homo sapiens
ccaggaagtgggagaag

SEQ ID NO: 318757 - DNA, 22 bp, Homo sapiens
ccaggaagtgggagaagtggcc

SEQ ID NO: 318758 - DNA, 23 bp, Homo sapiens
ccaggaagtgggagaagtggccc

SEQ ID NO: 318759 - DNA, 14 bp, Homo sapiens
ccaggacaccgggc

SEQ ID NO: 318760 - DNA, 13 bp, Homo sapiens
ccaggacagctgc

SEQ ID NO: 318761 - DNA, 18 bp, Homo sapiens
ccaggacagctgcaggtg

SEQ ID NO: 318762 - DNA, 22 bp, Homo sapiens
ccaggacagctgcaggtgccca

SEQ ID NO: 318763 - DNA, 17 bp, Homo sapiens
ccaggacatctctgccc

SEQ ID NO: 318764 - DNA, 13 bp, Homo sapiens
ccaggaccctggg

SEQ ID NO: 318765 - DNA, 15 bp, Homo sapiens
ccaggaccctgggtc

SEQ ID NO: 318766 - DNA, 20 bp, Homo sapiens
ccaggacgcagggagaccct

SEQ ID NO: 318767 - DNA, 15 bp, Homo sapiens
ccaggacgcttctga

SEQ ID NO: 318768 - DNA, 16 bp, Homo sapiens
ccaggacgcttctgaa

SEQ ID NO: 318769 - DNA, 23 bp, Homo sapiens
ccaggacgcttctgaatgctgct

SEQ ID NO: 318770 - DNA, 18 bp, Homo sapiens
ccaggactccctcctcac

SEQ ID NO: 318771 - DNA, 15 bp, Homo sapiens
ccaggactctctttc

SEQ ID NO: 318772 - DNA, 16 bp, Homo sapiens
ccaggactctctttct

SEQ ID NO: 318773 - DNA, 15 bp, Homo sapiens
ccaggactctgcctt

SEQ ID NO: 318774 - DNA, 15 bp, Homo sapiens
ccaggacttggggtc

SEQ ID NO: 318775 - DNA, 23 bp, Homo sapiens
ccaggagaaccactacatgcagc

SEQ ID NO: 318776 - DNA, 12 bp, Homo sapiens
ccaggagaccct

SEQ ID NO: 318777 - DNA, 16 bp, Homo sapiens
ccaggagaccctgtct

SEQ ID NO: 318778 - DNA, 15 bp, Homo sapiens
ccaggagaccttcca

SEQ ID NO: 318779 - DNA, 24 bp, Homo sapiens
ccaggagagcccccaccagcagca

SEQ ID NO: 318780 - DNA, 14 bp, Homo sapiens
ccaggagattacaa

SEQ ID NO: 318781 - DNA, 15 bp, Homo sapiens
ccaggagcaatggga

SEQ ID NO: 318782 - DNA, 16 bp, Homo sapiens
ccaggagcaatgggac

SEQ ID NO: 318783 - DNA, 17 bp, Homo sapiens
ccaggagcaatgggact

SEQ ID NO: 318784 - DNA, 22 bp, Homo sapiens
ccaggagcaggacctactagga

SEQ ID NO: 318785 - DNA, 11 bp, Homo sapiens
ccaggagccag

SEQ ID NO: 318786 - DNA, 14 bp, Homo sapiens
ccaggagccaggtg

SEQ ID NO: 318787 - DNA, 16 bp, Homo sapiens
ccaggagccaggtgtc

SEQ ID NO: 318788 - DNA, 14 bp, Homo sapiens
ccaggagccccagc

SEQ ID NO: 318789 - DNA, 16 bp, Homo sapiens
ccaggagccccagcca

SEQ ID NO: 318790 - DNA, 17 bp, Homo sapiens
ccaggagccccagccag

SEQ ID NO: 318791 - DNA, 13 bp, Homo sapiens
gaaacttccaaga

SEQ ID NO: 318792 - DNA, 21 bp, Homo sapiens
gaaacttgtaatggtctctga

SEQ ID NO: 318793 - DNA, 19 bp, Homo sapiens
gaaactttgatctctgctt

SEQ ID NO: 318794 - DNA, 18 bp, Homo sapiens
gaaagaaaagaatgtaca

SEQ ID NO: 318795 - DNA, 18 bp, Homo sapiens
gaaagaaaaggaatgcaa

SEQ ID NO: 318796 - DNA, 21 bp, Homo sapiens
gaaagaaagggaaaagggaga

SEQ ID NO: 318797 - DNA, 16 bp, Homo sapiens
gaaagaaataattgtt

SEQ ID NO: 318798 - DNA, 14 bp, Homo sapiens
gaaagaagcactct

SEQ ID NO: 318799 - DNA, 17 bp, Homo sapiens
gaaagaagcactctgct

SEQ ID NO: 318800 - DNA, 17 bp, Homo sapiens
gaaagaatgagaaagaa

SEQ ID NO: 318801 - DNA, 21 bp, Homo sapiens
gaaagaatgagaaagaaaagg

SEQ ID NO: 318802 - DNA, 16 bp, Homo sapiens
gaaagacaaagaagga

SEQ ID NO: 318803 - DNA, 18 bp, Homo sapiens
gaaagacaggaagaccaa

SEQ ID NO: 318804 - DNA, 14 bp, Homo sapiens
gaaagactgaaaga

SEQ ID NO: 318805 - DNA, 14 bp, Homo sapiens
gaaagagaaatgaa

SEQ ID NO: 318806 - DNA, 13 bp, Homo sapiens
gaaagagagaacc

SEQ ID NO: 318807 - DNA, 13 bp, Homo sapiens
gaaagagagtacc

SEQ ID NO: 318808 - DNA, 17 bp, Homo sapiens
gaaagagctgttttgga

SEQ ID NO: 318809 - DNA, 21 bp, Homo sapiens
gaaagaggagaaggagaggga

SEQ ID NO: 318810 - DNA, 22 bp, Homo sapiens
gaaagaggctgaggcctggact

SEQ ID NO: 318811 - DNA, 19 bp, Homo sapiens
gaaatttaaaaatctttca

SEQ ID NO: 318812 - DNA, 20 bp, Homo sapiens
gaaatttacagttactgcct

SEQ ID NO: 318813 - DNA, 19 bp, Homo sapiens
gaaatttatttccatctag

SEQ ID NO: 318814 - DNA, 14 bp, Homo sapiens
gaaatttgatttct

SEQ ID NO: 318815 - DNA, 21 bp, Homo sapiens
gaaatttgatttctattcaag

SEQ ID NO: 318816 - DNA, 15 bp, Homo sapiens
gaaattttacaatag

SEQ ID NO: 318817 - DNA, 18 bp, Homo sapiens
gaaatttttaaatcattt

SEQ ID NO: 318818 - DNA, 17 bp, Homo sapiens
gaaatttttatttttct

SEQ ID NO: 318819 - DNA, 21 bp, Homo sapiens
gaacaaagaacggcatgtgaa

SEQ ID NO: 318820 - DNA, 22 bp, Homo sapiens
gaacaaagaacggcatgtgaat

SEQ ID NO: 318821 - DNA, 18 bp, Homo sapiens
gaacaaagaccaatgtga

SEQ ID NO: 318822 - DNA, 23 bp, Homo sapiens
gaacaagtgcctcctggactgtt

SEQ ID NO: 318823 - DNA, 15 bp, Homo sapiens
gaacaagtgtacaga

SEQ ID NO: 318824 - DNA, 17 bp, Homo sapiens
gaacaagtgtacagaag

SEQ ID NO: 318825 - DNA, 19 bp, Homo sapiens
gaacaagtgtacagaagaa

SEQ ID NO: 318826 - DNA, 19 bp, Homo sapiens
gaacaatcacaaaagctgt

SEQ ID NO: 318827 - DNA, 23 bp, Homo sapiens
gaacaatcacaaaagctgtgtct

SEQ ID NO: 318828 - DNA, 14 bp, Homo sapiens
gaacaatcactatt

SEQ ID NO: 318829 - DNA, 11 bp, Homo sapiens
gaacacacaca

SEQ ID NO: 318830 - DNA, 20 bp, Homo sapiens
gaacacactcagcagccccc

SEQ ID NO: 318831 - DNA, 16 bp, Homo sapiens
gaacacccagccccag

SEQ ID NO: 318832 - DNA, 22 bp, Homo sapiens
gaacaccccgctctggcagtag

SEQ ID NO: 318833 - DNA, 11 bp, Homo sapiens
gaacacctggc

SEQ ID NO: 318834 - DNA, 19 bp, Homo sapiens
gaacactaaagagctagga

SEQ ID NO: 318835 - DNA, 23 bp, Homo sapiens
gaacagaaaacaacaaaaaataa

SEQ ID NO: 318836 - DNA, 14 bp, Homo sapiens
gaacagatggctgt

SEQ ID NO: 318837 - DNA, 16 bp, Homo sapiens
gaacagccctcggcct

SEQ ID NO: 318838 - DNA, 14 bp, Homo sapiens
gaacagcgggagac

SEQ ID NO: 318839 - DNA, 21 bp, Homo sapiens
gaacagctatgggagccccag

SEQ ID NO: 318840 - DNA, 19 bp, Homo sapiens
gaacagctgttcctgtgtt

SEQ ID NO: 318841 - DNA, 15 bp, Homo sapiens
gaacaggaggaactg

SEQ ID NO: 318842 - DNA, 19 bp, Homo sapiens
gaacagggcccaggcctgg

SEQ ID NO: 318843 - DNA, 21 bp, Homo sapiens
gaacagggcccaggcctggag

SEQ ID NO: 318844 - DNA, 14 bp, Homo sapiens
gaacagtggctggg

SEQ ID NO: 318845 - DNA, 18 bp, Homo sapiens
gaacagtggctgggtggg

SEQ ID NO: 318846 - DNA, 14 bp, Homo sapiens
gaacagtgtttccc

SEQ ID NO: 318847 - DNA, 15 bp, Homo sapiens
gaacagtttggatgt

SEQ ID NO: 318848 - DNA, 19 bp, Homo sapiens
gaacatctgccttgctgca

SEQ ID NO: 318849 - DNA, 21 bp, Homo sapiens
gaacatctgccttgctgcacc

SEQ ID NO: 318850 - DNA, 12 bp, Homo sapiens
gaacatcttcat

SEQ ID NO: 318851 - DNA, 13 bp, Homo sapiens
gaacatcttcata

SEQ ID NO: 318852 - DNA, 18 bp, Homo sapiens
gaacatcttcatataaac

SEQ ID NO: 318853 - DNA, 23 bp, Homo sapiens
gaacatggccaatagtcatatgt

SEQ ID NO: 318854 - DNA, 20 bp, Homo sapiens
gaacatggtgtgtgtctctg

SEQ ID NO: 318855 - DNA, 19 bp, Homo sapiens
gaacatgtcggagtagaaa

SEQ ID NO: 318856 - DNA, 13 bp, Homo sapiens
gaacatttctcat

SEQ ID NO: 318857 - DNA, 15 bp, Homo sapiens
gaaccaaaacattcc

SEQ ID NO: 318858 - DNA, 16 bp, Homo sapiens
gaaccaaaacattccg

SEQ ID NO: 318859 - DNA, 21 bp, Homo sapiens
gaaccaacgggtctgtgggac

SEQ ID NO: 318860 - DNA, 14 bp, Homo sapiens
gaaccaagcttgtc

SEQ ID NO: 318861 - DNA, 22 bp, Homo sapiens
gaaccaaggcagcctccagagc

SEQ ID NO: 318862 - DNA, 12 bp, Homo sapiens
gaaccagagcca

SEQ ID NO: 318863 - DNA, 19 bp, Homo sapiens
gaaccagagccatggactc

SEQ ID NO: 318864 - DNA, 23 bp, Homo sapiens
gaaccagagccatggactctaca

SEQ ID NO: 318865 - DNA, 13 bp, Homo sapiens
gaaccagcactcc

SEQ ID NO: 318866 - DNA, 19 bp, Homo sapiens
gaaccagcactcccagggc

SEQ ID NO: 318867 - DNA, 23 bp, Homo sapiens
gaaccagcactcccagggcccga

SEQ ID NO: 318868 - DNA, 18 bp, Homo sapiens
gaaccagccctccagagc

SEQ ID NO: 318869 - DNA, 16 bp, Homo sapiens
gaaccagggaggagag

SEQ ID NO: 318870 - DNA, 18 bp, Homo sapiens
gaaccagtgtctgaacca

SEQ ID NO: 318871 - DNA, 18 bp, Homo sapiens
gaaccccaactcccagcc

SEQ ID NO: 318872 - DNA, 16 bp, Homo sapiens
gaaccccatgggcttg

SEQ ID NO: 318873 - DNA, 19 bp, Homo sapiens
gaaccccatgggcttggac

SEQ ID NO: 318874 - DNA, 16 bp, Homo sapiens
gaaccccccactccct

SEQ ID NO: 318875 - DNA, 17 bp, Homo sapiens
gaaccccccccccccgc

SEQ ID NO: 318876 - DNA, 13 bp, Homo sapiens
gaacccccctccc

SEQ ID NO: 318877 - DNA, 13 bp, Homo sapiens
gaaccccgcagcc

SEQ ID NO: 318878 - DNA, 18 bp, Homo sapiens
gaacccggtcccaggccg

SEQ ID NO: 318879 - DNA, 19 bp, Homo sapiens
gaacccggtcccaggccgc

SEQ ID NO: 318880 - DNA, 23 bp, Homo sapiens
gaacccttctgctttctattacc

SEQ ID NO: 318881 - DNA, 18 bp, Homo sapiens
gaacccttgtgcttggtg

SEQ ID NO: 318882 - DNA, 17 bp, Homo sapiens
gaacccttttggccccc

SEQ ID NO: 318883 - DNA, 21 bp, Homo sapiens
gaaccgagcaaagatcaaaat

SEQ ID NO: 318884 - DNA, 23 bp, Homo sapiens
gaaccgagcaaagatcaaaataa

SEQ ID NO: 318885 - DNA, 20 bp, Homo sapiens
gaacctagtactctctgctc

SEQ ID NO: 318886 - DNA, 20 bp, Homo sapiens
gaacctccctgggcctgtct

SEQ ID NO: 318887 - DNA, 22 bp, Homo sapiens
gaacctcgttgacatgcacagt

SEQ ID NO: 318888 - DNA, 13 bp, Homo sapiens
gaacctcttcccc

SEQ ID NO: 318889 - DNA, 17 bp, Homo sapiens
gaacctgacgtagctgc

SEQ ID NO: 318890 - DNA, 13 bp, Homo sapiens
gaacctggctgcg

SEQ ID NO: 318891 - DNA, 22 bp, Homo sapiens
gaacgaggggaaagttctcaga

SEQ ID NO: 318892 - DNA, 15 bp, Homo sapiens
gaacgccagtctccc

SEQ ID NO: 318893 - DNA, 14 bp, Homo sapiens
gaacgcgtgtgtgc

SEQ ID NO: 318894 - DNA, 14 bp, Homo sapiens
gaacgggcctcccc

SEQ ID NO: 318895 - DNA, 14 bp, Homo sapiens
gaacgtctctcacc

SEQ ID NO: 318896 - DNA, 21 bp, Homo sapiens
gaacgtggttcagagactggc

SEQ ID NO: 318897 - DNA, 21 bp, Homo sapiens
gaacgtttctggcctgggttt

SEQ ID NO: 318898 - DNA, 19 bp, Homo sapiens
gaacgttttaataattttt

SEQ ID NO: 318899 - DNA, 22 bp, Homo sapiens
gaactaaatagatttttagatt

SEQ ID NO: 318900 - DNA, 18 bp, Homo sapiens
gaactaacagaggagaaa

SEQ ID NO: 318901 - DNA, 21 bp, Homo sapiens
gaactaagttttgtgtgtata

SEQ ID NO: 318902 - DNA, 17 bp, Homo sapiens
gaactatgggagcctca

SEQ ID NO: 318903 - DNA, 23 bp, Homo sapiens
gaactcaaaaggagaactgtgct

SEQ ID NO: 318904 - DNA, 19 bp, Homo sapiens
gaactcaaaggactgacct

SEQ ID NO: 318905 - DNA, 16 bp, Homo sapiens
gaactcaccgctcacc

SEQ ID NO: 318906 - DNA, 19 bp, Homo sapiens
gaactcaccgctcaccctc

SEQ ID NO: 318907 - DNA, 12 bp, Homo sapiens
gaactccactct

SEQ ID NO: 318908 - DNA, 18 bp, Homo sapiens
gaactccactctccttcg

SEQ ID NO: 318909 - DNA, 14 bp, Homo sapiens
gaactcccaagaac

SEQ ID NO: 318910 - DNA, 21 bp, Homo sapiens
gaactcccaagaacagcaggc

SEQ ID NO: 318911 - DNA, 14 bp, Homo sapiens
gaactcctgggctc

SEQ ID NO: 318912 - DNA, 21 bp, Homo sapiens
gaactccttggcctagcccac

SEQ ID NO: 318913 - DNA, 12 bp, Homo sapiens
gaactcgatgca

SEQ ID NO: 318914 - DNA, 18 bp, Homo sapiens
gaactctaccctggtagg

SEQ ID NO: 318915 - DNA, 20 bp, Homo sapiens
gaactctaccctggtaggaa

SEQ ID NO: 318916 - DNA, 19 bp, Homo sapiens
gaactctatctgggcctgg

SEQ ID NO: 318917 - DNA, 22 bp, Homo sapiens
gaactctcaaaagtctattttt

SEQ ID NO: 318918 - DNA, 16 bp, Homo sapiens
gaactctcctgctcct

SEQ ID NO: 318919 - DNA, 16 bp, Homo sapiens
gaactctctgtcttct

SEQ ID NO: 318920 - DNA, 20 bp, Homo sapiens
gaactctctgtcttctctcc

SEQ ID NO: 318921 - DNA, 17 bp, Homo sapiens
gaactgaccccctcccc

SEQ ID NO: 318922 - DNA, 17 bp, Homo sapiens
gaactgactttctcccc

SEQ ID NO: 318923 - DNA, 19 bp, Homo sapiens
gaactgagctcctctgggc

SEQ ID NO: 318924 - DNA, 16 bp, Homo sapiens
gaactgatgacactga

SEQ ID NO: 318925 - DNA, 14 bp, Homo sapiens
gaactgcatggacc

SEQ ID NO: 318926 - DNA, 15 bp, Homo sapiens
gaactgcatggacct

SEQ ID NO: 318927 - DNA, 12 bp, Homo sapiens
gaactgccccat

SEQ ID NO: 318928 - DNA, 18 bp, Homo sapiens
gaactgccccatctcctc

SEQ ID NO: 318929 - DNA, 18 bp, Homo sapiens
gaactgctaccatgaagt

SEQ ID NO: 318930 - DNA, 21 bp, Homo sapiens
gaactgctgccatgattttgg

SEQ ID NO: 318931 - DNA, 15 bp, Homo sapiens
gaactgctgctggtc

SEQ ID NO: 318932 - DNA, 18 bp, Homo sapiens
gaactgcttgcatttctt

SEQ ID NO: 318933 - DNA, 19 bp, Homo sapiens
gaactgcttgcatttcttt

SEQ ID NO: 318934 - DNA, 20 bp, Homo sapiens
gaactgcttgcatttcttta

SEQ ID NO: 318935 - DNA, 17 bp, Homo sapiens
gaactgggaagatgctg

SEQ ID NO: 318936 - DNA, 17 bp, Homo sapiens
gaactgtgcctttgagt

SEQ ID NO: 318937 - DNA, 16 bp, Homo sapiens
gaactgttagatgctg

SEQ ID NO: 318938 - DNA, 16 bp, Homo sapiens
gaactgttctcatgga

SEQ ID NO: 318939 - DNA, 20 bp, Homo sapiens
gaactgttgtttgatgtgta

SEQ ID NO: 318940 - DNA, 17 bp, Homo sapiens
gaagcttattaatgcta

SEQ ID NO: 318941 - DNA, 19 bp, Homo sapiens
gaagcttattaatgctaag

SEQ ID NO: 318942 - DNA, 21 bp, Homo sapiens
gaagcttattaatgctaaggg

SEQ ID NO: 318943 - DNA, 22 bp, Homo sapiens
gaagcttattaatgctaagggc

SEQ ID NO: 318944 - DNA, 23 bp, Homo sapiens
gaagcttattaatgctaagggca

SEQ ID NO: 318945 - DNA, 18 bp, Homo sapiens
gaagcttcttgctcctgt

SEQ ID NO: 318946 - DNA, 16 bp, Homo sapiens
gaagcttgagcctccc

SEQ ID NO: 318947 - DNA, 15 bp, Homo sapiens
gaagctttctctgct

SEQ ID NO: 318948 - DNA, 16 bp, Homo sapiens
gaaggaaaaggctggc

SEQ ID NO: 318949 - DNA, 20 bp, Homo sapiens
gaaggaaagcatgtctctgc

SEQ ID NO: 318950 - DNA, 22 bp, Homo sapiens
gaaggaacccggtcccaggccg

SEQ ID NO: 318951 - DNA, 21 bp, Homo sapiens
gaaggaagatcttgagagctg

SEQ ID NO: 318952 - DNA, 15 bp, Homo sapiens
gaaggaatagccaga

SEQ ID NO: 318953 - DNA, 23 bp, Homo sapiens
gaaggaccaacccatgccctgcc

SEQ ID NO: 318954 - DNA, 17 bp, Homo sapiens
gaaggacctatgtttgc

SEQ ID NO: 318955 - DNA, 16 bp, Homo sapiens
gaaggagagaagggga

SEQ ID NO: 318956 - DNA, 20 bp, Homo sapiens
gaaggagagaaggggaggag

SEQ ID NO: 318957 - DNA, 15 bp, Homo sapiens
gaaggagagcctgct

SEQ ID NO: 318958 - DNA, 16 bp, Homo sapiens
gaaggagagcctgctg

SEQ ID NO: 318959 - DNA, 14 bp, Homo sapiens
gaaggagaggagtg

SEQ ID NO: 318960 - DNA, 12 bp, Homo sapiens
gaaggagaggct

SEQ ID NO: 318961 - DNA, 12 bp, Homo sapiens
gaaggagcctgc

SEQ ID NO: 318962 - DNA, 12 bp, Homo sapiens
gaaggaggaagg

SEQ ID NO: 318963 - DNA, 14 bp, Homo sapiens
gaaggagggagctg

SEQ ID NO: 318964 - DNA, 16 bp, Homo sapiens
gaaggagggagctgct

SEQ ID NO: 318965 - DNA, 16 bp, Homo sapiens
gaaggagggcagagcc

SEQ ID NO: 318966 - DNA, 17 bp, Homo sapiens
gaaggagggcagagcca

SEQ ID NO: 318967 - DNA, 16 bp, Homo sapiens
gaaggaggggaagctg

SEQ ID NO: 318968 - DNA, 15 bp, Homo sapiens
gaaggcaaagcacga

SEQ ID NO: 318969 - DNA, 18 bp, Homo sapiens
gaaggcaaatataagctg

SEQ ID NO: 318970 - DNA, 17 bp, Homo sapiens
gaaggcaagctggcagg

SEQ ID NO: 318971 - DNA, 18 bp, Homo sapiens
gaaggcaagctggcagga

SEQ ID NO: 318972 - DNA, 14 bp, Homo sapiens
gaaggcagctgctc

SEQ ID NO: 318973 - DNA, 15 bp, Homo sapiens
gaaggcagggcagag

SEQ ID NO: 318974 - DNA, 16 bp, Homo sapiens
gaaggcagtctgaacc

SEQ ID NO: 318975 - DNA, 15 bp, Homo sapiens
gaaggccacaggcca

SEQ ID NO: 318976 - DNA, 16 bp, Homo sapiens
gaaggccacctgcagg

SEQ ID NO: 318977 - DNA, 17 bp, Homo sapiens
gaaggccacctgcaggt

SEQ ID NO: 318978 - DNA, 17 bp, Homo sapiens
gaaggccatcatctctg

SEQ ID NO: 318979 - DNA, 22 bp, Homo sapiens
gaaggccatcatctctgtaaac

SEQ ID NO: 318980 - DNA, 23 bp, Homo sapiens
gaaggcccaagagcagagtctgg

SEQ ID NO: 318981 - DNA, 22 bp, Homo sapiens
gaaggcctgagggaagcccacc

SEQ ID NO: 318982 - DNA, 17 bp, Homo sapiens
gaaggcctgcccccctt

SEQ ID NO: 318983 - DNA, 18 bp, Homo sapiens
gaaggcctgccccccttc

SEQ ID NO: 318984 - DNA, 18 bp, Homo sapiens
gaaggccttgctgtcatg

SEQ ID NO: 318985 - DNA, 15 bp, Homo sapiens
gaaggccttgttaaa

SEQ ID NO: 318986 - DNA, 17 bp, Homo sapiens
gaaggctctcaccccca

SEQ ID NO: 318987 - DNA, 14 bp, Homo sapiens
gaaggctggctgag

SEQ ID NO: 318988 - DNA, 17 bp, Homo sapiens
gaaggctttcagggcct

SEQ ID NO: 318989 - DNA, 24 bp, Homo sapiens
gaaggctttcagggcctccagccc

SEQ ID NO: 318990 - DNA, 17 bp, Homo sapiens
gaaggcttttggtctcc

SEQ ID NO: 318991 - DNA, 11 bp, Homo sapiens
gaagggaaatt

SEQ ID NO: 318992 - DNA, 15 bp, Homo sapiens
gaagggaagaaaagg

SEQ ID NO: 318993 - DNA, 23 bp, Homo sapiens
gaagggagagttctttgctgccc

SEQ ID NO: 318994 - DNA, 19 bp, Homo sapiens
gaagggcatccttctgcct

SEQ ID NO: 318995 - DNA, 10 bp, Homo sapiens
gaagggccag

SEQ ID NO: 318996 - DNA, 17 bp, Homo sapiens
gaagggccagagcctgg

SEQ ID NO: 318997 - DNA, 14 bp, Homo sapiens
gaagggccagtcct

SEQ ID NO: 318998 - DNA, 18 bp, Homo sapiens
gaagggccagtcctgcct

SEQ ID NO: 318999 - DNA, 22 bp, Homo sapiens
gaagggccagtcctgcctggcc

SEQ ID NO: 319000 - DNA, 19 bp, Homo sapiens
gaagggccagtctgggctg

SEQ ID NO: 319001 - DNA, 20 bp, Homo sapiens
gaagggccagtctgggctgc

SEQ ID NO: 319002 - DNA, 20 bp, Homo sapiens
gaagggcgctgagggcaggg

SEQ ID NO: 319003 - DNA, 13 bp, Homo sapiens
gaaggggcacacc

SEQ ID NO: 319004 - DNA, 23 bp, Homo sapiens
gaaggggcacaccactgccctgc

SEQ ID NO: 319005 - DNA, 21 bp, Homo sapiens
gaaggggccccggggctggca

SEQ ID NO: 319006 - DNA, 22 bp, Homo sapiens
gaaggggccccggggctggcaa

SEQ ID NO: 319007 - DNA, 23 bp, Homo sapiens
gaaggggccccggggctggcaag

SEQ ID NO: 319008 - DNA, 14 bp, Homo sapiens
gaagggggccatga

SEQ ID NO: 319009 - DNA, 18 bp, Homo sapiens
gaaggggggttgcagtgg

SEQ ID NO: 319010 - DNA, 14 bp, Homo sapiens
gaagggtccttccc

SEQ ID NO: 319011 - DNA, 15 bp, Homo sapiens
gaagggtttgtggct

SEQ ID NO: 319012 - DNA, 17 bp, Homo sapiens
gaaggtcacctgagccc

SEQ ID NO: 319013 - DNA, 19 bp, Homo sapiens
gaaggtgaccgcccagctc

SEQ ID NO: 319014 - DNA, 13 bp, Homo sapiens
gaaggtgcccagg

SEQ ID NO: 319015 - DNA, 20 bp, Homo sapiens
gaaggtgccgtgagcaggct

SEQ ID NO: 319016 - DNA, 15 bp, Homo sapiens
gaaggtgctgagctt

SEQ ID NO: 319017 - DNA, 14 bp, Homo sapiens
gaaggtgtgctaca

SEQ ID NO: 319018 - DNA, 20 bp, Homo sapiens
gaaggttaggatttaacagt

SEQ ID NO: 319019 - DNA, 12 bp, Homo sapiens
gaaggttgtaag

SEQ ID NO: 319020 - DNA, 21 bp, Homo sapiens
gaagtaagagctaagttctaa

SEQ ID NO: 319021 - DNA, 22 bp, Homo sapiens
gaagtaagcagagttctttgca

SEQ ID NO: 319022 - DNA, 17 bp, Homo sapiens
gaagtaagttctgaaaa

SEQ ID NO: 319023 - DNA, 22 bp, Homo sapiens
gaagtaagttctgaaaactgtt

SEQ ID NO: 319024 - DNA, 16 bp, Homo sapiens
gaagtacagtcccagc

SEQ ID NO: 319025 - DNA, 14 bp, Homo sapiens
gaagtactttgtgc

SEQ ID NO: 319026 - DNA, 16 bp, Homo sapiens
gaagtagagaacccag

SEQ ID NO: 319027 - DNA, 19 bp, Homo sapiens
gaagtagatgtgaaaaagc

SEQ ID NO: 319028 - DNA, 13 bp, Homo sapiens
gaagtatccaatt

SEQ ID NO: 319029 - DNA, 21 bp, Homo sapiens
gaagtatccaattatgtgaca

SEQ ID NO: 319030 - DNA, 23 bp, Homo sapiens
gaagtatccaattatgtgacaac

SEQ ID NO: 319031 - DNA, 15 bp, Homo sapiens
gaagtcaaacatttc

SEQ ID NO: 319032 - DNA, 20 bp, Homo sapiens
gaagtcactcaattgttttt

SEQ ID NO: 319033 - DNA, 19 bp, Homo sapiens
gaagtcagagaaaacactt

SEQ ID NO: 319034 - DNA, 20 bp, Homo sapiens
gaagtcagcccgaatgcctg

SEQ ID NO: 319035 - DNA, 12 bp, Homo sapiens
gaagtcaggagc

SEQ ID NO: 319036 - DNA, 15 bp, Homo sapiens
gaagtcaggagccag

SEQ ID NO: 319037 - DNA, 16 bp, Homo sapiens
gaagtcaggagccagc

SEQ ID NO: 319038 - DNA, 18 bp, Homo sapiens
gaagtcaggagccagcag

SEQ ID NO: 319039 - DNA, 15 bp, Homo sapiens
gaagtcatcataaaa

SEQ ID NO: 319040 - DNA, 15 bp, Homo sapiens
gaagtccaggcagag

SEQ ID NO: 319041 - DNA, 14 bp, Homo sapiens
gaagtcccttcctg

SEQ ID NO: 319042 - DNA, 19 bp, Homo sapiens
gaagtcccttcctgtcctg

SEQ ID NO: 319043 - DNA, 18 bp, Homo sapiens
gaagtcccttgccatcct

SEQ ID NO: 319044 - DNA, 22 bp, Homo sapiens
gaagtcctccctcctgcaggct

SEQ ID NO: 319045 - DNA, 22 bp, Homo sapiens
gaagtccttcagtgagcccctc

SEQ ID NO: 319046 - DNA, 20 bp, Homo sapiens
gaagtctgcttaccaaaaca

SEQ ID NO: 319047 - DNA, 21 bp, Homo sapiens
gaagtctgcttaccaaaacat

SEQ ID NO: 319048 - DNA, 20 bp, Homo sapiens
gaagtcttccatcagcagtg

SEQ ID NO: 319049 - DNA, 15 bp, Homo sapiens
gaagtcttgcattga

SEQ ID NO: 319050 - DNA, 14 bp, Homo sapiens
gaagtgaacatttc

SEQ ID NO: 319051 - DNA, 16 bp, Homo sapiens
gaagtgaatacatggt

SEQ ID NO: 319052 - DNA, 17 bp, Homo sapiens
gaagtgaatgggaaagg

SEQ ID NO: 319053 - DNA, 19 bp, Homo sapiens
gaagtgaatgggaaagggt

SEQ ID NO: 319054 - DNA, 16 bp, Homo sapiens
gaagtgacaagatgct

SEQ ID NO: 319055 - DNA, 18 bp, Homo sapiens
gaagtgacaaggccccag

SEQ ID NO: 319056 - DNA, 23 bp, Homo sapiens
gaagtgacaaggccccagagact

SEQ ID NO: 319057 - DNA, 17 bp, Homo sapiens
gaagtgacttgaatgta

SEQ ID NO: 319058 - DNA, 21 bp, Homo sapiens
gaagtgataacactggagtgg

SEQ ID NO: 319059 - DNA, 23 bp, Homo sapiens
gaagtgcatttctgaatagaaat

SEQ ID NO: 319060 - DNA, 18 bp, Homo sapiens
gaagtgcccctgctgcct

SEQ ID NO: 319061 - DNA, 22 bp, Homo sapiens
gaagtgcccctgctgcctcccc

SEQ ID NO: 319062 - DNA, 23 bp, Homo sapiens
gaagtgcccctgctgcctcccca

SEQ ID NO: 319063 - DNA, 20 bp, Homo sapiens
gaagtggcccctcgtgacct

SEQ ID NO: 319064 - DNA, 12 bp, Homo sapiens
gaagtgggagaa

SEQ ID NO: 319065 - DNA, 20 bp, Homo sapiens
gaagtgggagaagtggcccc

SEQ ID NO: 319066 - DNA, 21 bp, Homo sapiens
gaagtgggagtgggagaggaa

SEQ ID NO: 319067 - DNA, 21 bp, Homo sapiens
gaagtgggattcaggaatggg

SEQ ID NO: 319068 - DNA, 22 bp, Homo sapiens
gaagtgggattcaggaatgggc

SEQ ID NO: 319069 - DNA, 16 bp, Homo sapiens
gacaaggccccagaga

SEQ ID NO: 319070 - DNA, 13 bp, Homo sapiens
gacaagggattct

SEQ ID NO: 319071 - DNA, 15 bp, Homo sapiens
gacaagggattctgg

SEQ ID NO: 319072 - DNA, 20 bp, Homo sapiens
gacaagtgctgaacagtgga

SEQ ID NO: 319073 - DNA, 12 bp, Homo sapiens
gacaataaataa

SEQ ID NO: 319074 - DNA, 20 bp, Homo sapiens
gacaatcatgaaatatgcat

SEQ ID NO: 319075 - DNA, 17 bp, Homo sapiens
gacaatgcgtggcacat

SEQ ID NO: 319076 - DNA, 15 bp, Homo sapiens
gacaatggcaatagg

SEQ ID NO: 319077 - DNA, 13 bp, Homo sapiens
gacaatggcagct

SEQ ID NO: 319078 - DNA, 15 bp, Homo sapiens
gacaatggcagctag

SEQ ID NO: 319079 - DNA, 21 bp, Homo sapiens
gacaatggcagctagactgga

SEQ ID NO: 319080 - DNA, 17 bp, Homo sapiens
gacaatggctatattaa

SEQ ID NO: 319081 - DNA, 21 bp, Homo sapiens
gacaatgtcgagtatattatt

SEQ ID NO: 319082 - DNA, 19 bp, Homo sapiens
ctggccgagggtcctggct

SEQ ID NO: 319083 - DNA, 21 bp, Homo sapiens
ctggccgagggtcctggctcc

SEQ ID NO: 319084 - DNA, 15 bp, Homo sapiens
ctggccgctgggaga

SEQ ID NO: 319085 - DNA, 19 bp, Homo sapiens
ctggccgggtcaccctgtg

SEQ ID NO: 319086 - DNA, 22 bp, Homo sapiens
ctggccgggtcaccctgtgacc

SEQ ID NO: 319087 - DNA, 16 bp, Homo sapiens
ctggccggtccacccc

SEQ ID NO: 319088 - DNA, 17 bp, Homo sapiens
ctggccggtccaccccg

SEQ ID NO: 319089 - DNA, 18 bp, Homo sapiens
ctggccggtccaccccgt

SEQ ID NO: 319090 - DNA, 21 bp, Homo sapiens
ctggcctagtggggaggggcc

SEQ ID NO: 319091 - DNA, 22 bp, Homo sapiens
ctggcctagtggggaggggcct

SEQ ID NO: 319092 - DNA, 23 bp, Homo sapiens
ctggcctagtggggaggggcctg

SEQ ID NO: 319093 - DNA, 12 bp, Homo sapiens
ctggcctattta

SEQ ID NO: 319094 - DNA, 15 bp, Homo sapiens
ctggcctatttaagc

SEQ ID NO: 319095 - DNA, 17 bp, Homo sapiens
ctggcctatttaagccc

SEQ ID NO: 319096 - DNA, 16 bp, Homo sapiens
ctggcctcactggctg

SEQ ID NO: 319097 - DNA, 21 bp, Homo sapiens
ctggcctcactggctggggca

SEQ ID NO: 319098 - DNA, 12 bp, Homo sapiens
ctggcctcagac

SEQ ID NO: 319099 - DNA, 22 bp, Homo sapiens
ctggcctcccaataaagctgga

SEQ ID NO: 319100 - DNA, 23 bp, Homo sapiens
ctggcctcccaataaagctggac

SEQ ID NO: 319101 - DNA, 16 bp, Homo sapiens
ctggcctcccctgcgg

SEQ ID NO: 319102 - DNA, 17 bp, Homo sapiens
ctggcctcccctgcgga

SEQ ID NO: 319103 - DNA, 17 bp, Homo sapiens
ctggcctccttttgctg

SEQ ID NO: 319104 - DNA, 12 bp, Homo sapiens
ctggcctcttcc

SEQ ID NO: 319105 - DNA, 17 bp, Homo sapiens
ctggcctgagctggggc

SEQ ID NO: 319106 - DNA, 11 bp, Homo sapiens
ctggcctgcca

SEQ ID NO: 319107 - DNA, 16 bp, Homo sapiens
ctggcctgccaggctc

SEQ ID NO: 319108 - DNA, 22 bp, Homo sapiens
ctggcctggatctccccactct

SEQ ID NO: 319109 - DNA, 13 bp, Homo sapiens
ctggcctggccct

SEQ ID NO: 319110 - DNA, 19 bp, Homo sapiens
ctggcctggccctgccctg

SEQ ID NO: 319111 - DNA, 21 bp, Homo sapiens
ctggcctggccctgccctgag

SEQ ID NO: 319112 - DNA, 14 bp, Homo sapiens
ctggcctggcctgg

SEQ ID NO: 319113 - DNA, 17 bp, Homo sapiens
ctggcctggcctggccc

SEQ ID NO: 319114 - DNA, 18 bp, Homo sapiens
ctggcctggcctggccct

SEQ ID NO: 319115 - DNA, 14 bp, Homo sapiens
ctggcctggctccc

SEQ ID NO: 319116 - DNA, 19 bp, Homo sapiens
ctggcctggctccccacga

SEQ ID NO: 319117 - DNA, 18 bp, Homo sapiens
ctggcctgttctgtagga

SEQ ID NO: 319118 - DNA, 16 bp, Homo sapiens
ctggccttcctgccct

SEQ ID NO: 319119 - DNA, 20 bp, Homo sapiens
ctggccttggttcctccagc

SEQ ID NO: 319120 - DNA, 21 bp, Homo sapiens
ctggccttggttcctccagca

SEQ ID NO: 319121 - DNA, 15 bp, Homo sapiens
ctggcctttcctctc

SEQ ID NO: 319122 - DNA, 13 bp, Homo sapiens
ctggccttttcct

SEQ ID NO: 319123 - DNA, 14 bp, Homo sapiens
ctggccttttccta

SEQ ID NO: 319124 - DNA, 14 bp, Homo sapiens
ctggcgagccctta

SEQ ID NO: 319125 - DNA, 17 bp, Homo sapiens
ctggcggcttcctgtcc

SEQ ID NO: 319126 - DNA, 18 bp, Homo sapiens
ctggcggcttcctgtcca

SEQ ID NO: 319127 - DNA, 22 bp, Homo sapiens
ctggcgggcagcccctgctgga

SEQ ID NO: 319128 - DNA, 22 bp, Homo sapiens
ctggcgtctgtcttcaagggct

SEQ ID NO: 319129 - DNA, 16 bp, Homo sapiens
ctggctacatcccagc

SEQ ID NO: 319130 - DNA, 14 bp, Homo sapiens
ctggctagaggaca

SEQ ID NO: 319131 - DNA, 17 bp, Homo sapiens
ctggctagagtcctcac

SEQ ID NO: 319132 - DNA, 19 bp, Homo sapiens
ctggctagagtcctcactc

SEQ ID NO: 319133 - DNA, 12 bp, Homo sapiens
ctggctcacaga

SEQ ID NO: 319134 - DNA, 18 bp, Homo sapiens
ctggctcacagactggag

SEQ ID NO: 319135 - DNA, 19 bp, Homo sapiens
ctggctcacagactggaga

SEQ ID NO: 319136 - DNA, 16 bp, Homo sapiens
ctggctcacagccacc

SEQ ID NO: 319137 - DNA, 18 bp, Homo sapiens
ctggctcacagccaccac

SEQ ID NO: 319138 - DNA, 20 bp, Homo sapiens
ctggctcatattcctgcagc

SEQ ID NO: 319139 - DNA, 22 bp, Homo sapiens
ctggctcatattcctgcagcct

SEQ ID NO: 319140 - DNA, 22 bp, Homo sapiens
ctggctccacgccctggggagt

SEQ ID NO: 319141 - DNA, 15 bp, Homo sapiens
ctggctccaggctcc

SEQ ID NO: 319142 - DNA, 16 bp, Homo sapiens
ctggctccaggctcca

SEQ ID NO: 319143 - DNA, 22 bp, Homo sapiens
ctggctccaggctccaggctga

SEQ ID NO: 319144 - DNA, 15 bp, Homo sapiens
ctggctcccaaggga

SEQ ID NO: 319145 - DNA, 19 bp, Homo sapiens
ctggctcccacaggccctt

SEQ ID NO: 319146 - DNA, 14 bp, Homo sapiens
ctggctcccagggc

SEQ ID NO: 319147 - DNA, 15 bp, Homo sapiens
ctggctccccaaagg

SEQ ID NO: 319148 - DNA, 16 bp, Homo sapiens
ctggctccccacgagt

SEQ ID NO: 319149 - DNA, 21 bp, Homo sapiens
ctggctccccacgagtcacct

SEQ ID NO: 319150 - DNA, 23 bp, Homo sapiens
ctggctccccacgagtcacctgc

SEQ ID NO: 319151 - DNA, 16 bp, Homo sapiens
ctggctcctgaggggc

SEQ ID NO: 319152 - DNA, 18 bp, Homo sapiens
ctggctcggacccacccc

SEQ ID NO: 319153 - DNA, 19 bp, Homo sapiens
ctggctcggacccacccca

SEQ ID NO: 319154 - DNA, 15 bp, Homo sapiens
ctggctctgtggctt

SEQ ID NO: 319155 - DNA, 13 bp, Homo sapiens
ctggctgaaaatg

SEQ ID NO: 319156 - DNA, 15 bp, Homo sapiens
ctggctgaggcttgg

SEQ ID NO: 319157 - DNA, 13 bp, Homo sapiens
ctggctgcacagc

SEQ ID NO: 319158 - DNA, 17 bp, Homo sapiens
ctggctgcacagcccaa

SEQ ID NO: 319159 - DNA, 13 bp, Homo sapiens
ctggctgccaggc

SEQ ID NO: 319160 - DNA, 15 bp, Homo sapiens
ctggctgccaggcgt

SEQ ID NO: 319161 - DNA, 16 bp, Homo sapiens
ctggctgccaggcgtt

SEQ ID NO: 319162 - DNA, 18 bp, Homo sapiens
ctggctgcccagacccct

SEQ ID NO: 319163 - DNA, 16 bp, Homo sapiens
ctggctgccccaacct

SEQ ID NO: 319164 - DNA, 19 bp, Homo sapiens
ctggctgccccaacctgct

SEQ ID NO: 319165 - DNA, 20 bp, Homo sapiens
ctggctgccccaacctgctg

SEQ ID NO: 319166 - DNA, 13 bp, Homo sapiens
ctggctgcctggc

SEQ ID NO: 319167 - DNA, 19 bp, Homo sapiens
ctggctgcctggcccaggg

SEQ ID NO: 319168 - DNA, 19 bp, Homo sapiens
ctggctgccttagaacctt

SEQ ID NO: 319169 - DNA, 14 bp, Homo sapiens
ctggctggggatgg

SEQ ID NO: 319170 - DNA, 22 bp, Homo sapiens
ctggctgggggcctcactccag

SEQ ID NO: 319171 - DNA, 20 bp, Homo sapiens
ctggctgggtcgcccctcct

SEQ ID NO: 319172 - DNA, 13 bp, Homo sapiens
ctggctgggttca

SEQ ID NO: 319173 - DNA, 17 bp, Homo sapiens
ctggctgggttcaggtc

SEQ ID NO: 319174 - DNA, 20 bp, Homo sapiens
ctggctgggttttcaggggc

SEQ ID NO: 319175 - DNA, 19 bp, Homo sapiens
ctggctggtaagggccaag

SEQ ID NO: 319176 - DNA, 21 bp, Homo sapiens
ctggctgtctgcctgtatttt

SEQ ID NO: 319177 - DNA, 16 bp, Homo sapiens
ctggctgtgagcagcc

SEQ ID NO: 319178 - DNA, 11 bp, Homo sapiens
ctggctgtgca

SEQ ID NO: 319179 - DNA, 13 bp, Homo sapiens
ctggctgtgcaca

SEQ ID NO: 319180 - DNA, 22 bp, Homo sapiens
ctggctgtgcacattctccctt

SEQ ID NO: 319181 - DNA, 15 bp, Homo sapiens
ctggctgtgcctccc

SEQ ID NO: 319182 - DNA, 16 bp, Homo sapiens
ctggctgtggaggcct

SEQ ID NO: 319183 - DNA, 17 bp, Homo sapiens
ctggctgtggaggcctg

SEQ ID NO: 319184 - DNA, 19 bp, Homo sapiens
ctggctgtggaggcctgat

SEQ ID NO: 319185 - DNA, 14 bp, Homo sapiens
ctggctgtggcccc

SEQ ID NO: 319186 - DNA, 21 bp, Homo sapiens
ctggctgtggcccctccttct

SEQ ID NO: 319187 - DNA, 18 bp, Homo sapiens
ctggcttcccaggaccct

SEQ ID NO: 319188 - DNA, 16 bp, Homo sapiens
ctggcttctccctgga

SEQ ID NO: 319189 - DNA, 17 bp, Homo sapiens
ctggcttgctccagggt

SEQ ID NO: 319190 - DNA, 19 bp, Homo sapiens
ctggcttgctccagggtct

SEQ ID NO: 319191 - DNA, 22 bp, Homo sapiens
ctggcttgctccagggtcttgg

SEQ ID NO: 319192 - DNA, 20 bp, Homo sapiens
ctggcttgcttgccgagcct

SEQ ID NO: 319193 - DNA, 23 bp, Homo sapiens
ctggcttggccacaacctgaaag

SEQ ID NO: 319194 - DNA, 15 bp, Homo sapiens
ctggctttgtcccac

SEQ ID NO: 319195 - DNA, 15 bp, Homo sapiens
ctggcttttacttta

SEQ ID NO: 319196 - DNA, 16 bp, Homo sapiens
ctggcttttcactgct

SEQ ID NO: 319197 - DNA, 19 bp, Homo sapiens
ctggcttttcactgctggc

SEQ ID NO: 319198 - DNA, 22 bp, Homo sapiens
ctggcttttcactgctggctgc

SEQ ID NO: 319199 - DNA, 17 bp, Homo sapiens
ctggcttttctggctgg

SEQ ID NO: 319200 - DNA, 14 bp, Homo sapiens
ctggctttttccca

SEQ ID NO: 319201 - DNA, 16 bp, Homo sapiens
ctggctttttcccagc

SEQ ID NO: 319202 - DNA, 17 bp, Homo sapiens
ctgggaaagcagagtgg

SEQ ID NO: 319203 - DNA, 17 bp, Homo sapiens
ctgggaaaggacccacc

SEQ ID NO: 319204 - DNA, 21 bp, Homo sapiens
ctgggaaaggacccacccatc

SEQ ID NO: 319205 - DNA, 16 bp, Homo sapiens
ctgggaaaggtgctca

SEQ ID NO: 319206 - DNA, 17 bp, Homo sapiens
ctgggaaaggtgctcaa

SEQ ID NO: 319207 - DNA, 18 bp, Homo sapiens
ctgggaaaggtgctcaaa

SEQ ID NO: 319208 - DNA, 21 bp, Homo sapiens
ctgggaaaggtgctcaaagat

SEQ ID NO: 319209 - DNA, 22 bp, Homo sapiens
ctgggaacccgactgtgaaagt

SEQ ID NO: 319210 - DNA, 21 bp, Homo sapiens
ctgggaactcccaagaacagc

SEQ ID NO: 319211 - DNA, 23 bp, Homo sapiens
ctgggaactcccaagaacagcag

SEQ ID NO: 319212 - DNA, 24 bp, Homo sapiens
ctgggaagataggctctgcacaga

SEQ ID NO: 319213 - DNA, 14 bp, Homo sapiens
ctgggaagatgctg

SEQ ID NO: 319214 - DNA, 15 bp, Homo sapiens
ctgggaagatgctgg

SEQ ID NO: 319215 - DNA, 20 bp, Homo sapiens
ctgggaagcattactttgta

SEQ ID NO: 319216 - DNA, 20 bp, Homo sapiens
ctgctctcctcttgccactg

SEQ ID NO: 319217 - DNA, 21 bp, Homo sapiens
ctgctctcctcttgccactgc

SEQ ID NO: 319218 - DNA, 15 bp, Homo sapiens
ctgctctccttcact

SEQ ID NO: 319219 - DNA, 16 bp, Homo sapiens
ctgctctccttgccct

SEQ ID NO: 319220 - DNA, 14 bp, Homo sapiens
ctgctctctaccca

SEQ ID NO: 319221 - DNA, 22 bp, Homo sapiens
ctgctctgcagcccacagagga

SEQ ID NO: 319222 - DNA, 13 bp, Homo sapiens
ctgctctgcccag

SEQ ID NO: 319223 - DNA, 15 bp, Homo sapiens
ctgctctgcccagag

SEQ ID NO: 319224 - DNA, 17 bp, Homo sapiens
ctgctctgcccagagct

SEQ ID NO: 319225 - DNA, 23 bp, Homo sapiens
ctgctctgcccagagctgggtga

SEQ ID NO: 319226 - DNA, 12 bp, Homo sapiens
ctgctctgcccc

SEQ ID NO: 319227 - DNA, 14 bp, Homo sapiens
ctgctctgcccctt

SEQ ID NO: 319228 - DNA, 17 bp, Homo sapiens
ctgctcttagtgcccgc

SEQ ID NO: 319229 - DNA, 19 bp, Homo sapiens
ctgctcttagtgcccgcct

SEQ ID NO: 319230 - DNA, 21 bp, Homo sapiens
ctgctctttctacatgactgg

SEQ ID NO: 319231 - DNA, 17 bp, Homo sapiens
ctgctctttctctgcca

SEQ ID NO: 319232 - DNA, 18 bp, Homo sapiens
ctgctctttctctgccag

SEQ ID NO: 319233 - DNA, 22 bp, Homo sapiens
ctgctgaaaaccatctggcctg

SEQ ID NO: 319234 - DNA, 18 bp, Homo sapiens
ctgctgaaggaataaatt

SEQ ID NO: 319235 - DNA, 24 bp, Homo sapiens
ctgctgaccttggaggaatgacaa

SEQ ID NO: 319236 - DNA, 13 bp, Homo sapiens
ctgctgagccact

SEQ ID NO: 319237 - DNA, 17 bp, Homo sapiens
ctgctgagccactcgca

SEQ ID NO: 319238 - DNA, 19 bp, Homo sapiens
ctgctgatgtaggagctgg

SEQ ID NO: 319239 - DNA, 21 bp, Homo sapiens
ctgctgatgtaggagctggat

SEQ ID NO: 319240 - DNA, 17 bp, Homo sapiens
ctgctgcaccagagtga

SEQ ID NO: 319241 - DNA, 16 bp, Homo sapiens
ctgctgcatggggtgg

SEQ ID NO: 319242 - DNA, 17 bp, Homo sapiens
ctgctgccaccaaatct

SEQ ID NO: 319243 - DNA, 19 bp, Homo sapiens
ctgctgccaccaaatctgt

SEQ ID NO: 319244 - DNA, 18 bp, Homo sapiens
ctgctgccatgattttgg

SEQ ID NO: 319245 - DNA, 14 bp, Homo sapiens
ctgctgcccacggc

SEQ ID NO: 319246 - DNA, 21 bp, Homo sapiens
ctgctgcccacggccacccac

SEQ ID NO: 319247 - DNA, 15 bp, Homo sapiens
ctgctgcccagcctc

SEQ ID NO: 319248 - DNA, 16 bp, Homo sapiens
ctgctgccccaaagga

SEQ ID NO: 319249 - DNA, 19 bp, Homo sapiens
ctgctgccccaaaggaagc

SEQ ID NO: 319250 - DNA, 16 bp, Homo sapiens
ctgctgccccagctga

SEQ ID NO: 319251 - DNA, 18 bp, Homo sapiens
ctgctgcccccagacccc

SEQ ID NO: 319252 - DNA, 14 bp, Homo sapiens
ctgctgccctccat

SEQ ID NO: 319253 - DNA, 17 bp, Homo sapiens
ctgctgccctccatccc

SEQ ID NO: 319254 - DNA, 17 bp, Homo sapiens
ctgctgccgccactggc

SEQ ID NO: 319255 - DNA, 20 bp, Homo sapiens
ctgctgccgccactggctgt

SEQ ID NO: 319256 - DNA, 14 bp, Homo sapiens
ctgctgccgcctcc

SEQ ID NO: 319257 - DNA, 16 bp, Homo sapiens
ctgctgcctcaggaat

SEQ ID NO: 319258 - DNA, 15 bp, Homo sapiens
ctgctgcctccccaa

SEQ ID NO: 319259 - DNA, 23 bp, Homo sapiens
ctgctgcctccctggggaccagg

SEQ ID NO: 319260 - DNA, 21 bp, Homo sapiens
ctgctgcctgcccgcacagca

SEQ ID NO: 319261 - DNA, 13 bp, Homo sapiens
ctgctgcctgcct

SEQ ID NO: 319262 - DNA, 12 bp, Homo sapiens
ctgctgctcccc

SEQ ID NO: 319263 - DNA, 15 bp, Homo sapiens
ctgctgctccccacc

SEQ ID NO: 319264 - DNA, 16 bp, Homo sapiens
ctgctgctccccaccc

SEQ ID NO: 319265 - DNA, 19 bp, Homo sapiens
ctgctgctccccaccccta

SEQ ID NO: 319266 - DNA, 14 bp, Homo sapiens
ctgctgctcctcgg

SEQ ID NO: 319267 - DNA, 17 bp, Homo sapiens
ctgctgctcctcggcca

SEQ ID NO: 319268 - DNA, 18 bp, Homo sapiens
ctgctgctcctcggccag

SEQ ID NO: 319269 - DNA, 20 bp, Homo sapiens
ctgctgctcctcggccagag

SEQ ID NO: 319270 - DNA, 23 bp, Homo sapiens
ctgctgctcctcggccagagctc

SEQ ID NO: 319271 - DNA, 21 bp, Homo sapiens
ctgctgctcgggaaggcctga

SEQ ID NO: 319272 - DNA, 23 bp, Homo sapiens
ctgctgctcgggaaggcctgagg

SEQ ID NO: 319273 - DNA, 11 bp, Homo sapiens
ctgctgctgat

SEQ ID NO: 319274 - DNA, 15 bp, Homo sapiens
ctgctgctgctgctg

SEQ ID NO: 319275 - DNA, 20 bp, Homo sapiens
ctgctgctgtaactgctgag

SEQ ID NO: 319276 - DNA, 15 bp, Homo sapiens
ctgctgcttcctaac

SEQ ID NO: 319277 - DNA, 17 bp, Homo sapiens
ctgctgcttcctaactt

SEQ ID NO: 319278 - DNA, 15 bp, Homo sapiens
ctgctgctttccttc

SEQ ID NO: 319279 - DNA, 14 bp, Homo sapiens
ctgctggaaaccac

SEQ ID NO: 319280 - DNA, 14 bp, Homo sapiens
ctgctggcacagac

SEQ ID NO: 319281 - DNA, 16 bp, Homo sapiens
ctgctggccaaagtca

SEQ ID NO: 319282 - DNA, 16 bp, Homo sapiens
ctgctggcccagccaa

SEQ ID NO: 319283 - DNA, 11 bp, Homo sapiens
ctgctggcccc

SEQ ID NO: 319284 - DNA, 14 bp, Homo sapiens
ctgctggcccctca

SEQ ID NO: 319285 - DNA, 15 bp, Homo sapiens
ctgctggcccctcac

SEQ ID NO: 319286 - DNA, 16 bp, Homo sapiens
ctgctggcccctcacc

SEQ ID NO: 319287 - DNA, 16 bp, Homo sapiens
ctgctggccgggcaca

SEQ ID NO: 319288 - DNA, 17 bp, Homo sapiens
ctgctggccgggcacag

SEQ ID NO: 319289 - DNA, 13 bp, Homo sapiens
ctgctggcctgga

SEQ ID NO: 319290 - DNA, 14 bp, Homo sapiens
ctgctggcctggat

SEQ ID NO: 319291 - DNA, 16 bp, Homo sapiens
ctgctggcctggatct

SEQ ID NO: 319292 - DNA, 20 bp, Homo sapiens
ctgctggctgaggcttgggc

SEQ ID NO: 319293 - DNA, 11 bp, Homo sapiens
ctgctgggaac

SEQ ID NO: 319294 - DNA, 22 bp, Homo sapiens
ctgctgggaaccccgcagcccg

SEQ ID NO: 319295 - DNA, 23 bp, Homo sapiens
ctgctgggaagtggcttaatagt

SEQ ID NO: 319296 - DNA, 18 bp, Homo sapiens
ctgctgggagcagaacag

SEQ ID NO: 319297 - DNA, 19 bp, Homo sapiens
ctgctgggagcagaacagt

SEQ ID NO: 319298 - DNA, 12 bp, Homo sapiens
ctgctggggcat

SEQ ID NO: 319299 - DNA, 14 bp, Homo sapiens
ctgctggggcatgt

SEQ ID NO: 319300 - DNA, 21 bp, Homo sapiens
ctgctggggcatgtgtgcctg

SEQ ID NO: 319301 - DNA, 19 bp, Homo sapiens
ctgctgggttttcctccgg

SEQ ID NO: 319302 - DNA, 22 bp, Homo sapiens
ctgctggtaatttgtatctgaa

SEQ ID NO: 319303 - DNA, 14 bp, Homo sapiens
ctgctggtcttcaa

SEQ ID NO: 319304 - DNA, 15 bp, Homo sapiens
ctgctgtaactgctg

SEQ ID NO: 319305 - DNA, 20 bp, Homo sapiens
ctgctgtaactgctgagcca

SEQ ID NO: 319306 - DNA, 22 bp, Homo sapiens
ctgctgtaactgctgagccact

SEQ ID NO: 319307 - DNA, 19 bp, Homo sapiens
ctgctgtaagacggccttg

SEQ ID NO: 319308 - DNA, 22 bp, Homo sapiens
ctgctgtaagacggccttggac

SEQ ID NO: 319309 - DNA, 18 bp, Homo sapiens
ctgctgtagcaacagagc

SEQ ID NO: 319310 - DNA, 14 bp, Homo sapiens
ctgctgtcagacct

SEQ ID NO: 319311 - DNA, 23 bp, Homo sapiens
ctgctgtcagaccttcttccaca

SEQ ID NO: 319312 - DNA, 20 bp, Homo sapiens
ctgcttgaaacttcagccct

SEQ ID NO: 319313 - DNA, 21 bp, Homo sapiens
ctgcttgaaacttcagccctg

SEQ ID NO: 319314 - DNA, 17 bp, Homo sapiens
ctgcttgcccgctccca

SEQ ID NO: 319315 - DNA, 19 bp, Homo sapiens
ctgcttggatccatacaaa

SEQ ID NO: 319316 - DNA, 22 bp, Homo sapiens
ctgcttggatccatacaaaact

SEQ ID NO: 319317 - DNA, 23 bp, Homo sapiens
ctgcttggctgtcccctccatct

SEQ ID NO: 319318 - DNA, 18 bp, Homo sapiens
ctgcttggtccttgattt

SEQ ID NO: 319319 - DNA, 17 bp, Homo sapiens
ctgcttgtactaagcca

SEQ ID NO: 319320 - DNA, 19 bp, Homo sapiens
ctgcttgtactaagccagg

SEQ ID NO: 319321 - DNA, 22 bp, Homo sapiens
ctgcttgtactaagccaggagg

SEQ ID NO: 319322 - DNA, 23 bp, Homo sapiens
ctgcttgtactaagccaggaggc

SEQ ID NO: 319323 - DNA, 19 bp, Homo sapiens
ctgcttgtgaaaggaaaga

SEQ ID NO: 319324 - DNA, 22 bp, Homo sapiens
ctgcttgtgcctcccttcccag

SEQ ID NO: 319325 - DNA, 21 bp, Homo sapiens
ctgctttaattgtgaattgat

SEQ ID NO: 319326 - DNA, 22 bp, Homo sapiens
ctgctttcaacttaaatcactg

SEQ ID NO: 319327 - DNA, 12 bp, Homo sapiens
ctgctttctctt

SEQ ID NO: 319328 - DNA, 20 bp, Homo sapiens
ctgctttcttgccacacagt

SEQ ID NO: 319329 - DNA, 22 bp, Homo sapiens
ctgctttcttgccacacagtgg

SEQ ID NO: 319330 - DNA, 22 bp, Homo sapiens
ctgctttgactgagcagactgg

SEQ ID NO: 319331 - DNA, 23 bp, Homo sapiens
ctgctttgactgagcagactggt

SEQ ID NO: 319332 - DNA, 22 bp, Homo sapiens
ctgctttgggctgccctggtgc

SEQ ID NO: 319333 - DNA, 23 bp, Homo sapiens
ctgctttgggctgccctggtgct

SEQ ID NO: 319334 - DNA, 16 bp, Homo sapiens
ctgctttgttaatgaa

SEQ ID NO: 319335 - DNA, 13 bp, Homo sapiens
ctgctttgttacc

SEQ ID NO: 319336 - DNA, 22 bp, Homo sapiens
ctgcttttaggtcatccaacct

SEQ ID NO: 319337 - DNA, 17 bp, Homo sapiens
ctgcttttccaggatcc

SEQ ID NO: 319338 - DNA, 23 bp, Homo sapiens
ctgcttttccaggatcctgcagg

SEQ ID NO: 319339 - DNA, 24 bp, Homo sapiens
ctgcttttccaggatcctgcagga

SEQ ID NO: 319340 - DNA, 21 bp, Homo sapiens
ctgcttttgatggctatgttt

SEQ ID NO: 319341 - DNA, 19 bp, Homo sapiens
ctgctttttctttcttttt

SEQ ID NO: 319342 - DNA, 17 bp, Homo sapiens
ctgcttttttttttcca

SEQ ID NO: 319343 - DNA, 18 bp, Homo sapiens
ctgcttttttttttccag

SEQ ID NO: 319344 - DNA, 21 bp, Homo sapiens
ctgcttttttttttccagcaa

SEQ ID NO: 319345 - DNA, 23 bp, Homo sapiens
ctgcttttttttttccagcaagt

SEQ ID NO: 319346 - DNA, 17 bp, Homo sapiens
ctggaaaaaaaaaaata

SEQ ID NO: 319347 - DNA, 20 bp, Homo sapiens
ctggaaaccacacttcttga

SEQ ID NO: 319348 - DNA, 21 bp, Homo sapiens
ctggaaacctgttatgccaaa

SEQ ID NO: 319349 - DNA, 23 bp, Homo sapiens
ctggaaagagctgttttggatga

SEQ ID NO: 319350 - DNA, 15 bp, Homo sapiens
ctggaaagaggagaa

SEQ ID NO: 319351 - DNA, 20 bp, Homo sapiens
ctggaaagaggagaaggaga

SEQ ID NO: 319352 - DNA, 19 bp, Homo sapiens
ctggaaaggatgcttctgc

SEQ ID NO: 319353 - DNA, 20 bp, Homo sapiens
ctggaaaggatgcttctgct

SEQ ID NO: 319354 - DNA, 23 bp, Homo sapiens
ctggaaaggggggagctggggaa

SEQ ID NO: 319355 - DNA, 16 bp, Homo sapiens
ctggaacactgtactg

SEQ ID NO: 319356 - DNA, 23 bp, Homo sapiens
ctggaacatgggcattgggttct

SEQ ID NO: 319357 - DNA, 14 bp, Homo sapiens
ctggaaccagagcc

SEQ ID NO: 319358 - DNA, 14 bp, Homo sapiens
ctggaaccagggag

SEQ ID NO: 319359 - DNA, 23 bp, Homo sapiens
ctggaaccagggaggagaggaaa

SEQ ID NO: 319360 - DNA, 18 bp, Homo sapiens
ctggaacctccctgggcc

SEQ ID NO: 319361 - DNA, 20 bp, Homo sapiens
ctggaactctatctgggcct

SEQ ID NO: 319362 - DNA, 22 bp, Homo sapiens
ctggaactctatctgggcctgg

SEQ ID NO: 319363 - DNA, 17 bp, Homo sapiens
ctggaagaacatcaaga

SEQ ID NO: 319364 - DNA, 20 bp, Homo sapiens
ctggaagaacatcaagatac

SEQ ID NO: 319365 - DNA, 21 bp, Homo sapiens
ctggaagacgtggctctgggt

SEQ ID NO: 319366 - DNA, 22 bp, Homo sapiens
ctggaagacttagatctgagcc

SEQ ID NO: 319367 - DNA, 23 bp, Homo sapiens
ctggaagacttagatctgagccc

SEQ ID NO: 319368 - DNA, 14 bp, Homo sapiens
ctggaagagctggg

SEQ ID NO: 319369 - DNA, 23 bp, Homo sapiens
ctggaagagctgggtaccaggcc

SEQ ID NO: 319370 - DNA, 13 bp, Homo sapiens
ctggaagcctgct

SEQ ID NO: 319371 - DNA, 15 bp, Homo sapiens
ctggaagcctgctga

SEQ ID NO: 319372 - DNA, 16 bp, Homo sapiens
ctggaaggcagggcag

SEQ ID NO: 319373 - DNA, 19 bp, Homo sapiens
ctggaaggctggctgagtg

SEQ ID NO: 319374 - DNA, 20 bp, Homo sapiens
ctggaagggtccggcttggc

SEQ ID NO: 319375 - DNA, 18 bp, Homo sapiens
ctggaaggttcaggggcc

SEQ ID NO: 319376 - DNA, 16 bp, Homo sapiens
ctggaatccagaagga

SEQ ID NO: 319377 - DNA, 18 bp, Homo sapiens
ctggaatccagaaggaag

SEQ ID NO: 319378 - DNA, 20 bp, Homo sapiens
ctggaatccagaaggaagct

SEQ ID NO: 319379 - DNA, 21 bp, Homo sapiens
ctggaatccagaaggaagctc

SEQ ID NO: 319380 - DNA, 14 bp, Homo sapiens
ctggaatgaagcat

SEQ ID NO: 319381 - DNA, 20 bp, Homo sapiens
ctggaatggaagggttctgg

SEQ ID NO: 319382 - DNA, 16 bp, Homo sapiens
ctggaatggggacctg

SEQ ID NO: 319383 - DNA, 19 bp, Homo sapiens
ctggaatggggacctgggg

SEQ ID NO: 319384 - DNA, 14 bp, Homo sapiens
ctggaatgtaatca

SEQ ID NO: 319385 - DNA, 21 bp, Homo sapiens
ctggaattcagcaccctgggt

SEQ ID NO: 319386 - DNA, 23 bp, Homo sapiens
ctggaattcagcaccctgggtgc

SEQ ID NO: 319387 - DNA, 14 bp, Homo sapiens
ctggacaagaagct

SEQ ID NO: 319388 - DNA, 16 bp, Homo sapiens
ctggacaagaagctgc

SEQ ID NO: 319389 - DNA, 19 bp, Homo sapiens
ctggacaagaagctgctat

SEQ ID NO: 319390 - DNA, 11 bp, Homo sapiens
ctggacaagcc

SEQ ID NO: 319391 - DNA, 17 bp, Homo sapiens
ctggacacccctgctct

SEQ ID NO: 319392 - DNA, 19 bp, Homo sapiens
ctggacagtatcactgtct

SEQ ID NO: 319393 - DNA, 15 bp, Homo sapiens
ctggaccaaagctga

SEQ ID NO: 319394 - DNA, 22 bp, Homo sapiens
ctggaccaaggtgcggaccgga

SEQ ID NO: 319395 - DNA, 21 bp, Homo sapiens
ctggaccaccagccccagcaa

SEQ ID NO: 319396 - DNA, 21 bp, Homo sapiens
cagtgtactgctttcaactta

SEQ ID NO: 319397 - DNA, 14 bp, Homo sapiens
cagtgtatctaatt

SEQ ID NO: 319398 - DNA, 17 bp, Homo sapiens
cagtgtcacttgactct

SEQ ID NO: 319399 - DNA, 22 bp, Homo sapiens
cagtgtccattatctgctgttc

SEQ ID NO: 319400 - DNA, 14 bp, Homo sapiens
cagtgtccccaggg

SEQ ID NO: 319401 - DNA, 14 bp, Homo sapiens
cagtgtcccgggcc

SEQ ID NO: 319402 - DNA, 18 bp, Homo sapiens
cagtgtcctcatctataa

SEQ ID NO: 319403 - DNA, 19 bp, Homo sapiens
cagtgtcctgtgctttctg

SEQ ID NO: 319404 - DNA, 14 bp, Homo sapiens
cagtgtctcggagg

SEQ ID NO: 319405 - DNA, 22 bp, Homo sapiens
cagtgtctgaaccaccctggaa

SEQ ID NO: 319406 - DNA, 23 bp, Homo sapiens
cagtgtctgtatcggagacagtg

SEQ ID NO: 319407 - DNA, 16 bp, Homo sapiens
cagtgtctgtgccatg

SEQ ID NO: 319408 - DNA, 13 bp, Homo sapiens
cagtgtcttccat

SEQ ID NO: 319409 - DNA, 22 bp, Homo sapiens
cagtgtgcacgagtgggaagga

SEQ ID NO: 319410 - DNA, 11 bp, Homo sapiens
cagtgtgccac

SEQ ID NO: 319411 - DNA, 15 bp, Homo sapiens
cagtgtgccaccctc

SEQ ID NO: 319412 - DNA, 18 bp, Homo sapiens
cagtgtgccaccctctgc

SEQ ID NO: 319413 - DNA, 15 bp, Homo sapiens
cagtgtggagagggg

SEQ ID NO: 319414 - DNA, 23 bp, Homo sapiens
cagtgtggagaggggtgcaccca

SEQ ID NO: 319415 - DNA, 11 bp, Homo sapiens
cagtgtggctt

SEQ ID NO: 319416 - DNA, 16 bp, Homo sapiens
cagtgtggcttaaaca

SEQ ID NO: 319417 - DNA, 17 bp, Homo sapiens
cagtgtggcttaaacat

SEQ ID NO: 319418 - DNA, 19 bp, Homo sapiens
cagtgtggcttaaacattt

SEQ ID NO: 319419 - DNA, 23 bp, Homo sapiens
cagtgtgggaatgcggcaagaag

SEQ ID NO: 319420 - DNA, 13 bp, Homo sapiens
cagtgtgtctcct

SEQ ID NO: 319421 - DNA, 15 bp, Homo sapiens
cagtgtgtctcctgc

SEQ ID NO: 319422 - DNA, 15 bp, Homo sapiens
cagtgtgttgacttc

SEQ ID NO: 319423 - DNA, 15 bp, Homo sapiens
cagtgttaagtgaca

SEQ ID NO: 319424 - DNA, 14 bp, Homo sapiens
cagtgttagtggga

SEQ ID NO: 319425 - DNA, 15 bp, Homo sapiens
cagtgttagtgggaa

SEQ ID NO: 319426 - DNA, 23 bp, Homo sapiens
cagtgttagtgggaagagctggg

SEQ ID NO: 319427 - DNA, 21 bp, Homo sapiens
cagtgttcccttctggctgtc

SEQ ID NO: 319428 - DNA, 17 bp, Homo sapiens
cagtgttcgcttggctc

SEQ ID NO: 319429 - DNA, 13 bp, Homo sapiens
cagtgttctgagc

SEQ ID NO: 319430 - DNA, 15 bp, Homo sapiens
cagtgttctgagccc

SEQ ID NO: 319431 - DNA, 16 bp, Homo sapiens
cagtgttctgagcccc

SEQ ID NO: 319432 - DNA, 18 bp, Homo sapiens
cagtgttgcctcctccca

SEQ ID NO: 319433 - DNA, 16 bp, Homo sapiens
cagtgttgtttgtaaa

SEQ ID NO: 319434 - DNA, 22 bp, Homo sapiens
cagtgttgtttgtaaataagag

SEQ ID NO: 319435 - DNA, 15 bp, Homo sapiens
cagtgttttctggga

SEQ ID NO: 319436 - DNA, 15 bp, Homo sapiens
cagttaaacttgcaa

SEQ ID NO: 319437 - DNA, 20 bp, Homo sapiens
cagttaactttcagaagaga

SEQ ID NO: 319438 - DNA, 14 bp, Homo sapiens
cagttaagaaaaaa

SEQ ID NO: 319439 - DNA, 15 bp, Homo sapiens
cagttaagaaaaaaa

SEQ ID NO: 319440 - DNA, 17 bp, Homo sapiens
cagttaagaaaaaaata

SEQ ID NO: 319441 - DNA, 13 bp, Homo sapiens
cagttaagagaaa

SEQ ID NO: 319442 - DNA, 13 bp, Homo sapiens
cagttaattcttg

SEQ ID NO: 319443 - DNA, 15 bp, Homo sapiens
cagttactggtttca

SEQ ID NO: 319444 - DNA, 17 bp, Homo sapiens
cagttagagatgcctcc

SEQ ID NO: 319445 - DNA, 18 bp, Homo sapiens
cagttagagatgcctccc

SEQ ID NO: 319446 - DNA, 17 bp, Homo sapiens
cagttattagaacttag

SEQ ID NO: 319447 - DNA, 22 bp, Homo sapiens
cagttattagaacttagttttg

SEQ ID NO: 319448 - DNA, 21 bp, Homo sapiens
ctggaggccgggtgctcaggg

SEQ ID NO: 319449 - DNA, 12 bp, Homo sapiens
ctggaggcctct

SEQ ID NO: 319450 - DNA, 13 bp, Homo sapiens
ctggaggcctctg

SEQ ID NO: 319451 - DNA, 14 bp, Homo sapiens
ctggaggcctctgg

SEQ ID NO: 319452 - DNA, 17 bp, Homo sapiens
ctggaggcctctgggcc

SEQ ID NO: 319453 - DNA, 18 bp, Homo sapiens
ctggaggcctctgggcct

SEQ ID NO: 319454 - DNA, 23 bp, Homo sapiens
ctggaggggcatggccagcagct

SEQ ID NO: 319455 - DNA, 20 bp, Homo sapiens
ctggaggtaaggcctttgag

SEQ ID NO: 319456 - DNA, 22 bp, Homo sapiens
ctggaggtacgaaaagagggga

SEQ ID NO: 319457 - DNA, 22 bp, Homo sapiens
ctggaggtgggcatgccaccct

SEQ ID NO: 319458 - DNA, 22 bp, Homo sapiens
ctggagtcagatgagcaaggac

SEQ ID NO: 319459 - DNA, 23 bp, Homo sapiens
ctggagtcagatgagcaaggaca

SEQ ID NO: 319460 - DNA, 16 bp, Homo sapiens
ctggagtcctgttctc

SEQ ID NO: 319461 - DNA, 22 bp, Homo sapiens
ctggagtcctgttctcagagct

SEQ ID NO: 319462 - DNA, 16 bp, Homo sapiens
ctggagtctgaaggag

SEQ ID NO: 319463 - DNA, 22 bp, Homo sapiens
ctggagtgaggcttccaggctc

SEQ ID NO: 319464 - DNA, 19 bp, Homo sapiens
ctggagtgctgcttgtgcc

SEQ ID NO: 319465 - DNA, 22 bp, Homo sapiens
ctggagtgctggctccacgccc

SEQ ID NO: 319466 - DNA, 15 bp, Homo sapiens
ctggataaaaaagaa

SEQ ID NO: 319467 - DNA, 16 bp, Homo sapiens
ctggataaaaaagaaa

SEQ ID NO: 319468 - DNA, 15 bp, Homo sapiens
ctggataattttgca

SEQ ID NO: 319469 - DNA, 15 bp, Homo sapiens
ctggatacctgtgtg

SEQ ID NO: 319470 - DNA, 22 bp, Homo sapiens
ctggatattttcaaattgtatc

SEQ ID NO: 319471 - DNA, 14 bp, Homo sapiens
ctggatctggctta

SEQ ID NO: 319472 - DNA, 22 bp, Homo sapiens
ctggatctttcggactgaggcc

SEQ ID NO: 319473 - DNA, 13 bp, Homo sapiens
ctggatgaaattt

SEQ ID NO: 319474 - DNA, 13 bp, Homo sapiens
ctggatgaagatt

SEQ ID NO: 319475 - DNA, 21 bp, Homo sapiens
ctggatgcacagatgccatgg

SEQ ID NO: 319476 - DNA, 21 bp, Homo sapiens
ctggatggaggaaaaccaagc

SEQ ID NO: 319477 - DNA, 17 bp, Homo sapiens
ctggatggatctgctcc

SEQ ID NO: 319478 - DNA, 22 bp, Homo sapiens
ctggatggatctgctccatgca

SEQ ID NO: 319479 - DNA, 22 bp, Homo sapiens
ctggatggccgggctgctgctg

SEQ ID NO: 319480 - DNA, 22 bp, Homo sapiens
ctggatgggggtgcaggcagcc

SEQ ID NO: 319481 - DNA, 22 bp, Homo sapiens
ctggatgtcccctgtcccacca

SEQ ID NO: 319482 - DNA, 20 bp, Homo sapiens
ctggattggctataacatgt

SEQ ID NO: 319483 - DNA, 20 bp, Homo sapiens
ctggatttgggagctctgct

SEQ ID NO: 319484 - DNA, 22 bp, Homo sapiens
ctggatttttacaaataaagat

SEQ ID NO: 319485 - DNA, 18 bp, Homo sapiens
ctggcaaacatgtgcaac

SEQ ID NO: 319486 - DNA, 16 bp, Homo sapiens
ctggcaagcagggaaa

SEQ ID NO: 319487 - DNA, 22 bp, Homo sapiens
ctggcaagcagggaaagctcca

SEQ ID NO: 319488 - DNA, 16 bp, Homo sapiens
ctggcacagacttcac

SEQ ID NO: 319489 - DNA, 15 bp, Homo sapiens
ctggcacagggcagt

SEQ ID NO: 319490 - DNA, 16 bp, Homo sapiens
ctggcacagggcagtg

SEQ ID NO: 319491 - DNA, 17 bp, Homo sapiens
ctggcacagggcagtgg

SEQ ID NO: 319492 - DNA, 19 bp, Homo sapiens
ctggcacatttccccagac

SEQ ID NO: 319493 - DNA, 14 bp, Homo sapiens
ctggcacttggaga

SEQ ID NO: 319494 - DNA, 21 bp, Homo sapiens
ctggcacttggagacttgtat

SEQ ID NO: 319495 - DNA, 16 bp, Homo sapiens
ctggcagaactgagct

SEQ ID NO: 319496 - DNA, 19 bp, Homo sapiens
ctggcagaactgagctcct

SEQ ID NO: 319497 - DNA, 21 bp, Homo sapiens
ctggcagaactgagctcctct

SEQ ID NO: 319498 - DNA, 12 bp, Homo sapiens
ctggcagagaag

SEQ ID NO: 319499 - DNA, 13 bp, Homo sapiens
ctggcagagaaga

SEQ ID NO: 319500 - DNA, 14 bp, Homo sapiens
ctggcagccaggga

SEQ ID NO: 319501 - DNA, 17 bp, Homo sapiens
ctggcagccgtgccttc

SEQ ID NO: 319502 - DNA, 21 bp, Homo sapiens
ctggcagccgtgccttcagct

SEQ ID NO: 319503 - DNA, 22 bp, Homo sapiens
ctggcagccgtgccttcagctc

SEQ ID NO: 319504 - DNA, 15 bp, Homo sapiens
ctggcagcgcctccc

SEQ ID NO: 319505 - DNA, 21 bp, Homo sapiens
ctggcagcgcctcccgccgcc

SEQ ID NO: 319506 - DNA, 20 bp, Homo sapiens
ctggcagctcctctccttgg

SEQ ID NO: 319507 - DNA, 21 bp, Homo sapiens
ctggcagctcctctccttggg

SEQ ID NO: 319508 - DNA, 15 bp, Homo sapiens
ctggcagctctccag

SEQ ID NO: 319509 - DNA, 14 bp, Homo sapiens
ctggcaggagggtg

SEQ ID NO: 319510 - DNA, 21 bp, Homo sapiens
ctggcagggcaggcagagctc

SEQ ID NO: 319511 - DNA, 23 bp, Homo sapiens
ctggcaggtgcagatgggctgtt

SEQ ID NO: 319512 - DNA, 18 bp, Homo sapiens
ctggcaggtggccagggc

SEQ ID NO: 319513 - DNA, 19 bp, Homo sapiens
ctggcaggtggccagggct

SEQ ID NO: 319514 - DNA, 20 bp, Homo sapiens
ctggcaggtggccagggctc

SEQ ID NO: 319515 - DNA, 23 bp, Homo sapiens
ctggcaggtgttgggacctgctg

SEQ ID NO: 319516 - DNA, 17 bp, Homo sapiens
ctggcagtacagagtgc

SEQ ID NO: 319517 - DNA, 20 bp, Homo sapiens
ctggcagtacagagtgcagc

SEQ ID NO: 319518 - DNA, 24 bp, Homo sapiens
ctggcagtgcacctctcatcagcc

SEQ ID NO: 319519 - DNA, 15 bp, Homo sapiens
ctggcatagccctcc

SEQ ID NO: 319520 - DNA, 14 bp, Homo sapiens
ctggcatctctgga

SEQ ID NO: 319521 - DNA, 17 bp, Homo sapiens
ctggcatctgacacaaa

SEQ ID NO: 319522 - DNA, 19 bp, Homo sapiens
ctggcatctgacacaaaaa

SEQ ID NO: 319523 - DNA, 18 bp, Homo sapiens
ctggcattctacacctgg

SEQ ID NO: 319524 - DNA, 20 bp, Homo sapiens
ctggcattctacacctggac

SEQ ID NO: 319525 - DNA, 16 bp, Homo sapiens
ctgggggactgggagt

SEQ ID NO: 319526 - DNA, 16 bp, Homo sapiens
ctgggggcagtgactg

SEQ ID NO: 319527 - DNA, 21 bp, Homo sapiens
ctgggggcagtgactggcagg

SEQ ID NO: 319528 - DNA, 19 bp, Homo sapiens
ctgggggcatgggggaggc

SEQ ID NO: 319529 - DNA, 23 bp, Homo sapiens
ctgggggccatgagctccagacc

SEQ ID NO: 319530 - DNA, 19 bp, Homo sapiens
ctgggggccttgggtgagt

SEQ ID NO: 319531 - DNA, 19 bp, Homo sapiens
ctggggggcacagccagaa

SEQ ID NO: 319532 - DNA, 17 bp, Homo sapiens
ctggggggctgtcctga

SEQ ID NO: 319533 - DNA, 21 bp, Homo sapiens
ctggggggctgtcctgagccc

SEQ ID NO: 319534 - DNA, 19 bp, Homo sapiens
ctggggggggcaagagctc

SEQ ID NO: 319535 - DNA, 17 bp, Homo sapiens
ctgggggtgaggggcca

SEQ ID NO: 319536 - DNA, 15 bp, Homo sapiens
ctgggggtgccaacc

SEQ ID NO: 319537 - DNA, 20 bp, Homo sapiens
ctggggtataaaactttcct

SEQ ID NO: 319538 - DNA, 14 bp, Homo sapiens
ctggggtccccact

SEQ ID NO: 319539 - DNA, 16 bp, Homo sapiens
ctggggtccccactcc

SEQ ID NO: 319540 - DNA, 18 bp, Homo sapiens
ctggggtccccactccct

SEQ ID NO: 319541 - DNA, 13 bp, Homo sapiens
ctggggtccccca

SEQ ID NO: 319542 - DNA, 17 bp, Homo sapiens
ctggggtctctgagcag

SEQ ID NO: 319543 - DNA, 18 bp, Homo sapiens
ctggggtctctgagcagt

SEQ ID NO: 319544 - DNA, 20 bp, Homo sapiens
ctggggtctctgagcagtgg

SEQ ID NO: 319545 - DNA, 23 bp, Homo sapiens
ctggggtggcgtctgcctaggag

SEQ ID NO: 319546 - DNA, 21 bp, Homo sapiens
ctggggtggggaggcagaggg

SEQ ID NO: 319547 - DNA, 13 bp, Homo sapiens
ctggggtggggct

SEQ ID NO: 319548 - DNA, 18 bp, Homo sapiens
ctggggtggggcttggaa

SEQ ID NO: 319549 - DNA, 20 bp, Homo sapiens
ctggggtgggtttagcaggc

SEQ ID NO: 319550 - DNA, 22 bp, Homo sapiens
ctggggtgggtttagcaggctg

SEQ ID NO: 319551 - DNA, 22 bp, Homo sapiens
ctggggtggttggaggcctggt

SEQ ID NO: 319552 - DNA, 23 bp, Homo sapiens
ctggggttcacgtcactgccaga

SEQ ID NO: 319553 - DNA, 22 bp, Homo sapiens
ctggggtttccacacaggccca

SEQ ID NO: 319554 - DNA, 22 bp, Homo sapiens
ctgggtaactgtcaagtcatga

SEQ ID NO: 319555 - DNA, 18 bp, Homo sapiens
ctgggtcaccttcctggg

SEQ ID NO: 319556 - DNA, 14 bp, Homo sapiens
ctgggtcgcccctc

SEQ ID NO: 319557 - DNA, 18 bp, Homo sapiens
ctgggtcgcccctcctcg

SEQ ID NO: 319558 - DNA, 22 bp, Homo sapiens
ctgggtcgcccctcctcgggcg

SEQ ID NO: 319559 - DNA, 16 bp, Homo sapiens
ctgggtctcactcctg

SEQ ID NO: 319560 - DNA, 17 bp, Homo sapiens
ctgggtctgtgtctctt

SEQ ID NO: 319561 - DNA, 16 bp, Homo sapiens
ctgggtgagaatcctg

SEQ ID NO: 319562 - DNA, 19 bp, Homo sapiens
ctgggtgagaatcctgcct

SEQ ID NO: 319563 - DNA, 20 bp, Homo sapiens
ctgggtgagaatcctgcctc

SEQ ID NO: 319564 - DNA, 22 bp, Homo sapiens
ctgggtgagaatcctgcctctc

SEQ ID NO: 319565 - DNA, 14 bp, Homo sapiens
ctgggtgagtgggg

SEQ ID NO: 319566 - DNA, 13 bp, Homo sapiens
ctgggtgcccaca

SEQ ID NO: 319567 - DNA, 14 bp, Homo sapiens
ctgggtgcccacag

SEQ ID NO: 319568 - DNA, 19 bp, Homo sapiens
ctgggtgcccacagcccgc

SEQ ID NO: 319569 - DNA, 23 bp, Homo sapiens
ctgggtgcccacagcccgcatgc

SEQ ID NO: 319570 - DNA, 21 bp, Homo sapiens
ctgggtgccccgtccacggct

SEQ ID NO: 319571 - DNA, 23 bp, Homo sapiens
ctgggtggaactctcctgctcct

SEQ ID NO: 319572 - DNA, 20 bp, Homo sapiens
ctgggtggatcggcctcctc

SEQ ID NO: 319573 - DNA, 20 bp, Homo sapiens
ctgggtggggcagggcctgg

SEQ ID NO: 319574 - DNA, 23 bp, Homo sapiens
ctgggtggggcagggcctggcct

SEQ ID NO: 319575 - DNA, 19 bp, Homo sapiens
ctgggtggtaactgccagc

SEQ ID NO: 319576 - DNA, 20 bp, Homo sapiens
ctgggtggtaactgccagcc

SEQ ID NO: 319577 - DNA, 16 bp, Homo sapiens
ctgggtggttgccctt

SEQ ID NO: 319578 - DNA, 18 bp, Homo sapiens
ctgggtggttgcccttca

SEQ ID NO: 319579 - DNA, 19 bp, Homo sapiens
ctgggtgtattaggactgg

SEQ ID NO: 319580 - DNA, 23 bp, Homo sapiens
ctgggttaatggctagtactgta

SEQ ID NO: 319581 - DNA, 22 bp, Homo sapiens
ctgggttcagaaatgctgcctg

SEQ ID NO: 319582 - DNA, 17 bp, Homo sapiens
ctgggttccaatcctgg

SEQ ID NO: 319583 - DNA, 14 bp, Homo sapiens
ctgggttccctttc

SEQ ID NO: 319584 - DNA, 20 bp, Homo sapiens
ctgggttccctttccttcca

SEQ ID NO: 319585 - DNA, 15 bp, Homo sapiens
ctgggttctgggtgg

SEQ ID NO: 319586 - DNA, 16 bp, Homo sapiens
ctgggtttgggcagtg

SEQ ID NO: 319587 - DNA, 17 bp, Homo sapiens
ctgggtttgggcagtgg

SEQ ID NO: 319588 - DNA, 21 bp, Homo sapiens
ctgggtttgggcagtggagag

SEQ ID NO: 319589 - DNA, 22 bp, Homo sapiens
ctgggtttgggcagtggagagg

SEQ ID NO: 319590 - DNA, 23 bp, Homo sapiens
ctgggtttgggcagtggagaggg

SEQ ID NO: 319591 - DNA, 17 bp, Homo sapiens
ctgggttttcaggggct

SEQ ID NO: 319592 - DNA, 17 bp, Homo sapiens
ctggtaatttgtatctg

SEQ ID NO: 319593 - DNA, 22 bp, Homo sapiens
ctggtaatttgtatctgaagga

SEQ ID NO: 319594 - DNA, 19 bp, Homo sapiens
ctggtactcccccagccct

SEQ ID NO: 319595 - DNA, 16 bp, Homo sapiens
ctggtactctcctaga

SEQ ID NO: 319596 - DNA, 14 bp, Homo sapiens
ctggtagatagaaa

SEQ ID NO: 319597 - DNA, 14 bp, Homo sapiens
ctggtaggaaagca

SEQ ID NO: 319598 - DNA, 22 bp, Homo sapiens
ctggtaggaatagcatgtcact

SEQ ID NO: 319599 - DNA, 14 bp, Homo sapiens
ctggtaggttctgt

SEQ ID NO: 319600 - DNA, 15 bp, Homo sapiens
ctggtaggttctgtc

SEQ ID NO: 319601 - DNA, 19 bp, Homo sapiens
ctggtagttagtagcatgt

SEQ ID NO: 319602 - DNA, 12 bp, Homo sapiens
ctggtatctgca

SEQ ID NO: 319603 - DNA, 23 bp, Homo sapiens
ctggtatctgcatgtaaaatctt

SEQ ID NO: 319604 - DNA, 21 bp, Homo sapiens
ctggtatgaacttgaggacac

SEQ ID NO: 319605 - DNA, 22 bp, Homo sapiens
ctggtatgaacttgaggacaca

SEQ ID NO: 319606 - DNA, 23 bp, Homo sapiens
ctggtatgggtttctcccagttc

SEQ ID NO: 319607 - DNA, 15 bp, Homo sapiens
ctggtatgtgcctgc

SEQ ID NO: 319608 - DNA, 14 bp, Homo sapiens
ctggtattctctct

SEQ ID NO: 319609 - DNA, 21 bp, Homo sapiens
ctggtattctctctatgcaaa

SEQ ID NO: 319610 - DNA, 13 bp, Homo sapiens
ctggtcaaagaaa

SEQ ID NO: 319611 - DNA, 18 bp, Homo sapiens
ctggtcacaggactctgc

SEQ ID NO: 319612 - DNA, 19 bp, Homo sapiens
ctggtcacaggactctgcc

SEQ ID NO: 319613 - DNA, 22 bp, Homo sapiens
ctggtcacaggactctgcctcc

SEQ ID NO: 319614 - DNA, 23 bp, Homo sapiens
ctggtcacaggactctgcctcct

SEQ ID NO: 319615 - DNA, 14 bp, Homo sapiens
ctggtcagcagagc

SEQ ID NO: 319616 - DNA, 20 bp, Homo sapiens
ctggtcagcagagccgcccc

SEQ ID NO: 319617 - DNA, 22 bp, Homo sapiens
ctggtcagtgaagcccaggagg

SEQ ID NO: 319618 - DNA, 22 bp, Homo sapiens
ctggtcatcagtattgtgtaaa

SEQ ID NO: 319619 - DNA, 13 bp, Homo sapiens
ctggtccacacac

SEQ ID NO: 319620 - DNA, 21 bp, Homo sapiens
ctggtccacacaccacagaag

SEQ ID NO: 319621 - DNA, 16 bp, Homo sapiens
ctggtccatgatggag

SEQ ID NO: 319622 - DNA, 17 bp, Homo sapiens
ctggtccatgatggagt

SEQ ID NO: 319623 - DNA, 16 bp, Homo sapiens
ctggtccccccaaatc

SEQ ID NO: 319624 - DNA, 14 bp, Homo sapiens
ctggtcccctgtgg

SEQ ID NO: 319625 - DNA, 15 bp, Homo sapiens
ctggtcccctgtggt

SEQ ID NO: 319626 - DNA, 23 bp, Homo sapiens
ctggtccctcgtccacaggggca

SEQ ID NO: 319627 - DNA, 23 bp, Homo sapiens
ctggtctcgaactcctggcctca

SEQ ID NO: 319628 - DNA, 13 bp, Homo sapiens
ctggtctggagcc

SEQ ID NO: 319629 - DNA, 17 bp, Homo sapiens
ctggtctggagccccta

SEQ ID NO: 319630 - DNA, 18 bp, Homo sapiens
ctggtctggagcccctat

SEQ ID NO: 319631 - DNA, 21 bp, Homo sapiens
ctggtctggagcccctatcct

SEQ ID NO: 319632 - DNA, 16 bp, Homo sapiens
ctggtctgggtgcccc

SEQ ID NO: 319633 - DNA, 14 bp, Homo sapiens
ctggtctgtaggga

SEQ ID NO: 319634 - DNA, 16 bp, Homo sapiens
ctggtctgttttctgt

SEQ ID NO: 319635 - DNA, 15 bp, Homo sapiens
ctggtgacagccttg

SEQ ID NO: 319636 - DNA, 13 bp, Homo sapiens
ctggtgactgcag

SEQ ID NO: 319637 - DNA, 21 bp, Homo sapiens
ctggtgagatacccagagaga

SEQ ID NO: 319638 - DNA, 17 bp, Homo sapiens
ctggtgaggacaaggta

SEQ ID NO: 319639 - DNA, 14 bp, Homo sapiens
ctggtgaggagcac

SEQ ID NO: 319640 - DNA, 17 bp, Homo sapiens
ctggtgcacatgacatt

SEQ ID NO: 319641 - DNA, 23 bp, Homo sapiens
ctggtgcatgttcttttctggaa

SEQ ID NO: 319642 - DNA, 14 bp, Homo sapiens
ctggtgcattacag

SEQ ID NO: 319643 - DNA, 13 bp, Homo sapiens
ctggtgccccaca

SEQ ID NO: 319644 - DNA, 15 bp, Homo sapiens
ctggtgccccacagc

SEQ ID NO: 319645 - DNA, 18 bp, Homo sapiens
ctggtgcgctgtgctcca

SEQ ID NO: 319646 - DNA, 23 bp, Homo sapiens
ctggtgcgctgtgctccagcagt

SEQ ID NO: 319647 - DNA, 12 bp, Homo sapiens
ctggtgctgcca

SEQ ID NO: 319648 - DNA, 14 bp, Homo sapiens
ctggtgctgctgct

SEQ ID NO: 319649 - DNA, 20 bp, Homo sapiens
ctggtgctggatattttcaa

SEQ ID NO: 319650 - DNA, 22 bp, Homo sapiens
ctggtggatggtgacttttgaa

SEQ ID NO: 319651 - DNA, 22 bp, Homo sapiens
ctggtggcatggaagagggagg

SEQ ID NO: 319652 - DNA, 12 bp, Homo sapiens
ctggtggcccca

SEQ ID NO: 319653 - DNA, 24 bp, Homo sapiens
gactaggacctgagcctggtcctg

SEQ ID NO: 319654 - DNA, 20 bp, Homo sapiens
gactagggattcaggctgct

SEQ ID NO: 319655 - DNA, 12 bp, Homo sapiens
gactagtgctga

SEQ ID NO: 319656 - DNA, 16 bp, Homo sapiens
gactataaacattaaa

SEQ ID NO: 319657 - DNA, 22 bp, Homo sapiens
gactatataaagtactactgta

SEQ ID NO: 319658 - DNA, 22 bp, Homo sapiens
gactcaacatgttactgaccag

SEQ ID NO: 319659 - DNA, 22 bp, Homo sapiens
gactcaatgtggaaaaaatatt

SEQ ID NO: 319660 - DNA, 16 bp, Homo sapiens
gactcagccctgaggt

SEQ ID NO: 319661 - DNA, 23 bp, Homo sapiens
gactcaggcccacattgcccaca

SEQ ID NO: 319662 - DNA, 12 bp, Homo sapiens
gactcaggcctg

SEQ ID NO: 319663 - DNA, 16 bp, Homo sapiens
gactcaggcctgccaa

SEQ ID NO: 319664 - DNA, 21 bp, Homo sapiens
gactcaggcctgccaatgcca

SEQ ID NO: 319665 - DNA, 18 bp, Homo sapiens
gactcaggtggtgtcctt

SEQ ID NO: 319666 - DNA, 22 bp, Homo sapiens
gactcaggtggtgtccttcttc

SEQ ID NO: 319667 - DNA, 15 bp, Homo sapiens
gactcaggttccaga

SEQ ID NO: 319668 - DNA, 15 bp, Homo sapiens
gactcagtttgtcag

SEQ ID NO: 319669 - DNA, 22 bp, Homo sapiens
gactccagaatctgctgttgcc

SEQ ID NO: 319670 - DNA, 14 bp, Homo sapiens
gactccagagtctg

SEQ ID NO: 319671 - DNA, 15 bp, Homo sapiens
gactccagagtctga

SEQ ID NO: 319672 - DNA, 18 bp, Homo sapiens
gactccagagtctgagcc

SEQ ID NO: 319673 - DNA, 20 bp, Homo sapiens
gactccagagtctgagcccc

SEQ ID NO: 319674 - DNA, 12 bp, Homo sapiens
gactccaggaga

SEQ ID NO: 319675 - DNA, 15 bp, Homo sapiens
gactccaggccagct

SEQ ID NO: 319676 - DNA, 23 bp, Homo sapiens
gactccatgagaagccgtgggtg

SEQ ID NO: 319677 - DNA, 12 bp, Homo sapiens
gactccatggcc

SEQ ID NO: 319678 - DNA, 16 bp, Homo sapiens
gactcccagtgaactt

SEQ ID NO: 319679 - DNA, 16 bp, Homo sapiens
gactccccgcccgccc

SEQ ID NO: 319680 - DNA, 14 bp, Homo sapiens
gactccctcctcac

SEQ ID NO: 319681 - DNA, 22 bp, Homo sapiens
gactcccttaaaatagaaataa

SEQ ID NO: 319682 - DNA, 19 bp, Homo sapiens
gactccgggaccattgacc

SEQ ID NO: 319683 - DNA, 13 bp, Homo sapiens
gactcctcccttc

SEQ ID NO: 319684 - DNA, 19 bp, Homo sapiens
gactcctcccttccccact

SEQ ID NO: 319685 - DNA, 22 bp, Homo sapiens
gactcctcccttccccactctg

SEQ ID NO: 319686 - DNA, 11 bp, Homo sapiens
gactcctctgt

SEQ ID NO: 319687 - DNA, 14 bp, Homo sapiens
gactcctctgtcca

SEQ ID NO: 319688 - DNA, 17 bp, Homo sapiens
gactccttctccccaat

SEQ ID NO: 319689 - DNA, 23 bp, Homo sapiens
gactcctttcctgcatctttcat

SEQ ID NO: 319690 - DNA, 15 bp, Homo sapiens
gactcgagagggctg

SEQ ID NO: 319691 - DNA, 18 bp, Homo sapiens
gactcgagagggctgagc

SEQ ID NO: 319692 - DNA, 21 bp, Homo sapiens
gactcgggctaagtccagctc

SEQ ID NO: 319693 - DNA, 23 bp, Homo sapiens
gactcgggctaagtccagctctc

SEQ ID NO: 319694 - DNA, 20 bp, Homo sapiens
gactcgttctcgtgacccag

SEQ ID NO: 319695 - DNA, 15 bp, Homo sapiens
gactctaaatgcagt

SEQ ID NO: 319696 - DNA, 22 bp, Homo sapiens
gactctaaatgcagttttaaga

SEQ ID NO: 319697 - DNA, 13 bp, Homo sapiens
gactctcctcctc

SEQ ID NO: 319698 - DNA, 15 bp, Homo sapiens
gactctcctcctccc

SEQ ID NO: 319699 - DNA, 17 bp, Homo sapiens
gactctcctcctcccct

SEQ ID NO: 319700 - DNA, 18 bp, Homo sapiens
gactctcctcctcccctc

SEQ ID NO: 319701 - DNA, 17 bp, Homo sapiens
gactctgaaactataga

SEQ ID NO: 319702 - DNA, 20 bp, Homo sapiens
gactctgagtccactgctcc

SEQ ID NO: 319703 - DNA, 13 bp, Homo sapiens
gactctgcccctt

SEQ ID NO: 319704 - DNA, 12 bp, Homo sapiens
gactctgcctcc

SEQ ID NO: 319705 - DNA, 13 bp, Homo sapiens
gactctgctgctc

SEQ ID NO: 319706 - DNA, 19 bp, Homo sapiens
gactctgctgctcatggga

SEQ ID NO: 319707 - DNA, 20 bp, Homo sapiens
gactctgtaaccacctctct

SEQ ID NO: 319708 - DNA, 13 bp, Homo sapiens
gactctgtctcag

SEQ ID NO: 319709 - DNA, 16 bp, Homo sapiens
gactctgtggggccac

SEQ ID NO: 319710 - DNA, 12 bp, Homo sapiens
gactcttcctgc

SEQ ID NO: 319711 - DNA, 13 bp, Homo sapiens
gactcttcctgca

SEQ ID NO: 319712 - DNA, 16 bp, Homo sapiens
gactgaaagaagaaca

SEQ ID NO: 319713 - DNA, 19 bp, Homo sapiens
gactgaaatggcttctatg

SEQ ID NO: 319714 - DNA, 16 bp, Homo sapiens
gactgaagcctgcagg

SEQ ID NO: 319715 - DNA, 13 bp, Homo sapiens
gactgaaggggca

SEQ ID NO: 319716 - DNA, 15 bp, Homo sapiens
gactgaaggggcaca

SEQ ID NO: 319717 - DNA, 22 bp, Homo sapiens
gactgaatttaactactaagaa

SEQ ID NO: 319718 - DNA, 16 bp, Homo sapiens
gactgacctgcccctg

SEQ ID NO: 319719 - DNA, 17 bp, Homo sapiens
gactgacggctgtgtat

SEQ ID NO: 319720 - DNA, 23 bp, Homo sapiens
gactgacggctgtgtatttctgt

SEQ ID NO: 319721 - DNA, 19 bp, Homo sapiens
gactgagcagactggtgag

SEQ ID NO: 319722 - DNA, 17 bp, Homo sapiens
gactgagccagtcccag

SEQ ID NO: 319723 - DNA, 14 bp, Homo sapiens
gactgaggacaggc

SEQ ID NO: 319724 - DNA, 13 bp, Homo sapiens
gactgaggagtgg

SEQ ID NO: 319725 - DNA, 14 bp, Homo sapiens
gactgagggcctgg

SEQ ID NO: 319726 - DNA, 10 bp, Homo sapiens
gactgatcct

SEQ ID NO: 319727 - DNA, 19 bp, Homo sapiens
gactgatcctgaacaagaa

SEQ ID NO: 319728 - DNA, 20 bp, Homo sapiens
gactgatcctgaacaagaaa

SEQ ID NO: 319729 - DNA, 23 bp, Homo sapiens
gactgatcctgaacaagaaagag

SEQ ID NO: 319730 - DNA, 13 bp, Homo sapiens
gactgatgtcatc

SEQ ID NO: 319731 - DNA, 14 bp, Homo sapiens
gactgatgtcatct

SEQ ID NO: 319732 - DNA, 15 bp, Homo sapiens
gactgatgtcatctt

SEQ ID NO: 319733 - DNA, 21 bp, Homo sapiens
gactgatgttaggctgggccc

SEQ ID NO: 319734 - DNA, 18 bp, Homo sapiens
gactgcaacttctgtccc

SEQ ID NO: 319735 - DNA, 14 bp, Homo sapiens
gactgcaatatcaa

SEQ ID NO: 319736 - DNA, 15 bp, Homo sapiens
gactgcagaggagcc

SEQ ID NO: 319737 - DNA, 22 bp, Homo sapiens
gactgcagggacacgggcagcc

SEQ ID NO: 319738 - DNA, 23 bp, Homo sapiens
gactgcaggttggaccccagaga

SEQ ID NO: 319739 - DNA, 13 bp, Homo sapiens
gactgcatgcaag

SEQ ID NO: 319740 - DNA, 15 bp, Homo sapiens
gactgcatgcaagct

SEQ ID NO: 319741 - DNA, 19 bp, Homo sapiens
gactgcatggtaatttata

SEQ ID NO: 319742 - DNA, 14 bp, Homo sapiens
gactgcccaccctg

SEQ ID NO: 319743 - DNA, 19 bp, Homo sapiens
gactgcccaccctgggcct

SEQ ID NO: 319744 - DNA, 21 bp, Homo sapiens
gactgcccaccctgggcctcc

SEQ ID NO: 319745 - DNA, 22 bp, Homo sapiens
gactgcccaccctgggcctccc

SEQ ID NO: 319746 - DNA, 22 bp, Homo sapiens
gactgccccacggccctgtcag

SEQ ID NO: 319747 - DNA, 14 bp, Homo sapiens
gactgcccccagaa

SEQ ID NO: 319748 - DNA, 17 bp, Homo sapiens
gactgccccgtgcagac

SEQ ID NO: 319749 - DNA, 18 bp, Homo sapiens
gactgccccttgcttctc

SEQ ID NO: 319750 - DNA, 19 bp, Homo sapiens
gactgccccttgcttctca

SEQ ID NO: 319751 - DNA, 12 bp, Homo sapiens
gactgcctccct

SEQ ID NO: 319752 - DNA, 14 bp, Homo sapiens
gactgcctccctct

SEQ ID NO: 319753 - DNA, 16 bp, Homo sapiens
gactgctgctccccac

SEQ ID NO: 319754 - DNA, 15 bp, Homo sapiens
gactggaggtgggca

SEQ ID NO: 319755 - DNA, 17 bp, Homo sapiens
gactggaggtgggcatg

SEQ ID NO: 319756 - DNA, 18 bp, Homo sapiens
gactggagtcagatgagc

SEQ ID NO: 319757 - DNA, 20 bp, Homo sapiens
gactggagtcagatgagcaa

SEQ ID NO: 319758 - DNA, 15 bp, Homo sapiens
gactggagtgaggct

SEQ ID NO: 319759 - DNA, 14 bp, Homo sapiens
gactggcaggtgca

SEQ ID NO: 319760 - DNA, 23 bp, Homo sapiens
gactggcaggtgcagatgggctg

SEQ ID NO: 319761 - DNA, 23 bp, Homo sapiens
gactggccaaggtttggggaaga

SEQ ID NO: 319762 - DNA, 16 bp, Homo sapiens
gactggccagaggcag

SEQ ID NO: 319763 - DNA, 21 bp, Homo sapiens
gactggcccacccctcttccc

SEQ ID NO: 319764 - DNA, 17 bp, Homo sapiens
gactggcccttgcccaa

SEQ ID NO: 319765 - DNA, 14 bp, Homo sapiens
gactggctgcacag

SEQ ID NO: 319766 - DNA, 17 bp, Homo sapiens
gactggctgcacagccc

SEQ ID NO: 319767 - DNA, 15 bp, Homo sapiens
gactggctgtctgcc

SEQ ID NO: 319768 - DNA, 13 bp, Homo sapiens
gactggctgtgag

SEQ ID NO: 319769 - DNA, 20 bp, Homo sapiens
gactgggaagataggctctg

SEQ ID NO: 319770 - DNA, 22 bp, Homo sapiens
gactgggaagataggctctgca

SEQ ID NO: 319771 - DNA, 21 bp, Homo sapiens
gactgggagccacttctcccc

SEQ ID NO: 319772 - DNA, 16 bp, Homo sapiens
gactgggagtcagagc

SEQ ID NO: 319773 - DNA, 17 bp, Homo sapiens
gactgggagtcagagcc

SEQ ID NO: 319774 - DNA, 18 bp, Homo sapiens
gactgggagtcagagccc

SEQ ID NO: 319775 - DNA, 20 bp, Homo sapiens
gactgggcctcccttgggct

SEQ ID NO: 319776 - DNA, 21 bp, Homo sapiens
gactgggcctcccttgggctg

SEQ ID NO: 319777 - DNA, 15 bp, Homo sapiens
gactgggggcctctg

SEQ ID NO: 319778 - DNA, 23 bp, Homo sapiens
gactgggtctcgctttgttgccc

SEQ ID NO: 319779 - DNA, 9 bp, Homo sapiens
gactggtcc

SEQ ID NO: 319780 - DNA, 11 bp, Homo sapiens
gactggtccag

SEQ ID NO: 319781 - DNA, 14 bp, Homo sapiens
gactggtgagcaga

SEQ ID NO: 319782 - DNA, 16 bp, Homo sapiens
gactgtactcctccca

SEQ ID NO: 319783 - DNA, 23 bp, Homo sapiens
gactgtactcctcccaggcgccc

SEQ ID NO: 319784 - DNA, 21 bp, Homo sapiens
gactgtagattgcttctgtag

SEQ ID NO: 319785 - DNA, 22 bp, Homo sapiens
gactgtagattgcttctgtagt

SEQ ID NO: 319786 - DNA, 20 bp, Homo sapiens
gactgtaggcgcccctgggg

SEQ ID NO: 319787 - DNA, 24 bp, Homo sapiens
ccagggtagacttggagctgtcct

SEQ ID NO: 319788 - DNA, 20 bp, Homo sapiens
ccagggtagagcaaaggaga

SEQ ID NO: 319789 - DNA, 20 bp, Homo sapiens
ccagggtaggcaaggctgcc

SEQ ID NO: 319790 - DNA, 22 bp, Homo sapiens
ccagggtaggcaaggctgccgg

SEQ ID NO: 319791 - DNA, 17 bp, Homo sapiens
ccagggtccgcaccagc

SEQ ID NO: 319792 - DNA, 14 bp, Homo sapiens
ccagggtcctgtgc

SEQ ID NO: 319793 - DNA, 16 bp, Homo sapiens
ccagggtctcactgag

SEQ ID NO: 319794 - DNA, 17 bp, Homo sapiens
ccagggtctcgtcagga

SEQ ID NO: 319795 - DNA, 21 bp, Homo sapiens
ccagggtcttgggctactggc

SEQ ID NO: 319796 - DNA, 22 bp, Homo sapiens
ccagggtcttgggctactggca

SEQ ID NO: 319797 - DNA, 19 bp, Homo sapiens
ccagggtctttactgggaa

SEQ ID NO: 319798 - DNA, 13 bp, Homo sapiens
ccagggtgagcag

SEQ ID NO: 319799 - DNA, 18 bp, Homo sapiens
ccagggttaaagaaaggc

SEQ ID NO: 319800 - DNA, 16 bp, Homo sapiens
ccaggtaccacccttc

SEQ ID NO: 319801 - DNA, 14 bp, Homo sapiens
ccaggtccctggac

SEQ ID NO: 319802 - DNA, 20 bp, Homo sapiens
ccaggtcctgtgagcaaagt

SEQ ID NO: 319803 - DNA, 19 bp, Homo sapiens
ccaggtcctttctcctgat

SEQ ID NO: 319804 - DNA, 14 bp, Homo sapiens
ccaggtcgggctca

SEQ ID NO: 319805 - DNA, 18 bp, Homo sapiens
ccaggtcgggctcagctc

SEQ ID NO: 319806 - DNA, 20 bp, Homo sapiens
ccaggtcgggctcagctctg

SEQ ID NO: 319807 - DNA, 16 bp, Homo sapiens
ccaggtctcactgctt

SEQ ID NO: 319808 - DNA, 21 bp, Homo sapiens
ccaggtcttgacctgaactct

SEQ ID NO: 319809 - DNA, 13 bp, Homo sapiens
ccaggtgcacaga

SEQ ID NO: 319810 - DNA, 15 bp, Homo sapiens
ccaggtgccctgtgg

SEQ ID NO: 319811 - DNA, 16 bp, Homo sapiens
ccaggtggccactcca

SEQ ID NO: 319812 - DNA, 16 bp, Homo sapiens
ccaggtgtcctgactg

SEQ ID NO: 319813 - DNA, 21 bp, Homo sapiens
ccaggttctggttagctcagc

SEQ ID NO: 319814 - DNA, 22 bp, Homo sapiens
ccaggttctggttagctcagcc

SEQ ID NO: 319815 - DNA, 14 bp, Homo sapiens
ccaggttggaaaag

SEQ ID NO: 319816 - DNA, 21 bp, Homo sapiens
ccaggttggaggccctaggcg

SEQ ID NO: 319817 - DNA, 16 bp, Homo sapiens
ccaggtttagacagta

SEQ ID NO: 319818 - DNA, 17 bp, Homo sapiens
ccaggttttctgctctg

SEQ ID NO: 319819 - DNA, 20 bp, Homo sapiens
ccagtaacgcgtcttcctga

SEQ ID NO: 319820 - DNA, 17 bp, Homo sapiens
ccagtaaggcagctctg

SEQ ID NO: 319821 - DNA, 18 bp, Homo sapiens
ccagtacctccaagcaag

SEQ ID NO: 319822 - DNA, 23 bp, Homo sapiens
ccagtacgtcccgctgctgtgct

SEQ ID NO: 319823 - DNA, 16 bp, Homo sapiens
ccagtacgtgctaaca

SEQ ID NO: 319824 - DNA, 17 bp, Homo sapiens
ccagtactgggaaggag

SEQ ID NO: 319825 - DNA, 21 bp, Homo sapiens
ccagtagctacggttccctgc

SEQ ID NO: 319826 - DNA, 17 bp, Homo sapiens
ccagtatataagctgtt

SEQ ID NO: 319827 - DNA, 21 bp, Homo sapiens
ccagtatataagctgtttagt

SEQ ID NO: 319828 - DNA, 16 bp, Homo sapiens
ccagtattctcagagc

SEQ ID NO: 319829 - DNA, 17 bp, Homo sapiens
ccagtattgaaaacttc

SEQ ID NO: 319830 - DNA, 19 bp, Homo sapiens
ccagtcacagccatttcaa

SEQ ID NO: 319831 - DNA, 19 bp, Homo sapiens
ccagtcagggacagcagcc

SEQ ID NO: 319832 - DNA, 22 bp, Homo sapiens
ccagtcagggacagcagcctcc

SEQ ID NO: 319833 - DNA, 19 bp, Homo sapiens
ccagtcaggtagttgcaat

SEQ ID NO: 319834 - DNA, 18 bp, Homo sapiens
ccagtccaaatgtcctcc

SEQ ID NO: 319835 - DNA, 14 bp, Homo sapiens
ccagtccactgggg

SEQ ID NO: 319836 - DNA, 18 bp, Homo sapiens
ccagtccccctgccccag

SEQ ID NO: 319837 - DNA, 15 bp, Homo sapiens
ccagtccctggagct

SEQ ID NO: 319838 - DNA, 20 bp, Homo sapiens
ccagtcctcacatgcccgct

SEQ ID NO: 319839 - DNA, 19 bp, Homo sapiens
ccagtcctccagaccacca

SEQ ID NO: 319840 - DNA, 18 bp, Homo sapiens
ccagtcctgcctggccag

SEQ ID NO: 319841 - DNA, 23 bp, Homo sapiens
ccagtccttagcaaggggctcag

SEQ ID NO: 319842 - DNA, 15 bp, Homo sapiens
ccagtcgccctctgt

SEQ ID NO: 319843 - DNA, 16 bp, Homo sapiens
ccagtcgccctctgtg

SEQ ID NO: 319844 - DNA, 18 bp, Homo sapiens
ccagtctccaccaggaac

SEQ ID NO: 319845 - DNA, 19 bp, Homo sapiens
ccagtctccaccaggaacc

SEQ ID NO: 319846 - DNA, 23 bp, Homo sapiens
ccagtctccaccaggaacctctt

SEQ ID NO: 319847 - DNA, 12 bp, Homo sapiens
ccagtctcccag

SEQ ID NO: 319848 - DNA, 14 bp, Homo sapiens
ccagtctcccaggc

SEQ ID NO: 319849 - DNA, 12 bp, Homo sapiens
ccagtctgaagt

SEQ ID NO: 319850 - DNA, 14 bp, Homo sapiens
ccagtctgaagttt

SEQ ID NO: 319851 - DNA, 21 bp, Homo sapiens
ccagtctgaagtttcatttat

SEQ ID NO: 319852 - DNA, 23 bp, Homo sapiens
ccagtctgctgccctccatcccg

SEQ ID NO: 319853 - DNA, 14 bp, Homo sapiens
ccagtctgttctca

SEQ ID NO: 319854 - DNA, 15 bp, Homo sapiens
ccagtcttctccctg

SEQ ID NO: 319855 - DNA, 17 bp, Homo sapiens
ccagtcttctccctgtc

SEQ ID NO: 319856 - DNA, 17 bp, Homo sapiens
ccagtcttgcctaggcc

SEQ ID NO: 319857 - DNA, 14 bp, Homo sapiens
ccagtgaaaactag

SEQ ID NO: 319858 - DNA, 20 bp, Homo sapiens
ccagtgaacttacacttgga

SEQ ID NO: 319859 - DNA, 20 bp, Homo sapiens
ccagtgaagtccttcagtga

SEQ ID NO: 319860 - DNA, 19 bp, Homo sapiens
ccagtgacacttcagagag

SEQ ID NO: 319861 - DNA, 23 bp, Homo sapiens
ccagtgacacttcagagagctgg

SEQ ID NO: 319862 - DNA, 20 bp, Homo sapiens
ccagtgacctgctgggtaaa

SEQ ID NO: 319863 - DNA, 16 bp, Homo sapiens
ccagtgaggacctcga

SEQ ID NO: 319864 - DNA, 15 bp, Homo sapiens
ccagtgcaacagcac

SEQ ID NO: 319865 - DNA, 19 bp, Homo sapiens
ccagtgcccaaagtctgtg

SEQ ID NO: 319866 - DNA, 22 bp, Homo sapiens
ccagtgcccaaagtctgtgtga

SEQ ID NO: 319867 - DNA, 14 bp, Homo sapiens
ccagtgcctgccac

SEQ ID NO: 319868 - DNA, 15 bp, Homo sapiens
ccagtgcctgccact

SEQ ID NO: 319869 - DNA, 17 bp, Homo sapiens
ccagtgcctgccactct

SEQ ID NO: 319870 - DNA, 18 bp, Homo sapiens
ccagtgcctgccactctc

SEQ ID NO: 319871 - DNA, 21 bp, Homo sapiens
ccagtgcctgccactctctgg

SEQ ID NO: 319872 - DNA, 15 bp, Homo sapiens
ccagtgcctgtctgg

SEQ ID NO: 319873 - DNA, 20 bp, Homo sapiens
ccagtgcctgtctggagctc

SEQ ID NO: 319874 - DNA, 11 bp, Homo sapiens
gactttctgtt

SEQ ID NO: 319875 - DNA, 21 bp, Homo sapiens
gactttgcagccggcacaggg

SEQ ID NO: 319876 - DNA, 15 bp, Homo sapiens
gactttgcttcccat

SEQ ID NO: 319877 - DNA, 17 bp, Homo sapiens
gactttgtttttaaaat

SEQ ID NO: 319878 - DNA, 17 bp, Homo sapiens
gacttttcgttaacatt

SEQ ID NO: 319879 - DNA, 19 bp, Homo sapiens
gacttttcgttaacattga

SEQ ID NO: 319880 - DNA, 13 bp, Homo sapiens
gacttttgaagaa

SEQ ID NO: 319881 - DNA, 14 bp, Homo sapiens
gacttttgaagaac

SEQ ID NO: 319882 - DNA, 16 bp, Homo sapiens
gacttttgaagaacaa

SEQ ID NO: 319883 - DNA, 17 bp, Homo sapiens
gactttttaaaatataa

SEQ ID NO: 319884 - DNA, 17 bp, Homo sapiens
gactttttagccagtga

SEQ ID NO: 319885 - DNA, 14 bp, Homo sapiens
gagaaaaaagaagt

SEQ ID NO: 319886 - DNA, 17 bp, Homo sapiens
gagaaaaaccaatgatt

SEQ ID NO: 319887 - DNA, 12 bp, Homo sapiens
gagaaaaagaga

SEQ ID NO: 319888 - DNA, 23 bp, Homo sapiens
gagaaaactgaccatcagtatat

SEQ ID NO: 319889 - DNA, 16 bp, Homo sapiens
gagaaaataaatttaa

SEQ ID NO: 319890 - DNA, 23 bp, Homo sapiens
gagaaaccttattgtacctctct

SEQ ID NO: 319891 - DNA, 20 bp, Homo sapiens
gagaaacgtccatctctctc

SEQ ID NO: 319892 - DNA, 22 bp, Homo sapiens
gagaaagaaaaggaatgcaaga

SEQ ID NO: 319893 - DNA, 21 bp, Homo sapiens
gagaaagaaagagaaagtact

SEQ ID NO: 319894 - DNA, 14 bp, Homo sapiens
gagaaagaatgaga

SEQ ID NO: 319895 - DNA, 16 bp, Homo sapiens
gagaaagaatgagaaa

SEQ ID NO: 319896 - DNA, 20 bp, Homo sapiens
gagaaagcccacctgggctg

SEQ ID NO: 319897 - DNA, 21 bp, Homo sapiens
gagaaagcccacctgggctgg

SEQ ID NO: 319898 - DNA, 16 bp, Homo sapiens
gagaaaggattaagat

SEQ ID NO: 319899 - DNA, 16 bp, Homo sapiens
gagaaatgaggaagaa

SEQ ID NO: 319900 - DNA, 11 bp, Homo sapiens
gagaaattatt

SEQ ID NO: 319901 - DNA, 18 bp, Homo sapiens
gagaaatttttttccaga

SEQ ID NO: 319902 - DNA, 23 bp, Homo sapiens
gagaaatttttttccagaattga

SEQ ID NO: 319903 - DNA, 16 bp, Homo sapiens
gagaacaagtcacagc

SEQ ID NO: 319904 - DNA, 17 bp, Homo sapiens
gagaacaagtcacagct

SEQ ID NO: 319905 - DNA, 22 bp, Homo sapiens
gagaacaagtcacagctgcagc

SEQ ID NO: 319906 - DNA, 17 bp, Homo sapiens
gagaacacatttctaat

SEQ ID NO: 319907 - DNA, 22 bp, Homo sapiens
gagaacagttgagagagaatct

SEQ ID NO: 319908 - DNA, 22 bp, Homo sapiens
gagaacatctgccttgctgcac

SEQ ID NO: 319909 - DNA, 22 bp, Homo sapiens
gagaaccgagcaaagatcaaaa

SEQ ID NO: 319910 - DNA, 11 bp, Homo sapiens
gagaactgact

SEQ ID NO: 319911 - DNA, 16 bp, Homo sapiens
gagaactgactttctc

SEQ ID NO: 319912 - DNA, 13 bp, Homo sapiens
gagaagagccctg

SEQ ID NO: 319913 - DNA, 14 bp, Homo sapiens
gagaagagccctgg

SEQ ID NO: 319914 - DNA, 21 bp, Homo sapiens
gagaagcatcggagggaattg

SEQ ID NO: 319915 - DNA, 13 bp, Homo sapiens
gagaagcatgaaa

SEQ ID NO: 319916 - DNA, 16 bp, Homo sapiens
gagaagcctcatggga

SEQ ID NO: 319917 - DNA, 18 bp, Homo sapiens
gagaagcctcatgggagt

SEQ ID NO: 319918 - DNA, 20 bp, Homo sapiens
gagaagctctcgagggaagc

SEQ ID NO: 319919 - DNA, 18 bp, Homo sapiens
gagaaggaaaaggctggc

SEQ ID NO: 319920 - DNA, 22 bp, Homo sapiens
gagaaggaaaaggctggcaagg

SEQ ID NO: 319921 - DNA, 12 bp, Homo sapiens
gagaaggagagg

SEQ ID NO: 319922 - DNA, 15 bp, Homo sapiens
gagaaggagaggctc

SEQ ID NO: 319923 - DNA, 17 bp, Homo sapiens
gagaaggcaagctggca

SEQ ID NO: 319924 - DNA, 19 bp, Homo sapiens
ccatatataaattattact

SEQ ID NO: 319925 - DNA, 17 bp, Homo sapiens
ccatatcagacctctga

SEQ ID NO: 319926 - DNA, 19 bp, Homo sapiens
ccatatcagacctctgatc

SEQ ID NO: 319927 - DNA, 22 bp, Homo sapiens
ccatatcagacctctgatccct

SEQ ID NO: 319928 - DNA, 18 bp, Homo sapiens
ccatatcagctctctgca

SEQ ID NO: 319929 - DNA, 20 bp, Homo sapiens
ccatatcagctctctgcaga

SEQ ID NO: 319930 - DNA, 20 bp, Homo sapiens
ccatatgacaatttcaaaat

SEQ ID NO: 319931 - DNA, 23 bp, Homo sapiens
ccatatgacaatttcaaaatgca

SEQ ID NO: 319932 - DNA, 16 bp, Homo sapiens
ccatatggaggcctga

SEQ ID NO: 319933 - DNA, 16 bp, Homo sapiens
ccatatttctttttct

SEQ ID NO: 319934 - DNA, 23 bp, Homo sapiens
ccatcaccccttccccatttcct

SEQ ID NO: 319935 - DNA, 13 bp, Homo sapiens
ccatcactcggct

SEQ ID NO: 319936 - DNA, 22 bp, Homo sapiens
ccatcactgctgtccctcctga

SEQ ID NO: 319937 - DNA, 16 bp, Homo sapiens
ccatcacttctccccg

SEQ ID NO: 319938 - DNA, 15 bp, Homo sapiens
ccatcagcagtgatt

SEQ ID NO: 319939 - DNA, 16 bp, Homo sapiens
ccatcagcccctgctg

SEQ ID NO: 319940 - DNA, 19 bp, Homo sapiens
ccatcagcccctgctgctc

SEQ ID NO: 319941 - DNA, 14 bp, Homo sapiens
ccatcagttactgg

SEQ ID NO: 319942 - DNA, 18 bp, Homo sapiens
ccatcagttactggtttc

SEQ ID NO: 319943 - DNA, 20 bp, Homo sapiens
ccatcagttcccccagtacc

SEQ ID NO: 319944 - DNA, 15 bp, Homo sapiens
ccatcatcatagagg

SEQ ID NO: 319945 - DNA, 13 bp, Homo sapiens
ccatcatctctgc

SEQ ID NO: 319946 - DNA, 19 bp, Homo sapiens
ccatcatctctgtaaacca

SEQ ID NO: 319947 - DNA, 13 bp, Homo sapiens
ccatcatgcctga

SEQ ID NO: 319948 - DNA, 17 bp, Homo sapiens
ccatcattataaacgtg

SEQ ID NO: 319949 - DNA, 13 bp, Homo sapiens
ccatcatttctgt

SEQ ID NO: 319950 - DNA, 19 bp, Homo sapiens
ccatccactctaccctccc

SEQ ID NO: 319951 - DNA, 22 bp, Homo sapiens
ccatccactctaccctcccacc

SEQ ID NO: 319952 - DNA, 22 bp, Homo sapiens
ccatccagcatgtgtgtgtctc

SEQ ID NO: 319953 - DNA, 19 bp, Homo sapiens
ccatccatggagcacgagg

SEQ ID NO: 319954 - DNA, 20 bp, Homo sapiens
ccatcccaaacccttcagtg

SEQ ID NO: 319955 - DNA, 13 bp, Homo sapiens
ccatcccacctct

SEQ ID NO: 319956 - DNA, 16 bp, Homo sapiens
ccatccccaactccat

SEQ ID NO: 319957 - DNA, 13 bp, Homo sapiens
ccatccccaccag

SEQ ID NO: 319958 - DNA, 12 bp, Homo sapiens
ccatcccctccc

SEQ ID NO: 319959 - DNA, 12 bp, Homo sapiens
ccatccctgctt

SEQ ID NO: 319960 - DNA, 15 bp, Homo sapiens
ccatcctaccaatgc

SEQ ID NO: 319961 - DNA, 15 bp, Homo sapiens
ccatcctccccttcc

SEQ ID NO: 319962 - DNA, 18 bp, Homo sapiens
ccatcctccccttccctg

SEQ ID NO: 319963 - DNA, 21 bp, Homo sapiens
ccatcctccccttccctgcaa

SEQ ID NO: 319964 - DNA, 21 bp, Homo sapiens
ccatcctgcagcctcctcctg

SEQ ID NO: 319965 - DNA, 22 bp, Homo sapiens
ccatcctgcagcctcctcctga

SEQ ID NO: 319966 - DNA, 13 bp, Homo sapiens
ccatcctgccagg

SEQ ID NO: 319967 - DNA, 14 bp, Homo sapiens
ccatcctgccagga

SEQ ID NO: 319968 - DNA, 13 bp, Homo sapiens
ccatcctggcccc

SEQ ID NO: 319969 - DNA, 14 bp, Homo sapiens
ccatcctggcccct

SEQ ID NO: 319970 - DNA, 16 bp, Homo sapiens
ccatcctggcccctcc

SEQ ID NO: 319971 - DNA, 19 bp, Homo sapiens
ccatcctggcccctccaga

SEQ ID NO: 319972 - DNA, 20 bp, Homo sapiens
ccatccttgactgaagcgaa

SEQ ID NO: 319973 - DNA, 15 bp, Homo sapiens
ccatcgggtgccaaa

SEQ ID NO: 319974 - DNA, 20 bp, Homo sapiens
ccatcggtcctgtctcccct

SEQ ID NO: 319975 - DNA, 14 bp, Homo sapiens
ccatctactggata

SEQ ID NO: 319976 - DNA, 12 bp, Homo sapiens
ccatctcagcct

SEQ ID NO: 319977 - DNA, 18 bp, Homo sapiens
ccatctcagcctcctgag

SEQ ID NO: 319978 - DNA, 20 bp, Homo sapiens
ccatctcaggccacctgccc

SEQ ID NO: 319979 - DNA, 13 bp, Homo sapiens
ccatctcaggtgc

SEQ ID NO: 319980 - DNA, 14 bp, Homo sapiens
ccatctcaggtgcc

SEQ ID NO: 319981 - DNA, 15 bp, Homo sapiens
ccatctcaggtgcca

SEQ ID NO: 319982 - DNA, 17 bp, Homo sapiens
ccatctcaggtgccact

SEQ ID NO: 319983 - DNA, 22 bp, Homo sapiens
ccatctcaggtgccactccctg

SEQ ID NO: 319984 - DNA, 23 bp, Homo sapiens
ccatctccccaggcctccagcct

SEQ ID NO: 319985 - DNA, 13 bp, Homo sapiens
ccatctcctccca

SEQ ID NO: 319986 - DNA, 20 bp, Homo sapiens
ccatctccttcccccagccc

SEQ ID NO: 319987 - DNA, 23 bp, Homo sapiens
ccatctccttcccccagcccaat

SEQ ID NO: 319988 - DNA, 22 bp, Homo sapiens
ccatctcgtagtggtacattcc

SEQ ID NO: 319989 - DNA, 19 bp, Homo sapiens
ccatctctgaacttcagct

SEQ ID NO: 319990 - DNA, 15 bp, Homo sapiens
ccatctgctgagctc

SEQ ID NO: 319991 - DNA, 18 bp, Homo sapiens
ccatctgctgagctctga

SEQ ID NO: 319992 - DNA, 12 bp, Homo sapiens
ccatctggcctg

SEQ ID NO: 319993 - DNA, 13 bp, Homo sapiens
ccatctggcctgg

SEQ ID NO: 319994 - DNA, 11 bp, Homo sapiens
ccatctgtaaa

SEQ ID NO: 319995 - DNA, 20 bp, Homo sapiens
ccatctgtaaatatcccaga

SEQ ID NO: 319996 - DNA, 14 bp, Homo sapiens
ccatctgtacatat

SEQ ID NO: 319997 - DNA, 16 bp, Homo sapiens
ccatctgtaccctgct

SEQ ID NO: 319998 - DNA, 19 bp, Homo sapiens
ccatctgtttggtgggggt

SEQ ID NO: 319999 - DNA, 12 bp, Homo sapiens
ccatcttaatct

SEQ ID NO: 320000 - DNA, 15 bp, Homo sapiens
ccatcttaatcttta

SEQ ID NO: 320001 - DNA, 14 bp, Homo sapiens
ccatcttcctgctg

SEQ ID NO: 320002 - DNA, 15 bp, Homo sapiens
ccatcttcctgctgc

SEQ ID NO: 320003 - DNA, 16 bp, Homo sapiens
ccatcttcctgctgct

SEQ ID NO: 320004 - DNA, 20 bp, Homo sapiens
ccatcttggtagttctgtgc

SEQ ID NO: 320005 - DNA, 22 bp, Homo sapiens
ccatcttggtagttctgtgcct

SEQ ID NO: 320006 - DNA, 20 bp, Homo sapiens
ccatcttttaatatgctgtg

SEQ ID NO: 320007 - DNA, 21 bp, Homo sapiens
ccatcttttgttaagttcacc

SEQ ID NO: 320008 - DNA, 19 bp, Homo sapiens
ccatgaatgtatcaggaaa

SEQ ID NO: 320009 - DNA, 23 bp, Homo sapiens
ccatgaccagaagggaaacagtc

SEQ ID NO: 320010 - DNA, 16 bp, Homo sapiens
ccatgaccaggccacc

SEQ ID NO: 320011 - DNA, 20 bp, Homo sapiens
ccatgaccttgacgtgtgtg

SEQ ID NO: 320012 - DNA, 19 bp, Homo sapiens
ccatgaccttggggtacaa

SEQ ID NO: 320013 - DNA, 16 bp, Homo sapiens
ccatgactgcacccag

SEQ ID NO: 320014 - DNA, 17 bp, Homo sapiens
ccatgactgcacccagc

SEQ ID NO: 320015 - DNA, 20 bp, Homo sapiens
ccatgactgcacccagctcc

SEQ ID NO: 320016 - DNA, 21 bp, Homo sapiens
ccatgactgcacccagctcca

SEQ ID NO: 320017 - DNA, 17 bp, Homo sapiens
ccatgactgcattttac

SEQ ID NO: 320018 - DNA, 17 bp, Homo sapiens
ccatgactgccccttgc

SEQ ID NO: 320019 - DNA, 22 bp, Homo sapiens
ccatgactgccccttgcttctc

SEQ ID NO: 320020 - DNA, 14 bp, Homo sapiens
ccatgactggctgt

SEQ ID NO: 320021 - DNA, 22 bp, Homo sapiens
ccatgactggctgtctgcctgt

SEQ ID NO: 320022 - DNA, 18 bp, Homo sapiens
ccatgactgtgaccacct

SEQ ID NO: 320023 - DNA, 21 bp, Homo sapiens
ccatgactgtgaccaccttct

SEQ ID NO: 320024 - DNA, 20 bp, Homo sapiens
ccatgagaacaaaacctctt

SEQ ID NO: 320025 - DNA, 19 bp, Homo sapiens
ccatgagaagagggcctgt

SEQ ID NO: 320026 - DNA, 21 bp, Homo sapiens
ccatgagcaccccaaggctgc

SEQ ID NO: 320027 - DNA, 22 bp, Homo sapiens
ccatgagcaccccaaggctgcg

SEQ ID NO: 320028 - DNA, 17 bp, Homo sapiens
ccatgagctccagaccc

SEQ ID NO: 320029 - DNA, 23 bp, Homo sapiens
ccatgagctccagacccccagca

SEQ ID NO: 320030 - DNA, 16 bp, Homo sapiens
ccatgaggaacaaggc

SEQ ID NO: 320031 - DNA, 23 bp, Homo sapiens
ccatgaggaacaaggcaaggctg

SEQ ID NO: 320032 - DNA, 15 bp, Homo sapiens
ccatgaggcctcagt

SEQ ID NO: 320033 - DNA, 22 bp, Homo sapiens
ccatgaggtaaaagagccaagt

SEQ ID NO: 320034 - DNA, 18 bp, Homo sapiens
ccatgagtttgccctggt

SEQ ID NO: 320035 - DNA, 13 bp, Homo sapiens
ccatgataaaata

SEQ ID NO: 320036 - DNA, 14 bp, Homo sapiens
ccatgatccctgtg

SEQ ID NO: 320037 - DNA, 19 bp, Homo sapiens
ccatgatgtcgttcatttt

SEQ ID NO: 320038 - DNA, 15 bp, Homo sapiens
ccatgatgtggagtg

SEQ ID NO: 320039 - DNA, 22 bp, Homo sapiens
ccatgatgtggagtggggcagt

SEQ ID NO: 320040 - DNA, 14 bp, Homo sapiens
ccatgattccaagg

SEQ ID NO: 320041 - DNA, 22 bp, Homo sapiens
ccatgattccaagggcccagag

SEQ ID NO: 320042 - DNA, 16 bp, Homo sapiens
ccatgcaactccatgc

SEQ ID NO: 320043 - DNA, 20 bp, Homo sapiens
ccatgcaactccatgcctat

SEQ ID NO: 320044 - DNA, 16 bp, Homo sapiens
ccatgcacagaacaag

SEQ ID NO: 320045 - DNA, 17 bp, Homo sapiens
ccatgcagatctagcca

SEQ ID NO: 320046 - DNA, 21 bp, Homo sapiens
ccatgcagatctagccaggcc

SEQ ID NO: 320047 - DNA, 12 bp, Homo sapiens
ccatgcatggcc

SEQ ID NO: 320048 - DNA, 19 bp, Homo sapiens
ccatgcatggcctcccagc

SEQ ID NO: 320049 - DNA, 20 bp, Homo sapiens
ccatgcatggcctcccagcc

SEQ ID NO: 320050 - DNA, 16 bp, Homo sapiens
ccatgccaccacccac

SEQ ID NO: 320051 - DNA, 23 bp, Homo sapiens
ccatgccactgccaggcacctgg

SEQ ID NO: 320052 - DNA, 15 bp, Homo sapiens
ccatgcccacctgcc

SEQ ID NO: 320053 - DNA, 18 bp, Homo sapiens
ccatgcccacctgcccat

SEQ ID NO: 320054 - DNA, 15 bp, Homo sapiens
ccatgccctgccaag

SEQ ID NO: 320055 - DNA, 20 bp, Homo sapiens
ccatgcctcatgccacacct

SEQ ID NO: 320056 - DNA, 15 bp, Homo sapiens
ccatgcctgagggtg

SEQ ID NO: 320057 - DNA, 20 bp, Homo sapiens
gagaaggcaagctggcagga

SEQ ID NO: 320058 - DNA, 18 bp, Homo sapiens
gagaaggccctgtgccct

SEQ ID NO: 320059 - DNA, 12 bp, Homo sapiens
gagaaggcctgc

SEQ ID NO: 320060 - DNA, 18 bp, Homo sapiens
gagaaggcctgcccccct

SEQ ID NO: 320061 - DNA, 13 bp, Homo sapiens
gagaaggcctggt

SEQ ID NO: 320062 - DNA, 21 bp, Homo sapiens
gagaaggcctggtcagcagag

SEQ ID NO: 320063 - DNA, 16 bp, Homo sapiens
gagaagggagaacagg

SEQ ID NO: 320064 - DNA, 20 bp, Homo sapiens
gagaagggagaacaggggtc

SEQ ID NO: 320065 - DNA, 15 bp, Homo sapiens
gagaagtactaagac

SEQ ID NO: 320066 - DNA, 14 bp, Homo sapiens
gagaagtcaaacat

SEQ ID NO: 320067 - DNA, 21 bp, Homo sapiens
gagaagtcagttggagaaaat

SEQ ID NO: 320068 - DNA, 20 bp, Homo sapiens
gagaagtgcccctgctgcct

SEQ ID NO: 320069 - DNA, 23 bp, Homo sapiens
gagaagttaagcagcctttctgt

SEQ ID NO: 320070 - DNA, 16 bp, Homo sapiens
gagaataaatttggga

SEQ ID NO: 320071 - DNA, 22 bp, Homo sapiens
gagaataagagaaagaaaatga

SEQ ID NO: 320072 - DNA, 14 bp, Homo sapiens
gagaataattgtgt

SEQ ID NO: 320073 - DNA, 18 bp, Homo sapiens
gagaatagcagtttcact

SEQ ID NO: 320074 - DNA, 18 bp, Homo sapiens
gagaatcagacctgggtg

SEQ ID NO: 320075 - DNA, 22 bp, Homo sapiens
gagaatccaagcctaaaattaa

SEQ ID NO: 320076 - DNA, 18 bp, Homo sapiens
gagaatctcaagattcta

SEQ ID NO: 320077 - DNA, 14 bp, Homo sapiens
gagaatctgagggc

SEQ ID NO: 320078 - DNA, 19 bp, Homo sapiens
gagaatgagagagtgtgga

SEQ ID NO: 320079 - DNA, 15 bp, Homo sapiens
gagaatgccagccca

SEQ ID NO: 320080 - DNA, 18 bp, Homo sapiens
gagaatgccagcccaaag

SEQ ID NO: 320081 - DNA, 14 bp, Homo sapiens
gagaatggctctgg

SEQ ID NO: 320082 - DNA, 21 bp, Homo sapiens
gagaatgtagatattgtgaag

SEQ ID NO: 320083 - DNA, 13 bp, Homo sapiens
gagaatgtcattt

SEQ ID NO: 320084 - DNA, 17 bp, Homo sapiens
gagaatgtgcagtgtct

SEQ ID NO: 320085 - DNA, 12 bp, Homo sapiens
gagaattaaaat

SEQ ID NO: 320086 - DNA, 15 bp, Homo sapiens
gagaattaaactcct

SEQ ID NO: 320087 - DNA, 22 bp, Homo sapiens
gagaattattacatctttatta

SEQ ID NO: 320088 - DNA, 18 bp, Homo sapiens
gagaattcagctgccccc

SEQ ID NO: 320089 - DNA, 16 bp, Homo sapiens
gagacaaagcaggagt

SEQ ID NO: 320090 - DNA, 15 bp, Homo sapiens
gagacaacacacaca

SEQ ID NO: 320091 - DNA, 16 bp, Homo sapiens
gagacaagccctggca

SEQ ID NO: 320092 - DNA, 17 bp, Homo sapiens
gagacaagccctggcaa

SEQ ID NO: 320093 - DNA, 14 bp, Homo sapiens
gagacaatctaaaa

SEQ ID NO: 320094 - DNA, 18 bp, Homo sapiens
gagacaatgcagatgcca

SEQ ID NO: 320095 - DNA, 22 bp, Homo sapiens
gagacaccctaactcttgctca

SEQ ID NO: 320096 - DNA, 19 bp, Homo sapiens
gagacacctcagagccccg

SEQ ID NO: 320097 - DNA, 20 bp, Homo sapiens
gagacactaacgacttcagg

SEQ ID NO: 320098 - DNA, 15 bp, Homo sapiens
gagacactggtctca

SEQ ID NO: 320099 - DNA, 14 bp, Homo sapiens
gagacactgtcaag

SEQ ID NO: 320100 - DNA, 17 bp, Homo sapiens
gagacacttgccttctt

SEQ ID NO: 320101 - DNA, 12 bp, Homo sapiens
gagacagaagca

SEQ ID NO: 320102 - DNA, 16 bp, Homo sapiens
gagacagaagcaggct

SEQ ID NO: 320103 - DNA, 18 bp, Homo sapiens
gagacagagtctcgctct

SEQ ID NO: 320104 - DNA, 20 bp, Homo sapiens
gagacagccggatcttggag

SEQ ID NO: 320105 - DNA, 18 bp, Homo sapiens
gagacagcgcgagtagca

SEQ ID NO: 320106 - DNA, 12 bp, Homo sapiens
gagacaggaagg

SEQ ID NO: 320107 - DNA, 13 bp, Homo sapiens
gagacagtggggg

SEQ ID NO: 320108 - DNA, 19 bp, Homo sapiens
gagacagtgggggtgcctg

SEQ ID NO: 320109 - DNA, 20 bp, Homo sapiens
gagacagtgggggtgcctgg

SEQ ID NO: 320110 - DNA, 19 bp, Homo sapiens
gagaccaagccggtgccca

SEQ ID NO: 320111 - DNA, 19 bp, Homo sapiens
gagaccaagtcctggctac

SEQ ID NO: 320112 - DNA, 12 bp, Homo sapiens
gagaccacctct

SEQ ID NO: 320113 - DNA, 23 bp, Homo sapiens
gagaccagaagtgaatgggaaag

SEQ ID NO: 320114 - DNA, 13 bp, Homo sapiens
gagaccagccttt

SEQ ID NO: 320115 - DNA, 18 bp, Homo sapiens
gagaccagcctttcttcc

SEQ ID NO: 320116 - DNA, 12 bp, Homo sapiens
gagaccaggact

SEQ ID NO: 320117 - DNA, 14 bp, Homo sapiens
gagaccaggactct

SEQ ID NO: 320118 - DNA, 21 bp, Homo sapiens
gagaccagttgggagcactgg

SEQ ID NO: 320119 - DNA, 23 bp, Homo sapiens
gagaccatcctggcccctccaga

SEQ ID NO: 320120 - DNA, 17 bp, Homo sapiens
gagaccccagagtaggg

SEQ ID NO: 320121 - DNA, 13 bp, Homo sapiens
gagaccctcttct

SEQ ID NO: 320122 - DNA, 18 bp, Homo sapiens
gagaccctcttctctggg

SEQ ID NO: 320123 - DNA, 12 bp, Homo sapiens
gagaccctgcca

SEQ ID NO: 320124 - DNA, 23 bp, Homo sapiens
gagaccctgccaactttccagac

SEQ ID NO: 320125 - DNA, 14 bp, Homo sapiens
gagaccgagtgaac

SEQ ID NO: 320126 - DNA, 21 bp, Homo sapiens
gagaccgcttcacccctgcac

SEQ ID NO: 320127 - DNA, 20 bp, Homo sapiens
gagaccggaattgagaggtg

SEQ ID NO: 320128 - DNA, 12 bp, Homo sapiens
gagacctcatca

SEQ ID NO: 320129 - DNA, 19 bp, Homo sapiens
gagacctcatcaggatgaa

SEQ ID NO: 320130 - DNA, 21 bp, Homo sapiens
gagacctcatcaggatgaacc

SEQ ID NO: 320131 - DNA, 16 bp, Homo sapiens
gagacctcttctatct

SEQ ID NO: 320132 - DNA, 19 bp, Homo sapiens
gagacctggaaccagagcc

SEQ ID NO: 320133 - DNA, 12 bp, Homo sapiens
gagacctgtgct

SEQ ID NO: 320134 - DNA, 15 bp, Homo sapiens
ccatgttgggaaaaa

SEQ ID NO: 320135 - DNA, 19 bp, Homo sapiens
ccatgttgggaaaaactgg

SEQ ID NO: 320136 - DNA, 15 bp, Homo sapiens
ccatgtttgtaaaac

SEQ ID NO: 320137 - DNA, 16 bp, Homo sapiens
ccattaaaactgcttt

SEQ ID NO: 320138 - DNA, 21 bp, Homo sapiens
ccattaacaggtctttgaaat

SEQ ID NO: 320139 - DNA, 14 bp, Homo sapiens
ccattatctgctgt

SEQ ID NO: 320140 - DNA, 15 bp, Homo sapiens
ccattatctgctgtt

SEQ ID NO: 320141 - DNA, 17 bp, Homo sapiens
ccattatctgctgttcc

SEQ ID NO: 320142 - DNA, 18 bp, Homo sapiens
ccattatggctttgtgct

SEQ ID NO: 320143 - DNA, 13 bp, Homo sapiens
ccattcaccttcc

SEQ ID NO: 320144 - DNA, 17 bp, Homo sapiens
ccattcaggaacctgga

SEQ ID NO: 320145 - DNA, 18 bp, Homo sapiens
ccattcatctgggctggc

SEQ ID NO: 320146 - DNA, 15 bp, Homo sapiens
ccattcatctttcct

SEQ ID NO: 320147 - DNA, 21 bp, Homo sapiens
ccattccaagtcaacactctt

SEQ ID NO: 320148 - DNA, 15 bp, Homo sapiens
ccattccacatcccc

SEQ ID NO: 320149 - DNA, 14 bp, Homo sapiens
ccattcccccatgt

SEQ ID NO: 320150 - DNA, 17 bp, Homo sapiens
ccattcccccatgtggc

SEQ ID NO: 320151 - DNA, 15 bp, Homo sapiens
ccattccgaccttca

SEQ ID NO: 320152 - DNA, 16 bp, Homo sapiens
ccattcgtctgtccca

SEQ ID NO: 320153 - DNA, 19 bp, Homo sapiens
ccattctagatcctgcacc

SEQ ID NO: 320154 - DNA, 20 bp, Homo sapiens
ccattctcctgcctcagcct

SEQ ID NO: 320155 - DNA, 12 bp, Homo sapiens
ccattctttctg

SEQ ID NO: 320156 - DNA, 13 bp, Homo sapiens
ccattctttctga

SEQ ID NO: 320157 - DNA, 19 bp, Homo sapiens
ccattctttcttcctccag

SEQ ID NO: 320158 - DNA, 13 bp, Homo sapiens
ccattgacctcag

SEQ ID NO: 320159 - DNA, 22 bp, Homo sapiens
ccattgatgagcactcctgatt

SEQ ID NO: 320160 - DNA, 23 bp, Homo sapiens
ccattgcaaaaggttaagccata

SEQ ID NO: 320161 - DNA, 16 bp, Homo sapiens
ccattgctcccagtgc

SEQ ID NO: 320162 - DNA, 18 bp, Homo sapiens
ccattgctcccagtgcca

SEQ ID NO: 320163 - DNA, 20 bp, Homo sapiens
ccattgctcccagtgccaaa

SEQ ID NO: 320164 - DNA, 19 bp, Homo sapiens
ccattgtactccagcctgg

SEQ ID NO: 320165 - DNA, 20 bp, Homo sapiens
ccattgtactccagcctggg

SEQ ID NO: 320166 - DNA, 16 bp, Homo sapiens
ccattgtctcattgcc

SEQ ID NO: 320167 - DNA, 19 bp, Homo sapiens
ccattgtctcattgccagt

SEQ ID NO: 320168 - DNA, 22 bp, Homo sapiens
ccattgtgaatgttgtcctgtg

SEQ ID NO: 320169 - DNA, 20 bp, Homo sapiens
ccattgtggctcctatctgt

SEQ ID NO: 320170 - DNA, 20 bp, Homo sapiens
ccatttataaccccagcctg

SEQ ID NO: 320171 - DNA, 21 bp, Homo sapiens
ccatttataaccccagcctga

SEQ ID NO: 320172 - DNA, 14 bp, Homo sapiens
ccatttatagaata

SEQ ID NO: 320173 - DNA, 22 bp, Homo sapiens
ccatttcacacctgaaaatgtt

SEQ ID NO: 320174 - DNA, 12 bp, Homo sapiens
ccatttctattt

SEQ ID NO: 320175 - DNA, 13 bp, Homo sapiens
ccatttctattta

SEQ ID NO: 320176 - DNA, 14 bp, Homo sapiens
ccatttctctacac

SEQ ID NO: 320177 - DNA, 17 bp, Homo sapiens
ccatttctctacactaa

SEQ ID NO: 320178 - DNA, 13 bp, Homo sapiens
ccatttcttcaga

SEQ ID NO: 320179 - DNA, 17 bp, Homo sapiens
ccatttgattgttttat

SEQ ID NO: 320180 - DNA, 21 bp, Homo sapiens
ccatttgatttcgatgtacag

SEQ ID NO: 320181 - DNA, 21 bp, Homo sapiens
ccatttgcacaggttttcagc

SEQ ID NO: 320182 - DNA, 17 bp, Homo sapiens
ccatttgccatgctgct

SEQ ID NO: 320183 - DNA, 23 bp, Homo sapiens
ccatttggatcctgtgtggagag

SEQ ID NO: 320184 - DNA, 12 bp, Homo sapiens
ccatttgtaata

SEQ ID NO: 320185 - DNA, 15 bp, Homo sapiens
ccatttgtaataaag

SEQ ID NO: 320186 - DNA, 20 bp, Homo sapiens
ccatttgtaataaagtatat

SEQ ID NO: 320187 - DNA, 17 bp, Homo sapiens
ccatttgtaatgtatct

SEQ ID NO: 320188 - DNA, 12 bp, Homo sapiens
ccattttctaaa

SEQ ID NO: 320189 - DNA, 22 bp, Homo sapiens
ccattttctaaactgttttcat

SEQ ID NO: 320190 - DNA, 18 bp, Homo sapiens
ccattttgcgatgtgttt

SEQ ID NO: 320191 - DNA, 20 bp, Homo sapiens
ccattttgctgtcccttttc

SEQ ID NO: 320192 - DNA, 14 bp, Homo sapiens
ccattttggaaaat

SEQ ID NO: 320193 - DNA, 13 bp, Homo sapiens
ccattttgtaact

SEQ ID NO: 320194 - DNA, 21 bp, Homo sapiens
ccattttgtaactgcctacca

SEQ ID NO: 320195 - DNA, 18 bp, Homo sapiens
gagagcgccacccgcccg

SEQ ID NO: 320196 - DNA, 22 bp, Homo sapiens
gagagcgccacccgcccgcccc

SEQ ID NO: 320197 - DNA, 14 bp, Homo sapiens
gagagcgctggcct

SEQ ID NO: 320198 - DNA, 16 bp, Homo sapiens
gagagctcttagtttt

SEQ ID NO: 320199 - DNA, 13 bp, Homo sapiens
gagagctgctgag

SEQ ID NO: 320200 - DNA, 13 bp, Homo sapiens
gagagctggtgcc

SEQ ID NO: 320201 - DNA, 17 bp, Homo sapiens
gagagctggtgcccgga

SEQ ID NO: 320202 - DNA, 15 bp, Homo sapiens
gagagcttcctgttt

SEQ ID NO: 320203 - DNA, 23 bp, Homo sapiens
gagagctttctgtccttttggca

SEQ ID NO: 320204 - DNA, 23 bp, Homo sapiens
gagaggaactccttggcctagcc

SEQ ID NO: 320205 - DNA, 13 bp, Homo sapiens
gagaggaagccac

SEQ ID NO: 320206 - DNA, 23 bp, Homo sapiens
gagaggaagccacgtgctggaga

SEQ ID NO: 320207 - DNA, 16 bp, Homo sapiens
gagaggacgtgggcgg

SEQ ID NO: 320208 - DNA, 17 bp, Homo sapiens
gagaggacgtgggcggc

SEQ ID NO: 320209 - DNA, 14 bp, Homo sapiens
gagaggagagcatc

SEQ ID NO: 320210 - DNA, 19 bp, Homo sapiens
gagaggagcacctgaaccc

SEQ ID NO: 320211 - DNA, 15 bp, Homo sapiens
gagaggaggtgtgga

SEQ ID NO: 320212 - DNA, 19 bp, Homo sapiens
gagaggaggtgtggagtgg

SEQ ID NO: 320213 - DNA, 15 bp, Homo sapiens
gagaggagttcaatg

SEQ ID NO: 320214 - DNA, 16 bp, Homo sapiens
gagaggagttcaatga

SEQ ID NO: 320215 - DNA, 18 bp, Homo sapiens
gagaggagttcaatgatc

SEQ ID NO: 320216 - DNA, 15 bp, Homo sapiens
gagaggcaatggcca

SEQ ID NO: 320217 - DNA, 11 bp, Homo sapiens
gagaggcagaa

SEQ ID NO: 320218 - DNA, 16 bp, Homo sapiens
gagaggcagagtgccc

SEQ ID NO: 320219 - DNA, 14 bp, Homo sapiens
gagaggcatccagt

SEQ ID NO: 320220 - DNA, 22 bp, Homo sapiens
gagaggcatccagtatcttgaa

SEQ ID NO: 320221 - DNA, 12 bp, Homo sapiens
gagaggccatga

SEQ ID NO: 320222 - DNA, 13 bp, Homo sapiens
gagaggcctccct

SEQ ID NO: 320223 - DNA, 20 bp, Homo sapiens
gagaggcgttagtgggcagg

SEQ ID NO: 320224 - DNA, 23 bp, Homo sapiens
gagaggctctgaaagctgcttct

SEQ ID NO: 320225 - DNA, 18 bp, Homo sapiens
gagaggctgtctggggcc

SEQ ID NO: 320226 - DNA, 14 bp, Homo sapiens
gagagggaatgtga

SEQ ID NO: 320227 - DNA, 13 bp, Homo sapiens
gagagggctgagc

SEQ ID NO: 320228 - DNA, 22 bp, Homo sapiens
gagagggctgagcccctcctct

SEQ ID NO: 320229 - DNA, 18 bp, Homo sapiens
gagaggggcctctggctg

SEQ ID NO: 320230 - DNA, 16 bp, Homo sapiens
gagagggggctctcca

SEQ ID NO: 320231 - DNA, 24 bp, Homo sapiens
gagagggggtaatggaggccaagc

SEQ ID NO: 320232 - DNA, 14 bp, Homo sapiens
gagaggggtttggg

SEQ ID NO: 320233 - DNA, 19 bp, Homo sapiens
gagaggtcaagcccaggag

SEQ ID NO: 320234 - DNA, 24 bp, Homo sapiens
gagaggtcaagcccaggaggactg

SEQ ID NO: 320235 - DNA, 21 bp, Homo sapiens
gagaggtgggggatgctgagg

SEQ ID NO: 320236 - DNA, 19 bp, Homo sapiens
gagaggttgaggatgcact

SEQ ID NO: 320237 - DNA, 16 bp, Homo sapiens
gagagtaccatgctgg

SEQ ID NO: 320238 - DNA, 17 bp, Homo sapiens
gagagtaccatgctggc

SEQ ID NO: 320239 - DNA, 23 bp, Homo sapiens
gagagtgagaataattgtgtaca

SEQ ID NO: 320240 - DNA, 14 bp, Homo sapiens
gagagtgagagaga

SEQ ID NO: 320241 - DNA, 22 bp, Homo sapiens
gagagtgaggtcatcccggggc

SEQ ID NO: 320242 - DNA, 22 bp, Homo sapiens
gagagtgtggaaaaaaaaagaa

SEQ ID NO: 320243 - DNA, 14 bp, Homo sapiens
gagagttctggtga

SEQ ID NO: 320244 - DNA, 20 bp, Homo sapiens
gagagttctttgctgcccct

SEQ ID NO: 320245 - DNA, 20 bp, Homo sapiens
gagataaaccaataaatcca

SEQ ID NO: 320246 - DNA, 17 bp, Homo sapiens
gagataccaagatgcca

SEQ ID NO: 320247 - DNA, 21 bp, Homo sapiens
gagataccaagatgccatctg

SEQ ID NO: 320248 - DNA, 11 bp, Homo sapiens
gagatatttac

SEQ ID NO: 320249 - DNA, 22 bp, Homo sapiens
gagatatttacatgaattgcat

SEQ ID NO: 320250 - DNA, 21 bp, Homo sapiens
gagatcacagcctccagggcc

SEQ ID NO: 320251 - DNA, 16 bp, Homo sapiens
gagatcggggccagag

SEQ ID NO: 320252 - DNA, 19 bp, Homo sapiens
gagatctaagcctttccat

SEQ ID NO: 320253 - DNA, 15 bp, Homo sapiens
gagatcttccttccg

SEQ ID NO: 320254 - DNA, 14 bp, Homo sapiens
gagatgagaaatga

SEQ ID NO: 320255 - DNA, 19 bp, Homo sapiens
gagatgctactgtcagtgt

SEQ ID NO: 320256 - DNA, 12 bp, Homo sapiens
gagatggccata

SEQ ID NO: 320257 - DNA, 20 bp, Homo sapiens
gagatggggaaagaattcct

SEQ ID NO: 320258 - DNA, 19 bp, Homo sapiens
gagatggtgccccctgggg

SEQ ID NO: 320259 - DNA, 17 bp, Homo sapiens
gagatgtttttaaaagt

SEQ ID NO: 320260 - DNA, 18 bp, Homo sapiens
gagattaagaatattgcc

SEQ ID NO: 320261 - DNA, 17 bp, Homo sapiens
gagattagcatgaaagg

SEQ ID NO: 320262 - DNA, 12 bp, Homo sapiens
gagattctggga

SEQ ID NO: 320263 - DNA, 21 bp, Homo sapiens
gagattctgggaaaggtgctc

SEQ ID NO: 320264 - DNA, 23 bp, Homo sapiens
cccaaggcaaggggtgcctggga

SEQ ID NO: 320265 - DNA, 15 bp, Homo sapiens
cccaaggccagtctg

SEQ ID NO: 320266 - DNA, 22 bp, Homo sapiens
cccaaggcgtccgcgcgccagc

SEQ ID NO: 320267 - DNA, 17 bp, Homo sapiens
cccaaggctctgagcaa

SEQ ID NO: 320268 - DNA, 17 bp, Homo sapiens
cccaaggtcccctccac

SEQ ID NO: 320269 - DNA, 14 bp, Homo sapiens
cccaaggtcctctc

SEQ ID NO: 320270 - DNA, 18 bp, Homo sapiens
cccaaggtggtcttggag

SEQ ID NO: 320271 - DNA, 23 bp, Homo sapiens
cccaaggtggtcttggagaggag

SEQ ID NO: 320272 - DNA, 12 bp, Homo sapiens
cccaagtccacc

SEQ ID NO: 320273 - DNA, 11 bp, Homo sapiens
cccaataaaag

SEQ ID NO: 320274 - DNA, 12 bp, Homo sapiens
cccaataaagaa

SEQ ID NO: 320275 - DNA, 15 bp, Homo sapiens
cccaataaagctgga

SEQ ID NO: 320276 - DNA, 23 bp, Homo sapiens
cccaataaaggtcccttagcccc

SEQ ID NO: 320277 - DNA, 20 bp, Homo sapiens
cccaataaagtcctcttccc

SEQ ID NO: 320278 - DNA, 19 bp, Homo sapiens
cccaataagatacatcaca

SEQ ID NO: 320279 - DNA, 17 bp, Homo sapiens
cccaatattataatttt

SEQ ID NO: 320280 - DNA, 22 bp, Homo sapiens
cccaatccaacccatgcatggc

SEQ ID NO: 320281 - DNA, 20 bp, Homo sapiens
cccaatcttaccagatgcta

SEQ ID NO: 320282 - DNA, 14 bp, Homo sapiens
cccaatgctttggg

SEQ ID NO: 320283 - DNA, 18 bp, Homo sapiens
cccaatggagactttctg

SEQ ID NO: 320284 - DNA, 14 bp, Homo sapiens
cccaattaactgaa

SEQ ID NO: 320285 - DNA, 19 bp, Homo sapiens
cccaattatcctccttcac

SEQ ID NO: 320286 - DNA, 15 bp, Homo sapiens
cccacaatggctggg

SEQ ID NO: 320287 - DNA, 16 bp, Homo sapiens
cccacacaggcctggc

SEQ ID NO: 320288 - DNA, 19 bp, Homo sapiens
cccacacaggcctggccca

SEQ ID NO: 320289 - DNA, 23 bp, Homo sapiens
cccacacaggcctggcccagcca

SEQ ID NO: 320290 - DNA, 20 bp, Homo sapiens
cccacaccaggccgtcctcc

SEQ ID NO: 320291 - DNA, 15 bp, Homo sapiens
cccacaccccagccc

SEQ ID NO: 320292 - DNA, 22 bp, Homo sapiens
cccacaccccagcccaccctgc

SEQ ID NO: 320293 - DNA, 18 bp, Homo sapiens
cccacaccccgtctgccc

SEQ ID NO: 320294 - DNA, 18 bp, Homo sapiens
cccacacggactcccggg

SEQ ID NO: 320295 - DNA, 19 bp, Homo sapiens
cccacacttgagaggatga

SEQ ID NO: 320296 - DNA, 18 bp, Homo sapiens
cccacagacagatcccat

SEQ ID NO: 320297 - DNA, 18 bp, Homo sapiens
cccacagaggacagtgct

SEQ ID NO: 320298 - DNA, 21 bp, Homo sapiens
cccacagagtgtggtccctcc

SEQ ID NO: 320299 - DNA, 14 bp, Homo sapiens
cccacagcccgcat

SEQ ID NO: 320300 - DNA, 19 bp, Homo sapiens
cccacagctacctgagacg

SEQ ID NO: 320301 - DNA, 15 bp, Homo sapiens
cccacagcttcctga

SEQ ID NO: 320302 - DNA, 19 bp, Homo sapiens
cccacagcttcctgagggc

SEQ ID NO: 320303 - DNA, 18 bp, Homo sapiens
cccacaggcccttcctct

SEQ ID NO: 320304 - DNA, 22 bp, Homo sapiens
cccacaggtgtccccagcccac

SEQ ID NO: 320305 - DNA, 13 bp, Homo sapiens
cccacatcccagg

SEQ ID NO: 320306 - DNA, 20 bp, Homo sapiens
cccacatcccaggcttcacc

SEQ ID NO: 320307 - DNA, 12 bp, Homo sapiens
cccacatccccc

SEQ ID NO: 320308 - DNA, 15 bp, Homo sapiens
cccacatggccgggc

SEQ ID NO: 320309 - DNA, 17 bp, Homo sapiens
cccacattgcccacacc

SEQ ID NO: 320310 - DNA, 20 bp, Homo sapiens
cccacattgcccacacctgc

SEQ ID NO: 320311 - DNA, 13 bp, Homo sapiens
cccaccaaatgcc

SEQ ID NO: 320312 - DNA, 16 bp, Homo sapiens
cccaccaactctgcac

SEQ ID NO: 320313 - DNA, 17 bp, Homo sapiens
cccaccacacacaccct

SEQ ID NO: 320314 - DNA, 19 bp, Homo sapiens
cccaccacacacacccttc

SEQ ID NO: 320315 - DNA, 14 bp, Homo sapiens
cccaccacactgaa

SEQ ID NO: 320316 - DNA, 22 bp, Homo sapiens
cccaccaccaagccctgcaaat

SEQ ID NO: 320317 - DNA, 20 bp, Homo sapiens
cccaccagaacgcaccccac

SEQ ID NO: 320318 - DNA, 14 bp, Homo sapiens
cccaccagcagcac

SEQ ID NO: 320319 - DNA, 14 bp, Homo sapiens
cccaccagcccaca

SEQ ID NO: 320320 - DNA, 13 bp, Homo sapiens
cccaccagctcgt

SEQ ID NO: 320321 - DNA, 15 bp, Homo sapiens
cccacccaagcttgg

SEQ ID NO: 320322 - DNA, 16 bp, Homo sapiens
cccacccaagcttggc

SEQ ID NO: 320323 - DNA, 18 bp, Homo sapiens
cccacccaagcttggcag

SEQ ID NO: 320324 - DNA, 21 bp, Homo sapiens
cccacccacaccccgtctgcc

SEQ ID NO: 320325 - DNA, 12 bp, Homo sapiens
cccacccacctc

SEQ ID NO: 320326 - DNA, 15 bp, Homo sapiens
cccacccacctccac

SEQ ID NO: 320327 - DNA, 12 bp, Homo sapiens
cccacccaggag

SEQ ID NO: 320328 - DNA, 14 bp, Homo sapiens
cccacccagggccc

SEQ ID NO: 320329 - DNA, 18 bp, Homo sapiens
cccacccagggcccggca

SEQ ID NO: 320330 - DNA, 21 bp, Homo sapiens
cccacccatcttcctgctgct

SEQ ID NO: 320331 - DNA, 15 bp, Homo sapiens
cccaccccaaccact

SEQ ID NO: 320332 - DNA, 17 bp, Homo sapiens
cccaccccaactctccc

SEQ ID NO: 320333 - DNA, 18 bp, Homo sapiens
gagcagctccccaggagc

SEQ ID NO: 320334 - DNA, 11 bp, Homo sapiens
gagcagctggc

SEQ ID NO: 320335 - DNA, 17 bp, Homo sapiens
gagcagctggctctcca

SEQ ID NO: 320336 - DNA, 11 bp, Homo sapiens
gagcaggaagc

SEQ ID NO: 320337 - DNA, 17 bp, Homo sapiens
gagcaggaagcaaggcc

SEQ ID NO: 320338 - DNA, 19 bp, Homo sapiens
gagcaggaagcaaggccag

SEQ ID NO: 320339 - DNA, 18 bp, Homo sapiens
gagcaggaaggcctgggt

SEQ ID NO: 320340 - DNA, 22 bp, Homo sapiens
gagcaggaggaggaaaggtagc

SEQ ID NO: 320341 - DNA, 16 bp, Homo sapiens
gagcaggaggcccctg

SEQ ID NO: 320342 - DNA, 18 bp, Homo sapiens
gagcaggcggtggggaga

SEQ ID NO: 320343 - DNA, 19 bp, Homo sapiens
gagcaggctggcagctctc

SEQ ID NO: 320344 - DNA, 22 bp, Homo sapiens
gagcaggctggcagctctccag

SEQ ID NO: 320345 - DNA, 13 bp, Homo sapiens
gagcaggtctgca

SEQ ID NO: 320346 - DNA, 22 bp, Homo sapiens
gagcaggtctgcaggccaccag

SEQ ID NO: 320347 - DNA, 16 bp, Homo sapiens
gagcagtcctgcctca

SEQ ID NO: 320348 - DNA, 20 bp, Homo sapiens
gagcagtcctgcctcagcct

SEQ ID NO: 320349 - DNA, 23 bp, Homo sapiens
gagcagtgtcctgtgctttctgc

SEQ ID NO: 320350 - DNA, 18 bp, Homo sapiens
gagcagtgtgtctcctgc

SEQ ID NO: 320351 - DNA, 23 bp, Homo sapiens
gagcagtgtgtctcctgcatgca

SEQ ID NO: 320352 - DNA, 20 bp, Homo sapiens
gagcagttgttatattcatt

SEQ ID NO: 320353 - DNA, 20 bp, Homo sapiens
gagcagttttccaggaggcc

SEQ ID NO: 320354 - DNA, 19 bp, Homo sapiens
gagcatcccccaaagttca

SEQ ID NO: 320355 - DNA, 19 bp, Homo sapiens
gagcatccttcccagcaga

SEQ ID NO: 320356 - DNA, 15 bp, Homo sapiens
gagcatctgctctga

SEQ ID NO: 320357 - DNA, 16 bp, Homo sapiens
gagcatctgctctgag

SEQ ID NO: 320358 - DNA, 18 bp, Homo sapiens
gagcatctgtcccactgg

SEQ ID NO: 320359 - DNA, 18 bp, Homo sapiens
gagcatgtgggggaaggc

SEQ ID NO: 320360 - DNA, 16 bp, Homo sapiens
gagcattctgcctgcc

SEQ ID NO: 320361 - DNA, 20 bp, Homo sapiens
gagcattctgcctgcctggg

SEQ ID NO: 320362 - DNA, 16 bp, Homo sapiens
gagcattctggggtgg

SEQ ID NO: 320363 - DNA, 14 bp, Homo sapiens
gagcattttgtgtc

SEQ ID NO: 320364 - DNA, 16 bp, Homo sapiens
gagcatttttaaggga

SEQ ID NO: 320365 - DNA, 19 bp, Homo sapiens
gagccaacctcggcttgtg

SEQ ID NO: 320366 - DNA, 17 bp, Homo sapiens
gagccaagttcaaagaa

SEQ ID NO: 320367 - DNA, 22 bp, Homo sapiens
gagccaatactgagtgcctgca

SEQ ID NO: 320368 - DNA, 14 bp, Homo sapiens
gagccacaggcaga

SEQ ID NO: 320369 - DNA, 18 bp, Homo sapiens
gagccacccaggccactg

SEQ ID NO: 320370 - DNA, 21 bp, Homo sapiens
gagccaccgcgagggcctgcg

SEQ ID NO: 320371 - DNA, 22 bp, Homo sapiens
gagccacctgggctgggagaag

SEQ ID NO: 320372 - DNA, 15 bp, Homo sapiens
gagccactacctttg

SEQ ID NO: 320373 - DNA, 12 bp, Homo sapiens
gagccactctgt

SEQ ID NO: 320374 - DNA, 14 bp, Homo sapiens
gagccacttctccc

SEQ ID NO: 320375 - DNA, 15 bp, Homo sapiens
gagccacttctcccc

SEQ ID NO: 320376 - DNA, 19 bp, Homo sapiens
gagccacttctccccagaa

SEQ ID NO: 320377 - DNA, 13 bp, Homo sapiens
gagccagcagctg

SEQ ID NO: 320378 - DNA, 21 bp, Homo sapiens
gagccagcagctgaagtctct

SEQ ID NO: 320379 - DNA, 12 bp, Homo sapiens
gagccagcaggg

SEQ ID NO: 320380 - DNA, 20 bp, Homo sapiens
gagccagcagggcgggccag

SEQ ID NO: 320381 - DNA, 15 bp, Homo sapiens
gagccagcctgggac

SEQ ID NO: 320382 - DNA, 12 bp, Homo sapiens
gagccaggagcc

SEQ ID NO: 320383 - DNA, 11 bp, Homo sapiens
gagccagggct

SEQ ID NO: 320384 - DNA, 15 bp, Homo sapiens
gagccagggctgtcc

SEQ ID NO: 320385 - DNA, 18 bp, Homo sapiens
gagccagggctgtcctta

SEQ ID NO: 320386 - DNA, 17 bp, Homo sapiens
gagccagggtagagcaa

SEQ ID NO: 320387 - DNA, 21 bp, Homo sapiens
gagccatcccactccctttcc

SEQ ID NO: 320388 - DNA, 22 bp, Homo sapiens
gagccatcggtgaaactaacag

SEQ ID NO: 320389 - DNA, 13 bp, Homo sapiens
gagccatgctctt

SEQ ID NO: 320390 - DNA, 14 bp, Homo sapiens
gagccatgctctta

SEQ ID NO: 320391 - DNA, 19 bp, Homo sapiens
gagccatgggcctgggcct

SEQ ID NO: 320392 - DNA, 21 bp, Homo sapiens
gagcccacagagtctgtgtgt

SEQ ID NO: 320393 - DNA, 22 bp, Homo sapiens
gagcccacatggccgggccctc

SEQ ID NO: 320394 - DNA, 23 bp, Homo sapiens
cccacgacaaaaacaagactgcc

SEQ ID NO: 320395 - DNA, 13 bp, Homo sapiens
cccacgagtcacc

SEQ ID NO: 320396 - DNA, 15 bp, Homo sapiens
cccacgagtcacctg

SEQ ID NO: 320397 - DNA, 15 bp, Homo sapiens
cccacgcagagcccc

SEQ ID NO: 320398 - DNA, 21 bp, Homo sapiens
cccacgcagagccccggagca

SEQ ID NO: 320399 - DNA, 12 bp, Homo sapiens
cccacgctggga

SEQ ID NO: 320400 - DNA, 19 bp, Homo sapiens
cccacgctgggacacagac

SEQ ID NO: 320401 - DNA, 22 bp, Homo sapiens
cccacggaaaatgccaatctct

SEQ ID NO: 320402 - DNA, 18 bp, Homo sapiens
cccacggccactgcagtc

SEQ ID NO: 320403 - DNA, 15 bp, Homo sapiens
cccacggctaagagg

SEQ ID NO: 320404 - DNA, 19 bp, Homo sapiens
cccacggctaagaggctgc

SEQ ID NO: 320405 - DNA, 22 bp, Homo sapiens
cccacgtctggccaggcactgc

SEQ ID NO: 320406 - DNA, 22 bp, Homo sapiens
cccacgtggactctgtgctcac

SEQ ID NO: 320407 - DNA, 16 bp, Homo sapiens
cccactaagctttctc

SEQ ID NO: 320408 - DNA, 23 bp, Homo sapiens
cccactagccctctttctctctg

SEQ ID NO: 320409 - DNA, 19 bp, Homo sapiens
cccactaggataggaactg

SEQ ID NO: 320410 - DNA, 12 bp, Homo sapiens
cccactcacaga

SEQ ID NO: 320411 - DNA, 14 bp, Homo sapiens
cccactcacagaga

SEQ ID NO: 320412 - DNA, 15 bp, Homo sapiens
cccactcaccagggt

SEQ ID NO: 320413 - DNA, 16 bp, Homo sapiens
cccactcaccagggtc

SEQ ID NO: 320414 - DNA, 16 bp, Homo sapiens
cccactccctgccacc

SEQ ID NO: 320415 - DNA, 13 bp, Homo sapiens
cccactccctgtc

SEQ ID NO: 320416 - DNA, 19 bp, Homo sapiens
cccactcctaggacatgtt

SEQ ID NO: 320417 - DNA, 14 bp, Homo sapiens
cccactctccccac

SEQ ID NO: 320418 - DNA, 17 bp, Homo sapiens
cccactctccccacact

SEQ ID NO: 320419 - DNA, 13 bp, Homo sapiens
cccactctgctcc

SEQ ID NO: 320420 - DNA, 19 bp, Homo sapiens
cccactctgctcccagccc

SEQ ID NO: 320421 - DNA, 16 bp, Homo sapiens
cccactgacagcctcc

SEQ ID NO: 320422 - DNA, 21 bp, Homo sapiens
cccactgcacttggtgctgct

SEQ ID NO: 320423 - DNA, 23 bp, Homo sapiens
cccactgcatcctactcctacct

SEQ ID NO: 320424 - DNA, 13 bp, Homo sapiens
cccactgcctgcc

SEQ ID NO: 320425 - DNA, 17 bp, Homo sapiens
cccactggatctggctt

SEQ ID NO: 320426 - DNA, 15 bp, Homo sapiens
cccactggccagctc

SEQ ID NO: 320427 - DNA, 16 bp, Homo sapiens
cccactgtcctgggcg

SEQ ID NO: 320428 - DNA, 12 bp, Homo sapiens
cccactgtcctt

SEQ ID NO: 320429 - DNA, 17 bp, Homo sapiens
cccactgtcctttctcc

SEQ ID NO: 320430 - DNA, 15 bp, Homo sapiens
cccacttagtccact

SEQ ID NO: 320431 - DNA, 20 bp, Homo sapiens
cccacttagtccactctgag

SEQ ID NO: 320432 - DNA, 15 bp, Homo sapiens
cccacttcaccccca

SEQ ID NO: 320433 - DNA, 18 bp, Homo sapiens
cccacttctctctaagga

SEQ ID NO: 320434 - DNA, 15 bp, Homo sapiens
cccagaaagcctcct

SEQ ID NO: 320435 - DNA, 17 bp, Homo sapiens
cccagaaaggagactag

SEQ ID NO: 320436 - DNA, 17 bp, Homo sapiens
cccagaaatgccgctgt

SEQ ID NO: 320437 - DNA, 19 bp, Homo sapiens
cccagaaatgccgctgtgt

SEQ ID NO: 320438 - DNA, 20 bp, Homo sapiens
cccagaagctcaaggctgca

SEQ ID NO: 320439 - DNA, 20 bp, Homo sapiens
cccagaaggaacccggtccc

SEQ ID NO: 320440 - DNA, 19 bp, Homo sapiens
cccagaaggacctcctgag

SEQ ID NO: 320441 - DNA, 19 bp, Homo sapiens
cccagacaaggagagcgga

SEQ ID NO: 320442 - DNA, 15 bp, Homo sapiens
cccagacaccacaga

SEQ ID NO: 320443 - DNA, 19 bp, Homo sapiens
cccagacagacatctctgc

SEQ ID NO: 320444 - DNA, 20 bp, Homo sapiens
cccagacaggccctccctgt

SEQ ID NO: 320445 - DNA, 16 bp, Homo sapiens
cccagaccccagggca

SEQ ID NO: 320446 - DNA, 17 bp, Homo sapiens
cccagaccccagggcag

SEQ ID NO: 320447 - DNA, 17 bp, Homo sapiens
cccagaccccatccagc

SEQ ID NO: 320448 - DNA, 19 bp, Homo sapiens
cccagacccctctggccag

SEQ ID NO: 320449 - DNA, 18 bp, Homo sapiens
cccagacctcccctcttc

SEQ ID NO: 320450 - DNA, 22 bp, Homo sapiens
cccagacctgaatgcttctgag

SEQ ID NO: 320451 - DNA, 20 bp, Homo sapiens
cccagacttgtttcctgtgc

SEQ ID NO: 320452 - DNA, 21 bp, Homo sapiens
cccagagaacaatcactattc

SEQ ID NO: 320453 - DNA, 15 bp, Homo sapiens
cccagagaagcctca

SEQ ID NO: 320454 - DNA, 14 bp, Homo sapiens
cccagagactgccc

SEQ ID NO: 320455 - DNA, 17 bp, Homo sapiens
cccagagactgcccacc

SEQ ID NO: 320456 - DNA, 19 bp, Homo sapiens
cccagagactgcccaccct

SEQ ID NO: 320457 - DNA, 20 bp, Homo sapiens
cccagagactgcccaccctg

SEQ ID NO: 320458 - DNA, 19 bp, Homo sapiens
cccagagagaaaaagagag

SEQ ID NO: 320459 - DNA, 21 bp, Homo sapiens
cccagagagaaaaagagagag

SEQ ID NO: 320460 - DNA, 14 bp, Homo sapiens
cccagagagaccct

SEQ ID NO: 320461 - DNA, 13 bp, Homo sapiens
cccagagagctga

SEQ ID NO: 320462 - DNA, 21 bp, Homo sapiens
cccagagatgggactgggagg

SEQ ID NO: 320463 - DNA, 19 bp, Homo sapiens
cccagagcaggaggcccct

SEQ ID NO: 320464 - DNA, 23 bp, Homo sapiens
cccagagcaggaggcccctggcc

SEQ ID NO: 320465 - DNA, 14 bp, Homo sapiens
cccagagccagggc

SEQ ID NO: 320466 - DNA, 14 bp, Homo sapiens
cccagagccccact

SEQ ID NO: 320467 - DNA, 11 bp, Homo sapiens
cccagagcccg

SEQ ID NO: 320468 - DNA, 9 bp, Homo sapiens
cccagagct

SEQ ID NO: 320469 - DNA, 23 bp, Homo sapiens
cccagagctgtttatggcctcag

SEQ ID NO: 320470 - DNA, 19 bp, Homo sapiens
gagctatttccattccaga

SEQ ID NO: 320471 - DNA, 21 bp, Homo sapiens
gagctatttccattccagaat

SEQ ID NO: 320472 - DNA, 16 bp, Homo sapiens
gagctcacccaaggtc

SEQ ID NO: 320473 - DNA, 18 bp, Homo sapiens
gagctcagaggagtctgg

SEQ ID NO: 320474 - DNA, 17 bp, Homo sapiens
gagctcagcacagcctc

SEQ ID NO: 320475 - DNA, 13 bp, Homo sapiens
gagctcaggagaa

SEQ ID NO: 320476 - DNA, 15 bp, Homo sapiens
gagctcaggagaagg

SEQ ID NO: 320477 - DNA, 15 bp, Homo sapiens
gagctcaggagagag

SEQ ID NO: 320478 - DNA, 17 bp, Homo sapiens
gagctcaggtggggagt

SEQ ID NO: 320479 - DNA, 14 bp, Homo sapiens
gagctccaccctcc

SEQ ID NO: 320480 - DNA, 22 bp, Homo sapiens
gagctccaccctcccctcttct

SEQ ID NO: 320481 - DNA, 13 bp, Homo sapiens
gagctccagaccc

SEQ ID NO: 320482 - DNA, 17 bp, Homo sapiens
gagctccagacccccag

SEQ ID NO: 320483 - DNA, 20 bp, Homo sapiens
gagctccccaccaccccagc

SEQ ID NO: 320484 - DNA, 13 bp, Homo sapiens
gagctcccccttc

SEQ ID NO: 320485 - DNA, 14 bp, Homo sapiens
gagctcccccttcc

SEQ ID NO: 320486 - DNA, 21 bp, Homo sapiens
gagctcccctggagccagcag

SEQ ID NO: 320487 - DNA, 15 bp, Homo sapiens
gagctcctctgggca

SEQ ID NO: 320488 - DNA, 19 bp, Homo sapiens
gagctcgtgtatcctgggg

SEQ ID NO: 320489 - DNA, 20 bp, Homo sapiens
gagctcgtgtatcctggggc

SEQ ID NO: 320490 - DNA, 22 bp, Homo sapiens
gagctcgtgtatcctggggctc

SEQ ID NO: 320491 - DNA, 18 bp, Homo sapiens
gagctctcctgggccagg

SEQ ID NO: 320492 - DNA, 20 bp, Homo sapiens
gagctctcctgggccagggt

SEQ ID NO: 320493 - DNA, 17 bp, Homo sapiens
gagctctctcagaccct

SEQ ID NO: 320494 - DNA, 17 bp, Homo sapiens
gagctctggagccacct

SEQ ID NO: 320495 - DNA, 14 bp, Homo sapiens
gagctcttagtttt

SEQ ID NO: 320496 - DNA, 21 bp, Homo sapiens
gagctcttcaagctgtcccct

SEQ ID NO: 320497 - DNA, 22 bp, Homo sapiens
gagctcttcaagctgtcccctc

SEQ ID NO: 320498 - DNA, 16 bp, Homo sapiens
gagctcttcaggcctc

SEQ ID NO: 320499 - DNA, 15 bp, Homo sapiens
gagctcttggcagga

SEQ ID NO: 320500 - DNA, 21 bp, Homo sapiens
gagctctttgtctcaccagct

SEQ ID NO: 320501 - DNA, 17 bp, Homo sapiens
gagctgacaaaattttg

SEQ ID NO: 320502 - DNA, 17 bp, Homo sapiens
gagctgagatgagcccc

SEQ ID NO: 320503 - DNA, 19 bp, Homo sapiens
gagctgagatgagccccac

SEQ ID NO: 320504 - DNA, 15 bp, Homo sapiens
gagctgagtcacctc

SEQ ID NO: 320505 - DNA, 21 bp, Homo sapiens
gagctgagtcacctcctccac

SEQ ID NO: 320506 - DNA, 21 bp, Homo sapiens
gagctgagtcggctgggcagg

SEQ ID NO: 320507 - DNA, 15 bp, Homo sapiens
gagctgatccagagc

SEQ ID NO: 320508 - DNA, 16 bp, Homo sapiens
gagctgatttccaggc

SEQ ID NO: 320509 - DNA, 19 bp, Homo sapiens
gagctgcagccccccagag

SEQ ID NO: 320510 - DNA, 20 bp, Homo sapiens
gagctgcagcgcctcctgga

SEQ ID NO: 320511 - DNA, 18 bp, Homo sapiens
gagctgcatggacgcctg

SEQ ID NO: 320512 - DNA, 21 bp, Homo sapiens
gagctgcatggacgcctggct

SEQ ID NO: 320513 - DNA, 20 bp, Homo sapiens
gagctgccatccagggatgc

SEQ ID NO: 320514 - DNA, 12 bp, Homo sapiens
gagctgctcaga

SEQ ID NO: 320515 - DNA, 16 bp, Homo sapiens
gagctgctggcttgca

SEQ ID NO: 320516 - DNA, 17 bp, Homo sapiens
gagctgcttccagttgg

SEQ ID NO: 320517 - DNA, 14 bp, Homo sapiens
gagctggaaggcag

SEQ ID NO: 320518 - DNA, 15 bp, Homo sapiens
gagctggaaggcagg

SEQ ID NO: 320519 - DNA, 16 bp, Homo sapiens
gagctggaaggcaggg

SEQ ID NO: 320520 - DNA, 17 bp, Homo sapiens
gagctggaaggcagggc

SEQ ID NO: 320521 - DNA, 18 bp, Homo sapiens
gagctggaaggcagggca

SEQ ID NO: 320522 - DNA, 19 bp, Homo sapiens
gagctggaaggcagggcag

SEQ ID NO: 320523 - DNA, 21 bp, Homo sapiens
gagctggaaggcagggcagag

SEQ ID NO: 320524 - DNA, 19 bp, Homo sapiens
ctgccccctcccccgcaga

SEQ ID NO: 320525 - DNA, 21 bp, Homo sapiens
ctgccccctcccccgcagaca

SEQ ID NO: 320526 - DNA, 22 bp, Homo sapiens
ctgccccctcccccgcagacag

SEQ ID NO: 320527 - DNA, 23 bp, Homo sapiens
ctgccccctccccttcacaccat

SEQ ID NO: 320528 - DNA, 15 bp, Homo sapiens
ctgccccctgccagt

SEQ ID NO: 320529 - DNA, 18 bp, Homo sapiens
ctgccccctgccagtgaa

SEQ ID NO: 320530 - DNA, 20 bp, Homo sapiens
ctgcccccttctcccacact

SEQ ID NO: 320531 - DNA, 12 bp, Homo sapiens
ctgccccgcccc

SEQ ID NO: 320532 - DNA, 14 bp, Homo sapiens
ctgccccgcccccc

SEQ ID NO: 320533 - DNA, 20 bp, Homo sapiens
ctgccccgccccccagagcc

SEQ ID NO: 320534 - DNA, 21 bp, Homo sapiens
ctgccccgtcccctgggccac

SEQ ID NO: 320535 - DNA, 15 bp, Homo sapiens
ctgccccgtgcagac

SEQ ID NO: 320536 - DNA, 18 bp, Homo sapiens
ctgccccgtgcagactgg

SEQ ID NO: 320537 - DNA, 22 bp, Homo sapiens
ctgccccgttccctgtcagagg

SEQ ID NO: 320538 - DNA, 22 bp, Homo sapiens
ctgcccctcccccaacccccac

SEQ ID NO: 320539 - DNA, 11 bp, Homo sapiens
ctgcccctgcc

SEQ ID NO: 320540 - DNA, 12 bp, Homo sapiens
ctgcccctgccc

SEQ ID NO: 320541 - DNA, 15 bp, Homo sapiens
ctgcccctgcccgag

SEQ ID NO: 320542 - DNA, 17 bp, Homo sapiens
ctgcccctgcccgagag

SEQ ID NO: 320543 - DNA, 13 bp, Homo sapiens
ctgcccctgtagg

SEQ ID NO: 320544 - DNA, 18 bp, Homo sapiens
ctgcccctgtctggaaga

SEQ ID NO: 320545 - DNA, 20 bp, Homo sapiens
ctgccccttctacactctcc

SEQ ID NO: 320546 - DNA, 23 bp, Homo sapiens
ctgccccttctacactctcctgg

SEQ ID NO: 320547 - DNA, 16 bp, Homo sapiens
ctgccccttgcttctc

SEQ ID NO: 320548 - DNA, 17 bp, Homo sapiens
ctgcccgactcaggtcc

SEQ ID NO: 320549 - DNA, 17 bp, Homo sapiens
ctgcccgagagctctta

SEQ ID NO: 320550 - DNA, 20 bp, Homo sapiens
ctgcccgagagctcttagtt

SEQ ID NO: 320551 - DNA, 14 bp, Homo sapiens
ctgcccgagctggt

SEQ ID NO: 320552 - DNA, 21 bp, Homo sapiens
ctgcccgagctggtgcattac

SEQ ID NO: 320553 - DNA, 13 bp, Homo sapiens
ctgcccgcccgcc

SEQ ID NO: 320554 - DNA, 16 bp, Homo sapiens
ctgcccggggcagctg

SEQ ID NO: 320555 - DNA, 22 bp, Homo sapiens
ctgcccggggcagctgccagag

SEQ ID NO: 320556 - DNA, 23 bp, Homo sapiens
ctgcccggtggtttgccatgtcg

SEQ ID NO: 320557 - DNA, 18 bp, Homo sapiens
ctgccctacagaggtctc

SEQ ID NO: 320558 - DNA, 21 bp, Homo sapiens
ctgccctcacgctctccatca

SEQ ID NO: 320559 - DNA, 18 bp, Homo sapiens
ctgccctcactccactcc

SEQ ID NO: 320560 - DNA, 15 bp, Homo sapiens
ctgccctccatcccg

SEQ ID NO: 320561 - DNA, 18 bp, Homo sapiens
ctgccctcccccacggcc

SEQ ID NO: 320562 - DNA, 22 bp, Homo sapiens
ctgccctcccccacggccgtcc

SEQ ID NO: 320563 - DNA, 21 bp, Homo sapiens
ctgccctccctcggccccacc

SEQ ID NO: 320564 - DNA, 13 bp, Homo sapiens
ctgccctctgttc

SEQ ID NO: 320565 - DNA, 22 bp, Homo sapiens
ctgccctctgtttcccctcaga

SEQ ID NO: 320566 - DNA, 13 bp, Homo sapiens
ctgccctgcacct

SEQ ID NO: 320567 - DNA, 15 bp, Homo sapiens
ctgccctgcaccttg

SEQ ID NO: 320568 - DNA, 20 bp, Homo sapiens
ctgccctgccacctgtctgt

SEQ ID NO: 320569 - DNA, 21 bp, Homo sapiens
ctgccctgccacctgtctgtc

SEQ ID NO: 320570 - DNA, 13 bp, Homo sapiens
ctgccctgcccac

SEQ ID NO: 320571 - DNA, 14 bp, Homo sapiens
ctgccctgccctgc

SEQ ID NO: 320572 - DNA, 21 bp, Homo sapiens
ctgccctgcctccctttctgg

SEQ ID NO: 320573 - DNA, 12 bp, Homo sapiens
ctgccctgcctg

SEQ ID NO: 320574 - DNA, 13 bp, Homo sapiens
ctgccctgcctga

SEQ ID NO: 320575 - DNA, 15 bp, Homo sapiens
ctgccctgcctgagg

SEQ ID NO: 320576 - DNA, 16 bp, Homo sapiens
ctgccctgcctgaggg

SEQ ID NO: 320577 - DNA, 13 bp, Homo sapiens
ctgccctgcctgc

SEQ ID NO: 320578 - DNA, 15 bp, Homo sapiens
ctgccctgcctgccc

SEQ ID NO: 320579 - DNA, 16 bp, Homo sapiens
ctgccctgcctgccca

SEQ ID NO: 320580 - DNA, 11 bp, Homo sapiens
ctgccctgctg

SEQ ID NO: 320581 - DNA, 23 bp, Homo sapiens
ctgccctggtccagggaagctgg

SEQ ID NO: 320582 - DNA, 20 bp, Homo sapiens
ctgccctggtgctgccacac

SEQ ID NO: 320583 - DNA, 13 bp, Homo sapiens
ctgccctgtacct

SEQ ID NO: 320584 - DNA, 15 bp, Homo sapiens
ctgccctgtccctgt

SEQ ID NO: 320585 - DNA, 18 bp, Homo sapiens
ctgcccttttaaatggca

SEQ ID NO: 320586 - DNA, 21 bp, Homo sapiens
ctgcccttttaaatggcatga

SEQ ID NO: 320587 - DNA, 20 bp, Homo sapiens
ctgcccttttcctgggcctt

SEQ ID NO: 320588 - DNA, 20 bp, Homo sapiens
ctgccgacacgctccctccc

SEQ ID NO: 320589 - DNA, 23 bp, Homo sapiens
ctgccgaccgaggctggagctgg

SEQ ID NO: 320590 - DNA, 14 bp, Homo sapiens
ctgccgaccgcctg

SEQ ID NO: 320591 - DNA, 15 bp, Homo sapiens
ctgccgaccgcctgc

SEQ ID NO: 320592 - DNA, 21 bp, Homo sapiens
ctgccgaccgcctgcttcaca

SEQ ID NO: 320593 - DNA, 14 bp, Homo sapiens
ctgccgcctcccag

SEQ ID NO: 320594 - DNA, 16 bp, Homo sapiens
ctgccgcctcccagcc

SEQ ID NO: 320595 - DNA, 19 bp, Homo sapiens
ctgccgcctcccagcctgg

SEQ ID NO: 320596 - DNA, 20 bp, Homo sapiens
ctgccggccgcccagacacc

SEQ ID NO: 320597 - DNA, 13 bp, Homo sapiens
ctgccggccttgg

SEQ ID NO: 320598 - DNA, 16 bp, Homo sapiens
ctgccggccttggcct

SEQ ID NO: 320599 - DNA, 14 bp, Homo sapiens
ctgccggctctttc

SEQ ID NO: 320600 - DNA, 17 bp, Homo sapiens
ctgccgggcaggtccca

SEQ ID NO: 320601 - DNA, 22 bp, Homo sapiens
ctgccgggcaggtcccaggttg

SEQ ID NO: 320602 - DNA, 22 bp, Homo sapiens
ctgccggtcccccatgccacca

SEQ ID NO: 320603 - DNA, 23 bp, Homo sapiens
ctgccggtcccccatgccaccac

SEQ ID NO: 320604 - DNA, 14 bp, Homo sapiens
ctgccgtgagagcc

SEQ ID NO: 320605 - DNA, 15 bp, Homo sapiens
ctgccgtgagagccc

SEQ ID NO: 320606 - DNA, 19 bp, Homo sapiens
ctgccgtgcatggctcctg

SEQ ID NO: 320607 - DNA, 20 bp, Homo sapiens
ctgccgtgcatggctcctgt

SEQ ID NO: 320608 - DNA, 16 bp, Homo sapiens
ctgcctaggagctggc

SEQ ID NO: 320609 - DNA, 23 bp, Homo sapiens
ctgcctaggagctggctggcagg

SEQ ID NO: 320610 - DNA, 19 bp, Homo sapiens
ctgcctaggagctggggag

SEQ ID NO: 320611 - DNA, 16 bp, Homo sapiens
ctgcctaggctgacct

SEQ ID NO: 320612 - DNA, 20 bp, Homo sapiens
ctgcctagggttgcttgggc

SEQ ID NO: 320613 - DNA, 15 bp, Homo sapiens
ctgcctatccatcct

SEQ ID NO: 320614 - DNA, 16 bp, Homo sapiens
ctgcctatccatcctg

SEQ ID NO: 320615 - DNA, 16 bp, Homo sapiens
ctgcctcacatctccc

SEQ ID NO: 320616 - DNA, 19 bp, Homo sapiens
ctgcctcacatctcccttc

SEQ ID NO: 320617 - DNA, 24 bp, Homo sapiens
ctgcctcacatctcccttccacct

SEQ ID NO: 320618 - DNA, 15 bp, Homo sapiens
ctgcctcagccttcc

SEQ ID NO: 320619 - DNA, 22 bp, Homo sapiens
ctgcctccagaatggtctttct

SEQ ID NO: 320620 - DNA, 11 bp, Homo sapiens
ctgcctccagg

SEQ ID NO: 320621 - DNA, 19 bp, Homo sapiens
ctgcctccaggagggcatc

SEQ ID NO: 320622 - DNA, 18 bp, Homo sapiens
ctgcctcccacgctggga

SEQ ID NO: 320623 - DNA, 18 bp, Homo sapiens
ctgcctccccaaccctgc

SEQ ID NO: 320624 - DNA, 11 bp, Homo sapiens
ctgcctccctc

SEQ ID NO: 320625 - DNA, 17 bp, Homo sapiens
ctgcctccctctcttcc

SEQ ID NO: 320626 - DNA, 20 bp, Homo sapiens
ctgcctccctttctgggagg

SEQ ID NO: 320627 - DNA, 19 bp, Homo sapiens
ctgcctccggccctgcccc

SEQ ID NO: 320628 - DNA, 24 bp, Homo sapiens
ctgcctcctcttcaactgaccagc

SEQ ID NO: 320629 - DNA, 15 bp, Homo sapiens
ctgcctcctgcctgc

SEQ ID NO: 320630 - DNA, 16 bp, Homo sapiens
ctgcctcctgcctgcc

SEQ ID NO: 320631 - DNA, 16 bp, Homo sapiens
ctgcctcggcctccca

SEQ ID NO: 320632 - DNA, 17 bp, Homo sapiens
ctgcctctaaggccaag

SEQ ID NO: 320633 - DNA, 21 bp, Homo sapiens
ctgcctctaaggccaaggcct

SEQ ID NO: 320634 - DNA, 22 bp, Homo sapiens
ctgcctctaaggccaaggcctc

SEQ ID NO: 320635 - DNA, 18 bp, Homo sapiens
ctgcctctcggtggccag

SEQ ID NO: 320636 - DNA, 15 bp, Homo sapiens
ctgcctctgaactgc

SEQ ID NO: 320637 - DNA, 21 bp, Homo sapiens
ctgcctctgacagcagcctgt

SEQ ID NO: 320638 - DNA, 22 bp, Homo sapiens
ctgcctctgacagcagcctgtg

SEQ ID NO: 320639 - DNA, 23 bp, Homo sapiens
ctgcctctgacagcagcctgtga

SEQ ID NO: 320640 - DNA, 14 bp, Homo sapiens
ctgcctctgccaca

SEQ ID NO: 320641 - DNA, 20 bp, Homo sapiens
ctgcctctgccacactctga

SEQ ID NO: 320642 - DNA, 12 bp, Homo sapiens
ctgcctctgcct

SEQ ID NO: 320643 - DNA, 14 bp, Homo sapiens
ctgcctctgcctta

SEQ ID NO: 320644 - DNA, 14 bp, Homo sapiens
ctgcctctgggtga

SEQ ID NO: 320645 - DNA, 12 bp, Homo sapiens
ctgcctcttcct

SEQ ID NO: 320646 - DNA, 19 bp, Homo sapiens
ctgcctgaaacagccatgt

SEQ ID NO: 320647 - DNA, 21 bp, Homo sapiens
ctgcctgacactgagccccac

SEQ ID NO: 320648 - DNA, 12 bp, Homo sapiens
ctgcctgagccc

SEQ ID NO: 320649 - DNA, 19 bp, Homo sapiens
ctgcctgagcccaggagct

SEQ ID NO: 320650 - DNA, 15 bp, Homo sapiens
ctgcctgcagagcag

SEQ ID NO: 320651 - DNA, 20 bp, Homo sapiens
ctgcctgcagtactttacct

SEQ ID NO: 320652 - DNA, 21 bp, Homo sapiens
ctgcctgcagtactttacctc

SEQ ID NO: 320653 - DNA, 13 bp, Homo sapiens
ctgcctgcccact

SEQ ID NO: 320654 - DNA, 19 bp, Homo sapiens
ctgcctgcccgcacagcag

SEQ ID NO: 320655 - DNA, 21 bp, Homo sapiens
ctgcctgccggccgcccagac

SEQ ID NO: 320656 - DNA, 17 bp, Homo sapiens
ctgcctgcctccggccc

SEQ ID NO: 320657 - DNA, 22 bp, Homo sapiens
cagggtcttgggctactggcag

SEQ ID NO: 320658 - DNA, 23 bp, Homo sapiens
cagggtcttgggctactggcagc

SEQ ID NO: 320659 - DNA, 22 bp, Homo sapiens
cagggtgagcagggccctcaga

SEQ ID NO: 320660 - DNA, 11 bp, Homo sapiens
cagggtgcagg

SEQ ID NO: 320661 - DNA, 19 bp, Homo sapiens
cagggtgcaggcgcgcacc

SEQ ID NO: 320662 - DNA, 23 bp, Homo sapiens
cagggtgcaggcgcgcaccgccc

SEQ ID NO: 320663 - DNA, 20 bp, Homo sapiens
cagggtgggatgagcctctc

SEQ ID NO: 320664 - DNA, 17 bp, Homo sapiens
cagggtgggcagcctat

SEQ ID NO: 320665 - DNA, 20 bp, Homo sapiens
cagggtgggcagcctatggg

SEQ ID NO: 320666 - DNA, 16 bp, Homo sapiens
cagggtggggcttaga

SEQ ID NO: 320667 - DNA, 11 bp, Homo sapiens
cagggtggggg

SEQ ID NO: 320668 - DNA, 12 bp, Homo sapiens
cagggtgggggg

SEQ ID NO: 320669 - DNA, 16 bp, Homo sapiens
cagggtggggggtgac

SEQ ID NO: 320670 - DNA, 17 bp, Homo sapiens
cagggtggtgctgggac

SEQ ID NO: 320671 - DNA, 19 bp, Homo sapiens
cagggtggtgctgggactg

SEQ ID NO: 320672 - DNA, 18 bp, Homo sapiens
cagggttcaaaatgtctg

SEQ ID NO: 320673 - DNA, 13 bp, Homo sapiens
cagggttccagac

SEQ ID NO: 320674 - DNA, 14 bp, Homo sapiens
cagggttccagaca

SEQ ID NO: 320675 - DNA, 17 bp, Homo sapiens
cagggttccagacaggg

SEQ ID NO: 320676 - DNA, 21 bp, Homo sapiens
cagggttccagacagggtggg

SEQ ID NO: 320677 - DNA, 21 bp, Homo sapiens
cagggttcccccagccctgtg

SEQ ID NO: 320678 - DNA, 17 bp, Homo sapiens
cagggttctagaagggg

SEQ ID NO: 320679 - DNA, 15 bp, Homo sapiens
cagggttctcctctc

SEQ ID NO: 320680 - DNA, 20 bp, Homo sapiens
cagggttctcctctcccctc

SEQ ID NO: 320681 - DNA, 14 bp, Homo sapiens
cagggttctgtatt

SEQ ID NO: 320682 - DNA, 21 bp, Homo sapiens
cagggttgggcccagatctgg

SEQ ID NO: 320683 - DNA, 23 bp, Homo sapiens
caggtaaactgatgctttcagat

SEQ ID NO: 320684 - DNA, 17 bp, Homo sapiens
caggtacttcctcctga

SEQ ID NO: 320685 - DNA, 19 bp, Homo sapiens
caggtacttcctcctgatg

SEQ ID NO: 320686 - DNA, 19 bp, Homo sapiens
caggtagatcgcttgagcc

SEQ ID NO: 320687 - DNA, 22 bp, Homo sapiens
caggtagatcgcttgagcccag

SEQ ID NO: 320688 - DNA, 13 bp, Homo sapiens
caggtaggccctt

SEQ ID NO: 320689 - DNA, 19 bp, Homo sapiens
caggtaggcccttgtcctg

SEQ ID NO: 320690 - DNA, 20 bp, Homo sapiens
caggtaggcccttgtcctgc

SEQ ID NO: 320691 - DNA, 16 bp, Homo sapiens
caggtagtactgggaa

SEQ ID NO: 320692 - DNA, 17 bp, Homo sapiens
caggtagtttgtaccat

SEQ ID NO: 320693 - DNA, 18 bp, Homo sapiens
caggtcccacgtctggcc

SEQ ID NO: 320694 - DNA, 20 bp, Homo sapiens
caggtcccagtgccattggc

SEQ ID NO: 320695 - DNA, 20 bp, Homo sapiens
caggtcccgagccccctgtc

SEQ ID NO: 320696 - DNA, 21 bp, Homo sapiens
caggtcccgagccccctgtcc

SEQ ID NO: 320697 - DNA, 21 bp, Homo sapiens
caggtccctggaccagcctcc

SEQ ID NO: 320698 - DNA, 14 bp, Homo sapiens
caggtcctggggag

SEQ ID NO: 320699 - DNA, 18 bp, Homo sapiens
caggtcctggggaggctg

SEQ ID NO: 320700 - DNA, 21 bp, Homo sapiens
caggtcctggggaggctgaga

SEQ ID NO: 320701 - DNA, 23 bp, Homo sapiens
caggtcctggggaggctgagact

SEQ ID NO: 320702 - DNA, 12 bp, Homo sapiens
caggtcctttcc

SEQ ID NO: 320703 - DNA, 18 bp, Homo sapiens
caggtcctttccttctcg

SEQ ID NO: 320704 - DNA, 13 bp, Homo sapiens
caggtcgggctca

SEQ ID NO: 320705 - DNA, 16 bp, Homo sapiens
caggtctcactgcttt

SEQ ID NO: 320706 - DNA, 14 bp, Homo sapiens
caggtctgcaggcc

SEQ ID NO: 320707 - DNA, 15 bp, Homo sapiens
caggtctgcaggcca

SEQ ID NO: 320708 - DNA, 16 bp, Homo sapiens
caggtctgcaggccac

SEQ ID NO: 320709 - DNA, 13 bp, Homo sapiens
caggtctttgaaa

SEQ ID NO: 320710 - DNA, 19 bp, Homo sapiens
caggtctttgaaatatgca

SEQ ID NO: 320711 - DNA, 21 bp, Homo sapiens
caggtctttgaaatatgcatg

SEQ ID NO: 320712 - DNA, 23 bp, Homo sapiens
caggtctttgaaatatgcatgta

SEQ ID NO: 320713 - DNA, 20 bp, Homo sapiens
caggtgagtgtgagggcagc

SEQ ID NO: 320714 - DNA, 21 bp, Homo sapiens
caggtgagtgtgagggcagca

SEQ ID NO: 320715 - DNA, 19 bp, Homo sapiens
caggtgatccacccacctg

SEQ ID NO: 320716 - DNA, 15 bp, Homo sapiens
caggtgatccacctg

SEQ ID NO: 320717 - DNA, 18 bp, Homo sapiens
caggtgcagatgggctgt

SEQ ID NO: 320718 - DNA, 15 bp, Homo sapiens
caggtgccaccaata

SEQ ID NO: 320719 - DNA, 14 bp, Homo sapiens
caggtgccactccc

SEQ ID NO: 320720 - DNA, 16 bp, Homo sapiens
caggtgccactccctg

SEQ ID NO: 320721 - DNA, 22 bp, Homo sapiens
caggtgcccattagcaacgcct

SEQ ID NO: 320722 - DNA, 19 bp, Homo sapiens
caggtgccctgtgggagag

SEQ ID NO: 320723 - DNA, 11 bp, Homo sapiens
caggtgctgcc

SEQ ID NO: 320724 - DNA, 12 bp, Homo sapiens
caggtgctgcct

SEQ ID NO: 320725 - DNA, 13 bp, Homo sapiens
caggtgctggagg

SEQ ID NO: 320726 - DNA, 16 bp, Homo sapiens
caggtggaacaggagg

SEQ ID NO: 320727 - DNA, 22 bp, Homo sapiens
caggtggaacaggaggaactgg

SEQ ID NO: 320728 - DNA, 15 bp, Homo sapiens
caggtggccactcca

SEQ ID NO: 320729 - DNA, 14 bp, Homo sapiens
caggtggccagggc

SEQ ID NO: 320730 - DNA, 18 bp, Homo sapiens
caggtggcctaaggctgc

SEQ ID NO: 320731 - DNA, 19 bp, Homo sapiens
caggtggggcatgtcctca

SEQ ID NO: 320732 - DNA, 20 bp, Homo sapiens
caggtggtgtccttcttcct

SEQ ID NO: 320733 - DNA, 21 bp, Homo sapiens
caggtgtcatatatggggggc

SEQ ID NO: 320734 - DNA, 16 bp, Homo sapiens
caggtgtccccagccc

SEQ ID NO: 320735 - DNA, 15 bp, Homo sapiens
caggtgtcctgactg

SEQ ID NO: 320736 - DNA, 16 bp, Homo sapiens
caggtgtgtgccatca

SEQ ID NO: 320737 - DNA, 18 bp, Homo sapiens
caggtgtgtgccatcatg

SEQ ID NO: 320738 - DNA, 15 bp, Homo sapiens
caggtgttaaaaacc

SEQ ID NO: 320739 - DNA, 20 bp, Homo sapiens
caggtgttctacactcatct

SEQ ID NO: 320740 - DNA, 22 bp, Homo sapiens
caggtgttgggacctgctgctc

SEQ ID NO: 320741 - DNA, 16 bp, Homo sapiens
caggttatgtcagcag

SEQ ID NO: 320742 - DNA, 21 bp, Homo sapiens
caggttatgtcagcagctctg

SEQ ID NO: 320743 - DNA, 23 bp, Homo sapiens
caggttccagaacagccctcggc

SEQ ID NO: 320744 - DNA, 16 bp, Homo sapiens
caggttccatccacca

SEQ ID NO: 320745 - DNA, 19 bp, Homo sapiens
caggttccatccaccacct

SEQ ID NO: 320746 - DNA, 17 bp, Homo sapiens
caggttcgtatagaaaa

SEQ ID NO: 320747 - DNA, 19 bp, Homo sapiens
caggttctctcctgtgagc

SEQ ID NO: 320748 - DNA, 20 bp, Homo sapiens
caggttctggttagctcagc

SEQ ID NO: 320749 - DNA, 16 bp, Homo sapiens
caggttgcagctgctc

SEQ ID NO: 320750 - DNA, 21 bp, Homo sapiens
caggttggatgggagtgggca

SEQ ID NO: 320751 - DNA, 23 bp, Homo sapiens
caggttgtctgaagtcactgcac

SEQ ID NO: 320752 - DNA, 19 bp, Homo sapiens
caggtttcactattcctat

SEQ ID NO: 320753 - DNA, 14 bp, Homo sapiens
caggtttgttacat

SEQ ID NO: 320754 - DNA, 12 bp, Homo sapiens
caggttttcctg

SEQ ID NO: 320755 - DNA, 14 bp, Homo sapiens
cagtaaatgtatat

SEQ ID NO: 320756 - DNA, 17 bp, Homo sapiens
cagtaaatgtatattga

SEQ ID NO: 320757 - DNA, 12 bp, Homo sapiens
cagtaaccattt

SEQ ID NO: 320758 - DNA, 22 bp, Homo sapiens
cagtaagaccggaagctcctgg

SEQ ID NO: 320759 - DNA, 15 bp, Homo sapiens
cagtaagccactgcc

SEQ ID NO: 320760 - DNA, 13 bp, Homo sapiens
cagtaaggcaggg

SEQ ID NO: 320761 - DNA, 14 bp, Homo sapiens
cagtaatagctgaa

SEQ ID NO: 320762 - DNA, 21 bp, Homo sapiens
cagtaattggtccgatctttg

SEQ ID NO: 320763 - DNA, 18 bp, Homo sapiens
cagtacacccaattttaa

SEQ ID NO: 320764 - DNA, 21 bp, Homo sapiens
cagtacacttggtgtactggg

SEQ ID NO: 320765 - DNA, 18 bp, Homo sapiens
cagtacagctatttctca

SEQ ID NO: 320766 - DNA, 16 bp, Homo sapiens
cagtacagtggttcta

SEQ ID NO: 320767 - DNA, 13 bp, Homo sapiens
cagtacatttttg

SEQ ID NO: 320768 - DNA, 13 bp, Homo sapiens
cagtacctgggaa

SEQ ID NO: 320769 - DNA, 24 bp, Homo sapiens
ctgctcaggcctcacctggcttcc

SEQ ID NO: 320770 - DNA, 15 bp, Homo sapiens
ctgctccacccttgg

SEQ ID NO: 320771 - DNA, 21 bp, Homo sapiens
ctgctccacccttggcctgtc

SEQ ID NO: 320772 - DNA, 14 bp, Homo sapiens
ctgctccatgcaga

SEQ ID NO: 320773 - DNA, 21 bp, Homo sapiens
ctgctccatgcagatctagcc

SEQ ID NO: 320774 - DNA, 23 bp, Homo sapiens
ctgctccatgcagatctagccag

SEQ ID NO: 320775 - DNA, 22 bp, Homo sapiens
ctgctccatggatgcatgccct

SEQ ID NO: 320776 - DNA, 15 bp, Homo sapiens
ctgctcccagcctct

SEQ ID NO: 320777 - DNA, 19 bp, Homo sapiens
ctgctcccagcctcttgct

SEQ ID NO: 320778 - DNA, 16 bp, Homo sapiens
ctgctcccagcctgct

SEQ ID NO: 320779 - DNA, 17 bp, Homo sapiens
ctgctcccattcctccc

SEQ ID NO: 320780 - DNA, 15 bp, Homo sapiens
ctgctccccacccct

SEQ ID NO: 320781 - DNA, 15 bp, Homo sapiens
ctgctccgccaggaa

SEQ ID NO: 320782 - DNA, 22 bp, Homo sapiens
ctgctcctcacccccacccctg

SEQ ID NO: 320783 - DNA, 12 bp, Homo sapiens
ctgctcctcgca

SEQ ID NO: 320784 - DNA, 20 bp, Homo sapiens
ctgctcctcggccagagctc

SEQ ID NO: 320785 - DNA, 23 bp, Homo sapiens
ctgctcctcggccagagctccca

SEQ ID NO: 320786 - DNA, 18 bp, Homo sapiens
ctgctccttccttcacct

SEQ ID NO: 320787 - DNA, 16 bp, Homo sapiens
ctgctccttggcaccc

SEQ ID NO: 320788 - DNA, 21 bp, Homo sapiens
ctgctccttggcctagtcaga

SEQ ID NO: 320789 - DNA, 21 bp, Homo sapiens
ctgctctacccatgagcctgc

SEQ ID NO: 320790 - DNA, 13 bp, Homo sapiens
ctgctctagccag

SEQ ID NO: 320791 - DNA, 14 bp, Homo sapiens
ctgctctagccagg

SEQ ID NO: 320792 - DNA, 15 bp, Homo sapiens
ctgctctagctggca

SEQ ID NO: 320793 - DNA, 17 bp, Homo sapiens
ctgctctagctggcagg

SEQ ID NO: 320794 - DNA, 15 bp, Homo sapiens
cagtatataagctgt

SEQ ID NO: 320795 - DNA, 18 bp, Homo sapiens
cagtatataagctgttta

SEQ ID NO: 320796 - DNA, 13 bp, Homo sapiens
cagtatcaaggct

SEQ ID NO: 320797 - DNA, 19 bp, Homo sapiens
cagtatcaaggctgcctgg

SEQ ID NO: 320798 - DNA, 16 bp, Homo sapiens
cagtatcctgctggtt

SEQ ID NO: 320799 - DNA, 18 bp, Homo sapiens
cagtatcttgaagacttt

SEQ ID NO: 320800 - DNA, 23 bp, Homo sapiens
cagtatgagtcaatgtgcagtgt

SEQ ID NO: 320801 - DNA, 15 bp, Homo sapiens
cagtatggcggaggc

SEQ ID NO: 320802 - DNA, 17 bp, Homo sapiens
cagtatggcggaggcca

SEQ ID NO: 320803 - DNA, 21 bp, Homo sapiens
cagtatgggctacacagcagc

SEQ ID NO: 320804 - DNA, 11 bp, Homo sapiens
cagtatgtgtc

SEQ ID NO: 320805 - DNA, 19 bp, Homo sapiens
cagtattaacatcaaagac

SEQ ID NO: 320806 - DNA, 20 bp, Homo sapiens
cagtattatttctccatccc

SEQ ID NO: 320807 - DNA, 13 bp, Homo sapiens
cagtattcccttt

SEQ ID NO: 320808 - DNA, 15 bp, Homo sapiens
cagtattctaggtag

SEQ ID NO: 320809 - DNA, 21 bp, Homo sapiens
cagtattctaggtagtgccct

SEQ ID NO: 320810 - DNA, 17 bp, Homo sapiens
cagtattctcagtgctc

SEQ ID NO: 320811 - DNA, 22 bp, Homo sapiens
cagtattgaaaacttcaaagct

SEQ ID NO: 320812 - DNA, 14 bp, Homo sapiens
cagtattgccacct

SEQ ID NO: 320813 - DNA, 18 bp, Homo sapiens
cagtattgttcttgtaaa

SEQ ID NO: 320814 - DNA, 18 bp, Homo sapiens
cagtatttaccttccttt

SEQ ID NO: 320815 - DNA, 19 bp, Homo sapiens
cagtatttaccttcctttg

SEQ ID NO: 320816 - DNA, 15 bp, Homo sapiens
cagtatttattgttc

SEQ ID NO: 320817 - DNA, 14 bp, Homo sapiens
cagtattttggaga

SEQ ID NO: 320818 - DNA, 19 bp, Homo sapiens
cagtattttggagaaatta

SEQ ID NO: 320819 - DNA, 19 bp, Homo sapiens
cagtcaaagacgctgagtg

SEQ ID NO: 320820 - DNA, 21 bp, Homo sapiens
cagtcaaaggaacgccttccc

SEQ ID NO: 320821 - DNA, 19 bp, Homo sapiens
cagtcaagttccgtctcct

SEQ ID NO: 320822 - DNA, 13 bp, Homo sapiens
cagtcacactgct

SEQ ID NO: 320823 - DNA, 17 bp, Homo sapiens
cagtcacactgctggga

SEQ ID NO: 320824 - DNA, 15 bp, Homo sapiens
cagtcacccctgtct

SEQ ID NO: 320825 - DNA, 18 bp, Homo sapiens
cagtcacccctgtctgcg

SEQ ID NO: 320826 - DNA, 15 bp, Homo sapiens
cagtcaccctgtggc

SEQ ID NO: 320827 - DNA, 17 bp, Homo sapiens
cagtcacccttctgggc

SEQ ID NO: 320828 - DNA, 17 bp, Homo sapiens
cagtcacctgcccagat

SEQ ID NO: 320829 - DNA, 20 bp, Homo sapiens
cagtcagatttccagtctcc

SEQ ID NO: 320830 - DNA, 12 bp, Homo sapiens
cagtcagccagc

SEQ ID NO: 320831 - DNA, 12 bp, Homo sapiens
cagtcaggaagc

SEQ ID NO: 320832 - DNA, 20 bp, Homo sapiens
cagtcaggctgcagaggcac

SEQ ID NO: 320833 - DNA, 15 bp, Homo sapiens
cagtcagttcccgga

SEQ ID NO: 320834 - DNA, 19 bp, Homo sapiens
cagtcagttcccggagcac

SEQ ID NO: 320835 - DNA, 21 bp, Homo sapiens
cagtcagttcccggagcacag

SEQ ID NO: 320836 - DNA, 18 bp, Homo sapiens
cagtcattatttaaagca

SEQ ID NO: 320837 - DNA, 21 bp, Homo sapiens
cagtcattgggttttatcagt

SEQ ID NO: 320838 - DNA, 18 bp, Homo sapiens
cagtccaaatgtcctcca

SEQ ID NO: 320839 - DNA, 23 bp, Homo sapiens
cagtccaaatgtcctccagaagc

SEQ ID NO: 320840 - DNA, 21 bp, Homo sapiens
cagtccacccccattgtgaat

SEQ ID NO: 320841 - DNA, 16 bp, Homo sapiens
cagtccacctgagctg

SEQ ID NO: 320842 - DNA, 21 bp, Homo sapiens
cagtcccagaaccacactgtt

SEQ ID NO: 320843 - DNA, 13 bp, Homo sapiens
cagtcccaggggc

SEQ ID NO: 320844 - DNA, 19 bp, Homo sapiens
cagtccccagcccttctgc

SEQ ID NO: 320845 - DNA, 20 bp, Homo sapiens
cagtcccccaccacactgaa

SEQ ID NO: 320846 - DNA, 22 bp, Homo sapiens
cagtccccctatccttggcacc

SEQ ID NO: 320847 - DNA, 17 bp, Homo sapiens
cagtccccctgccccag

SEQ ID NO: 320848 - DNA, 18 bp, Homo sapiens
cagtccccgggaaaggcc

SEQ ID NO: 320849 - DNA, 14 bp, Homo sapiens
cagtccctaaagaa

SEQ ID NO: 320850 - DNA, 15 bp, Homo sapiens
cagtccctccctcct

SEQ ID NO: 320851 - DNA, 18 bp, Homo sapiens
cagtccctccctcctggc

SEQ ID NO: 320852 - DNA, 19 bp, Homo sapiens
cagtccctccctcctggct

SEQ ID NO: 320853 - DNA, 14 bp, Homo sapiens
cagtccctcctgtt

SEQ ID NO: 320854 - DNA, 19 bp, Homo sapiens
cagtccctgagcagtctac

SEQ ID NO: 320855 - DNA, 13 bp, Homo sapiens
cagtccctggagc

SEQ ID NO: 320856 - DNA, 16 bp, Homo sapiens
cagtccctggagctgt

SEQ ID NO: 320857 - DNA, 18 bp, Homo sapiens
cagtcctcacatgcccgc

SEQ ID NO: 320858 - DNA, 11 bp, Homo sapiens
cagtcctgcaa

SEQ ID NO: 320859 - DNA, 12 bp, Homo sapiens
cagtcctgcctg

SEQ ID NO: 320860 - DNA, 16 bp, Homo sapiens
cagtcctgcctggcca

SEQ ID NO: 320861 - DNA, 13 bp, Homo sapiens
cagtcctgctctc

SEQ ID NO: 320862 - DNA, 17 bp, Homo sapiens
cagtcctgctctctacc

SEQ ID NO: 320863 - DNA, 18 bp, Homo sapiens
cagtcctgctctctaccc

SEQ ID NO: 320864 - DNA, 14 bp, Homo sapiens
cagtcgcaggatcc

SEQ ID NO: 320865 - DNA, 17 bp, Homo sapiens
cagtcgccctctgtgcc

SEQ ID NO: 320866 - DNA, 19 bp, Homo sapiens
cagtcgccctctgtgccta

SEQ ID NO: 320867 - DNA, 20 bp, Homo sapiens
cagtcgctcacacctgtaat

SEQ ID NO: 320868 - DNA, 17 bp, Homo sapiens
cagtcggagcctcactc

SEQ ID NO: 320869 - DNA, 14 bp, Homo sapiens
cagtctacaggcct

SEQ ID NO: 320870 - DNA, 23 bp, Homo sapiens
cagtctacccacctcagcctcct

SEQ ID NO: 320871 - DNA, 12 bp, Homo sapiens
cagtctacttct

SEQ ID NO: 320872 - DNA, 22 bp, Homo sapiens
cagtctacttctgtgtctgtca

SEQ ID NO: 320873 - DNA, 15 bp, Homo sapiens
cagtctcaattttgt

SEQ ID NO: 320874 - DNA, 20 bp, Homo sapiens
cagtctcaattttgtattta

SEQ ID NO: 320875 - DNA, 14 bp, Homo sapiens
cagtctcccaggcc

SEQ ID NO: 320876 - DNA, 23 bp, Homo sapiens
cagtctcccaggccccctgcatc

SEQ ID NO: 320877 - DNA, 11 bp, Homo sapiens
cagtctccctt

SEQ ID NO: 320878 - DNA, 22 bp, Homo sapiens
cagtctctcttacccttctgtg

SEQ ID NO: 320879 - DNA, 19 bp, Homo sapiens
cagtctctttaatcttcag

SEQ ID NO: 320880 - DNA, 19 bp, Homo sapiens
cagtctgaacccttgtgct

SEQ ID NO: 320881 - DNA, 22 bp, Homo sapiens
cagtctgagtcatcaaaaagag

SEQ ID NO: 320882 - DNA, 12 bp, Homo sapiens
cagtctgcagct

SEQ ID NO: 320883 - DNA, 19 bp, Homo sapiens
cagtctgcagctattcaca

SEQ ID NO: 320884 - DNA, 12 bp, Homo sapiens
cagtctgctgcc

SEQ ID NO: 320885 - DNA, 13 bp, Homo sapiens
cagtctggagggg

SEQ ID NO: 320886 - DNA, 16 bp, Homo sapiens
cagtctggaggggcat

SEQ ID NO: 320887 - DNA, 12 bp, Homo sapiens
cagtctgttctc

SEQ ID NO: 320888 - DNA, 15 bp, Homo sapiens
cagtctgttctcaca

SEQ ID NO: 320889 - DNA, 20 bp, Homo sapiens
cagtcttccctagggctggg

SEQ ID NO: 320890 - DNA, 22 bp, Homo sapiens
cagtcttccctagggctgggtg

SEQ ID NO: 320891 - DNA, 18 bp, Homo sapiens
cagtcttctaccaaatgt

SEQ ID NO: 320892 - DNA, 14 bp, Homo sapiens
cagtcttctccctg

SEQ ID NO: 320893 - DNA, 18 bp, Homo sapiens
cagtcttgagtgggcccc

SEQ ID NO: 320894 - DNA, 18 bp, Homo sapiens
cagtcttgcctaggccaa

SEQ ID NO: 320895 - DNA, 11 bp, Homo sapiens
cagtcttgctc

SEQ ID NO: 320896 - DNA, 20 bp, Homo sapiens
cagtctttgggggattcaaa

SEQ ID NO: 320897 - DNA, 19 bp, Homo sapiens
cagtgaacacactcagcag

SEQ ID NO: 320898 - DNA, 16 bp, Homo sapiens
cagtgaacagtttgga

SEQ ID NO: 320899 - DNA, 15 bp, Homo sapiens
ctgagagtgaaacca

SEQ ID NO: 320900 - DNA, 13 bp, Homo sapiens
ctgagatgcacca

SEQ ID NO: 320901 - DNA, 22 bp, Homo sapiens
ctgagatgcaccaagtacagcc

SEQ ID NO: 320902 - DNA, 17 bp, Homo sapiens
ctgagatgggaggatca

SEQ ID NO: 320903 - DNA, 19 bp, Homo sapiens
ctgagatgtaggctccacc

SEQ ID NO: 320904 - DNA, 21 bp, Homo sapiens
ctgagatgtaggctccacctt

SEQ ID NO: 320905 - DNA, 14 bp, Homo sapiens
ctgagattctggga

SEQ ID NO: 320906 - DNA, 18 bp, Homo sapiens
ctgagattctgggaaagg

SEQ ID NO: 320907 - DNA, 19 bp, Homo sapiens
ctgagattctgggaaaggt

SEQ ID NO: 320908 - DNA, 22 bp, Homo sapiens
ctgagcaactgtgcagcaccct

SEQ ID NO: 320909 - DNA, 15 bp, Homo sapiens
ctgagcaccctctcc

SEQ ID NO: 320910 - DNA, 19 bp, Homo sapiens
ctgagcacgggcaaagaaa

SEQ ID NO: 320911 - DNA, 22 bp, Homo sapiens
ctgagcagactggtgagcagac

SEQ ID NO: 320912 - DNA, 24 bp, Homo sapiens
ctgagcagcctctgccaggcctgt

SEQ ID NO: 320913 - DNA, 21 bp, Homo sapiens
ctgagcagtctacttctgtgt

SEQ ID NO: 320914 - DNA, 16 bp, Homo sapiens
ctgagcagtggggagc

SEQ ID NO: 320915 - DNA, 19 bp, Homo sapiens
ctgagcagttttccaggag

SEQ ID NO: 320916 - DNA, 20 bp, Homo sapiens
ctgagccacagtggggccca

SEQ ID NO: 320917 - DNA, 23 bp, Homo sapiens
ctgcaccttgggcacgggagagc

SEQ ID NO: 320918 - DNA, 18 bp, Homo sapiens
ctgcactactcctctgca

SEQ ID NO: 320919 - DNA, 20 bp, Homo sapiens
ctgcactactcctctgcagt

SEQ ID NO: 320920 - DNA, 17 bp, Homo sapiens
ctgcactatagccattt

SEQ ID NO: 320921 - DNA, 14 bp, Homo sapiens
ctgcactcaagctt

SEQ ID NO: 320922 - DNA, 22 bp, Homo sapiens
ctgcactccatggccaccccgt

SEQ ID NO: 320923 - DNA, 13 bp, Homo sapiens
ctgcactgtaaaa

SEQ ID NO: 320924 - DNA, 16 bp, Homo sapiens
ctgcactgtaaaatgt

SEQ ID NO: 320925 - DNA, 20 bp, Homo sapiens
ctgcactgtaaaatgtggga

SEQ ID NO: 320926 - DNA, 15 bp, Homo sapiens
ctgcacttcagacac

SEQ ID NO: 320927 - DNA, 19 bp, Homo sapiens
ctgcacttggtgctgcttt

SEQ ID NO: 320928 - DNA, 22 bp, Homo sapiens
ctgcacttggtgctgctttggc

SEQ ID NO: 320929 - DNA, 14 bp, Homo sapiens
ctgcagacaaaaag

SEQ ID NO: 320930 - DNA, 17 bp, Homo sapiens
ctgcagagacagagagg

SEQ ID NO: 320931 - DNA, 14 bp, Homo sapiens
ctgcagagctgggg

SEQ ID NO: 320932 - DNA, 19 bp, Homo sapiens
ctgcagaggaccacagtgg

SEQ ID NO: 320933 - DNA, 21 bp, Homo sapiens
ctgcagaggaccacagtgggt

SEQ ID NO: 320934 - DNA, 20 bp, Homo sapiens
ctgcagaggagccacctggg

SEQ ID NO: 320935 - DNA, 21 bp, Homo sapiens
ctgcagaggagccacctgggc

SEQ ID NO: 320936 - DNA, 22 bp, Homo sapiens
ctgcagaggagccacctgggct

SEQ ID NO: 320937 - DNA, 23 bp, Homo sapiens
ctgcagaggagccacctgggctg

SEQ ID NO: 320938 - DNA, 11 bp, Homo sapiens
ctgcagaggca

SEQ ID NO: 320939 - DNA, 13 bp, Homo sapiens
ctgcagcaggcag

SEQ ID NO: 320940 - DNA, 17 bp, Homo sapiens
ctgcagcatgacctgtg

SEQ ID NO: 320941 - DNA, 19 bp, Homo sapiens
ctgcagcatgacctgtgac

SEQ ID NO: 320942 - DNA, 19 bp, Homo sapiens
ctgcagcccacagaggaca

SEQ ID NO: 320943 - DNA, 23 bp, Homo sapiens
ctgcagcccagaacgggcctccc

SEQ ID NO: 320944 - DNA, 15 bp, Homo sapiens
ctgcagccccccaga

SEQ ID NO: 320945 - DNA, 19 bp, Homo sapiens
ctgcagccctctccaccct

SEQ ID NO: 320946 - DNA, 15 bp, Homo sapiens
ctgcagcccttgggc

SEQ ID NO: 320947 - DNA, 17 bp, Homo sapiens
ctgcagcctcctcctga

SEQ ID NO: 320948 - DNA, 21 bp, Homo sapiens
ctgcagcctctgcctcccagg

SEQ ID NO: 320949 - DNA, 22 bp, Homo sapiens
ctgcagcctgagctccaccctc

SEQ ID NO: 320950 - DNA, 14 bp, Homo sapiens
ctgcagcctggagg

SEQ ID NO: 320951 - DNA, 20 bp, Homo sapiens
ctgcagcctggaggccgggt

SEQ ID NO: 320952 - DNA, 16 bp, Homo sapiens
ctgcagcgcctcctgg

SEQ ID NO: 320953 - DNA, 19 bp, Homo sapiens
ctgcagctattcacacaca

SEQ ID NO: 320954 - DNA, 15 bp, Homo sapiens
ctgcagctgggcccc

SEQ ID NO: 320955 - DNA, 19 bp, Homo sapiens
ctgcagctgggccccatgc

SEQ ID NO: 320956 - DNA, 22 bp, Homo sapiens
ctgcagctgggccccatgctct

SEQ ID NO: 320957 - DNA, 23 bp, Homo sapiens
ctgcagctgggccccatgctctg

SEQ ID NO: 320958 - DNA, 24 bp, Homo sapiens
ctgcagctgggccccatgctctgc

SEQ ID NO: 320959 - DNA, 14 bp, Homo sapiens
ctgcagctgggctg

SEQ ID NO: 320960 - DNA, 23 bp, Homo sapiens
ctgcagctgttttagttaaattt

SEQ ID NO: 320961 - DNA, 12 bp, Homo sapiens
ctgcagctttac

SEQ ID NO: 320962 - DNA, 18 bp, Homo sapiens
ctgcaggaacgagcactg

SEQ ID NO: 320963 - DNA, 19 bp, Homo sapiens
ctgcaggaacgagcactgg

SEQ ID NO: 320964 - DNA, 21 bp, Homo sapiens
ctgcaggaacgagcactggcc

SEQ ID NO: 320965 - DNA, 24 bp, Homo sapiens
ctgcaggaacgagcactggccaga

SEQ ID NO: 320966 - DNA, 18 bp, Homo sapiens
ctgcaggaggcctgggag

SEQ ID NO: 320967 - DNA, 21 bp, Homo sapiens
ctgcaggaggcctgggagggc

SEQ ID NO: 320968 - DNA, 18 bp, Homo sapiens
ctgcaggccaccagctgc

SEQ ID NO: 320969 - DNA, 14 bp, Homo sapiens
ctgcaggccccagc

SEQ ID NO: 320970 - DNA, 18 bp, Homo sapiens
ctgcaggctggctgttgg

SEQ ID NO: 320971 - DNA, 15 bp, Homo sapiens
ctgcagggacacggg

SEQ ID NO: 320972 - DNA, 20 bp, Homo sapiens
ctgcagggacacgggcagcc

SEQ ID NO: 320973 - DNA, 17 bp, Homo sapiens
ctgcagggactgccagt

SEQ ID NO: 320974 - DNA, 23 bp, Homo sapiens
ctgcagggagcaactctccactc

SEQ ID NO: 320975 - DNA, 12 bp, Homo sapiens
ctgcagggcagc

SEQ ID NO: 320976 - DNA, 17 bp, Homo sapiens
ctgcagggcagcctgtg

SEQ ID NO: 320977 - DNA, 18 bp, Homo sapiens
ctgcagggcagcctgtgg

SEQ ID NO: 320978 - DNA, 20 bp, Homo sapiens
ctgcagggtggtgctgggac

SEQ ID NO: 320979 - DNA, 15 bp, Homo sapiens
ctgcaggtacttcct

SEQ ID NO: 320980 - DNA, 19 bp, Homo sapiens
ctgcaggtacttcctcctg

SEQ ID NO: 320981 - DNA, 20 bp, Homo sapiens
ctgcaggtacttcctcctga

SEQ ID NO: 320982 - DNA, 18 bp, Homo sapiens
ctgcaggttggaccccag

SEQ ID NO: 320983 - DNA, 15 bp, Homo sapiens
ctgcagtcacccctg

SEQ ID NO: 320984 - DNA, 19 bp, Homo sapiens
ctgcagtcacccctgtctg

SEQ ID NO: 320985 - DNA, 21 bp, Homo sapiens
ctgcagtcacccctgtctgcg

SEQ ID NO: 320986 - DNA, 16 bp, Homo sapiens
ctgcagtcctggtggg

SEQ ID NO: 320987 - DNA, 19 bp, Homo sapiens
ctgcagtgttcgcttggct

SEQ ID NO: 320988 - DNA, 20 bp, Homo sapiens
ctgcagtgttcgcttggctc

SEQ ID NO: 320989 - DNA, 22 bp, Homo sapiens
ctgcagtgttcgcttggctcca

SEQ ID NO: 320990 - DNA, 17 bp, Homo sapiens
ctgcagttgaagagcct

SEQ ID NO: 320991 - DNA, 17 bp, Homo sapiens
ctgcagttgtgaaagca

SEQ ID NO: 320992 - DNA, 15 bp, Homo sapiens
ctgcatagacaaagg

SEQ ID NO: 320993 - DNA, 16 bp, Homo sapiens
ctgcatagctctattt

SEQ ID NO: 320994 - DNA, 18 bp, Homo sapiens
ctgcatagctctatttta

SEQ ID NO: 320995 - DNA, 21 bp, Homo sapiens
ctgcatatagataattatcca

SEQ ID NO: 320996 - DNA, 20 bp, Homo sapiens
ctgcatatcctggtgtctag

SEQ ID NO: 320997 - DNA, 21 bp, Homo sapiens
ctgcatatcctggtgtctagt

SEQ ID NO: 320998 - DNA, 20 bp, Homo sapiens
ctgcatcagcctctggccag

SEQ ID NO: 320999 - DNA, 13 bp, Homo sapiens
ctgcatcatctgt

SEQ ID NO: 321000 - DNA, 14 bp, Homo sapiens
ctgcatcatctgta

SEQ ID NO: 321001 - DNA, 18 bp, Homo sapiens
ctgcatcatctgtagata

SEQ ID NO: 321002 - DNA, 17 bp, Homo sapiens
ctgcatccaggcctgag

SEQ ID NO: 321003 - DNA, 23 bp, Homo sapiens
ctgcatccaggcctgaggctgct

SEQ ID NO: 321004 - DNA, 16 bp, Homo sapiens
ctgcatccctccaccc

SEQ ID NO: 321005 - DNA, 22 bp, Homo sapiens
ctgcatccctccaccccagtcc

SEQ ID NO: 321006 - DNA, 20 bp, Homo sapiens
ctgcatcctactcctacctg

SEQ ID NO: 321007 - DNA, 14 bp, Homo sapiens
ctgcatcctcagcc

SEQ ID NO: 321008 - DNA, 15 bp, Homo sapiens
ctgcatcctcagccc

SEQ ID NO: 321009 - DNA, 18 bp, Homo sapiens
ctgcatcctcagccccag

SEQ ID NO: 321010 - DNA, 19 bp, Homo sapiens
ctgcatcctcagccccagg

SEQ ID NO: 321011 - DNA, 22 bp, Homo sapiens
ctgcatcctcagccccagggcc

SEQ ID NO: 321012 - DNA, 23 bp, Homo sapiens
ctgcatctttcatagttctgtta

SEQ ID NO: 321013 - DNA, 13 bp, Homo sapiens
ctgcatgcaagct

SEQ ID NO: 321014 - DNA, 17 bp, Homo sapiens
ctgcatgcaagctcagg

SEQ ID NO: 321015 - DNA, 20 bp, Homo sapiens
ctgcatgcaagctcagggtg

SEQ ID NO: 321016 - DNA, 15 bp, Homo sapiens
ctgcatgcagcaaca

SEQ ID NO: 321017 - DNA, 16 bp, Homo sapiens
ctgcatgcagcaacac

SEQ ID NO: 321018 - DNA, 22 bp, Homo sapiens
ctgcatgcgggcttcctcctgg

SEQ ID NO: 321019 - DNA, 13 bp, Homo sapiens
ctgcatgctgctg

SEQ ID NO: 321020 - DNA, 22 bp, Homo sapiens
ctgcatgctgctggacagtatc

SEQ ID NO: 321021 - DNA, 13 bp, Homo sapiens
ctgcatggaccta

SEQ ID NO: 321022 - DNA, 16 bp, Homo sapiens
ctgcatggacctaaca

SEQ ID NO: 321023 - DNA, 18 bp, Homo sapiens
ctgcatggacctaacatt

SEQ ID NO: 321024 - DNA, 14 bp, Homo sapiens
ctgcatggacgcct

SEQ ID NO: 321025 - DNA, 23 bp, Homo sapiens
ctgcatggacgcctggctccagg

SEQ ID NO: 321026 - DNA, 17 bp, Homo sapiens
ctgcatggcagaagcgt

SEQ ID NO: 321027 - DNA, 16 bp, Homo sapiens
ctgcatggtaatttat

SEQ ID NO: 321028 - DNA, 18 bp, Homo sapiens
ctgcatgtaaaatcttca

SEQ ID NO: 321029 - DNA, 16 bp, Homo sapiens
ctgcattcgcagcagc

SEQ ID NO: 321030 - DNA, 15 bp, Homo sapiens
ctgcattgttattgt

SEQ ID NO: 321031 - DNA, 13 bp, Homo sapiens
ctgcatttagcac

SEQ ID NO: 321032 - DNA, 14 bp, Homo sapiens
ctgcatttagcaca

SEQ ID NO: 321033 - DNA, 15 bp, Homo sapiens
ctgcatttagcacaa

SEQ ID NO: 321034 - DNA, 18 bp, Homo sapiens
ctgcatttagcacaaaaa

SEQ ID NO: 321035 - DNA, 23 bp, Homo sapiens
ctgcatttagcacaaaaaaaatt

SEQ ID NO: 321036 - DNA, 18 bp, Homo sapiens
ctgcatttataaatgtgt

SEQ ID NO: 321037 - DNA, 20 bp, Homo sapiens
ctgcatttggggcctttccc

SEQ ID NO: 321038 - DNA, 22 bp, Homo sapiens
ctgcatttgtgaaatgatggtg

SEQ ID NO: 321039 - DNA, 21 bp, Homo sapiens
ctgcattttctgggttctggg

SEQ ID NO: 321040 - DNA, 19 bp, Homo sapiens
ctgcatttttaaaggacaa

SEQ ID NO: 321041 - DNA, 19 bp, Homo sapiens
ctgccaaaaagaacaccca

SEQ ID NO: 321042 - DNA, 17 bp, Homo sapiens
ctgccaactccatgacc

SEQ ID NO: 321043 - DNA, 23 bp, Homo sapiens
ctgccaactccatgaccaggcca

SEQ ID NO: 321044 - DNA, 15 bp, Homo sapiens
ctgccaactttccag

SEQ ID NO: 321045 - DNA, 16 bp, Homo sapiens
ctgccaactttccaga

SEQ ID NO: 321046 - DNA, 19 bp, Homo sapiens
ctgccaagaactctgggca

SEQ ID NO: 321047 - DNA, 22 bp, Homo sapiens
cagggagtcccctccccggccc

SEQ ID NO: 321048 - DNA, 15 bp, Homo sapiens
cagggagtgatgatt

SEQ ID NO: 321049 - DNA, 22 bp, Homo sapiens
cagggagtgtctgcagtcctgg

SEQ ID NO: 321050 - DNA, 15 bp, Homo sapiens
cagggatcttctccc

SEQ ID NO: 321051 - DNA, 16 bp, Homo sapiens
cagggatcttctccct

SEQ ID NO: 321052 - DNA, 17 bp, Homo sapiens
cagggatcttctccctc

SEQ ID NO: 321053 - DNA, 14 bp, Homo sapiens
cagggatttgagga

SEQ ID NO: 321054 - DNA, 18 bp, Homo sapiens
cagggcaccaagcccaca

SEQ ID NO: 321055 - DNA, 19 bp, Homo sapiens
cagggcaccaagcccacag

SEQ ID NO: 321056 - DNA, 12 bp, Homo sapiens
cagggcagaggg

SEQ ID NO: 321057 - DNA, 20 bp, Homo sapiens
cagggcagccgtcacccctg

SEQ ID NO: 321058 - DNA, 22 bp, Homo sapiens
cagggcagcctgtgggagaagg

SEQ ID NO: 321059 - DNA, 21 bp, Homo sapiens
cagggcaggcagagctcagca

SEQ ID NO: 321060 - DNA, 17 bp, Homo sapiens
cagggcagggctctgat

SEQ ID NO: 321061 - DNA, 19 bp, Homo sapiens
cagggcagtgtggtgggag

SEQ ID NO: 321062 - DNA, 15 bp, Homo sapiens
cagggcatctcctgt

SEQ ID NO: 321063 - DNA, 19 bp, Homo sapiens
cagggccagaaggagggca

SEQ ID NO: 321064 - DNA, 22 bp, Homo sapiens
cagggccagaaggagggcagag

SEQ ID NO: 321065 - DNA, 23 bp, Homo sapiens
cagggccagaaggagggcagagc

SEQ ID NO: 321066 - DNA, 16 bp, Homo sapiens
cagggccatgcctgcc

SEQ ID NO: 321067 - DNA, 12 bp, Homo sapiens
cagggcccacct

SEQ ID NO: 321068 - DNA, 13 bp, Homo sapiens
cagggcccagagg

SEQ ID NO: 321069 - DNA, 17 bp, Homo sapiens
cagggcccaggcctgga

SEQ ID NO: 321070 - DNA, 18 bp, Homo sapiens
cagggcccaggcctggag

SEQ ID NO: 321071 - DNA, 16 bp, Homo sapiens
cagggcccccggccac

SEQ ID NO: 321072 - DNA, 21 bp, Homo sapiens
cagggcccctcaccctgcctt

SEQ ID NO: 321073 - DNA, 19 bp, Homo sapiens
cagggcccctccctctgcc

SEQ ID NO: 321074 - DNA, 20 bp, Homo sapiens
cagggcccggcacagagtcg

SEQ ID NO: 321075 - DNA, 19 bp, Homo sapiens
cagggccctgctcaggcct

SEQ ID NO: 321076 - DNA, 20 bp, Homo sapiens
cagggccctgctcaggcctc

SEQ ID NO: 321077 - DNA, 21 bp, Homo sapiens
cagggccctggggtctctgag

SEQ ID NO: 321078 - DNA, 16 bp, Homo sapiens
cagggccgcagggcgc

SEQ ID NO: 321079 - DNA, 20 bp, Homo sapiens
cagggccgcccgggcccaga

SEQ ID NO: 321080 - DNA, 23 bp, Homo sapiens
cagggccgcccgggcccagagga

SEQ ID NO: 321081 - DNA, 12 bp, Homo sapiens
cagggcctggcc

SEQ ID NO: 321082 - DNA, 13 bp, Homo sapiens
cagggcctggcct

SEQ ID NO: 321083 - DNA, 14 bp, Homo sapiens
cagggcctggcctg

SEQ ID NO: 321084 - DNA, 17 bp, Homo sapiens
cagggcctggcctggtc

SEQ ID NO: 321085 - DNA, 12 bp, Homo sapiens
cagggcctgggg

SEQ ID NO: 321086 - DNA, 13 bp, Homo sapiens
cagggcctggggg

SEQ ID NO: 321087 - DNA, 15 bp, Homo sapiens
cagggccttgctaat

SEQ ID NO: 321088 - DNA, 18 bp, Homo sapiens
cagggccttggcccaggg

SEQ ID NO: 321089 - DNA, 14 bp, Homo sapiens
cagggcgctccggc

SEQ ID NO: 321090 - DNA, 17 bp, Homo sapiens
cagggcgctccggcaga

SEQ ID NO: 321091 - DNA, 20 bp, Homo sapiens
cagggcgctccggcagaggc

SEQ ID NO: 321092 - DNA, 22 bp, Homo sapiens
cagggcgctccggcagaggcag

SEQ ID NO: 321093 - DNA, 21 bp, Homo sapiens
cagggcggctaggccggccag

SEQ ID NO: 321094 - DNA, 17 bp, Homo sapiens
cagggctaaggccccca

SEQ ID NO: 321095 - DNA, 16 bp, Homo sapiens
cagggctcagctcctt

SEQ ID NO: 321096 - DNA, 15 bp, Homo sapiens
cagggctcccacaga

SEQ ID NO: 321097 - DNA, 15 bp, Homo sapiens
cagggctcccggaga

SEQ ID NO: 321098 - DNA, 17 bp, Homo sapiens
cagggctcccggagagg

SEQ ID NO: 321099 - DNA, 23 bp, Homo sapiens
cagggctcccggagagggagtca

SEQ ID NO: 321100 - DNA, 16 bp, Homo sapiens
cagggctccctcctgg

SEQ ID NO: 321101 - DNA, 20 bp, Homo sapiens
cagggctccctcctggagca

SEQ ID NO: 321102 - DNA, 15 bp, Homo sapiens
cagggctctggcagg

SEQ ID NO: 321103 - DNA, 18 bp, Homo sapiens
cagggctctggcaggtgg

SEQ ID NO: 321104 - DNA, 18 bp, Homo sapiens
cagggctctttgatggac

SEQ ID NO: 321105 - DNA, 18 bp, Homo sapiens
cagggctgcccctgtagg

SEQ ID NO: 321106 - DNA, 22 bp, Homo sapiens
cagggctggagtgcgctcttgg

SEQ ID NO: 321107 - DNA, 13 bp, Homo sapiens
cagggctggcccg

SEQ ID NO: 321108 - DNA, 22 bp, Homo sapiens
cagggctgggctctgtcttcct

SEQ ID NO: 321109 - DNA, 13 bp, Homo sapiens
cagggctgtcctt

SEQ ID NO: 321110 - DNA, 12 bp, Homo sapiens
cagggctgtggg

SEQ ID NO: 321111 - DNA, 19 bp, Homo sapiens
cagggctgtgggtggggaa

SEQ ID NO: 321112 - DNA, 19 bp, Homo sapiens
cagggcttacctgtacact

SEQ ID NO: 321113 - DNA, 22 bp, Homo sapiens
cagggcttcagatattttgcac

SEQ ID NO: 321114 - DNA, 14 bp, Homo sapiens
caggggacactgaa

SEQ ID NO: 321115 - DNA, 18 bp, Homo sapiens
caggggactcagccctga

SEQ ID NO: 321116 - DNA, 17 bp, Homo sapiens
caggggagccagggtag

SEQ ID NO: 321117 - DNA, 18 bp, Homo sapiens
caggggagccagggtaga

SEQ ID NO: 321118 - DNA, 13 bp, Homo sapiens
caggggagggtcc

SEQ ID NO: 321119 - DNA, 14 bp, Homo sapiens
caggggattgaagc

SEQ ID NO: 321120 - DNA, 20 bp, Homo sapiens
caggggcaaagaactgcccc

SEQ ID NO: 321121 - DNA, 14 bp, Homo sapiens
caggggcagaagga

SEQ ID NO: 321122 - DNA, 14 bp, Homo sapiens
caggggcatctctg

SEQ ID NO: 321123 - DNA, 23 bp, Homo sapiens
caggggcatgtattggcctggag

SEQ ID NO: 321124 - DNA, 12 bp, Homo sapiens
caggggccccag

SEQ ID NO: 321125 - DNA, 16 bp, Homo sapiens
caggggccccagatct

SEQ ID NO: 321126 - DNA, 17 bp, Homo sapiens
caggggccccagatctg

SEQ ID NO: 321127 - DNA, 21 bp, Homo sapiens
caggggccccagatctgcctg

SEQ ID NO: 321128 - DNA, 22 bp, Homo sapiens
caggggccccagatctgcctgg

SEQ ID NO: 321129 - DNA, 22 bp, Homo sapiens
caggggcccctcctctgtgctc

SEQ ID NO: 321130 - DNA, 19 bp, Homo sapiens
caggggcccttgggacagc

SEQ ID NO: 321131 - DNA, 22 bp, Homo sapiens
caggggcccttgggacagccag

SEQ ID NO: 321132 - DNA, 13 bp, Homo sapiens
caggggcggggca

SEQ ID NO: 321133 - DNA, 14 bp, Homo sapiens
caggggcggggcag

SEQ ID NO: 321134 - DNA, 23 bp, Homo sapiens
caggggctatcccttctcagaaa

SEQ ID NO: 321135 - DNA, 21 bp, Homo sapiens
caggggctgcatcctcagccc

SEQ ID NO: 321136 - DNA, 22 bp, Homo sapiens
caggggctgcatcctcagcccc

SEQ ID NO: 321137 - DNA, 23 bp, Homo sapiens
caggggctgcatcctcagcccca

SEQ ID NO: 321138 - DNA, 17 bp, Homo sapiens
caggggctgggcagagg

SEQ ID NO: 321139 - DNA, 15 bp, Homo sapiens
caggggctggtgggc

SEQ ID NO: 321140 - DNA, 20 bp, Homo sapiens
caggggctgtggccgtctcc

SEQ ID NO: 321141 - DNA, 21 bp, Homo sapiens
caggggctttggtggcccctc

SEQ ID NO: 321142 - DNA, 11 bp, Homo sapiens
cagggggccag

SEQ ID NO: 321143 - DNA, 19 bp, Homo sapiens
cagggggccaggtgcacag

SEQ ID NO: 321144 - DNA, 20 bp, Homo sapiens
cagggggcctgcaggcccca

SEQ ID NO: 321145 - DNA, 20 bp, Homo sapiens
caggggggtcggaagcctgt

SEQ ID NO: 321146 - DNA, 21 bp, Homo sapiens
caggggggtcggaagcctgtc

SEQ ID NO: 321147 - DNA, 13 bp, Homo sapiens
caggggggttggg

SEQ ID NO: 321148 - DNA, 22 bp, Homo sapiens
caggggggttgggttccagaca

SEQ ID NO: 321149 - DNA, 16 bp, Homo sapiens
caggggtcaccttgag

SEQ ID NO: 321150 - DNA, 18 bp, Homo sapiens
caggggtcccagccaccc

SEQ ID NO: 321151 - DNA, 20 bp, Homo sapiens
caggggtcccagccaccccg

SEQ ID NO: 321152 - DNA, 16 bp, Homo sapiens
caggggtcccccctca

SEQ ID NO: 321153 - DNA, 16 bp, Homo sapiens
caggggtctccctgag

SEQ ID NO: 321154 - DNA, 17 bp, Homo sapiens
caggggtctccctgagc

SEQ ID NO: 321155 - DNA, 18 bp, Homo sapiens
caggggtctccctgagcc

SEQ ID NO: 321156 - DNA, 12 bp, Homo sapiens
caggggtgggag

SEQ ID NO: 321157 - DNA, 17 bp, Homo sapiens
caggggtgggaggctcc

SEQ ID NO: 321158 - DNA, 13 bp, Homo sapiens
caggggttgcagt

SEQ ID NO: 321159 - DNA, 23 bp, Homo sapiens
cagggtagaattgtttggcaatg

SEQ ID NO: 321160 - DNA, 23 bp, Homo sapiens
cagggtagacttggagctgtcct

SEQ ID NO: 321161 - DNA, 17 bp, Homo sapiens
cagggtagagcaaagga

SEQ ID NO: 321162 - DNA, 18 bp, Homo sapiens
cagggtagggggcctgag

SEQ ID NO: 321163 - DNA, 17 bp, Homo sapiens
cagggtatcccagaccc

SEQ ID NO: 321164 - DNA, 18 bp, Homo sapiens
cagggtccgcaccagctg

SEQ ID NO: 321165 - DNA, 19 bp, Homo sapiens
cagggtccgcaccagctgc

SEQ ID NO: 321166 - DNA, 21 bp, Homo sapiens
cagggtccgcaccagctgctc

SEQ ID NO: 321167 - DNA, 22 bp, Homo sapiens
cagggtccgcaccagctgctct

SEQ ID NO: 321168 - DNA, 12 bp, Homo sapiens
cagggtcctgct

SEQ ID NO: 321169 - DNA, 13 bp, Homo sapiens
cagggtcctgcta

SEQ ID NO: 321170 - DNA, 14 bp, Homo sapiens
cagggtcctgctat

SEQ ID NO: 321171 - DNA, 20 bp, Homo sapiens
cagggtcctgctatttccca

SEQ ID NO: 321172 - DNA, 13 bp, Homo sapiens
cagggtctgctct

SEQ ID NO: 321173 - DNA, 17 bp, Homo sapiens
cagggtctgctctttct

SEQ ID NO: 321174 - DNA, 17 bp, Homo sapiens
cagggtcttccctacct

SEQ ID NO: 321175 - DNA, 15 bp, Homo sapiens
cagggtcttgggcta

SEQ ID NO: 321176 - DNA, 17 bp, Homo sapiens
cagggtcttgggctact

SEQ ID NO: 321177 - DNA, 19 bp, Homo sapiens
cagggtcttgggctactgg

SEQ ID NO: 321178 - DNA, 20 bp, Homo sapiens
cagggtcttgggctactggc

SEQ ID NO: 321179 - DNA, 21 bp, Homo sapiens
cagggtcttgggctactggca

SEQ ID NO: 321180 - DNA, 13 bp, Homo sapiens
ctgccaagcctgg

SEQ ID NO: 321181 - DNA, 15 bp, Homo sapiens
ctgccaagtcctgcc

SEQ ID NO: 321182 - DNA, 15 bp, Homo sapiens
ctgccaatgccacag

SEQ ID NO: 321183 - DNA, 16 bp, Homo sapiens
ctgccaatgccacagc

SEQ ID NO: 321184 - DNA, 15 bp, Homo sapiens
ctgccacaatgtgat

SEQ ID NO: 321185 - DNA, 18 bp, Homo sapiens
ctgccacaatgtgatatg

SEQ ID NO: 321186 - DNA, 22 bp, Homo sapiens
ctgccacacgtctgaccctctc

SEQ ID NO: 321187 - DNA, 23 bp, Homo sapiens
ctgccacactcagtcccccacca

SEQ ID NO: 321188 - DNA, 16 bp, Homo sapiens
ctgccacactctgacg

SEQ ID NO: 321189 - DNA, 17 bp, Homo sapiens
ctgccaccaaatctgtc

SEQ ID NO: 321190 - DNA, 14 bp, Homo sapiens
ctgccaccacgtct

SEQ ID NO: 321191 - DNA, 16 bp, Homo sapiens
ctgccaccacgtctgc

SEQ ID NO: 321192 - DNA, 17 bp, Homo sapiens
ctgccaccacgtctgcc

SEQ ID NO: 321193 - DNA, 14 bp, Homo sapiens
ctgccacccactca

SEQ ID NO: 321194 - DNA, 12 bp, Homo sapiens
ctgccacctccc

SEQ ID NO: 321195 - DNA, 15 bp, Homo sapiens
ctgccacctccctga

SEQ ID NO: 321196 - DNA, 19 bp, Homo sapiens
ctgccacctcctgcctcag

SEQ ID NO: 321197 - DNA, 12 bp, Homo sapiens
ctgccacctgtc

SEQ ID NO: 321198 - DNA, 15 bp, Homo sapiens
ctgccacctgtctgt

SEQ ID NO: 321199 - DNA, 18 bp, Homo sapiens
ctgccacctgtctgtctg

SEQ ID NO: 321200 - DNA, 15 bp, Homo sapiens
ctgccactaggctgg

SEQ ID NO: 321201 - DNA, 16 bp, Homo sapiens
ctgccactaggctggg

SEQ ID NO: 321202 - DNA, 16 bp, Homo sapiens
ctgccactctctggga

SEQ ID NO: 321203 - DNA, 18 bp, Homo sapiens
ctgccactctctgggact

SEQ ID NO: 321204 - DNA, 19 bp, Homo sapiens
ctgccactctctgggactc

SEQ ID NO: 321205 - DNA, 21 bp, Homo sapiens
ctgccactctctgggactctc

SEQ ID NO: 321206 - DNA, 11 bp, Homo sapiens
ctgccagagaa

SEQ ID NO: 321207 - DNA, 15 bp, Homo sapiens
ctgccagcgcatgtg

SEQ ID NO: 321208 - DNA, 19 bp, Homo sapiens
ctgccagcgcatgtgtcct

SEQ ID NO: 321209 - DNA, 20 bp, Homo sapiens
ctgccagcgcatgtgtcctt

SEQ ID NO: 321210 - DNA, 14 bp, Homo sapiens
ctgccagctccaca

SEQ ID NO: 321211 - DNA, 15 bp, Homo sapiens
ctgccagctccacag

SEQ ID NO: 321212 - DNA, 18 bp, Homo sapiens
ctgccagctccacagggt

SEQ ID NO: 321213 - DNA, 13 bp, Homo sapiens
ctgccagctgcct

SEQ ID NO: 321214 - DNA, 19 bp, Homo sapiens
ctgccagctgccttcctca

SEQ ID NO: 321215 - DNA, 17 bp, Homo sapiens
ctgccaggagcagcctc

SEQ ID NO: 321216 - DNA, 15 bp, Homo sapiens
ctgccaggattttgt

SEQ ID NO: 321217 - DNA, 13 bp, Homo sapiens
ctgccaggcacct

SEQ ID NO: 321218 - DNA, 23 bp, Homo sapiens
ctgccaggcacctggcctgctgg

SEQ ID NO: 321219 - DNA, 13 bp, Homo sapiens
ctgccaggcccat

SEQ ID NO: 321220 - DNA, 18 bp, Homo sapiens
ctgccaggcccatctcag

SEQ ID NO: 321221 - DNA, 20 bp, Homo sapiens
ctgccaggcccatctcaggt

SEQ ID NO: 321222 - DNA, 19 bp, Homo sapiens
ctgccaggcgttggtgcca

SEQ ID NO: 321223 - DNA, 22 bp, Homo sapiens
ctgccaggcgttggtgccactt

SEQ ID NO: 321224 - DNA, 18 bp, Homo sapiens
ctgccaggctcctctccc

SEQ ID NO: 321225 - DNA, 17 bp, Homo sapiens
ctgccaggctctccctc

SEQ ID NO: 321226 - DNA, 21 bp, Homo sapiens
ctgccaggctctccctctctg

SEQ ID NO: 321227 - DNA, 22 bp, Homo sapiens
ctgccaggctctccctctctgc

SEQ ID NO: 321228 - DNA, 22 bp, Homo sapiens
ctgccaggctgtcagcgcctca

SEQ ID NO: 321229 - DNA, 12 bp, Homo sapiens
ctgccagggagc

SEQ ID NO: 321230 - DNA, 12 bp, Homo sapiens
ctgccagggcag

SEQ ID NO: 321231 - DNA, 13 bp, Homo sapiens
ctgccagggcagt

SEQ ID NO: 321232 - DNA, 15 bp, Homo sapiens
ctgccagggcagtgc

SEQ ID NO: 321233 - DNA, 17 bp, Homo sapiens
ctgccagggcccgacct

SEQ ID NO: 321234 - DNA, 20 bp, Homo sapiens
ctgccagggcccgacctggg

SEQ ID NO: 321235 - DNA, 17 bp, Homo sapiens
ctgccagtccccctgcc

SEQ ID NO: 321236 - DNA, 12 bp, Homo sapiens
ctgccagtgaca

SEQ ID NO: 321237 - DNA, 22 bp, Homo sapiens
ctgccagtggggtcgtgaggca

SEQ ID NO: 321238 - DNA, 15 bp, Homo sapiens
ctgccatcagcccct

SEQ ID NO: 321239 - DNA, 16 bp, Homo sapiens
ctgccatcagcccctg

SEQ ID NO: 321240 - DNA, 19 bp, Homo sapiens
ctgccatcagcccctgctg

SEQ ID NO: 321241 - DNA, 24 bp, Homo sapiens
ctgccatcagcccctgctgctcct

SEQ ID NO: 321242 - DNA, 17 bp, Homo sapiens
ctgccatccagggatgc

SEQ ID NO: 321243 - DNA, 15 bp, Homo sapiens
ctgccatgatagctg

SEQ ID NO: 321244 - DNA, 18 bp, Homo sapiens
ctgccatgattttggcca

SEQ ID NO: 321245 - DNA, 13 bp, Homo sapiens
ctgccatgccact

SEQ ID NO: 321246 - DNA, 14 bp, Homo sapiens
ctgccatgccactg

SEQ ID NO: 321247 - DNA, 17 bp, Homo sapiens
ctgccatgccactgcca

SEQ ID NO: 321248 - DNA, 18 bp, Homo sapiens
ctgccatgccactgccag

SEQ ID NO: 321249 - DNA, 20 bp, Homo sapiens
ctgccatgccactgccaggc

SEQ ID NO: 321250 - DNA, 22 bp, Homo sapiens
ctgccatgccactgccaggcac

SEQ ID NO: 321251 - DNA, 17 bp, Homo sapiens
ctgccatggaggcacac

SEQ ID NO: 321252 - DNA, 20 bp, Homo sapiens
ctgccatggaggcacacagc

SEQ ID NO: 321253 - DNA, 14 bp, Homo sapiens
ctgccatgtggcag

SEQ ID NO: 321254 - DNA, 21 bp, Homo sapiens
ctgccattagactgaatttaa

SEQ ID NO: 321255 - DNA, 21 bp, Homo sapiens
ctgccatttcccttctggaca

SEQ ID NO: 321256 - DNA, 17 bp, Homo sapiens
ctgcccaacctgctctc

SEQ ID NO: 321257 - DNA, 19 bp, Homo sapiens
ctgcccaacctgctctcct

SEQ ID NO: 321258 - DNA, 19 bp, Homo sapiens
ctgcccaactttcattggt

SEQ ID NO: 321259 - DNA, 21 bp, Homo sapiens
ctgcccaagggcctcccacca

SEQ ID NO: 321260 - DNA, 16 bp, Homo sapiens
ctgcccaatgctttgg

SEQ ID NO: 321261 - DNA, 15 bp, Homo sapiens
ctgcccacaagccat

SEQ ID NO: 321262 - DNA, 12 bp, Homo sapiens
ctgcccaccctg

SEQ ID NO: 321263 - DNA, 16 bp, Homo sapiens
ctgcccaccgaccccc

SEQ ID NO: 321264 - DNA, 23 bp, Homo sapiens
ctgcccaccgaccccctttctaa

SEQ ID NO: 321265 - DNA, 12 bp, Homo sapiens
ctgcccacggcc

SEQ ID NO: 321266 - DNA, 23 bp, Homo sapiens
ctgcccacttagccgtccatggc

SEQ ID NO: 321267 - DNA, 23 bp, Homo sapiens
ctgcccagacccctctggccagg

SEQ ID NO: 321268 - DNA, 18 bp, Homo sapiens
ctgcccagatcccagaag

SEQ ID NO: 321269 - DNA, 17 bp, Homo sapiens
ctgcccagcctccaagc

SEQ ID NO: 321270 - DNA, 13 bp, Homo sapiens
ctgcccagcttgg

SEQ ID NO: 321271 - DNA, 23 bp, Homo sapiens
ctgcccagcttgggcccagctgg

SEQ ID NO: 321272 - DNA, 20 bp, Homo sapiens
ctgcccaggcagtctttgct

SEQ ID NO: 321273 - DNA, 22 bp, Homo sapiens
ctgcccaggcagtctttgctca

SEQ ID NO: 321274 - DNA, 12 bp, Homo sapiens
ctgcccaggctc

SEQ ID NO: 321275 - DNA, 15 bp, Homo sapiens
ctgcccaggctctgc

SEQ ID NO: 321276 - DNA, 18 bp, Homo sapiens
ctgcccaggctctgctga

SEQ ID NO: 321277 - DNA, 20 bp, Homo sapiens
ctgcccagtgttgtttgtaa

SEQ ID NO: 321278 - DNA, 22 bp, Homo sapiens
ctgcccagtgttgtttgtaaat

SEQ ID NO: 321279 - DNA, 19 bp, Homo sapiens
ctgccccaaaattataaac

SEQ ID NO: 321280 - DNA, 12 bp, Homo sapiens
ctgccccaagca

SEQ ID NO: 321281 - DNA, 16 bp, Homo sapiens
ctgccccaagcagcca

SEQ ID NO: 321282 - DNA, 17 bp, Homo sapiens
ctgccccaagcagccag

SEQ ID NO: 321283 - DNA, 16 bp, Homo sapiens
ctgccccacacaggcc

SEQ ID NO: 321284 - DNA, 17 bp, Homo sapiens
ctgccccacacaggcct

SEQ ID NO: 321285 - DNA, 18 bp, Homo sapiens
ctgccccacacaggcctg

SEQ ID NO: 321286 - DNA, 20 bp, Homo sapiens
ctgccccacacaggcctggc

SEQ ID NO: 321287 - DNA, 21 bp, Homo sapiens
ctgccccacacaggcctggcc

SEQ ID NO: 321288 - DNA, 22 bp, Homo sapiens
ctgccccacacaggcctggccc

SEQ ID NO: 321289 - DNA, 17 bp, Homo sapiens
ctgccccacacggactc

SEQ ID NO: 321290 - DNA, 14 bp, Homo sapiens
ctgccccacaggcc

SEQ ID NO: 321291 - DNA, 21 bp, Homo sapiens
ctgccccacaggccacacgct

SEQ ID NO: 321292 - DNA, 12 bp, Homo sapiens
ctgccccagaga

SEQ ID NO: 321293 - DNA, 15 bp, Homo sapiens
ctgccccagagaagc

SEQ ID NO: 321294 - DNA, 19 bp, Homo sapiens
ctgccccagagaagcctca

SEQ ID NO: 321295 - DNA, 21 bp, Homo sapiens
ctgccccagagaagcctcagt

SEQ ID NO: 321296 - DNA, 23 bp, Homo sapiens
ctgccccagagaagcctcagtcc

SEQ ID NO: 321297 - DNA, 12 bp, Homo sapiens
ctgccccaggcc

SEQ ID NO: 321298 - DNA, 13 bp, Homo sapiens
ctgccccaggcct

SEQ ID NO: 321299 - DNA, 14 bp, Homo sapiens
ctgccccaggcctg

SEQ ID NO: 321300 - DNA, 16 bp, Homo sapiens
ctgccccatctcctcc

SEQ ID NO: 321301 - DNA, 23 bp, Homo sapiens
ctgcccccactgtccccctaccc

SEQ ID NO: 321302 - DNA, 19 bp, Homo sapiens
ctgcccccagaaagcctcc

SEQ ID NO: 321303 - DNA, 21 bp, Homo sapiens
ctgcccccagaaagcctcctg

SEQ ID NO: 321304 - DNA, 13 bp, Homo sapiens
ctgccccccttcc

SEQ ID NO: 321305 - DNA, 22 bp, Homo sapiens
ctgccccccttcccacccctat

SEQ ID NO: 321306 - DNA, 16 bp, Homo sapiens
ctgcccccgccctgct

SEQ ID NO: 321307 - DNA, 17 bp, Homo sapiens
ctgcccccgctcatggg

SEQ ID NO: 321308 - DNA, 19 bp, Homo sapiens
ctgcccccgctctgccatc

SEQ ID NO: 321309 - DNA, 16 bp, Homo sapiens
ctgcccccgtcccacc

SEQ ID NO: 321310 - DNA, 18 bp, Homo sapiens
ctgcccccgttccagctg

SEQ ID NO: 321311 - DNA, 19 bp, Homo sapiens
ctgcccccgttccagctga

SEQ ID NO: 321312 - DNA, 13 bp, Homo sapiens
ctgccccctcagg

SEQ ID NO: 321313 - DNA, 17 bp, Homo sapiens
ctgccccctcccccgca

SEQ ID NO: 321314 - DNA, 15 bp, Homo sapiens
ctcttttttagctct

SEQ ID NO: 321315 - DNA, 17 bp, Homo sapiens
ctgaaaaatctagacat

SEQ ID NO: 321316 - DNA, 20 bp, Homo sapiens
ctgaaaacataaaaagttaa

SEQ ID NO: 321317 - DNA, 12 bp, Homo sapiens
ctgaaaaccagt

SEQ ID NO: 321318 - DNA, 22 bp, Homo sapiens
ctgaaaaccagtcttctccctg

SEQ ID NO: 321319 - DNA, 18 bp, Homo sapiens
ctgaaaaccatctggcct

SEQ ID NO: 321320 - DNA, 20 bp, Homo sapiens
ctgaaaaccatctggcctgg

SEQ ID NO: 321321 - DNA, 21 bp, Homo sapiens
ctgaaaaccatctggcctggc

SEQ ID NO: 321322 - DNA, 22 bp, Homo sapiens
ctgaaaaccatctggcctggcc

SEQ ID NO: 321323 - DNA, 14 bp, Homo sapiens
ctgaaaactgtaaa

SEQ ID NO: 321324 - DNA, 20 bp, Homo sapiens
ctgaaaactgtaaatacaaa

SEQ ID NO: 321325 - DNA, 12 bp, Homo sapiens
ctgaaaatcact

SEQ ID NO: 321326 - DNA, 12 bp, Homo sapiens
ctgaaaatggtg

SEQ ID NO: 321327 - DNA, 21 bp, Homo sapiens
ctgaaaatgttgttatgctat

SEQ ID NO: 321328 - DNA, 13 bp, Homo sapiens
ctgaaacaggaga

SEQ ID NO: 321329 - DNA, 14 bp, Homo sapiens
ctgaaacaggagag

SEQ ID NO: 321330 - DNA, 20 bp, Homo sapiens
ctgaaacattccgaagaggg

SEQ ID NO: 321331 - DNA, 17 bp, Homo sapiens
ctgaaacttacacacaa

SEQ ID NO: 321332 - DNA, 23 bp, Homo sapiens
ctgaaacttcccaacttccctgt

SEQ ID NO: 321333 - DNA, 16 bp, Homo sapiens
ctgaaagaaacagtta

SEQ ID NO: 321334 - DNA, 20 bp, Homo sapiens
ctgaaagaagaacagctgtt

SEQ ID NO: 321335 - DNA, 14 bp, Homo sapiens
ctgaaagaggccaa

SEQ ID NO: 321336 - DNA, 13 bp, Homo sapiens
ctgaaagcagcag

SEQ ID NO: 321337 - DNA, 15 bp, Homo sapiens
ctgaaagcagcagct

SEQ ID NO: 321338 - DNA, 17 bp, Homo sapiens
ctgaaagcagcagctag

SEQ ID NO: 321339 - DNA, 13 bp, Homo sapiens
ctgaaagcctgtc

SEQ ID NO: 321340 - DNA, 14 bp, Homo sapiens
ctgaaagcctgtct

SEQ ID NO: 321341 - DNA, 16 bp, Homo sapiens
ctgaaagcctgtctct

SEQ ID NO: 321342 - DNA, 18 bp, Homo sapiens
ctgaaagcctgtctcttt

SEQ ID NO: 321343 - DNA, 21 bp, Homo sapiens
ctgaaagcctgtctctttcca

SEQ ID NO: 321344 - DNA, 22 bp, Homo sapiens
ctgaaagcctgtctctttccac

SEQ ID NO: 321345 - DNA, 15 bp, Homo sapiens
ctgaaagctgcttct

SEQ ID NO: 321346 - DNA, 11 bp, Homo sapiens
ctgaaaggaaa

SEQ ID NO: 321347 - DNA, 15 bp, Homo sapiens
ctgaaagggagcccc

SEQ ID NO: 321348 - DNA, 14 bp, Homo sapiens
ctgaaagtgtttta

SEQ ID NO: 321349 - DNA, 12 bp, Homo sapiens
ctgaaataaact

SEQ ID NO: 321350 - DNA, 22 bp, Homo sapiens
ctgaaatgaaacaaataatcac

SEQ ID NO: 321351 - DNA, 14 bp, Homo sapiens
ctgaaatggcttct

SEQ ID NO: 321352 - DNA, 15 bp, Homo sapiens
ctgaaatggcttcta

SEQ ID NO: 321353 - DNA, 22 bp, Homo sapiens
ctgaaatggcttctatgatcag

SEQ ID NO: 321354 - DNA, 15 bp, Homo sapiens
ctgaaatgtttccag

SEQ ID NO: 321355 - DNA, 11 bp, Homo sapiens
ctgaaattatg

SEQ ID NO: 321356 - DNA, 17 bp, Homo sapiens
ctgaaattatgtcaaat

SEQ ID NO: 321357 - DNA, 12 bp, Homo sapiens
ctgaaatttccc

SEQ ID NO: 321358 - DNA, 21 bp, Homo sapiens
ctgaaatttgttatacttcaa

SEQ ID NO: 321359 - DNA, 22 bp, Homo sapiens
ctgaaatttgttatacttcaaa

SEQ ID NO: 321360 - DNA, 16 bp, Homo sapiens
ctgaacaaaaaataaa

SEQ ID NO: 321361 - DNA, 12 bp, Homo sapiens
ctgaacaagaaa

SEQ ID NO: 321362 - DNA, 14 bp, Homo sapiens
ctgaacaagaaaga

SEQ ID NO: 321363 - DNA, 17 bp, Homo sapiens
ctgaacacatactagaa

SEQ ID NO: 321364 - DNA, 19 bp, Homo sapiens
ctgaacacatactagaaag

SEQ ID NO: 321365 - DNA, 16 bp, Homo sapiens
ctgaacacttattgct

SEQ ID NO: 321366 - DNA, 22 bp, Homo sapiens
ctgaacacttattgctttgaaa

SEQ ID NO: 321367 - DNA, 18 bp, Homo sapiens
ctgaacatcctaaatatt

SEQ ID NO: 321368 - DNA, 22 bp, Homo sapiens
ctgaacatgagtgtcaactcca

SEQ ID NO: 321369 - DNA, 18 bp, Homo sapiens
ctgaaccccatgggcttg

SEQ ID NO: 321370 - DNA, 19 bp, Homo sapiens
ctgaactccatacagcctc

SEQ ID NO: 321371 - DNA, 18 bp, Homo sapiens
ctgaactctcaaaagtct

SEQ ID NO: 321372 - DNA, 16 bp, Homo sapiens
ctgaactgctgctggt

SEQ ID NO: 321373 - DNA, 21 bp, Homo sapiens
ctgaactggccgctgggagaa

SEQ ID NO: 321374 - DNA, 13 bp, Homo sapiens
ctgaactgtgcat

SEQ ID NO: 321375 - DNA, 13 bp, Homo sapiens
ctgaacttcagct

SEQ ID NO: 321376 - DNA, 14 bp, Homo sapiens
ctgaactttggaag

SEQ ID NO: 321377 - DNA, 20 bp, Homo sapiens
ctgaagaagaccagtcacag

SEQ ID NO: 321378 - DNA, 23 bp, Homo sapiens
ctgaagaagaccagtcacagcca

SEQ ID NO: 321379 - DNA, 19 bp, Homo sapiens
ctgaagaattgaaaaacca

SEQ ID NO: 321380 - DNA, 16 bp, Homo sapiens
ctgaagacctccacat

SEQ ID NO: 321381 - DNA, 20 bp, Homo sapiens
ctgaagagcgctcctctgcc

SEQ ID NO: 321382 - DNA, 16 bp, Homo sapiens
ctgaagatgatcattt

SEQ ID NO: 321383 - DNA, 17 bp, Homo sapiens
ctgaagatgatcatttg

SEQ ID NO: 321384 - DNA, 13 bp, Homo sapiens
ctgaagcatgttt

SEQ ID NO: 321385 - DNA, 13 bp, Homo sapiens
ctgaagcctctgc

SEQ ID NO: 321386 - DNA, 21 bp, Homo sapiens
ctgaagcctctgccctgcctc

SEQ ID NO: 321387 - DNA, 23 bp, Homo sapiens
ctgaagcctctgccctgcctccc

SEQ ID NO: 321388 - DNA, 16 bp, Homo sapiens
ctgaagcgaacatctt

SEQ ID NO: 321389 - DNA, 17 bp, Homo sapiens
ctgaagcgaacatcttc

SEQ ID NO: 321390 - DNA, 19 bp, Homo sapiens
ctgaagcgaacatcttcat

SEQ ID NO: 321391 - DNA, 23 bp, Homo sapiens
ctgaagcgaacatcttcatataa

SEQ ID NO: 321392 - DNA, 12 bp, Homo sapiens
ctgaagcttatt

SEQ ID NO: 321393 - DNA, 16 bp, Homo sapiens
ctgaagcttattaatg

SEQ ID NO: 321394 - DNA, 17 bp, Homo sapiens
ctgaagcttattaatgc

SEQ ID NO: 321395 - DNA, 18 bp, Homo sapiens
ctgaagcttattaatgct

SEQ ID NO: 321396 - DNA, 17 bp, Homo sapiens
ctgaaggaatagccaga

SEQ ID NO: 321397 - DNA, 18 bp, Homo sapiens
ctgaaggacccttcagag

SEQ ID NO: 321398 - DNA, 12 bp, Homo sapiens
ctgaaggactgg

SEQ ID NO: 321399 - DNA, 13 bp, Homo sapiens
ctgaaggactgga

SEQ ID NO: 321400 - DNA, 14 bp, Homo sapiens
ctgaaggagaggag

SEQ ID NO: 321401 - DNA, 23 bp, Homo sapiens
ctgaaggcaaatctcctttgtcc

SEQ ID NO: 321402 - DNA, 17 bp, Homo sapiens
ctgaaggcaacctggaa

SEQ ID NO: 321403 - DNA, 13 bp, Homo sapiens
ctgaaggctttca

SEQ ID NO: 321404 - DNA, 21 bp, Homo sapiens
ctgaaggggcacaccactgcc

SEQ ID NO: 321405 - DNA, 21 bp, Homo sapiens
ctgaaggttggaactgctgcc

SEQ ID NO: 321406 - DNA, 16 bp, Homo sapiens
ctgaagtcaaacctta

SEQ ID NO: 321407 - DNA, 15 bp, Homo sapiens
ctgaagtcactgcac

SEQ ID NO: 321408 - DNA, 15 bp, Homo sapiens
ctgaagtcccttcct

SEQ ID NO: 321409 - DNA, 18 bp, Homo sapiens
ctgaagtcccttcctgtc

SEQ ID NO: 321410 - DNA, 21 bp, Homo sapiens
ctgaagtcccttcctgtcctg

SEQ ID NO: 321411 - DNA, 16 bp, Homo sapiens
ctgaagtctctttttc

SEQ ID NO: 321412 - DNA, 15 bp, Homo sapiens
ctgaagtttcattta

SEQ ID NO: 321413 - DNA, 17 bp, Homo sapiens
ctgaagtttcatttatg

SEQ ID NO: 321414 - DNA, 15 bp, Homo sapiens
ctgaataacaacaat

SEQ ID NO: 321415 - DNA, 13 bp, Homo sapiens
ctgaataatttct

SEQ ID NO: 321416 - DNA, 16 bp, Homo sapiens
ctgaatacttgaagta

SEQ ID NO: 321417 - DNA, 15 bp, Homo sapiens
ctgaatatctgttca

SEQ ID NO: 321418 - DNA, 19 bp, Homo sapiens
ctgaatatctgttcacttt

SEQ ID NO: 321419 - DNA, 16 bp, Homo sapiens
ctgaatatttatattt

SEQ ID NO: 321420 - DNA, 21 bp, Homo sapiens
ctgaatatttatatttcacta

SEQ ID NO: 321421 - DNA, 19 bp, Homo sapiens
ctgaatcgagtgagacaaa

SEQ ID NO: 321422 - DNA, 15 bp, Homo sapiens
ctgaatcgtttcatg

SEQ ID NO: 321423 - DNA, 18 bp, Homo sapiens
ctgaatctctcaaaatgt

SEQ ID NO: 321424 - DNA, 19 bp, Homo sapiens
ctgaatctctcaaaatgtg

SEQ ID NO: 321425 - DNA, 21 bp, Homo sapiens
ctgaatctctcaaaatgtgcc

SEQ ID NO: 321426 - DNA, 16 bp, Homo sapiens
ctgaatgctgctactt

SEQ ID NO: 321427 - DNA, 20 bp, Homo sapiens
ctgaatgcttctgagagcaa

SEQ ID NO: 321428 - DNA, 20 bp, Homo sapiens
ctgaatgtcattatttgata

SEQ ID NO: 321429 - DNA, 12 bp, Homo sapiens
ctgaatgttctg

SEQ ID NO: 321430 - DNA, 22 bp, Homo sapiens
ctgaatgttctgacattaacag

SEQ ID NO: 321431 - DNA, 23 bp, Homo sapiens
ctgaattcctttacaactaaata

SEQ ID NO: 321432 - DNA, 16 bp, Homo sapiens
ctgaattctatttgct

SEQ ID NO: 321433 - DNA, 14 bp, Homo sapiens
ctgaatttctttga

SEQ ID NO: 321434 - DNA, 21 bp, Homo sapiens
ctgaatttctttgatttaact

SEQ ID NO: 321435 - DNA, 19 bp, Homo sapiens
ctgaatttgggcctcttgt

SEQ ID NO: 321436 - DNA, 23 bp, Homo sapiens
ctgacaaaaaggtgctacggtag

SEQ ID NO: 321437 - DNA, 21 bp, Homo sapiens
ctgacaaatattttagaagct

SEQ ID NO: 321438 - DNA, 22 bp, Homo sapiens
ctgacaaccaccgctccccagc

SEQ ID NO: 321439 - DNA, 20 bp, Homo sapiens
ctgacaactgtttaattgaa

SEQ ID NO: 321440 - DNA, 22 bp, Homo sapiens
ctgacaagtgaagttgtaaaca

SEQ ID NO: 321441 - DNA, 14 bp, Homo sapiens
ctgacacaggggac

SEQ ID NO: 321442 - DNA, 20 bp, Homo sapiens
ctgacacaggggacactgaa

SEQ ID NO: 321443 - DNA, 17 bp, Homo sapiens
ctgacacgtccacccca

SEQ ID NO: 321444 - DNA, 17 bp, Homo sapiens
ccttttttgtcccccaa

SEQ ID NO: 321445 - DNA, 23 bp, Homo sapiens
ccttttttgtcccccaacttgag

SEQ ID NO: 321446 - DNA, 21 bp, Homo sapiens
ccttttttttttttttcagtt

SEQ ID NO: 321447 - DNA, 17 bp, Homo sapiens
cgaaacacagaactcag

SEQ ID NO: 321448 - DNA, 16 bp, Homo sapiens
cgaaccaaggcagcct

SEQ ID NO: 321449 - DNA, 18 bp, Homo sapiens
cgaacccacactgcaaca

SEQ ID NO: 321450 - DNA, 19 bp, Homo sapiens
cgaactcctgacatcaggt

SEQ ID NO: 321451 - DNA, 12 bp, Homo sapiens
cgaactcctggg

SEQ ID NO: 321452 - DNA, 16 bp, Homo sapiens
cgaactcctgggctca

SEQ ID NO: 321453 - DNA, 12 bp, Homo sapiens
cgaactgtgcag

SEQ ID NO: 321454 - DNA, 22 bp, Homo sapiens
cgaactgtgcagttacgttgca

SEQ ID NO: 321455 - DNA, 19 bp, Homo sapiens
cgaagaaaaaaaataacac

SEQ ID NO: 321456 - DNA, 14 bp, Homo sapiens
cgaagaaacaaaaa

SEQ ID NO: 321457 - DNA, 22 bp, Homo sapiens
cgaagaccttctgaagatctca

SEQ ID NO: 321458 - DNA, 22 bp, Homo sapiens
cgaagagggaatggatggggag

SEQ ID NO: 321459 - DNA, 20 bp, Homo sapiens
cgaagccatcacttctcccc

SEQ ID NO: 321460 - DNA, 16 bp, Homo sapiens
cgaagctcagcccacc

SEQ ID NO: 321461 - DNA, 12 bp, Homo sapiens
cgaaggcctctg

SEQ ID NO: 321462 - DNA, 14 bp, Homo sapiens
cgaagtcttccatc

SEQ ID NO: 321463 - DNA, 22 bp, Homo sapiens
cgaataaggtaccaagatcaca

SEQ ID NO: 321464 - DNA, 19 bp, Homo sapiens
cgaatataagcttaaaata

SEQ ID NO: 321465 - DNA, 19 bp, Homo sapiens
cgaatcccctccctgtcaa

SEQ ID NO: 321466 - DNA, 20 bp, Homo sapiens
cgaatgagctgggccctggg

SEQ ID NO: 321467 - DNA, 11 bp, Homo sapiens
cgaatggacca

SEQ ID NO: 321468 - DNA, 17 bp, Homo sapiens
cgaatggagtccagacc

SEQ ID NO: 321469 - DNA, 14 bp, Homo sapiens
cgaattaatagctt

SEQ ID NO: 321470 - DNA, 23 bp, Homo sapiens
cgaattctcagacgacacctgga

SEQ ID NO: 321471 - DNA, 15 bp, Homo sapiens
cgacaaccgatgctc

SEQ ID NO: 321472 - DNA, 17 bp, Homo sapiens
cgacaccagccctgctg

SEQ ID NO: 321473 - DNA, 13 bp, Homo sapiens
cgacactgctgca

SEQ ID NO: 321474 - DNA, 18 bp, Homo sapiens
cgacatagtatggaagta

SEQ ID NO: 321475 - DNA, 19 bp, Homo sapiens
cgacatggacccggagcta

SEQ ID NO: 321476 - DNA, 19 bp, Homo sapiens
cgaccgaggctggagctgg

SEQ ID NO: 321477 - DNA, 16 bp, Homo sapiens
cgaccgcctgcttcac

SEQ ID NO: 321478 - DNA, 20 bp, Homo sapiens
cgaccgcctgcttcacaccc

SEQ ID NO: 321479 - DNA, 23 bp, Homo sapiens
cgacgccacagcccagccacgga

SEQ ID NO: 321480 - DNA, 22 bp, Homo sapiens
cgacggtgggcatttgtgaggc

SEQ ID NO: 321481 - DNA, 19 bp, Homo sapiens
cgacggtttcaaaccagga

SEQ ID NO: 321482 - DNA, 14 bp, Homo sapiens
cgactactttgcta

SEQ ID NO: 321483 - DNA, 13 bp, Homo sapiens
cgactagcaggca

SEQ ID NO: 321484 - DNA, 17 bp, Homo sapiens
cgactagcaggcatgcc

SEQ ID NO: 321485 - DNA, 13 bp, Homo sapiens
cgactctgctgct

SEQ ID NO: 321486 - DNA, 19 bp, Homo sapiens
cgactgtcatgtggcttgg

SEQ ID NO: 321487 - DNA, 19 bp, Homo sapiens
cgactgtgacctgtgggga

SEQ ID NO: 321488 - DNA, 19 bp, Homo sapiens
cgacttatatatttgaaag

SEQ ID NO: 321489 - DNA, 21 bp, Homo sapiens
cgagaattgcttgaacccggg

SEQ ID NO: 321490 - DNA, 13 bp, Homo sapiens
cgagacaccctaa

SEQ ID NO: 321491 - DNA, 15 bp, Homo sapiens
cgagaccatcctggc

SEQ ID NO: 321492 - DNA, 19 bp, Homo sapiens
cgagaccatcctggcccct

SEQ ID NO: 321493 - DNA, 21 bp, Homo sapiens
cgagaccatcctggcccctcc

SEQ ID NO: 321494 - DNA, 17 bp, Homo sapiens
cgagactgagaggcaga

SEQ ID NO: 321495 - DNA, 12 bp, Homo sapiens
cgagagaggcgc

SEQ ID NO: 321496 - DNA, 22 bp, Homo sapiens
cgagagctcttagtttttaaaa

SEQ ID NO: 321497 - DNA, 15 bp, Homo sapiens
cgagagggctgagcc

SEQ ID NO: 321498 - DNA, 20 bp, Homo sapiens
cgagatgtgacccaccagtg

SEQ ID NO: 321499 - DNA, 23 bp, Homo sapiens
cgagatgtgacccaccagtgcct

SEQ ID NO: 321500 - DNA, 14 bp, Homo sapiens
cgagcaaagatcaa

SEQ ID NO: 321501 - DNA, 20 bp, Homo sapiens
cgagcaaagatcaaaataaa

SEQ ID NO: 321502 - DNA, 23 bp, Homo sapiens
cgagcaaagatcaaaataaaaag

SEQ ID NO: 321503 - DNA, 19 bp, Homo sapiens
cgagcaaagtctaaagttt

SEQ ID NO: 321504 - DNA, 14 bp, Homo sapiens
cgagcactggccag

SEQ ID NO: 321505 - DNA, 21 bp, Homo sapiens
cgagcagtcctgcctcagcct

SEQ ID NO: 321506 - DNA, 23 bp, Homo sapiens
cgagcagtcctgcctcagcctcc

SEQ ID NO: 321507 - DNA, 19 bp, Homo sapiens
cgagcatgttgttttttca

SEQ ID NO: 321508 - DNA, 19 bp, Homo sapiens
cgagcccagctacattcct

SEQ ID NO: 321509 - DNA, 16 bp, Homo sapiens
cgagccccctgtcctt

SEQ ID NO: 321510 - DNA, 14 bp, Homo sapiens
cgagccgggcctgg

SEQ ID NO: 321511 - DNA, 17 bp, Homo sapiens
cgagccgggcctggggc

SEQ ID NO: 321512 - DNA, 17 bp, Homo sapiens
cgagcgacggctcctcc

SEQ ID NO: 321513 - DNA, 20 bp, Homo sapiens
cgagcgacggctcctccccg

SEQ ID NO: 321514 - DNA, 23 bp, Homo sapiens
cgagcgacggctcctccccgatc

SEQ ID NO: 321515 - DNA, 18 bp, Homo sapiens
cgagcgcgtgccttcccc

SEQ ID NO: 321516 - DNA, 21 bp, Homo sapiens
cgagctactctcttgccagca

SEQ ID NO: 321517 - DNA, 19 bp, Homo sapiens
cgagctcgtgtatcctggg

SEQ ID NO: 321518 - DNA, 21 bp, Homo sapiens
cgagctcgtgtatcctggggc

SEQ ID NO: 321519 - DNA, 21 bp, Homo sapiens
cgagctctcctgggccagggt

SEQ ID NO: 321520 - DNA, 14 bp, Homo sapiens
cgagctgctctgct

SEQ ID NO: 321521 - DNA, 16 bp, Homo sapiens
cgagctgggggccatg

SEQ ID NO: 321522 - DNA, 13 bp, Homo sapiens
cgagctggtgcat

SEQ ID NO: 321523 - DNA, 15 bp, Homo sapiens
cgagctggtgcatta

SEQ ID NO: 321524 - DNA, 19 bp, Homo sapiens
cgaggaaccagagccatgg

SEQ ID NO: 321525 - DNA, 22 bp, Homo sapiens
cgaggaagggccagagcctggt

SEQ ID NO: 321526 - DNA, 21 bp, Homo sapiens
cgaggacactcgcttgccggg

SEQ ID NO: 321527 - DNA, 22 bp, Homo sapiens
cgaggacactcgcttgccgggc

SEQ ID NO: 321528 - DNA, 23 bp, Homo sapiens
cgaggagtccagtttgtgcaaga

SEQ ID NO: 321529 - DNA, 17 bp, Homo sapiens
cgaggcaccggcgctgc

SEQ ID NO: 321530 - DNA, 20 bp, Homo sapiens
cgaggcagaatggtgggctc

SEQ ID NO: 321531 - DNA, 12 bp, Homo sapiens
cgaggcagagga

SEQ ID NO: 321532 - DNA, 14 bp, Homo sapiens
cgaggcaggggctg

SEQ ID NO: 321533 - DNA, 14 bp, Homo sapiens
cgaggcgaggctgc

SEQ ID NO: 321534 - DNA, 20 bp, Homo sapiens
cgaggcgggggatcctggag

SEQ ID NO: 321535 - DNA, 14 bp, Homo sapiens
cgaggctccccgcc

SEQ ID NO: 321536 - DNA, 22 bp, Homo sapiens
cgaggctccccgcctccactct

SEQ ID NO: 321537 - DNA, 14 bp, Homo sapiens
cgaggctgcctctg

SEQ ID NO: 321538 - DNA, 15 bp, Homo sapiens
cgaggctggagctgg

SEQ ID NO: 321539 - DNA, 16 bp, Homo sapiens
cgaggctgggccaagc

SEQ ID NO: 321540 - DNA, 12 bp, Homo sapiens
cgagggccgaat

SEQ ID NO: 321541 - DNA, 16 bp, Homo sapiens
cgagggcggccaggga

SEQ ID NO: 321542 - DNA, 22 bp, Homo sapiens
cgagggggctgtcatgcggttt

SEQ ID NO: 321543 - DNA, 16 bp, Homo sapiens
cgagggtcctggctcc

SEQ ID NO: 321544 - DNA, 14 bp, Homo sapiens
cgagggttccaggc

SEQ ID NO: 321545 - DNA, 18 bp, Homo sapiens
cgagggttccaggctgtg

SEQ ID NO: 321546 - DNA, 16 bp, Homo sapiens
cgaggtggtagctctg

SEQ ID NO: 321547 - DNA, 21 bp, Homo sapiens
cgaggtggtagctctgagccc

SEQ ID NO: 321548 - DNA, 19 bp, Homo sapiens
cgaggtgtcaccctgcaga

SEQ ID NO: 321549 - DNA, 20 bp, Homo sapiens
cgaggtgtcaccctgcagag

SEQ ID NO: 321550 - DNA, 17 bp, Homo sapiens
cgaggttcccagggctg

SEQ ID NO: 321551 - DNA, 21 bp, Homo sapiens
cgaggttcccagggctggaga

SEQ ID NO: 321552 - DNA, 15 bp, Homo sapiens
cgagtcacctgcaag

SEQ ID NO: 321553 - DNA, 16 bp, Homo sapiens
cgagtcacctgcaagc

SEQ ID NO: 321554 - DNA, 15 bp, Homo sapiens
cgagtccaaaatcat

SEQ ID NO: 321555 - DNA, 18 bp, Homo sapiens
cgagtccaggagccccag

SEQ ID NO: 321556 - DNA, 17 bp, Homo sapiens
cgagtctcttctccact

SEQ ID NO: 321557 - DNA, 20 bp, Homo sapiens
cgagtctcttctccactgga

SEQ ID NO: 321558 - DNA, 21 bp, Homo sapiens
cgagtctcttctccactggat

SEQ ID NO: 321559 - DNA, 13 bp, Homo sapiens
cgagtctggagac

SEQ ID NO: 321560 - DNA, 15 bp, Homo sapiens
cgagtctggagacca

SEQ ID NO: 321561 - DNA, 17 bp, Homo sapiens
cgagtgagacaaaattt

SEQ ID NO: 321562 - DNA, 13 bp, Homo sapiens
cgagtgccccaga

SEQ ID NO: 321563 - DNA, 16 bp, Homo sapiens
cgagtgcccctgcagg

SEQ ID NO: 321564 - DNA, 20 bp, Homo sapiens
cgagtggatagatgccctgc

SEQ ID NO: 321565 - DNA, 23 bp, Homo sapiens
cgagtggatagatgccctgctag

SEQ ID NO: 321566 - DNA, 13 bp, Homo sapiens
cgagtgggaagga

SEQ ID NO: 321567 - DNA, 18 bp, Homo sapiens
cgagtggtctcctctcag

SEQ ID NO: 321568 - DNA, 20 bp, Homo sapiens
cgagtggtctcctctcagct

SEQ ID NO: 321569 - DNA, 21 bp, Homo sapiens
cgagtggtctcctctcagctt

SEQ ID NO: 321570 - DNA, 16 bp, Homo sapiens
cgagtgtggagctgct

SEQ ID NO: 321571 - DNA, 19 bp, Homo sapiens
cgagtgtgtgcatgtgtgt

SEQ ID NO: 321572 - DNA, 18 bp, Homo sapiens
cgatacaccgggcctgga

SEQ ID NO: 321573 - DNA, 15 bp, Homo sapiens
cgatatacagatgaa

SEQ ID NO: 321574 - DNA, 18 bp, Homo sapiens
cgatcatatctgtatgcc

SEQ ID NO: 321575 - DNA, 21 bp, Homo sapiens
cgatcatggctcactgcagcc

SEQ ID NO: 321576 - DNA, 23 bp, Homo sapiens
cgatcatggctcactgcagcctc

SEQ ID NO: 321577 - DNA, 17 bp, Homo sapiens
ctccttagccctgtctg

SEQ ID NO: 321578 - DNA, 17 bp, Homo sapiens
ctccttagtcttctcat

SEQ ID NO: 321579 - DNA, 19 bp, Homo sapiens
ctccttagtcttctcatag

SEQ ID NO: 321580 - DNA, 16 bp, Homo sapiens
ctccttattttgtatt

SEQ ID NO: 321581 - DNA, 15 bp, Homo sapiens
ctccttccacctccc

SEQ ID NO: 321582 - DNA, 18 bp, Homo sapiens
ctccttccacctccctcc

SEQ ID NO: 321583 - DNA, 12 bp, Homo sapiens
ctccttccagcc

SEQ ID NO: 321584 - DNA, 16 bp, Homo sapiens
ctccttccagcctgag

SEQ ID NO: 321585 - DNA, 13 bp, Homo sapiens
ctccttccatcct

SEQ ID NO: 321586 - DNA, 15 bp, Homo sapiens
ctccttccatccttg

SEQ ID NO: 321587 - DNA, 16 bp, Homo sapiens
ctccttccatccttga

SEQ ID NO: 321588 - DNA, 14 bp, Homo sapiens
ctccttcccactgt

SEQ ID NO: 321589 - DNA, 16 bp, Homo sapiens
ctccttcccactgtcc

SEQ ID NO: 321590 - DNA, 21 bp, Homo sapiens
ctccttcccactgtcctttct

SEQ ID NO: 321591 - DNA, 22 bp, Homo sapiens
ctccttcccactgtcctttctc

SEQ ID NO: 321592 - DNA, 13 bp, Homo sapiens
ctccttcccatgc

SEQ ID NO: 321593 - DNA, 15 bp, Homo sapiens
ctccttcccatgcct

SEQ ID NO: 321594 - DNA, 16 bp, Homo sapiens
ctccttcccatgcctg

SEQ ID NO: 321595 - DNA, 20 bp, Homo sapiens
ctccttcccatttctctaca

SEQ ID NO: 321596 - DNA, 21 bp, Homo sapiens
ctccttcccccagcccaataa

SEQ ID NO: 321597 - DNA, 21 bp, Homo sapiens
ctccttcccgccgcccgaccc

SEQ ID NO: 321598 - DNA, 22 bp, Homo sapiens
ctccttcccgccgcccgacccc

SEQ ID NO: 321599 - DNA, 10 bp, Homo sapiens
ctccttcctc

SEQ ID NO: 321600 - DNA, 16 bp, Homo sapiens
ctccttcctgccacct

SEQ ID NO: 321601 - DNA, 14 bp, Homo sapiens
ctccttcgtgtctc

SEQ ID NO: 321602 - DNA, 13 bp, Homo sapiens
ctccttctcccca

SEQ ID NO: 321603 - DNA, 14 bp, Homo sapiens
ctccttctcccctc

SEQ ID NO: 321604 - DNA, 15 bp, Homo sapiens
ctccttctcccctcc

SEQ ID NO: 321605 - DNA, 17 bp, Homo sapiens
ctccttctcccctccag

SEQ ID NO: 321606 - DNA, 19 bp, Homo sapiens
ctccttcttgccctgagct

SEQ ID NO: 321607 - DNA, 17 bp, Homo sapiens
ctccttgaagacatatc

SEQ ID NO: 321608 - DNA, 21 bp, Homo sapiens
ctccttgaagacatatcatgt

SEQ ID NO: 321609 - DNA, 15 bp, Homo sapiens
ctccttgattacata

SEQ ID NO: 321610 - DNA, 13 bp, Homo sapiens
ctccttgccaccc

SEQ ID NO: 321611 - DNA, 16 bp, Homo sapiens
ctccttgccacccccc

SEQ ID NO: 321612 - DNA, 14 bp, Homo sapiens
ctccttgcccagac

SEQ ID NO: 321613 - DNA, 22 bp, Homo sapiens
ctccttgccccagtcctggttc

SEQ ID NO: 321614 - DNA, 16 bp, Homo sapiens
ctccttgccctgggcc

SEQ ID NO: 321615 - DNA, 16 bp, Homo sapiens
ctccttgccgctggga

SEQ ID NO: 321616 - DNA, 17 bp, Homo sapiens
ctccttgccgctgggag

SEQ ID NO: 321617 - DNA, 22 bp, Homo sapiens
ctccttggatttgcatttttgt

SEQ ID NO: 321618 - DNA, 18 bp, Homo sapiens
ctccttggcacccccatg

SEQ ID NO: 321619 - DNA, 20 bp, Homo sapiens
ctccttggcacccccatgct

SEQ ID NO: 321620 - DNA, 19 bp, Homo sapiens
ctccttgggctcctggctg

SEQ ID NO: 321621 - DNA, 21 bp, Homo sapiens
ctccttgggctcctggctgcc

SEQ ID NO: 321622 - DNA, 15 bp, Homo sapiens
ctccttgggtcctgc

SEQ ID NO: 321623 - DNA, 12 bp, Homo sapiens
ctccttgttcct

SEQ ID NO: 321624 - DNA, 19 bp, Homo sapiens
ctccttgtttgcctttagg

SEQ ID NO: 321625 - DNA, 11 bp, Homo sapiens
ctcctttccca

SEQ ID NO: 321626 - DNA, 17 bp, Homo sapiens
ctcctttctccagccag

SEQ ID NO: 321627 - DNA, 18 bp, Homo sapiens
ctcctttctccagccagc

SEQ ID NO: 321628 - DNA, 21 bp, Homo sapiens
ctcctttctccagccagcaat

SEQ ID NO: 321629 - DNA, 23 bp, Homo sapiens
ctcctttgatattatgtggcttt

SEQ ID NO: 321630 - DNA, 18 bp, Homo sapiens
ctcctttgcactgagggc

SEQ ID NO: 321631 - DNA, 23 bp, Homo sapiens
ctcctttgctgaggcctccagct

SEQ ID NO: 321632 - DNA, 20 bp, Homo sapiens
ctcctttgtcttttttttca

SEQ ID NO: 321633 - DNA, 23 bp, Homo sapiens
ctccttttctctttgggtttctt

SEQ ID NO: 321634 - DNA, 13 bp, Homo sapiens
ctccttttctgtg

SEQ ID NO: 321635 - DNA, 21 bp, Homo sapiens
ctccttttctgtgaagccctt

SEQ ID NO: 321636 - DNA, 22 bp, Homo sapiens
ctctagccaggagtctgtgctc

SEQ ID NO: 321637 - DNA, 21 bp, Homo sapiens
ctctagcctgggccagagaag

SEQ ID NO: 321638 - DNA, 19 bp, Homo sapiens
ctctagctggcaggacaca

SEQ ID NO: 321639 - DNA, 21 bp, Homo sapiens
ctctaggagggagccttgtga

SEQ ID NO: 321640 - DNA, 22 bp, Homo sapiens
ctctaggagggagccttgtgag

SEQ ID NO: 321641 - DNA, 15 bp, Homo sapiens
ctctaggcctcagtg

SEQ ID NO: 321642 - DNA, 20 bp, Homo sapiens
ctctaggcctcagtgtcctc

SEQ ID NO: 321643 - DNA, 17 bp, Homo sapiens
ctctaggtaaactagca

SEQ ID NO: 321644 - DNA, 12 bp, Homo sapiens
ctctaggtttct

SEQ ID NO: 321645 - DNA, 21 bp, Homo sapiens
ctctagtccctgtgttctgca

SEQ ID NO: 321646 - DNA, 19 bp, Homo sapiens
ctctagtgacttcctggtg

SEQ ID NO: 321647 - DNA, 22 bp, Homo sapiens
ctctagtgacttcctggtgagg

SEQ ID NO: 321648 - DNA, 14 bp, Homo sapiens
ctctagttctagat

SEQ ID NO: 321649 - DNA, 20 bp, Homo sapiens
ctctatatatacatgtatag

SEQ ID NO: 321650 - DNA, 23 bp, Homo sapiens
ctctatccaaagaacttgatttg

SEQ ID NO: 321651 - DNA, 14 bp, Homo sapiens
ctctatctgggcct

SEQ ID NO: 321652 - DNA, 15 bp, Homo sapiens
ctctatctgggcctg

SEQ ID NO: 321653 - DNA, 16 bp, Homo sapiens
ctctatctgggcctgg

SEQ ID NO: 321654 - DNA, 20 bp, Homo sapiens
ctctatctgggcctgggcta

SEQ ID NO: 321655 - DNA, 19 bp, Homo sapiens
ctctatggtaaagatatta

SEQ ID NO: 321656 - DNA, 21 bp, Homo sapiens
ctctattctcaaagtttccta

SEQ ID NO: 321657 - DNA, 17 bp, Homo sapiens
ctctcaaaagtctattt

SEQ ID NO: 321658 - DNA, 18 bp, Homo sapiens
ctctcaaaagtctatttt

SEQ ID NO: 321659 - DNA, 23 bp, Homo sapiens
ctctcaaactaaaagacatttgt

SEQ ID NO: 321660 - DNA, 21 bp, Homo sapiens
ctctcaatagcaaaagtgatg

SEQ ID NO: 321661 - DNA, 10 bp, Homo sapiens
ctctcaatat

SEQ ID NO: 321662 - DNA, 22 bp, Homo sapiens
ctctcaatatataataaatggg

SEQ ID NO: 321663 - DNA, 19 bp, Homo sapiens
ctctcaatttgggtcccag

SEQ ID NO: 321664 - DNA, 14 bp, Homo sapiens
ctctcacccccatc

SEQ ID NO: 321665 - DNA, 16 bp, Homo sapiens
ctctcacccccatccc

SEQ ID NO: 321666 - DNA, 12 bp, Homo sapiens
ctctcacctcct

SEQ ID NO: 321667 - DNA, 14 bp, Homo sapiens
ctctcactccccag

SEQ ID NO: 321668 - DNA, 19 bp, Homo sapiens
ctctcactccccagcccca

SEQ ID NO: 321669 - DNA, 14 bp, Homo sapiens
ctctcactggccag

SEQ ID NO: 321670 - DNA, 14 bp, Homo sapiens
ctctcactgtgtcc

SEQ ID NO: 321671 - DNA, 22 bp, Homo sapiens
ctctcactttggttggaacttt

SEQ ID NO: 321672 - DNA, 16 bp, Homo sapiens
ctctcagaactcctgt

SEQ ID NO: 321673 - DNA, 17 bp, Homo sapiens
ctctcagaactcctgtg

SEQ ID NO: 321674 - DNA, 11 bp, Homo sapiens
ctctcagaccc

SEQ ID NO: 321675 - DNA, 12 bp, Homo sapiens
ctctcagagact

SEQ ID NO: 321676 - DNA, 17 bp, Homo sapiens
ctctcagagactcccag

SEQ ID NO: 321677 - DNA, 18 bp, Homo sapiens
ctctcagagggttttctc

SEQ ID NO: 321678 - DNA, 22 bp, Homo sapiens
ctctcagatccctcggtcagca

SEQ ID NO: 321679 - DNA, 19 bp, Homo sapiens
ctctcagccttacatttgt

SEQ ID NO: 321680 - DNA, 18 bp, Homo sapiens
ctctcaggagcacaggca

SEQ ID NO: 321681 - DNA, 21 bp, Homo sapiens
ctctcaggagcacaggcagct

SEQ ID NO: 321682 - DNA, 15 bp, Homo sapiens
ctctcagttgcagcc

SEQ ID NO: 321683 - DNA, 22 bp, Homo sapiens
ctctcagttgcagccctgctgc

SEQ ID NO: 321684 - DNA, 21 bp, Homo sapiens
ctctcataggagttaggctgt

SEQ ID NO: 321685 - DNA, 15 bp, Homo sapiens
ctctcatcccccatt

SEQ ID NO: 321686 - DNA, 14 bp, Homo sapiens
ctctcatgtttccc

SEQ ID NO: 321687 - DNA, 18 bp, Homo sapiens
ctctccaagtctctctgt

SEQ ID NO: 321688 - DNA, 20 bp, Homo sapiens
ctctccaagtctctctgtga

SEQ ID NO: 321689 - DNA, 23 bp, Homo sapiens
ctctccacacccatgactgcccc

SEQ ID NO: 321690 - DNA, 13 bp, Homo sapiens
ctctccactccat

SEQ ID NO: 321691 - DNA, 14 bp, Homo sapiens
ctctccactgcctt

SEQ ID NO: 321692 - DNA, 18 bp, Homo sapiens
ctctccagcctcagctct

SEQ ID NO: 321693 - DNA, 20 bp, Homo sapiens
ctctccaggattgtccacaa

SEQ ID NO: 321694 - DNA, 24 bp, Homo sapiens
ctctccaggattgtccacaaatgt

SEQ ID NO: 321695 - DNA, 16 bp, Homo sapiens
ctctccatcataggct

SEQ ID NO: 321696 - DNA, 22 bp, Homo sapiens
ctctccatcataggctgacacc

SEQ ID NO: 321697 - DNA, 21 bp, Homo sapiens
ctctcccaccccggcctccac

SEQ ID NO: 321698 - DNA, 22 bp, Homo sapiens
ctctcccaccccggcctccact

SEQ ID NO: 321699 - DNA, 22 bp, Homo sapiens
ctctcccagaggctcctggagc

SEQ ID NO: 321700 - DNA, 13 bp, Homo sapiens
ctctccccacact

SEQ ID NO: 321701 - DNA, 15 bp, Homo sapiens
ctctccccacactaa

SEQ ID NO: 321702 - DNA, 11 bp, Homo sapiens
ctctccccagt

SEQ ID NO: 321703 - DNA, 16 bp, Homo sapiens
ctctccccagtgcctg

SEQ ID NO: 321704 - DNA, 15 bp, Homo sapiens
ctctccccatatata

SEQ ID NO: 321705 - DNA, 18 bp, Homo sapiens
ctctcccctgccctgctg

SEQ ID NO: 321706 - DNA, 19 bp, Homo sapiens
ctctcccctgcgcaggccc

SEQ ID NO: 321707 - DNA, 14 bp, Homo sapiens
ctctcccggctgcc

SEQ ID NO: 321708 - DNA, 16 bp, Homo sapiens
ctctcccggctgcctg

SEQ ID NO: 321709 - DNA, 20 bp, Homo sapiens
ctctccctccactcctccca

SEQ ID NO: 321710 - DNA, 15 bp, Homo sapiens
ctctccctctctgca

SEQ ID NO: 321711 - DNA, 15 bp, Homo sapiens
ctctccctgcctcac

SEQ ID NO: 321712 - DNA, 12 bp, Homo sapiens
ctctccctgttg

SEQ ID NO: 321713 - DNA, 17 bp, Homo sapiens
ctctcccttctttacct

SEQ ID NO: 321714 - DNA, 18 bp, Homo sapiens
ctctcctcggtggcattt

SEQ ID NO: 321715 - DNA, 12 bp, Homo sapiens
ctctcctcgtcc

SEQ ID NO: 321716 - DNA, 15 bp, Homo sapiens
ctctcctctctctcc

SEQ ID NO: 321717 - DNA, 18 bp, Homo sapiens
ctctcctctctctccctc

SEQ ID NO: 321718 - DNA, 20 bp, Homo sapiens
ctctcctctctctccctcca

SEQ ID NO: 321719 - DNA, 18 bp, Homo sapiens
ctctcctgagcctgtctc

SEQ ID NO: 321720 - DNA, 20 bp, Homo sapiens
ctctcctgagcctgtctctc

SEQ ID NO: 321721 - DNA, 21 bp, Homo sapiens
ctctcctgatagtctttcagt

SEQ ID NO: 321722 - DNA, 12 bp, Homo sapiens
ctctcctgccca

SEQ ID NO: 321723 - DNA, 18 bp, Homo sapiens
ctctcctgcccagatgcc

SEQ ID NO: 321724 - DNA, 19 bp, Homo sapiens
ctctcctgcccagctctga

SEQ ID NO: 321725 - DNA, 21 bp, Homo sapiens
ctctcctgggcccctccctac

SEQ ID NO: 321726 - DNA, 20 bp, Homo sapiens
ctctcctgtttcccttccct

SEQ ID NO: 321727 - DNA, 23 bp, Homo sapiens
ctctccttcactctgacagtatt

SEQ ID NO: 321728 - DNA, 22 bp, Homo sapiens
ctctccttcgtgtctctcccac

SEQ ID NO: 321729 - DNA, 15 bp, Homo sapiens
ctctccttgccccag

SEQ ID NO: 321730 - DNA, 14 bp, Homo sapiens
ctctccttgccctg

SEQ ID NO: 321731 - DNA, 17 bp, Homo sapiens
ctctccttgccctgggc

SEQ ID NO: 321732 - DNA, 22 bp, Homo sapiens
ctctccttgggctcctggctgc

SEQ ID NO: 321733 - DNA, 14 bp, Homo sapiens
ctctcctttctttt

SEQ ID NO: 321734 - DNA, 21 bp, Homo sapiens
ctctcctttctttttcttctt

SEQ ID NO: 321735 - DNA, 22 bp, Homo sapiens
ctctccttttgaggcttctcct

SEQ ID NO: 321736 - DNA, 16 bp, Homo sapiens
ctctcgccccatccct

SEQ ID NO: 321737 - DNA, 21 bp, Homo sapiens
ctctcggaactgcatgctgct

SEQ ID NO: 321738 - DNA, 19 bp, Homo sapiens
ctctcggctggaagaacat

SEQ ID NO: 321739 - DNA, 19 bp, Homo sapiens
ctctcgggttcaagcaatt

SEQ ID NO: 321740 - DNA, 21 bp, Homo sapiens
ctctcggttccacgtccccct

SEQ ID NO: 321741 - DNA, 16 bp, Homo sapiens
ctctcgtccctctgct

SEQ ID NO: 321742 - DNA, 17 bp, Homo sapiens
ctctctaaaaataaaat

SEQ ID NO: 321743 - DNA, 20 bp, Homo sapiens
ctctctaatggcccctccat

SEQ ID NO: 321744 - DNA, 14 bp, Homo sapiens
ctctctactgtcag

SEQ ID NO: 321745 - DNA, 22 bp, Homo sapiens
ctctctaggagggagccttgtg

SEQ ID NO: 321746 - DNA, 15 bp, Homo sapiens
ctctctatatataca

SEQ ID NO: 321747 - DNA, 13 bp, Homo sapiens
ctctctatctttt

SEQ ID NO: 321748 - DNA, 14 bp, Homo sapiens
ctctctatcttttt

SEQ ID NO: 321749 - DNA, 18 bp, Homo sapiens
ctctctatggtaaagata

SEQ ID NO: 321750 - DNA, 23 bp, Homo sapiens
ctctctatggtaaagatattatt

SEQ ID NO: 321751 - DNA, 15 bp, Homo sapiens
ctctctcaaaattat

SEQ ID NO: 321752 - DNA, 12 bp, Homo sapiens
ctctctcatgtg

SEQ ID NO: 321753 - DNA, 14 bp, Homo sapiens
ctctctctccctcc

SEQ ID NO: 321754 - DNA, 10 bp, Homo sapiens
ctctctctct

SEQ ID NO: 321755 - DNA, 16 bp, Homo sapiens
ctctctctctctgttc

SEQ ID NO: 321756 - DNA, 13 bp, Homo sapiens
ctctctctctgtt

SEQ ID NO: 321757 - DNA, 16 bp, Homo sapiens
ctctctctctgttcca

SEQ ID NO: 321758 - DNA, 13 bp, Homo sapiens
ctctctctctttt

SEQ ID NO: 321759 - DNA, 10 bp, Homo sapiens
ctctctctgt

SEQ ID NO: 321760 - DNA, 13 bp, Homo sapiens
ctctctctgttcc

SEQ ID NO: 321761 - DNA, 13 bp, Homo sapiens
ctctctctgttgt

SEQ ID NO: 321762 - DNA, 12 bp, Homo sapiens
ctctctcttctg

SEQ ID NO: 321763 - DNA, 14 bp, Homo sapiens
ctctctctttttct

SEQ ID NO: 321764 - DNA, 20 bp, Homo sapiens
ctctctgaagatgatcattt

SEQ ID NO: 321765 - DNA, 16 bp, Homo sapiens
ctctctgcacctgtct

SEQ ID NO: 321766 - DNA, 20 bp, Homo sapiens
ctctgctcaatgaaaccttc

SEQ ID NO: 321767 - DNA, 21 bp, Homo sapiens
ctctgctcaatgaaaccttcc

SEQ ID NO: 321768 - DNA, 19 bp, Homo sapiens
ctctgctccaccacatcct

SEQ ID NO: 321769 - DNA, 12 bp, Homo sapiens
ctctgctcccag

SEQ ID NO: 321770 - DNA, 16 bp, Homo sapiens
ctctgctccgtgtgtc

SEQ ID NO: 321771 - DNA, 18 bp, Homo sapiens
ctctgctccgtgtgtctc

SEQ ID NO: 321772 - DNA, 15 bp, Homo sapiens
ctctgctcctcaccc

SEQ ID NO: 321773 - DNA, 14 bp, Homo sapiens
ctctgctcctggag

SEQ ID NO: 321774 - DNA, 18 bp, Homo sapiens
ctctgctctagccaggag

SEQ ID NO: 321775 - DNA, 19 bp, Homo sapiens
ctctgctgaacatttggaa

SEQ ID NO: 321776 - DNA, 14 bp, Homo sapiens
ctctgctgaaggtt

SEQ ID NO: 321777 - DNA, 14 bp, Homo sapiens
ctctgctgacttct

SEQ ID NO: 321778 - DNA, 20 bp, Homo sapiens
ctctgctgcccacggccacc

SEQ ID NO: 321779 - DNA, 19 bp, Homo sapiens
ctctgctgcttctgggcct

SEQ ID NO: 321780 - DNA, 21 bp, Homo sapiens
ctctgctgcttctgggcctga

SEQ ID NO: 321781 - DNA, 18 bp, Homo sapiens
ctctgctggcccagccaa

SEQ ID NO: 321782 - DNA, 22 bp, Homo sapiens
ctctgctggccgggcacagctg

SEQ ID NO: 321783 - DNA, 15 bp, Homo sapiens
ctctgctgtcctgca

SEQ ID NO: 321784 - DNA, 17 bp, Homo sapiens
ctctgctgtcctgcagt

SEQ ID NO: 321785 - DNA, 21 bp, Homo sapiens
ctctgcttactaatgtgcccc

SEQ ID NO: 321786 - DNA, 17 bp, Homo sapiens
ctctgcttgagtcaggt

SEQ ID NO: 321787 - DNA, 13 bp, Homo sapiens
ctctgcttggctg

SEQ ID NO: 321788 - DNA, 13 bp, Homo sapiens
ctctgctttgcat

SEQ ID NO: 321789 - DNA, 21 bp, Homo sapiens
ctctggaaaactcaggattct

SEQ ID NO: 321790 - DNA, 23 bp, Homo sapiens
ctctggaaaggaggaaggagcct

SEQ ID NO: 321791 - DNA, 22 bp, Homo sapiens
ctctggaaaggggggagctggg

SEQ ID NO: 321792 - DNA, 14 bp, Homo sapiens
ctctggaagcctgc

SEQ ID NO: 321793 - DNA, 16 bp, Homo sapiens
ctctggaccccaggcc

SEQ ID NO: 321794 - DNA, 14 bp, Homo sapiens
ctctggactggcta

SEQ ID NO: 321795 - DNA, 19 bp, Homo sapiens
ctctggactggctagagtc

SEQ ID NO: 321796 - DNA, 22 bp, Homo sapiens
ctctggagccacctgtcccacc

SEQ ID NO: 321797 - DNA, 20 bp, Homo sapiens
ctctggaggcctctgggcct

SEQ ID NO: 321798 - DNA, 13 bp, Homo sapiens
ctctggagtgtgt

SEQ ID NO: 321799 - DNA, 17 bp, Homo sapiens
ctctggatcctgcactc

SEQ ID NO: 321800 - DNA, 16 bp, Homo sapiens
ctctggcaggtggcca

SEQ ID NO: 321801 - DNA, 19 bp, Homo sapiens
ctctggccaaatatgcact

SEQ ID NO: 321802 - DNA, 20 bp, Homo sapiens
ctctggccaaatatgcactt

SEQ ID NO: 321803 - DNA, 21 bp, Homo sapiens
ctctggccaaatatgcacttt

SEQ ID NO: 321804 - DNA, 22 bp, Homo sapiens
ctctggccaaatatgcactttc

SEQ ID NO: 321805 - DNA, 12 bp, Homo sapiens
ctctggccacaa

SEQ ID NO: 321806 - DNA, 22 bp, Homo sapiens
ctctggccacaatcctccccac

SEQ ID NO: 321807 - DNA, 13 bp, Homo sapiens
ctctggccaccct

SEQ ID NO: 321808 - DNA, 18 bp, Homo sapiens
ctctggccaccctggccc

SEQ ID NO: 321809 - DNA, 19 bp, Homo sapiens
ctctggccaccctggcccg

SEQ ID NO: 321810 - DNA, 15 bp, Homo sapiens
ctctggccactctgc

SEQ ID NO: 321811 - DNA, 13 bp, Homo sapiens
ctctggccagacg

SEQ ID NO: 321812 - DNA, 16 bp, Homo sapiens
ctctggccagacggcc

SEQ ID NO: 321813 - DNA, 14 bp, Homo sapiens
ctctggccctgttg

SEQ ID NO: 321814 - DNA, 20 bp, Homo sapiens
ctctggccttggttcctcca

SEQ ID NO: 321815 - DNA, 23 bp, Homo sapiens
ctctggccttggttcctccagca

SEQ ID NO: 321816 - DNA, 15 bp, Homo sapiens
ctctggccttttcct

SEQ ID NO: 321817 - DNA, 16 bp, Homo sapiens
ctctggccttttccta

SEQ ID NO: 321818 - DNA, 19 bp, Homo sapiens
ctctggctagaggccagcc

SEQ ID NO: 321819 - DNA, 22 bp, Homo sapiens
ctctggctagaggccagcccca

SEQ ID NO: 321820 - DNA, 22 bp, Homo sapiens
ctctggctcacagactggagac

SEQ ID NO: 321821 - DNA, 15 bp, Homo sapiens
ctctggctcagggcc

SEQ ID NO: 321822 - DNA, 14 bp, Homo sapiens
ctctggctccctgg

SEQ ID NO: 321823 - DNA, 22 bp, Homo sapiens
ctctggctccttcagcagctag

SEQ ID NO: 321824 - DNA, 13 bp, Homo sapiens
ctctggctgcctg

SEQ ID NO: 321825 - DNA, 17 bp, Homo sapiens
ctctgggagaggatttt

SEQ ID NO: 321826 - DNA, 19 bp, Homo sapiens
ctctgggaggggtgctgcc

SEQ ID NO: 321827 - DNA, 23 bp, Homo sapiens
ctctgggcaggacctcagagtcc

SEQ ID NO: 321828 - DNA, 22 bp, Homo sapiens
ctctgggcccaggggctgtggc

SEQ ID NO: 321829 - DNA, 19 bp, Homo sapiens
ctctgggccctgcaggagg

SEQ ID NO: 321830 - DNA, 12 bp, Homo sapiens
ctctgggctcag

SEQ ID NO: 321831 - DNA, 17 bp, Homo sapiens
ctctgggctcagggctg

SEQ ID NO: 321832 - DNA, 18 bp, Homo sapiens
ctctgggctcagggctgg

SEQ ID NO: 321833 - DNA, 14 bp, Homo sapiens
ctctgggctgagcc

SEQ ID NO: 321834 - DNA, 21 bp, Homo sapiens
ctctgggctgagcctactgtc

SEQ ID NO: 321835 - DNA, 23 bp, Homo sapiens
ctctgggctgagcctactgtctc

SEQ ID NO: 321836 - DNA, 22 bp, Homo sapiens
ctctggggaagggaaccagccc

SEQ ID NO: 321837 - DNA, 23 bp, Homo sapiens
ctctggggaagggaaccagccct

SEQ ID NO: 321838 - DNA, 18 bp, Homo sapiens
ctctggggatttctggga

SEQ ID NO: 321839 - DNA, 19 bp, Homo sapiens
ctctggggatttctgggat

SEQ ID NO: 321840 - DNA, 16 bp, Homo sapiens
ctctggggctctaggg

SEQ ID NO: 321841 - DNA, 15 bp, Homo sapiens
ctctggggcttgcta

SEQ ID NO: 321842 - DNA, 22 bp, Homo sapiens
ctctgggtgagtggctgacaga

SEQ ID NO: 321843 - DNA, 23 bp, Homo sapiens
ctctgggtttacaacaaacactg

SEQ ID NO: 321844 - DNA, 22 bp, Homo sapiens
ctctggtctcctctttgttttg

SEQ ID NO: 321845 - DNA, 10 bp, Homo sapiens
ctctggtggg

SEQ ID NO: 321846 - DNA, 22 bp, Homo sapiens
ctctggtttggggcgaggcaga

SEQ ID NO: 321847 - DNA, 15 bp, Homo sapiens
ctctgtaacatcact

SEQ ID NO: 321848 - DNA, 23 bp, Homo sapiens
ctctgtatatagctctacacaac

SEQ ID NO: 321849 - DNA, 22 bp, Homo sapiens
ctctgtattctgcaacagcctg

SEQ ID NO: 321850 - DNA, 16 bp, Homo sapiens
ctctgtcagtttgtga

SEQ ID NO: 321851 - DNA, 18 bp, Homo sapiens
caggaggaggagatggcc

SEQ ID NO: 321852 - DNA, 17 bp, Homo sapiens
caggaggagggcgcatg

SEQ ID NO: 321853 - DNA, 21 bp, Homo sapiens
caggaggagggcgcatgtgtg

SEQ ID NO: 321854 - DNA, 23 bp, Homo sapiens
caggaggagggcgcatgtgtgta

SEQ ID NO: 321855 - DNA, 21 bp, Homo sapiens
caggaggcagagggttgcagt

SEQ ID NO: 321856 - DNA, 14 bp, Homo sapiens
caggaggcccctgg

SEQ ID NO: 321857 - DNA, 15 bp, Homo sapiens
caggaggctggagga

SEQ ID NO: 321858 - DNA, 18 bp, Homo sapiens
caggaggctggaggaagg

SEQ ID NO: 321859 - DNA, 19 bp, Homo sapiens
caggagggaggtttgtgag

SEQ ID NO: 321860 - DNA, 16 bp, Homo sapiens
caggagggccctacct

SEQ ID NO: 321861 - DNA, 16 bp, Homo sapiens
caggaggggcctctga

SEQ ID NO: 321862 - DNA, 17 bp, Homo sapiens
caggaggggtctgcctc

SEQ ID NO: 321863 - DNA, 15 bp, Homo sapiens
caggagggtctatgg

SEQ ID NO: 321864 - DNA, 21 bp, Homo sapiens
caggaggtactgtgaggaaga

SEQ ID NO: 321865 - DNA, 15 bp, Homo sapiens
caggaggtgcctgag

SEQ ID NO: 321866 - DNA, 16 bp, Homo sapiens
caggaggtgcctgaga

SEQ ID NO: 321867 - DNA, 19 bp, Homo sapiens
caggaggtgcctgagagca

SEQ ID NO: 321868 - DNA, 20 bp, Homo sapiens
caggaggtgcctgagagcag

SEQ ID NO: 321869 - DNA, 22 bp, Homo sapiens
caggaggtggctatggccaccc

SEQ ID NO: 321870 - DNA, 15 bp, Homo sapiens
caggaggtgggtgag

SEQ ID NO: 321871 - DNA, 16 bp, Homo sapiens
caggaggtgggtgagc

SEQ ID NO: 321872 - DNA, 20 bp, Homo sapiens
caggaggttggtgactgaaa

SEQ ID NO: 321873 - DNA, 22 bp, Homo sapiens
caggagtctctgccacccactc

SEQ ID NO: 321874 - DNA, 17 bp, Homo sapiens
caggagtctgtgctctt

SEQ ID NO: 321875 - DNA, 21 bp, Homo sapiens
caggagtgggtgggacacaga

SEQ ID NO: 321876 - DNA, 22 bp, Homo sapiens
caggagtttgagacaagccctg

SEQ ID NO: 321877 - DNA, 14 bp, Homo sapiens
caggataaggagac

SEQ ID NO: 321878 - DNA, 17 bp, Homo sapiens
caggataaggagactga

SEQ ID NO: 321879 - DNA, 17 bp, Homo sapiens
caggatcagccccgctc

SEQ ID NO: 321880 - DNA, 15 bp, Homo sapiens
caggatcccctgcta

SEQ ID NO: 321881 - DNA, 15 bp, Homo sapiens
caggatccgctgcca

SEQ ID NO: 321882 - DNA, 19 bp, Homo sapiens
caggatccgctgccaccac

SEQ ID NO: 321883 - DNA, 14 bp, Homo sapiens
caggatcctcctgg

SEQ ID NO: 321884 - DNA, 14 bp, Homo sapiens
caggatcctgcagg

SEQ ID NO: 321885 - DNA, 15 bp, Homo sapiens
caggatcctgcagga

SEQ ID NO: 321886 - DNA, 17 bp, Homo sapiens
caggatcctgcaggaac

SEQ ID NO: 321887 - DNA, 15 bp, Homo sapiens
caggatctgaacttt

SEQ ID NO: 321888 - DNA, 19 bp, Homo sapiens
caggatgcacggtttctgt

SEQ ID NO: 321889 - DNA, 21 bp, Homo sapiens
caggatggaggggtggtcctg

SEQ ID NO: 321890 - DNA, 23 bp, Homo sapiens
caggatggaggggtggtcctgac

SEQ ID NO: 321891 - DNA, 20 bp, Homo sapiens
caggatggcgtgtcccctgc

SEQ ID NO: 321892 - DNA, 12 bp, Homo sapiens
caggattaatat

SEQ ID NO: 321893 - DNA, 19 bp, Homo sapiens
caggattaatctctaaaat

SEQ ID NO: 321894 - DNA, 23 bp, Homo sapiens
caggattaatctctaaaattcta

SEQ ID NO: 321895 - DNA, 13 bp, Homo sapiens
ctcttaagacact

SEQ ID NO: 321896 - DNA, 13 bp, Homo sapiens
ctcttaatgttgc

SEQ ID NO: 321897 - DNA, 14 bp, Homo sapiens
ctcttaccccgtcc

SEQ ID NO: 321898 - DNA, 22 bp, Homo sapiens
ctcttaccccgtccctttccct

SEQ ID NO: 321899 - DNA, 16 bp, Homo sapiens
ctcttacgctctctgt

SEQ ID NO: 321900 - DNA, 15 bp, Homo sapiens
ctcttagagaataag

SEQ ID NO: 321901 - DNA, 16 bp, Homo sapiens
ctcttagattgggcca

SEQ ID NO: 321902 - DNA, 22 bp, Homo sapiens
ctcttagattgggccatggctt

SEQ ID NO: 321903 - DNA, 18 bp, Homo sapiens
ctcttagcagcttccaga

SEQ ID NO: 321904 - DNA, 21 bp, Homo sapiens
ctcttagcattttaattagat

SEQ ID NO: 321905 - DNA, 17 bp, Homo sapiens
ctcttagcttacaggaa

SEQ ID NO: 321906 - DNA, 19 bp, Homo sapiens
ctcttagcttacaggaagc

SEQ ID NO: 321907 - DNA, 17 bp, Homo sapiens
ctcttagcttttctgca

SEQ ID NO: 321908 - DNA, 19 bp, Homo sapiens
ctcttaggaagagaaacca

SEQ ID NO: 321909 - DNA, 14 bp, Homo sapiens
ctcttagtttttaa

SEQ ID NO: 321910 - DNA, 17 bp, Homo sapiens
ctcttagtttttaaaaa

SEQ ID NO: 321911 - DNA, 23 bp, Homo sapiens
ctcttagtttttaaaaaggcctt

SEQ ID NO: 321912 - DNA, 17 bp, Homo sapiens
ctcttatagaatattta

SEQ ID NO: 321913 - DNA, 12 bp, Homo sapiens
ctcttatgaaat

SEQ ID NO: 321914 - DNA, 13 bp, Homo sapiens
ctcttatgccatt

SEQ ID NO: 321915 - DNA, 18 bp, Homo sapiens
ctcttatgccatttgttt

SEQ ID NO: 321916 - DNA, 22 bp, Homo sapiens
ctcttattacagagggaaaggc

SEQ ID NO: 321917 - DNA, 12 bp, Homo sapiens
ctcttattctaa

SEQ ID NO: 321918 - DNA, 16 bp, Homo sapiens
ctcttcaactgaccag

SEQ ID NO: 321919 - DNA, 20 bp, Homo sapiens
ctcttcaactgaccagcctc

SEQ ID NO: 321920 - DNA, 13 bp, Homo sapiens
ctcttcaaggcca

SEQ ID NO: 321921 - DNA, 15 bp, Homo sapiens
ctcttcaccaggaag

SEQ ID NO: 321922 - DNA, 16 bp, Homo sapiens
ctcttcaccttggttt

SEQ ID NO: 321923 - DNA, 17 bp, Homo sapiens
ctcttcaccttggttta

SEQ ID NO: 321924 - DNA, 19 bp, Homo sapiens
ctcttcagcctcattcact

SEQ ID NO: 321925 - DNA, 14 bp, Homo sapiens
ctcttcaggcctcc

SEQ ID NO: 321926 - DNA, 15 bp, Homo sapiens
ctcttcaggcctccc

SEQ ID NO: 321927 - DNA, 18 bp, Homo sapiens
ctcttcaggcctccctct

SEQ ID NO: 321928 - DNA, 15 bp, Homo sapiens
ctcttcattcccact

SEQ ID NO: 321929 - DNA, 18 bp, Homo sapiens
ctcttcattcccactgca

SEQ ID NO: 321930 - DNA, 22 bp, Homo sapiens
ctcttccagaagatgccctcca

SEQ ID NO: 321931 - DNA, 14 bp, Homo sapiens
ctcttccaggaagc

SEQ ID NO: 321932 - DNA, 19 bp, Homo sapiens
ctcttccaggaagcacagg

SEQ ID NO: 321933 - DNA, 20 bp, Homo sapiens
ctcttcccccatgtgcctgt

SEQ ID NO: 321934 - DNA, 14 bp, Homo sapiens
ctcttcccccttcc

SEQ ID NO: 321935 - DNA, 17 bp, Homo sapiens
ctcttcccccttcccct

SEQ ID NO: 321936 - DNA, 19 bp, Homo sapiens
ctcttccggagatgtagca

SEQ ID NO: 321937 - DNA, 23 bp, Homo sapiens
ctcttccggagatgtagcaaaac

SEQ ID NO: 321938 - DNA, 12 bp, Homo sapiens
ctcttcctaccc

SEQ ID NO: 321939 - DNA, 15 bp, Homo sapiens
ctcttcctacccaac

SEQ ID NO: 321940 - DNA, 20 bp, Homo sapiens
ctcttcctacccaaccactc

SEQ ID NO: 321941 - DNA, 16 bp, Homo sapiens
ctcttcctcatcctgc

SEQ ID NO: 321942 - DNA, 17 bp, Homo sapiens
ctcttcctcatcctgct

SEQ ID NO: 321943 - DNA, 19 bp, Homo sapiens
ctcttcctccaaagcctgg

SEQ ID NO: 321944 - DNA, 21 bp, Homo sapiens
ctcttcctctgcaggacacag

SEQ ID NO: 321945 - DNA, 19 bp, Homo sapiens
ctcttcctggacctgagtc

SEQ ID NO: 321946 - DNA, 11 bp, Homo sapiens
ctcttccttct

SEQ ID NO: 321947 - DNA, 12 bp, Homo sapiens
ctcttccttctc

SEQ ID NO: 321948 - DNA, 23 bp, Homo sapiens
ctcttccttgctttctcttctaa

SEQ ID NO: 321949 - DNA, 14 bp, Homo sapiens
ctcttcgctgtgat

SEQ ID NO: 321950 - DNA, 15 bp, Homo sapiens
ctcttcgctgtgatg

SEQ ID NO: 321951 - DNA, 17 bp, Homo sapiens
ctcttcgctgtgatgca

SEQ ID NO: 321952 - DNA, 16 bp, Homo sapiens
ctcttctcagctccac

SEQ ID NO: 321953 - DNA, 14 bp, Homo sapiens
ctcttctccactgg

SEQ ID NO: 321954 - DNA, 15 bp, Homo sapiens
ctcttctcctttcac

SEQ ID NO: 321955 - DNA, 15 bp, Homo sapiens
ctcttctctgggccc

SEQ ID NO: 321956 - DNA, 18 bp, Homo sapiens
ctcttctgctccaccctt

SEQ ID NO: 321957 - DNA, 23 bp, Homo sapiens
ctcttctgggcagagcctgtccc

SEQ ID NO: 321958 - DNA, 22 bp, Homo sapiens
ctcttctgtattttttttttcc

SEQ ID NO: 321959 - DNA, 17 bp, Homo sapiens
ctcttcttgagcagacc

SEQ ID NO: 321960 - DNA, 22 bp, Homo sapiens
ctcttcttgcggcaccgcccac

SEQ ID NO: 321961 - DNA, 22 bp, Homo sapiens
ctcttgaaaaatgcccatttgc

SEQ ID NO: 321962 - DNA, 19 bp, Homo sapiens
ctcttgaataaaaataact

SEQ ID NO: 321963 - DNA, 16 bp, Homo sapiens
ctcttgagaggggtga

SEQ ID NO: 321964 - DNA, 22 bp, Homo sapiens
ctcttgagcagtggctggtcca

SEQ ID NO: 321965 - DNA, 20 bp, Homo sapiens
ctcttgagccctcctggaat

SEQ ID NO: 321966 - DNA, 19 bp, Homo sapiens
ctcttgagggtcattttcc

SEQ ID NO: 321967 - DNA, 16 bp, Homo sapiens
ctcttgatgtgaagat

SEQ ID NO: 321968 - DNA, 24 bp, Homo sapiens
ctcttgattcataatgacttaagc

SEQ ID NO: 321969 - DNA, 21 bp, Homo sapiens
ctcttgcatcctcctcccaac

SEQ ID NO: 321970 - DNA, 23 bp, Homo sapiens
ctcttgcatctgggccagaagtc

SEQ ID NO: 321971 - DNA, 17 bp, Homo sapiens
ctcttgccactgcctct

SEQ ID NO: 321972 - DNA, 18 bp, Homo sapiens
ctcttgccactgcctctt

SEQ ID NO: 321973 - DNA, 22 bp, Homo sapiens
ctcttgccccccaccccagcct

SEQ ID NO: 321974 - DNA, 16 bp, Homo sapiens
ctcttgccgaggagcc

SEQ ID NO: 321975 - DNA, 15 bp, Homo sapiens
ctcttgcctctctca

SEQ ID NO: 321976 - DNA, 12 bp, Homo sapiens
ctcttgctcaaa

SEQ ID NO: 321977 - DNA, 20 bp, Homo sapiens
ctcttgctcaaaaatctgtt

SEQ ID NO: 321978 - DNA, 11 bp, Homo sapiens
ctcttgctcac

SEQ ID NO: 321979 - DNA, 18 bp, Homo sapiens
ctcttgctcactccctaa

SEQ ID NO: 321980 - DNA, 15 bp, Homo sapiens
ctcttgctcagagct

SEQ ID NO: 321981 - DNA, 14 bp, Homo sapiens
ctcttgctctttct

SEQ ID NO: 321982 - DNA, 17 bp, Homo sapiens
ctcttggactccctccc

SEQ ID NO: 321983 - DNA, 15 bp, Homo sapiens
ctcttggctggcttc

SEQ ID NO: 321984 - DNA, 20 bp, Homo sapiens
ctcttgggagacgtccaccc

SEQ ID NO: 321985 - DNA, 15 bp, Homo sapiens
ctcttgggctgagac

SEQ ID NO: 321986 - DNA, 22 bp, Homo sapiens
ctcttggtctctttctttccaa

SEQ ID NO: 321987 - DNA, 14 bp, Homo sapiens
ctcttgtacagtta

SEQ ID NO: 321988 - DNA, 17 bp, Homo sapiens
ctcttgttgagttctgt

SEQ ID NO: 321989 - DNA, 15 bp, Homo sapiens
ctaaaattgggcttg

SEQ ID NO: 321990 - DNA, 18 bp, Homo sapiens
ctaaaattgtatgaaaat

SEQ ID NO: 321991 - DNA, 22 bp, Homo sapiens
ctaaaattgtatgaaaatcctt

SEQ ID NO: 321992 - DNA, 16 bp, Homo sapiens
ctaaacagactattta

SEQ ID NO: 321993 - DNA, 12 bp, Homo sapiens
ctaaacagatat

SEQ ID NO: 321994 - DNA, 13 bp, Homo sapiens
ctaaacagatata

SEQ ID NO: 321995 - DNA, 17 bp, Homo sapiens
ctaaacagatataaatg

SEQ ID NO: 321996 - DNA, 18 bp, Homo sapiens
ctaaacagatgtccctga

SEQ ID NO: 321997 - DNA, 19 bp, Homo sapiens
ctaaagaatagtgcctcag

SEQ ID NO: 321998 - DNA, 23 bp, Homo sapiens
ctaaagaggtggggtgaagctgg

SEQ ID NO: 321999 - DNA, 19 bp, Homo sapiens
ctaaagatatcagagctct

SEQ ID NO: 322000 - DNA, 13 bp, Homo sapiens
ctaaagcaggcct

SEQ ID NO: 322001 - DNA, 11 bp, Homo sapiens
ctaaagcagtg

SEQ ID NO: 322002 - DNA, 17 bp, Homo sapiens
ctaaagcagtgttttca

SEQ ID NO: 322003 - DNA, 15 bp, Homo sapiens
ctaaagccctcttca

SEQ ID NO: 322004 - DNA, 14 bp, Homo sapiens
ctaaaggactggtt

SEQ ID NO: 322005 - DNA, 17 bp, Homo sapiens
ctaaaggatagatcaaa

SEQ ID NO: 322006 - DNA, 15 bp, Homo sapiens
ctaaaggggacagat

SEQ ID NO: 322007 - DNA, 16 bp, Homo sapiens
ctaaaggggagaaact

SEQ ID NO: 322008 - DNA, 17 bp, Homo sapiens
ctaaaggggagaaactg

SEQ ID NO: 322009 - DNA, 18 bp, Homo sapiens
ctaaagggtgtgggtcag

SEQ ID NO: 322010 - DNA, 23 bp, Homo sapiens
ctaaagggtgtgggtcagggagg

SEQ ID NO: 322011 - DNA, 17 bp, Homo sapiens
ctaaagtgttggtcttt

SEQ ID NO: 322012 - DNA, 22 bp, Homo sapiens
ctcagttcccttggcctcagaa

SEQ ID NO: 322013 - DNA, 16 bp, Homo sapiens
ctcagttctctccctt

SEQ ID NO: 322014 - DNA, 14 bp, Homo sapiens
ctcagttggaatca

SEQ ID NO: 322015 - DNA, 13 bp, Homo sapiens
ctcagttgtactt

SEQ ID NO: 322016 - DNA, 14 bp, Homo sapiens
ctcagttgtacttt

SEQ ID NO: 322017 - DNA, 16 bp, Homo sapiens
ctcagtttctccatca

SEQ ID NO: 322018 - DNA, 14 bp, Homo sapiens
ctcagtttggctgt

SEQ ID NO: 322019 - DNA, 15 bp, Homo sapiens
ctcagtttttgctga

SEQ ID NO: 322020 - DNA, 17 bp, Homo sapiens
ctcataaggcatataca

SEQ ID NO: 322021 - DNA, 15 bp, Homo sapiens
ctcatactgtcatat

SEQ ID NO: 322022 - DNA, 12 bp, Homo sapiens
ctcatagcatta

SEQ ID NO: 322023 - DNA, 14 bp, Homo sapiens
ctcatagcattaac

SEQ ID NO: 322024 - DNA, 19 bp, Homo sapiens
ctcatatacttgaatatta

SEQ ID NO: 322025 - DNA, 21 bp, Homo sapiens
ctcatatgctatgttagaagt

SEQ ID NO: 322026 - DNA, 20 bp, Homo sapiens
ctcatatggtctaccagttt

SEQ ID NO: 322027 - DNA, 20 bp, Homo sapiens
ctcatcagaaacaatttctg

SEQ ID NO: 322028 - DNA, 12 bp, Homo sapiens
ctcatcaggatg

SEQ ID NO: 322029 - DNA, 22 bp, Homo sapiens
ctcatcaggatgaacccaggac

SEQ ID NO: 322030 - DNA, 12 bp, Homo sapiens
ctcatcataaaa

SEQ ID NO: 322031 - DNA, 13 bp, Homo sapiens
ctcatccacagag

SEQ ID NO: 322032 - DNA, 15 bp, Homo sapiens
ctcatccacagaggc

SEQ ID NO: 322033 - DNA, 21 bp, Homo sapiens
ctcatccactaggtgcccagt

SEQ ID NO: 322034 - DNA, 22 bp, Homo sapiens
ctcatccactaggtgcccagtc

SEQ ID NO: 322035 - DNA, 22 bp, Homo sapiens
ctcatccaggtcctttccttct

SEQ ID NO: 322036 - DNA, 15 bp, Homo sapiens
ctcatccccaaactg

SEQ ID NO: 322037 - DNA, 21 bp, Homo sapiens
ctcatccccaaactgtagtaa

SEQ ID NO: 322038 - DNA, 13 bp, Homo sapiens
ctcatccccaggg

SEQ ID NO: 322039 - DNA, 14 bp, Homo sapiens
ctcatccccagggg

SEQ ID NO: 322040 - DNA, 22 bp, Homo sapiens
ctcatccccaggggtcccagcc

SEQ ID NO: 322041 - DNA, 17 bp, Homo sapiens
ctcatccctcggaagcc

SEQ ID NO: 322042 - DNA, 15 bp, Homo sapiens
ctcatcctgcttctc

SEQ ID NO: 322043 - DNA, 22 bp, Homo sapiens
ctcatcggagactgccccacgg

SEQ ID NO: 322044 - DNA, 15 bp, Homo sapiens
cagcctcttaaagct

SEQ ID NO: 322045 - DNA, 21 bp, Homo sapiens
cagcctcttaaagctgcctgt

SEQ ID NO: 322046 - DNA, 13 bp, Homo sapiens
cagcctcttactt

SEQ ID NO: 322047 - DNA, 17 bp, Homo sapiens
cagcctcttgctcagag

SEQ ID NO: 322048 - DNA, 13 bp, Homo sapiens
cagcctgacctga

SEQ ID NO: 322049 - DNA, 12 bp, Homo sapiens
cagcctgagcca

SEQ ID NO: 322050 - DNA, 15 bp, Homo sapiens
cagcctgagccacag

SEQ ID NO: 322051 - DNA, 11 bp, Homo sapiens
cagcctgagct

SEQ ID NO: 322052 - DNA, 16 bp, Homo sapiens
cagcctgagctccacc

SEQ ID NO: 322053 - DNA, 19 bp, Homo sapiens
cagcctgagtctcctgtgc

SEQ ID NO: 322054 - DNA, 22 bp, Homo sapiens
cagcctgagtctcctgtgccca

SEQ ID NO: 322055 - DNA, 14 bp, Homo sapiens
cagcctgatggcca

SEQ ID NO: 322056 - DNA, 16 bp, Homo sapiens
cagcctgatggccaag

SEQ ID NO: 322057 - DNA, 15 bp, Homo sapiens
cagcctgcacacacc

SEQ ID NO: 322058 - DNA, 16 bp, Homo sapiens
cagcctgctgagagcc

SEQ ID NO: 322059 - DNA, 23 bp, Homo sapiens
cagcctgcttcccacctccctgc

SEQ ID NO: 322060 - DNA, 18 bp, Homo sapiens
cagcctgcttcttcccca

SEQ ID NO: 322061 - DNA, 11 bp, Homo sapiens
cagcctggagc

SEQ ID NO: 322062 - DNA, 10 bp, Homo sapiens
cagcctggca

SEQ ID NO: 322063 - DNA, 13 bp, Homo sapiens
cagcctggcacag

SEQ ID NO: 322064 - DNA, 20 bp, Homo sapiens
cagcctggcacagggcagtg

SEQ ID NO: 322065 - DNA, 18 bp, Homo sapiens
cagcctggccacgcagcc

SEQ ID NO: 322066 - DNA, 20 bp, Homo sapiens
cagcctggccacgcagccag

SEQ ID NO: 322067 - DNA, 21 bp, Homo sapiens
cagcctggccacgcagccagg

SEQ ID NO: 322068 - DNA, 22 bp, Homo sapiens
cagcctggccacgcagccagga

SEQ ID NO: 322069 - DNA, 14 bp, Homo sapiens
cagcctggcctccc

SEQ ID NO: 322070 - DNA, 12 bp, Homo sapiens
cagcctggctcc

SEQ ID NO: 322071 - DNA, 19 bp, Homo sapiens
cagcctggctcccaggaca

SEQ ID NO: 322072 - DNA, 18 bp, Homo sapiens
cagcctgggactcccagt

SEQ ID NO: 322073 - DNA, 21 bp, Homo sapiens
cagcctgggactcccagtgaa

SEQ ID NO: 322074 - DNA, 19 bp, Homo sapiens
cagcctgggcagccaggct

SEQ ID NO: 322075 - DNA, 15 bp, Homo sapiens
cagcctggggcctgg

SEQ ID NO: 322076 - DNA, 18 bp, Homo sapiens
cagcctggggcctggcag

SEQ ID NO: 322077 - DNA, 19 bp, Homo sapiens
cagcctggggcctggcagg

SEQ ID NO: 322078 - DNA, 17 bp, Homo sapiens
cagcctgggtgacagag

SEQ ID NO: 322079 - DNA, 15 bp, Homo sapiens
cagcctggttccctc

SEQ ID NO: 322080 - DNA, 17 bp, Homo sapiens
cagcctggttccctctt

SEQ ID NO: 322081 - DNA, 18 bp, Homo sapiens
cagcctggttccctcttt

SEQ ID NO: 322082 - DNA, 19 bp, Homo sapiens
cagcctggttccctctttc

SEQ ID NO: 322083 - DNA, 17 bp, Homo sapiens
cagcctgtcctggtaca

SEQ ID NO: 322084 - DNA, 19 bp, Homo sapiens
cagcctgtggcatctttgc

SEQ ID NO: 322085 - DNA, 19 bp, Homo sapiens
cagcctgtttgggaggctg

SEQ ID NO: 322086 - DNA, 16 bp, Homo sapiens
cagccttagcatcccc

SEQ ID NO: 322087 - DNA, 20 bp, Homo sapiens
cagccttagcatcccctgtg

SEQ ID NO: 322088 - DNA, 18 bp, Homo sapiens
cagccttagctgccagtg

SEQ ID NO: 322089 - DNA, 21 bp, Homo sapiens
cagccttcctctgcagctgac

SEQ ID NO: 322090 - DNA, 22 bp, Homo sapiens
cagccttcctctgcagctgacc

SEQ ID NO: 322091 - DNA, 22 bp, Homo sapiens
cagccttgaccacggctgttcc

SEQ ID NO: 322092 - DNA, 22 bp, Homo sapiens
cagcctttctgtatcaagcccc

SEQ ID NO: 322093 - DNA, 17 bp, Homo sapiens
cagcctttgcctccccg

SEQ ID NO: 322094 - DNA, 15 bp, Homo sapiens
cagcgacagaaaacc

SEQ ID NO: 322095 - DNA, 23 bp, Homo sapiens
cagcgagacccttgcattagaaa

SEQ ID NO: 322096 - DNA, 19 bp, Homo sapiens
cagcgaggcgaggctgcct

SEQ ID NO: 322097 - DNA, 20 bp, Homo sapiens
cagcgagtctggagaccagg

SEQ ID NO: 322098 - DNA, 19 bp, Homo sapiens
cagcgcaggccctggtgga

SEQ ID NO: 322099 - DNA, 20 bp, Homo sapiens
cagcgcctcaagggtagggt

SEQ ID NO: 322100 - DNA, 13 bp, Homo sapiens
cagcgcctcctgg

SEQ ID NO: 322101 - DNA, 14 bp, Homo sapiens
cagcgcctcctgga

SEQ ID NO: 322102 - DNA, 19 bp, Homo sapiens
cagcgcctgtgctgaggac

SEQ ID NO: 322103 - DNA, 14 bp, Homo sapiens
cagcgctccctgtc

SEQ ID NO: 322104 - DNA, 15 bp, Homo sapiens
cagcgctccctgtcg

SEQ ID NO: 322105 - DNA, 13 bp, Homo sapiens
cagcgctcctgga

SEQ ID NO: 322106 - DNA, 12 bp, Homo sapiens
cagcgctgccca

SEQ ID NO: 322107 - DNA, 13 bp, Homo sapiens
cagcgctgcccac

SEQ ID NO: 322108 - DNA, 14 bp, Homo sapiens
cagcgctgcccaca

SEQ ID NO: 322109 - DNA, 19 bp, Homo sapiens
cagcgctggcagcgctcct

SEQ ID NO: 322110 - DNA, 15 bp, Homo sapiens
cagcggcccctccca

SEQ ID NO: 322111 - DNA, 19 bp, Homo sapiens
cagcggcccctcccacaca

SEQ ID NO: 322112 - DNA, 19 bp, Homo sapiens
cagcggcccggcccacgca

SEQ ID NO: 322113 - DNA, 20 bp, Homo sapiens
cagcggcccggcccacgcag

SEQ ID NO: 322114 - DNA, 19 bp, Homo sapiens
cagcgggagacctgtgcta

SEQ ID NO: 322115 - DNA, 18 bp, Homo sapiens
cagcgggcgctgctggga

SEQ ID NO: 322116 - DNA, 18 bp, Homo sapiens
cagcggggccccagggct

SEQ ID NO: 322117 - DNA, 18 bp, Homo sapiens
cagcggtggaaggagcct

SEQ ID NO: 322118 - DNA, 15 bp, Homo sapiens
cagcggtttggggag

SEQ ID NO: 322119 - DNA, 14 bp, Homo sapiens
cagcgtcccagtct

SEQ ID NO: 322120 - DNA, 21 bp, Homo sapiens
cagcgtcccagtctctggcag

SEQ ID NO: 322121 - DNA, 22 bp, Homo sapiens
cagcgtccggggtggtggacag

SEQ ID NO: 322122 - DNA, 14 bp, Homo sapiens
cagcgtggcctccg

SEQ ID NO: 322123 - DNA, 17 bp, Homo sapiens
cagcgttcttcaggaga

SEQ ID NO: 322124 - DNA, 24 bp, Homo sapiens
cagcgtttagtttctagaggcctc

SEQ ID NO: 322125 - DNA, 21 bp, Homo sapiens
cagctaaaagcatccctgtga

SEQ ID NO: 322126 - DNA, 15 bp, Homo sapiens
cagctaaagaggtgg

SEQ ID NO: 322127 - DNA, 17 bp, Homo sapiens
cagctaagcctgatgat

SEQ ID NO: 322128 - DNA, 17 bp, Homo sapiens
cagctaatctgtagggc

SEQ ID NO: 322129 - DNA, 15 bp, Homo sapiens
cagctacatgggagg

SEQ ID NO: 322130 - DNA, 12 bp, Homo sapiens
cagctacattcc

SEQ ID NO: 322131 - DNA, 18 bp, Homo sapiens
cagctacattcctcagct

SEQ ID NO: 322132 - DNA, 18 bp, Homo sapiens
cagctaccaggtgttcta

SEQ ID NO: 322133 - DNA, 13 bp, Homo sapiens
cagctaccccttc

SEQ ID NO: 322134 - DNA, 23 bp, Homo sapiens
cagctaccccttctttgcagggc

SEQ ID NO: 322135 - DNA, 13 bp, Homo sapiens
cagctacctgaga

SEQ ID NO: 322136 - DNA, 16 bp, Homo sapiens
cagctactaacctgga

SEQ ID NO: 322137 - DNA, 21 bp, Homo sapiens
cagctactaacctggagacag

SEQ ID NO: 322138 - DNA, 22 bp, Homo sapiens
cagctactaacctggagacagt

SEQ ID NO: 322139 - DNA, 18 bp, Homo sapiens
cagctactctgtccaggc

SEQ ID NO: 322140 - DNA, 20 bp, Homo sapiens
cagctactctgtccaggcca

SEQ ID NO: 322141 - DNA, 19 bp, Homo sapiens
cagctacttgggagcctga

SEQ ID NO: 322142 - DNA, 18 bp, Homo sapiens
ctccacgggggcctagtg

SEQ ID NO: 322143 - DNA, 19 bp, Homo sapiens
ctccacgggggcctagtgg

SEQ ID NO: 322144 - DNA, 17 bp, Homo sapiens
ctccacggtgcgtggct

SEQ ID NO: 322145 - DNA, 19 bp, Homo sapiens
ctccacggtgcgtggctgt

SEQ ID NO: 322146 - DNA, 21 bp, Homo sapiens
ctccacggtgcgtggctgtgg

SEQ ID NO: 322147 - DNA, 22 bp, Homo sapiens
ctccacggtgcgtggctgtggc

SEQ ID NO: 322148 - DNA, 23 bp, Homo sapiens
ctccacggtgcgtggctgtggca

SEQ ID NO: 322149 - DNA, 12 bp, Homo sapiens
ctccactcaggg

SEQ ID NO: 322150 - DNA, 13 bp, Homo sapiens
ctccactcagggc

SEQ ID NO: 322151 - DNA, 16 bp, Homo sapiens
ctccactcagggctgg

SEQ ID NO: 322152 - DNA, 9 bp, Homo sapiens
ctccactcc

SEQ ID NO: 322153 - DNA, 13 bp, Homo sapiens
ctccactccccca

SEQ ID NO: 322154 - DNA, 18 bp, Homo sapiens
ctccactcccccacctga

SEQ ID NO: 322155 - DNA, 15 bp, Homo sapiens
ctccactcccctcat

SEQ ID NO: 322156 - DNA, 13 bp, Homo sapiens
ctccactcctccc

SEQ ID NO: 322157 - DNA, 16 bp, Homo sapiens
ctccactcctcccaac

SEQ ID NO: 322158 - DNA, 22 bp, Homo sapiens
ctccactccttcctgccacctg

SEQ ID NO: 322159 - DNA, 21 bp, Homo sapiens
ctccactctccttcgtgtctc

SEQ ID NO: 322160 - DNA, 18 bp, Homo sapiens
ctccactgacctggaaga

SEQ ID NO: 322161 - DNA, 15 bp, Homo sapiens
ctccactgccttcga

SEQ ID NO: 322162 - DNA, 16 bp, Homo sapiens
ctccactggatggagg

SEQ ID NO: 322163 - DNA, 14 bp, Homo sapiens
ctccactggcctgc

SEQ ID NO: 322164 - DNA, 18 bp, Homo sapiens
ctccactggcctgcccgt

SEQ ID NO: 322165 - DNA, 13 bp, Homo sapiens
ctccacttctggt

SEQ ID NO: 322166 - DNA, 17 bp, Homo sapiens
ctccagaagcctctggc

SEQ ID NO: 322167 - DNA, 19 bp, Homo sapiens
ctccagaagcctctggcta

SEQ ID NO: 322168 - DNA, 16 bp, Homo sapiens
ctccagaatctgctgt

SEQ ID NO: 322169 - DNA, 17 bp, Homo sapiens
ctccagaatctgctgtt

SEQ ID NO: 322170 - DNA, 21 bp, Homo sapiens
ctccagaatctgctgttgcca

SEQ ID NO: 322171 - DNA, 22 bp, Homo sapiens
ctccagaatctgctgttgccat

SEQ ID NO: 322172 - DNA, 21 bp, Homo sapiens
ctccagaatttcccaaagcag

SEQ ID NO: 322173 - DNA, 15 bp, Homo sapiens
ctccagacattgtat

SEQ ID NO: 322174 - DNA, 16 bp, Homo sapiens
ctccagaccaccagcc

SEQ ID NO: 322175 - DNA, 21 bp, Homo sapiens
ctccagacccctaccctttcc

SEQ ID NO: 322176 - DNA, 14 bp, Homo sapiens
ctccagacccctgg

SEQ ID NO: 322177 - DNA, 19 bp, Homo sapiens
ctccagacccctggctttt

SEQ ID NO: 322178 - DNA, 21 bp, Homo sapiens
ctccagacccctggcttttca

SEQ ID NO: 322179 - DNA, 13 bp, Homo sapiens
ctccagaccctgc

SEQ ID NO: 322180 - DNA, 14 bp, Homo sapiens
ctccagaccctgcc

SEQ ID NO: 322181 - DNA, 15 bp, Homo sapiens
ctccagaccctgcct

SEQ ID NO: 322182 - DNA, 17 bp, Homo sapiens
ctccagaccctgcctga

SEQ ID NO: 322183 - DNA, 16 bp, Homo sapiens
cagctccgcctggcac

SEQ ID NO: 322184 - DNA, 17 bp, Homo sapiens
cagctccgcctggcacc

SEQ ID NO: 322185 - DNA, 23 bp, Homo sapiens
cagctccgcctggcacccactcc

SEQ ID NO: 322186 - DNA, 13 bp, Homo sapiens
cagctcctctcct

SEQ ID NO: 322187 - DNA, 14 bp, Homo sapiens
cagctcctctcctt

SEQ ID NO: 322188 - DNA, 17 bp, Homo sapiens
cagctcctctccttggg

SEQ ID NO: 322189 - DNA, 21 bp, Homo sapiens
cagctcctctccttgggctcc

SEQ ID NO: 322190 - DNA, 22 bp, Homo sapiens
cagctcctctccttgggctcct

SEQ ID NO: 322191 - DNA, 16 bp, Homo sapiens
cagctccttaaactga

SEQ ID NO: 322192 - DNA, 19 bp, Homo sapiens
cagctccttggttccctct

SEQ ID NO: 322193 - DNA, 14 bp, Homo sapiens
cagctccttttctg

SEQ ID NO: 322194 - DNA, 19 bp, Homo sapiens
cagctccttttgtccccag

SEQ ID NO: 322195 - DNA, 22 bp, Homo sapiens
cagctccttttgtccccagggc

SEQ ID NO: 322196 - DNA, 22 bp, Homo sapiens
cagctcgtttttcagcaccccc

SEQ ID NO: 322197 - DNA, 23 bp, Homo sapiens
cagctcgtttttcagcaccccca

SEQ ID NO: 322198 - DNA, 16 bp, Homo sapiens
cagctctaataaaaca

SEQ ID NO: 322199 - DNA, 17 bp, Homo sapiens
cagctctagacaaccct

SEQ ID NO: 322200 - DNA, 15 bp, Homo sapiens
cagctctcactggcc

SEQ ID NO: 322201 - DNA, 13 bp, Homo sapiens
cagctctccagtc

SEQ ID NO: 322202 - DNA, 13 bp, Homo sapiens
cagctctcccaca

SEQ ID NO: 322203 - DNA, 14 bp, Homo sapiens
cagctctcccacat

SEQ ID NO: 322204 - DNA, 20 bp, Homo sapiens
cagctctcccacatcccact

SEQ ID NO: 322205 - DNA, 15 bp, Homo sapiens
cagctctctgcagaa

SEQ ID NO: 322206 - DNA, 20 bp, Homo sapiens
cagctctctgggacctcctt

SEQ ID NO: 322207 - DNA, 15 bp, Homo sapiens
cagctctgaccctga

SEQ ID NO: 322208 - DNA, 12 bp, Homo sapiens
cagctctgagac

SEQ ID NO: 322209 - DNA, 20 bp, Homo sapiens
cagctctgcccccgcgggtt

SEQ ID NO: 322210 - DNA, 23 bp, Homo sapiens
cagctctgcccccgcgggttcta

SEQ ID NO: 322211 - DNA, 17 bp, Homo sapiens
cagctctggctcacaga

SEQ ID NO: 322212 - DNA, 13 bp, Homo sapiens
cagctctgtggcc

SEQ ID NO: 322213 - DNA, 15 bp, Homo sapiens
cagctctgtggcctg

SEQ ID NO: 322214 - DNA, 19 bp, Homo sapiens
cagctctgtggcctgtgtc

SEQ ID NO: 322215 - DNA, 13 bp, Homo sapiens
cagctcttctggg

SEQ ID NO: 322216 - DNA, 23 bp, Homo sapiens
cagctcttctgggcagagcctgt

SEQ ID NO: 322217 - DNA, 19 bp, Homo sapiens
cagctcttggcattttcct

SEQ ID NO: 322218 - DNA, 11 bp, Homo sapiens
cagctcttgtt

SEQ ID NO: 322219 - DNA, 15 bp, Homo sapiens
cagctcttgtttgga

SEQ ID NO: 322220 - DNA, 13 bp, Homo sapiens
cagctctttcctc

SEQ ID NO: 322221 - DNA, 19 bp, Homo sapiens
cagctctttcctccttcca

SEQ ID NO: 322222 - DNA, 16 bp, Homo sapiens
cagctgaaaagtaaat

SEQ ID NO: 322223 - DNA, 22 bp, Homo sapiens
cagctgaaacattccgaagagg

SEQ ID NO: 322224 - DNA, 20 bp, Homo sapiens
cagctgaagtctctttttct

SEQ ID NO: 322225 - DNA, 15 bp, Homo sapiens
cagctgacatggagt

SEQ ID NO: 322226 - DNA, 15 bp, Homo sapiens
cagctgactgtggcc

SEQ ID NO: 322227 - DNA, 19 bp, Homo sapiens
cagctgactgtggccccct

SEQ ID NO: 322228 - DNA, 20 bp, Homo sapiens
cagctgactgtggccccctc

SEQ ID NO: 322229 - DNA, 22 bp, Homo sapiens
cagctgagaaaatgagtgacta

SEQ ID NO: 322230 - DNA, 21 bp, Homo sapiens
cagctgagagacttttaatca

SEQ ID NO: 322231 - DNA, 14 bp, Homo sapiens
cagctgagatgtgg

SEQ ID NO: 322232 - DNA, 19 bp, Homo sapiens
cagctgaggacacacccca

SEQ ID NO: 322233 - DNA, 22 bp, Homo sapiens
cagctgaggacacaccccacac

SEQ ID NO: 322234 - DNA, 20 bp, Homo sapiens
cagctgaggtctcttgaggg

SEQ ID NO: 322235 - DNA, 12 bp, Homo sapiens
cagctgatttta

SEQ ID NO: 322236 - DNA, 17 bp, Homo sapiens
cagctgattttaacaat

SEQ ID NO: 322237 - DNA, 20 bp, Homo sapiens
cagctgattttaacaataac

SEQ ID NO: 322238 - DNA, 20 bp, Homo sapiens
cagctgcacattcctggccc

SEQ ID NO: 322239 - DNA, 21 bp, Homo sapiens
cagctgcagttgaagagcctg

SEQ ID NO: 322240 - DNA, 13 bp, Homo sapiens
cagctgccaagca

SEQ ID NO: 322241 - DNA, 19 bp, Homo sapiens
cagctgccaagtgctcttt

SEQ ID NO: 322242 - DNA, 10 bp, Homo sapiens
cagctgcccc

SEQ ID NO: 322243 - DNA, 15 bp, Homo sapiens
cagctgcccccgctc

SEQ ID NO: 322244 - DNA, 12 bp, Homo sapiens
cagctgcccctc

SEQ ID NO: 322245 - DNA, 21 bp, Homo sapiens
cagctgcctctgccactgact

SEQ ID NO: 322246 - DNA, 12 bp, Homo sapiens
cagctgcctgca

SEQ ID NO: 322247 - DNA, 13 bp, Homo sapiens
cagctgccttcct

SEQ ID NO: 322248 - DNA, 18 bp, Homo sapiens
cagctgccttcctcatcc

SEQ ID NO: 322249 - DNA, 15 bp, Homo sapiens
cagctgctcccctcc

SEQ ID NO: 322250 - DNA, 21 bp, Homo sapiens
cagctgctcccctccctcctc

SEQ ID NO: 322251 - DNA, 15 bp, Homo sapiens
cagctgctcctcgca

SEQ ID NO: 322252 - DNA, 11 bp, Homo sapiens
cagctgctctg

SEQ ID NO: 322253 - DNA, 14 bp, Homo sapiens
cagctgctctgccc

SEQ ID NO: 322254 - DNA, 21 bp, Homo sapiens
cagctgctctgcccagagctg

SEQ ID NO: 322255 - DNA, 22 bp, Homo sapiens
cagctgctctgcccagagctgg

SEQ ID NO: 322256 - DNA, 23 bp, Homo sapiens
cagctgctctgcccagagctggg

SEQ ID NO: 322257 - DNA, 21 bp, Homo sapiens
cagctgctctgccccttgggc

SEQ ID NO: 322258 - DNA, 22 bp, Homo sapiens
cagctgctcttagtgcccgcct

SEQ ID NO: 322259 - DNA, 13 bp, Homo sapiens
cagctgctggcca

SEQ ID NO: 322260 - DNA, 13 bp, Homo sapiens
cagctgctgtgcc

SEQ ID NO: 322261 - DNA, 23 bp, Homo sapiens
cagctgctgtgccaggactgtga

SEQ ID NO: 322262 - DNA, 11 bp, Homo sapiens
cagctgcttct

SEQ ID NO: 322263 - DNA, 14 bp, Homo sapiens
cagctgctttgtta

SEQ ID NO: 322264 - DNA, 22 bp, Homo sapiens
cagctgctttgttaccttaaaa

SEQ ID NO: 322265 - DNA, 18 bp, Homo sapiens
cagctggagaaatatggt

SEQ ID NO: 322266 - DNA, 18 bp, Homo sapiens
cagctggcagcgcctccc

SEQ ID NO: 322267 - DNA, 15 bp, Homo sapiens
cagctggcaggagag

SEQ ID NO: 322268 - DNA, 17 bp, Homo sapiens
cagctggcaggagagag

SEQ ID NO: 322269 - DNA, 20 bp, Homo sapiens
cagctggctctccaccttgt

SEQ ID NO: 322270 - DNA, 15 bp, Homo sapiens
cagctgggacccctc

SEQ ID NO: 322271 - DNA, 23 bp, Homo sapiens
cagctgggatttgaaccaggcct

SEQ ID NO: 322272 - DNA, 23 bp, Homo sapiens
ctccatgcctatttactggaaac

SEQ ID NO: 322273 - DNA, 18 bp, Homo sapiens
ctccatgctcctcactgc

SEQ ID NO: 322274 - DNA, 13 bp, Homo sapiens
ctccatgctgcct

SEQ ID NO: 322275 - DNA, 13 bp, Homo sapiens
ctccatggccacc

SEQ ID NO: 322276 - DNA, 15 bp, Homo sapiens
ctccatggccacccc

SEQ ID NO: 322277 - DNA, 13 bp, Homo sapiens
ctccatggcccat

SEQ ID NO: 322278 - DNA, 23 bp, Homo sapiens
ctccatggcccatcactcggctg

SEQ ID NO: 322279 - DNA, 22 bp, Homo sapiens
ctccatggggttcgagactcca

SEQ ID NO: 322280 - DNA, 23 bp, Homo sapiens
ctccatggggttcgagactccat

SEQ ID NO: 322281 - DNA, 18 bp, Homo sapiens
ctccatggtgcctctgga

SEQ ID NO: 322282 - DNA, 19 bp, Homo sapiens
ctccatgtagaagagggag

SEQ ID NO: 322283 - DNA, 14 bp, Homo sapiens
ctccatgtttagaa

SEQ ID NO: 322284 - DNA, 17 bp, Homo sapiens
ctccatttttcccagga

SEQ ID NO: 322285 - DNA, 18 bp, Homo sapiens
ctccatttttcccaggac

SEQ ID NO: 322286 - DNA, 21 bp, Homo sapiens
ctccatttttcccaggacagg

SEQ ID NO: 322287 - DNA, 23 bp, Homo sapiens
ctccatttttcccaggacaggaa

SEQ ID NO: 322288 - DNA, 20 bp, Homo sapiens
ctcccaaataaactccttaa

SEQ ID NO: 322289 - DNA, 22 bp, Homo sapiens
ctcccaaatatgcccctcccca

SEQ ID NO: 322290 - DNA, 18 bp, Homo sapiens
ctcccaacagaggcctcc

SEQ ID NO: 322291 - DNA, 15 bp, Homo sapiens
ctcccaacccattca

SEQ ID NO: 322292 - DNA, 21 bp, Homo sapiens
ctcccaacctcaatgccctgc

SEQ ID NO: 322293 - DNA, 18 bp, Homo sapiens
ctcccaagaacagcaggc

SEQ ID NO: 322294 - DNA, 17 bp, Homo sapiens
ctcccaagcgttcctgg

SEQ ID NO: 322295 - DNA, 22 bp, Homo sapiens
ctcccaagcgttcctggccttc

SEQ ID NO: 322296 - DNA, 22 bp, Homo sapiens
ctcccaagggaggcccatgtga

SEQ ID NO: 322297 - DNA, 21 bp, Homo sapiens
ctcccaagggtgccctttggg

SEQ ID NO: 322298 - DNA, 19 bp, Homo sapiens
ctcccaaggtcctctcagt

SEQ ID NO: 322299 - DNA, 15 bp, Homo sapiens
ctcccacactgctag

SEQ ID NO: 322300 - DNA, 15 bp, Homo sapiens
ctcccacagcttcct

SEQ ID NO: 322301 - DNA, 19 bp, Homo sapiens
ctcccacagcttcctgagg

SEQ ID NO: 322302 - DNA, 14 bp, Homo sapiens
ctcccacaggccct

SEQ ID NO: 322303 - DNA, 22 bp, Homo sapiens
ctcccacccggccacagctgct

SEQ ID NO: 322304 - DNA, 14 bp, Homo sapiens
ctcccacgctggga

SEQ ID NO: 322305 - DNA, 19 bp, Homo sapiens
ctcccacgctgggacacag

SEQ ID NO: 322306 - DNA, 14 bp, Homo sapiens
ctcccactgccagg

SEQ ID NO: 322307 - DNA, 18 bp, Homo sapiens
ctcccagacaggccctcc

SEQ ID NO: 322308 - DNA, 12 bp, Homo sapiens
ctcccagaccca

SEQ ID NO: 322309 - DNA, 17 bp, Homo sapiens
ctcccagacccagggca

SEQ ID NO: 322310 - DNA, 15 bp, Homo sapiens
ctcccagacttgttt

SEQ ID NO: 322311 - DNA, 17 bp, Homo sapiens
ctcccagacttgtttcc

SEQ ID NO: 322312 - DNA, 19 bp, Homo sapiens
ctcccagacttgtttcctg

SEQ ID NO: 322313 - DNA, 15 bp, Homo sapiens
ctcccagaggctcct

SEQ ID NO: 322314 - DNA, 16 bp, Homo sapiens
ctcccagaggctcctg

SEQ ID NO: 322315 - DNA, 22 bp, Homo sapiens
ctcccagaggctcctggagcca

SEQ ID NO: 322316 - DNA, 19 bp, Homo sapiens
ctcccagcagccctaagga

SEQ ID NO: 322317 - DNA, 15 bp, Homo sapiens
ctcccagcatttgtc

SEQ ID NO: 322318 - DNA, 16 bp, Homo sapiens
ctcccagccaccacca

SEQ ID NO: 322319 - DNA, 22 bp, Homo sapiens
ctcccagccacccggatctcca

SEQ ID NO: 322320 - DNA, 12 bp, Homo sapiens
ctcccagcctgc

SEQ ID NO: 322321 - DNA, 14 bp, Homo sapiens
ctcccagcctgctg

SEQ ID NO: 322322 - DNA, 16 bp, Homo sapiens
ctcccagcctgctgag

SEQ ID NO: 322323 - DNA, 18 bp, Homo sapiens
ctcccagctctagacaac

SEQ ID NO: 322324 - DNA, 20 bp, Homo sapiens
ctcccagctctagacaaccc

SEQ ID NO: 322325 - DNA, 23 bp, Homo sapiens
ctcccagctctagacaaccctgc

SEQ ID NO: 322326 - DNA, 21 bp, Homo sapiens
ctcccagctggtgtcactctg

SEQ ID NO: 322327 - DNA, 16 bp, Homo sapiens
ctcccaggacgcaggg

SEQ ID NO: 322328 - DNA, 19 bp, Homo sapiens
ctcccaggacgcagggaga

SEQ ID NO: 322329 - DNA, 23 bp, Homo sapiens
ctcccaggacgcagggagaccct

SEQ ID NO: 322330 - DNA, 19 bp, Homo sapiens
ctcccaggcgccccttccc

SEQ ID NO: 322331 - DNA, 20 bp, Homo sapiens
ctcccaggcgccccttcccc

SEQ ID NO: 322332 - DNA, 14 bp, Homo sapiens
ctcccagggccatg

SEQ ID NO: 322333 - DNA, 20 bp, Homo sapiens
ctcccagggccatgaacttt

SEQ ID NO: 322334 - DNA, 15 bp, Homo sapiens
ctcccagggcccgag

SEQ ID NO: 322335 - DNA, 20 bp, Homo sapiens
ctcccaggtggattttgtgg

SEQ ID NO: 322336 - DNA, 14 bp, Homo sapiens
ctcccagtgccaaa

SEQ ID NO: 322337 - DNA, 14 bp, Homo sapiens
ctcccatccagcgt

SEQ ID NO: 322338 - DNA, 17 bp, Homo sapiens
ctcccatctccttcccc

SEQ ID NO: 322339 - DNA, 18 bp, Homo sapiens
ctcccatctccttccccc

SEQ ID NO: 322340 - DNA, 19 bp, Homo sapiens
ctcccatctccttccccca

SEQ ID NO: 322341 - DNA, 21 bp, Homo sapiens
ctcccatgaccatactgaggg

SEQ ID NO: 322342 - DNA, 22 bp, Homo sapiens
ctcccatgcacaactctccaaa

SEQ ID NO: 322343 - DNA, 15 bp, Homo sapiens
ctcccatggcccagc

SEQ ID NO: 322344 - DNA, 17 bp, Homo sapiens
ctcccatggccttccct

SEQ ID NO: 322345 - DNA, 15 bp, Homo sapiens
ctcccattcctccct

SEQ ID NO: 322346 - DNA, 12 bp, Homo sapiens
ctccccaaccct

SEQ ID NO: 322347 - DNA, 20 bp, Homo sapiens
ctccccaaccctgcccctgc

SEQ ID NO: 322348 - DNA, 23 bp, Homo sapiens
ctccccaagtggtttccacatgc

SEQ ID NO: 322349 - DNA, 21 bp, Homo sapiens
ctccccaatccaacccatgca

SEQ ID NO: 322350 - DNA, 13 bp, Homo sapiens
ctccccacagtcc

SEQ ID NO: 322351 - DNA, 19 bp, Homo sapiens
ctccccacagtcctcacag

SEQ ID NO: 322352 - DNA, 19 bp, Homo sapiens
ctccccaccaccccagctg

SEQ ID NO: 322353 - DNA, 20 bp, Homo sapiens
ctccccacgagtcacctgca

SEQ ID NO: 322354 - DNA, 13 bp, Homo sapiens
ctccccactctag

SEQ ID NO: 322355 - DNA, 11 bp, Homo sapiens
ctccccagcca

SEQ ID NO: 322356 - DNA, 15 bp, Homo sapiens
ctccccagccagccc

SEQ ID NO: 322357 - DNA, 15 bp, Homo sapiens
ctccccagcccaggg

SEQ ID NO: 322358 - DNA, 16 bp, Homo sapiens
ctccccagccccaccc

SEQ ID NO: 322359 - DNA, 20 bp, Homo sapiens
ctccccagccccatcccaaa

SEQ ID NO: 322360 - DNA, 12 bp, Homo sapiens
ctccccagccct

SEQ ID NO: 322361 - DNA, 13 bp, Homo sapiens
ctccccaggagct

SEQ ID NO: 322362 - DNA, 15 bp, Homo sapiens
ctccccaggagctca

SEQ ID NO: 322363 - DNA, 18 bp, Homo sapiens
ctccccaggcctccagcc

SEQ ID NO: 322364 - DNA, 20 bp, Homo sapiens
ctccccaggcctccagcctc

SEQ ID NO: 322365 - DNA, 12 bp, Homo sapiens
ctccccagtgcc

SEQ ID NO: 322366 - DNA, 18 bp, Homo sapiens
ctccccagtgcctgccac

SEQ ID NO: 322367 - DNA, 17 bp, Homo sapiens
ctccccatatataaatt

SEQ ID NO: 322368 - DNA, 18 bp, Homo sapiens
ctccccatatataaatta

SEQ ID NO: 322369 - DNA, 19 bp, Homo sapiens
ctcccccaaaccctgcttc

SEQ ID NO: 322370 - DNA, 11 bp, Homo sapiens
ctcccccacca

SEQ ID NO: 322371 - DNA, 21 bp, Homo sapiens
ctcccccacggccgtccctga

SEQ ID NO: 322372 - DNA, 12 bp, Homo sapiens
ctcccccagagc

SEQ ID NO: 322373 - DNA, 12 bp, Homo sapiens
ctcccccagccc

SEQ ID NO: 322374 - DNA, 13 bp, Homo sapiens
ctcccccagccct

SEQ ID NO: 322375 - DNA, 23 bp, Homo sapiens
ctccccccagaccccgcccctgg

SEQ ID NO: 322376 - DNA, 15 bp, Homo sapiens
ctcccccgacactgc

SEQ ID NO: 322377 - DNA, 16 bp, Homo sapiens
ctcccccgacactgct

SEQ ID NO: 322378 - DNA, 17 bp, Homo sapiens
ctcccccgacactgctg

SEQ ID NO: 322379 - DNA, 19 bp, Homo sapiens
ctcccccgacactgctgca

SEQ ID NO: 322380 - DNA, 21 bp, Homo sapiens
ctcccccgacactgctgcacc

SEQ ID NO: 322381 - DNA, 22 bp, Homo sapiens
ctcccccgacactgctgcacca

SEQ ID NO: 322382 - DNA, 12 bp, Homo sapiens
ctccccctgcca

SEQ ID NO: 322383 - DNA, 15 bp, Homo sapiens
ctccccctgccagca

SEQ ID NO: 322384 - DNA, 16 bp, Homo sapiens
ctccccctgccagcaa

SEQ ID NO: 322385 - DNA, 23 bp, Homo sapiens
ctccccgatccccgacagtggct

SEQ ID NO: 322386 - DNA, 20 bp, Homo sapiens
ctccccgcagcccgcctgcc

SEQ ID NO: 322387 - DNA, 13 bp, Homo sapiens
ctccccgcctcca

SEQ ID NO: 322388 - DNA, 15 bp, Homo sapiens
ctccccgctctggat

SEQ ID NO: 322389 - DNA, 16 bp, Homo sapiens
ctccccggccctacca

SEQ ID NO: 322390 - DNA, 19 bp, Homo sapiens
ctccccgggggtccccgga

SEQ ID NO: 322391 - DNA, 21 bp, Homo sapiens
ctcccctcaagaaattttcaa

SEQ ID NO: 322392 - DNA, 15 bp, Homo sapiens
ctcccctccagaccc

SEQ ID NO: 322393 - DNA, 16 bp, Homo sapiens
ctcccctcccagtcct

SEQ ID NO: 322394 - DNA, 14 bp, Homo sapiens
ctcccctccctcct

SEQ ID NO: 322395 - DNA, 16 bp, Homo sapiens
ctcccctcctcttccc

SEQ ID NO: 322396 - DNA, 17 bp, Homo sapiens
ctcccctcctcttccct

SEQ ID NO: 322397 - DNA, 18 bp, Homo sapiens
ctcccctctcctgagcct

SEQ ID NO: 322398 - DNA, 19 bp, Homo sapiens
ctcccctctcgccccatcc

SEQ ID NO: 322399 - DNA, 14 bp, Homo sapiens
ctcccctctgctgg

SEQ ID NO: 322400 - DNA, 16 bp, Homo sapiens
ctcccctctgctggcc

SEQ ID NO: 322401 - DNA, 12 bp, Homo sapiens
ctcccctcttcc

SEQ ID NO: 322402 - DNA, 19 bp, Homo sapiens
ctccggattccggccctgg

SEQ ID NO: 322403 - DNA, 22 bp, Homo sapiens
ctccggattccggccctggctg

SEQ ID NO: 322404 - DNA, 20 bp, Homo sapiens
ctccggccagcgagtggtca

SEQ ID NO: 322405 - DNA, 13 bp, Homo sapiens
ctccggccctgcc

SEQ ID NO: 322406 - DNA, 17 bp, Homo sapiens
ctccggccctgccccac

SEQ ID NO: 322407 - DNA, 20 bp, Homo sapiens
ctccgggaccattgacctca

SEQ ID NO: 322408 - DNA, 22 bp, Homo sapiens
ctccgggaccattgacctcagc

SEQ ID NO: 322409 - DNA, 14 bp, Homo sapiens
ctccgggcagggga

SEQ ID NO: 322410 - DNA, 15 bp, Homo sapiens
ctccgggcaggggag

SEQ ID NO: 322411 - DNA, 20 bp, Homo sapiens
ctccgggcaggggagccagg

SEQ ID NO: 322412 - DNA, 21 bp, Homo sapiens
ctccgggcaggggagccaggg

SEQ ID NO: 322413 - DNA, 13 bp, Homo sapiens
ctccggggtctgt

SEQ ID NO: 322414 - DNA, 16 bp, Homo sapiens
ctccgtccacccaggc

SEQ ID NO: 322415 - DNA, 18 bp, Homo sapiens
ctccgtccacccaggctg

SEQ ID NO: 322416 - DNA, 19 bp, Homo sapiens
ctccgtccacccaggctgc

SEQ ID NO: 322417 - DNA, 20 bp, Homo sapiens
ctccgtccacccaggctgca

SEQ ID NO: 322418 - DNA, 22 bp, Homo sapiens
ctccgtccacccaggctgcact

SEQ ID NO: 322419 - DNA, 21 bp, Homo sapiens
ctccgtccactacgctcctgt

SEQ ID NO: 322420 - DNA, 13 bp, Homo sapiens
ctccgtccccagg

SEQ ID NO: 322421 - DNA, 21 bp, Homo sapiens
ctccgtgatccatccatctcc

SEQ ID NO: 322422 - DNA, 15 bp, Homo sapiens
ctccgtgtggagcac

SEQ ID NO: 322423 - DNA, 13 bp, Homo sapiens
ctccgtgtgtctc

SEQ ID NO: 322424 - DNA, 20 bp, Homo sapiens
ctccgtgtgtctcatgccag

SEQ ID NO: 322425 - DNA, 21 bp, Homo sapiens
ctccgttcccacctctgagga

SEQ ID NO: 322426 - DNA, 15 bp, Homo sapiens
ctccgtttatgggcc

SEQ ID NO: 322427 - DNA, 20 bp, Homo sapiens
ctccgtttatgggccttgct

SEQ ID NO: 322428 - DNA, 18 bp, Homo sapiens
ctccgtttccaaatacat

SEQ ID NO: 322429 - DNA, 19 bp, Homo sapiens
ctcctacaaccaggtcttg

SEQ ID NO: 322430 - DNA, 16 bp, Homo sapiens
ctcctaccctcccacc

SEQ ID NO: 322431 - DNA, 22 bp, Homo sapiens
ctcctaccctcttattgttcct

SEQ ID NO: 322432 - DNA, 13 bp, Homo sapiens
ctcctacctggta

SEQ ID NO: 322433 - DNA, 17 bp, Homo sapiens
ctcctacctggtcaacc

SEQ ID NO: 322434 - DNA, 18 bp, Homo sapiens
ctcctagagacagaagca

SEQ ID NO: 322435 - DNA, 21 bp, Homo sapiens
ctcctagaggtgggcagctgg

SEQ ID NO: 322436 - DNA, 22 bp, Homo sapiens
ctcctagcacaaggagtgcccg

SEQ ID NO: 322437 - DNA, 20 bp, Homo sapiens
ctcctaggagagccaacctc

SEQ ID NO: 322438 - DNA, 20 bp, Homo sapiens
ctcctagggaaaagttcata

SEQ ID NO: 322439 - DNA, 21 bp, Homo sapiens
ctcctagttcttcatcccact

SEQ ID NO: 322440 - DNA, 22 bp, Homo sapiens
ctcctatcagaagtttctcagc

SEQ ID NO: 322441 - DNA, 14 bp, Homo sapiens
ctcctatccccagg

SEQ ID NO: 322442 - DNA, 14 bp, Homo sapiens
ctcctatctgtgtt

SEQ ID NO: 322443 - DNA, 12 bp, Homo sapiens
ctcctatctttt

SEQ ID NO: 322444 - DNA, 14 bp, Homo sapiens
ctcctatcttttat

SEQ ID NO: 322445 - DNA, 17 bp, Homo sapiens
ctcctatgtggcagctg

SEQ ID NO: 322446 - DNA, 19 bp, Homo sapiens
ctcctatgtggcagctggg

SEQ ID NO: 322447 - DNA, 17 bp, Homo sapiens
ctcctatttttcagaat

SEQ ID NO: 322448 - DNA, 18 bp, Homo sapiens
ctcctcaccccagtgcct

SEQ ID NO: 322449 - DNA, 21 bp, Homo sapiens
ctcctcaccccagtgcctgtc

SEQ ID NO: 322450 - DNA, 23 bp, Homo sapiens
ctcctcaccccagtgcctgtctg

SEQ ID NO: 322451 - DNA, 20 bp, Homo sapiens
ctcctcacccccacccctgt

SEQ ID NO: 322452 - DNA, 21 bp, Homo sapiens
ctcctcacccccacccctgta

SEQ ID NO: 322453 - DNA, 18 bp, Homo sapiens
ctcctcaccccttccttt

SEQ ID NO: 322454 - DNA, 13 bp, Homo sapiens
ctcctcacctctg

SEQ ID NO: 322455 - DNA, 16 bp, Homo sapiens
ctcctcactgcccgca

SEQ ID NO: 322456 - DNA, 17 bp, Homo sapiens
ctcctcactgcccgcac

SEQ ID NO: 322457 - DNA, 20 bp, Homo sapiens
ctcctcagggtccctcagga

SEQ ID NO: 322458 - DNA, 16 bp, Homo sapiens
ctcctcagggtggggg

SEQ ID NO: 322459 - DNA, 21 bp, Homo sapiens
cagcttgggcccagctgggct

SEQ ID NO: 322460 - DNA, 17 bp, Homo sapiens
cagcttggttcctgccc

SEQ ID NO: 322461 - DNA, 13 bp, Homo sapiens
cagcttgtccaac

SEQ ID NO: 322462 - DNA, 21 bp, Homo sapiens
cagcttgttttggactttgtt

SEQ ID NO: 322463 - DNA, 19 bp, Homo sapiens
cagctttacatgcaattta

SEQ ID NO: 322464 - DNA, 15 bp, Homo sapiens
cagctttcagagcca

SEQ ID NO: 322465 - DNA, 17 bp, Homo sapiens
cagctttcatgattagc

SEQ ID NO: 322466 - DNA, 20 bp, Homo sapiens
cagctttcatgattagcaag

SEQ ID NO: 322467 - DNA, 15 bp, Homo sapiens
cagctttccctggct

SEQ ID NO: 322468 - DNA, 16 bp, Homo sapiens
cagctttccctggctc

SEQ ID NO: 322469 - DNA, 13 bp, Homo sapiens
cagctttcctggg

SEQ ID NO: 322470 - DNA, 23 bp, Homo sapiens
cagctttgactttatctcctgct

SEQ ID NO: 322471 - DNA, 22 bp, Homo sapiens
cagctttgggatctatatacat

SEQ ID NO: 322472 - DNA, 21 bp, Homo sapiens
cagcttttagtacccacctga

SEQ ID NO: 322473 - DNA, 23 bp, Homo sapiens
cagcttttagtacccacctgagc

SEQ ID NO: 322474 - DNA, 16 bp, Homo sapiens
cagcttttctcttttt

SEQ ID NO: 322475 - DNA, 17 bp, Homo sapiens
cagcttttcttgccagc

SEQ ID NO: 322476 - DNA, 14 bp, Homo sapiens
cagcttttgttcta

SEQ ID NO: 322477 - DNA, 18 bp, Homo sapiens
cagcttttgttctagact

SEQ ID NO: 322478 - DNA, 21 bp, Homo sapiens
cagcttttgttctagacttcc

SEQ ID NO: 322479 - DNA, 14 bp, Homo sapiens
caggaaaaaaactt

SEQ ID NO: 322480 - DNA, 16 bp, Homo sapiens
caggaaaaaaactttt

SEQ ID NO: 322481 - DNA, 19 bp, Homo sapiens
caggaaagctcagctactg

SEQ ID NO: 322482 - DNA, 15 bp, Homo sapiens
caggaaaggaagatg

SEQ ID NO: 322483 - DNA, 17 bp, Homo sapiens
caggaaagggaaggccc

SEQ ID NO: 322484 - DNA, 21 bp, Homo sapiens
caggaaatagtgttcttttta

SEQ ID NO: 322485 - DNA, 15 bp, Homo sapiens
caggaaatatatatg

SEQ ID NO: 322486 - DNA, 20 bp, Homo sapiens
caggaaatgagagatagagg

SEQ ID NO: 322487 - DNA, 18 bp, Homo sapiens
caggaacagtggctgggt

SEQ ID NO: 322488 - DNA, 19 bp, Homo sapiens
caggaacagtggctgggtg

SEQ ID NO: 322489 - DNA, 20 bp, Homo sapiens
caggaacagtggctgggtgg

SEQ ID NO: 322490 - DNA, 13 bp, Homo sapiens
caggaacctggac

SEQ ID NO: 322491 - DNA, 18 bp, Homo sapiens
caggaacgagcactggcc

SEQ ID NO: 322492 - DNA, 22 bp, Homo sapiens
caggaacgagcactggccagag

SEQ ID NO: 322493 - DNA, 20 bp, Homo sapiens
caggaactatgggagcctca

SEQ ID NO: 322494 - DNA, 12 bp, Homo sapiens
caggaactgaaa

SEQ ID NO: 322495 - DNA, 17 bp, Homo sapiens
caggaagactggagact

SEQ ID NO: 322496 - DNA, 13 bp, Homo sapiens
caggaagcacagc

SEQ ID NO: 322497 - DNA, 17 bp, Homo sapiens
caggaagcacaggccag

SEQ ID NO: 322498 - DNA, 15 bp, Homo sapiens
caggaagcaccccat

SEQ ID NO: 322499 - DNA, 16 bp, Homo sapiens
caggaagcaccccatg

SEQ ID NO: 322500 - DNA, 16 bp, Homo sapiens
caggaagcccaaggca

SEQ ID NO: 322501 - DNA, 24 bp, Homo sapiens
caggaagccccgctcaggtagcca

SEQ ID NO: 322502 - DNA, 14 bp, Homo sapiens
caggaagcctcctg

SEQ ID NO: 322503 - DNA, 19 bp, Homo sapiens
caggaagcctcctgctgag

SEQ ID NO: 322504 - DNA, 13 bp, Homo sapiens
caggaagcctctc

SEQ ID NO: 322505 - DNA, 15 bp, Homo sapiens
caggaaggagagcct

SEQ ID NO: 322506 - DNA, 15 bp, Homo sapiens
caggaaggcagctgc

SEQ ID NO: 322507 - DNA, 15 bp, Homo sapiens
caggaaggcctgggt

SEQ ID NO: 322508 - DNA, 22 bp, Homo sapiens
caggaagggaaagcgggcagcc

SEQ ID NO: 322509 - DNA, 17 bp, Homo sapiens
caggaagggagaggagg

SEQ ID NO: 322510 - DNA, 17 bp, Homo sapiens
caggaagtactggagaa

SEQ ID NO: 322511 - DNA, 19 bp, Homo sapiens
caggaagtcaggagccagc

SEQ ID NO: 322512 - DNA, 20 bp, Homo sapiens
caggaagtcaggagccagca

SEQ ID NO: 322513 - DNA, 16 bp, Homo sapiens
caggaagtccctgaga

SEQ ID NO: 322514 - DNA, 21 bp, Homo sapiens
caggaagtcccttgccatcct

SEQ ID NO: 322515 - DNA, 12 bp, Homo sapiens
caggaataaggc

SEQ ID NO: 322516 - DNA, 15 bp, Homo sapiens
caggaatcaaggagc

SEQ ID NO: 322517 - DNA, 18 bp, Homo sapiens
caggaatcaaggagcctc

SEQ ID NO: 322518 - DNA, 15 bp, Homo sapiens
caggacacagtcaga

SEQ ID NO: 322519 - DNA, 19 bp, Homo sapiens
caggacacatcccggcctc

SEQ ID NO: 322520 - DNA, 23 bp, Homo sapiens
caggacagcatggtgcatgccgc

SEQ ID NO: 322521 - DNA, 19 bp, Homo sapiens
caggacagctgcaggtgcc

SEQ ID NO: 322522 - DNA, 19 bp, Homo sapiens
caggacagctgcttctgtg

SEQ ID NO: 322523 - DNA, 11 bp, Homo sapiens
caggacaggaa

SEQ ID NO: 322524 - DNA, 12 bp, Homo sapiens
caggacaggaaa

SEQ ID NO: 322525 - DNA, 23 bp, Homo sapiens
caggaccaagcttaaggagagga

SEQ ID NO: 322526 - DNA, 14 bp, Homo sapiens
caggaccaggagcc

SEQ ID NO: 322527 - DNA, 15 bp, Homo sapiens
caggaccaggagcca

SEQ ID NO: 322528 - DNA, 18 bp, Homo sapiens
caggaccccatctgctga

SEQ ID NO: 322529 - DNA, 23 bp, Homo sapiens
caggaccccatctgctgagctct

SEQ ID NO: 322530 - DNA, 12 bp, Homo sapiens
caggaccctggg

SEQ ID NO: 322531 - DNA, 16 bp, Homo sapiens
ctcctctttgttttgt

SEQ ID NO: 322532 - DNA, 20 bp, Homo sapiens
ctcctgacatcaggtgatcc

SEQ ID NO: 322533 - DNA, 23 bp, Homo sapiens
ctcctgacccagtccccgtgccc

SEQ ID NO: 322534 - DNA, 13 bp, Homo sapiens
ctcctgaccctgt

SEQ ID NO: 322535 - DNA, 15 bp, Homo sapiens
ctcctgaccctgtga

SEQ ID NO: 322536 - DNA, 20 bp, Homo sapiens
ctcctgaccctgtgatgcct

SEQ ID NO: 322537 - DNA, 23 bp, Homo sapiens
ctcctgacctcaggtgatccacc

SEQ ID NO: 322538 - DNA, 17 bp, Homo sapiens
ctcctgagaaggcgagg

SEQ ID NO: 322539 - DNA, 21 bp, Homo sapiens
ctcctgagcacccgctgacat

SEQ ID NO: 322540 - DNA, 15 bp, Homo sapiens
ctcctgagcctgtct

SEQ ID NO: 322541 - DNA, 16 bp, Homo sapiens
ctcctgaggggcatct

SEQ ID NO: 322542 - DNA, 20 bp, Homo sapiens
ctcctgaggggcatctgccc

SEQ ID NO: 322543 - DNA, 23 bp, Homo sapiens
ctcctgattgctctggaagcctg

SEQ ID NO: 322544 - DNA, 15 bp, Homo sapiens
ctcctgatttgagtt

SEQ ID NO: 322545 - DNA, 14 bp, Homo sapiens
ctcctgcaggctgg

SEQ ID NO: 322546 - DNA, 21 bp, Homo sapiens
ctcctgcaggctggctgttgg

SEQ ID NO: 322547 - DNA, 17 bp, Homo sapiens
ctcctgcatccctccac

SEQ ID NO: 322548 - DNA, 19 bp, Homo sapiens
ctcctgcatccctccaccc

SEQ ID NO: 322549 - DNA, 20 bp, Homo sapiens
ctcctgccactcctcaactg

SEQ ID NO: 322550 - DNA, 13 bp, Homo sapiens
ctcctgcccagat

SEQ ID NO: 322551 - DNA, 23 bp, Homo sapiens
ctcctgcccagatgccctttgga

SEQ ID NO: 322552 - DNA, 14 bp, Homo sapiens
ctcctgcccagctc

SEQ ID NO: 322553 - DNA, 14 bp, Homo sapiens
ctcctgccctcgtc

SEQ ID NO: 322554 - DNA, 22 bp, Homo sapiens
ctcctgccctcgtctccctggc

SEQ ID NO: 322555 - DNA, 12 bp, Homo sapiens
ctcctgccctgt

SEQ ID NO: 322556 - DNA, 18 bp, Homo sapiens
ctcctgccctgtccctgt

SEQ ID NO: 322557 - DNA, 14 bp, Homo sapiens
ctcctgccgggcag

SEQ ID NO: 322558 - DNA, 16 bp, Homo sapiens
ctcctgcctcagcctc

SEQ ID NO: 322559 - DNA, 16 bp, Homo sapiens
ctcctgcctcagcctt

SEQ ID NO: 322560 - DNA, 14 bp, Homo sapiens
ctcctgcctgcccc

SEQ ID NO: 322561 - DNA, 13 bp, Homo sapiens
ctcctgctggctg

SEQ ID NO: 322562 - DNA, 21 bp, Homo sapiens
ctcctgctggggggcagggcc

SEQ ID NO: 322563 - DNA, 21 bp, Homo sapiens
ctcctgcttgtactaagccag

SEQ ID NO: 322564 - DNA, 16 bp, Homo sapiens
ctcctggaatggagct

SEQ ID NO: 322565 - DNA, 14 bp, Homo sapiens
ctcctggcctcaag

SEQ ID NO: 322566 - DNA, 17 bp, Homo sapiens
ctcctggcctcaagcca

SEQ ID NO: 322567 - DNA, 13 bp, Homo sapiens
ctcctggctcaca

SEQ ID NO: 322568 - DNA, 19 bp, Homo sapiens
ctcctggctcacagccacc

SEQ ID NO: 322569 - DNA, 20 bp, Homo sapiens
ctcctggctcacagccacca

SEQ ID NO: 322570 - DNA, 12 bp, Homo sapiens
ctcctggctgcc

SEQ ID NO: 322571 - DNA, 15 bp, Homo sapiens
ctcctggctgccagg

SEQ ID NO: 322572 - DNA, 16 bp, Homo sapiens
ctcctggctgccaggc

SEQ ID NO: 322573 - DNA, 18 bp, Homo sapiens
ctcctggctgccaggcgt

SEQ ID NO: 322574 - DNA, 23 bp, Homo sapiens
ctcctgggaaggagggagctgct

SEQ ID NO: 322575 - DNA, 23 bp, Homo sapiens
ctcctgggcatgtttgtctgtgt

SEQ ID NO: 322576 - DNA, 15 bp, Homo sapiens
ctcctgggccagggt

SEQ ID NO: 322577 - DNA, 18 bp, Homo sapiens
ctcctgggcccaggcagc

SEQ ID NO: 322578 - DNA, 22 bp, Homo sapiens
ctcctgggcccaggcagcacct

SEQ ID NO: 322579 - DNA, 15 bp, Homo sapiens
ctcctggtcttgaga

SEQ ID NO: 322580 - DNA, 13 bp, Homo sapiens
ctcctgtaaaata

SEQ ID NO: 322581 - DNA, 13 bp, Homo sapiens
ctcctgtctcctc

SEQ ID NO: 322582 - DNA, 18 bp, Homo sapiens
ctcctgtctcctctgtca

SEQ ID NO: 322583 - DNA, 13 bp, Homo sapiens
ctcctgtctggct

SEQ ID NO: 322584 - DNA, 17 bp, Homo sapiens
ctcctgtgagctcccca

SEQ ID NO: 322585 - DNA, 14 bp, Homo sapiens
ctcctgtgcccaca

SEQ ID NO: 322586 - DNA, 18 bp, Homo sapiens
ctcctgtggtttgctcca

SEQ ID NO: 322587 - DNA, 19 bp, Homo sapiens
ctcctgtggtttgctccag

SEQ ID NO: 322588 - DNA, 20 bp, Homo sapiens
ctcctgtggtttgctccaga

SEQ ID NO: 322589 - DNA, 22 bp, Homo sapiens
ctcctgtgtctggtccacacac

SEQ ID NO: 322590 - DNA, 19 bp, Homo sapiens
ctcctgttcctgccttctc

SEQ ID NO: 322591 - DNA, 22 bp, Homo sapiens
ctcctgttcctgccttctcttc

SEQ ID NO: 322592 - DNA, 15 bp, Homo sapiens
ctcctgttgccacac

SEQ ID NO: 322593 - DNA, 20 bp, Homo sapiens
ctcctgtttcccttcccttc

SEQ ID NO: 322594 - DNA, 15 bp, Homo sapiens
ctcctgtttgcaggc

SEQ ID NO: 322595 - DNA, 16 bp, Homo sapiens
ctccttactctgagcc

SEQ ID NO: 322596 - DNA, 20 bp, Homo sapiens
ctccttactctgagcccagg

SEQ ID NO: 322597 - DNA, 12 bp, Homo sapiens
cgccctgccctt

SEQ ID NO: 322598 - DNA, 21 bp, Homo sapiens
cgccctgcgttggagccactc

SEQ ID NO: 322599 - DNA, 22 bp, Homo sapiens
cgccctggaagccggcggccca

SEQ ID NO: 322600 - DNA, 13 bp, Homo sapiens
cgccctgggctgg

SEQ ID NO: 322601 - DNA, 14 bp, Homo sapiens
cgccctgggctgga

SEQ ID NO: 322602 - DNA, 17 bp, Homo sapiens
cgccctgggctggactg

SEQ ID NO: 322603 - DNA, 21 bp, Homo sapiens
cgccctggggagtgagcttgg

SEQ ID NO: 322604 - DNA, 15 bp, Homo sapiens
cgcccttaccttccc

SEQ ID NO: 322605 - DNA, 18 bp, Homo sapiens
cgccctttccttgccttc

SEQ ID NO: 322606 - DNA, 16 bp, Homo sapiens
cgccgcctcgggccgc

SEQ ID NO: 322607 - DNA, 14 bp, Homo sapiens
cgccggggctggcc

SEQ ID NO: 322608 - DNA, 16 bp, Homo sapiens
cgccggggctggccct

SEQ ID NO: 322609 - DNA, 20 bp, Homo sapiens
cgccggttggccggctggcc

SEQ ID NO: 322610 - DNA, 13 bp, Homo sapiens
cgccgtggctgcg

SEQ ID NO: 322611 - DNA, 21 bp, Homo sapiens
cgcctccactctagttctaga

SEQ ID NO: 322612 - DNA, 15 bp, Homo sapiens
cgcctcccagcctgg

SEQ ID NO: 322613 - DNA, 10 bp, Homo sapiens
cgcctccccg

SEQ ID NO: 322614 - DNA, 22 bp, Homo sapiens
cgcctccccgaaacaggctact

SEQ ID NO: 322615 - DNA, 20 bp, Homo sapiens
cgcctccctcccctgccctc

SEQ ID NO: 322616 - DNA, 14 bp, Homo sapiens
cgcctccgagggac

SEQ ID NO: 322617 - DNA, 14 bp, Homo sapiens
cgcctccgcccaaa

SEQ ID NO: 322618 - DNA, 13 bp, Homo sapiens
cgcctcctccaga

SEQ ID NO: 322619 - DNA, 14 bp, Homo sapiens
cgcctcctccagac

SEQ ID NO: 322620 - DNA, 15 bp, Homo sapiens
cgcctcctccagact

SEQ ID NO: 322621 - DNA, 13 bp, Homo sapiens
cgcctcctggaca

SEQ ID NO: 322622 - DNA, 12 bp, Homo sapiens
cgcctctgagcc

SEQ ID NO: 322623 - DNA, 16 bp, Homo sapiens
cgcctctgagccagga

SEQ ID NO: 322624 - DNA, 18 bp, Homo sapiens
cgcctctgagccaggagc

SEQ ID NO: 322625 - DNA, 13 bp, Homo sapiens
cgcctctgcattc

SEQ ID NO: 322626 - DNA, 18 bp, Homo sapiens
cgcctctggttccactca

SEQ ID NO: 322627 - DNA, 16 bp, Homo sapiens
cgcctcttttccctct

SEQ ID NO: 322628 - DNA, 20 bp, Homo sapiens
cgcctgacaaccactggtct

SEQ ID NO: 322629 - DNA, 21 bp, Homo sapiens
cgcctgacaaccactggtctg

SEQ ID NO: 322630 - DNA, 23 bp, Homo sapiens
cgcctgacaaccactggtctgta

SEQ ID NO: 322631 - DNA, 18 bp, Homo sapiens
cgcctgattggggcctca

SEQ ID NO: 322632 - DNA, 20 bp, Homo sapiens
cgcctgattggggcctcacc

SEQ ID NO: 322633 - DNA, 21 bp, Homo sapiens
cgcctgattggggcctcaccc

SEQ ID NO: 322634 - DNA, 12 bp, Homo sapiens
cgcctgcccgcc

SEQ ID NO: 322635 - DNA, 13 bp, Homo sapiens
cgcctgccctccc

SEQ ID NO: 322636 - DNA, 17 bp, Homo sapiens
cgcctgccgtgcatggc

SEQ ID NO: 322637 - DNA, 23 bp, Homo sapiens
cgcctgccgtgcatggctcctgt

SEQ ID NO: 322638 - DNA, 16 bp, Homo sapiens
cgcctgccttctgggc

SEQ ID NO: 322639 - DNA, 14 bp, Homo sapiens
cgcctgcgctcctc

SEQ ID NO: 322640 - DNA, 22 bp, Homo sapiens
cgcctgcgctcctctgcagcct

SEQ ID NO: 322641 - DNA, 16 bp, Homo sapiens
cgcctgcggactccat

SEQ ID NO: 322642 - DNA, 20 bp, Homo sapiens
cgcctgcggactccatggcc

SEQ ID NO: 322643 - DNA, 15 bp, Homo sapiens
cgcctggcacccact

SEQ ID NO: 322644 - DNA, 14 bp, Homo sapiens
cgcctggcaggtgg

SEQ ID NO: 322645 - DNA, 11 bp, Homo sapiens
cgcctggctcc

SEQ ID NO: 322646 - DNA, 19 bp, Homo sapiens
cgcctggggctccggtgcg

SEQ ID NO: 322647 - DNA, 20 bp, Homo sapiens
cgcctgtaatcccagcactt

SEQ ID NO: 322648 - DNA, 18 bp, Homo sapiens
cgcctgtgctgaggactc

SEQ ID NO: 322649 - DNA, 13 bp, Homo sapiens
cgccttcctcctc

SEQ ID NO: 322650 - DNA, 15 bp, Homo sapiens
cgccttcctcctcca

SEQ ID NO: 322651 - DNA, 22 bp, Homo sapiens
cgccttcctcctccacagtgct

SEQ ID NO: 322652 - DNA, 13 bp, Homo sapiens
cgccttccttgac

SEQ ID NO: 322653 - DNA, 17 bp, Homo sapiens
cgccttctacctgcagg

SEQ ID NO: 322654 - DNA, 17 bp, Homo sapiens
cggatctccaggcccag

SEQ ID NO: 322655 - DNA, 19 bp, Homo sapiens
cggatctccaggcccagcc

SEQ ID NO: 322656 - DNA, 15 bp, Homo sapiens
cggatgcccacccct

SEQ ID NO: 322657 - DNA, 20 bp, Homo sapiens
cggatgcccacccctgctgc

SEQ ID NO: 322658 - DNA, 14 bp, Homo sapiens
cggatgtataaatg

SEQ ID NO: 322659 - DNA, 15 bp, Homo sapiens
cggatgtataaatgt

SEQ ID NO: 322660 - DNA, 18 bp, Homo sapiens
cggattattatttgtact

SEQ ID NO: 322661 - DNA, 13 bp, Homo sapiens
cggcaacctgtaa

SEQ ID NO: 322662 - DNA, 17 bp, Homo sapiens
cggcaacctgtaactgc

SEQ ID NO: 322663 - DNA, 20 bp, Homo sapiens
cggcacagagtcgatgctca

SEQ ID NO: 322664 - DNA, 21 bp, Homo sapiens
cggcacagagtcgatgctcaa

SEQ ID NO: 322665 - DNA, 12 bp, Homo sapiens
cggcaccgccca

SEQ ID NO: 322666 - DNA, 23 bp, Homo sapiens
cggcacgccaacagcccccccct

SEQ ID NO: 322667 - DNA, 14 bp, Homo sapiens
cggcagaactctct

SEQ ID NO: 322668 - DNA, 15 bp, Homo sapiens
cggcagaggcagggc

SEQ ID NO: 322669 - DNA, 18 bp, Homo sapiens
cggcagaggcagggccct

SEQ ID NO: 322670 - DNA, 19 bp, Homo sapiens
cggcagaggcagggccctg

SEQ ID NO: 322671 - DNA, 15 bp, Homo sapiens
cggcagccccacttc

SEQ ID NO: 322672 - DNA, 12 bp, Homo sapiens
cggcagccccat

SEQ ID NO: 322673 - DNA, 15 bp, Homo sapiens
cggcagccccatcct

SEQ ID NO: 322674 - DNA, 17 bp, Homo sapiens
cggcagcctggttccct

SEQ ID NO: 322675 - DNA, 20 bp, Homo sapiens
cggcagctcttctgggcaga

SEQ ID NO: 322676 - DNA, 13 bp, Homo sapiens
cggcagctggggc

SEQ ID NO: 322677 - DNA, 10 bp, Homo sapiens
cggcagctgt

SEQ ID NO: 322678 - DNA, 14 bp, Homo sapiens
cggcagctgtagct

SEQ ID NO: 322679 - DNA, 15 bp, Homo sapiens
cggcaggccctgcag

SEQ ID NO: 322680 - DNA, 17 bp, Homo sapiens
cggcaggccctgcagtg

SEQ ID NO: 322681 - DNA, 22 bp, Homo sapiens
cggcaggggcccctcctctgtg

SEQ ID NO: 322682 - DNA, 18 bp, Homo sapiens
cggcaggtggcctaaggc

SEQ ID NO: 322683 - DNA, 16 bp, Homo sapiens
cggcagtgcaccccct

SEQ ID NO: 322684 - DNA, 19 bp, Homo sapiens
cggcatgagggctgagatg

SEQ ID NO: 322685 - DNA, 22 bp, Homo sapiens
cggcatgggaaagccacctctc

SEQ ID NO: 322686 - DNA, 12 bp, Homo sapiens
cggcatgtttcc

SEQ ID NO: 322687 - DNA, 18 bp, Homo sapiens
cggcattcacacacagcc

SEQ ID NO: 322688 - DNA, 22 bp, Homo sapiens
cggcattcacacacagcctggc

SEQ ID NO: 322689 - DNA, 23 bp, Homo sapiens
cggcattcacacacagcctggcc

SEQ ID NO: 322690 - DNA, 19 bp, Homo sapiens
cggccactccctgccaact

SEQ ID NO: 322691 - DNA, 15 bp, Homo sapiens
cggcccaagcccgac

SEQ ID NO: 322692 - DNA, 12 bp, Homo sapiens
cggcccagccat

SEQ ID NO: 322693 - DNA, 20 bp, Homo sapiens
cggcccagccatgggccctc

SEQ ID NO: 322694 - DNA, 21 bp, Homo sapiens
cggccccacccaccctctggt

SEQ ID NO: 322695 - DNA, 18 bp, Homo sapiens
cggcccccagagcgcccc

SEQ ID NO: 322696 - DNA, 21 bp, Homo sapiens
cggcccctaccagccacgggc

SEQ ID NO: 322697 - DNA, 15 bp, Homo sapiens
cggcccgccaccttg

SEQ ID NO: 322698 - DNA, 14 bp, Homo sapiens
cggcccggcccacg

SEQ ID NO: 322699 - DNA, 16 bp, Homo sapiens
cggcccggcccacgca

SEQ ID NO: 322700 - DNA, 17 bp, Homo sapiens
cggcccggcccacgcag

SEQ ID NO: 322701 - DNA, 20 bp, Homo sapiens
cggcccggcccacgcagagc

SEQ ID NO: 322702 - DNA, 16 bp, Homo sapiens
cggcccgtgcgcagcc

SEQ ID NO: 322703 - DNA, 17 bp, Homo sapiens
cggcccgtgcgcagccg

SEQ ID NO: 322704 - DNA, 12 bp, Homo sapiens
cggccctgcaat

SEQ ID NO: 322705 - DNA, 11 bp, Homo sapiens
cggccctgccc

SEQ ID NO: 322706 - DNA, 12 bp, Homo sapiens
cggccctggctg

SEQ ID NO: 322707 - DNA, 14 bp, Homo sapiens
cggccctgtcagag

SEQ ID NO: 322708 - DNA, 22 bp, Homo sapiens
cggccgcatgtctgcatggcag

SEQ ID NO: 322709 - DNA, 15 bp, Homo sapiens
cggccgcccagacac

SEQ ID NO: 322710 - DNA, 21 bp, Homo sapiens
cggccgccccgccccagagct

SEQ ID NO: 322711 - DNA, 14 bp, Homo sapiens
cggccgcctgtcct

SEQ ID NO: 322712 - DNA, 15 bp, Homo sapiens
cggcctccaggctgg

SEQ ID NO: 322713 - DNA, 16 bp, Homo sapiens
cggcctccaggctggg

SEQ ID NO: 322714 - DNA, 17 bp, Homo sapiens
cggcctccaggctgggg

SEQ ID NO: 322715 - DNA, 18 bp, Homo sapiens
cggcctccaggctggggc

SEQ ID NO: 322716 - DNA, 19 bp, Homo sapiens
cggcctccaggctggggcc

SEQ ID NO: 322717 - DNA, 14 bp, Homo sapiens
cggcctctggggag

SEQ ID NO: 322718 - DNA, 16 bp, Homo sapiens
cggcctgatgctccct

SEQ ID NO: 322719 - DNA, 12 bp, Homo sapiens
cggcctgcagcc

SEQ ID NO: 322720 - DNA, 13 bp, Homo sapiens
cggcctgcagccc

SEQ ID NO: 322721 - DNA, 14 bp, Homo sapiens
cggcctgcagccca

SEQ ID NO: 322722 - DNA, 18 bp, Homo sapiens
cggcctgcagcccagaac

SEQ ID NO: 322723 - DNA, 14 bp, Homo sapiens
cggcctgctcccag

SEQ ID NO: 322724 - DNA, 18 bp, Homo sapiens
cggcctgctcccagcagc

SEQ ID NO: 322725 - DNA, 12 bp, Homo sapiens
cggcctgggagg

SEQ ID NO: 322726 - DNA, 20 bp, Homo sapiens
cggcctggggccgggctggc

SEQ ID NO: 322727 - DNA, 21 bp, Homo sapiens
cggcctggggccgggctggct

SEQ ID NO: 322728 - DNA, 23 bp, Homo sapiens
cggcctggggccgggctggcttc

SEQ ID NO: 322729 - DNA, 18 bp, Homo sapiens
cggcctgtgcgttccctt

SEQ ID NO: 322730 - DNA, 22 bp, Homo sapiens
cggcctgtgcgttcccttcagt

SEQ ID NO: 322731 - DNA, 14 bp, Homo sapiens
cggccttcgacctg

SEQ ID NO: 322732 - DNA, 24 bp, Homo sapiens
cggccttggccttggggccagact

SEQ ID NO: 322733 - DNA, 15 bp, Homo sapiens
cggcgatttttgtat

SEQ ID NO: 322734 - DNA, 17 bp, Homo sapiens
cggcgccaccatcctgc

SEQ ID NO: 322735 - DNA, 20 bp, Homo sapiens
cggctaggccggccagctcc

SEQ ID NO: 322736 - DNA, 22 bp, Homo sapiens
cggctcccggggcagggcagcc

SEQ ID NO: 322737 - DNA, 19 bp, Homo sapiens
cggctccgagggcggccag

SEQ ID NO: 322738 - DNA, 22 bp, Homo sapiens
cggctccgagggcggccaggga

SEQ ID NO: 322739 - DNA, 18 bp, Homo sapiens
cggctcctccccgatccc

SEQ ID NO: 322740 - DNA, 20 bp, Homo sapiens
cggctcgagcagtcctgcct

SEQ ID NO: 322741 - DNA, 20 bp, Homo sapiens
cggctctcgtccctctgctc

SEQ ID NO: 322742 - DNA, 18 bp, Homo sapiens
cggctctttccttgctca

SEQ ID NO: 322743 - DNA, 23 bp, Homo sapiens
cggctgaccaacattcaaaagca

SEQ ID NO: 322744 - DNA, 19 bp, Homo sapiens
cggctgcaccctgtatgga

SEQ ID NO: 322745 - DNA, 14 bp, Homo sapiens
cggctgcctgccgc

SEQ ID NO: 322746 - DNA, 17 bp, Homo sapiens
cggctgcctgccgccca

SEQ ID NO: 322747 - DNA, 22 bp, Homo sapiens
cggctgcctgccgcccaaagag

SEQ ID NO: 322748 - DNA, 22 bp, Homo sapiens
cggctggaaagaggagaaggag

SEQ ID NO: 322749 - DNA, 16 bp, Homo sapiens
cggctggaagaacatc

SEQ ID NO: 322750 - DNA, 14 bp, Homo sapiens
cggctggccggtcc

SEQ ID NO: 322751 - DNA, 23 bp, Homo sapiens
cggctgggagcctcgcccctcca

SEQ ID NO: 322752 - DNA, 12 bp, Homo sapiens
cggctgggcagg

SEQ ID NO: 322753 - DNA, 15 bp, Homo sapiens
cggctgggcagggcc

SEQ ID NO: 322754 - DNA, 20 bp, Homo sapiens
cggctgggtcggccctgccc

SEQ ID NO: 322755 - DNA, 12 bp, Homo sapiens
cggctgtggagc

SEQ ID NO: 322756 - DNA, 13 bp, Homo sapiens
cggctgtggagca

SEQ ID NO: 322757 - DNA, 14 bp, Homo sapiens
cggctgtggagcaa

SEQ ID NO: 322758 - DNA, 22 bp, Homo sapiens
cggctgtggagcaaaaggcagc

SEQ ID NO: 322759 - DNA, 23 bp, Homo sapiens
cggctgtggagcaaaaggcagct

SEQ ID NO: 322760 - DNA, 16 bp, Homo sapiens
cggctgtgtatttctg

SEQ ID NO: 322761 - DNA, 18 bp, Homo sapiens
cggctgtgtatttctgta

SEQ ID NO: 322762 - DNA, 19 bp, Homo sapiens
cggctgtgtatttctgtag

SEQ ID NO: 322763 - DNA, 19 bp, Homo sapiens
cggctgtgtggggagggtg

SEQ ID NO: 322764 - DNA, 23 bp, Homo sapiens
cggcttagacttcgactcaggat

SEQ ID NO: 322765 - DNA, 20 bp, Homo sapiens
cgggaaagccagtgactcca

SEQ ID NO: 322766 - DNA, 22 bp, Homo sapiens
cgggaaaggcatctaagacatt

SEQ ID NO: 322767 - DNA, 16 bp, Homo sapiens
cgggaaattctgctgc

SEQ ID NO: 322768 - DNA, 23 bp, Homo sapiens
cgggaagagaggagttcaatgat

SEQ ID NO: 322769 - DNA, 13 bp, Homo sapiens
cgggaaggcctga

SEQ ID NO: 322770 - DNA, 14 bp, Homo sapiens
cgggaaggcctgag

SEQ ID NO: 322771 - DNA, 19 bp, Homo sapiens
cgggacagcggcccggccc

SEQ ID NO: 322772 - DNA, 23 bp, Homo sapiens
cgggaccacagctgctggccagg

SEQ ID NO: 322773 - DNA, 18 bp, Homo sapiens
cgggaccattgacctcag

SEQ ID NO: 322774 - DNA, 14 bp, Homo sapiens
cgggacctgtggct

SEQ ID NO: 322775 - DNA, 20 bp, Homo sapiens
cgggacggatagtagacagc

SEQ ID NO: 322776 - DNA, 19 bp, Homo sapiens
cgggagagagtgagagaga

SEQ ID NO: 322777 - DNA, 15 bp, Homo sapiens
cgggagagcgccacc

SEQ ID NO: 322778 - DNA, 16 bp, Homo sapiens
cgggagagcgccaccc

SEQ ID NO: 322779 - DNA, 17 bp, Homo sapiens
cgggagagcgccacccg

SEQ ID NO: 322780 - DNA, 19 bp, Homo sapiens
cgggagagcgccacccgcc

SEQ ID NO: 322781 - DNA, 20 bp, Homo sapiens
cgggagagcgccacccgccc

SEQ ID NO: 322782 - DNA, 14 bp, Homo sapiens
cgggagcctgcgtg

SEQ ID NO: 322783 - DNA, 11 bp, Homo sapiens
cgggagctggt

SEQ ID NO: 322784 - DNA, 17 bp, Homo sapiens
cactgccatggaggcac

SEQ ID NO: 322785 - DNA, 22 bp, Homo sapiens
cactgccatggaggcacacagc

SEQ ID NO: 322786 - DNA, 18 bp, Homo sapiens
cactgcccgagctggtgc

SEQ ID NO: 322787 - DNA, 15 bp, Homo sapiens
cactgcccgcacacc

SEQ ID NO: 322788 - DNA, 17 bp, Homo sapiens
cactgcccgcacaccct

SEQ ID NO: 322789 - DNA, 21 bp, Homo sapiens
cactgccctctccacacccat

SEQ ID NO: 322790 - DNA, 12 bp, Homo sapiens
cactgccctgcc

SEQ ID NO: 322791 - DNA, 13 bp, Homo sapiens
cactgccctgcct

SEQ ID NO: 322792 - DNA, 18 bp, Homo sapiens
cactgccctgcctgccca

SEQ ID NO: 322793 - DNA, 10 bp, Homo sapiens
cactgcctgc

SEQ ID NO: 322794 - DNA, 14 bp, Homo sapiens
cactgcctgcccac

SEQ ID NO: 322795 - DNA, 21 bp, Homo sapiens
cactgccttctcctctctggg

SEQ ID NO: 322796 - DNA, 16 bp, Homo sapiens
cactgcgccacctgct

SEQ ID NO: 322797 - DNA, 16 bp, Homo sapiens
cactgctaaatttacg

SEQ ID NO: 322798 - DNA, 12 bp, Homo sapiens
cactgctaataa

SEQ ID NO: 322799 - DNA, 15 bp, Homo sapiens
cactgctaataaatg

SEQ ID NO: 322800 - DNA, 20 bp, Homo sapiens
cactgctaataaatgaccag

SEQ ID NO: 322801 - DNA, 21 bp, Homo sapiens
cactgctaataaatgaccagt

SEQ ID NO: 322802 - DNA, 16 bp, Homo sapiens
cactgctacacttctg

SEQ ID NO: 322803 - DNA, 16 bp, Homo sapiens
cactgctaggtgggcc

SEQ ID NO: 322804 - DNA, 17 bp, Homo sapiens
cactgctaggtgggcca

SEQ ID NO: 322805 - DNA, 19 bp, Homo sapiens
cactgctcaagaagacatg

SEQ ID NO: 322806 - DNA, 18 bp, Homo sapiens
cactgctgcaccagagtg

SEQ ID NO: 322807 - DNA, 15 bp, Homo sapiens
cactgctgctcctct

SEQ ID NO: 322808 - DNA, 16 bp, Homo sapiens
cactgctgctgccttt

SEQ ID NO: 322809 - DNA, 12 bp, Homo sapiens
cactgctggctg

SEQ ID NO: 322810 - DNA, 14 bp, Homo sapiens
cactgctggctgcc

SEQ ID NO: 322811 - DNA, 21 bp, Homo sapiens
cactgctgttcctgctccatg

SEQ ID NO: 322812 - DNA, 20 bp, Homo sapiens
cactggaacctccctgggcc

SEQ ID NO: 322813 - DNA, 17 bp, Homo sapiens
cactggcatagccctcc

SEQ ID NO: 322814 - DNA, 20 bp, Homo sapiens
cactggcatagccctcctga

SEQ ID NO: 322815 - DNA, 20 bp, Homo sapiens
cactggccagagagggccca

SEQ ID NO: 322816 - DNA, 22 bp, Homo sapiens
cactggccagagagggcccagc

SEQ ID NO: 322817 - DNA, 17 bp, Homo sapiens
cactggccagctctggc

SEQ ID NO: 322818 - DNA, 16 bp, Homo sapiens
cactggccagtagctg

SEQ ID NO: 322819 - DNA, 12 bp, Homo sapiens
cactggcctggg

SEQ ID NO: 322820 - DNA, 21 bp, Homo sapiens
cactggcctgggtctccctgg

SEQ ID NO: 322821 - DNA, 14 bp, Homo sapiens
cactggctgctctg

SEQ ID NO: 322822 - DNA, 15 bp, Homo sapiens
cactggctgctctgt

SEQ ID NO: 322823 - DNA, 18 bp, Homo sapiens
cactggctgctctgtctt

SEQ ID NO: 322824 - DNA, 15 bp, Homo sapiens
cactggctggggcag

SEQ ID NO: 322825 - DNA, 19 bp, Homo sapiens
cactggctggggcagaggg

SEQ ID NO: 322826 - DNA, 14 bp, Homo sapiens
cactggctgtgcct

SEQ ID NO: 322827 - DNA, 23 bp, Homo sapiens
cactgggaagctggagtgctgct

SEQ ID NO: 322828 - DNA, 15 bp, Homo sapiens
cactgggcataatgc

SEQ ID NO: 322829 - DNA, 20 bp, Homo sapiens
cactgggccccattctccct

SEQ ID NO: 322830 - DNA, 18 bp, Homo sapiens
cactgggccggcagcctg

SEQ ID NO: 322831 - DNA, 21 bp, Homo sapiens
cactgggccggcagcctggtt

SEQ ID NO: 322832 - DNA, 20 bp, Homo sapiens
cactgggggaacagatgcta

SEQ ID NO: 322833 - DNA, 17 bp, Homo sapiens
cactgggtctcactcct

SEQ ID NO: 322834 - DNA, 19 bp, Homo sapiens
cactgggtggggtgaggac

SEQ ID NO: 322835 - DNA, 23 bp, Homo sapiens
cactgggtggggtgaggaccact

SEQ ID NO: 322836 - DNA, 14 bp, Homo sapiens
cactggtctcagag

SEQ ID NO: 322837 - DNA, 16 bp, Homo sapiens
cactggtgcatttaaa

SEQ ID NO: 322838 - DNA, 13 bp, Homo sapiens
cactggtggcccg

SEQ ID NO: 322839 - DNA, 21 bp, Homo sapiens
cactggtggcccgacagcctg

SEQ ID NO: 322840 - DNA, 15 bp, Homo sapiens
cactgtaaacccctg

SEQ ID NO: 322841 - DNA, 14 bp, Homo sapiens
cactgtaatatctt

SEQ ID NO: 322842 - DNA, 19 bp, Homo sapiens
cactgtagccttagtgtca

SEQ ID NO: 322843 - DNA, 18 bp, Homo sapiens
cactgtattacataaata

SEQ ID NO: 322844 - DNA, 14 bp, Homo sapiens
cactgtatttgtat

SEQ ID NO: 322845 - DNA, 19 bp, Homo sapiens
cactgtcactgtttctctg

SEQ ID NO: 322846 - DNA, 22 bp, Homo sapiens
cactgtcactgtttctctgctg

SEQ ID NO: 322847 - DNA, 13 bp, Homo sapiens
cactgtcactttg

SEQ ID NO: 322848 - DNA, 16 bp, Homo sapiens
cactgtcactttgctc

SEQ ID NO: 322849 - DNA, 17 bp, Homo sapiens
cactgtcactttgctct

SEQ ID NO: 322850 - DNA, 20 bp, Homo sapiens
cactgtcactttgctctggg

SEQ ID NO: 322851 - DNA, 20 bp, Homo sapiens
cactgtccccctacccaccg

SEQ ID NO: 322852 - DNA, 18 bp, Homo sapiens
cactgtccctaccactga

SEQ ID NO: 322853 - DNA, 12 bp, Homo sapiens
cactgtcccttg

SEQ ID NO: 322854 - DNA, 18 bp, Homo sapiens
cactgtcccttgcctcaa

SEQ ID NO: 322855 - DNA, 11 bp, Homo sapiens
cactgtcctgg

SEQ ID NO: 322856 - DNA, 12 bp, Homo sapiens
cactgtcctggg

SEQ ID NO: 322857 - DNA, 13 bp, Homo sapiens
cactgtcctgggc

SEQ ID NO: 322858 - DNA, 15 bp, Homo sapiens
cactgtcctgggcgc

SEQ ID NO: 322859 - DNA, 16 bp, Homo sapiens
cactgtcctgggcgcc

SEQ ID NO: 322860 - DNA, 16 bp, Homo sapiens
cactgtgaccttgact

SEQ ID NO: 322861 - DNA, 22 bp, Homo sapiens
cactgtgctcctaaaggcagca

SEQ ID NO: 322862 - DNA, 12 bp, Homo sapiens
cactgtgcttgc

SEQ ID NO: 322863 - DNA, 16 bp, Homo sapiens
cactgtgcttgctcct

SEQ ID NO: 322864 - DNA, 17 bp, Homo sapiens
cactgtgcttgctccta

SEQ ID NO: 322865 - DNA, 14 bp, Homo sapiens
cactgtggaacact

SEQ ID NO: 322866 - DNA, 17 bp, Homo sapiens
cactgtggccagagctg

SEQ ID NO: 322867 - DNA, 12 bp, Homo sapiens
cactgtggcctt

SEQ ID NO: 322868 - DNA, 19 bp, Homo sapiens
cactgtggggcaagcctga

SEQ ID NO: 322869 - DNA, 23 bp, Homo sapiens
cactgttcccagcaaagttttca

SEQ ID NO: 322870 - DNA, 14 bp, Homo sapiens
cactgttgaaaatt

SEQ ID NO: 322871 - DNA, 17 bp, Homo sapiens
cactgttgaattttctc

SEQ ID NO: 322872 - DNA, 20 bp, Homo sapiens
cactgttgcttaattgtgaa

SEQ ID NO: 322873 - DNA, 12 bp, Homo sapiens
cactgtttctct

SEQ ID NO: 322874 - DNA, 14 bp, Homo sapiens
cacttaaactttgt

SEQ ID NO: 322875 - DNA, 21 bp, Homo sapiens
cggtcacctgtgctacctcta

SEQ ID NO: 322876 - DNA, 20 bp, Homo sapiens
cggtccaccccgtcccggcc

SEQ ID NO: 322877 - DNA, 15 bp, Homo sapiens
cggtcccaggccgca

SEQ ID NO: 322878 - DNA, 22 bp, Homo sapiens
cggtcccaggccgcatggcccc

SEQ ID NO: 322879 - DNA, 18 bp, Homo sapiens
cggtccccatccccacca

SEQ ID NO: 322880 - DNA, 23 bp, Homo sapiens
cggtccccatccccaccagctcg

SEQ ID NO: 322881 - DNA, 20 bp, Homo sapiens
cggtcccccatgccaccacc

SEQ ID NO: 322882 - DNA, 20 bp, Homo sapiens
cggtcctttaggcagcctgc

SEQ ID NO: 322883 - DNA, 16 bp, Homo sapiens
cggtgagactctgagg

SEQ ID NO: 322884 - DNA, 12 bp, Homo sapiens
cggtgaggcagg

SEQ ID NO: 322885 - DNA, 14 bp, Homo sapiens
cggtgaggcagggg

SEQ ID NO: 322886 - DNA, 16 bp, Homo sapiens
cggtgatcagcagaga

SEQ ID NO: 322887 - DNA, 13 bp, Homo sapiens
cggtgcactggtc

SEQ ID NO: 322888 - DNA, 17 bp, Homo sapiens
cggtgcagcggtggaag

SEQ ID NO: 322889 - DNA, 21 bp, Homo sapiens
cggtgcagcggtggaaggagc

SEQ ID NO: 322890 - DNA, 22 bp, Homo sapiens
cggtgcagcggtggaaggagcc

SEQ ID NO: 322891 - DNA, 23 bp, Homo sapiens
cggtgcagcggtggaaggagcct

SEQ ID NO: 322892 - DNA, 23 bp, Homo sapiens
cggtgcatacacccccacctcct

SEQ ID NO: 322893 - DNA, 12 bp, Homo sapiens
cggtgcccacct

SEQ ID NO: 322894 - DNA, 19 bp, Homo sapiens
cggtgcgtggctgtggcac

SEQ ID NO: 322895 - DNA, 23 bp, Homo sapiens
cggtgcttccctttcactgaagt

SEQ ID NO: 322896 - DNA, 15 bp, Homo sapiens
cggtggaaggagcct

SEQ ID NO: 322897 - DNA, 16 bp, Homo sapiens
cggtggcatttgctga

SEQ ID NO: 322898 - DNA, 13 bp, Homo sapiens
cggtggctaaagg

SEQ ID NO: 322899 - DNA, 22 bp, Homo sapiens
cggtggctaaaggtcccaaggc

SEQ ID NO: 322900 - DNA, 20 bp, Homo sapiens
cggtggctcacgcctgtaat

SEQ ID NO: 322901 - DNA, 17 bp, Homo sapiens
cggtgtggccctgcaag

SEQ ID NO: 322902 - DNA, 21 bp, Homo sapiens
cggttaattggttaatcactt

SEQ ID NO: 322903 - DNA, 16 bp, Homo sapiens
cggttcagacccctgc

SEQ ID NO: 322904 - DNA, 19 bp, Homo sapiens
cggttctccagaatgtaag

SEQ ID NO: 322905 - DNA, 22 bp, Homo sapiens
cggttgccttttttatcatttc

SEQ ID NO: 322906 - DNA, 19 bp, Homo sapiens
cggtttcaaaccaggattt

SEQ ID NO: 322907 - DNA, 19 bp, Homo sapiens
cggtttccaaggtgcacat

SEQ ID NO: 322908 - DNA, 13 bp, Homo sapiens
cggtttctgttct

SEQ ID NO: 322909 - DNA, 18 bp, Homo sapiens
cggtttctttgttacttt

SEQ ID NO: 322910 - DNA, 16 bp, Homo sapiens
cggtttgggagaacac

SEQ ID NO: 322911 - DNA, 24 bp, Homo sapiens
cgtaagatacaagtttcagacagg

SEQ ID NO: 322912 - DNA, 16 bp, Homo sapiens
cgtaatgggcctgccc

SEQ ID NO: 322913 - DNA, 16 bp, Homo sapiens
cgtaattttgccaaat

SEQ ID NO: 322914 - DNA, 20 bp, Homo sapiens
cacttcttgaaacagcctgg

SEQ ID NO: 322915 - DNA, 18 bp, Homo sapiens
cacttcttgttccccact

SEQ ID NO: 322916 - DNA, 20 bp, Homo sapiens
cacttcttttccaaaaatac

SEQ ID NO: 322917 - DNA, 13 bp, Homo sapiens
cacttgcactgtg

SEQ ID NO: 322918 - DNA, 18 bp, Homo sapiens
cacttgcccctgttacct

SEQ ID NO: 322919 - DNA, 17 bp, Homo sapiens
cacttgcgtcctgcaga

SEQ ID NO: 322920 - DNA, 20 bp, Homo sapiens
cacttgcgtcctgcagagga

SEQ ID NO: 322921 - DNA, 17 bp, Homo sapiens
cacttgctcccaaccca

SEQ ID NO: 322922 - DNA, 13 bp, Homo sapiens
cacttgctggggc

SEQ ID NO: 322923 - DNA, 16 bp, Homo sapiens
cacttggcctctggat

SEQ ID NO: 322924 - DNA, 18 bp, Homo sapiens
cacttggtttttggctct

SEQ ID NO: 322925 - DNA, 23 bp, Homo sapiens
cacttgtcactacaaaaatacaa

SEQ ID NO: 322926 - DNA, 15 bp, Homo sapiens
cacttgtgtgtgggc

SEQ ID NO: 322927 - DNA, 21 bp, Homo sapiens
cacttgtgtgtgggctgtgag

SEQ ID NO: 322928 - DNA, 22 bp, Homo sapiens
cacttgtgtgtgggctgtgagt

SEQ ID NO: 322929 - DNA, 17 bp, Homo sapiens
cacttgtgttgctttct

SEQ ID NO: 322930 - DNA, 16 bp, Homo sapiens
cacttgttccagctct

SEQ ID NO: 322931 - DNA, 16 bp, Homo sapiens
cactttacataggatt

SEQ ID NO: 322932 - DNA, 18 bp, Homo sapiens
cactttagtgtattttct

SEQ ID NO: 322933 - DNA, 12 bp, Homo sapiens
cactttcaaaac

SEQ ID NO: 322934 - DNA, 22 bp, Homo sapiens
cactttccccgtgggccatggc

SEQ ID NO: 322935 - DNA, 20 bp, Homo sapiens
cactttccctagaaagccat

SEQ ID NO: 322936 - DNA, 19 bp, Homo sapiens
cactttcccttcccctgtg

SEQ ID NO: 322937 - DNA, 17 bp, Homo sapiens
cactttcctagttctta

SEQ ID NO: 322938 - DNA, 21 bp, Homo sapiens
cactttcctggataaaaaaga

SEQ ID NO: 322939 - DNA, 16 bp, Homo sapiens
cactttctatagcaga

SEQ ID NO: 322940 - DNA, 21 bp, Homo sapiens
cactttgagcatttttaaggg

SEQ ID NO: 322941 - DNA, 14 bp, Homo sapiens
cactttgcagacct

SEQ ID NO: 322942 - DNA, 12 bp, Homo sapiens
cactttgctctg

SEQ ID NO: 322943 - DNA, 13 bp, Homo sapiens
cactttgctctgg

SEQ ID NO: 322944 - DNA, 12 bp, Homo sapiens
cactttggggaa

SEQ ID NO: 322945 - DNA, 19 bp, Homo sapiens
cactttggggaactcaaag

SEQ ID NO: 322946 - DNA, 23 bp, Homo sapiens
cactttggtctccatttttccca

SEQ ID NO: 322947 - DNA, 14 bp, Homo sapiens
cactttgtattctc

SEQ ID NO: 322948 - DNA, 19 bp, Homo sapiens
cactttgtattctctgtcc

SEQ ID NO: 322949 - DNA, 16 bp, Homo sapiens
cactttgtgagtattc

SEQ ID NO: 322950 - DNA, 23 bp, Homo sapiens
cactttgttggcccttccagtgg

SEQ ID NO: 322951 - DNA, 14 bp, Homo sapiens
cacttttcacttgt

SEQ ID NO: 322952 - DNA, 12 bp, Homo sapiens
cacttttctcca

SEQ ID NO: 322953 - DNA, 16 bp, Homo sapiens
cacttttgaactcacg

SEQ ID NO: 322954 - DNA, 19 bp, Homo sapiens
cacttttgcacatatattt

SEQ ID NO: 322955 - DNA, 13 bp, Homo sapiens
cactttttcacat

SEQ ID NO: 322956 - DNA, 19 bp, Homo sapiens
cactttttcacataagcca

SEQ ID NO: 322957 - DNA, 16 bp, Homo sapiens
cactttttccatttct

SEQ ID NO: 322958 - DNA, 15 bp, Homo sapiens
cactttttgcagctt

SEQ ID NO: 322959 - DNA, 22 bp, Homo sapiens
cacttttttcctgtcaatatat

SEQ ID NO: 322960 - DNA, 16 bp, Homo sapiens
cagaaaacaacaaaaa

SEQ ID NO: 322961 - DNA, 13 bp, Homo sapiens
cagaaaacagaaa

SEQ ID NO: 322962 - DNA, 16 bp, Homo sapiens
cagaaaacagaaaaaa

SEQ ID NO: 322963 - DNA, 22 bp, Homo sapiens
cagaaaatagggtggacagaag

SEQ ID NO: 322964 - DNA, 20 bp, Homo sapiens
cagaaacacctagatcagaa

SEQ ID NO: 322965 - DNA, 21 bp, Homo sapiens
cagaaaccattgttcagaaga

SEQ ID NO: 322966 - DNA, 17 bp, Homo sapiens
cagaaaccttgtttgtt

SEQ ID NO: 322967 - DNA, 19 bp, Homo sapiens
cagaaaccttgtttgtttt

SEQ ID NO: 322968 - DNA, 20 bp, Homo sapiens
cagaaagcaaatcagacaca

SEQ ID NO: 322969 - DNA, 21 bp, Homo sapiens
cagaaagcaaatcagacacaa

SEQ ID NO: 322970 - DNA, 17 bp, Homo sapiens
cagaaagcagaggctgg

SEQ ID NO: 322971 - DNA, 22 bp, Homo sapiens
cagaaagcagaggctggcctca

SEQ ID NO: 322972 - DNA, 22 bp, Homo sapiens
cagaaagcctcctgccccctgc

SEQ ID NO: 322973 - DNA, 23 bp, Homo sapiens
cagaaagcctcctgccccctgcc

SEQ ID NO: 322974 - DNA, 12 bp, Homo sapiens
cagaaaggagac

SEQ ID NO: 322975 - DNA, 20 bp, Homo sapiens
cagaaaggatatttaagaaa

SEQ ID NO: 322976 - DNA, 22 bp, Homo sapiens
cagaaagggagcagagaaggcc

SEQ ID NO: 322977 - DNA, 17 bp, Homo sapiens
cagaaagggcagcccct

SEQ ID NO: 322978 - DNA, 20 bp, Homo sapiens
cagaaagggcagcccctccc

SEQ ID NO: 322979 - DNA, 15 bp, Homo sapiens
cagaaagggcagctt

SEQ ID NO: 322980 - DNA, 24 bp, Homo sapiens
cagaaagggcagcttcagtctctg

SEQ ID NO: 322981 - DNA, 19 bp, Homo sapiens
cagaaagtcaccaggactt

SEQ ID NO: 322982 - DNA, 17 bp, Homo sapiens
cagaaagtgtgctttat

SEQ ID NO: 322983 - DNA, 16 bp, Homo sapiens
cagaaatcagaggaga

SEQ ID NO: 322984 - DNA, 16 bp, Homo sapiens
cagaaatcccagttca

SEQ ID NO: 322985 - DNA, 21 bp, Homo sapiens
cagaaatgctgcctgcctgtc

SEQ ID NO: 322986 - DNA, 23 bp, Homo sapiens
cagaaatgctgcctgcctgtctg

SEQ ID NO: 322987 - DNA, 11 bp, Homo sapiens
cagaaatgtgc

SEQ ID NO: 322988 - DNA, 19 bp, Homo sapiens
cagaaatgtgctgcaaaga

SEQ ID NO: 322989 - DNA, 20 bp, Homo sapiens
cagaacaaacctctatatgt

SEQ ID NO: 322990 - DNA, 14 bp, Homo sapiens
cagaacacattctt

SEQ ID NO: 322991 - DNA, 12 bp, Homo sapiens
cagaacacctgg

SEQ ID NO: 322992 - DNA, 12 bp, Homo sapiens
cagaacagctga

SEQ ID NO: 322993 - DNA, 19 bp, Homo sapiens
cagaacagttaagcagccg

SEQ ID NO: 322994 - DNA, 17 bp, Homo sapiens
cagaacatgagtgctga

SEQ ID NO: 322995 - DNA, 13 bp, Homo sapiens
cagaacatgagtt

SEQ ID NO: 322996 - DNA, 14 bp, Homo sapiens
cagaacatttctca

SEQ ID NO: 322997 - DNA, 16 bp, Homo sapiens
cagaaccaaagctcaa

SEQ ID NO: 322998 - DNA, 20 bp, Homo sapiens
cagaaccaacgggtctgtgg

SEQ ID NO: 322999 - DNA, 14 bp, Homo sapiens
cagaaccacactgt

SEQ ID NO: 323000 - DNA, 15 bp, Homo sapiens
cagaaccacactgtt

SEQ ID NO: 323001 - DNA, 13 bp, Homo sapiens
cagaaccagcact

SEQ ID NO: 323002 - DNA, 15 bp, Homo sapiens
cagaaccagcactcc

SEQ ID NO: 323003 - DNA, 16 bp, Homo sapiens
cagaaccagcactccc

SEQ ID NO: 323004 - DNA, 18 bp, Homo sapiens
cagaaccagcactcccag

SEQ ID NO: 323005 - DNA, 13 bp, Homo sapiens
cagaaccagctct

SEQ ID NO: 323006 - DNA, 19 bp, Homo sapiens
cagaaccccaactcccagc

SEQ ID NO: 323007 - DNA, 22 bp, Homo sapiens
cagaaccctggtgaggaagctc

SEQ ID NO: 323008 - DNA, 14 bp, Homo sapiens
cagaacctcttccc

SEQ ID NO: 323009 - DNA, 15 bp, Homo sapiens
cagaacctcttcccc

SEQ ID NO: 323010 - DNA, 18 bp, Homo sapiens
cagaacctcttccccaga

SEQ ID NO: 323011 - DNA, 17 bp, Homo sapiens
cagaacgcaccccactg

SEQ ID NO: 323012 - DNA, 22 bp, Homo sapiens
cgtgcacgtggagagctggtgc

SEQ ID NO: 323013 - DNA, 13 bp, Homo sapiens
cgtgcactctgct

SEQ ID NO: 323014 - DNA, 14 bp, Homo sapiens
cgtgcactctgcta

SEQ ID NO: 323015 - DNA, 16 bp, Homo sapiens
cgtgcagtacaggcaa

SEQ ID NO: 323016 - DNA, 14 bp, Homo sapiens
cgtgcatggctcct

SEQ ID NO: 323017 - DNA, 21 bp, Homo sapiens
cgtgcattggaagaccccacc

SEQ ID NO: 323018 - DNA, 13 bp, Homo sapiens
cgtgcatttgtga

SEQ ID NO: 323019 - DNA, 14 bp, Homo sapiens
cgtgccattgtctt

SEQ ID NO: 323020 - DNA, 16 bp, Homo sapiens
cgtgcccagtggctgc

SEQ ID NO: 323021 - DNA, 14 bp, Homo sapiens
cgtgccccccagtt

SEQ ID NO: 323022 - DNA, 15 bp, Homo sapiens
cgtgcccccctcctc

SEQ ID NO: 323023 - DNA, 16 bp, Homo sapiens
cgtgcccccctcctcc

SEQ ID NO: 323024 - DNA, 15 bp, Homo sapiens
cgtgcccgcccacct

SEQ ID NO: 323025 - DNA, 19 bp, Homo sapiens
cgtgcctccttccacctcc

SEQ ID NO: 323026 - DNA, 23 bp, Homo sapiens
cgtgcctccttccacctccctcc

SEQ ID NO: 323027 - DNA, 18 bp, Homo sapiens
cgtgccttcagctctaca

SEQ ID NO: 323028 - DNA, 23 bp, Homo sapiens
cgtgcgcagccgcgctctgcccc

SEQ ID NO: 323029 - DNA, 12 bp, Homo sapiens
cgtgcggcccgt

SEQ ID NO: 323030 - DNA, 13 bp, Homo sapiens
cgtgctggagagt

SEQ ID NO: 323031 - DNA, 15 bp, Homo sapiens
cgtgctggagagtag

SEQ ID NO: 323032 - DNA, 12 bp, Homo sapiens
cgtgctggagga

SEQ ID NO: 323033 - DNA, 16 bp, Homo sapiens
cgtgctgtctgtccta

SEQ ID NO: 323034 - DNA, 17 bp, Homo sapiens
cgtggacacctgccctg

SEQ ID NO: 323035 - DNA, 17 bp, Homo sapiens
cgtggactctgtgctca

SEQ ID NO: 323036 - DNA, 19 bp, Homo sapiens
cgtggactctgtgctcacc

SEQ ID NO: 323037 - DNA, 12 bp, Homo sapiens
cgtggagaggga

SEQ ID NO: 323038 - DNA, 13 bp, Homo sapiens
cgtggagagggat

SEQ ID NO: 323039 - DNA, 22 bp, Homo sapiens
cgtggagatagtgccaggtggc

SEQ ID NO: 323040 - DNA, 12 bp, Homo sapiens
cgtggagccaca

SEQ ID NO: 323041 - DNA, 17 bp, Homo sapiens
cgtggagccacaggcag

SEQ ID NO: 323042 - DNA, 19 bp, Homo sapiens
cgtggagccacaggcagac

SEQ ID NO: 323043 - DNA, 20 bp, Homo sapiens
cgtggagccacaggcagacg

SEQ ID NO: 323044 - DNA, 16 bp, Homo sapiens
cgtggagccagggagc

SEQ ID NO: 323045 - DNA, 15 bp, Homo sapiens
cgatccacctgtctc

SEQ ID NO: 323046 - DNA, 23 bp, Homo sapiens
cgatctggaaagagctgttttgg

SEQ ID NO: 323047 - DNA, 21 bp, Homo sapiens
cgatgatgcttgtaacaagaa

SEQ ID NO: 323048 - DNA, 21 bp, Homo sapiens
cgatgcactcgcactgcaaat

SEQ ID NO: 323049 - DNA, 13 bp, Homo sapiens
cgatgcactgacc

SEQ ID NO: 323050 - DNA, 17 bp, Homo sapiens
cgatgcactgacctgct

SEQ ID NO: 323051 - DNA, 19 bp, Homo sapiens
cgatgcccgcccggggagt

SEQ ID NO: 323052 - DNA, 20 bp, Homo sapiens
cgatgctccagccaacccct

SEQ ID NO: 323053 - DNA, 22 bp, Homo sapiens
cgatgctccagccaacccctgt

SEQ ID NO: 323054 - DNA, 23 bp, Homo sapiens
cgatgctccagccaacccctgtg

SEQ ID NO: 323055 - DNA, 15 bp, Homo sapiens
cgatggagcccccag

SEQ ID NO: 323056 - DNA, 16 bp, Homo sapiens
cgatggagcccccaga

SEQ ID NO: 323057 - DNA, 21 bp, Homo sapiens
cgatgggggatgcttcatgtg

SEQ ID NO: 323058 - DNA, 17 bp, Homo sapiens
cgatggtcccaggaagc

SEQ ID NO: 323059 - DNA, 21 bp, Homo sapiens
cgatgttaaaacaaattaaaa

SEQ ID NO: 323060 - DNA, 15 bp, Homo sapiens
cgattctcatgcctc

SEQ ID NO: 323061 - DNA, 14 bp, Homo sapiens
cgattttatctgtt

SEQ ID NO: 323062 - DNA, 16 bp, Homo sapiens
cgcaaggcctgtgctg

SEQ ID NO: 323063 - DNA, 19 bp, Homo sapiens
cgcaagggcatcaggcact

SEQ ID NO: 323064 - DNA, 21 bp, Homo sapiens
cgcaagggcatcaggcactgg

SEQ ID NO: 323065 - DNA, 18 bp, Homo sapiens
cgcaatgtgcccccagac

SEQ ID NO: 323066 - DNA, 23 bp, Homo sapiens
cgcacaaatgaccgcacgttctc

SEQ ID NO: 323067 - DNA, 10 bp, Homo sapiens
cgcacacaca

SEQ ID NO: 323068 - DNA, 10 bp, Homo sapiens
cgcacagcag

SEQ ID NO: 323069 - DNA, 23 bp, Homo sapiens
cgcacatgccgcgggcggccagg

SEQ ID NO: 323070 - DNA, 13 bp, Homo sapiens
cgcaccagctgct

SEQ ID NO: 323071 - DNA, 14 bp, Homo sapiens
cgcacccccaccct

SEQ ID NO: 323072 - DNA, 22 bp, Homo sapiens
cgcaccccgatgtggacctcta

SEQ ID NO: 323073 - DNA, 13 bp, Homo sapiens
cgcacctaaagca

SEQ ID NO: 323074 - DNA, 17 bp, Homo sapiens
cgcacctgtagtcccag

SEQ ID NO: 323075 - DNA, 22 bp, Homo sapiens
cgcaccttgtcatgtaccatca

SEQ ID NO: 323076 - DNA, 11 bp, Homo sapiens
cgcacgcacac

SEQ ID NO: 323077 - DNA, 14 bp, Homo sapiens
cgcacgcacacaca

SEQ ID NO: 323078 - DNA, 11 bp, Homo sapiens
cgcagacacac

SEQ ID NO: 323079 - DNA, 14 bp, Homo sapiens
cgcagagccccgga

SEQ ID NO: 323080 - DNA, 20 bp, Homo sapiens
cgcagagccccggagcacca

SEQ ID NO: 323081 - DNA, 15 bp, Homo sapiens
cgcagagtaaaataa

SEQ ID NO: 323082 - DNA, 14 bp, Homo sapiens
cgcagatgatccat

SEQ ID NO: 323083 - DNA, 17 bp, Homo sapiens
cgcagcaccagcctgag

SEQ ID NO: 323084 - DNA, 10 bp, Homo sapiens
cgcagcagct

SEQ ID NO: 323085 - DNA, 13 bp, Homo sapiens
cgcagccaggaca

SEQ ID NO: 323086 - DNA, 15 bp, Homo sapiens
cgcagcccctggagc

SEQ ID NO: 323087 - DNA, 15 bp, Homo sapiens
cgcagcccgcctgcc

SEQ ID NO: 323088 - DNA, 16 bp, Homo sapiens
cgcagcccgcctgccg

SEQ ID NO: 323089 - DNA, 22 bp, Homo sapiens
cgcagcccgtgaagcagtgcct

SEQ ID NO: 323090 - DNA, 10 bp, Homo sapiens
cgcagccctg

SEQ ID NO: 323091 - DNA, 16 bp, Homo sapiens
cgcagccgcgctctgc

SEQ ID NO: 323092 - DNA, 18 bp, Homo sapiens
cgcagccgcgctctgccc

SEQ ID NO: 323093 - DNA, 22 bp, Homo sapiens
cgcagccgcgctctgcccctcc

SEQ ID NO: 323094 - DNA, 13 bp, Homo sapiens
cgcagcctccagt

SEQ ID NO: 323095 - DNA, 11 bp, Homo sapiens
cgcaggaatgg

SEQ ID NO: 323096 - DNA, 14 bp, Homo sapiens
cgcaggagagagag

SEQ ID NO: 323097 - DNA, 19 bp, Homo sapiens
cgcaggagtctctgccacc

SEQ ID NO: 323098 - DNA, 22 bp, Homo sapiens
cgcaggagtctctgccacccac

SEQ ID NO: 323099 - DNA, 17 bp, Homo sapiens
cgcaggatccgctgcca

SEQ ID NO: 323100 - DNA, 13 bp, Homo sapiens
cgcagggcgctcc

SEQ ID NO: 323101 - DNA, 16 bp, Homo sapiens
cgcaggggttgcagtg

SEQ ID NO: 323102 - DNA, 17 bp, Homo sapiens
cgcagtccccagccctt

SEQ ID NO: 323103 - DNA, 15 bp, Homo sapiens
cgcagtgcccagtga

SEQ ID NO: 323104 - DNA, 23 bp, Homo sapiens
cgcatagtgtgctcggacacagt

SEQ ID NO: 323105 - DNA, 22 bp, Homo sapiens
cgcatatgtgagtgaaagtact

SEQ ID NO: 323106 - DNA, 22 bp, Homo sapiens
cgcatccgcctctgagccagga

SEQ ID NO: 323107 - DNA, 13 bp, Homo sapiens
cgcatcctccagg

SEQ ID NO: 323108 - DNA, 13 bp, Homo sapiens
cgcatctgctcat

SEQ ID NO: 323109 - DNA, 16 bp, Homo sapiens
cgcatctgctcatctg

SEQ ID NO: 323110 - DNA, 18 bp, Homo sapiens
cgcatctgctcatctgat

SEQ ID NO: 323111 - DNA, 16 bp, Homo sapiens
cgcatgcagcagcttg

SEQ ID NO: 323112 - DNA, 17 bp, Homo sapiens
cgcatggcccctccagg

SEQ ID NO: 323113 - DNA, 21 bp, Homo sapiens
cgcatggcccctccaggaaca

SEQ ID NO: 323114 - DNA, 13 bp, Homo sapiens
cgcatgtgtctgt

SEQ ID NO: 323115 - DNA, 14 bp, Homo sapiens
cgccaacagccccc

SEQ ID NO: 323116 - DNA, 23 bp, Homo sapiens
cgccaccatcctgcagcctcctc

SEQ ID NO: 323117 - DNA, 21 bp, Homo sapiens
cgccacctgtgtgttcttttg

SEQ ID NO: 323118 - DNA, 12 bp, Homo sapiens
cgccacggccac

SEQ ID NO: 323119 - DNA, 18 bp, Homo sapiens
cgccacggccaccctcct

SEQ ID NO: 323120 - DNA, 23 bp, Homo sapiens
cgccactaggtgtccccaacgtc

SEQ ID NO: 323121 - DNA, 24 bp, Homo sapiens
cgccactcctatccccaggccagg

SEQ ID NO: 323122 - DNA, 20 bp, Homo sapiens
cgccactggctgtgcctccc

SEQ ID NO: 323123 - DNA, 16 bp, Homo sapiens
cgccagattctccctt

SEQ ID NO: 323124 - DNA, 21 bp, Homo sapiens
cgccattctcctgcctcagcc

SEQ ID NO: 323125 - DNA, 15 bp, Homo sapiens
cgcccacccacaccc

SEQ ID NO: 323126 - DNA, 10 bp, Homo sapiens
cgcccacccc

SEQ ID NO: 323127 - DNA, 18 bp, Homo sapiens
cgcccaccccgctgcctg

SEQ ID NO: 323128 - DNA, 15 bp, Homo sapiens
cgcccacctctgctg

SEQ ID NO: 323129 - DNA, 18 bp, Homo sapiens
cgcccacctgcatcagcc

SEQ ID NO: 323130 - DNA, 15 bp, Homo sapiens
cgcccacctgcccag

SEQ ID NO: 323131 - DNA, 15 bp, Homo sapiens
cgcccactgtcctgg

SEQ ID NO: 323132 - DNA, 18 bp, Homo sapiens
cgcccactgtcctgggcg

SEQ ID NO: 323133 - DNA, 16 bp, Homo sapiens
cgcccagacaccacag

SEQ ID NO: 323134 - DNA, 24 bp, Homo sapiens
cgcccagacaccacagacgccacc

SEQ ID NO: 323135 - DNA, 19 bp, Homo sapiens
cgcccattcgtctgtccca

SEQ ID NO: 323136 - DNA, 14 bp, Homo sapiens
cgccccagagactg

SEQ ID NO: 323137 - DNA, 21 bp, Homo sapiens
cgccccagagactgcccaccc

SEQ ID NO: 323138 - DNA, 23 bp, Homo sapiens
cgccccagagactgcccaccctg

SEQ ID NO: 323139 - DNA, 12 bp, Homo sapiens
cgccccagagct

SEQ ID NO: 323140 - DNA, 13 bp, Homo sapiens
cgccccagagctc

SEQ ID NO: 323141 - DNA, 19 bp, Homo sapiens
cgccccagataccagcccc

SEQ ID NO: 323142 - DNA, 12 bp, Homo sapiens
cgccccagcccg

SEQ ID NO: 323143 - DNA, 14 bp, Homo sapiens
cgccccagcctctg

SEQ ID NO: 323144 - DNA, 12 bp, Homo sapiens
cgcccccagtgt

SEQ ID NO: 323145 - DNA, 12 bp, Homo sapiens
cgccccccacct

SEQ ID NO: 323146 - DNA, 13 bp, Homo sapiens
cgccccccacctt

SEQ ID NO: 323147 - DNA, 13 bp, Homo sapiens
cgccccccagagc

SEQ ID NO: 323148 - DNA, 14 bp, Homo sapiens
cgccccccagagcc

SEQ ID NO: 323149 - DNA, 22 bp, Homo sapiens
cgcccccctacccccttgtctg

SEQ ID NO: 323150 - DNA, 23 bp, Homo sapiens
cgcccccctacccccttgtctgc

SEQ ID NO: 323151 - DNA, 13 bp, Homo sapiens
cgccccctcccta

SEQ ID NO: 323152 - DNA, 13 bp, Homo sapiens
cgccccgccccac

SEQ ID NO: 323153 - DNA, 14 bp, Homo sapiens
cgccccgccccaca

SEQ ID NO: 323154 - DNA, 17 bp, Homo sapiens
cgccccgccccacattc

SEQ ID NO: 323155 - DNA, 14 bp, Homo sapiens
cgccccgccccaga

SEQ ID NO: 323156 - DNA, 17 bp, Homo sapiens
cgccccgccccagagct

SEQ ID NO: 323157 - DNA, 15 bp, Homo sapiens
cgcccctccagtgtt

SEQ ID NO: 323158 - DNA, 15 bp, Homo sapiens
cgcccctcccaagcg

SEQ ID NO: 323159 - DNA, 16 bp, Homo sapiens
cgcccctccccacccc

SEQ ID NO: 323160 - DNA, 20 bp, Homo sapiens
cgcccctcgctgctgctact

SEQ ID NO: 323161 - DNA, 19 bp, Homo sapiens
cgcccgactagcaggcatg

SEQ ID NO: 323162 - DNA, 21 bp, Homo sapiens
cgcccgactagcaggcatgcc

SEQ ID NO: 323163 - DNA, 12 bp, Homo sapiens
cgcccgcccacc

SEQ ID NO: 323164 - DNA, 20 bp, Homo sapiens
cgcccgcccaccccgctgcc

SEQ ID NO: 323165 - DNA, 13 bp, Homo sapiens
cgcccgcccccgc

SEQ ID NO: 323166 - DNA, 19 bp, Homo sapiens
cgcccgccctcctctgccc

SEQ ID NO: 323167 - DNA, 21 bp, Homo sapiens
cgcccgccctcctctgccccc

SEQ ID NO: 323168 - DNA, 22 bp, Homo sapiens
cgcccgccctcctctgccccct

SEQ ID NO: 323169 - DNA, 14 bp, Homo sapiens
cgcccgctgggctg

SEQ ID NO: 323170 - DNA, 23 bp, Homo sapiens
cgcccgctgggctgagcccctac

SEQ ID NO: 323171 - DNA, 13 bp, Homo sapiens
cgcccgggcccag

SEQ ID NO: 323172 - DNA, 18 bp, Homo sapiens
cgccctccctccctccac

SEQ ID NO: 323173 - DNA, 15 bp, Homo sapiens
cgccctccctctccc

SEQ ID NO: 323174 - DNA, 10 bp, Homo sapiens
cgccctcctc

SEQ ID NO: 323175 - DNA, 19 bp, Homo sapiens
cgccctcctcgctgtgcca

SEQ ID NO: 323176 - DNA, 14 bp, Homo sapiens
cgccctcctctgcc

SEQ ID NO: 323177 - DNA, 15 bp, Homo sapiens
cgccctcctctgccc

SEQ ID NO: 323178 - DNA, 15 bp, Homo sapiens
cgccctctgccccca

SEQ ID NO: 323179 - DNA, 15 bp, Homo sapiens
cgccctgatttgctg

SEQ ID NO: 323180 - DNA, 17 bp, Homo sapiens
cacgtggactctgtgct

SEQ ID NO: 323181 - DNA, 18 bp, Homo sapiens
cacgtggactctgtgctc

SEQ ID NO: 323182 - DNA, 17 bp, Homo sapiens
cacgtggcctcttgagc

SEQ ID NO: 323183 - DNA, 20 bp, Homo sapiens
cacgtggcctcttgagcagt

SEQ ID NO: 323184 - DNA, 23 bp, Homo sapiens
cacgtgtctggaatcccagctcc

SEQ ID NO: 323185 - DNA, 15 bp, Homo sapiens
cacgtgtttttgtat

SEQ ID NO: 323186 - DNA, 20 bp, Homo sapiens
cacgttccttcccccgcaat

SEQ ID NO: 323187 - DNA, 14 bp, Homo sapiens
cactaaaagtgatg

SEQ ID NO: 323188 - DNA, 18 bp, Homo sapiens
cactaaaagtgatgtgat

SEQ ID NO: 323189 - DNA, 19 bp, Homo sapiens
cactaaaagtgatgtgatt

SEQ ID NO: 323190 - DNA, 21 bp, Homo sapiens
cactaaaataaaatttaaaaa

SEQ ID NO: 323191 - DNA, 15 bp, Homo sapiens
cactaaagtatgtaa

SEQ ID NO: 323192 - DNA, 22 bp, Homo sapiens
cactaaagtatgtaaagtatgt

SEQ ID NO: 323193 - DNA, 15 bp, Homo sapiens
cactaaatttctcag

SEQ ID NO: 323194 - DNA, 17 bp, Homo sapiens
cactaagctttctcctt

SEQ ID NO: 323195 - DNA, 20 bp, Homo sapiens
cactaagctttctcctttga

SEQ ID NO: 323196 - DNA, 16 bp, Homo sapiens
cactaataatagtact

SEQ ID NO: 323197 - DNA, 18 bp, Homo sapiens
cactaatgttagaattga

SEQ ID NO: 323198 - DNA, 22 bp, Homo sapiens
cactaatgttagaattgatttc

SEQ ID NO: 323199 - DNA, 12 bp, Homo sapiens
cactacaaacat

SEQ ID NO: 323200 - DNA, 17 bp, Homo sapiens
cactacaacctccacct

SEQ ID NO: 323201 - DNA, 15 bp, Homo sapiens
cactacagagcagct

SEQ ID NO: 323202 - DNA, 23 bp, Homo sapiens
cactacatgcagcccatgcccac

SEQ ID NO: 323203 - DNA, 20 bp, Homo sapiens
cactacatgtggtttataga

SEQ ID NO: 323204 - DNA, 22 bp, Homo sapiens
cactacccatcggtgtccattt

SEQ ID NO: 323205 - DNA, 19 bp, Homo sapiens
cactaccctcctgtaaaat

SEQ ID NO: 323206 - DNA, 14 bp, Homo sapiens
cactacctttgtcc

SEQ ID NO: 323207 - DNA, 20 bp, Homo sapiens
cactacctttgtccaggcct

SEQ ID NO: 323208 - DNA, 14 bp, Homo sapiens
cactactctgtgcc

SEQ ID NO: 323209 - DNA, 13 bp, Homo sapiens
cactactgacatg

SEQ ID NO: 323210 - DNA, 15 bp, Homo sapiens
cactactgacatgtg

SEQ ID NO: 323211 - DNA, 17 bp, Homo sapiens
cactagcattttcttga

SEQ ID NO: 323212 - DNA, 23 bp, Homo sapiens
cactagccctctttctctctgtg

SEQ ID NO: 323213 - DNA, 22 bp, Homo sapiens
cactaggataggaactgggcct

SEQ ID NO: 323214 - DNA, 14 bp, Homo sapiens
cactaggctgggtg

SEQ ID NO: 323215 - DNA, 22 bp, Homo sapiens
cactaggctgggtgcccacagc

SEQ ID NO: 323216 - DNA, 21 bp, Homo sapiens
cactaggggatataggagagg

SEQ ID NO: 323217 - DNA, 14 bp, Homo sapiens
cactaggtgtcccc

SEQ ID NO: 323218 - DNA, 16 bp, Homo sapiens
cactaggtgtccccaa

SEQ ID NO: 323219 - DNA, 17 bp, Homo sapiens
cactaggtgtccccaac

SEQ ID NO: 323220 - DNA, 21 bp, Homo sapiens
cactaggtgtccccaacgtcc

SEQ ID NO: 323221 - DNA, 22 bp, Homo sapiens
cactaggtgtccccaacgtccc

SEQ ID NO: 323222 - DNA, 14 bp, Homo sapiens
cactagtagagcaa

SEQ ID NO: 323223 - DNA, 12 bp, Homo sapiens
cactagttttgt

SEQ ID NO: 323224 - DNA, 16 bp, Homo sapiens
cactatccatgcacca

SEQ ID NO: 323225 - DNA, 14 bp, Homo sapiens
cactatgcatttta

SEQ ID NO: 323226 - DNA, 15 bp, Homo sapiens
cactatgcattttaa

SEQ ID NO: 323227 - DNA, 18 bp, Homo sapiens
cactatgggaagctctgt

SEQ ID NO: 323228 - DNA, 17 bp, Homo sapiens
cactatggtatttgagt

SEQ ID NO: 323229 - DNA, 16 bp, Homo sapiens
cactatgtttctcaga

SEQ ID NO: 323230 - DNA, 13 bp, Homo sapiens
cactattagagaa

SEQ ID NO: 323231 - DNA, 16 bp, Homo sapiens
cactattcttaagcac

SEQ ID NO: 323232 - DNA, 17 bp, Homo sapiens
cactattcttaagcact

SEQ ID NO: 323233 - DNA, 18 bp, Homo sapiens
cactcacagagacacagg

SEQ ID NO: 323234 - DNA, 15 bp, Homo sapiens
cactcacaggctaca

SEQ ID NO: 323235 - DNA, 23 bp, Homo sapiens
cactcacatgctggacaggtctg

SEQ ID NO: 323236 - DNA, 15 bp, Homo sapiens
cactcaccagggtcc

SEQ ID NO: 323237 - DNA, 22 bp, Homo sapiens
cactcaccagggtccgcaccag

SEQ ID NO: 323238 - DNA, 15 bp, Homo sapiens
cactcactgcatttg

SEQ ID NO: 323239 - DNA, 13 bp, Homo sapiens
cactcagaattat

SEQ ID NO: 323240 - DNA, 22 bp, Homo sapiens
cactcagctgagaaggccagcc

SEQ ID NO: 323241 - DNA, 21 bp, Homo sapiens
cactcagctgttcagattgga

SEQ ID NO: 323242 - DNA, 13 bp, Homo sapiens
cactcagggctgg

SEQ ID NO: 323243 - DNA, 17 bp, Homo sapiens
cactcagggctggcccg

SEQ ID NO: 323244 - DNA, 21 bp, Homo sapiens
cactcagggctggcccgggga

SEQ ID NO: 323245 - DNA, 18 bp, Homo sapiens
cactcatgcggcccagcc

SEQ ID NO: 323246 - DNA, 19 bp, Homo sapiens
cactcatgcggcccagcca

SEQ ID NO: 323247 - DNA, 21 bp, Homo sapiens
cactcatgcggcccagccatg

SEQ ID NO: 323248 - DNA, 23 bp, Homo sapiens
cactcatttacgtaaaaagatat

SEQ ID NO: 323249 - DNA, 16 bp, Homo sapiens
cactccacctccaccc

SEQ ID NO: 323250 - DNA, 17 bp, Homo sapiens
cactccacctccaccca

SEQ ID NO: 323251 - DNA, 15 bp, Homo sapiens
cactccactcccctc

SEQ ID NO: 323252 - DNA, 17 bp, Homo sapiens
cactccactcccctcat

SEQ ID NO: 323253 - DNA, 14 bp, Homo sapiens
cactccagacccct

SEQ ID NO: 323254 - DNA, 16 bp, Homo sapiens
cactccagacccctgg

SEQ ID NO: 323255 - DNA, 14 bp, Homo sapiens
cactccatggccac

SEQ ID NO: 323256 - DNA, 17 bp, Homo sapiens
cactccatggccacccc

SEQ ID NO: 323257 - DNA, 17 bp, Homo sapiens
cactcccactgccagga

SEQ ID NO: 323258 - DNA, 19 bp, Homo sapiens
cactcccactgccaggatt

SEQ ID NO: 323259 - DNA, 12 bp, Homo sapiens
cactcccagggc

SEQ ID NO: 323260 - DNA, 14 bp, Homo sapiens
cactcccagggccc

SEQ ID NO: 323261 - DNA, 16 bp, Homo sapiens
cactcccccacctgac

SEQ ID NO: 323262 - DNA, 21 bp, Homo sapiens
cactccctaaagccctcttca

SEQ ID NO: 323263 - DNA, 14 bp, Homo sapiens
cactccctgagctt

SEQ ID NO: 323264 - DNA, 14 bp, Homo sapiens
cactccctgccaac

SEQ ID NO: 323265 - DNA, 12 bp, Homo sapiens
cactccctgctc

SEQ ID NO: 323266 - DNA, 16 bp, Homo sapiens
cactccctgctccacg

SEQ ID NO: 323267 - DNA, 14 bp, Homo sapiens
cactccctgtccat

SEQ ID NO: 323268 - DNA, 23 bp, Homo sapiens
cactccctgtccatccccagttg

SEQ ID NO: 323269 - DNA, 17 bp, Homo sapiens
cactccctttcccctct

SEQ ID NO: 323270 - DNA, 19 bp, Homo sapiens
cactccctttgtggacttt

SEQ ID NO: 323271 - DNA, 16 bp, Homo sapiens
cactccggattccggc

SEQ ID NO: 323272 - DNA, 17 bp, Homo sapiens
cactcctaggacatgtt

SEQ ID NO: 323273 - DNA, 18 bp, Homo sapiens
cactcctaggagagccaa

SEQ ID NO: 323274 - DNA, 23 bp, Homo sapiens
cactcctatccccaggccaggtc

SEQ ID NO: 323275 - DNA, 18 bp, Homo sapiens
cactcctcaactgatgat

SEQ ID NO: 323276 - DNA, 14 bp, Homo sapiens
cactcctcccaact

SEQ ID NO: 323277 - DNA, 16 bp, Homo sapiens
cactcctgctgtgccc

SEQ ID NO: 323278 - DNA, 12 bp, Homo sapiens
cactcctggggc

SEQ ID NO: 323279 - DNA, 13 bp, Homo sapiens
cactcctgtacac

SEQ ID NO: 323280 - DNA, 16 bp, Homo sapiens
cactcctgtcccgcct

SEQ ID NO: 323281 - DNA, 20 bp, Homo sapiens
cactcctgtcccgccttcct

SEQ ID NO: 323282 - DNA, 21 bp, Homo sapiens
cactccttcctgccacctgct

SEQ ID NO: 323283 - DNA, 22 bp, Homo sapiens
cactcctttcttgcactattcc

SEQ ID NO: 323284 - DNA, 17 bp, Homo sapiens
cactcgagaccatcctg

SEQ ID NO: 323285 - DNA, 19 bp, Homo sapiens
cactcgagaccatcctggc

SEQ ID NO: 323286 - DNA, 22 bp, Homo sapiens
cactcgagaccatcctggcccc

SEQ ID NO: 323287 - DNA, 13 bp, Homo sapiens
cactcgcactgca

SEQ ID NO: 323288 - DNA, 17 bp, Homo sapiens
cactcgcccgcccactg

SEQ ID NO: 323289 - DNA, 23 bp, Homo sapiens
cactcgcccgcccactgtcctgg

SEQ ID NO: 323290 - DNA, 13 bp, Homo sapiens
cactcgccttctg

SEQ ID NO: 323291 - DNA, 15 bp, Homo sapiens
cactctaccctccca

SEQ ID NO: 323292 - DNA, 18 bp, Homo sapiens
cactctaccctcccaccc

SEQ ID NO: 323293 - DNA, 17 bp, Homo sapiens
cactctaggggtcaggc

SEQ ID NO: 323294 - DNA, 19 bp, Homo sapiens
cactctagtgacttcctgg

SEQ ID NO: 323295 - DNA, 20 bp, Homo sapiens
cactctagtgacttcctggt

SEQ ID NO: 323296 - DNA, 22 bp, Homo sapiens
cactctagtgacttcctggtga

SEQ ID NO: 323297 - DNA, 13 bp, Homo sapiens
cactctcagagac

SEQ ID NO: 323298 - DNA, 14 bp, Homo sapiens
cactctcagagact

SEQ ID NO: 323299 - DNA, 16 bp, Homo sapiens
cactctcccagaggct

SEQ ID NO: 323300 - DNA, 24 bp, Homo sapiens
cactctcccagaggctcctggagc

SEQ ID NO: 323301 - DNA, 14 bp, Homo sapiens
cactctccccacac

SEQ ID NO: 323302 - DNA, 15 bp, Homo sapiens
cactctcctgggccc

SEQ ID NO: 323303 - DNA, 14 bp, Homo sapiens
cactctctgaagat

SEQ ID NO: 323304 - DNA, 18 bp, Homo sapiens
cactctgaagtcccttcc

SEQ ID NO: 323305 - DNA, 21 bp, Homo sapiens
cactctgaagtcccttcctgt

SEQ ID NO: 323306 - DNA, 15 bp, Homo sapiens
cactctgacagtatt

SEQ ID NO: 323307 - DNA, 12 bp, Homo sapiens
cactctgacctt

SEQ ID NO: 323308 - DNA, 15 bp, Homo sapiens
cactctgccagggca

SEQ ID NO: 323309 - DNA, 23 bp, Homo sapiens
cactctgcctctaaggccaaggc

SEQ ID NO: 323310 - DNA, 16 bp, Homo sapiens
cactctgctctgcaca

SEQ ID NO: 323311 - DNA, 10 bp, Homo sapiens
cactctgctg

SEQ ID NO: 323312 - DNA, 12 bp, Homo sapiens
cactctgctggc

SEQ ID NO: 323313 - DNA, 13 bp, Homo sapiens
cactctgctggcg

SEQ ID NO: 323314 - DNA, 15 bp, Homo sapiens
cacctggggcagtca

SEQ ID NO: 323315 - DNA, 17 bp, Homo sapiens
cacctggtggcctctgc

SEQ ID NO: 323316 - DNA, 18 bp, Homo sapiens
cacctgtacatacattgt

SEQ ID NO: 323317 - DNA, 16 bp, Homo sapiens
cacctgtcccacctca

SEQ ID NO: 323318 - DNA, 15 bp, Homo sapiens
cacctgtctcagcct

SEQ ID NO: 323319 - DNA, 20 bp, Homo sapiens
cacctgtctcatagcctcga

SEQ ID NO: 323320 - DNA, 13 bp, Homo sapiens
cacctgtctgtct

SEQ ID NO: 323321 - DNA, 13 bp, Homo sapiens
cacctgtgacaaa

SEQ ID NO: 323322 - DNA, 19 bp, Homo sapiens
cacctgtgagtttaaagca

SEQ ID NO: 323323 - DNA, 23 bp, Homo sapiens
cacctgtgcagcgaagcttagcg

SEQ ID NO: 323324 - DNA, 20 bp, Homo sapiens
cacctgtgctacctctaaca

SEQ ID NO: 323325 - DNA, 22 bp, Homo sapiens
cacctgtgctacctctaacacc

SEQ ID NO: 323326 - DNA, 14 bp, Homo sapiens
cacctgtgctgctg

SEQ ID NO: 323327 - DNA, 17 bp, Homo sapiens
cacctgtggccagagca

SEQ ID NO: 323328 - DNA, 23 bp, Homo sapiens
cacctgtggccagagcacctcag

SEQ ID NO: 323329 - DNA, 21 bp, Homo sapiens
cacctgtgtgttcttttgata

SEQ ID NO: 323330 - DNA, 23 bp, Homo sapiens
cacctgttaaggtggaaaatgga

SEQ ID NO: 323331 - DNA, 15 bp, Homo sapiens
cacctgttgcacctc

SEQ ID NO: 323332 - DNA, 19 bp, Homo sapiens
cacctgtttttaagctgtt

SEQ ID NO: 323333 - DNA, 20 bp, Homo sapiens
caccttaaaattagcatctg

SEQ ID NO: 323334 - DNA, 17 bp, Homo sapiens
caccttaccaactttct

SEQ ID NO: 323335 - DNA, 19 bp, Homo sapiens
caccttaccctactggctg

SEQ ID NO: 323336 - DNA, 20 bp, Homo sapiens
caccttaccctactggctgt

SEQ ID NO: 323337 - DNA, 23 bp, Homo sapiens
caccttattagctaaaaatatat

SEQ ID NO: 323338 - DNA, 18 bp, Homo sapiens
caccttcattctccgttg

SEQ ID NO: 323339 - DNA, 13 bp, Homo sapiens
caccttccaagga

SEQ ID NO: 323340 - DNA, 15 bp, Homo sapiens
caccttccctccacc

SEQ ID NO: 323341 - DNA, 17 bp, Homo sapiens
caccttcctgactggga

SEQ ID NO: 323342 - DNA, 12 bp, Homo sapiens
caccttcctggg

SEQ ID NO: 323343 - DNA, 14 bp, Homo sapiens
caccttcctgggca

SEQ ID NO: 323344 - DNA, 23 bp, Homo sapiens
caccttcctgggcagcccagaga

SEQ ID NO: 323345 - DNA, 16 bp, Homo sapiens
caccttcttggcttct

SEQ ID NO: 323346 - DNA, 20 bp, Homo sapiens
caccttcttggcttctggga

SEQ ID NO: 323347 - DNA, 18 bp, Homo sapiens
caccttgaacaccacgct

SEQ ID NO: 323348 - DNA, 22 bp, Homo sapiens
caccttgaagaacctctcactt

SEQ ID NO: 323349 - DNA, 23 bp, Homo sapiens
caccttgagaggcatgacagctg

SEQ ID NO: 323350 - DNA, 16 bp, Homo sapiens
caccttgcaacacaca

SEQ ID NO: 323351 - DNA, 20 bp, Homo sapiens
caccttgcactattggactt

SEQ ID NO: 323352 - DNA, 16 bp, Homo sapiens
caccttgccgagagag

SEQ ID NO: 323353 - DNA, 19 bp, Homo sapiens
caccttgccgagagaggcg

SEQ ID NO: 323354 - DNA, 12 bp, Homo sapiens
caccttgctgca

SEQ ID NO: 323355 - DNA, 16 bp, Homo sapiens
caccttgctgcagtgt

SEQ ID NO: 323356 - DNA, 23 bp, Homo sapiens
caccttgggcacgggagagcgcc

SEQ ID NO: 323357 - DNA, 17 bp, Homo sapiens
caccttgtacagaacca

SEQ ID NO: 323358 - DNA, 19 bp, Homo sapiens
cacctttcttcttgtgtct

SEQ ID NO: 323359 - DNA, 17 bp, Homo sapiens
cacctttgggatcagcc

SEQ ID NO: 323360 - DNA, 22 bp, Homo sapiens
cacctttgtaaatacacaattc

SEQ ID NO: 323361 - DNA, 11 bp, Homo sapiens
caccttttcta

SEQ ID NO: 323362 - DNA, 15 bp, Homo sapiens
cacctttttgacttt

SEQ ID NO: 323363 - DNA, 16 bp, Homo sapiens
cacgaaatgttatttt

SEQ ID NO: 323364 - DNA, 17 bp, Homo sapiens
cacgaaatgttattttt

SEQ ID NO: 323365 - DNA, 21 bp, Homo sapiens
cacgaattttaaaacatggca

SEQ ID NO: 323366 - DNA, 19 bp, Homo sapiens
cacgactcttcctgcaaag

SEQ ID NO: 323367 - DNA, 23 bp, Homo sapiens
cacgacttcttcggaggtggcag

SEQ ID NO: 323368 - DNA, 18 bp, Homo sapiens
cacgagatcttccttccg

SEQ ID NO: 323369 - DNA, 20 bp, Homo sapiens
cacgaggtggtagctctgag

SEQ ID NO: 323370 - DNA, 23 bp, Homo sapiens
cacgaggtggtagctctgagccc

SEQ ID NO: 323371 - DNA, 17 bp, Homo sapiens
cacgagtcacctgcaag

SEQ ID NO: 323372 - DNA, 19 bp, Homo sapiens
cacgagtcacctgcaagcc

SEQ ID NO: 323373 - DNA, 23 bp, Homo sapiens
cacgagtcacctgcaagccccag

SEQ ID NO: 323374 - DNA, 11 bp, Homo sapiens
cacgattttaa

SEQ ID NO: 323375 - DNA, 20 bp, Homo sapiens
cacgcaagggcatcaggcac

SEQ ID NO: 323376 - DNA, 21 bp, Homo sapiens
cacgcaagggcatcaggcact

SEQ ID NO: 323377 - DNA, 23 bp, Homo sapiens
cacgcaagggcatcaggcactgg

SEQ ID NO: 323378 - DNA, 13 bp, Homo sapiens
cacgcacacacac

SEQ ID NO: 323379 - DNA, 14 bp, Homo sapiens
cacgcacacacaca

SEQ ID NO: 323380 - DNA, 22 bp, Homo sapiens
cacgcacacacacacacaggag

SEQ ID NO: 323381 - DNA, 13 bp, Homo sapiens
cacgcacgcacac

SEQ ID NO: 323382 - DNA, 15 bp, Homo sapiens
cacgcacgcacacac

SEQ ID NO: 323383 - DNA, 16 bp, Homo sapiens
cacgcacgcacacaca

SEQ ID NO: 323384 - DNA, 11 bp, Homo sapiens
cacgcagagcc

SEQ ID NO: 323385 - DNA, 12 bp, Homo sapiens
cacgcagagccc

SEQ ID NO: 323386 - DNA, 18 bp, Homo sapiens
cacgcagagccccggagc

SEQ ID NO: 323387 - DNA, 20 bp, Homo sapiens
cacgcagagccccggagcac

SEQ ID NO: 323388 - DNA, 23 bp, Homo sapiens
cacgcagagccccggagcaccac

SEQ ID NO: 323389 - DNA, 14 bp, Homo sapiens
cacgccattctcct

SEQ ID NO: 323390 - DNA, 22 bp, Homo sapiens
cacgccattctcctgcctcagc

SEQ ID NO: 323391 - DNA, 14 bp, Homo sapiens
cacgcccatgtgtg

SEQ ID NO: 323392 - DNA, 15 bp, Homo sapiens
cacgcccatgtgtga

SEQ ID NO: 323393 - DNA, 13 bp, Homo sapiens
cacgccccagccc

SEQ ID NO: 323394 - DNA, 18 bp, Homo sapiens
cacgccccagcccgacaa

SEQ ID NO: 323395 - DNA, 16 bp, Homo sapiens
cacgccggggctggcc

SEQ ID NO: 323396 - DNA, 20 bp, Homo sapiens
cacgccggggctggccctgc

SEQ ID NO: 323397 - DNA, 19 bp, Homo sapiens
cacgcctgtaatcccagca

SEQ ID NO: 323398 - DNA, 23 bp, Homo sapiens
cacgcctgtaatcccagcacttt

SEQ ID NO: 323399 - DNA, 17 bp, Homo sapiens
cacgctcctctgttcag

SEQ ID NO: 323400 - DNA, 15 bp, Homo sapiens
cacgctgcccaggct

SEQ ID NO: 323401 - DNA, 17 bp, Homo sapiens
cacgctgcccaggctct

SEQ ID NO: 323402 - DNA, 20 bp, Homo sapiens
cacgctgcccaggctctgct

SEQ ID NO: 323403 - DNA, 16 bp, Homo sapiens
cacgctgggacacaga

SEQ ID NO: 323404 - DNA, 16 bp, Homo sapiens
cacgctgtctccagac

SEQ ID NO: 323405 - DNA, 18 bp, Homo sapiens
cacgctgtctccagaccc

SEQ ID NO: 323406 - DNA, 19 bp, Homo sapiens
cacgctgtctccagacccc

SEQ ID NO: 323407 - DNA, 22 bp, Homo sapiens
cacgcttgacaggacagcatgg

SEQ ID NO: 323408 - DNA, 19 bp, Homo sapiens
cacgcttgcgtatgtctgt

SEQ ID NO: 323409 - DNA, 17 bp, Homo sapiens
cacgctttctagctgtt

SEQ ID NO: 323410 - DNA, 20 bp, Homo sapiens
cacggaaaatgccaatctct

SEQ ID NO: 323411 - DNA, 14 bp, Homo sapiens
cacggacaggaagc

SEQ ID NO: 323412 - DNA, 19 bp, Homo sapiens
cacggaccgcatcctccag

SEQ ID NO: 323413 - DNA, 19 bp, Homo sapiens
cacggacgctggctcccca

SEQ ID NO: 323414 - DNA, 20 bp, Homo sapiens
cacggagggtgacgggggtg

SEQ ID NO: 323415 - DNA, 12 bp, Homo sapiens
cacggccaccca

SEQ ID NO: 323416 - DNA, 13 bp, Homo sapiens
cacggccacccac

SEQ ID NO: 323417 - DNA, 18 bp, Homo sapiens
cacggccacccacccttc

SEQ ID NO: 323418 - DNA, 17 bp, Homo sapiens
cacggccaccctccttc

SEQ ID NO: 323419 - DNA, 12 bp, Homo sapiens
cacggcctctgg

SEQ ID NO: 323420 - DNA, 13 bp, Homo sapiens
cacggcctctggg

SEQ ID NO: 323421 - DNA, 18 bp, Homo sapiens
cacggcctctggggagac

SEQ ID NO: 323422 - DNA, 20 bp, Homo sapiens
cacggctaagaggctgctga

SEQ ID NO: 323423 - DNA, 20 bp, Homo sapiens
cacggctctaggtggggcgg

SEQ ID NO: 323424 - DNA, 23 bp, Homo sapiens
cacggctgcctgacactgagccc

SEQ ID NO: 323425 - DNA, 16 bp, Homo sapiens
cacgggagagcgccac

SEQ ID NO: 323426 - DNA, 17 bp, Homo sapiens
cacgggcaaagaaaaca

SEQ ID NO: 323427 - DNA, 16 bp, Homo sapiens
cacgggcacagctgct

SEQ ID NO: 323428 - DNA, 18 bp, Homo sapiens
cacgggcccgctcaacct

SEQ ID NO: 323429 - DNA, 20 bp, Homo sapiens
cacgggggaggccgaggcag

SEQ ID NO: 323430 - DNA, 21 bp, Homo sapiens
cacgggggaggccgaggcagg

SEQ ID NO: 323431 - DNA, 15 bp, Homo sapiens
cacggggtattttag

SEQ ID NO: 323432 - DNA, 17 bp, Homo sapiens
cacggggtcgggggagg

SEQ ID NO: 323433 - DNA, 19 bp, Homo sapiens
cacggtgcgtggctgtggc

SEQ ID NO: 323434 - DNA, 13 bp, Homo sapiens
cacggtttctgtt

SEQ ID NO: 323435 - DNA, 23 bp, Homo sapiens
cacgtagcccccaggctgctgga

SEQ ID NO: 323436 - DNA, 15 bp, Homo sapiens
cacgtatagtcctag

SEQ ID NO: 323437 - DNA, 15 bp, Homo sapiens
cacgtcactgccaga

SEQ ID NO: 323438 - DNA, 14 bp, Homo sapiens
cacgtcctccaccg

SEQ ID NO: 323439 - DNA, 19 bp, Homo sapiens
cacgtcctccaccggtgcc

SEQ ID NO: 323440 - DNA, 14 bp, Homo sapiens
cacgtctgccaggc

SEQ ID NO: 323441 - DNA, 17 bp, Homo sapiens
cacgtctgccaggccca

SEQ ID NO: 323442 - DNA, 15 bp, Homo sapiens
cacgtctgtcttcac

SEQ ID NO: 323443 - DNA, 17 bp, Homo sapiens
cacgtcttggtgccttt

SEQ ID NO: 323444 - DNA, 18 bp, Homo sapiens
cacgtcttggtgcctttt

SEQ ID NO: 323445 - DNA, 20 bp, Homo sapiens
cacgtgccattgtctttcct

SEQ ID NO: 323446 - DNA, 16 bp, Homo sapiens
cacgtggactctgtgc

SEQ ID NO: 323447 - DNA, 15 bp, Homo sapiens
aggaaacttccaact

SEQ ID NO: 323448 - DNA, 22 bp, Homo sapiens
aggaaagcaccgcagcatgtgg

SEQ ID NO: 323449 - DNA, 23 bp, Homo sapiens
aggaaagcatgtctctgcttcca

SEQ ID NO: 323450 - DNA, 13 bp, Homo sapiens
aggaaaggcagaa

SEQ ID NO: 323451 - DNA, 17 bp, Homo sapiens
aggaaataaaacctttc

SEQ ID NO: 323452 - DNA, 22 bp, Homo sapiens
aggaaataaaacctttcaaatt

SEQ ID NO: 323453 - DNA, 14 bp, Homo sapiens
aggaaataacattg

SEQ ID NO: 323454 - DNA, 15 bp, Homo sapiens
aggaaatactcagca

SEQ ID NO: 323455 - DNA, 14 bp, Homo sapiens
aggaaatagtgttc

SEQ ID NO: 323456 - DNA, 16 bp, Homo sapiens
aggaaatagtgttctt

SEQ ID NO: 323457 - DNA, 23 bp, Homo sapiens
aggaaatagtgttctttttaaaa

SEQ ID NO: 323458 - DNA, 20 bp, Homo sapiens
aggaaatatatatgtgtgtg

SEQ ID NO: 323459 - DNA, 19 bp, Homo sapiens
aggaaatccagtagggaaa

SEQ ID NO: 323460 - DNA, 15 bp, Homo sapiens
aggaaatctcctctt

SEQ ID NO: 323461 - DNA, 23 bp, Homo sapiens
aggaaatgctattgttgtgggct

SEQ ID NO: 323462 - DNA, 15 bp, Homo sapiens
aggaaatgttggaac

SEQ ID NO: 323463 - DNA, 16 bp, Homo sapiens
aggaaatgttggaact

SEQ ID NO: 323464 - DNA, 13 bp, Homo sapiens
aggaaattaaata

SEQ ID NO: 323465 - DNA, 14 bp, Homo sapiens
aggaaattaaataa

SEQ ID NO: 323466 - DNA, 15 bp, Homo sapiens
aggaaattaaataat

SEQ ID NO: 323467 - DNA, 17 bp, Homo sapiens
aggaaattaaataattt

SEQ ID NO: 323468 - DNA, 16 bp, Homo sapiens
aggaaattgcaaagaa

SEQ ID NO: 323469 - DNA, 17 bp, Homo sapiens
aggaaattgcaaagaaa

SEQ ID NO: 323470 - DNA, 21 bp, Homo sapiens
aggaaattgcaaagaaaattc

SEQ ID NO: 323471 - DNA, 12 bp, Homo sapiens
aggaacaaggca

SEQ ID NO: 323472 - DNA, 17 bp, Homo sapiens
aggaacaaggcaaggct

SEQ ID NO: 323473 - DNA, 20 bp, Homo sapiens
aggaacaaggcaaggctgtc

SEQ ID NO: 323474 - DNA, 16 bp, Homo sapiens
aggaacacccggaaag

SEQ ID NO: 323475 - DNA, 20 bp, Homo sapiens
aggaacacccggaaagactg

SEQ ID NO: 323476 - DNA, 15 bp, Homo sapiens
aggaacccggtccca

SEQ ID NO: 323477 - DNA, 19 bp, Homo sapiens
aggaacccggtcccaggcc

SEQ ID NO: 323478 - DNA, 19 bp, Homo sapiens
aggaacctcctccacacca

SEQ ID NO: 323479 - DNA, 16 bp, Homo sapiens
aggaacgagcactggc

SEQ ID NO: 323480 - DNA, 13 bp, Homo sapiens
aggaactgggcct

SEQ ID NO: 323481 - DNA, 21 bp, Homo sapiens
aggaacttgctgctgtgcctg

SEQ ID NO: 323482 - DNA, 17 bp, Homo sapiens
aggaagaccaaggcctc

SEQ ID NO: 323483 - DNA, 20 bp, Homo sapiens
aggaagaccaaggcctcggc

SEQ ID NO: 323484 - DNA, 19 bp, Homo sapiens
aggaagacttggcccagga

SEQ ID NO: 323485 - DNA, 16 bp, Homo sapiens
aggaagagatgctcta

SEQ ID NO: 323486 - DNA, 16 bp, Homo sapiens
aggaagagctaataaa

SEQ ID NO: 323487 - DNA, 21 bp, Homo sapiens
aggaagagggctgagctgagc

SEQ ID NO: 323488 - DNA, 21 bp, Homo sapiens
aggaagatcactttgctctga

SEQ ID NO: 323489 - DNA, 21 bp, Homo sapiens
aggaagatcttgagagctgct

SEQ ID NO: 323490 - DNA, 19 bp, Homo sapiens
aggaagcaaggccagccct

SEQ ID NO: 323491 - DNA, 13 bp, Homo sapiens
aggaagcacaggc

SEQ ID NO: 323492 - DNA, 15 bp, Homo sapiens
aggaagcagagcact

SEQ ID NO: 323493 - DNA, 13 bp, Homo sapiens
aggaagcagggag

SEQ ID NO: 323494 - DNA, 15 bp, Homo sapiens
aggaagcattgcttt

SEQ ID NO: 323495 - DNA, 20 bp, Homo sapiens
aggaagccacgtgctggaga

SEQ ID NO: 323496 - DNA, 16 bp, Homo sapiens
aggaagcccaaggcag

SEQ ID NO: 323497 - DNA, 17 bp, Homo sapiens
aggaagcccaaggcagt

SEQ ID NO: 323498 - DNA, 18 bp, Homo sapiens
aggaagccccgctcaggt

SEQ ID NO: 323499 - DNA, 19 bp, Homo sapiens
aggaagctttctctgcttc

SEQ ID NO: 323500 - DNA, 21 bp, Homo sapiens
aggaagctttctctgcttcag

SEQ ID NO: 323501 - DNA, 19 bp, Homo sapiens
aggaaggcagctgctctta

SEQ ID NO: 323502 - DNA, 18 bp, Homo sapiens
aggaaggcgtgtccagga

SEQ ID NO: 323503 - DNA, 13 bp, Homo sapiens
aggaagggactgg

SEQ ID NO: 323504 - DNA, 15 bp, Homo sapiens
aggaagggactggtc

SEQ ID NO: 323505 - DNA, 16 bp, Homo sapiens
aggaagggactggtcc

SEQ ID NO: 323506 - DNA, 19 bp, Homo sapiens
aggaagggactggtccagg

SEQ ID NO: 323507 - DNA, 18 bp, Homo sapiens
aggaagggccagagcctg

SEQ ID NO: 323508 - DNA, 14 bp, Homo sapiens
aggaaggggctgga

SEQ ID NO: 323509 - DNA, 17 bp, Homo sapiens
aggaaggtgctgagctt

SEQ ID NO: 323510 - DNA, 16 bp, Homo sapiens
aggaagtcaggagcca

SEQ ID NO: 323511 - DNA, 17 bp, Homo sapiens
aggaagtcaggagccag

SEQ ID NO: 323512 - DNA, 13 bp, Homo sapiens
aggaagtccctga

SEQ ID NO: 323513 - DNA, 19 bp, Homo sapiens
aggaataaataaaaatgga

SEQ ID NO: 323514 - DNA, 21 bp, Homo sapiens
aggaataaataaaaatggata

SEQ ID NO: 323515 - DNA, 19 bp, Homo sapiens
aggaataaattgctccttg

SEQ ID NO: 323516 - DNA, 14 bp, Homo sapiens
aggaataacactgc

SEQ ID NO: 323517 - DNA, 14 bp, Homo sapiens
aggaatagccagag

SEQ ID NO: 323518 - DNA, 20 bp, Homo sapiens
aggaatatgacggaagaaca

SEQ ID NO: 323519 - DNA, 21 bp, Homo sapiens
aggaatcatgtgccaagcaga

SEQ ID NO: 323520 - DNA, 15 bp, Homo sapiens
aggaatcccagaggt

SEQ ID NO: 323521 - DNA, 16 bp, Homo sapiens
aggaatctgccttcca

SEQ ID NO: 323522 - DNA, 22 bp, Homo sapiens
aggaatctgccttccagcccag

SEQ ID NO: 323523 - DNA, 13 bp, Homo sapiens
aggaatgaagata

SEQ ID NO: 323524 - DNA, 17 bp, Homo sapiens
aggaatgcaagagaagg

SEQ ID NO: 323525 - DNA, 14 bp, Homo sapiens
aggaatgcctgtgc

SEQ ID NO: 323526 - DNA, 15 bp, Homo sapiens
aggaatgcctgtgcc

SEQ ID NO: 323527 - DNA, 16 bp, Homo sapiens
aggaatgcctgtgcca

SEQ ID NO: 323528 - DNA, 14 bp, Homo sapiens
aggaatgctccccc

SEQ ID NO: 323529 - DNA, 15 bp, Homo sapiens
aggaatgctccccca

SEQ ID NO: 323530 - DNA, 16 bp, Homo sapiens
aggaatgctctgtgcc

SEQ ID NO: 323531 - DNA, 17 bp, Homo sapiens
aggaatgctctgtgcca

SEQ ID NO: 323532 - DNA, 20 bp, Homo sapiens
aggaatgcttggaatatctg

SEQ ID NO: 323533 - DNA, 24 bp, Homo sapiens
aggaatgcttggaatatctgctgt

SEQ ID NO: 323534 - DNA, 19 bp, Homo sapiens
aggaatgggccaagccagg

SEQ ID NO: 323535 - DNA, 17 bp, Homo sapiens
aggaattaagttatctt

SEQ ID NO: 323536 - DNA, 20 bp, Homo sapiens
aggaattccccaaagaatgt

SEQ ID NO: 323537 - DNA, 12 bp, Homo sapiens
aggaattgactt

SEQ ID NO: 323538 - DNA, 21 bp, Homo sapiens
aggaattgacttcagcagggg

SEQ ID NO: 323539 - DNA, 18 bp, Homo sapiens
aggaattgagaagtaatt

SEQ ID NO: 323540 - DNA, 19 bp, Homo sapiens
aggaattggggtttctggt

SEQ ID NO: 323541 - DNA, 14 bp, Homo sapiens
aggaattttagaag

SEQ ID NO: 323542 - DNA, 18 bp, Homo sapiens
aggacaaacagtgaattt

SEQ ID NO: 323543 - DNA, 15 bp, Homo sapiens
aggacaacctgcccc

SEQ ID NO: 323544 - DNA, 14 bp, Homo sapiens
aggacaaggtacag

SEQ ID NO: 323545 - DNA, 13 bp, Homo sapiens
aggacacactaat

SEQ ID NO: 323546 - DNA, 13 bp, Homo sapiens
aggacacagatct

SEQ ID NO: 323547 - DNA, 13 bp, Homo sapiens
aggacacatcccg

SEQ ID NO: 323548 - DNA, 20 bp, Homo sapiens
aggacacatcccggcctctt

SEQ ID NO: 323549 - DNA, 21 bp, Homo sapiens
aggacacatcgttcgatttaa

SEQ ID NO: 323550 - DNA, 13 bp, Homo sapiens
aggacacatgtcc

SEQ ID NO: 323551 - DNA, 18 bp, Homo sapiens
aggacactgatgggtcct

SEQ ID NO: 323552 - DNA, 20 bp, Homo sapiens
aggacactgatgggtcctgc

SEQ ID NO: 323553 - DNA, 21 bp, Homo sapiens
aggacactgatgggtcctgct

SEQ ID NO: 323554 - DNA, 23 bp, Homo sapiens
aggacactgatgggtcctgctgc

SEQ ID NO: 323555 - DNA, 23 bp, Homo sapiens
aggacagaaccaacgggtctgtg

SEQ ID NO: 323556 - DNA, 23 bp, Homo sapiens
aggacagagggttttgattttaa

SEQ ID NO: 323557 - DNA, 14 bp, Homo sapiens
aggacagctgcagg

SEQ ID NO: 323558 - DNA, 17 bp, Homo sapiens
aggacagggagggaaca

SEQ ID NO: 323559 - DNA, 16 bp, Homo sapiens
aggacatactgcatgt

SEQ ID NO: 323560 - DNA, 16 bp, Homo sapiens
aggacatgttcccttc

SEQ ID NO: 323561 - DNA, 15 bp, Homo sapiens
aggacatgtttttgt

SEQ ID NO: 323562 - DNA, 16 bp, Homo sapiens
aggacatgtttttgtt

SEQ ID NO: 323563 - DNA, 21 bp, Homo sapiens
aggacatgtttttgttttctt

SEQ ID NO: 323564 - DNA, 23 bp, Homo sapiens
aggacatgtttttgttttctttg

SEQ ID NO: 323565 - DNA, 14 bp, Homo sapiens
aggacattgcccca

SEQ ID NO: 323566 - DNA, 15 bp, Homo sapiens
aggaccaaagaacac

SEQ ID NO: 323567 - DNA, 19 bp, Homo sapiens
aggaccaacccatgccctg

SEQ ID NO: 323568 - DNA, 22 bp, Homo sapiens
aggaccactcctgtacactgaa

SEQ ID NO: 323569 - DNA, 12 bp, Homo sapiens
aggaccaggagc

SEQ ID NO: 323570 - DNA, 16 bp, Homo sapiens
aggaccaggagccagg

SEQ ID NO: 323571 - DNA, 13 bp, Homo sapiens
aggacccaaggtg

SEQ ID NO: 323572 - DNA, 21 bp, Homo sapiens
aggacccaaggtggtcttgga

SEQ ID NO: 323573 - DNA, 16 bp, Homo sapiens
cagagcttcagggctg

SEQ ID NO: 323574 - DNA, 19 bp, Homo sapiens
cagagcttcagggctgggc

SEQ ID NO: 323575 - DNA, 19 bp, Homo sapiens
cagagcttgattagaagcc

SEQ ID NO: 323576 - DNA, 13 bp, Homo sapiens
cagagcttttcag

SEQ ID NO: 323577 - DNA, 16 bp, Homo sapiens
cagaggagccacctgg

SEQ ID NO: 323578 - DNA, 21 bp, Homo sapiens
cagaggagctgggagccgggc

SEQ ID NO: 323579 - DNA, 21 bp, Homo sapiens
cagaggaggcagaataagaaa

SEQ ID NO: 323580 - DNA, 15 bp, Homo sapiens
cagaggatgctgaag

SEQ ID NO: 323581 - DNA, 16 bp, Homo sapiens
cagaggatgctgaagt

SEQ ID NO: 323582 - DNA, 22 bp, Homo sapiens
cagaggatgttctggacctccc

SEQ ID NO: 323583 - DNA, 15 bp, Homo sapiens
cagaggattctgtct

SEQ ID NO: 323584 - DNA, 18 bp, Homo sapiens
cagaggcagcaggagcca

SEQ ID NO: 323585 - DNA, 16 bp, Homo sapiens
cagaggcaggagtggc

SEQ ID NO: 323586 - DNA, 18 bp, Homo sapiens
cagaggcaggagtggcag

SEQ ID NO: 323587 - DNA, 14 bp, Homo sapiens
cagaggcagggccc

SEQ ID NO: 323588 - DNA, 16 bp, Homo sapiens
cagaggcagggccctg

SEQ ID NO: 323589 - DNA, 17 bp, Homo sapiens
cagaggcagggccctgg

SEQ ID NO: 323590 - DNA, 14 bp, Homo sapiens
cagaggcccagcca

SEQ ID NO: 323591 - DNA, 12 bp, Homo sapiens
cagaggcctccc

SEQ ID NO: 323592 - DNA, 16 bp, Homo sapiens
cagaggcctcccccag

SEQ ID NO: 323593 - DNA, 22 bp, Homo sapiens
cagaggcctcccccagccagga

SEQ ID NO: 323594 - DNA, 16 bp, Homo sapiens
cagaggctaagatgag

SEQ ID NO: 323595 - DNA, 16 bp, Homo sapiens
cagaggctgagcagga

SEQ ID NO: 323596 - DNA, 17 bp, Homo sapiens
cagaggctggcctcaga

SEQ ID NO: 323597 - DNA, 13 bp, Homo sapiens
cagagggaaaggc

SEQ ID NO: 323598 - DNA, 20 bp, Homo sapiens
cagagggaatgttccctgca

SEQ ID NO: 323599 - DNA, 16 bp, Homo sapiens
cagagggaccagctgg

SEQ ID NO: 323600 - DNA, 17 bp, Homo sapiens
cagagggaccagctggg

SEQ ID NO: 323601 - DNA, 23 bp, Homo sapiens
cagagggaccagctggggggcag

SEQ ID NO: 323602 - DNA, 20 bp, Homo sapiens
cagagggactgtcagctgag

SEQ ID NO: 323603 - DNA, 21 bp, Homo sapiens
cagagggactgtcagctgagc

SEQ ID NO: 323604 - DNA, 18 bp, Homo sapiens
cagagggatctaggtctt

SEQ ID NO: 323605 - DNA, 18 bp, Homo sapiens
cagaggggagaggaagca

SEQ ID NO: 323606 - DNA, 15 bp, Homo sapiens
cagaggggcagccgc

SEQ ID NO: 323607 - DNA, 16 bp, Homo sapiens
cagaggggcagccgct

SEQ ID NO: 323608 - DNA, 18 bp, Homo sapiens
cagaggggcggggccagg

SEQ ID NO: 323609 - DNA, 21 bp, Homo sapiens
cagagggtgtcgtcctgcagt

SEQ ID NO: 323610 - DNA, 18 bp, Homo sapiens
cagaggtagggctgccac

SEQ ID NO: 323611 - DNA, 13 bp, Homo sapiens
cagaggtcccctg

SEQ ID NO: 323612 - DNA, 15 bp, Homo sapiens
cagaggtctctgccg

SEQ ID NO: 323613 - DNA, 14 bp, Homo sapiens
cagaggtggaaaat

SEQ ID NO: 323614 - DNA, 19 bp, Homo sapiens
cagaggtgggatcctccct

SEQ ID NO: 323615 - DNA, 20 bp, Homo sapiens
cagaggtgggatcctccctc

SEQ ID NO: 323616 - DNA, 20 bp, Homo sapiens
cagaggtggggaagagagcc

SEQ ID NO: 323617 - DNA, 21 bp, Homo sapiens
cagaggtggggaagagagcct

SEQ ID NO: 323618 - DNA, 22 bp, Homo sapiens
cagaggtggggaagagagcctg

SEQ ID NO: 323619 - DNA, 22 bp, Homo sapiens
cagaggttatctgcctggcctg

SEQ ID NO: 323620 - DNA, 20 bp, Homo sapiens
cagaggttgtggtgagccga

SEQ ID NO: 323621 - DNA, 17 bp, Homo sapiens
cagagtaagctgctttt

SEQ ID NO: 323622 - DNA, 14 bp, Homo sapiens
cagagtatatatgt

SEQ ID NO: 323623 - DNA, 16 bp, Homo sapiens
cagagtatatatgtac

SEQ ID NO: 323624 - DNA, 23 bp, Homo sapiens
cagagtatatatgtacagttata

SEQ ID NO: 323625 - DNA, 14 bp, Homo sapiens
cagagtcattgtta

SEQ ID NO: 323626 - DNA, 15 bp, Homo sapiens
cagagtccaggcccc

SEQ ID NO: 323627 - DNA, 15 bp, Homo sapiens
cagagtccctcccat

SEQ ID NO: 323628 - DNA, 16 bp, Homo sapiens
cagagtccggaggcag

SEQ ID NO: 323629 - DNA, 17 bp, Homo sapiens
cagagtctcccgctgca

SEQ ID NO: 323630 - DNA, 15 bp, Homo sapiens
cagagtctgacagga

SEQ ID NO: 323631 - DNA, 16 bp, Homo sapiens
cagagtctggcctgcc

SEQ ID NO: 323632 - DNA, 19 bp, Homo sapiens
cagagtctgggcctctgac

SEQ ID NO: 323633 - DNA, 20 bp, Homo sapiens
cagagtctgtgtgtagccag

SEQ ID NO: 323634 - DNA, 22 bp, Homo sapiens
cagagtctgtgtgtagccagga

SEQ ID NO: 323635 - DNA, 15 bp, Homo sapiens
cagagtgaaagggct

SEQ ID NO: 323636 - DNA, 23 bp, Homo sapiens
cagagtgaaagggctatggcaag

SEQ ID NO: 323637 - DNA, 18 bp, Homo sapiens
cagagtgactgacggctg

SEQ ID NO: 323638 - DNA, 14 bp, Homo sapiens
cagagtgccccacc

SEQ ID NO: 323639 - DNA, 14 bp, Homo sapiens
cagagtggatctgg

SEQ ID NO: 323640 - DNA, 17 bp, Homo sapiens
cagagtggcccctcacc

SEQ ID NO: 323641 - DNA, 13 bp, Homo sapiens
cagagtggcctgg

SEQ ID NO: 323642 - DNA, 17 bp, Homo sapiens
cagagtggcctggccag

SEQ ID NO: 323643 - DNA, 22 bp, Homo sapiens
cagagtggcctggccaggagct

SEQ ID NO: 323644 - DNA, 23 bp, Homo sapiens
cagagtggcctggccaggagctc

SEQ ID NO: 323645 - DNA, 21 bp, Homo sapiens
cagagtggtctttctggagag

SEQ ID NO: 323646 - DNA, 22 bp, Homo sapiens
cagagtggtctttctggagagg

SEQ ID NO: 323647 - DNA, 14 bp, Homo sapiens
cagagttcagggag

SEQ ID NO: 323648 - DNA, 21 bp, Homo sapiens
cagagttcagggaggggctga

SEQ ID NO: 323649 - DNA, 14 bp, Homo sapiens
cagagttccacagt

SEQ ID NO: 323650 - DNA, 13 bp, Homo sapiens
cagagttctttgc

SEQ ID NO: 323651 - DNA, 14 bp, Homo sapiens
cagagttctttgca

SEQ ID NO: 323652 - DNA, 22 bp, Homo sapiens
cagagtttgatatgggctttct

SEQ ID NO: 323653 - DNA, 23 bp, Homo sapiens
cagagtttgatatgggctttctc

SEQ ID NO: 323654 - DNA, 22 bp, Homo sapiens
cagagtttgtagtaaatattat

SEQ ID NO: 323655 - DNA, 17 bp, Homo sapiens
cagataaccagctgtaa

SEQ ID NO: 323656 - DNA, 21 bp, Homo sapiens
cagataagaatgctggttttc

SEQ ID NO: 323657 - DNA, 22 bp, Homo sapiens
cagataagcaagagagatgttt

SEQ ID NO: 323658 - DNA, 16 bp, Homo sapiens
cagataatcagcctct

SEQ ID NO: 323659 - DNA, 21 bp, Homo sapiens
cagataatttattttgtattt

SEQ ID NO: 323660 - DNA, 17 bp, Homo sapiens
cagatacatggttgtga

SEQ ID NO: 323661 - DNA, 16 bp, Homo sapiens
cagataccagcccctg

SEQ ID NO: 323662 - DNA, 17 bp, Homo sapiens
cagatactgaaacattt

SEQ ID NO: 323663 - DNA, 22 bp, Homo sapiens
cagatactggaagttttgcatt

SEQ ID NO: 323664 - DNA, 17 bp, Homo sapiens
cagatagagctgggtgg

SEQ ID NO: 323665 - DNA, 20 bp, Homo sapiens
cagatatatatcatattggt

SEQ ID NO: 323666 - DNA, 20 bp, Homo sapiens
cagatatgtattacttttct

SEQ ID NO: 323667 - DNA, 13 bp, Homo sapiens
cagatattccaga

SEQ ID NO: 323668 - DNA, 11 bp, Homo sapiens
cagatatttat

SEQ ID NO: 323669 - DNA, 21 bp, Homo sapiens
cagatatttatatttttattt

SEQ ID NO: 323670 - DNA, 23 bp, Homo sapiens
cagatcaatggcgcagtgcctct

SEQ ID NO: 323671 - DNA, 22 bp, Homo sapiens
cagatcaccagcccggcctgct

SEQ ID NO: 323672 - DNA, 13 bp, Homo sapiens
cagatcactactg

SEQ ID NO: 323673 - DNA, 18 bp, Homo sapiens
cagatcatttgaggccag

SEQ ID NO: 323674 - DNA, 13 bp, Homo sapiens
cagatccagggac

SEQ ID NO: 323675 - DNA, 14 bp, Homo sapiens
cagatcccatccat

SEQ ID NO: 323676 - DNA, 23 bp, Homo sapiens
cagatcccatccatcagctccct

SEQ ID NO: 323677 - DNA, 19 bp, Homo sapiens
cagatccctcggtcagcac

SEQ ID NO: 323678 - DNA, 21 bp, Homo sapiens
cagatccctcggtcagcaccg

SEQ ID NO: 323679 - DNA, 15 bp, Homo sapiens
cagatccgcatgtgt

SEQ ID NO: 323680 - DNA, 18 bp, Homo sapiens
cagatccgcatgtgtctg

SEQ ID NO: 323681 - DNA, 23 bp, Homo sapiens
cagatcctccatttttgttggga

SEQ ID NO: 323682 - DNA, 12 bp, Homo sapiens
cagatcctttca

SEQ ID NO: 323683 - DNA, 17 bp, Homo sapiens
cagatctagccaggcct

SEQ ID NO: 323684 - DNA, 14 bp, Homo sapiens
cagatctccaaagc

SEQ ID NO: 323685 - DNA, 18 bp, Homo sapiens
cagatctggtcccttgca

SEQ ID NO: 323686 - DNA, 12 bp, Homo sapiens
cagatctgtgcc

SEQ ID NO: 323687 - DNA, 14 bp, Homo sapiens
cagatctgtgcccc

SEQ ID NO: 323688 - DNA, 14 bp, Homo sapiens
cagatcttacaagt

SEQ ID NO: 323689 - DNA, 18 bp, Homo sapiens
cagatcttacaagtttat

SEQ ID NO: 323690 - DNA, 14 bp, Homo sapiens
cagatgaaaataaa

SEQ ID NO: 323691 - DNA, 17 bp, Homo sapiens
cagatgaaaatttgaga

SEQ ID NO: 323692 - DNA, 15 bp, Homo sapiens
cagatgacagggagc

SEQ ID NO: 323693 - DNA, 14 bp, Homo sapiens
cagatgacccctcc

SEQ ID NO: 323694 - DNA, 18 bp, Homo sapiens
cagatgacccctccccta

SEQ ID NO: 323695 - DNA, 14 bp, Homo sapiens
cagatgactagaaa

SEQ ID NO: 323696 - DNA, 15 bp, Homo sapiens
cagatgagaagacta

SEQ ID NO: 323697 - DNA, 16 bp, Homo sapiens
cagatgagaagactag

SEQ ID NO: 323698 - DNA, 21 bp, Homo sapiens
cagatgagaagttaagcagcc

SEQ ID NO: 323699 - DNA, 15 bp, Homo sapiens
cagatgagcaaggac

SEQ ID NO: 323700 - DNA, 16 bp, Homo sapiens
cagatgagcaaggaca

SEQ ID NO: 323701 - DNA, 14 bp, Homo sapiens
cagatgccagagca

SEQ ID NO: 323702 - DNA, 22 bp, Homo sapiens
cagatgccctttggaaagccat

SEQ ID NO: 323703 - DNA, 23 bp, Homo sapiens
agctctgtgttgccatgtgtgct

SEQ ID NO: 323704 - DNA, 16 bp, Homo sapiens
agctcttagtcctccc

SEQ ID NO: 323705 - DNA, 21 bp, Homo sapiens
agctcttagtcctccctgctc

SEQ ID NO: 323706 - DNA, 19 bp, Homo sapiens
agctcttagtttttaaaaa

SEQ ID NO: 323707 - DNA, 14 bp, Homo sapiens
agctcttcaagctg

SEQ ID NO: 323708 - DNA, 15 bp, Homo sapiens
agctcttcaggcctc

SEQ ID NO: 323709 - DNA, 16 bp, Homo sapiens
agctcttctccccagg

SEQ ID NO: 323710 - DNA, 13 bp, Homo sapiens
agctcttctgggc

SEQ ID NO: 323711 - DNA, 15 bp, Homo sapiens
agctcttctgggcag

SEQ ID NO: 323712 - DNA, 23 bp, Homo sapiens
agctcttcttgtgaaatgtctgt

SEQ ID NO: 323713 - DNA, 16 bp, Homo sapiens
agctcttggcaggagt

SEQ ID NO: 323714 - DNA, 12 bp, Homo sapiens
agctctttcctc

SEQ ID NO: 323715 - DNA, 17 bp, Homo sapiens
agctctttcctccttcc

SEQ ID NO: 323716 - DNA, 19 bp, Homo sapiens
agctctttgtctcaccagc

SEQ ID NO: 323717 - DNA, 22 bp, Homo sapiens
agctctttgtctcaccagctca

SEQ ID NO: 323718 - DNA, 21 bp, Homo sapiens
agctcttttttagctctctta

SEQ ID NO: 323719 - DNA, 18 bp, Homo sapiens
agctgaaagggagcccct

SEQ ID NO: 323720 - DNA, 16 bp, Homo sapiens
agctgaaccccctcca

SEQ ID NO: 323721 - DNA, 14 bp, Homo sapiens
agctgacatggaaa

SEQ ID NO: 323722 - DNA, 23 bp, Homo sapiens
agctgacccagccccttgagaaa

SEQ ID NO: 323723 - DNA, 21 bp, Homo sapiens
agctgacctctgttgtcctcc

SEQ ID NO: 323724 - DNA, 19 bp, Homo sapiens
agctgacgaggctgggcca

SEQ ID NO: 323725 - DNA, 22 bp, Homo sapiens
agctgactggccccagggactc

SEQ ID NO: 323726 - DNA, 14 bp, Homo sapiens
agctgactgtggcc

SEQ ID NO: 323727 - DNA, 20 bp, Homo sapiens
agctgagaaggccagccctc

SEQ ID NO: 323728 - DNA, 21 bp, Homo sapiens
agctgagcttcggttctccag

SEQ ID NO: 323729 - DNA, 19 bp, Homo sapiens
agctgaggccattccctgt

SEQ ID NO: 323730 - DNA, 20 bp, Homo sapiens
agctgaggccattccctgta

SEQ ID NO: 323731 - DNA, 11 bp, Homo sapiens
agctgaggccc

SEQ ID NO: 323732 - DNA, 18 bp, Homo sapiens
agctgagtactcaggcca

SEQ ID NO: 323733 - DNA, 20 bp, Homo sapiens
agctgagtactcaggccact

SEQ ID NO: 323734 - DNA, 16 bp, Homo sapiens
agctgagtcacctcct

SEQ ID NO: 323735 - DNA, 18 bp, Homo sapiens
agctgagtcacctcctcc

SEQ ID NO: 323736 - DNA, 17 bp, Homo sapiens
agctgagtcggctgggc

SEQ ID NO: 323737 - DNA, 21 bp, Homo sapiens
agctgagttacttgtctgagg

SEQ ID NO: 323738 - DNA, 19 bp, Homo sapiens
agctgataaagaaaccttt

SEQ ID NO: 323739 - DNA, 21 bp, Homo sapiens
agctgatgatgtctcttgtag

SEQ ID NO: 323740 - DNA, 18 bp, Homo sapiens
agctgattactgtcaata

SEQ ID NO: 323741 - DNA, 18 bp, Homo sapiens
agctgattcccagagcag

SEQ ID NO: 323742 - DNA, 18 bp, Homo sapiens
agctgatttccaggcccc

SEQ ID NO: 323743 - DNA, 22 bp, Homo sapiens
agctgatttcccttttttcttc

SEQ ID NO: 323744 - DNA, 23 bp, Homo sapiens
agctgatttcccttttttcttcc

SEQ ID NO: 323745 - DNA, 14 bp, Homo sapiens
agctgcaaaggaca

SEQ ID NO: 323746 - DNA, 12 bp, Homo sapiens
agctgcagctgg

SEQ ID NO: 323747 - DNA, 16 bp, Homo sapiens
agctgcagctgggccc

SEQ ID NO: 323748 - DNA, 21 bp, Homo sapiens
agctgcagctgggccccatgc

SEQ ID NO: 323749 - DNA, 19 bp, Homo sapiens
agctgcagggaattttcat

SEQ ID NO: 323750 - DNA, 16 bp, Homo sapiens
agctgcatggacgcct

SEQ ID NO: 323751 - DNA, 20 bp, Homo sapiens
agctgcatggacgcctggct

SEQ ID NO: 323752 - DNA, 22 bp, Homo sapiens
agctgccaagtaaatagcaaca

SEQ ID NO: 323753 - DNA, 20 bp, Homo sapiens
agctgccaagtgctctttgt

SEQ ID NO: 323754 - DNA, 12 bp, Homo sapiens
agctgccagaga

SEQ ID NO: 323755 - DNA, 14 bp, Homo sapiens
agctgcctaagagg

SEQ ID NO: 323756 - DNA, 13 bp, Homo sapiens
agctgcctcactt

SEQ ID NO: 323757 - DNA, 18 bp, Homo sapiens
agctgcctgctctgcagc

SEQ ID NO: 323758 - DNA, 19 bp, Homo sapiens
agctgccttcctcatcccc

SEQ ID NO: 323759 - DNA, 14 bp, Homo sapiens
agctgcgggtctga

SEQ ID NO: 323760 - DNA, 15 bp, Homo sapiens
agctgctctccttca

SEQ ID NO: 323761 - DNA, 18 bp, Homo sapiens
agctgctctccttcactc

SEQ ID NO: 323762 - DNA, 14 bp, Homo sapiens
agctgctctgccca

SEQ ID NO: 323763 - DNA, 16 bp, Homo sapiens
agctgctctgcccaga

SEQ ID NO: 323764 - DNA, 19 bp, Homo sapiens
agctgctctgcccagagct

SEQ ID NO: 323765 - DNA, 20 bp, Homo sapiens
agctgctctgcccagagctg

SEQ ID NO: 323766 - DNA, 20 bp, Homo sapiens
agctgcttctgggggatttc

SEQ ID NO: 323767 - DNA, 13 bp, Homo sapiens
agctgctttgtta

SEQ ID NO: 323768 - DNA, 16 bp, Homo sapiens
agctgctttgttacct

SEQ ID NO: 323769 - DNA, 14 bp, Homo sapiens
agctggacaagaag

SEQ ID NO: 323770 - DNA, 20 bp, Homo sapiens
agctggacaagaagctgcta

SEQ ID NO: 323771 - DNA, 15 bp, Homo sapiens
agctggagtgctgct

SEQ ID NO: 323772 - DNA, 22 bp, Homo sapiens
agctggagtggggtttgctttt

SEQ ID NO: 323773 - DNA, 22 bp, Homo sapiens
agctggatttgggagctctgct

SEQ ID NO: 323774 - DNA, 14 bp, Homo sapiens
agctggcagcgcct

SEQ ID NO: 323775 - DNA, 16 bp, Homo sapiens
agctggcagcgcctcc

SEQ ID NO: 323776 - DNA, 17 bp, Homo sapiens
agctggcagcgcctccc

SEQ ID NO: 323777 - DNA, 19 bp, Homo sapiens
agctggcagcgcctcccgc

SEQ ID NO: 323778 - DNA, 20 bp, Homo sapiens
agctggcagcgcctcccgcc

SEQ ID NO: 323779 - DNA, 17 bp, Homo sapiens
agctggcaggacacatc

SEQ ID NO: 323780 - DNA, 16 bp, Homo sapiens
agctggcaggagggtg

SEQ ID NO: 323781 - DNA, 20 bp, Homo sapiens
agctggccgagggtcctggc

SEQ ID NO: 323782 - DNA, 16 bp, Homo sapiens
agctggcggaacctgg

SEQ ID NO: 323783 - DNA, 18 bp, Homo sapiens
agctggcggaacctggct

SEQ ID NO: 323784 - DNA, 19 bp, Homo sapiens
agctggcggaacctggctg

SEQ ID NO: 323785 - DNA, 13 bp, Homo sapiens
agctggctggcag

SEQ ID NO: 323786 - DNA, 17 bp, Homo sapiens
agctggctggcaggtgt

SEQ ID NO: 323787 - DNA, 20 bp, Homo sapiens
agctggctggcaggtgttgg

SEQ ID NO: 323788 - DNA, 22 bp, Homo sapiens
agctgggaacccgactgtgaaa

SEQ ID NO: 323789 - DNA, 18 bp, Homo sapiens
agctgggaagctgtactc

SEQ ID NO: 323790 - DNA, 14 bp, Homo sapiens
agctgggacccctc

SEQ ID NO: 323791 - DNA, 17 bp, Homo sapiens
agctgggcactgggccg

SEQ ID NO: 323792 - DNA, 16 bp, Homo sapiens
agctgggccccatgct

SEQ ID NO: 323793 - DNA, 15 bp, Homo sapiens
agctgggctctgcca

SEQ ID NO: 323794 - DNA, 19 bp, Homo sapiens
agctggggagcagctgaga

SEQ ID NO: 323795 - DNA, 16 bp, Homo sapiens
agctgggggccatgag

SEQ ID NO: 323796 - DNA, 16 bp, Homo sapiens
agctggggggaaggcg

SEQ ID NO: 323797 - DNA, 16 bp, Homo sapiens
agctgggtaccaggcc

SEQ ID NO: 323798 - DNA, 14 bp, Homo sapiens
agctgggtggtcca

SEQ ID NO: 323799 - DNA, 21 bp, Homo sapiens
agctggtagttagtagcatgt

SEQ ID NO: 323800 - DNA, 10 bp, Homo sapiens
agctggtgca

SEQ ID NO: 323801 - DNA, 13 bp, Homo sapiens
agctggtgcatta

SEQ ID NO: 323802 - DNA, 14 bp, Homo sapiens
agctggtgcattac

SEQ ID NO: 323803 - DNA, 21 bp, Homo sapiens
agctggtggatggtgactttt

SEQ ID NO: 323804 - DNA, 19 bp, Homo sapiens
agctggtgtcactctgcct

SEQ ID NO: 323805 - DNA, 18 bp, Homo sapiens
agctggtgtctgattgtt

SEQ ID NO: 323806 - DNA, 15 bp, Homo sapiens
agctgtaaaaagaga

SEQ ID NO: 323807 - DNA, 22 bp, Homo sapiens
agctgtaagaagagactgggaa

SEQ ID NO: 323808 - DNA, 18 bp, Homo sapiens
agctgtactagtgccatt

SEQ ID NO: 323809 - DNA, 16 bp, Homo sapiens
agctgtactcagagca

SEQ ID NO: 323810 - DNA, 18 bp, Homo sapiens
agctgtactcagagcaga

SEQ ID NO: 323811 - DNA, 21 bp, Homo sapiens
agctgtactcagagcagagca

SEQ ID NO: 323812 - DNA, 19 bp, Homo sapiens
caagctttcttctacaacc

SEQ ID NO: 323813 - DNA, 21 bp, Homo sapiens
caagctttcttctacaaccag

SEQ ID NO: 323814 - DNA, 23 bp, Homo sapiens
caagctttcttctacaaccagag

SEQ ID NO: 323815 - DNA, 16 bp, Homo sapiens
caaggaataaatgaga

SEQ ID NO: 323816 - DNA, 17 bp, Homo sapiens
caaggaatgcctgtgcc

SEQ ID NO: 323817 - DNA, 20 bp, Homo sapiens
caaggacattgccccaagat

SEQ ID NO: 323818 - DNA, 21 bp, Homo sapiens
caaggaccaggactccctcct

SEQ ID NO: 323819 - DNA, 17 bp, Homo sapiens
caaggacccctcacctt

SEQ ID NO: 323820 - DNA, 18 bp, Homo sapiens
caaggaccgtttttacta

SEQ ID NO: 323821 - DNA, 14 bp, Homo sapiens
caaggactgccgac

SEQ ID NO: 323822 - DNA, 16 bp, Homo sapiens
caaggacttgaaagca

SEQ ID NO: 323823 - DNA, 18 bp, Homo sapiens
caaggacttgaaagcatc

SEQ ID NO: 323824 - DNA, 21 bp, Homo sapiens
caaggagaatatgataaaaca

SEQ ID NO: 323825 - DNA, 16 bp, Homo sapiens
caaggagaccaagtcc

SEQ ID NO: 323826 - DNA, 22 bp, Homo sapiens
caaggagaccaagtcctggcta

SEQ ID NO: 323827 - DNA, 13 bp, Homo sapiens
caaggagagcgga

SEQ ID NO: 323828 - DNA, 21 bp, Homo sapiens
caaggagcaaacactgaaata

SEQ ID NO: 323829 - DNA, 23 bp, Homo sapiens
caaggagcctccgttcccacctc

SEQ ID NO: 323830 - DNA, 20 bp, Homo sapiens
caaggagctgatttccaggc

SEQ ID NO: 323831 - DNA, 15 bp, Homo sapiens
caaggaggtagagag

SEQ ID NO: 323832 - DNA, 17 bp, Homo sapiens
caagttcaagactgaaa

SEQ ID NO: 323833 - DNA, 16 bp, Homo sapiens
caagttccgtctcctc

SEQ ID NO: 323834 - DNA, 13 bp, Homo sapiens
caagttctattta

SEQ ID NO: 323835 - DNA, 14 bp, Homo sapiens
caagttcttcacct

SEQ ID NO: 323836 - DNA, 15 bp, Homo sapiens
caagttcttcacctc

SEQ ID NO: 323837 - DNA, 17 bp, Homo sapiens
caagttggctagaagaa

SEQ ID NO: 323838 - DNA, 21 bp, Homo sapiens
caagtttattgccctcaaaat

SEQ ID NO: 323839 - DNA, 16 bp, Homo sapiens
caagtttcagacaggg

SEQ ID NO: 323840 - DNA, 19 bp, Homo sapiens
caagtttcagtaatagctg

SEQ ID NO: 323841 - DNA, 23 bp, Homo sapiens
caagtttctagctagaaatatga

SEQ ID NO: 323842 - DNA, 17 bp, Homo sapiens
caagttttgtataaata

SEQ ID NO: 323843 - DNA, 14 bp, Homo sapiens
caagtttttctctc

SEQ ID NO: 323844 - DNA, 17 bp, Homo sapiens
caataaaaaagtgagct

SEQ ID NO: 323845 - DNA, 13 bp, Homo sapiens
caataaaacaaga

SEQ ID NO: 323846 - DNA, 12 bp, Homo sapiens
caataaaacatt

SEQ ID NO: 323847 - DNA, 20 bp, Homo sapiens
caataaaatcttgaaaatgc

SEQ ID NO: 323848 - DNA, 15 bp, Homo sapiens
caataaaatgcactg

SEQ ID NO: 323849 - DNA, 18 bp, Homo sapiens
caataaaatgcactgacc

SEQ ID NO: 323850 - DNA, 16 bp, Homo sapiens
caataaaatgtgattt

SEQ ID NO: 323851 - DNA, 11 bp, Homo sapiens
caataaactat

SEQ ID NO: 323852 - DNA, 13 bp, Homo sapiens
caataaagaaaaa

SEQ ID NO: 323853 - DNA, 17 bp, Homo sapiens
caataaagaaaaaaata

SEQ ID NO: 323854 - DNA, 12 bp, Homo sapiens
caataaagctgg

SEQ ID NO: 323855 - DNA, 13 bp, Homo sapiens
caataaaggtcat

SEQ ID NO: 323856 - DNA, 16 bp, Homo sapiens
caataaagtcctcttc

SEQ ID NO: 323857 - DNA, 16 bp, Homo sapiens
caataaataatattat

SEQ ID NO: 323858 - DNA, 14 bp, Homo sapiens
caataaatgtattc

SEQ ID NO: 323859 - DNA, 18 bp, Homo sapiens
caataaatgtattcaaat

SEQ ID NO: 323860 - DNA, 19 bp, Homo sapiens
caataaatgtgtgttgact

SEQ ID NO: 323861 - DNA, 18 bp, Homo sapiens
caataaattttatctcag

SEQ ID NO: 323862 - DNA, 15 bp, Homo sapiens
caataactactgtgt

SEQ ID NO: 323863 - DNA, 21 bp, Homo sapiens
caataactactgtgttcctgg

SEQ ID NO: 323864 - DNA, 17 bp, Homo sapiens
caataacttcagagaag

SEQ ID NO: 323865 - DNA, 20 bp, Homo sapiens
caataacttcagagaagtca

SEQ ID NO: 323866 - DNA, 21 bp, Homo sapiens
caataagcagaggtggaaaat

SEQ ID NO: 323867 - DNA, 16 bp, Homo sapiens
caataagttcattaaa

SEQ ID NO: 323868 - DNA, 18 bp, Homo sapiens
caataagttcattaaaca

SEQ ID NO: 323869 - DNA, 15 bp, Homo sapiens
caataattgtggaga

SEQ ID NO: 323870 - DNA, 17 bp, Homo sapiens
caataattgtggagagg

SEQ ID NO: 323871 - DNA, 23 bp, Homo sapiens
caataattgtggagaggagagaa

SEQ ID NO: 323872 - DNA, 23 bp, Homo sapiens
caatacaaattgaggacttaatt

SEQ ID NO: 323873 - DNA, 18 bp, Homo sapiens
caatacagataacattag

SEQ ID NO: 323874 - DNA, 21 bp, Homo sapiens
caatacccctagtatctggct

SEQ ID NO: 323875 - DNA, 17 bp, Homo sapiens
caatacccttggcactg

SEQ ID NO: 323876 - DNA, 23 bp, Homo sapiens
caatacccttggcactgatgggc

SEQ ID NO: 323877 - DNA, 18 bp, Homo sapiens
caatactgagtgcctgca

SEQ ID NO: 323878 - DNA, 23 bp, Homo sapiens
caatactgagtgcctgcagcatc

SEQ ID NO: 323879 - DNA, 15 bp, Homo sapiens
caatactttgtgtct

SEQ ID NO: 323880 - DNA, 17 bp, Homo sapiens
caatactttgtgtcttt

SEQ ID NO: 323881 - DNA, 21 bp, Homo sapiens
caatacttttgtgtattctgt

SEQ ID NO: 323882 - DNA, 15 bp, Homo sapiens
caatagacagaaaca

SEQ ID NO: 323883 - DNA, 15 bp, Homo sapiens
caatagagactgtag

SEQ ID NO: 323884 - DNA, 18 bp, Homo sapiens
caatagctttaccctcag

SEQ ID NO: 323885 - DNA, 17 bp, Homo sapiens
caatagtcatatgtgaa

SEQ ID NO: 323886 - DNA, 23 bp, Homo sapiens
caatagtcatatgtgaagacaga

SEQ ID NO: 323887 - DNA, 14 bp, Homo sapiens
caatagtgtgttct

SEQ ID NO: 323888 - DNA, 16 bp, Homo sapiens
caatagtgtgttctga

SEQ ID NO: 323889 - DNA, 17 bp, Homo sapiens
caatagtgtgttctgat

SEQ ID NO: 323890 - DNA, 16 bp, Homo sapiens
caatatattaccagca

SEQ ID NO: 323891 - DNA, 14 bp, Homo sapiens
caatatcaacaaca

SEQ ID NO: 323892 - DNA, 22 bp, Homo sapiens
caatatgaggggactgcatgca

SEQ ID NO: 323893 - DNA, 15 bp, Homo sapiens
caatatgctttacac

SEQ ID NO: 323894 - DNA, 13 bp, Homo sapiens
caatatgggagga

SEQ ID NO: 323895 - DNA, 17 bp, Homo sapiens
caatatggtggccctgg

SEQ ID NO: 323896 - DNA, 15 bp, Homo sapiens
caatatgtaaatagt

SEQ ID NO: 323897 - DNA, 15 bp, Homo sapiens
caatatgtattgtaa

SEQ ID NO: 323898 - DNA, 20 bp, Homo sapiens
caatattaaatacagacact

SEQ ID NO: 323899 - DNA, 23 bp, Homo sapiens
caatattaaatacagacactaag

SEQ ID NO: 323900 - DNA, 20 bp, Homo sapiens
caatattaccatcttaatct

SEQ ID NO: 323901 - DNA, 18 bp, Homo sapiens
caatattatactaagaaa

SEQ ID NO: 323902 - DNA, 22 bp, Homo sapiens
caatattatactaagaaaagat

SEQ ID NO: 323903 - DNA, 15 bp, Homo sapiens
caatattcaataaag

SEQ ID NO: 323904 - DNA, 16 bp, Homo sapiens
caatattcaataaagc

SEQ ID NO: 323905 - DNA, 17 bp, Homo sapiens
caatattcaataaagct

SEQ ID NO: 323906 - DNA, 18 bp, Homo sapiens
caatattgagatgtaatt

SEQ ID NO: 323907 - DNA, 13 bp, Homo sapiens
caatatttattgt

SEQ ID NO: 323908 - DNA, 16 bp, Homo sapiens
caatatttattgtatt

SEQ ID NO: 323909 - DNA, 22 bp, Homo sapiens
caatatttattgtattttagta

SEQ ID NO: 323910 - DNA, 19 bp, Homo sapiens
caatcaacagcatgtctac

SEQ ID NO: 323911 - DNA, 17 bp, Homo sapiens
caatcaacctgcacttc

SEQ ID NO: 323912 - DNA, 15 bp, Homo sapiens
caatcaactctaata

SEQ ID NO: 323913 - DNA, 23 bp, Homo sapiens
caatcacaaaagctgtgtctctg

SEQ ID NO: 323914 - DNA, 22 bp, Homo sapiens
caatcacgagatcttccttccg

SEQ ID NO: 323915 - DNA, 23 bp, Homo sapiens
caatcacgagatcttccttccgc

SEQ ID NO: 323916 - DNA, 13 bp, Homo sapiens
caatcactattct

SEQ ID NO: 323917 - DNA, 21 bp, Homo sapiens
caatcactattcttaagcact

SEQ ID NO: 323918 - DNA, 15 bp, Homo sapiens
caatcactgctcccc

SEQ ID NO: 323919 - DNA, 11 bp, Homo sapiens
caatcagctgc

SEQ ID NO: 323920 - DNA, 18 bp, Homo sapiens
caatcagctgctttgtta

SEQ ID NO: 323921 - DNA, 23 bp, Homo sapiens
caatcagtagacctgattttcaa

SEQ ID NO: 323922 - DNA, 19 bp, Homo sapiens
caatcagtatgtattcttt

SEQ ID NO: 323923 - DNA, 17 bp, Homo sapiens
caatcatctgtgtgaaa

SEQ ID NO: 323924 - DNA, 19 bp, Homo sapiens
caatcatctgtgtgaaaat

SEQ ID NO: 323925 - DNA, 14 bp, Homo sapiens
caatcatttctcac

SEQ ID NO: 323926 - DNA, 17 bp, Homo sapiens
caatcatttctcactgt

SEQ ID NO: 323927 - DNA, 18 bp, Homo sapiens
caatcatttctcactgtg

SEQ ID NO: 323928 - DNA, 15 bp, Homo sapiens
caatccaaatgcatt

SEQ ID NO: 323929 - DNA, 16 bp, Homo sapiens
caatccaaatgcattc

SEQ ID NO: 323930 - DNA, 15 bp, Homo sapiens
caatccacagtattg

SEQ ID NO: 323931 - DNA, 17 bp, Homo sapiens
caatcccaatctttcta

SEQ ID NO: 323932 - DNA, 16 bp, Homo sapiens
caatcccaccaaccct

SEQ ID NO: 323933 - DNA, 23 bp, Homo sapiens
caatcccaccaaccctcagagcc

SEQ ID NO: 323934 - DNA, 22 bp, Homo sapiens
caatcctaacacattatcggga

SEQ ID NO: 323935 - DNA, 18 bp, Homo sapiens
caatcctatgtcatttct

SEQ ID NO: 323936 - DNA, 13 bp, Homo sapiens
caatcctccccac

SEQ ID NO: 323937 - DNA, 20 bp, Homo sapiens
caatcctccccaccagtctc

SEQ ID NO: 323938 - DNA, 19 bp, Homo sapiens
caatcctggctctgtggct

SEQ ID NO: 323939 - DNA, 15 bp, Homo sapiens
caatcctgtcaatgt

SEQ ID NO: 323940 - DNA, 12 bp, Homo sapiens
caatcctttcca

SEQ ID NO: 323941 - DNA, 16 bp, Homo sapiens
caatcctttctgccca

SEQ ID NO: 323942 - DNA, 16 bp, Homo sapiens
caatcgggtccagaga

SEQ ID NO: 323943 - DNA, 18 bp, Homo sapiens
caatctcacacagctggg

SEQ ID NO: 323944 - DNA, 12 bp, Homo sapiens
caatctccaggg

SEQ ID NO: 323945 - DNA, 10 bp, Homo sapiens
caatctctgg

SEQ ID NO: 323946 - DNA, 11 bp, Homo sapiens
caatctctgtt

SEQ ID NO: 323947 - DNA, 22 bp, Homo sapiens
caatctgggtggtaactgccag

SEQ ID NO: 323948 - DNA, 17 bp, Homo sapiens
caatcttaccagatgct

SEQ ID NO: 323949 - DNA, 15 bp, Homo sapiens
caatcttatgttgat

SEQ ID NO: 323950 - DNA, 13 bp, Homo sapiens
caatcttgctgtg

SEQ ID NO: 323951 - DNA, 15 bp, Homo sapiens
caatcttgctgtgaa

SEQ ID NO: 323952 - DNA, 13 bp, Homo sapiens
caatctttctata

SEQ ID NO: 323953 - DNA, 14 bp, Homo sapiens
caatctttctatat

SEQ ID NO: 323954 - DNA, 21 bp, Homo sapiens
caatctttctatataaaatgt

SEQ ID NO: 323955 - DNA, 14 bp, Homo sapiens
agctgtagaaaggt

SEQ ID NO: 323956 - DNA, 16 bp, Homo sapiens
agctgtagaaatgtat

SEQ ID NO: 323957 - DNA, 22 bp, Homo sapiens
agctgtagccatggctcaggca

SEQ ID NO: 323958 - DNA, 21 bp, Homo sapiens
agctgtagtagccctttctgt

SEQ ID NO: 323959 - DNA, 22 bp, Homo sapiens
agctgtagtagccctttctgtg

SEQ ID NO: 323960 - DNA, 15 bp, Homo sapiens
agctgtctctaactt

SEQ ID NO: 323961 - DNA, 18 bp, Homo sapiens
agctgtcttgtcatcttt

SEQ ID NO: 323962 - DNA, 19 bp, Homo sapiens
agctgtcttgtcatctttt

SEQ ID NO: 323963 - DNA, 21 bp, Homo sapiens
caatgacacagtcttggctca

SEQ ID NO: 323964 - DNA, 15 bp, Homo sapiens
caatgacagggatgc

SEQ ID NO: 323965 - DNA, 20 bp, Homo sapiens
caatgacagggatgccaaca

SEQ ID NO: 323966 - DNA, 15 bp, Homo sapiens
caatgacctgtattt

SEQ ID NO: 323967 - DNA, 22 bp, Homo sapiens
caatgactgtgagcgagcctgg

SEQ ID NO: 323968 - DNA, 18 bp, Homo sapiens
caatgatctaggtttaac

SEQ ID NO: 323969 - DNA, 20 bp, Homo sapiens
caatgatctaggtttaactc

SEQ ID NO: 323970 - DNA, 21 bp, Homo sapiens
caatgatctaggtttaactca

SEQ ID NO: 323971 - DNA, 19 bp, Homo sapiens
caatgatgatgataatgat

SEQ ID NO: 323972 - DNA, 21 bp, Homo sapiens
caatgatgattaaacacctga

SEQ ID NO: 323973 - DNA, 14 bp, Homo sapiens
caatgatgtccaga

SEQ ID NO: 323974 - DNA, 15 bp, Homo sapiens
caatgattcataaca

SEQ ID NO: 323975 - DNA, 19 bp, Homo sapiens
caatgattgtttaattgta

SEQ ID NO: 323976 - DNA, 19 bp, Homo sapiens
caatgcagatgccagagca

SEQ ID NO: 323977 - DNA, 16 bp, Homo sapiens
caatgcatgcagccac

SEQ ID NO: 323978 - DNA, 14 bp, Homo sapiens
caatgcatttttaa

SEQ ID NO: 323979 - DNA, 13 bp, Homo sapiens
caatgccacagcc

SEQ ID NO: 323980 - DNA, 13 bp, Homo sapiens
caatgccctgcca

SEQ ID NO: 323981 - DNA, 15 bp, Homo sapiens
caatgccctgccatt

SEQ ID NO: 323982 - DNA, 15 bp, Homo sapiens
caatgccttgttgta

SEQ ID NO: 323983 - DNA, 12 bp, Homo sapiens
caatgcgtggca

SEQ ID NO: 323984 - DNA, 22 bp, Homo sapiens
caatgctatggactgcacaaaa

SEQ ID NO: 323985 - DNA, 13 bp, Homo sapiens
caatgctttggga

SEQ ID NO: 323986 - DNA, 20 bp, Homo sapiens
caatggagactgtctcaaga

SEQ ID NO: 323987 - DNA, 23 bp, Homo sapiens
caatggagtagacccctggctgg

SEQ ID NO: 323988 - DNA, 18 bp, Homo sapiens
caatggcagctagactgg

SEQ ID NO: 323989 - DNA, 22 bp, Homo sapiens
caatggcagctagactggagtg

SEQ ID NO: 323990 - DNA, 18 bp, Homo sapiens
caatggcgcagtgcctct

SEQ ID NO: 323991 - DNA, 19 bp, Homo sapiens
caatggcgcagtgcctctg

SEQ ID NO: 323992 - DNA, 13 bp, Homo sapiens
caatggctgggag

SEQ ID NO: 323993 - DNA, 22 bp, Homo sapiens
caatgggactggagtcagatga

SEQ ID NO: 323994 - DNA, 21 bp, Homo sapiens
caatgggagtgaacatttcta

SEQ ID NO: 323995 - DNA, 16 bp, Homo sapiens
caatggggtgggccca

SEQ ID NO: 323996 - DNA, 21 bp, Homo sapiens
caatggtgtagctgtcctctc

SEQ ID NO: 323997 - DNA, 23 bp, Homo sapiens
caatgtatcccttctcacagcac

SEQ ID NO: 323998 - DNA, 22 bp, Homo sapiens
caatgtatgtgaaagtgtaaaa

SEQ ID NO: 323999 - DNA, 23 bp, Homo sapiens
caatgtatgtgaaagtgtaaaat

SEQ ID NO: 324000 - DNA, 19 bp, Homo sapiens
caatgtcacaacctctctg

SEQ ID NO: 324001 - DNA, 21 bp, Homo sapiens
caatgtcacaacctctctgat

SEQ ID NO: 324002 - DNA, 22 bp, Homo sapiens
caatgtcacaacctctctgatc

SEQ ID NO: 324003 - DNA, 14 bp, Homo sapiens
caatgtcacttaaa

SEQ ID NO: 324004 - DNA, 20 bp, Homo sapiens
caatgtcttaaataaaacta

SEQ ID NO: 324005 - DNA, 19 bp, Homo sapiens
caatgtgagtcccagagcc

SEQ ID NO: 324006 - DNA, 16 bp, Homo sapiens
caatgtgatatgtgta

SEQ ID NO: 324007 - DNA, 18 bp, Homo sapiens
caatgtggaaaaaatatt

SEQ ID NO: 324008 - DNA, 20 bp, Homo sapiens
caatgtggaaaaaatatttt

SEQ ID NO: 324009 - DNA, 16 bp, Homo sapiens
caatgtggaattacat

SEQ ID NO: 324010 - DNA, 21 bp, Homo sapiens
caatgtggtggcaataaatgt

SEQ ID NO: 324011 - DNA, 20 bp, Homo sapiens
caatgttcaggagagtaaaa

SEQ ID NO: 324012 - DNA, 21 bp, Homo sapiens
caatgttcaggagagtaaaaa

SEQ ID NO: 324013 - DNA, 13 bp, Homo sapiens
caatgttcattgt

SEQ ID NO: 324014 - DNA, 18 bp, Homo sapiens
caatgttcattgtaatgt

SEQ ID NO: 324015 - DNA, 23 bp, Homo sapiens
caatgttcattgtaatgttactg

SEQ ID NO: 324016 - DNA, 21 bp, Homo sapiens
caatgttccgttcatctgagg

SEQ ID NO: 324017 - DNA, 18 bp, Homo sapiens
caatgttggcctgtcaga

SEQ ID NO: 324018 - DNA, 13 bp, Homo sapiens
caatgttgtgatt

SEQ ID NO: 324019 - DNA, 18 bp, Homo sapiens
caattacaggaagtactg

SEQ ID NO: 324020 - DNA, 22 bp, Homo sapiens
caattaggaagtgtaacagctg

SEQ ID NO: 324021 - DNA, 20 bp, Homo sapiens
caattaggtctgcattttct

SEQ ID NO: 324022 - DNA, 22 bp, Homo sapiens
caattatgtgacaacctttgtg

SEQ ID NO: 324023 - DNA, 23 bp, Homo sapiens
caattatgtgacaacctttgtgt

SEQ ID NO: 324024 - DNA, 15 bp, Homo sapiens
caattattacattta

SEQ ID NO: 324025 - DNA, 14 bp, Homo sapiens
caattatttaaaga

SEQ ID NO: 324026 - DNA, 19 bp, Homo sapiens
caattcaactttttatttt

SEQ ID NO: 324027 - DNA, 14 bp, Homo sapiens
caattcagagaata

SEQ ID NO: 324028 - DNA, 23 bp, Homo sapiens
caattcagttttagtttcaaaat

SEQ ID NO: 324029 - DNA, 24 bp, Homo sapiens
caattcccgggcccttcagtccct

SEQ ID NO: 324030 - DNA, 22 bp, Homo sapiens
caattcctagataaaaagatgg

SEQ ID NO: 324031 - DNA, 13 bp, Homo sapiens
caattcctctggg

SEQ ID NO: 324032 - DNA, 13 bp, Homo sapiens
caattctactagt

SEQ ID NO: 324033 - DNA, 12 bp, Homo sapiens
caattctgtccc

SEQ ID NO: 324034 - DNA, 15 bp, Homo sapiens
caattctgtcccaat

SEQ ID NO: 324035 - DNA, 14 bp, Homo sapiens
caattctgtccctg

SEQ ID NO: 324036 - DNA, 16 bp, Homo sapiens
caattctgtccctgtc

SEQ ID NO: 324037 - DNA, 15 bp, Homo sapiens
caattcttcttctca

SEQ ID NO: 324038 - DNA, 17 bp, Homo sapiens
caattctttgttgctta

SEQ ID NO: 324039 - DNA, 13 bp, Homo sapiens
caattgcactgct

SEQ ID NO: 324040 - DNA, 18 bp, Homo sapiens
caattgctgcatcttagt

SEQ ID NO: 324041 - DNA, 18 bp, Homo sapiens
caattgtgagccaccacg

SEQ ID NO: 324042 - DNA, 18 bp, Homo sapiens
caatttaggaatgctcaa

SEQ ID NO: 324043 - DNA, 13 bp, Homo sapiens
caatttatgcaga

SEQ ID NO: 324044 - DNA, 16 bp, Homo sapiens
caatttcaaaatgcat

SEQ ID NO: 324045 - DNA, 17 bp, Homo sapiens
caatttcaaaatgcatg

SEQ ID NO: 324046 - DNA, 18 bp, Homo sapiens
caatttcaaaatgcatgt

SEQ ID NO: 324047 - DNA, 21 bp, Homo sapiens
caatttcaaaatgcatgtgat

SEQ ID NO: 324048 - DNA, 19 bp, Homo sapiens
caatttcctttatatttag

SEQ ID NO: 324049 - DNA, 15 bp, Homo sapiens
caatttctaaatttg

SEQ ID NO: 324050 - DNA, 22 bp, Homo sapiens
caatttctgtccttcagatgga

SEQ ID NO: 324051 - DNA, 22 bp, Homo sapiens
caatttgcataatactaattta

SEQ ID NO: 324052 - DNA, 17 bp, Homo sapiens
caatttggtcttagctt

SEQ ID NO: 324053 - DNA, 22 bp, Homo sapiens
caatttggtcttagctttacat

SEQ ID NO: 324054 - DNA, 17 bp, Homo sapiens
caatttgtctcctactc

SEQ ID NO: 324055 - DNA, 17 bp, Homo sapiens
caatttgtttaaagaat

SEQ ID NO: 324056 - DNA, 18 bp, Homo sapiens
caatttgtttaaagaata

SEQ ID NO: 324057 - DNA, 14 bp, Homo sapiens
caattttaaaaaat

SEQ ID NO: 324058 - DNA, 15 bp, Homo sapiens
caattttaacatttg

SEQ ID NO: 324059 - DNA, 14 bp, Homo sapiens
caattttgtcacag

SEQ ID NO: 324060 - DNA, 15 bp, Homo sapiens
caattttttaaacca

SEQ ID NO: 324061 - DNA, 17 bp, Homo sapiens
caattttttatttttat

SEQ ID NO: 324062 - DNA, 14 bp, Homo sapiens
caatttttttatac

SEQ ID NO: 324063 - DNA, 16 bp, Homo sapiens
cacaaaaaaagtaatt

SEQ ID NO: 324064 - DNA, 22 bp, Homo sapiens
cacaaaaaaagttgaaggcctt

SEQ ID NO: 324065 - DNA, 23 bp, Homo sapiens
cacaaaaaaatggaaagaaaaga

SEQ ID NO: 324066 - DNA, 19 bp, Homo sapiens
cacaaaaagaaagctgtga

SEQ ID NO: 324067 - DNA, 14 bp, Homo sapiens
cacaaaaagcacaa

SEQ ID NO: 324068 - DNA, 14 bp, Homo sapiens
cacaaaaaggagcg

SEQ ID NO: 324069 - DNA, 21 bp, Homo sapiens
cacaaaaaggagcgggcaggg

SEQ ID NO: 324070 - DNA, 22 bp, Homo sapiens
cacaaaaaggagcgggcagggc

SEQ ID NO: 324071 - DNA, 15 bp, Homo sapiens
cacaaaacaacagca

SEQ ID NO: 324072 - DNA, 16 bp, Homo sapiens
cacaaaacaacagcaa

SEQ ID NO: 324073 - DNA, 14 bp, Homo sapiens
cacaaaatatttct

SEQ ID NO: 324074 - DNA, 23 bp, Homo sapiens
cacaaacgtttacttatcttatg

SEQ ID NO: 324075 - DNA, 15 bp, Homo sapiens
cacaaagagttctgg

SEQ ID NO: 324076 - DNA, 15 bp, Homo sapiens
cacaaagatattatt

SEQ ID NO: 324077 - DNA, 20 bp, Homo sapiens
cacaaagccttatcaagtgt

SEQ ID NO: 324078 - DNA, 17 bp, Homo sapiens
cacaaaggtagcttttc

SEQ ID NO: 324079 - DNA, 20 bp, Homo sapiens
cacaaataagtaatatcttt

SEQ ID NO: 324080 - DNA, 20 bp, Homo sapiens
cacaaatgcagacacacaac

SEQ ID NO: 324081 - DNA, 11 bp, Homo sapiens
cacaaatgtcc

SEQ ID NO: 324082 - DNA, 14 bp, Homo sapiens
cacaaatgtgtact

SEQ ID NO: 324083 - DNA, 14 bp, Homo sapiens
cacaaatttgcttt

SEQ ID NO: 324084 - DNA, 12 bp, Homo sapiens
cacaacaaaaat

SEQ ID NO: 324085 - DNA, 14 bp, Homo sapiens
cacaacaccaggac

SEQ ID NO: 324086 - DNA, 15 bp, Homo sapiens
cacaacaccaggact

SEQ ID NO: 324087 - DNA, 22 bp, Homo sapiens
cacaaccactaatttgtcactg

SEQ ID NO: 324088 - DNA, 14 bp, Homo sapiens
cacaacctgaaaga

SEQ ID NO: 324089 - DNA, 17 bp, Homo sapiens
cacaacctgaaagacaa

SEQ ID NO: 324090 - DNA, 17 bp, Homo sapiens
cacaaccttctgtggct

SEQ ID NO: 324091 - DNA, 23 bp, Homo sapiens
cacaaccttctgtggctcacaga

SEQ ID NO: 324092 - DNA, 16 bp, Homo sapiens
atgtaaccaagctgta

SEQ ID NO: 324093 - DNA, 22 bp, Homo sapiens
atgtaagaaaacaaaatctaaa

SEQ ID NO: 324094 - DNA, 13 bp, Homo sapiens
atgtaagaagccc

SEQ ID NO: 324095 - DNA, 19 bp, Homo sapiens
atgtaataaaaagtatatg

SEQ ID NO: 324096 - DNA, 14 bp, Homo sapiens
atgtaatattaaat

SEQ ID NO: 324097 - DNA, 16 bp, Homo sapiens
atgtaatcaatgtttc

SEQ ID NO: 324098 - DNA, 16 bp, Homo sapiens
atgtaatgacagagag

SEQ ID NO: 324099 - DNA, 19 bp, Homo sapiens
atgtaatgcttatgtgttg

SEQ ID NO: 324100 - DNA, 15 bp, Homo sapiens
atgtaattgaataaa

SEQ ID NO: 324101 - DNA, 15 bp, Homo sapiens
atgtacaaagatact

SEQ ID NO: 324102 - DNA, 16 bp, Homo sapiens
atgtacaaggtatgta

SEQ ID NO: 324103 - DNA, 15 bp, Homo sapiens
atgtacaagttttgt

SEQ ID NO: 324104 - DNA, 22 bp, Homo sapiens
atgtacaataaaggatgtttat

SEQ ID NO: 324105 - DNA, 22 bp, Homo sapiens
atgtacagtctcaattttgtat

SEQ ID NO: 324106 - DNA, 13 bp, Homo sapiens
atgtacagtctgt

SEQ ID NO: 324107 - DNA, 15 bp, Homo sapiens
atgtacagttcataa

SEQ ID NO: 324108 - DNA, 15 bp, Homo sapiens
atgtaccatgtacat

SEQ ID NO: 324109 - DNA, 18 bp, Homo sapiens
atgtactacatttgcatg

SEQ ID NO: 324110 - DNA, 19 bp, Homo sapiens
atgtactacatttgcatgc

SEQ ID NO: 324111 - DNA, 20 bp, Homo sapiens
atgtactatatgtatatctt

SEQ ID NO: 324112 - DNA, 17 bp, Homo sapiens
atgtactcctctttaca

SEQ ID NO: 324113 - DNA, 23 bp, Homo sapiens
atgtactgagaggaggggtaaat

SEQ ID NO: 324114 - DNA, 14 bp, Homo sapiens
atgtactgagattt

SEQ ID NO: 324115 - DNA, 15 bp, Homo sapiens
atgtactggagagtg

SEQ ID NO: 324116 - DNA, 19 bp, Homo sapiens
atgtactgtagtttttctt

SEQ ID NO: 324117 - DNA, 19 bp, Homo sapiens
atgtacttaagagtggcat

SEQ ID NO: 324118 - DNA, 13 bp, Homo sapiens
atgtactttatat

SEQ ID NO: 324119 - DNA, 23 bp, Homo sapiens
atgtagaaatattataaatccaa

SEQ ID NO: 324120 - DNA, 15 bp, Homo sapiens
atgtagaactcagca

SEQ ID NO: 324121 - DNA, 22 bp, Homo sapiens
atgtagaactgttcatttccac

SEQ ID NO: 324122 - DNA, 12 bp, Homo sapiens
atgtagaagaaa

SEQ ID NO: 324123 - DNA, 18 bp, Homo sapiens
atgtagaagaaagcaaaa

SEQ ID NO: 324124 - DNA, 14 bp, Homo sapiens
atgtagaagaggga

SEQ ID NO: 324125 - DNA, 22 bp, Homo sapiens
atgtagatattgttttctgtaa

SEQ ID NO: 324126 - DNA, 17 bp, Homo sapiens
atgtagcaaaacgcatg

SEQ ID NO: 324127 - DNA, 20 bp, Homo sapiens
atgtagcaaaacgcatggag

SEQ ID NO: 324128 - DNA, 23 bp, Homo sapiens
atgtagcattgttccacacattt

SEQ ID NO: 324129 - DNA, 22 bp, Homo sapiens
atgtagctctgcatctcctgtc

SEQ ID NO: 324130 - DNA, 19 bp, Homo sapiens
atgtagctgaaacaaaaat

SEQ ID NO: 324131 - DNA, 22 bp, Homo sapiens
atgtagttttcttttttaaatt

SEQ ID NO: 324132 - DNA, 17 bp, Homo sapiens
atgtataaagaacaagg

SEQ ID NO: 324133 - DNA, 13 bp, Homo sapiens
atgtatcaggaaa

SEQ ID NO: 324134 - DNA, 15 bp, Homo sapiens
atgtatcctgataaa

SEQ ID NO: 324135 - DNA, 19 bp, Homo sapiens
atgtatctagtggtctgat

SEQ ID NO: 324136 - DNA, 17 bp, Homo sapiens
atgtatcttatttatat

SEQ ID NO: 324137 - DNA, 18 bp, Homo sapiens
atgtatcttatttatata

SEQ ID NO: 324138 - DNA, 19 bp, Homo sapiens
atgtatcttatttatatat

SEQ ID NO: 324139 - DNA, 15 bp, Homo sapiens
atgtatgtgcactgt

SEQ ID NO: 324140 - DNA, 12 bp, Homo sapiens
atgtatgtgtag

SEQ ID NO: 324141 - DNA, 13 bp, Homo sapiens
atgtatgtgtagt

SEQ ID NO: 324142 - DNA, 15 bp, Homo sapiens
atgtatgtgtagtgt

SEQ ID NO: 324143 - DNA, 22 bp, Homo sapiens
atgtatgtgtagtgtgtttgtg

SEQ ID NO: 324144 - DNA, 18 bp, Homo sapiens
atgtatgttggtttttta

SEQ ID NO: 324145 - DNA, 13 bp, Homo sapiens
atgtatgtttaca

SEQ ID NO: 324146 - DNA, 16 bp, Homo sapiens
atgtatgtttacatat

SEQ ID NO: 324147 - DNA, 17 bp, Homo sapiens
atgtatgtttacatatc

SEQ ID NO: 324148 - DNA, 22 bp, Homo sapiens
atgtattaccagccccccaccc

SEQ ID NO: 324149 - DNA, 18 bp, Homo sapiens
atgtattacttttctgca

SEQ ID NO: 324150 - DNA, 17 bp, Homo sapiens
atgtattatgcaaagta

SEQ ID NO: 324151 - DNA, 13 bp, Homo sapiens
atgtattattctg

SEQ ID NO: 324152 - DNA, 16 bp, Homo sapiens
atgtattggcatttat

SEQ ID NO: 324153 - DNA, 17 bp, Homo sapiens
atgtatttataaatata

SEQ ID NO: 324154 - DNA, 20 bp, Homo sapiens
atgtatttcattgctgtgtc

SEQ ID NO: 324155 - DNA, 22 bp, Homo sapiens
atgtattttcaataaagaaaaa

SEQ ID NO: 324156 - DNA, 19 bp, Homo sapiens
atgtcaaagtgaaagacat

SEQ ID NO: 324157 - DNA, 17 bp, Homo sapiens
atgtcaaatatctcaga

SEQ ID NO: 324158 - DNA, 19 bp, Homo sapiens
atgtcaaatatctcagagg

SEQ ID NO: 324159 - DNA, 15 bp, Homo sapiens
atgtcaaatggatgt

SEQ ID NO: 324160 - DNA, 19 bp, Homo sapiens
atgtcaaccttgtgtgagt

SEQ ID NO: 324161 - DNA, 20 bp, Homo sapiens
atgtcaaggtgctgttgtca

SEQ ID NO: 324162 - DNA, 19 bp, Homo sapiens
atgtcacaaattgatcaag

SEQ ID NO: 324163 - DNA, 14 bp, Homo sapiens
atgtcactgtggtc

SEQ ID NO: 324164 - DNA, 23 bp, Homo sapiens
atgtcagacatccatgtttgtaa

SEQ ID NO: 324165 - DNA, 20 bp, Homo sapiens
atgtcagtctacaggccttt

SEQ ID NO: 324166 - DNA, 22 bp, Homo sapiens
atgtcagtctacaggcctttca

SEQ ID NO: 324167 - DNA, 17 bp, Homo sapiens
atgtcatactctgtgta

SEQ ID NO: 324168 - DNA, 22 bp, Homo sapiens
atgtcattatttgataacattt

SEQ ID NO: 324169 - DNA, 14 bp, Homo sapiens
atgtcatttctact

SEQ ID NO: 324170 - DNA, 18 bp, Homo sapiens
atgtcatttctactttga

SEQ ID NO: 324171 - DNA, 20 bp, Homo sapiens
atgtcatttctactttgact

SEQ ID NO: 324172 - DNA, 13 bp, Homo sapiens
atgtcatttgcta

SEQ ID NO: 324173 - DNA, 14 bp, Homo sapiens
atgtcatttgctaa

SEQ ID NO: 324174 - DNA, 15 bp, Homo sapiens
atgtcatttgctaat

SEQ ID NO: 324175 - DNA, 19 bp, Homo sapiens
atgtcatttgctaatgaat

SEQ ID NO: 324176 - DNA, 17 bp, Homo sapiens
atgtccaagttcttcac

SEQ ID NO: 324177 - DNA, 12 bp, Homo sapiens
atgtccagaaga

SEQ ID NO: 324178 - DNA, 21 bp, Homo sapiens
atgtccagaagaatattcagg

SEQ ID NO: 324179 - DNA, 22 bp, Homo sapiens
atgtccagaagaatattcagga

SEQ ID NO: 324180 - DNA, 23 bp, Homo sapiens
atgtccagaagaatattcaggac

SEQ ID NO: 324181 - DNA, 16 bp, Homo sapiens
atgtcccaaataaatt

SEQ ID NO: 324182 - DNA, 14 bp, Homo sapiens
atgtcccccacctc

SEQ ID NO: 324183 - DNA, 21 bp, Homo sapiens
atgtcccccacctcttttcct

SEQ ID NO: 324184 - DNA, 14 bp, Homo sapiens
atgtcccctgtccc

SEQ ID NO: 324185 - DNA, 15 bp, Homo sapiens
atgtcccctgtccca

SEQ ID NO: 324186 - DNA, 19 bp, Homo sapiens
atgtccctagaaaacaatg

SEQ ID NO: 324187 - DNA, 16 bp, Homo sapiens
atgtccctttcttggc

SEQ ID NO: 324188 - DNA, 16 bp, Homo sapiens
atgtcctaaggacaca

SEQ ID NO: 324189 - DNA, 18 bp, Homo sapiens
atgtcctaaggacacact

SEQ ID NO: 324190 - DNA, 21 bp, Homo sapiens
atgtcctaaggacacactaat

SEQ ID NO: 324191 - DNA, 22 bp, Homo sapiens
atgtcctaggggccgagggaaa

SEQ ID NO: 324192 - DNA, 16 bp, Homo sapiens
atgtcctccagaagcc

SEQ ID NO: 324193 - DNA, 19 bp, Homo sapiens
atgtcctccagaagcctct

SEQ ID NO: 324194 - DNA, 22 bp, Homo sapiens
atgtcctccagaagcctctggc

SEQ ID NO: 324195 - DNA, 23 bp, Homo sapiens
atgtcctccagaagcctctggct

SEQ ID NO: 324196 - DNA, 13 bp, Homo sapiens
atgtcctgtaaac

SEQ ID NO: 324197 - DNA, 14 bp, Homo sapiens
atgtcgattaaaat

SEQ ID NO: 324198 - DNA, 15 bp, Homo sapiens
atgtcgattttcaat

SEQ ID NO: 324199 - DNA, 12 bp, Homo sapiens
atgtcgcttttg

SEQ ID NO: 324200 - DNA, 19 bp, Homo sapiens
atgtcggagtagaaattgt

SEQ ID NO: 324201 - DNA, 20 bp, Homo sapiens
atgtctaaaagattctttaa

SEQ ID NO: 324202 - DNA, 11 bp, Homo sapiens
atgtctaaaga

SEQ ID NO: 324203 - DNA, 22 bp, Homo sapiens
atgtctcaggtccctgcagggc

SEQ ID NO: 324204 - DNA, 22 bp, Homo sapiens
atgtctccagattggcacccct

SEQ ID NO: 324205 - DNA, 14 bp, Homo sapiens
atgtctctaaagca

SEQ ID NO: 324206 - DNA, 20 bp, Homo sapiens
atgtctgagagaccatctcc

SEQ ID NO: 324207 - DNA, 21 bp, Homo sapiens
atgtctgagagaccatctcct

SEQ ID NO: 324208 - DNA, 12 bp, Homo sapiens
agcagcttccag

SEQ ID NO: 324209 - DNA, 14 bp, Homo sapiens
agcagcttccagat

SEQ ID NO: 324210 - DNA, 14 bp, Homo sapiens
agcagcttggctga

SEQ ID NO: 324211 - DNA, 12 bp, Homo sapiens
agcaggaaatag

SEQ ID NO: 324212 - DNA, 19 bp, Homo sapiens
agcaggaagcaaggccagc

SEQ ID NO: 324213 - DNA, 12 bp, Homo sapiens
agcaggactgag

SEQ ID NO: 324214 - DNA, 15 bp, Homo sapiens
agcaggagcagctgt

SEQ ID NO: 324215 - DNA, 16 bp, Homo sapiens
agcaggagcagctgtg

SEQ ID NO: 324216 - DNA, 15 bp, Homo sapiens
agcaggaggcccctg

SEQ ID NO: 324217 - DNA, 22 bp, Homo sapiens
agcaggatagttgctccgcctc

SEQ ID NO: 324218 - DNA, 15 bp, Homo sapiens
agcaggcaagcatgt

SEQ ID NO: 324219 - DNA, 18 bp, Homo sapiens
agcaggcaccagcagcag

SEQ ID NO: 324220 - DNA, 16 bp, Homo sapiens
agcaggcagaggagag

SEQ ID NO: 324221 - DNA, 16 bp, Homo sapiens
agcaggcccagctggg

SEQ ID NO: 324222 - DNA, 23 bp, Homo sapiens
attttggcaagaagactgtattt

SEQ ID NO: 324223 - DNA, 16 bp, Homo sapiens
attttggctcactgca

SEQ ID NO: 324224 - DNA, 20 bp, Homo sapiens
attttggtattacactgtat

SEQ ID NO: 324225 - DNA, 20 bp, Homo sapiens
attttggtccaaattcttta

SEQ ID NO: 324226 - DNA, 21 bp, Homo sapiens
attttggtccaaattctttat

SEQ ID NO: 324227 - DNA, 18 bp, Homo sapiens
attttggtgaatgtgggt

SEQ ID NO: 324228 - DNA, 22 bp, Homo sapiens
attttgtaactgcctaccagtc

SEQ ID NO: 324229 - DNA, 20 bp, Homo sapiens
attttgtacaaatttgttat

SEQ ID NO: 324230 - DNA, 12 bp, Homo sapiens
attttgtagcta

SEQ ID NO: 324231 - DNA, 14 bp, Homo sapiens
attttgtagctagt

SEQ ID NO: 324232 - DNA, 18 bp, Homo sapiens
attttgtatccatttaaa

SEQ ID NO: 324233 - DNA, 16 bp, Homo sapiens
attttgtatcttgatg

SEQ ID NO: 324234 - DNA, 13 bp, Homo sapiens
attttgtatgtat

SEQ ID NO: 324235 - DNA, 17 bp, Homo sapiens
attttgtcacagctctt

SEQ ID NO: 324236 - DNA, 23 bp, Homo sapiens
attttgtcatataagattcatat

SEQ ID NO: 324237 - DNA, 19 bp, Homo sapiens
attttgtccaagttcacag

SEQ ID NO: 324238 - DNA, 21 bp, Homo sapiens
attttgtccaagttcacagta

SEQ ID NO: 324239 - DNA, 15 bp, Homo sapiens
attttgtctggctgt

SEQ ID NO: 324240 - DNA, 17 bp, Homo sapiens
attttgtgaatctattg

SEQ ID NO: 324241 - DNA, 20 bp, Homo sapiens
attttgtgatgatgctgtga

SEQ ID NO: 324242 - DNA, 13 bp, Homo sapiens
attttgtgctctt

SEQ ID NO: 324243 - DNA, 17 bp, Homo sapiens
attttgtggttaagaga

SEQ ID NO: 324244 - DNA, 16 bp, Homo sapiens
attttgttatagaata

SEQ ID NO: 324245 - DNA, 23 bp, Homo sapiens
atttttaaaggacaaacagtgaa

SEQ ID NO: 324246 - DNA, 12 bp, Homo sapiens
atttttaaagtt

SEQ ID NO: 324247 - DNA, 15 bp, Homo sapiens
atttttaaagtttaa

SEQ ID NO: 324248 - DNA, 22 bp, Homo sapiens
atttttaaagtttaaataccag

SEQ ID NO: 324249 - DNA, 17 bp, Homo sapiens
atttttaaatcatttca

SEQ ID NO: 324250 - DNA, 19 bp, Homo sapiens
atttttaaatgtaaaacat

SEQ ID NO: 324251 - DNA, 14 bp, Homo sapiens
atttttaaattctg

SEQ ID NO: 324252 - DNA, 20 bp, Homo sapiens
atttttaatgtttttaaata

SEQ ID NO: 324253 - DNA, 18 bp, Homo sapiens
atttttacaaataaagat

SEQ ID NO: 324254 - DNA, 14 bp, Homo sapiens
atttttacaataaa

SEQ ID NO: 324255 - DNA, 19 bp, Homo sapiens
atttttacaataaataatc

SEQ ID NO: 324256 - DNA, 22 bp, Homo sapiens
atttttacagaattgcttgttt

SEQ ID NO: 324257 - DNA, 21 bp, Homo sapiens
atttttaccccctaaggaata

SEQ ID NO: 324258 - DNA, 15 bp, Homo sapiens
atttttactaaagca

SEQ ID NO: 324259 - DNA, 17 bp, Homo sapiens
atttttactaaagcagt

SEQ ID NO: 324260 - DNA, 18 bp, Homo sapiens
atttttactaaagcagtg

SEQ ID NO: 324261 - DNA, 19 bp, Homo sapiens
atttttactaaagcagtgt

SEQ ID NO: 324262 - DNA, 17 bp, Homo sapiens
atttttaggtgtctttt

SEQ ID NO: 324263 - DNA, 14 bp, Homo sapiens
atttttatatttaa

SEQ ID NO: 324264 - DNA, 19 bp, Homo sapiens
atttttatcccatctcact

SEQ ID NO: 324265 - DNA, 14 bp, Homo sapiens
atttttatttcaaa

SEQ ID NO: 324266 - DNA, 16 bp, Homo sapiens
atttttatttttctaa

SEQ ID NO: 324267 - DNA, 18 bp, Homo sapiens
atttttcatattgtgcca

SEQ ID NO: 324268 - DNA, 12 bp, Homo sapiens
atttttcccagg

SEQ ID NO: 324269 - DNA, 12 bp, Homo sapiens
atttttccctcc

SEQ ID NO: 324270 - DNA, 21 bp, Homo sapiens
atttttctcacctagctgctc

SEQ ID NO: 324271 - DNA, 19 bp, Homo sapiens
atttttctgggaagaaaat

SEQ ID NO: 324272 - DNA, 11 bp, Homo sapiens
atttttcttcc

SEQ ID NO: 324273 - DNA, 19 bp, Homo sapiens
atttttcttgttgcatctt

SEQ ID NO: 324274 - DNA, 14 bp, Homo sapiens
atttttgaaaaggc

SEQ ID NO: 324275 - DNA, 14 bp, Homo sapiens
atttttgaataaaa

SEQ ID NO: 324276 - DNA, 15 bp, Homo sapiens
atttttgccatacat

SEQ ID NO: 324277 - DNA, 13 bp, Homo sapiens
atttttgtactgt

SEQ ID NO: 324278 - DNA, 20 bp, Homo sapiens
atttttgtatgttatgaaca

SEQ ID NO: 324279 - DNA, 18 bp, Homo sapiens
atttttgtattttgtaca

SEQ ID NO: 324280 - DNA, 20 bp, Homo sapiens
atttttgtgaaatgaaaaca

SEQ ID NO: 324281 - DNA, 17 bp, Homo sapiens
atttttgtgtttctaaa

SEQ ID NO: 324282 - DNA, 12 bp, Homo sapiens
atttttgttaag

SEQ ID NO: 324283 - DNA, 22 bp, Homo sapiens
atttttgtttcttccaaagcac

SEQ ID NO: 324284 - DNA, 15 bp, Homo sapiens
attttttaaaacaag

SEQ ID NO: 324285 - DNA, 19 bp, Homo sapiens
attttttaaatgaaagaag

SEQ ID NO: 324286 - DNA, 16 bp, Homo sapiens
attttttaactgctgc

SEQ ID NO: 324287 - DNA, 18 bp, Homo sapiens
attttttaagtatttata

SEQ ID NO: 324288 - DNA, 20 bp, Homo sapiens
attttttaagtatttatata

SEQ ID NO: 324289 - DNA, 19 bp, Homo sapiens
attttttacagctgcctgc

SEQ ID NO: 324290 - DNA, 15 bp, Homo sapiens
attttttactacata

SEQ ID NO: 324291 - DNA, 21 bp, Homo sapiens
attttttactacataattaaa

SEQ ID NO: 324292 - DNA, 13 bp, Homo sapiens
attttttattgtt

SEQ ID NO: 324293 - DNA, 16 bp, Homo sapiens
acctctttccaaaggc

SEQ ID NO: 324294 - DNA, 17 bp, Homo sapiens
acctctttcctctctgg

SEQ ID NO: 324295 - DNA, 22 bp, Homo sapiens
acctctttgaaagaaggaagac

SEQ ID NO: 324296 - DNA, 16 bp, Homo sapiens
acctcttttcctagtt

SEQ ID NO: 324297 - DNA, 16 bp, Homo sapiens
acctgaaaattcaaca

SEQ ID NO: 324298 - DNA, 18 bp, Homo sapiens
acctgaaccccatgggct

SEQ ID NO: 324299 - DNA, 21 bp, Homo sapiens
acctgaaccccatgggcttgg

SEQ ID NO: 324300 - DNA, 21 bp, Homo sapiens
acctgaagagcgctcctctgc

SEQ ID NO: 324301 - DNA, 23 bp, Homo sapiens
acctgaagagcgctcctctgcct

SEQ ID NO: 324302 - DNA, 21 bp, Homo sapiens
acctgaagggtgacatcccag

SEQ ID NO: 324303 - DNA, 15 bp, Homo sapiens
acctgaagtcaaacc

SEQ ID NO: 324304 - DNA, 15 bp, Homo sapiens
acctgaagtctttgt

SEQ ID NO: 324305 - DNA, 22 bp, Homo sapiens
acctgaagtctttgtacagaca

SEQ ID NO: 324306 - DNA, 19 bp, Homo sapiens
acctgaatgcttctgagag

SEQ ID NO: 324307 - DNA, 17 bp, Homo sapiens
acctgacaatggcagct

SEQ ID NO: 324308 - DNA, 14 bp, Homo sapiens
acctgacacatctt

SEQ ID NO: 324309 - DNA, 12 bp, Homo sapiens
acctgacagatg

SEQ ID NO: 324310 - DNA, 21 bp, Homo sapiens
acctgagactgtcggagaggc

SEQ ID NO: 324311 - DNA, 14 bp, Homo sapiens
acctgagctcccca

SEQ ID NO: 324312 - DNA, 13 bp, Homo sapiens
acctgagctttgg

SEQ ID NO: 324313 - DNA, 21 bp, Homo sapiens
acctgaggccaggacgtctgg

SEQ ID NO: 324314 - DNA, 22 bp, Homo sapiens
acctgagtcggccccacatggg

SEQ ID NO: 324315 - DNA, 17 bp, Homo sapiens
acctgataagggagagg

SEQ ID NO: 324316 - DNA, 21 bp, Homo sapiens
acctgatgccccttccccaag

SEQ ID NO: 324317 - DNA, 21 bp, Homo sapiens
acctgatgttaaaattccatc

SEQ ID NO: 324318 - DNA, 21 bp, Homo sapiens
acctgatttccatttgcaaca

SEQ ID NO: 324319 - DNA, 15 bp, Homo sapiens
acctgcaagccccag

SEQ ID NO: 324320 - DNA, 16 bp, Homo sapiens
acctgcaagccccagg

SEQ ID NO: 324321 - DNA, 19 bp, Homo sapiens
acctgcaagccccagggcc

SEQ ID NO: 324322 - DNA, 18 bp, Homo sapiens
acctgcacttcatatcta

SEQ ID NO: 324323 - DNA, 19 bp, Homo sapiens
acctgcagcccctcctcct

SEQ ID NO: 324324 - DNA, 13 bp, Homo sapiens
acctgcaggactc

SEQ ID NO: 324325 - DNA, 19 bp, Homo sapiens
acctgcatcagcctctggc

SEQ ID NO: 324326 - DNA, 20 bp, Homo sapiens
acctgcatcagcctctggcc

SEQ ID NO: 324327 - DNA, 23 bp, Homo sapiens
acctgcatcagcctctggccaga

SEQ ID NO: 324328 - DNA, 11 bp, Homo sapiens
acctgcatgca

SEQ ID NO: 324329 - DNA, 22 bp, Homo sapiens
acctgcatgcagcaacacccaa

SEQ ID NO: 324330 - DNA, 15 bp, Homo sapiens
acctgcatttttaaa

SEQ ID NO: 324331 - DNA, 13 bp, Homo sapiens
acctgcccaacct

SEQ ID NO: 324332 - DNA, 21 bp, Homo sapiens
acctgcccaacctgctctcct

SEQ ID NO: 324333 - DNA, 20 bp, Homo sapiens
acctgcccagatcccagaag

SEQ ID NO: 324334 - DNA, 20 bp, Homo sapiens
acctgcccagttagcccggc

SEQ ID NO: 324335 - DNA, 17 bp, Homo sapiens
acctgcccccactcagc

SEQ ID NO: 324336 - DNA, 18 bp, Homo sapiens
acctgcccccactcagca

SEQ ID NO: 324337 - DNA, 15 bp, Homo sapiens
acctgcccccgctct

SEQ ID NO: 324338 - DNA, 12 bp, Homo sapiens
acctgccccctt

SEQ ID NO: 324339 - DNA, 17 bp, Homo sapiens
acctgcccccttctccc

SEQ ID NO: 324340 - DNA, 14 bp, Homo sapiens
acctgcccctcccc

SEQ ID NO: 324341 - DNA, 13 bp, Homo sapiens
acctgccctgccc

SEQ ID NO: 324342 - DNA, 22 bp, Homo sapiens
acctgccctgccctgccacctg

SEQ ID NO: 324343 - DNA, 13 bp, Homo sapiens
acctgccctgcct

SEQ ID NO: 324344 - DNA, 15 bp, Homo sapiens
acctgccctgcctga

SEQ ID NO: 324345 - DNA, 19 bp, Homo sapiens
acctgccctgcctgagggc

SEQ ID NO: 324346 - DNA, 18 bp, Homo sapiens
acctgcctatccatcctg

SEQ ID NO: 324347 - DNA, 21 bp, Homo sapiens
acctgcctatccatcctgcga

SEQ ID NO: 324348 - DNA, 17 bp, Homo sapiens
acctgcctcctgcctgc

SEQ ID NO: 324349 - DNA, 22 bp, Homo sapiens
acctgcctgaccatcccatgag

SEQ ID NO: 324350 - DNA, 20 bp, Homo sapiens
acctgcctgccccacacgga

SEQ ID NO: 324351 - DNA, 22 bp, Homo sapiens
acctgctccttggcctagtcag

SEQ ID NO: 324352 - DNA, 17 bp, Homo sapiens
acctgctctcctcttgc

SEQ ID NO: 324353 - DNA, 17 bp, Homo sapiens
acctgctgccccagctg

SEQ ID NO: 324354 - DNA, 14 bp, Homo sapiens
acctgctggcccct

SEQ ID NO: 324355 - DNA, 17 bp, Homo sapiens
acctgctggcccctcac

SEQ ID NO: 324356 - DNA, 19 bp, Homo sapiens
acctgctggcccctcacct

SEQ ID NO: 324357 - DNA, 20 bp, Homo sapiens
acctgctggttgttgccagg

SEQ ID NO: 324358 - DNA, 21 bp, Homo sapiens
acctgcttgtgttgggcccca

SEQ ID NO: 324359 - DNA, 16 bp, Homo sapiens
acctggaagagctggg

SEQ ID NO: 324360 - DNA, 14 bp, Homo sapiens
acctggagacagta

SEQ ID NO: 324361 - DNA, 22 bp, Homo sapiens
acctggatggatctgctccatg

SEQ ID NO: 324362 - DNA, 14 bp, Homo sapiens
acctggcctgctgg

SEQ ID NO: 324363 - DNA, 15 bp, Homo sapiens
acctggcctgctggg

SEQ ID NO: 324364 - DNA, 21 bp, Homo sapiens
acctggctgcgaactgtgcag

SEQ ID NO: 324365 - DNA, 22 bp, Homo sapiens
acctggcttcccaggaccctgg

SEQ ID NO: 324366 - DNA, 24 bp, Homo sapiens
acctgggaaaggacccacccatct

SEQ ID NO: 324367 - DNA, 15 bp, Homo sapiens
acctgggccctaggc

SEQ ID NO: 324368 - DNA, 17 bp, Homo sapiens
acctgggccctaggcat

SEQ ID NO: 324369 - DNA, 18 bp, Homo sapiens
acctgggcctttcctgtg

SEQ ID NO: 324370 - DNA, 20 bp, Homo sapiens
acctgggcctttcctgtgcc

SEQ ID NO: 324371 - DNA, 15 bp, Homo sapiens
acctgggctgaggag

SEQ ID NO: 324372 - DNA, 12 bp, Homo sapiens
acctgggctggg

SEQ ID NO: 324373 - DNA, 16 bp, Homo sapiens
acctgggctgggagaa

SEQ ID NO: 324374 - DNA, 23 bp, Homo sapiens
acctgggcttaagttttacttga

SEQ ID NO: 324375 - DNA, 22 bp, Homo sapiens
acctggggtggggaggcagagg

SEQ ID NO: 324376 - DNA, 22 bp, Homo sapiens
acctgggttccctttccttcca

SEQ ID NO: 324377 - DNA, 21 bp, Homo sapiens
acctggtcacaggactctgcc

SEQ ID NO: 324378 - DNA, 22 bp, Homo sapiens
acctggtcacaggactctgcct

SEQ ID NO: 324379 - DNA, 10 bp, Homo sapiens
acctggtgct

SEQ ID NO: 324380 - DNA, 14 bp, Homo sapiens
acctggtgctggat

SEQ ID NO: 324381 - DNA, 13 bp, Homo sapiens
acctggtggctgg

SEQ ID NO: 324382 - DNA, 15 bp, Homo sapiens
acctggtggctggag

SEQ ID NO: 324383 - DNA, 22 bp, Homo sapiens
acctggttccggaatcctgtcc

SEQ ID NO: 324384 - DNA, 11 bp, Homo sapiens
acctgtaaaac

SEQ ID NO: 324385 - DNA, 14 bp, Homo sapiens
acctgtaaaacttt

SEQ ID NO: 324386 - DNA, 17 bp, Homo sapiens
acctgtaaaactttatt

SEQ ID NO: 324387 - DNA, 22 bp, Homo sapiens
acctgtaaaactttattttata

SEQ ID NO: 324388 - DNA, 18 bp, Homo sapiens
acctgtaaattattttaa

SEQ ID NO: 324389 - DNA, 13 bp, Homo sapiens
acctgtaactgcc

SEQ ID NO: 324390 - DNA, 23 bp, Homo sapiens
acctgtaactgcccttttaaatg

SEQ ID NO: 324391 - DNA, 14 bp, Homo sapiens
acctgtaacttttt

SEQ ID NO: 324392 - DNA, 19 bp, Homo sapiens
acctgtaatcccagctact

SEQ ID NO: 324393 - DNA, 20 bp, Homo sapiens
acctgtaatcccagctactt

SEQ ID NO: 324394 - DNA, 18 bp, Homo sapiens
acctgtacatacattgta

SEQ ID NO: 324395 - DNA, 15 bp, Homo sapiens
acctgtagtgagaaa

SEQ ID NO: 324396 - DNA, 16 bp, Homo sapiens
acctgtagtgagaaac

SEQ ID NO: 324397 - DNA, 16 bp, Homo sapiens
acctgtcatctgggcc

SEQ ID NO: 324398 - DNA, 14 bp, Homo sapiens
acctgtcccacctc

SEQ ID NO: 324399 - DNA, 14 bp, Homo sapiens
acctgtctcagcct

SEQ ID NO: 324400 - DNA, 16 bp, Homo sapiens
acctgtgccaggctga

SEQ ID NO: 324401 - DNA, 19 bp, Homo sapiens
acctgtgcctgagaattta

SEQ ID NO: 324402 - DNA, 21 bp, Homo sapiens
acctgtgctagttttacagat

SEQ ID NO: 324403 - DNA, 17 bp, Homo sapiens
acctgtggataaaacat

SEQ ID NO: 324404 - DNA, 19 bp, Homo sapiens
acctgtggataaaacatta

SEQ ID NO: 324405 - DNA, 18 bp, Homo sapiens
acctgtggccagagcacc

SEQ ID NO: 324406 - DNA, 17 bp, Homo sapiens
acctgtggcctctcagt

SEQ ID NO: 324407 - DNA, 20 bp, Homo sapiens
acctgtggggatttctccca

SEQ ID NO: 324408 - DNA, 22 bp, Homo sapiens
acctgtggggatttctcccagc

SEQ ID NO: 324409 - DNA, 23 bp, Homo sapiens
acctgtggggatttctcccagct

SEQ ID NO: 324410 - DNA, 16 bp, Homo sapiens
acctgtgtgagagaat

SEQ ID NO: 324411 - DNA, 19 bp, Homo sapiens
acctgtgtgagagaattta

SEQ ID NO: 324412 - DNA, 22 bp, Homo sapiens
acctgtgtgtatgtgtgtgttt

SEQ ID NO: 324413 - DNA, 22 bp, Homo sapiens
acctgtgtgttcttttgataca

SEQ ID NO: 324414 - DNA, 23 bp, Homo sapiens
acctgttaaggtggaaaatggac

SEQ ID NO: 324415 - DNA, 18 bp, Homo sapiens
acctgttcaaaatgttaa

SEQ ID NO: 324416 - DNA, 20 bp, Homo sapiens
acctgttcaaaatgttaata

SEQ ID NO: 324417 - DNA, 15 bp, Homo sapiens
acctgttgcacctca

SEQ ID NO: 324418 - DNA, 18 bp, Homo sapiens
acctgtttcttgtaactg

SEQ ID NO: 324419 - DNA, 19 bp, Homo sapiens
acctgtttttaagctgttt

SEQ ID NO: 324420 - DNA, 12 bp, Homo sapiens
accttaaaacta

SEQ ID NO: 324421 - DNA, 17 bp, Homo sapiens
accttaaagcaataagt

SEQ ID NO: 324422 - DNA, 21 bp, Homo sapiens
acgcaggagagagagagagaa

SEQ ID NO: 324423 - DNA, 15 bp, Homo sapiens
acgcagggagaccct

SEQ ID NO: 324424 - DNA, 16 bp, Homo sapiens
acgcagggagaccctg

SEQ ID NO: 324425 - DNA, 14 bp, Homo sapiens
acgccacagcccag

SEQ ID NO: 324426 - DNA, 15 bp, Homo sapiens
acgccacagcccagc

SEQ ID NO: 324427 - DNA, 20 bp, Homo sapiens
acgccacagcccagccacgg

SEQ ID NO: 324428 - DNA, 22 bp, Homo sapiens
acgccattctcctgcctcagcc

SEQ ID NO: 324429 - DNA, 23 bp, Homo sapiens
acgcccctcccaagcgttcctgg

SEQ ID NO: 324430 - DNA, 22 bp, Homo sapiens
acgccctccctctcccaggccc

SEQ ID NO: 324431 - DNA, 19 bp, Homo sapiens
acgccctgcgttggagcca

SEQ ID NO: 324432 - DNA, 21 bp, Homo sapiens
acgcctcttttccctctctag

SEQ ID NO: 324433 - DNA, 15 bp, Homo sapiens
acgcctgcccccgtc

SEQ ID NO: 324434 - DNA, 19 bp, Homo sapiens
acgcctgccctccccagag

SEQ ID NO: 324435 - DNA, 16 bp, Homo sapiens
acgcctgccttctggg

SEQ ID NO: 324436 - DNA, 15 bp, Homo sapiens
acgcctggctccagg

SEQ ID NO: 324437 - DNA, 18 bp, Homo sapiens
acgcctggctccaggctc

SEQ ID NO: 324438 - DNA, 20 bp, Homo sapiens
acgcctggctccaggctcca

SEQ ID NO: 324439 - DNA, 18 bp, Homo sapiens
acgcctgtaatcccagca

SEQ ID NO: 324440 - DNA, 21 bp, Homo sapiens
acgcctgtaatcccagcactt

SEQ ID NO: 324441 - DNA, 16 bp, Homo sapiens
acgcgcgcacacacac

SEQ ID NO: 324442 - DNA, 24 bp, Homo sapiens
acgcggctcccggggcagggcagc

SEQ ID NO: 324443 - DNA, 15 bp, Homo sapiens
acgcgtgattgaccc

SEQ ID NO: 324444 - DNA, 23 bp, Homo sapiens
acgcgtgtgtgcctgaacattct

SEQ ID NO: 324445 - DNA, 21 bp, Homo sapiens
acgctcccccgcagtccccag

SEQ ID NO: 324446 - DNA, 19 bp, Homo sapiens
acgctcccctgagaggttt

SEQ ID NO: 324447 - DNA, 20 bp, Homo sapiens
acgctcccctgagaggtttc

SEQ ID NO: 324448 - DNA, 16 bp, Homo sapiens
acgctccctccccctg

SEQ ID NO: 324449 - DNA, 17 bp, Homo sapiens
acgctccctccccctgc

SEQ ID NO: 324450 - DNA, 11 bp, Homo sapiens
acgctcctctg

SEQ ID NO: 324451 - DNA, 12 bp, Homo sapiens
acgctcctctgc

SEQ ID NO: 324452 - DNA, 12 bp, Homo sapiens
acgctctggaca

SEQ ID NO: 324453 - DNA, 13 bp, Homo sapiens
acgctctggacat

SEQ ID NO: 324454 - DNA, 13 bp, Homo sapiens
acgctggcttcca

SEQ ID NO: 324455 - DNA, 17 bp, Homo sapiens
acgctgtctccagaccc

SEQ ID NO: 324456 - DNA, 19 bp, Homo sapiens
acgctgtctccagaccccc

SEQ ID NO: 324457 - DNA, 21 bp, Homo sapiens
acgctgtctccagacccccac

SEQ ID NO: 324458 - DNA, 22 bp, Homo sapiens
acgctgtctccagacccccacc

SEQ ID NO: 324459 - DNA, 14 bp, Homo sapiens
acgctgtgggcagg

SEQ ID NO: 324460 - DNA, 18 bp, Homo sapiens
acgcttgacaggacagca

SEQ ID NO: 324461 - DNA, 12 bp, Homo sapiens
acgctttcatga

SEQ ID NO: 324462 - DNA, 17 bp, Homo sapiens
acgctttctagctgttg

SEQ ID NO: 324463 - DNA, 15 bp, Homo sapiens
acggaaaatgccaat

SEQ ID NO: 324464 - DNA, 18 bp, Homo sapiens
acggaaaatgccaatctc

SEQ ID NO: 324465 - DNA, 19 bp, Homo sapiens
acggaaaatgccaatctct

SEQ ID NO: 324466 - DNA, 14 bp, Homo sapiens
acggaagtggcctg

SEQ ID NO: 324467 - DNA, 22 bp, Homo sapiens
acggaagtggcctgagaagagt

SEQ ID NO: 324468 - DNA, 19 bp, Homo sapiens
acggaccgcatcctccagg

SEQ ID NO: 324469 - DNA, 17 bp, Homo sapiens
acggactcccgggccac

SEQ ID NO: 324470 - DNA, 24 bp, Homo sapiens
acggactcccgggccacgccccag

SEQ ID NO: 324471 - DNA, 14 bp, Homo sapiens
acggactctttgct

SEQ ID NO: 324472 - DNA, 13 bp, Homo sapiens
acggagagaaaaa

SEQ ID NO: 324473 - DNA, 16 bp, Homo sapiens
acggatggaaggagag

SEQ ID NO: 324474 - DNA, 14 bp, Homo sapiens
acggcactgtggcc

SEQ ID NO: 324475 - DNA, 12 bp, Homo sapiens
acggcagcccca

SEQ ID NO: 324476 - DNA, 14 bp, Homo sapiens
acggcagccccatc

SEQ ID NO: 324477 - DNA, 15 bp, Homo sapiens
acggcagccccatcc

SEQ ID NO: 324478 - DNA, 11 bp, Homo sapiens
acggcagctgt

SEQ ID NO: 324479 - DNA, 23 bp, Homo sapiens
acggcatgtgaattctgtgaaga

SEQ ID NO: 324480 - DNA, 10 bp, Homo sapiens
acggccaccc

SEQ ID NO: 324481 - DNA, 16 bp, Homo sapiens
acggccacccaccctt

SEQ ID NO: 324482 - DNA, 15 bp, Homo sapiens
acggccaccctcctt

SEQ ID NO: 324483 - DNA, 18 bp, Homo sapiens
acggccaccctccttccc

SEQ ID NO: 324484 - DNA, 15 bp, Homo sapiens
acggcctgatgctcc

SEQ ID NO: 324485 - DNA, 17 bp, Homo sapiens
acggcgcccccagtgtg

SEQ ID NO: 324486 - DNA, 20 bp, Homo sapiens
acggctccgagggcggccag

SEQ ID NO: 324487 - DNA, 13 bp, Homo sapiens
acggctcctcccc

SEQ ID NO: 324488 - DNA, 16 bp, Homo sapiens
acggctcctccccgat

SEQ ID NO: 324489 - DNA, 18 bp, Homo sapiens
acggctcctccccgatcc

SEQ ID NO: 324490 - DNA, 18 bp, Homo sapiens
acggctctaggtggggcg

SEQ ID NO: 324491 - DNA, 22 bp, Homo sapiens
acggctctcgtccctctgctcc

SEQ ID NO: 324492 - DNA, 22 bp, Homo sapiens
acggctgggtgtttcagtttga

SEQ ID NO: 324493 - DNA, 22 bp, Homo sapiens
acggctgtgtatttctgtagaa

SEQ ID NO: 324494 - DNA, 22 bp, Homo sapiens
acggctgttcccctcacccaaa

SEQ ID NO: 324495 - DNA, 23 bp, Homo sapiens
acggctgttcccctcacccaaaa

SEQ ID NO: 324496 - DNA, 23 bp, Homo sapiens
acggcttagacttcgactcagga

SEQ ID NO: 324497 - DNA, 15 bp, Homo sapiens
acgggaagcaacctc

SEQ ID NO: 324498 - DNA, 21 bp, Homo sapiens
acgggacagcggcccggccca

SEQ ID NO: 324499 - DNA, 13 bp, Homo sapiens
acgggagagcgcc

SEQ ID NO: 324500 - DNA, 22 bp, Homo sapiens
acgggaggaatcttttactgtg

SEQ ID NO: 324501 - DNA, 15 bp, Homo sapiens
acgggcacagctgct

SEQ ID NO: 324502 - DNA, 17 bp, Homo sapiens
acgggcagcctggctcc

SEQ ID NO: 324503 - DNA, 22 bp, Homo sapiens
acgggcagcctggctcccagga

SEQ ID NO: 324504 - DNA, 22 bp, Homo sapiens
acgggcccgctcaacctctcag

SEQ ID NO: 324505 - DNA, 18 bp, Homo sapiens
acggggagtgagactcct

SEQ ID NO: 324506 - DNA, 12 bp, Homo sapiens
acggggcagagc

SEQ ID NO: 324507 - DNA, 15 bp, Homo sapiens
acggggcagagctga

SEQ ID NO: 324508 - DNA, 17 bp, Homo sapiens
acggggccagcatccat

SEQ ID NO: 324509 - DNA, 17 bp, Homo sapiens
acgggggctgcttctcc

SEQ ID NO: 324510 - DNA, 23 bp, Homo sapiens
acgggtctcacttataccaaagg

SEQ ID NO: 324511 - DNA, 22 bp, Homo sapiens
acgggtctgtgggactggccca

SEQ ID NO: 324512 - DNA, 21 bp, Homo sapiens
acggtacttggtaagagggag

SEQ ID NO: 324513 - DNA, 17 bp, Homo sapiens
acggtagtgatgaaatt

SEQ ID NO: 324514 - DNA, 14 bp, Homo sapiens
acggtcatgatgtc

SEQ ID NO: 324515 - DNA, 20 bp, Homo sapiens
acggtcctttaggcagcctg

SEQ ID NO: 324516 - DNA, 16 bp, Homo sapiens
acggtgaaggtgacag

SEQ ID NO: 324517 - DNA, 19 bp, Homo sapiens
acggtgaaggtgacagcag

SEQ ID NO: 324518 - DNA, 16 bp, Homo sapiens
acggtgagactctgag

SEQ ID NO: 324519 - DNA, 16 bp, Homo sapiens
acggtgatattgtgca

SEQ ID NO: 324520 - DNA, 18 bp, Homo sapiens
acggtggctcacgcctgt

SEQ ID NO: 324521 - DNA, 19 bp, Homo sapiens
acggtgggcatttgtgagg

SEQ ID NO: 324522 - DNA, 22 bp, Homo sapiens
acggttccctgcctaggagctg

SEQ ID NO: 324523 - DNA, 13 bp, Homo sapiens
acggttttaaatg

SEQ ID NO: 324524 - DNA, 23 bp, Homo sapiens
acgtaatttgttatatcagcaga

SEQ ID NO: 324525 - DNA, 22 bp, Homo sapiens
acgtagtgtagatttgttttgt

SEQ ID NO: 324526 - DNA, 14 bp, Homo sapiens
acgtataaatatga

SEQ ID NO: 324527 - DNA, 16 bp, Homo sapiens
acgtatgtatttcatt

SEQ ID NO: 324528 - DNA, 14 bp, Homo sapiens
acgtcactgccaga

SEQ ID NO: 324529 - DNA, 15 bp, Homo sapiens
acgtcactgccagag

SEQ ID NO: 324530 - DNA, 19 bp, Homo sapiens
acgtccacccgtttccaag

SEQ ID NO: 324531 - DNA, 15 bp, Homo sapiens
acgtccatctctctc

SEQ ID NO: 324532 - DNA, 14 bp, Homo sapiens
acgtcccctccgcc

SEQ ID NO: 324533 - DNA, 19 bp, Homo sapiens
acgtcccgctgctgtgctc

SEQ ID NO: 324534 - DNA, 13 bp, Homo sapiens
acgtcctccaccg

SEQ ID NO: 324535 - DNA, 18 bp, Homo sapiens
acgtcctccaccggtgcc

SEQ ID NO: 324536 - DNA, 21 bp, Homo sapiens
acgtcctcgaattctcagacg

SEQ ID NO: 324537 - DNA, 15 bp, Homo sapiens
acgtcctgccacctg

SEQ ID NO: 324538 - DNA, 14 bp, Homo sapiens
acgtctgccaggcc

SEQ ID NO: 324539 - DNA, 16 bp, Homo sapiens
acgtctgccaggccca

SEQ ID NO: 324540 - DNA, 17 bp, Homo sapiens
acgtctgccaggcccat

SEQ ID NO: 324541 - DNA, 16 bp, Homo sapiens
acgtctggccaggcac

SEQ ID NO: 324542 - DNA, 12 bp, Homo sapiens
acgtctgtgagt

SEQ ID NO: 324543 - DNA, 16 bp, Homo sapiens
acgtctgtgagtctgt

SEQ ID NO: 324544 - DNA, 21 bp, Homo sapiens
acgtcttggtgccttttgtgt

SEQ ID NO: 324545 - DNA, 19 bp, Homo sapiens
acgtgaaagatgcaagcac

SEQ ID NO: 324546 - DNA, 16 bp, Homo sapiens
acgtgacagtgcctgg

SEQ ID NO: 324547 - DNA, 19 bp, Homo sapiens
acgtgacagtgcctgggaa

SEQ ID NO: 324548 - DNA, 17 bp, Homo sapiens
acgtgagggggagctga

SEQ ID NO: 324549 - DNA, 18 bp, Homo sapiens
acgtgagggggagctgaa

SEQ ID NO: 324550 - DNA, 21 bp, Homo sapiens
acgtgatgtgctcatcagaaa

SEQ ID NO: 324551 - DNA, 17 bp, Homo sapiens
acgtgccccccagttcc

SEQ ID NO: 324552 - DNA, 20 bp, Homo sapiens
acgtgcgtgtctctgccatg

SEQ ID NO: 324553 - DNA, 21 bp, Homo sapiens
acgtgcgtgtctctgccatgt

SEQ ID NO: 324554 - DNA, 15 bp, Homo sapiens
acgtgctggagagta

SEQ ID NO: 324555 - DNA, 17 bp, Homo sapiens
acgtggactctgtgctc

SEQ ID NO: 324556 - DNA, 19 bp, Homo sapiens
acgtggagagctggtgccc

SEQ ID NO: 324557 - DNA, 12 bp, Homo sapiens
acgtggagaggg

SEQ ID NO: 324558 - DNA, 14 bp, Homo sapiens
acgtggagagggat

SEQ ID NO: 324559 - DNA, 21 bp, Homo sapiens
acgtgggagttcagctgcttc

SEQ ID NO: 324560 - DNA, 23 bp, Homo sapiens
acgtgggagttcagctgcttctc

SEQ ID NO: 324561 - DNA, 22 bp, Homo sapiens
acgtgggtcttcagggggccag

SEQ ID NO: 324562 - DNA, 19 bp, Homo sapiens
acgtggtcagggcagggct

SEQ ID NO: 324563 - DNA, 22 bp, Homo sapiens
acgtggttcagagactggcagc

SEQ ID NO: 324564 - DNA, 17 bp, Homo sapiens
acgtgtattttcattac

SEQ ID NO: 324565 - DNA, 21 bp, Homo sapiens
acgtgtctggaatcccagctc

SEQ ID NO: 324566 - DNA, 23 bp, Homo sapiens
acgtgtctggaatcccagctccg

SEQ ID NO: 324567 - DNA, 11 bp, Homo sapiens
acgtgtgtgac

SEQ ID NO: 324568 - DNA, 23 bp, Homo sapiens
acgtgtgtgactcagatgtctct

SEQ ID NO: 324569 - DNA, 18 bp, Homo sapiens
acgtgtttaattaaattt

SEQ ID NO: 324570 - DNA, 15 bp, Homo sapiens
acgtgtttttgtatc

SEQ ID NO: 324571 - DNA, 13 bp, Homo sapiens
acgttcacccctc

SEQ ID NO: 324572 - DNA, 14 bp, Homo sapiens
acgttcatgcattt

SEQ ID NO: 324573 - DNA, 11 bp, Homo sapiens
acgttgatctc

SEQ ID NO: 324574 - DNA, 17 bp, Homo sapiens
acgtttcagtaataaaa

SEQ ID NO: 324575 - DNA, 14 bp, Homo sapiens
acgttttaataatt

SEQ ID NO: 324576 - DNA, 13 bp, Homo sapiens
actaaaagacatt

SEQ ID NO: 324577 - DNA, 15 bp, Homo sapiens
actaaaagacatttg

SEQ ID NO: 324578 - DNA, 13 bp, Homo sapiens
actaaaagtgatg

SEQ ID NO: 324579 - DNA, 22 bp, Homo sapiens
actaaaattcaacaaatgatgt

SEQ ID NO: 324580 - DNA, 14 bp, Homo sapiens
actaaacattttgt

SEQ ID NO: 324581 - DNA, 12 bp, Homo sapiens
actaaagagaga

SEQ ID NO: 324582 - DNA, 21 bp, Homo sapiens
actaaagagagaatgtagata

SEQ ID NO: 324583 - DNA, 20 bp, Homo sapiens
actaaagcacttcttttcca

SEQ ID NO: 324584 - DNA, 14 bp, Homo sapiens
actaaagcagtgtt

SEQ ID NO: 324585 - DNA, 14 bp, Homo sapiens
actaaagtatgtaa

SEQ ID NO: 324586 - DNA, 20 bp, Homo sapiens
gcttttgtctaattaaaaca

SEQ ID NO: 324587 - DNA, 23 bp, Homo sapiens
gctttttaccgttcacttcccct

SEQ ID NO: 324588 - DNA, 14 bp, Homo sapiens
gctttttgaaaacc

SEQ ID NO: 324589 - DNA, 21 bp, Homo sapiens
gcttttttttttccagcaagt

SEQ ID NO: 324590 - DNA, 13 bp, Homo sapiens
ggaaaaaaaaatc

SEQ ID NO: 324591 - DNA, 23 bp, Homo sapiens
ggaaaaaaacttttataaattaa

SEQ ID NO: 324592 - DNA, 22 bp, Homo sapiens
ggaaaaacagaggatgctgaag

SEQ ID NO: 324593 - DNA, 23 bp, Homo sapiens
ggaaaaatggatccccagtgaaa

SEQ ID NO: 324594 - DNA, 21 bp, Homo sapiens
ggaaaaccaagccgtggcttc

SEQ ID NO: 324595 - DNA, 22 bp, Homo sapiens
ggaaaaccaagccgtggcttcc

SEQ ID NO: 324596 - DNA, 16 bp, Homo sapiens
ggaaaactcaccattt

SEQ ID NO: 324597 - DNA, 18 bp, Homo sapiens
ggaaaactcaccatttca

SEQ ID NO: 324598 - DNA, 20 bp, Homo sapiens
ggaaaactgaatccatcttt

SEQ ID NO: 324599 - DNA, 15 bp, Homo sapiens
ggaaaactgcctgtt

SEQ ID NO: 324600 - DNA, 19 bp, Homo sapiens
ggaaaactgcctgttcctt

SEQ ID NO: 324601 - DNA, 12 bp, Homo sapiens
ggaaaagccagt

SEQ ID NO: 324602 - DNA, 17 bp, Homo sapiens
ggaaaatgccaatctct

SEQ ID NO: 324603 - DNA, 16 bp, Homo sapiens
ggaaaatgtcctgtgg

SEQ ID NO: 324604 - DNA, 20 bp, Homo sapiens
ggaaacagaaaagagaagaa

SEQ ID NO: 324605 - DNA, 14 bp, Homo sapiens
ggaaacagtcattt

SEQ ID NO: 324606 - DNA, 10 bp, Homo sapiens
ggaaaccaga

SEQ ID NO: 324607 - DNA, 17 bp, Homo sapiens
ggaaacctgccctgcct

SEQ ID NO: 324608 - DNA, 17 bp, Homo sapiens
ggaaacctgttatgcca

SEQ ID NO: 324609 - DNA, 22 bp, Homo sapiens
ggaaactcacctgctggcccct

SEQ ID NO: 324610 - DNA, 18 bp, Homo sapiens
ggaaactgaggcccagag

SEQ ID NO: 324611 - DNA, 17 bp, Homo sapiens
ggaaactgttgccagag

SEQ ID NO: 324612 - DNA, 22 bp, Homo sapiens
ggaaagacctacattccctctc

SEQ ID NO: 324613 - DNA, 13 bp, Homo sapiens
ggaaagaggagaa

SEQ ID NO: 324614 - DNA, 15 bp, Homo sapiens
ggaaagatcccaagt

SEQ ID NO: 324615 - DNA, 20 bp, Homo sapiens
ggaaagatcccaagtcaaac

SEQ ID NO: 324616 - DNA, 18 bp, Homo sapiens
ggaaagccacctctccct

SEQ ID NO: 324617 - DNA, 18 bp, Homo sapiens
ggaaagccagtgactcca

SEQ ID NO: 324618 - DNA, 14 bp, Homo sapiens
tacatatacacaaa

SEQ ID NO: 324619 - DNA, 14 bp, Homo sapiens
tacatatatatatt

SEQ ID NO: 324620 - DNA, 13 bp, Homo sapiens
tacatatgcttta

SEQ ID NO: 324621 - DNA, 21 bp, Homo sapiens
tacatatgctttaagaatcga

SEQ ID NO: 324622 - DNA, 23 bp, Homo sapiens
tacatattactgttgcatttact

SEQ ID NO: 324623 - DNA, 18 bp, Homo sapiens
tacatattaggaaaatat

SEQ ID NO: 324624 - DNA, 23 bp, Homo sapiens
tacatcacctttttgacttttcc

SEQ ID NO: 324625 - DNA, 18 bp, Homo sapiens
tacatcagttattcattc

SEQ ID NO: 324626 - DNA, 14 bp, Homo sapiens
tacatcatgttatt

SEQ ID NO: 324627 - DNA, 14 bp, Homo sapiens
tacatcatttcttt

SEQ ID NO: 324628 - DNA, 13 bp, Homo sapiens
tacatcccagcct

SEQ ID NO: 324629 - DNA, 14 bp, Homo sapiens
tacatcgccctcca

SEQ ID NO: 324630 - DNA, 18 bp, Homo sapiens
tacatctagcacagctgt

SEQ ID NO: 324631 - DNA, 19 bp, Homo sapiens
tacatctagcacagctgtg

SEQ ID NO: 324632 - DNA, 19 bp, Homo sapiens
tacatctgcaatatgaatt

SEQ ID NO: 324633 - DNA, 22 bp, Homo sapiens
tacatctgcagctctttcttct

SEQ ID NO: 324634 - DNA, 15 bp, Homo sapiens
tacatctttatcatt

SEQ ID NO: 324635 - DNA, 13 bp, Homo sapiens
tacatctttatta

SEQ ID NO: 324636 - DNA, 13 bp, Homo sapiens
tacatgactgggc

SEQ ID NO: 324637 - DNA, 17 bp, Homo sapiens
tacatgactgggcctcc

SEQ ID NO: 324638 - DNA, 13 bp, Homo sapiens
tacatgagttcaa

SEQ ID NO: 324639 - DNA, 15 bp, Homo sapiens
tacatgatgatttca

SEQ ID NO: 324640 - DNA, 22 bp, Homo sapiens
tacatgcagcccatgcccacct

SEQ ID NO: 324641 - DNA, 17 bp, Homo sapiens
tacatgctgtgctcttt

SEQ ID NO: 324642 - DNA, 21 bp, Homo sapiens
tacatggaagaagtatatttt

SEQ ID NO: 324643 - DNA, 19 bp, Homo sapiens
tacatgtctcatattttca

SEQ ID NO: 324644 - DNA, 19 bp, Homo sapiens
tacatgtgccgaatgtgca

SEQ ID NO: 324645 - DNA, 13 bp, Homo sapiens
tacatgtgggagc

SEQ ID NO: 324646 - DNA, 18 bp, Homo sapiens
tacatgtgtggatgtgta

SEQ ID NO: 324647 - DNA, 15 bp, Homo sapiens
tacattaatgttaat

SEQ ID NO: 324648 - DNA, 20 bp, Homo sapiens
tacattaatgttaattcagc

SEQ ID NO: 324649 - DNA, 23 bp, Homo sapiens
tacattaatgttaattcagcact

SEQ ID NO: 324650 - DNA, 18 bp, Homo sapiens
tacattacaaatttctgt

SEQ ID NO: 324651 - DNA, 19 bp, Homo sapiens
tacattagcagtttgcttt

SEQ ID NO: 324652 - DNA, 20 bp, Homo sapiens
tacattagcagtttgctttg

SEQ ID NO: 324653 - DNA, 21 bp, Homo sapiens
tacattccctctcctgcccag

SEQ ID NO: 324654 - DNA, 22 bp, Homo sapiens
tacattccctctcctgcccaga

SEQ ID NO: 324655 - DNA, 14 bp, Homo sapiens
tacattcctcagct

SEQ ID NO: 324656 - DNA, 20 bp, Homo sapiens
tacattcctgagattctggg

SEQ ID NO: 324657 - DNA, 22 bp, Homo sapiens
tacattcctgagattctgggaa

SEQ ID NO: 324658 - DNA, 15 bp, Homo sapiens
tacattggcttttta

SEQ ID NO: 324659 - DNA, 13 bp, Homo sapiens
tacattgtaatct

SEQ ID NO: 324660 - DNA, 22 bp, Homo sapiens
tacattgtataggccatctgta

SEQ ID NO: 324661 - DNA, 15 bp, Homo sapiens
tacatttaaaactta

SEQ ID NO: 324662 - DNA, 15 bp, Homo sapiens
tacatttaatacagc

SEQ ID NO: 324663 - DNA, 19 bp, Homo sapiens
tacatttataatgtttgct

SEQ ID NO: 324664 - DNA, 13 bp, Homo sapiens
tacatttatacat

SEQ ID NO: 324665 - DNA, 23 bp, Homo sapiens
tacatttatcttctgtttttctc

SEQ ID NO: 324666 - DNA, 16 bp, Homo sapiens
tacatttgtgagattc

SEQ ID NO: 324667 - DNA, 14 bp, Homo sapiens
tacattttatttat

SEQ ID NO: 324668 - DNA, 18 bp, Homo sapiens
tacattttatttattagc

SEQ ID NO: 324669 - DNA, 22 bp, Homo sapiens
tacattttatttattagctgta

SEQ ID NO: 324670 - DNA, 20 bp, Homo sapiens
tacattttcagtaccaaaga

SEQ ID NO: 324671 - DNA, 14 bp, Homo sapiens
tacatttttacaat

SEQ ID NO: 324672 - DNA, 17 bp, Homo sapiens
tacatttttttaaacaa

SEQ ID NO: 324673 - DNA, 22 bp, Homo sapiens
taccaaagaaacaccacttaat

SEQ ID NO: 324674 - DNA, 15 bp, Homo sapiens
taccaaagttttatc

SEQ ID NO: 324675 - DNA, 14 bp, Homo sapiens
taccaaatgccttt

SEQ ID NO: 324676 - DNA, 13 bp, Homo sapiens
taccaactttctg

SEQ ID NO: 324677 - DNA, 19 bp, Homo sapiens
taccaactttctgtaaact

SEQ ID NO: 324678 - DNA, 14 bp, Homo sapiens
taccaagacataat

SEQ ID NO: 324679 - DNA, 17 bp, Homo sapiens
taccaagacataatgca

SEQ ID NO: 324680 - DNA, 18 bp, Homo sapiens
taccaagacataatgcac

SEQ ID NO: 324681 - DNA, 20 bp, Homo sapiens
taccaagagtatgagaaata

SEQ ID NO: 324682 - DNA, 20 bp, Homo sapiens
taccaatcaacagcatgtct

SEQ ID NO: 324683 - DNA, 13 bp, Homo sapiens
taccaatgcatgc

SEQ ID NO: 324684 - DNA, 14 bp, Homo sapiens
taccaatgcatgca

SEQ ID NO: 324685 - DNA, 17 bp, Homo sapiens
taccaatgctgttgtaa

SEQ ID NO: 324686 - DNA, 13 bp, Homo sapiens
taccacaaggaaa

SEQ ID NO: 324687 - DNA, 14 bp, Homo sapiens
taccacagtgtctg

SEQ ID NO: 324688 - DNA, 16 bp, Homo sapiens
taccaccgaatcccta

SEQ ID NO: 324689 - DNA, 17 bp, Homo sapiens
taccacctgtacataca

SEQ ID NO: 324690 - DNA, 18 bp, Homo sapiens
taccactgagcccttgca

SEQ ID NO: 324691 - DNA, 20 bp, Homo sapiens
taccactgagcccttgcaca

SEQ ID NO: 324692 - DNA, 16 bp, Homo sapiens
taccactgcactccag

SEQ ID NO: 324693 - DNA, 11 bp, Homo sapiens
taccactgcta

SEQ ID NO: 324694 - DNA, 12 bp, Homo sapiens
taccactgctaa

SEQ ID NO: 324695 - DNA, 15 bp, Homo sapiens
taccagactgcaggt

SEQ ID NO: 324696 - DNA, 14 bp, Homo sapiens
taccagagacctga

SEQ ID NO: 324697 - DNA, 14 bp, Homo sapiens
taccagagactctg

SEQ ID NO: 324698 - DNA, 14 bp, Homo sapiens
taccagccacgggc

SEQ ID NO: 324699 - DNA, 12 bp, Homo sapiens
taccagcccccc

SEQ ID NO: 324700 - DNA, 20 bp, Homo sapiens
taccagccccccaccccaca

SEQ ID NO: 324701 - DNA, 23 bp, Homo sapiens
taccagccccccaccccacagat

SEQ ID NO: 324702 - DNA, 11 bp, Homo sapiens
taccaggccac

SEQ ID NO: 324703 - DNA, 22 bp, Homo sapiens
taccaggccgccccagcctctg

SEQ ID NO: 324704 - DNA, 22 bp, Homo sapiens
taccaggtgctagggtgcctgc

SEQ ID NO: 324705 - DNA, 15 bp, Homo sapiens
taccaggttgaaaga

SEQ ID NO: 324706 - DNA, 12 bp, Homo sapiens
taccagtacttg

SEQ ID NO: 324707 - DNA, 20 bp, Homo sapiens
taccagtcgccctctgtgcc

SEQ ID NO: 324708 - DNA, 21 bp, Homo sapiens
taccagtgttagtgggaagag

SEQ ID NO: 324709 - DNA, 15 bp, Homo sapiens
taccataatgtattt

SEQ ID NO: 324710 - DNA, 15 bp, Homo sapiens
taccatcaataaagt

SEQ ID NO: 324711 - DNA, 15 bp, Homo sapiens
taccatcttaatctt

SEQ ID NO: 324712 - DNA, 22 bp, Homo sapiens
taccatgagaagagggcctgtg

SEQ ID NO: 324713 - DNA, 14 bp, Homo sapiens
taccatgtcactgt

SEQ ID NO: 324714 - DNA, 15 bp, Homo sapiens
taccatgtcactgtg

SEQ ID NO: 324715 - DNA, 21 bp, Homo sapiens
taccattatggctttgtgctt

SEQ ID NO: 324716 - DNA, 13 bp, Homo sapiens
taccatttgtaat

SEQ ID NO: 324717 - DNA, 18 bp, Homo sapiens
taccatttgtaataaagt

SEQ ID NO: 324718 - DNA, 16 bp, Homo sapiens
taccattttctggttc

SEQ ID NO: 324719 - DNA, 16 bp, Homo sapiens
taccattttgaaatat

SEQ ID NO: 324720 - DNA, 21 bp, Homo sapiens
tacccaaccactcaaattaat

SEQ ID NO: 324721 - DNA, 15 bp, Homo sapiens
tacccacagggcctg

SEQ ID NO: 324722 - DNA, 21 bp, Homo sapiens
tacccaccctaatttgccctt

SEQ ID NO: 324723 - DNA, 14 bp, Homo sapiens
tacccacctcagcc

SEQ ID NO: 324724 - DNA, 15 bp, Homo sapiens
tacccacctcagcct

SEQ ID NO: 324725 - DNA, 11 bp, Homo sapiens
tacccacctga

SEQ ID NO: 324726 - DNA, 14 bp, Homo sapiens
tacccacctgagct

SEQ ID NO: 324727 - DNA, 17 bp, Homo sapiens
tacccactatgcacaga

SEQ ID NO: 324728 - DNA, 20 bp, Homo sapiens
tacccagagaatatatacat

SEQ ID NO: 324729 - DNA, 23 bp, Homo sapiens
tacccagccaccttcctgactgg

SEQ ID NO: 324730 - DNA, 15 bp, Homo sapiens
tacccagcccatctt

SEQ ID NO: 324731 - DNA, 20 bp, Homo sapiens
tacccatcggtgtccattta

SEQ ID NO: 324732 - DNA, 21 bp, Homo sapiens
tacccatcggtgtccatttat

SEQ ID NO: 324733 - DNA, 19 bp, Homo sapiens
tacccatgttgggaaaaac

SEQ ID NO: 324734 - DNA, 21 bp, Homo sapiens
tacccatgttgggaaaaactg

SEQ ID NO: 324735 - DNA, 14 bp, Homo sapiens
gctgggctgagccc

SEQ ID NO: 324736 - DNA, 15 bp, Homo sapiens
gctgggctgttggct

SEQ ID NO: 324737 - DNA, 22 bp, Homo sapiens
gctggggacagctttcctgggt

SEQ ID NO: 324738 - DNA, 23 bp, Homo sapiens
gctggggacagctttcctgggtg

SEQ ID NO: 324739 - DNA, 13 bp, Homo sapiens
gctggggagggag

SEQ ID NO: 324740 - DNA, 13 bp, Homo sapiens
gctggggcagagg

SEQ ID NO: 324741 - DNA, 23 bp, Homo sapiens
gctggggctcacggggcctccaa

SEQ ID NO: 324742 - DNA, 18 bp, Homo sapiens
gctggggcttttgtgcca

SEQ ID NO: 324743 - DNA, 20 bp, Homo sapiens
gctgggggcctcactccagg

SEQ ID NO: 324744 - DNA, 18 bp, Homo sapiens
gctggggggcagggggga

SEQ ID NO: 324745 - DNA, 23 bp, Homo sapiens
gctgggggtgaggggccaggcca

SEQ ID NO: 324746 - DNA, 19 bp, Homo sapiens
gctggggtacacagtgaga

SEQ ID NO: 324747 - DNA, 16 bp, Homo sapiens
gctggggtgagagagg

SEQ ID NO: 324748 - DNA, 16 bp, Homo sapiens
gctgggtaccaggcca

SEQ ID NO: 324749 - DNA, 22 bp, Homo sapiens
gctgggtccagggtaggcaagg

SEQ ID NO: 324750 - DNA, 17 bp, Homo sapiens
gctgggtcgcccctcct

SEQ ID NO: 324751 - DNA, 19 bp, Homo sapiens
gctgggtcgcccctcctcg

SEQ ID NO: 324752 - DNA, 13 bp, Homo sapiens
gctgggtgcccac

SEQ ID NO: 324753 - DNA, 17 bp, Homo sapiens
gctgggtgcccacagcc

SEQ ID NO: 324754 - DNA, 22 bp, Homo sapiens
gctgggtgtattaggactggct

SEQ ID NO: 324755 - DNA, 22 bp, Homo sapiens
gctgggtgtgtttcaggacagc

SEQ ID NO: 324756 - DNA, 18 bp, Homo sapiens
gctgggtttccacacagc

SEQ ID NO: 324757 - DNA, 18 bp, Homo sapiens
gctgggttttcaggggct

SEQ ID NO: 324758 - DNA, 14 bp, Homo sapiens
gctggtagagatgg

SEQ ID NO: 324759 - DNA, 15 bp, Homo sapiens
gctggtagagatgga

SEQ ID NO: 324760 - DNA, 23 bp, Homo sapiens
gctggtagagatggaggaggagg

SEQ ID NO: 324761 - DNA, 12 bp, Homo sapiens
gctggtcacccc

SEQ ID NO: 324762 - DNA, 20 bp, Homo sapiens
gctggtctcaaactcctgac

SEQ ID NO: 324763 - DNA, 16 bp, Homo sapiens
gctggtctgtttccag

SEQ ID NO: 324764 - DNA, 13 bp, Homo sapiens
gctggtgccagcc

SEQ ID NO: 324765 - DNA, 14 bp, Homo sapiens
gctggtgccagcct

SEQ ID NO: 324766 - DNA, 14 bp, Homo sapiens
gctggtgcccggag

SEQ ID NO: 324767 - DNA, 15 bp, Homo sapiens
gctggtgggcaccaa

SEQ ID NO: 324768 - DNA, 23 bp, Homo sapiens
gctggtgggggcatccttgagga

SEQ ID NO: 324769 - DNA, 13 bp, Homo sapiens
gctggttcactct

SEQ ID NO: 324770 - DNA, 15 bp, Homo sapiens
gctggttgctgggcc

SEQ ID NO: 324771 - DNA, 17 bp, Homo sapiens
gctggttgttgccaggt

SEQ ID NO: 324772 - DNA, 20 bp, Homo sapiens
gctggttgttgccaggttgc

SEQ ID NO: 324773 - DNA, 23 bp, Homo sapiens
gctggtttctgagagagtgccat

SEQ ID NO: 324774 - DNA, 14 bp, Homo sapiens
gctggttttcctaa

SEQ ID NO: 324775 - DNA, 18 bp, Homo sapiens
gctgtaactcagacattc

SEQ ID NO: 324776 - DNA, 19 bp, Homo sapiens
gctgtaactgctgagccac

SEQ ID NO: 324777 - DNA, 21 bp, Homo sapiens
gctgtaactgctgagccactc

SEQ ID NO: 324778 - DNA, 16 bp, Homo sapiens
gctgtaagaagagact

SEQ ID NO: 324779 - DNA, 19 bp, Homo sapiens
gctgtaagacggccttgga

SEQ ID NO: 324780 - DNA, 15 bp, Homo sapiens
gctgtacacaccctc

SEQ ID NO: 324781 - DNA, 19 bp, Homo sapiens
gctgtacacaccctccagc

SEQ ID NO: 324782 - DNA, 21 bp, Homo sapiens
gctgtacacaccctccagcac

SEQ ID NO: 324783 - DNA, 17 bp, Homo sapiens
gctgtacccttccacct

SEQ ID NO: 324784 - DNA, 20 bp, Homo sapiens
gctgtacccttccacctcct

SEQ ID NO: 324785 - DNA, 15 bp, Homo sapiens
gctgtacccttgaga

SEQ ID NO: 324786 - DNA, 16 bp, Homo sapiens
gctgtacgtctggtgt

SEQ ID NO: 324787 - DNA, 13 bp, Homo sapiens
gctgtactcagag

SEQ ID NO: 324788 - DNA, 14 bp, Homo sapiens
gctgtactcagagc

SEQ ID NO: 324789 - DNA, 19 bp, Homo sapiens
gctgtactcagagcagagc

SEQ ID NO: 324790 - DNA, 20 bp, Homo sapiens
gctgtacttcgtcttctaat

SEQ ID NO: 324791 - DNA, 21 bp, Homo sapiens
gctgtagccatggctcaggca

SEQ ID NO: 324792 - DNA, 22 bp, Homo sapiens
gctgtagccatggctcaggcaa

SEQ ID NO: 324793 - DNA, 15 bp, Homo sapiens
gctgtagctcccgag

SEQ ID NO: 324794 - DNA, 14 bp, Homo sapiens
gctgtatgatttag

SEQ ID NO: 324795 - DNA, 21 bp, Homo sapiens
gctgtattttcttttatatct

SEQ ID NO: 324796 - DNA, 23 bp, Homo sapiens
gctgtcaattacaggaagtactg

SEQ ID NO: 324797 - DNA, 13 bp, Homo sapiens
gctgtcacccagc

SEQ ID NO: 324798 - DNA, 19 bp, Homo sapiens
gctgtcagaccttcttcca

SEQ ID NO: 324799 - DNA, 22 bp, Homo sapiens
gctgtcagaccttcttccacag

SEQ ID NO: 324800 - DNA, 18 bp, Homo sapiens
gctgtcagccctgctgtc

SEQ ID NO: 324801 - DNA, 22 bp, Homo sapiens
gctgtcccaggggtctccctga

SEQ ID NO: 324802 - DNA, 17 bp, Homo sapiens
gctgtcccctccatctg

SEQ ID NO: 324803 - DNA, 18 bp, Homo sapiens
gctgtcccctccatctgg

SEQ ID NO: 324804 - DNA, 20 bp, Homo sapiens
gctgtcccctccatctgggg

SEQ ID NO: 324805 - DNA, 14 bp, Homo sapiens
gctgtcccctctcc

SEQ ID NO: 324806 - DNA, 15 bp, Homo sapiens
gctgtcccctctgtc

SEQ ID NO: 324807 - DNA, 14 bp, Homo sapiens
gctgtccccttcca

SEQ ID NO: 324808 - DNA, 17 bp, Homo sapiens
gctgtccccttccaggg

SEQ ID NO: 324809 - DNA, 22 bp, Homo sapiens
gctgtcccttacgtgagtcctg

SEQ ID NO: 324810 - DNA, 16 bp, Homo sapiens
gctgtcctccagaggg

SEQ ID NO: 324811 - DNA, 20 bp, Homo sapiens
gctgtcctgagccccctgca

SEQ ID NO: 324812 - DNA, 15 bp, Homo sapiens
gctgtctgcctgtat

SEQ ID NO: 324813 - DNA, 12 bp, Homo sapiens
gctgtctggggc

SEQ ID NO: 324814 - DNA, 14 bp, Homo sapiens
gctgtgaaatgact

SEQ ID NO: 324815 - DNA, 20 bp, Homo sapiens
gctgtgaacaagtgaacaca

SEQ ID NO: 324816 - DNA, 12 bp, Homo sapiens
gctgtgaggctg

SEQ ID NO: 324817 - DNA, 16 bp, Homo sapiens
gctgtgaggctgtcct

SEQ ID NO: 324818 - DNA, 17 bp, Homo sapiens
gctgtgaggctgtcctg

SEQ ID NO: 324819 - DNA, 20 bp, Homo sapiens
gctgtgccaccacccctccc

SEQ ID NO: 324820 - DNA, 23 bp, Homo sapiens
gctgtgccaccacccctccctct

SEQ ID NO: 324821 - DNA, 14 bp, Homo sapiens
gctgtgccaggagg

SEQ ID NO: 324822 - DNA, 14 bp, Homo sapiens
gctgtgcctctgcc

SEQ ID NO: 324823 - DNA, 12 bp, Homo sapiens
gctgtgcctgct

SEQ ID NO: 324824 - DNA, 21 bp, Homo sapiens
gctgtgcgctgacaaccaccg

SEQ ID NO: 324825 - DNA, 20 bp, Homo sapiens
gctgtggagaacaaagacca

SEQ ID NO: 324826 - DNA, 19 bp, Homo sapiens
gctgtggattttgtggctt

SEQ ID NO: 324827 - DNA, 14 bp, Homo sapiens
gctgtggcaggcca

SEQ ID NO: 324828 - DNA, 18 bp, Homo sapiens
gctgtggcccctccttct

SEQ ID NO: 324829 - DNA, 21 bp, Homo sapiens
gctgtggcccctccttctccc

SEQ ID NO: 324830 - DNA, 12 bp, Homo sapiens
gctgtggctggg

SEQ ID NO: 324831 - DNA, 19 bp, Homo sapiens
gctgtgggcctcaaggact

SEQ ID NO: 324832 - DNA, 18 bp, Homo sapiens
gctgtgggtacagagagg

SEQ ID NO: 324833 - DNA, 23 bp, Homo sapiens
gctgtgggtcagtgtgccaccct

SEQ ID NO: 324834 - DNA, 13 bp, Homo sapiens
gctgtgggtgggg

SEQ ID NO: 324835 - DNA, 14 bp, Homo sapiens
gctgtgggtgggga

SEQ ID NO: 324836 - DNA, 13 bp, Homo sapiens
gctgtggtctctt

SEQ ID NO: 324837 - DNA, 13 bp, Homo sapiens
gctgtggttcctg

SEQ ID NO: 324838 - DNA, 14 bp, Homo sapiens
gctgtggttttctt

SEQ ID NO: 324839 - DNA, 22 bp, Homo sapiens
gctgtggttttcttttgccatg

SEQ ID NO: 324840 - DNA, 13 bp, Homo sapiens
gctgtgtctctgt

SEQ ID NO: 324841 - DNA, 15 bp, Homo sapiens
gctgtgtctctgtat

SEQ ID NO: 324842 - DNA, 21 bp, Homo sapiens
gctgtgtgtggggcccaagca

SEQ ID NO: 324843 - DNA, 19 bp, Homo sapiens
gctgttcagattggacata

SEQ ID NO: 324844 - DNA, 18 bp, Homo sapiens
gctgttcctgctccatga

SEQ ID NO: 324845 - DNA, 21 bp, Homo sapiens
gctgttctttaaatgcgttcc

SEQ ID NO: 324846 - DNA, 23 bp, Homo sapiens
gctgttgacgttgatctcctggt

SEQ ID NO: 324847 - DNA, 15 bp, Homo sapiens
gctgttgattctttc

SEQ ID NO: 324848 - DNA, 23 bp, Homo sapiens
gctgttggcccctctgctgtcct

SEQ ID NO: 324849 - DNA, 18 bp, Homo sapiens
gctgttgtcattgcttta

SEQ ID NO: 324850 - DNA, 22 bp, Homo sapiens
gctgttgtcattgctttactgg

SEQ ID NO: 324851 - DNA, 20 bp, Homo sapiens
gctgttgtctgccgtgagag

SEQ ID NO: 324852 - DNA, 13 bp, Homo sapiens
gctgttgttcaga

SEQ ID NO: 324853 - DNA, 14 bp, Homo sapiens
gctgtttatggcct

SEQ ID NO: 324854 - DNA, 15 bp, Homo sapiens
gctgtttatggcctc

SEQ ID NO: 324855 - DNA, 22 bp, Homo sapiens
gctgtttatggcctcagctgcc

SEQ ID NO: 324856 - DNA, 13 bp, Homo sapiens
gctgtttccatag

SEQ ID NO: 324857 - DNA, 19 bp, Homo sapiens
gctgttttatgtcatactc

SEQ ID NO: 324858 - DNA, 13 bp, Homo sapiens
gcttaaaaaaaac

SEQ ID NO: 324859 - DNA, 13 bp, Homo sapiens
gcttaaaagacat

SEQ ID NO: 324860 - DNA, 22 bp, Homo sapiens
gcttaaaataaacagttgtgaa

SEQ ID NO: 324861 - DNA, 14 bp, Homo sapiens
gcttaaacaaagtg

SEQ ID NO: 324862 - DNA, 12 bp, Homo sapiens
gcttaaacattt

SEQ ID NO: 324863 - DNA, 22 bp, Homo sapiens
gcttaaattgcttttgttgtga

SEQ ID NO: 324864 - DNA, 19 bp, Homo sapiens
gcttaagagagagagcctt

SEQ ID NO: 324865 - DNA, 16 bp, Homo sapiens
gcttaagcagaagcat

SEQ ID NO: 324866 - DNA, 12 bp, Homo sapiens
gcttaaggagag

SEQ ID NO: 324867 - DNA, 15 bp, Homo sapiens
gcttaaggagaggag

SEQ ID NO: 324868 - DNA, 15 bp, Homo sapiens
gcttaatagccctcc

SEQ ID NO: 324869 - DNA, 19 bp, Homo sapiens
gccgtctgactccagagtc

SEQ ID NO: 324870 - DNA, 23 bp, Homo sapiens
gccgtctggcgagcccttagcct

SEQ ID NO: 324871 - DNA, 15 bp, Homo sapiens
gccgtgagcaggctt

SEQ ID NO: 324872 - DNA, 18 bp, Homo sapiens
gccgtgagcaggctttgg

SEQ ID NO: 324873 - DNA, 19 bp, Homo sapiens
gccgtgcacggggccagca

SEQ ID NO: 324874 - DNA, 21 bp, Homo sapiens
gccgtgcatggctcctgtctg

SEQ ID NO: 324875 - DNA, 22 bp, Homo sapiens
gccgtgcccgcccacctctgct

SEQ ID NO: 324876 - DNA, 17 bp, Homo sapiens
gccgtgccttcagctct

SEQ ID NO: 324877 - DNA, 21 bp, Homo sapiens
gccgtggattgcacgtggcct

SEQ ID NO: 324878 - DNA, 15 bp, Homo sapiens
gccgtggcttcccgc

SEQ ID NO: 324879 - DNA, 22 bp, Homo sapiens
gccgttagggaaatccaactcc

SEQ ID NO: 324880 - DNA, 12 bp, Homo sapiens
gccgttcctggg

SEQ ID NO: 324881 - DNA, 18 bp, Homo sapiens
gcctaaaattgtatgaaa

SEQ ID NO: 324882 - DNA, 20 bp, Homo sapiens
gcctaaaggatagatcaaag

SEQ ID NO: 324883 - DNA, 12 bp, Homo sapiens
gcctaaggctgc

SEQ ID NO: 324884 - DNA, 15 bp, Homo sapiens
gcctaattcctggca

SEQ ID NO: 324885 - DNA, 17 bp, Homo sapiens
gcctaattcctggcatg

SEQ ID NO: 324886 - DNA, 16 bp, Homo sapiens
gcctaccagtcgccct

SEQ ID NO: 324887 - DNA, 16 bp, Homo sapiens
gcctacctcagcctcc

SEQ ID NO: 324888 - DNA, 22 bp, Homo sapiens
gcctactctttgttttctttcc

SEQ ID NO: 324889 - DNA, 22 bp, Homo sapiens
gcctagcccaccctgctgcctt

SEQ ID NO: 324890 - DNA, 23 bp, Homo sapiens
gcctagcccaccctgctgccttc

SEQ ID NO: 324891 - DNA, 13 bp, Homo sapiens
gcctaggagctgg

SEQ ID NO: 324892 - DNA, 21 bp, Homo sapiens
gcctaggagctggctggcagg

SEQ ID NO: 324893 - DNA, 23 bp, Homo sapiens
gcctaggagctggctggcaggtg

SEQ ID NO: 324894 - DNA, 14 bp, Homo sapiens
gcctaggagctggg

SEQ ID NO: 324895 - DNA, 22 bp, Homo sapiens
gcctaggagctggggagggaga

SEQ ID NO: 324896 - DNA, 21 bp, Homo sapiens
gcctaggagttgagtacagtg

SEQ ID NO: 324897 - DNA, 19 bp, Homo sapiens
gcctaggccaaatgcacaa

SEQ ID NO: 324898 - DNA, 21 bp, Homo sapiens
gcctaggccaaatgcacaagc

SEQ ID NO: 324899 - DNA, 22 bp, Homo sapiens
gcctaggggtcagggaccaagg

SEQ ID NO: 324900 - DNA, 15 bp, Homo sapiens
gcctagtcagccaca

SEQ ID NO: 324901 - DNA, 18 bp, Homo sapiens
gcctagtcagccacatgg

SEQ ID NO: 324902 - DNA, 18 bp, Homo sapiens
gcctagtggcttcagccc

SEQ ID NO: 324903 - DNA, 20 bp, Homo sapiens
gcctagtggcttcagcccct

SEQ ID NO: 324904 - DNA, 21 bp, Homo sapiens
gcctagtggcttcagcccctg

SEQ ID NO: 324905 - DNA, 23 bp, Homo sapiens
gcctagtggggaggggcctggcc

SEQ ID NO: 324906 - DNA, 17 bp, Homo sapiens
gcctagttcatccaatc

SEQ ID NO: 324907 - DNA, 16 bp, Homo sapiens
gcctatcctaagagct

SEQ ID NO: 324908 - DNA, 23 bp, Homo sapiens
gcctatgcaaaaagaggatccgt

SEQ ID NO: 324909 - DNA, 18 bp, Homo sapiens
gcctattgtaaatacaag

SEQ ID NO: 324910 - DNA, 15 bp, Homo sapiens
gcctatttactggaa

SEQ ID NO: 324911 - DNA, 23 bp, Homo sapiens
gcctatttactggaaacctgtta

SEQ ID NO: 324912 - DNA, 13 bp, Homo sapiens
gcctcaaatgcag

SEQ ID NO: 324913 - DNA, 17 bp, Homo sapiens
gcctcaagccatcttcc

SEQ ID NO: 324914 - DNA, 19 bp, Homo sapiens
gcctcaagccatcttcccg

SEQ ID NO: 324915 - DNA, 13 bp, Homo sapiens
gcctcaaggactt

SEQ ID NO: 324916 - DNA, 15 bp, Homo sapiens
gcctcacccagaagg

SEQ ID NO: 324917 - DNA, 15 bp, Homo sapiens
gcctcacccctgcag

SEQ ID NO: 324918 - DNA, 17 bp, Homo sapiens
gcctcacccctgcaggc

SEQ ID NO: 324919 - DNA, 20 bp, Homo sapiens
gcctcaccctgcttggggcc

SEQ ID NO: 324920 - DNA, 23 bp, Homo sapiens
gcctcaccctgcttggggcctgg

SEQ ID NO: 324921 - DNA, 14 bp, Homo sapiens
gcctcacccttgcg

SEQ ID NO: 324922 - DNA, 14 bp, Homo sapiens
gcctcacctggctt

SEQ ID NO: 324923 - DNA, 19 bp, Homo sapiens
gcctcacctggcttcccag

SEQ ID NO: 324924 - DNA, 22 bp, Homo sapiens
gcctcacggggttggctgttcc

SEQ ID NO: 324925 - DNA, 14 bp, Homo sapiens
gcctcactggctgg

SEQ ID NO: 324926 - DNA, 22 bp, Homo sapiens
gcctcactggctggggcagagg

SEQ ID NO: 324927 - DNA, 16 bp, Homo sapiens
gcctcagaccaactct

SEQ ID NO: 324928 - DNA, 20 bp, Homo sapiens
gcctcagaccaactctctcc

SEQ ID NO: 324929 - DNA, 18 bp, Homo sapiens
gcctcagccagctgccca

SEQ ID NO: 324930 - DNA, 18 bp, Homo sapiens
gcctcagcctcctgagta

SEQ ID NO: 324931 - DNA, 12 bp, Homo sapiens
gcctcagccttc

SEQ ID NO: 324932 - DNA, 18 bp, Homo sapiens
gcctcagcgctgcccaca

SEQ ID NO: 324933 - DNA, 19 bp, Homo sapiens
gcctggacctgcctcctgc

SEQ ID NO: 324934 - DNA, 23 bp, Homo sapiens
gcctggactgtcctaggtgaccc

SEQ ID NO: 324935 - DNA, 14 bp, Homo sapiens
gcctggactttcct

SEQ ID NO: 324936 - DNA, 15 bp, Homo sapiens
gcctggagaaaggat

SEQ ID NO: 324937 - DNA, 23 bp, Homo sapiens
gcctggagcccctgtgtgggagg

SEQ ID NO: 324938 - DNA, 14 bp, Homo sapiens
gcctggagcgtttg

SEQ ID NO: 324939 - DNA, 15 bp, Homo sapiens
gcctggagctcctgg

SEQ ID NO: 324940 - DNA, 16 bp, Homo sapiens
gcctggagctcctggg

SEQ ID NO: 324941 - DNA, 23 bp, Homo sapiens
gcctggatgggggtgcaggcagc

SEQ ID NO: 324942 - DNA, 17 bp, Homo sapiens
gcctggatttcttccta

SEQ ID NO: 324943 - DNA, 13 bp, Homo sapiens
gcctggcacaggg

SEQ ID NO: 324944 - DNA, 17 bp, Homo sapiens
gcctggcacccactccg

SEQ ID NO: 324945 - DNA, 19 bp, Homo sapiens
gcctggcacccactccgga

SEQ ID NO: 324946 - DNA, 18 bp, Homo sapiens
gcctggcagaactgagct

SEQ ID NO: 324947 - DNA, 20 bp, Homo sapiens
gcctggcagggaggtcaggc

SEQ ID NO: 324948 - DNA, 17 bp, Homo sapiens
gcctggcaggtgccccg

SEQ ID NO: 324949 - DNA, 14 bp, Homo sapiens
gcctggccacctct

SEQ ID NO: 324950 - DNA, 22 bp, Homo sapiens
gcctggccacgcagccaggaca

SEQ ID NO: 324951 - DNA, 14 bp, Homo sapiens
gcctggccaggagc

SEQ ID NO: 324952 - DNA, 12 bp, Homo sapiens
gcctggcccagc

SEQ ID NO: 324953 - DNA, 13 bp, Homo sapiens
gcctggcccagcc

SEQ ID NO: 324954 - DNA, 18 bp, Homo sapiens
gcctggcccagccagcag

SEQ ID NO: 324955 - DNA, 18 bp, Homo sapiens
gcctggcccagggaggaa

SEQ ID NO: 324956 - DNA, 16 bp, Homo sapiens
gcctggccccaaatgt

SEQ ID NO: 324957 - DNA, 17 bp, Homo sapiens
gcctggccccaaatgtt

SEQ ID NO: 324958 - DNA, 18 bp, Homo sapiens
gcctggcccccagctgtg

SEQ ID NO: 324959 - DNA, 15 bp, Homo sapiens
gcctggcccccctcc

SEQ ID NO: 324960 - DNA, 15 bp, Homo sapiens
gcctggccctgccct

SEQ ID NO: 324961 - DNA, 16 bp, Homo sapiens
gcctggccctgccctg

SEQ ID NO: 324962 - DNA, 14 bp, Homo sapiens
gcctggcctattta

SEQ ID NO: 324963 - DNA, 19 bp, Homo sapiens
gcctggcctcccctgcgga

SEQ ID NO: 324964 - DNA, 11 bp, Homo sapiens
gcctggcctga

SEQ ID NO: 324965 - DNA, 16 bp, Homo sapiens
gcctggcctgagctgg

SEQ ID NO: 324966 - DNA, 12 bp, Homo sapiens
gcctggcctggc

SEQ ID NO: 324967 - DNA, 14 bp, Homo sapiens
gcctggcctggctc

SEQ ID NO: 324968 - DNA, 15 bp, Homo sapiens
gcctggcctggctcc

SEQ ID NO: 324969 - DNA, 22 bp, Homo sapiens
gcctggcgggcagcccctgctg

SEQ ID NO: 324970 - DNA, 17 bp, Homo sapiens
gcctggctcccaggaca

SEQ ID NO: 324971 - DNA, 13 bp, Homo sapiens
gcctggctcccca

SEQ ID NO: 324972 - DNA, 23 bp, Homo sapiens
gcctggctccccacgagtcacct

SEQ ID NO: 324973 - DNA, 16 bp, Homo sapiens
gcctggcttgctccag

SEQ ID NO: 324974 - DNA, 15 bp, Homo sapiens
gcctggcttttctgg

SEQ ID NO: 324975 - DNA, 15 bp, Homo sapiens
gcctgggaatgtatt

SEQ ID NO: 324976 - DNA, 23 bp, Homo sapiens
gcctgggaatgtattattctgca

SEQ ID NO: 324977 - DNA, 16 bp, Homo sapiens
gcctgggactcccagt

SEQ ID NO: 324978 - DNA, 17 bp, Homo sapiens
gcctgggactcccagtg

SEQ ID NO: 324979 - DNA, 18 bp, Homo sapiens
gcctgggactcccagtga

SEQ ID NO: 324980 - DNA, 23 bp, Homo sapiens
gcctgggcagccaggctgccaag

SEQ ID NO: 324981 - DNA, 12 bp, Homo sapiens
gcctgggcagtg

SEQ ID NO: 324982 - DNA, 15 bp, Homo sapiens
gcctgggcagtgccc

SEQ ID NO: 324983 - DNA, 20 bp, Homo sapiens
gcctgggccacagggcgaga

SEQ ID NO: 324984 - DNA, 14 bp, Homo sapiens
gcctgggccactgg

SEQ ID NO: 324985 - DNA, 16 bp, Homo sapiens
gcctgggccagagaag

SEQ ID NO: 324986 - DNA, 13 bp, Homo sapiens
gcctgggcctcct

SEQ ID NO: 324987 - DNA, 15 bp, Homo sapiens
gcctgggcctcctgg

SEQ ID NO: 324988 - DNA, 14 bp, Homo sapiens
gcctgggcctgctt

SEQ ID NO: 324989 - DNA, 13 bp, Homo sapiens
gcctgggcctgtg

SEQ ID NO: 324990 - DNA, 14 bp, Homo sapiens
gcctgggcctgtgc

SEQ ID NO: 324991 - DNA, 17 bp, Homo sapiens
gcctggggcctggcagg

SEQ ID NO: 324992 - DNA, 23 bp, Homo sapiens
gcctggggctcctttctccagcc

SEQ ID NO: 324993 - DNA, 16 bp, Homo sapiens
gcctgggtgacagagc

SEQ ID NO: 324994 - DNA, 21 bp, Homo sapiens
gcctgggtgagaatcctgcct

SEQ ID NO: 324995 - DNA, 14 bp, Homo sapiens
gcctgggtgctggc

SEQ ID NO: 324996 - DNA, 21 bp, Homo sapiens
gcctgggtggggcagggcctg

SEQ ID NO: 324997 - DNA, 22 bp, Homo sapiens
gcctgggttttgtggtcatcta

SEQ ID NO: 324998 - DNA, 13 bp, Homo sapiens
gcctggtctggag

SEQ ID NO: 324999 - DNA, 16 bp, Homo sapiens
gcctggtctggagccc

SEQ ID NO: 325000 - DNA, 19 bp, Homo sapiens
gcctggtctggagccccta

SEQ ID NO: 325001 - DNA, 17 bp, Homo sapiens
gcctggtgacaggcaga

SEQ ID NO: 325002 - DNA, 18 bp, Homo sapiens
gcctggtgcgctgtgctc

SEQ ID NO: 325003 - DNA, 15 bp, Homo sapiens
gcctggttccctctt

SEQ ID NO: 325004 - DNA, 24 bp, Homo sapiens
gcctggttccctctttcctgtgcc

SEQ ID NO: 325005 - DNA, 17 bp, Homo sapiens
gcctgtaatctttttct

SEQ ID NO: 325006 - DNA, 14 bp, Homo sapiens
gcctgtagagccag

SEQ ID NO: 325007 - DNA, 19 bp, Homo sapiens
gcctgtagttaggaaataa

SEQ ID NO: 325008 - DNA, 15 bp, Homo sapiens
gcctgtcactactgg

SEQ ID NO: 325009 - DNA, 18 bp, Homo sapiens
gcctgtcagtttcatgga

SEQ ID NO: 325010 - DNA, 15 bp, Homo sapiens
gcctgtccagcctgg

SEQ ID NO: 325011 - DNA, 18 bp, Homo sapiens
gcctgtccctctcaggca

SEQ ID NO: 325012 - DNA, 13 bp, Homo sapiens
gcctgtccctggc

SEQ ID NO: 325013 - DNA, 18 bp, Homo sapiens
gcctgtccctggccatct

SEQ ID NO: 325014 - DNA, 12 bp, Homo sapiens
gcctgtcctcac

SEQ ID NO: 325015 - DNA, 12 bp, Homo sapiens
gcctgtcctggt

SEQ ID NO: 325016 - DNA, 20 bp, Homo sapiens
gcctgtcctggtacagcagg

SEQ ID NO: 325017 - DNA, 21 bp, Homo sapiens
gcctgtcctggtacagcaggg

SEQ ID NO: 325018 - DNA, 15 bp, Homo sapiens
gcctgtcgtgccagt

SEQ ID NO: 325019 - DNA, 22 bp, Homo sapiens
gcctgtctcatccccaggggtc

SEQ ID NO: 325020 - DNA, 24 bp, Homo sapiens
tatattctttccatgcagttatta

SEQ ID NO: 325021 - DNA, 14 bp, Homo sapiens
tatattgagacaaa

SEQ ID NO: 325022 - DNA, 17 bp, Homo sapiens
tatattgccagtatata

SEQ ID NO: 325023 - DNA, 18 bp, Homo sapiens
tatattgccagtatataa

SEQ ID NO: 325024 - DNA, 22 bp, Homo sapiens
tatattgccagtatataagctg

SEQ ID NO: 325025 - DNA, 22 bp, Homo sapiens
tatattgtttttatatattata

SEQ ID NO: 325026 - DNA, 20 bp, Homo sapiens
tatatttatcatatttaata

SEQ ID NO: 325027 - DNA, 15 bp, Homo sapiens
tatatttcatattga

SEQ ID NO: 325028 - DNA, 16 bp, Homo sapiens
tatatttgaaactgct

SEQ ID NO: 325029 - DNA, 23 bp, Homo sapiens
tatattttcatgacttttccatg

SEQ ID NO: 325030 - DNA, 24 bp, Homo sapiens
tatattttcatgacttttccatgt

SEQ ID NO: 325031 - DNA, 15 bp, Homo sapiens
tatattttgaaagga

SEQ ID NO: 325032 - DNA, 20 bp, Homo sapiens
tatatttttccctgtttgcc

SEQ ID NO: 325033 - DNA, 18 bp, Homo sapiens
tatatttttggttgtcaa

SEQ ID NO: 325034 - DNA, 19 bp, Homo sapiens
tatatttttggttgtcaat

SEQ ID NO: 325035 - DNA, 20 bp, Homo sapiens
tatatttttgtttgttttgt

SEQ ID NO: 325036 - DNA, 21 bp, Homo sapiens
tatatttttgtttgttttgtg

SEQ ID NO: 325037 - DNA, 15 bp, Homo sapiens
tatcaaacagctcag

SEQ ID NO: 325038 - DNA, 13 bp, Homo sapiens
tatcaaaggcaga

SEQ ID NO: 325039 - DNA, 14 bp, Homo sapiens
tatcaaaggcagaa

SEQ ID NO: 325040 - DNA, 18 bp, Homo sapiens
tatcaaaggcagaaagga

SEQ ID NO: 325041 - DNA, 13 bp, Homo sapiens
tatcaaatcattc

SEQ ID NO: 325042 - DNA, 13 bp, Homo sapiens
tatcaaatctgta

SEQ ID NO: 325043 - DNA, 15 bp, Homo sapiens
tatcaacaacaagtt

SEQ ID NO: 325044 - DNA, 21 bp, Homo sapiens
tatcaagaagtcagagaaaac

SEQ ID NO: 325045 - DNA, 13 bp, Homo sapiens
tatcaagctaata

SEQ ID NO: 325046 - DNA, 15 bp, Homo sapiens
tatcaaggctgcctg

SEQ ID NO: 325047 - DNA, 16 bp, Homo sapiens
tatcaataaagcacta

SEQ ID NO: 325048 - DNA, 22 bp, Homo sapiens
tatcacaatgtactatatgtat

SEQ ID NO: 325049 - DNA, 14 bp, Homo sapiens
tatcacacaaagca

SEQ ID NO: 325050 - DNA, 15 bp, Homo sapiens
tatcacacactttct

SEQ ID NO: 325051 - DNA, 18 bp, Homo sapiens
tatcacacactttctgac

SEQ ID NO: 325052 - DNA, 13 bp, Homo sapiens
tatcacacttctg

SEQ ID NO: 325053 - DNA, 16 bp, Homo sapiens
tatcacaggccagatg

SEQ ID NO: 325054 - DNA, 13 bp, Homo sapiens
tatcacattattt

SEQ ID NO: 325055 - DNA, 15 bp, Homo sapiens
tatcaccctcagctg

SEQ ID NO: 325056 - DNA, 14 bp, Homo sapiens
tatcacctcccctc

SEQ ID NO: 325057 - DNA, 15 bp, Homo sapiens
tatcacctcccctcc

SEQ ID NO: 325058 - DNA, 20 bp, Homo sapiens
tatcacctcccctccttgcc

SEQ ID NO: 325059 - DNA, 12 bp, Homo sapiens
tatcacctgtca

SEQ ID NO: 325060 - DNA, 18 bp, Homo sapiens
tatcactgaagcttttta

SEQ ID NO: 325061 - DNA, 11 bp, Homo sapiens
tatcactttgt

SEQ ID NO: 325062 - DNA, 18 bp, Homo sapiens
tatcactttgtattctct

SEQ ID NO: 325063 - DNA, 21 bp, Homo sapiens
tatcagaagaccacaaaaatt

SEQ ID NO: 325064 - DNA, 13 bp, Homo sapiens
tatcagacctctg

SEQ ID NO: 325065 - DNA, 16 bp, Homo sapiens
tatcagacctctgatc

SEQ ID NO: 325066 - DNA, 18 bp, Homo sapiens
tatcagacctctgatccc

SEQ ID NO: 325067 - DNA, 17 bp, Homo sapiens
tatcagattgcttttgt

SEQ ID NO: 325068 - DNA, 20 bp, Homo sapiens
tatcagattgcttttgtgca

SEQ ID NO: 325069 - DNA, 13 bp, Homo sapiens
tatcagcctgagt

SEQ ID NO: 325070 - DNA, 19 bp, Homo sapiens
tatcagcctgagtctcctg

SEQ ID NO: 325071 - DNA, 15 bp, Homo sapiens
tatcagctctctgca

SEQ ID NO: 325072 - DNA, 22 bp, Homo sapiens
tatcagtcataactaaataaag

SEQ ID NO: 325073 - DNA, 22 bp, Homo sapiens
tatcagtgacagagttcactat

SEQ ID NO: 325074 - DNA, 20 bp, Homo sapiens
tatcagtttgtcctgtagag

SEQ ID NO: 325075 - DNA, 17 bp, Homo sapiens
tatcatatgtatctaaa

SEQ ID NO: 325076 - DNA, 20 bp, Homo sapiens
tatcatcccaacagccaaga

SEQ ID NO: 325077 - DNA, 13 bp, Homo sapiens
tatcatctccatc

SEQ ID NO: 325078 - DNA, 23 bp, Homo sapiens
tatcatctccatcatatgcctga

SEQ ID NO: 325079 - DNA, 16 bp, Homo sapiens
tatcatgaagccttgc

SEQ ID NO: 325080 - DNA, 12 bp, Homo sapiens
tatcatgcattc

SEQ ID NO: 325081 - DNA, 17 bp, Homo sapiens
tatcatggtctcagtca

SEQ ID NO: 325082 - DNA, 14 bp, Homo sapiens
tatcattaaacatg

SEQ ID NO: 325083 - DNA, 20 bp, Homo sapiens
tatcattaaacatgaattta

SEQ ID NO: 325084 - DNA, 21 bp, Homo sapiens
tatcattatagcatgtaatat

SEQ ID NO: 325085 - DNA, 12 bp, Homo sapiens
tatcattctttg

SEQ ID NO: 325086 - DNA, 22 bp, Homo sapiens
tatcattctttgtatcttaaat

SEQ ID NO: 325087 - DNA, 14 bp, Homo sapiens
tatcattttattca

SEQ ID NO: 325088 - DNA, 19 bp, Homo sapiens
tatccaaaccaaataaaaa

SEQ ID NO: 325089 - DNA, 16 bp, Homo sapiens
tatccaaatcttgaat

SEQ ID NO: 325090 - DNA, 19 bp, Homo sapiens
tatccaagtaccaatgctg

SEQ ID NO: 325091 - DNA, 17 bp, Homo sapiens
tatccaattatgtgaca

SEQ ID NO: 325092 - DNA, 20 bp, Homo sapiens
tatccacaatagctgacggc

SEQ ID NO: 325093 - DNA, 21 bp, Homo sapiens
tatccacagaacctttgtcaa

SEQ ID NO: 325094 - DNA, 20 bp, Homo sapiens
tatccactgtctatgtacaa

SEQ ID NO: 325095 - DNA, 15 bp, Homo sapiens
tatccagtcaaagac

SEQ ID NO: 325096 - DNA, 16 bp, Homo sapiens
tatccagtcaaagacg

SEQ ID NO: 325097 - DNA, 16 bp, Homo sapiens
tatccatgcaccaaac

SEQ ID NO: 325098 - DNA, 20 bp, Homo sapiens
tatccatgcatgtgcatata

SEQ ID NO: 325099 - DNA, 18 bp, Homo sapiens
tatccatgggggcagggc

SEQ ID NO: 325100 - DNA, 20 bp, Homo sapiens
tatccatgggggcagggcat

SEQ ID NO: 325101 - DNA, 14 bp, Homo sapiens
tatccatgtactgt

SEQ ID NO: 325102 - DNA, 19 bp, Homo sapiens
tatcccacctccagcccac

SEQ ID NO: 325103 - DNA, 14 bp, Homo sapiens
tatcccagaaatta

SEQ ID NO: 325104 - DNA, 14 bp, Homo sapiens
tatcccagagaaca

SEQ ID NO: 325105 - DNA, 18 bp, Homo sapiens
tatcccagagaacaatca

SEQ ID NO: 325106 - DNA, 15 bp, Homo sapiens
tatccccaggccagg

SEQ ID NO: 325107 - DNA, 18 bp, Homo sapiens
tatccggacagagcacgt

SEQ ID NO: 325108 - DNA, 17 bp, Homo sapiens
tatcctacatacttctt

SEQ ID NO: 325109 - DNA, 19 bp, Homo sapiens
tatcctagttccattcttg

SEQ ID NO: 325110 - DNA, 23 bp, Homo sapiens
tatcctgacttctaatatcattc

SEQ ID NO: 325111 - DNA, 13 bp, Homo sapiens
tatcctgagccat

SEQ ID NO: 325112 - DNA, 15 bp, Homo sapiens
tatcctgcccagtgt

SEQ ID NO: 325113 - DNA, 20 bp, Homo sapiens
tatcctggtgtctagtttgc

SEQ ID NO: 325114 - DNA, 15 bp, Homo sapiens
tatcctgtgctacag

SEQ ID NO: 325115 - DNA, 22 bp, Homo sapiens
tatcgagtttgcaatgtcacaa

SEQ ID NO: 325116 - DNA, 16 bp, Homo sapiens
tatcgatctcttattt

SEQ ID NO: 325117 - DNA, 16 bp, Homo sapiens
tatcgatctggaaaga

SEQ ID NO: 325118 - DNA, 16 bp, Homo sapiens
tatcgggaacagtgtt

SEQ ID NO: 325119 - DNA, 17 bp, Homo sapiens
tatcgggaacagtgttt

SEQ ID NO: 325120 - DNA, 14 bp, Homo sapiens
tatcgggagcagtg

SEQ ID NO: 325121 - DNA, 12 bp, Homo sapiens
tatctaaatgat

SEQ ID NO: 325122 - DNA, 21 bp, Homo sapiens
tatctacccagtcatgtactg

SEQ ID NO: 325123 - DNA, 12 bp, Homo sapiens
tatctagaaaga

SEQ ID NO: 325124 - DNA, 15 bp, Homo sapiens
tatctagaaagaaaa

SEQ ID NO: 325125 - DNA, 18 bp, Homo sapiens
tatctagaaagaaaagac

SEQ ID NO: 325126 - DNA, 21 bp, Homo sapiens
tatctagaaagaaaagaccct

SEQ ID NO: 325127 - DNA, 19 bp, Homo sapiens
tatctagcaagaagattct

SEQ ID NO: 325128 - DNA, 21 bp, Homo sapiens
tatctagcaagaagattctaa

SEQ ID NO: 325129 - DNA, 22 bp, Homo sapiens
tatctagcaagaagattctaaa

SEQ ID NO: 325130 - DNA, 23 bp, Homo sapiens
tatctagcaagaagattctaaaa

SEQ ID NO: 325131 - DNA, 16 bp, Homo sapiens
tatctagtaggtctgc

SEQ ID NO: 325132 - DNA, 21 bp, Homo sapiens
tatctagtaggtctgcacaca

SEQ ID NO: 325133 - DNA, 23 bp, Homo sapiens
tatctagtaggtctgcacacata

SEQ ID NO: 325134 - DNA, 14 bp, Homo sapiens
tatctagtgcagct

SEQ ID NO: 325135 - DNA, 19 bp, Homo sapiens
tatctagtgcagctgattt

SEQ ID NO: 325136 - DNA, 17 bp, Homo sapiens
tatctatttatctgtct

SEQ ID NO: 325137 - DNA, 18 bp, Homo sapiens
tatctccctgcttcatat

SEQ ID NO: 325138 - DNA, 13 bp, Homo sapiens
tatctcctgctct

SEQ ID NO: 325139 - DNA, 22 bp, Homo sapiens
tatctcgaagtcttccatcagc

SEQ ID NO: 325140 - DNA, 16 bp, Homo sapiens
tatctcgtgggagagc

SEQ ID NO: 325141 - DNA, 22 bp, Homo sapiens
tatctctagtccctgtgttctg

SEQ ID NO: 325142 - DNA, 14 bp, Homo sapiens
tatctctcccttct

SEQ ID NO: 325143 - DNA, 20 bp, Homo sapiens
tatctctctctctttttgga

SEQ ID NO: 325144 - DNA, 15 bp, Homo sapiens
tatctctgaagcatg

SEQ ID NO: 325145 - DNA, 13 bp, Homo sapiens
tatctgaacacat

SEQ ID NO: 325146 - DNA, 14 bp, Homo sapiens
tatctgaacacata

SEQ ID NO: 325147 - DNA, 12 bp, Homo sapiens
tatctgcatgta

SEQ ID NO: 325148 - DNA, 21 bp, Homo sapiens
tatctgcatgtaaaatcttca

SEQ ID NO: 325149 - DNA, 22 bp, Homo sapiens
tatctgcatgtaaaatcttcag

SEQ ID NO: 325150 - DNA, 17 bp, Homo sapiens
gagcagcctccaagaaa

SEQ ID NO: 325151 - DNA, 13 bp, Homo sapiens
gagcagcctccac

SEQ ID NO: 325152 - DNA, 19 bp, Homo sapiens
gagcagcctctgccaggcc

SEQ ID NO: 325153 - DNA, 21 bp, Homo sapiens
gagcagcctctgccaggcctg

SEQ ID NO: 325154 - DNA, 14 bp, Homo sapiens
gagcagctccccag

SEQ ID NO: 325155 - DNA, 16 bp, Homo sapiens
gagcagctccccagga

SEQ ID NO: 325156 - DNA, 17 bp, Homo sapiens
gagcagctccccaggag

SEQ ID NO: 325157 - DNA, 14 bp, Homo sapiens
gagcagctggctct

SEQ ID NO: 325158 - DNA, 15 bp, Homo sapiens
gagcagctggctctc

SEQ ID NO: 325159 - DNA, 19 bp, Homo sapiens
gagcagctggctctccacc

SEQ ID NO: 325160 - DNA, 14 bp, Homo sapiens
gagcaggaaggcct

SEQ ID NO: 325161 - DNA, 17 bp, Homo sapiens
gagcaggaggcccctgg

SEQ ID NO: 325162 - DNA, 22 bp, Homo sapiens
gagcaggcaaaaaagggacagc

SEQ ID NO: 325163 - DNA, 21 bp, Homo sapiens
gagcaggctggcagctctcca

SEQ ID NO: 325164 - DNA, 21 bp, Homo sapiens
gagcagggattaacctctgca

SEQ ID NO: 325165 - DNA, 18 bp, Homo sapiens
gagcagggccctcagagg

SEQ ID NO: 325166 - DNA, 19 bp, Homo sapiens
gagcaggtctgcaggccac

SEQ ID NO: 325167 - DNA, 13 bp, Homo sapiens
gagcagtccagag

SEQ ID NO: 325168 - DNA, 14 bp, Homo sapiens
gagcagtggctggt

SEQ ID NO: 325169 - DNA, 23 bp, Homo sapiens
gagcagtggctggtccagggcta

SEQ ID NO: 325170 - DNA, 16 bp, Homo sapiens
gagcagtggggagcgg

SEQ ID NO: 325171 - DNA, 12 bp, Homo sapiens
gagcagtgtctt

SEQ ID NO: 325172 - DNA, 21 bp, Homo sapiens
gagcagttttccaggaggccg

SEQ ID NO: 325173 - DNA, 18 bp, Homo sapiens
gagcatcagagaaggcca

SEQ ID NO: 325174 - DNA, 15 bp, Homo sapiens
gagcatcgtgaccct

SEQ ID NO: 325175 - DNA, 13 bp, Homo sapiens
gagcatctgtccc

SEQ ID NO: 325176 - DNA, 19 bp, Homo sapiens
gagcatgtgggggaaggcc

SEQ ID NO: 325177 - DNA, 20 bp, Homo sapiens
gagcatgttgttttttcata

SEQ ID NO: 325178 - DNA, 19 bp, Homo sapiens
gagcattctggggtggggc

SEQ ID NO: 325179 - DNA, 14 bp, Homo sapiens
gagccaacctcggc

SEQ ID NO: 325180 - DNA, 16 bp, Homo sapiens
gagccaacctcggctt

SEQ ID NO: 325181 - DNA, 21 bp, Homo sapiens
gagccaactcactcttatgaa

SEQ ID NO: 325182 - DNA, 20 bp, Homo sapiens
gagccaatgaacagctcctc

SEQ ID NO: 325183 - DNA, 13 bp, Homo sapiens
gagccacaggcag

SEQ ID NO: 325184 - DNA, 18 bp, Homo sapiens
gagccacagtggggccca

SEQ ID NO: 325185 - DNA, 14 bp, Homo sapiens
gagccaccacacct

SEQ ID NO: 325186 - DNA, 19 bp, Homo sapiens
gagccaccacgccctgcct

SEQ ID NO: 325187 - DNA, 14 bp, Homo sapiens
gagccaccatgccc

SEQ ID NO: 325188 - DNA, 19 bp, Homo sapiens
gagccaccatgcccagctc

SEQ ID NO: 325189 - DNA, 21 bp, Homo sapiens
gagccacctgggctgggagaa

SEQ ID NO: 325190 - DNA, 20 bp, Homo sapiens
gagccacctgtcccacctca

SEQ ID NO: 325191 - DNA, 12 bp, Homo sapiens
gagccactcctg

SEQ ID NO: 325192 - DNA, 16 bp, Homo sapiens
gagccactcctgtccc

SEQ ID NO: 325193 - DNA, 14 bp, Homo sapiens
gagccactgcgccc

SEQ ID NO: 325194 - DNA, 12 bp, Homo sapiens
gagccagcctgg

SEQ ID NO: 325195 - DNA, 14 bp, Homo sapiens
gagccagcctggga

SEQ ID NO: 325196 - DNA, 13 bp, Homo sapiens
gagccagctctgg

SEQ ID NO: 325197 - DNA, 14 bp, Homo sapiens
gagccagcttggtc

SEQ ID NO: 325198 - DNA, 14 bp, Homo sapiens
gagccaggagcctc

SEQ ID NO: 325199 - DNA, 12 bp, Homo sapiens
gagccaggcctg

SEQ ID NO: 325200 - DNA, 13 bp, Homo sapiens
gagccagggtaga

SEQ ID NO: 325201 - DNA, 13 bp, Homo sapiens
gagccagtcccag

SEQ ID NO: 325202 - DNA, 22 bp, Homo sapiens
gagccatggaccacgcaggaag

SEQ ID NO: 325203 - DNA, 21 bp, Homo sapiens
gagccatgggcctgggcctgc

SEQ ID NO: 325204 - DNA, 15 bp, Homo sapiens
gagccatgtaccagt

SEQ ID NO: 325205 - DNA, 22 bp, Homo sapiens
gagccatgtctacaaaagcaaa

SEQ ID NO: 325206 - DNA, 18 bp, Homo sapiens
gagcccaatcactgccta

SEQ ID NO: 325207 - DNA, 23 bp, Homo sapiens
gagcccacgcccgactagcaggc

SEQ ID NO: 325208 - DNA, 22 bp, Homo sapiens
gagcccacggctaagaggctgc

SEQ ID NO: 325209 - DNA, 14 bp, Homo sapiens
gagcccagcacact

SEQ ID NO: 325210 - DNA, 19 bp, Homo sapiens
gagcccagctacattcctc

SEQ ID NO: 325211 - DNA, 11 bp, Homo sapiens
gagcccaggcc

SEQ ID NO: 325212 - DNA, 14 bp, Homo sapiens
gagcccaggcctgc

SEQ ID NO: 325213 - DNA, 14 bp, Homo sapiens
gagcccaggcctgg

SEQ ID NO: 325214 - DNA, 16 bp, Homo sapiens
gagcccaggcctggcc

SEQ ID NO: 325215 - DNA, 19 bp, Homo sapiens
gagcccaggcctggcctcg

SEQ ID NO: 325216 - DNA, 13 bp, Homo sapiens
gagcccattccca

SEQ ID NO: 325217 - DNA, 13 bp, Homo sapiens
gagccccagccag

SEQ ID NO: 325218 - DNA, 18 bp, Homo sapiens
gagccccagccagccctt

SEQ ID NO: 325219 - DNA, 13 bp, Homo sapiens
gagccccagctga

SEQ ID NO: 325220 - DNA, 12 bp, Homo sapiens
gagcccccacca

SEQ ID NO: 325221 - DNA, 17 bp, Homo sapiens
gagcccccaccagcagc

SEQ ID NO: 325222 - DNA, 18 bp, Homo sapiens
gagcccccaccagcagca

SEQ ID NO: 325223 - DNA, 14 bp, Homo sapiens
gagcccccaccttg

SEQ ID NO: 325224 - DNA, 12 bp, Homo sapiens
gagcccccagat

SEQ ID NO: 325225 - DNA, 23 bp, Homo sapiens
gagccccctgcacccacccctgc

SEQ ID NO: 325226 - DNA, 12 bp, Homo sapiens
gagccccggagc

SEQ ID NO: 325227 - DNA, 13 bp, Homo sapiens
gagccccggagca

SEQ ID NO: 325228 - DNA, 16 bp, Homo sapiens
gagccccggagcacca

SEQ ID NO: 325229 - DNA, 13 bp, Homo sapiens
gagcccctcccca

SEQ ID NO: 325230 - DNA, 15 bp, Homo sapiens
gagcccctccccagc

SEQ ID NO: 325231 - DNA, 16 bp, Homo sapiens
gagcccctccccagcc

SEQ ID NO: 325232 - DNA, 21 bp, Homo sapiens
gagcccctccccagccagccc

SEQ ID NO: 325233 - DNA, 12 bp, Homo sapiens
gagcccctccta

SEQ ID NO: 325234 - DNA, 15 bp, Homo sapiens
gagcccctcctctcc

SEQ ID NO: 325235 - DNA, 18 bp, Homo sapiens
gagcccctcctctcctcg

SEQ ID NO: 325236 - DNA, 23 bp, Homo sapiens
gagcccctcctctgagcagcctc

SEQ ID NO: 325237 - DNA, 21 bp, Homo sapiens
gagcccctgtgtgggagggcg

SEQ ID NO: 325238 - DNA, 17 bp, Homo sapiens
gagcccgcccacctggg

SEQ ID NO: 325239 - DNA, 19 bp, Homo sapiens
gagcccggggcagagctca

SEQ ID NO: 325240 - DNA, 22 bp, Homo sapiens
gagcccggggcagagctcagag

SEQ ID NO: 325241 - DNA, 23 bp, Homo sapiens
gagcccggggcagagctcagagg

SEQ ID NO: 325242 - DNA, 13 bp, Homo sapiens
gagccctccctct

SEQ ID NO: 325243 - DNA, 18 bp, Homo sapiens
gagccctccctcttccca

SEQ ID NO: 325244 - DNA, 21 bp, Homo sapiens
gagccctccctcttcccagca

SEQ ID NO: 325245 - DNA, 15 bp, Homo sapiens
gagccctcctggaat

SEQ ID NO: 325246 - DNA, 20 bp, Homo sapiens
gagccctcctggaatggagc

SEQ ID NO: 325247 - DNA, 17 bp, Homo sapiens
gagccctgaccttggct

SEQ ID NO: 325248 - DNA, 18 bp, Homo sapiens
gagccctgaccttggctg

SEQ ID NO: 325249 - DNA, 22 bp, Homo sapiens
gagccctgaccttggctgactg

SEQ ID NO: 325250 - DNA, 19 bp, Homo sapiens
gagccctgccctcactcca

SEQ ID NO: 325251 - DNA, 23 bp, Homo sapiens
gagccctgccctcactccactcc

SEQ ID NO: 325252 - DNA, 15 bp, Homo sapiens
gagccctgccctgca

SEQ ID NO: 325253 - DNA, 21 bp, Homo sapiens
gagccctggacacccctgctc

SEQ ID NO: 325254 - DNA, 14 bp, Homo sapiens
gagccctggctggg

SEQ ID NO: 325255 - DNA, 18 bp, Homo sapiens
gagccctggctgggttca

SEQ ID NO: 325256 - DNA, 23 bp, Homo sapiens
gagccctggggtttccacacagg

SEQ ID NO: 325257 - DNA, 19 bp, Homo sapiens
tcaatttactttttaaaca

SEQ ID NO: 325258 - DNA, 22 bp, Homo sapiens
tcaatttactttttaaacagtg

SEQ ID NO: 325259 - DNA, 20 bp, Homo sapiens
tcaatttgtaattgcttaca

SEQ ID NO: 325260 - DNA, 16 bp, Homo sapiens
tcaatttgtataaaat

SEQ ID NO: 325261 - DNA, 21 bp, Homo sapiens
tcaatttgttcagtctttcat

SEQ ID NO: 325262 - DNA, 14 bp, Homo sapiens
tcaattttctttaa

SEQ ID NO: 325263 - DNA, 20 bp, Homo sapiens
tcaattttgtatttaatgat

SEQ ID NO: 325264 - DNA, 18 bp, Homo sapiens
tcacaaaagctgtgtctc

SEQ ID NO: 325265 - DNA, 18 bp, Homo sapiens
tcacaaagagttctggaa

SEQ ID NO: 325266 - DNA, 20 bp, Homo sapiens
tcacaaataagtaatatctt

SEQ ID NO: 325267 - DNA, 22 bp, Homo sapiens
tcacaaataagtaatatctttc

SEQ ID NO: 325268 - DNA, 23 bp, Homo sapiens
tcacaacactgaacctctggcta

SEQ ID NO: 325269 - DNA, 12 bp, Homo sapiens
tcacaacagatc

SEQ ID NO: 325270 - DNA, 12 bp, Homo sapiens
tcacaactcctt

SEQ ID NO: 325271 - DNA, 19 bp, Homo sapiens
tcacaactccttccatcct

SEQ ID NO: 325272 - DNA, 19 bp, Homo sapiens
tcacaactgtttttgaaga

SEQ ID NO: 325273 - DNA, 13 bp, Homo sapiens
tcacaagctgcct

SEQ ID NO: 325274 - DNA, 15 bp, Homo sapiens
tcacaagctgcctcc

SEQ ID NO: 325275 - DNA, 16 bp, Homo sapiens
tcacaagctgcctccc

SEQ ID NO: 325276 - DNA, 22 bp, Homo sapiens
tcacaagctgcctccctgtcca

SEQ ID NO: 325277 - DNA, 14 bp, Homo sapiens
tcacaaggtcagga

SEQ ID NO: 325278 - DNA, 18 bp, Homo sapiens
tcacaaggtctttactta

SEQ ID NO: 325279 - DNA, 16 bp, Homo sapiens
tcacaagtaggagaca

SEQ ID NO: 325280 - DNA, 18 bp, Homo sapiens
tcacaagtaggagacaca

SEQ ID NO: 325281 - DNA, 18 bp, Homo sapiens
gaggaagggactggtcca

SEQ ID NO: 325282 - DNA, 18 bp, Homo sapiens
gaggaaggtgctgagctt

SEQ ID NO: 325283 - DNA, 17 bp, Homo sapiens
gaggaataattatttat

SEQ ID NO: 325284 - DNA, 15 bp, Homo sapiens
gaggaatcttttact

SEQ ID NO: 325285 - DNA, 21 bp, Homo sapiens
gaggaatgctcccccatcctc

SEQ ID NO: 325286 - DNA, 15 bp, Homo sapiens
gaggaatgctctgtg

SEQ ID NO: 325287 - DNA, 18 bp, Homo sapiens
gaggaatgtgcttttcca

SEQ ID NO: 325288 - DNA, 14 bp, Homo sapiens
gaggaattgggacc

SEQ ID NO: 325289 - DNA, 16 bp, Homo sapiens
gaggaattgggacctg

SEQ ID NO: 325290 - DNA, 18 bp, Homo sapiens
gaggaattggggtttctg

SEQ ID NO: 325291 - DNA, 21 bp, Homo sapiens
gaggacatgtttttgttttct

SEQ ID NO: 325292 - DNA, 23 bp, Homo sapiens
gaggaccacagtgggtggcacct

SEQ ID NO: 325293 - DNA, 23 bp, Homo sapiens
gaggaccccagcttttcttgcca

SEQ ID NO: 325294 - DNA, 16 bp, Homo sapiens
gaggacctccacctgg

SEQ ID NO: 325295 - DNA, 17 bp, Homo sapiens
gaggacctccacctggg

SEQ ID NO: 325296 - DNA, 22 bp, Homo sapiens
gaggacctccacctgggagatg

SEQ ID NO: 325297 - DNA, 13 bp, Homo sapiens
gaggacctctggg

SEQ ID NO: 325298 - DNA, 19 bp, Homo sapiens
gaggaccttatctgtgcgt

SEQ ID NO: 325299 - DNA, 19 bp, Homo sapiens
gaggacggagttcagaggg

SEQ ID NO: 325300 - DNA, 16 bp, Homo sapiens
gaggacggggcagagc

SEQ ID NO: 325301 - DNA, 21 bp, Homo sapiens
gaggactccctccatgtggcc

SEQ ID NO: 325302 - DNA, 18 bp, Homo sapiens
gaggactccgggaccatt

SEQ ID NO: 325303 - DNA, 22 bp, Homo sapiens
gaggagaaaagtgacagatcct

SEQ ID NO: 325304 - DNA, 20 bp, Homo sapiens
gaggagaacactagacatgc

SEQ ID NO: 325305 - DNA, 14 bp, Homo sapiens
gaggagaaggagag

SEQ ID NO: 325306 - DNA, 16 bp, Homo sapiens
gaggagaccctggaat

SEQ ID NO: 325307 - DNA, 22 bp, Homo sapiens
gaggagagcatctgctctgaga

SEQ ID NO: 325308 - DNA, 14 bp, Homo sapiens
gaggagagggcaga

SEQ ID NO: 325309 - DNA, 20 bp, Homo sapiens
gaggagagtacccccctgag

SEQ ID NO: 325310 - DNA, 14 bp, Homo sapiens
gaggagagtcccag

SEQ ID NO: 325311 - DNA, 11 bp, Homo sapiens
gaggagcaccc

SEQ ID NO: 325312 - DNA, 13 bp, Homo sapiens
gaggagcaccccc

SEQ ID NO: 325313 - DNA, 15 bp, Homo sapiens
gaggagcacccccag

SEQ ID NO: 325314 - DNA, 18 bp, Homo sapiens
gaggagcacccccagcct

SEQ ID NO: 325315 - DNA, 21 bp, Homo sapiens
gaggagcacccccagcctccc

SEQ ID NO: 325316 - DNA, 13 bp, Homo sapiens
gaggagcacctga

SEQ ID NO: 325317 - DNA, 17 bp, Homo sapiens
gaggagcacctgaaccc

SEQ ID NO: 325318 - DNA, 22 bp, Homo sapiens
gaggagcaggaagcaaggccag

SEQ ID NO: 325319 - DNA, 12 bp, Homo sapiens
gaggagctgctg

SEQ ID NO: 325320 - DNA, 13 bp, Homo sapiens
gaggagctgctgg

SEQ ID NO: 325321 - DNA, 15 bp, Homo sapiens
gaggagctgctggct

SEQ ID NO: 325322 - DNA, 12 bp, Homo sapiens
gaggaggagaaa

SEQ ID NO: 325323 - DNA, 13 bp, Homo sapiens
gaggaggaggcag

SEQ ID NO: 325324 - DNA, 13 bp, Homo sapiens
gaggaggatccgg

SEQ ID NO: 325325 - DNA, 22 bp, Homo sapiens
gaggaggcccttaagggaagct

SEQ ID NO: 325326 - DNA, 20 bp, Homo sapiens
gaggagggatagagacgcag

SEQ ID NO: 325327 - DNA, 18 bp, Homo sapiens
gaggaggggtaaatatat

SEQ ID NO: 325328 - DNA, 21 bp, Homo sapiens
gaggaggggtaaatatatgtt

SEQ ID NO: 325329 - DNA, 20 bp, Homo sapiens
gaggaggtgtggagtggagg

SEQ ID NO: 325330 - DNA, 14 bp, Homo sapiens
gaggagtccaaaat

SEQ ID NO: 325331 - DNA, 17 bp, Homo sapiens
gaggagttcaatgatct

SEQ ID NO: 325332 - DNA, 14 bp, Homo sapiens
gaggatgagacagg

SEQ ID NO: 325333 - DNA, 17 bp, Homo sapiens
gaggatgcactggcctg

SEQ ID NO: 325334 - DNA, 16 bp, Homo sapiens
gaggatgctgtgcctc

SEQ ID NO: 325335 - DNA, 19 bp, Homo sapiens
gaggatgggcagctggggg

SEQ ID NO: 325336 - DNA, 23 bp, Homo sapiens
gaggatggtcatcgtgacagcag

SEQ ID NO: 325337 - DNA, 13 bp, Homo sapiens
gaggatgttctgg

SEQ ID NO: 325338 - DNA, 13 bp, Homo sapiens
gaggattttgagt

SEQ ID NO: 325339 - DNA, 23 bp, Homo sapiens
gaggcaaaaggcagtggggctgg

SEQ ID NO: 325340 - DNA, 22 bp, Homo sapiens
gaggcaacagtgttctgagccc

SEQ ID NO: 325341 - DNA, 20 bp, Homo sapiens
gaggcaaccccctcggagcc

SEQ ID NO: 325342 - DNA, 21 bp, Homo sapiens
gaggcaaccccctcggagcct

SEQ ID NO: 325343 - DNA, 14 bp, Homo sapiens
gaggcaagagaaat

SEQ ID NO: 325344 - DNA, 15 bp, Homo sapiens
gaggcaagagaaatg

SEQ ID NO: 325345 - DNA, 23 bp, Homo sapiens
gaggcaagagaaatgaggaagaa

SEQ ID NO: 325346 - DNA, 15 bp, Homo sapiens
gaggcaccagctctg

SEQ ID NO: 325347 - DNA, 20 bp, Homo sapiens
gaggcaccagctctgtggcc

SEQ ID NO: 325348 - DNA, 17 bp, Homo sapiens
gaggcaccggcgctgca

SEQ ID NO: 325349 - DNA, 20 bp, Homo sapiens
gaggcaccggcgctgcaggt

SEQ ID NO: 325350 - DNA, 18 bp, Homo sapiens
gaggcagaaagcagaggc

SEQ ID NO: 325351 - DNA, 19 bp, Homo sapiens
gaggcagaaagcagaggct

SEQ ID NO: 325352 - DNA, 23 bp, Homo sapiens
gaggcagaaagcagaggctggcc

SEQ ID NO: 325353 - DNA, 22 bp, Homo sapiens
gaggcagaatggtgggctccag

SEQ ID NO: 325354 - DNA, 23 bp, Homo sapiens
gaggcagaatggtgggctccaga

SEQ ID NO: 325355 - DNA, 16 bp, Homo sapiens
gaggcagagtgcccca

SEQ ID NO: 325356 - DNA, 15 bp, Homo sapiens
gaggcagcaacagga

SEQ ID NO: 325357 - DNA, 23 bp, Homo sapiens
gaggcagcaacaggaccaggagc

SEQ ID NO: 325358 - DNA, 12 bp, Homo sapiens
gaggcagccagg

SEQ ID NO: 325359 - DNA, 12 bp, Homo sapiens
gaggcagggccc

SEQ ID NO: 325360 - DNA, 14 bp, Homo sapiens
gaggcagggccctg

SEQ ID NO: 325361 - DNA, 15 bp, Homo sapiens
gaggcaggggagtct

SEQ ID NO: 325362 - DNA, 21 bp, Homo sapiens
gaggcaggggagtctgcttgt

SEQ ID NO: 325363 - DNA, 16 bp, Homo sapiens
gaggcaggggctgggc

SEQ ID NO: 325364 - DNA, 13 bp, Homo sapiens
gaggcagtggcag

SEQ ID NO: 325365 - DNA, 19 bp, Homo sapiens
gaggcagtttttgttcctt

SEQ ID NO: 325366 - DNA, 20 bp, Homo sapiens
gaggcagtttttgttccttc

SEQ ID NO: 325367 - DNA, 15 bp, Homo sapiens
gaggcattcccagag

SEQ ID NO: 325368 - DNA, 23 bp, Homo sapiens
gaggcatttgtcttagagagaga

SEQ ID NO: 325369 - DNA, 17 bp, Homo sapiens
gaggccaagcctgcagc

SEQ ID NO: 325370 - DNA, 12 bp, Homo sapiens
gaggccaaggca

SEQ ID NO: 325371 - DNA, 13 bp, Homo sapiens
gaggccaaggcag

SEQ ID NO: 325372 - DNA, 17 bp, Homo sapiens
gaggccaagtgcaggct

SEQ ID NO: 325373 - DNA, 16 bp, Homo sapiens
gaggccacttagggaa

SEQ ID NO: 325374 - DNA, 16 bp, Homo sapiens
gaggccagccccaccc

SEQ ID NO: 325375 - DNA, 20 bp, Homo sapiens
gaggccagccccacccagga

SEQ ID NO: 325376 - DNA, 22 bp, Homo sapiens
gaggccagccccacccaggagg

SEQ ID NO: 325377 - DNA, 14 bp, Homo sapiens
gaggccaggccctc

SEQ ID NO: 325378 - DNA, 17 bp, Homo sapiens
gaggccaggccctcctg

SEQ ID NO: 325379 - DNA, 22 bp, Homo sapiens
gaggccaggccctcctgctggc

SEQ ID NO: 325380 - DNA, 20 bp, Homo sapiens
gaggccatgattcgcccaaa

SEQ ID NO: 325381 - DNA, 23 bp, Homo sapiens
gaggccatgggggcccctcggca

SEQ ID NO: 325382 - DNA, 15 bp, Homo sapiens
gaggccattccctgt

SEQ ID NO: 325383 - DNA, 14 bp, Homo sapiens
gaggcccagagagc

SEQ ID NO: 325384 - DNA, 16 bp, Homo sapiens
gaggcccagcagagcc

SEQ ID NO: 325385 - DNA, 17 bp, Homo sapiens
gaggcccagcagagccg

SEQ ID NO: 325386 - DNA, 18 bp, Homo sapiens
gaggcccagcagagccgt

SEQ ID NO: 325387 - DNA, 20 bp, Homo sapiens
gaggcccagcagagccgttc

SEQ ID NO: 325388 - DNA, 11 bp, Homo sapiens
gaggcccagcc

SEQ ID NO: 325389 - DNA, 16 bp, Homo sapiens
gaggcccagcctgtcc

SEQ ID NO: 325390 - DNA, 18 bp, Homo sapiens
gaggcccagcctgtcctg

SEQ ID NO: 325391 - DNA, 21 bp, Homo sapiens
gaggcccagcctgtcctggta

SEQ ID NO: 325392 - DNA, 16 bp, Homo sapiens
gaggccccaggcccta

SEQ ID NO: 325393 - DNA, 20 bp, Homo sapiens
gaggcccccggaggcgccca

SEQ ID NO: 325394 - DNA, 18 bp, Homo sapiens
gaggcccttttctggctc

SEQ ID NO: 325395 - DNA, 15 bp, Homo sapiens
gaggccgctagaggc

SEQ ID NO: 325396 - DNA, 22 bp, Homo sapiens
gaggccgctagaggcctgagga

SEQ ID NO: 325397 - DNA, 19 bp, Homo sapiens
gaggccggggggagcagga

SEQ ID NO: 325398 - DNA, 16 bp, Homo sapiens
gaggcctcaccctgct

SEQ ID NO: 325399 - DNA, 21 bp, Homo sapiens
gaggcctcagtggactttcca

SEQ ID NO: 325400 - DNA, 14 bp, Homo sapiens
gaggcctcatccct

SEQ ID NO: 325401 - DNA, 16 bp, Homo sapiens
gaggcctcccccagcc

SEQ ID NO: 325402 - DNA, 22 bp, Homo sapiens
gaggcctgaaatgtttccaggc

SEQ ID NO: 325403 - DNA, 14 bp, Homo sapiens
tcactgttcatgaa

SEQ ID NO: 325404 - DNA, 16 bp, Homo sapiens
tcactgttccctctgc

SEQ ID NO: 325405 - DNA, 15 bp, Homo sapiens
tcactgttgaaaatt

SEQ ID NO: 325406 - DNA, 14 bp, Homo sapiens
tcactgttgcttaa

SEQ ID NO: 325407 - DNA, 22 bp, Homo sapiens
tcactgttgcttaattgtgaac

SEQ ID NO: 325408 - DNA, 14 bp, Homo sapiens
tcactgtttctctg

SEQ ID NO: 325409 - DNA, 23 bp, Homo sapiens
tcacttaaactttgtcacttctg

SEQ ID NO: 325410 - DNA, 16 bp, Homo sapiens
tcacttaagcccagga

SEQ ID NO: 325411 - DNA, 21 bp, Homo sapiens
tcatacttgctccttgaataa

SEQ ID NO: 325412 - DNA, 22 bp, Homo sapiens
tcatacttgctccttgaataag

SEQ ID NO: 325413 - DNA, 12 bp, Homo sapiens
tcatactttgcc

SEQ ID NO: 325414 - DNA, 12 bp, Homo sapiens
tcatagaatagc

SEQ ID NO: 325415 - DNA, 20 bp, Homo sapiens
tcatagaggatgatgtaatt

SEQ ID NO: 325416 - DNA, 14 bp, Homo sapiens
tcatagatgaactt

SEQ ID NO: 325417 - DNA, 18 bp, Homo sapiens
tcatagcagattttaatt

SEQ ID NO: 325418 - DNA, 13 bp, Homo sapiens
tcataggctgaca

SEQ ID NO: 325419 - DNA, 15 bp, Homo sapiens
tcataggctgacacc

SEQ ID NO: 325420 - DNA, 20 bp, Homo sapiens
tcatagggtctcttcaggtt

SEQ ID NO: 325421 - DNA, 21 bp, Homo sapiens
tcatagggtctcttcaggttc

SEQ ID NO: 325422 - DNA, 15 bp, Homo sapiens
gagtgccccacctgc

SEQ ID NO: 325423 - DNA, 17 bp, Homo sapiens
gagtgccccagaaatgc

SEQ ID NO: 325424 - DNA, 22 bp, Homo sapiens
gagtgccccagaaatgccgctg

SEQ ID NO: 325425 - DNA, 23 bp, Homo sapiens
gagtgcccttaaaataatgattt

SEQ ID NO: 325426 - DNA, 15 bp, Homo sapiens
gagtgcctgcagcat

SEQ ID NO: 325427 - DNA, 23 bp, Homo sapiens
gagtgcgctcttggtccctggtc

SEQ ID NO: 325428 - DNA, 17 bp, Homo sapiens
gagtggaatgcagggaa

SEQ ID NO: 325429 - DNA, 10 bp, Homo sapiens
gagtggaggc

SEQ ID NO: 325430 - DNA, 20 bp, Homo sapiens
gagtggaggggtcagcaggg

SEQ ID NO: 325431 - DNA, 16 bp, Homo sapiens
gagtggatagatgccc

SEQ ID NO: 325432 - DNA, 18 bp, Homo sapiens
gagtggatctggagtctg

SEQ ID NO: 325433 - DNA, 15 bp, Homo sapiens
gagtggcagccatgc

SEQ ID NO: 325434 - DNA, 21 bp, Homo sapiens
gagtggcagctgtcccctctc

SEQ ID NO: 325435 - DNA, 14 bp, Homo sapiens
gagtggcccctggc

SEQ ID NO: 325436 - DNA, 18 bp, Homo sapiens
gagtggcctcatttcact

SEQ ID NO: 325437 - DNA, 20 bp, Homo sapiens
gagtggcctggccaggagct

SEQ ID NO: 325438 - DNA, 13 bp, Homo sapiens
gagtggctcctcc

SEQ ID NO: 325439 - DNA, 17 bp, Homo sapiens
gagtgggacagagtctg

SEQ ID NO: 325440 - DNA, 14 bp, Homo sapiens
gagtgggccccctc

SEQ ID NO: 325441 - DNA, 22 bp, Homo sapiens
gagtgggctgggccctctgtcc

SEQ ID NO: 325442 - DNA, 19 bp, Homo sapiens
gagtgggggagagcaggct

SEQ ID NO: 325443 - DNA, 22 bp, Homo sapiens
gagtgggggagagcaggctggc

SEQ ID NO: 325444 - DNA, 15 bp, Homo sapiens
gagtggggtttgctt

SEQ ID NO: 325445 - DNA, 21 bp, Homo sapiens
gagtggtctttctggagaggt

SEQ ID NO: 325446 - DNA, 15 bp, Homo sapiens
gagtggtggcagctc

SEQ ID NO: 325447 - DNA, 21 bp, Homo sapiens
gagtggtttttcttttcttgg

SEQ ID NO: 325448 - DNA, 14 bp, Homo sapiens
gagtgtaagtgtga

SEQ ID NO: 325449 - DNA, 20 bp, Homo sapiens
gagtgtaagtgtgagtaaga

SEQ ID NO: 325450 - DNA, 23 bp, Homo sapiens
gagtgtagactggccatgcaagt

SEQ ID NO: 325451 - DNA, 20 bp, Homo sapiens
gagtgtcaactccaggactt

SEQ ID NO: 325452 - DNA, 14 bp, Homo sapiens
gagtgtcaggctct

SEQ ID NO: 325453 - DNA, 19 bp, Homo sapiens
gagtgtgctcaggccgggc

SEQ ID NO: 325454 - DNA, 20 bp, Homo sapiens
gagtgtgctcaggccgggct

SEQ ID NO: 325455 - DNA, 16 bp, Homo sapiens
gagtgtggctcccctc

SEQ ID NO: 325456 - DNA, 19 bp, Homo sapiens
gagtgtgtagaaacacagc

SEQ ID NO: 325457 - DNA, 18 bp, Homo sapiens
gagtgtgtattgttccca

SEQ ID NO: 325458 - DNA, 21 bp, Homo sapiens
gagtgtgtccaagtgtgtgtg

SEQ ID NO: 325459 - DNA, 11 bp, Homo sapiens
gagtgtgtgca

SEQ ID NO: 325460 - DNA, 19 bp, Homo sapiens
gagtgtgtgcatgtgtgtg

SEQ ID NO: 325461 - DNA, 19 bp, Homo sapiens
gagtgtgtgtttgtgctga

SEQ ID NO: 325462 - DNA, 22 bp, Homo sapiens
gagtgttcattttagtgactgt

SEQ ID NO: 325463 - DNA, 18 bp, Homo sapiens
gagtgttctgtgggcttg

SEQ ID NO: 325464 - DNA, 19 bp, Homo sapiens
gagtgttctgtgggcttgg

SEQ ID NO: 325465 - DNA, 13 bp, Homo sapiens
gagttacagacaa

SEQ ID NO: 325466 - DNA, 17 bp, Homo sapiens
gagttacattaatgtta

SEQ ID NO: 325467 - DNA, 21 bp, Homo sapiens
gagttacttgtctgaggcctc

SEQ ID NO: 325468 - DNA, 19 bp, Homo sapiens
gagttaggttaataaatca

SEQ ID NO: 325469 - DNA, 20 bp, Homo sapiens
gagttatatgacttcttgtt

SEQ ID NO: 325470 - DNA, 21 bp, Homo sapiens
gagttattcactctcccagag

SEQ ID NO: 325471 - DNA, 15 bp, Homo sapiens
gagttcaaatacttt

SEQ ID NO: 325472 - DNA, 16 bp, Homo sapiens
gagttcaatgatctag

SEQ ID NO: 325473 - DNA, 19 bp, Homo sapiens
gagttcaatgatctaggtt

SEQ ID NO: 325474 - DNA, 21 bp, Homo sapiens
gagttcagggaggggctgagt

SEQ ID NO: 325475 - DNA, 20 bp, Homo sapiens
gagttcatcttgaattgtaa

SEQ ID NO: 325476 - DNA, 17 bp, Homo sapiens
gagttcctagcaagttg

SEQ ID NO: 325477 - DNA, 11 bp, Homo sapiens
gagttctacat

SEQ ID NO: 325478 - DNA, 21 bp, Homo sapiens
gagttctcactatgtttctca

SEQ ID NO: 325479 - DNA, 12 bp, Homo sapiens
gagttctttgct

SEQ ID NO: 325480 - DNA, 22 bp, Homo sapiens
gagttctttgctgcccctgtct

SEQ ID NO: 325481 - DNA, 17 bp, Homo sapiens
gagttgaccttctgaac

SEQ ID NO: 325482 - DNA, 22 bp, Homo sapiens
gagttgagcacaggcaacatta

SEQ ID NO: 325483 - DNA, 23 bp, Homo sapiens
gagttgctcctacccctgtcctg

SEQ ID NO: 325484 - DNA, 14 bp, Homo sapiens
gagttgctcctcag

SEQ ID NO: 325485 - DNA, 20 bp, Homo sapiens
gagttggcaaaatggggttt

SEQ ID NO: 325486 - DNA, 16 bp, Homo sapiens
gagttggggaaggcaa

SEQ ID NO: 325487 - DNA, 14 bp, Homo sapiens
gagtttaccatttg

SEQ ID NO: 325488 - DNA, 20 bp, Homo sapiens
gagtttcctcaggctgctgg

SEQ ID NO: 325489 - DNA, 21 bp, Homo sapiens
gagtttcctcaggctgctgga

SEQ ID NO: 325490 - DNA, 22 bp, Homo sapiens
gagtttgagacaagccctggca

SEQ ID NO: 325491 - DNA, 17 bp, Homo sapiens
gagtttgcaatgtcaca

SEQ ID NO: 325492 - DNA, 13 bp, Homo sapiens
gagtttgccctgg

SEQ ID NO: 325493 - DNA, 21 bp, Homo sapiens
gagttttctctttgtggggct

SEQ ID NO: 325494 - DNA, 14 bp, Homo sapiens
gagttttcttcctt

SEQ ID NO: 325495 - DNA, 17 bp, Homo sapiens
gataaaaaagaaaacat

SEQ ID NO: 325496 - DNA, 14 bp, Homo sapiens
gataaaaagatggc

SEQ ID NO: 325497 - DNA, 23 bp, Homo sapiens
gataaaagatacatttgtatgtt

SEQ ID NO: 325498 - DNA, 19 bp, Homo sapiens
gataaaagggcaaatctgc

SEQ ID NO: 325499 - DNA, 21 bp, Homo sapiens
gataaaataagtaacatataa

SEQ ID NO: 325500 - DNA, 16 bp, Homo sapiens
gataaaatgttccttt

SEQ ID NO: 325501 - DNA, 21 bp, Homo sapiens
gataaacacagaggttttaaa

SEQ ID NO: 325502 - DNA, 23 bp, Homo sapiens
gataaacacagaggttttaaaca

SEQ ID NO: 325503 - DNA, 12 bp, Homo sapiens
gataaagatgat

SEQ ID NO: 325504 - DNA, 13 bp, Homo sapiens
gataaagatgatc

SEQ ID NO: 325505 - DNA, 14 bp, Homo sapiens
gataaagtgaccag

SEQ ID NO: 325506 - DNA, 18 bp, Homo sapiens
gataaatcatttcagtat

SEQ ID NO: 325507 - DNA, 15 bp, Homo sapiens
gataaccagctgtaa

SEQ ID NO: 325508 - DNA, 23 bp, Homo sapiens
gataacctatatgatttatagtt

SEQ ID NO: 325509 - DNA, 22 bp, Homo sapiens
gataacctgtacttcaagttaa

SEQ ID NO: 325510 - DNA, 18 bp, Homo sapiens
gataacgcaggagagaga

SEQ ID NO: 325511 - DNA, 15 bp, Homo sapiens
gataacttaaataat

SEQ ID NO: 325512 - DNA, 17 bp, Homo sapiens
gataagaatgctggttt

SEQ ID NO: 325513 - DNA, 15 bp, Homo sapiens
gataagactggaaaa

SEQ ID NO: 325514 - DNA, 22 bp, Homo sapiens
gataagacttgtttctttctgt

SEQ ID NO: 325515 - DNA, 23 bp, Homo sapiens
gataagacttgtttctttctgtc

SEQ ID NO: 325516 - DNA, 16 bp, Homo sapiens
gataagagttggctgg

SEQ ID NO: 325517 - DNA, 21 bp, Homo sapiens
gataaggaaactgaggcccag

SEQ ID NO: 325518 - DNA, 20 bp, Homo sapiens
gataaggatgatacagtctc

SEQ ID NO: 325519 - DNA, 17 bp, Homo sapiens
gataagggagagggaaa

SEQ ID NO: 325520 - DNA, 22 bp, Homo sapiens
gataataaattgaaattgtgaa

SEQ ID NO: 325521 - DNA, 22 bp, Homo sapiens
gataatcaattattacatttat

SEQ ID NO: 325522 - DNA, 13 bp, Homo sapiens
gataatcagcctc

SEQ ID NO: 325523 - DNA, 14 bp, Homo sapiens
gataatcagcctct

SEQ ID NO: 325524 - DNA, 16 bp, Homo sapiens
gataatcagcctctta

SEQ ID NO: 325525 - DNA, 21 bp, Homo sapiens
gataatcagtgtgtctaaatt

SEQ ID NO: 325526 - DNA, 15 bp, Homo sapiens
gataatcttcggcca

SEQ ID NO: 325527 - DNA, 18 bp, Homo sapiens
gataatcttcggccaatt

SEQ ID NO: 325528 - DNA, 18 bp, Homo sapiens
gataatgaaatagttatt

SEQ ID NO: 325529 - DNA, 22 bp, Homo sapiens
gataatgttctttaatgttgtc

SEQ ID NO: 325530 - DNA, 21 bp, Homo sapiens
gataatttgcatattctattg

SEQ ID NO: 325531 - DNA, 17 bp, Homo sapiens
gataattttgcataaaa

SEQ ID NO: 325532 - DNA, 17 bp, Homo sapiens
gataatttttaaaagag

SEQ ID NO: 325533 - DNA, 18 bp, Homo sapiens
gataatttttaaaagagg

SEQ ID NO: 325534 - DNA, 15 bp, Homo sapiens
gatacaaactttgtt

SEQ ID NO: 325535 - DNA, 19 bp, Homo sapiens
gatacaagtttcagacagg

SEQ ID NO: 325536 - DNA, 14 bp, Homo sapiens
gatacaatcagctg

SEQ ID NO: 325537 - DNA, 15 bp, Homo sapiens
gatacaatcagctgc

SEQ ID NO: 325538 - DNA, 23 bp, Homo sapiens
gatacacaagagggactgtattt

SEQ ID NO: 325539 - DNA, 19 bp, Homo sapiens
gatacagatccgcatgtgt

SEQ ID NO: 325540 - DNA, 22 bp, Homo sapiens
gatcggaggcttgtcagagctg

SEQ ID NO: 325541 - DNA, 18 bp, Homo sapiens
gatcgtggccaacgtgga

SEQ ID NO: 325542 - DNA, 20 bp, Homo sapiens
gatctaaggcatgctcccag

SEQ ID NO: 325543 - DNA, 18 bp, Homo sapiens
gatctaccagcataaata

SEQ ID NO: 325544 - DNA, 15 bp, Homo sapiens
gatctagccaggcct

SEQ ID NO: 325545 - DNA, 15 bp, Homo sapiens
gatctaggtttaact

SEQ ID NO: 325546 - DNA, 17 bp, Homo sapiens
gatctaggtttaactca

SEQ ID NO: 325547 - DNA, 18 bp, Homo sapiens
gatctaggtttaactcag

SEQ ID NO: 325548 - DNA, 21 bp, Homo sapiens
gatctaggtttaactcagatc

SEQ ID NO: 325549 - DNA, 21 bp, Homo sapiens
gatctagttctcaatcactgc

SEQ ID NO: 325550 - DNA, 13 bp, Homo sapiens
gatctataaagcg

SEQ ID NO: 325551 - DNA, 14 bp, Homo sapiens
gatctatcacctgt

SEQ ID NO: 325552 - DNA, 17 bp, Homo sapiens
gatctcattcagtatta

SEQ ID NO: 325553 - DNA, 11 bp, Homo sapiens
gatctccaggc

SEQ ID NO: 325554 - DNA, 13 bp, Homo sapiens
gatctccaggccc

SEQ ID NO: 325555 - DNA, 15 bp, Homo sapiens
gatctccaggcccag

SEQ ID NO: 325556 - DNA, 16 bp, Homo sapiens
gatctccaggcccagc

SEQ ID NO: 325557 - DNA, 17 bp, Homo sapiens
gatctcctgacctcatg

SEQ ID NO: 325558 - DNA, 13 bp, Homo sapiens
gatctctcaggag

SEQ ID NO: 325559 - DNA, 21 bp, Homo sapiens
gatctctcaggagcacaggca

SEQ ID NO: 325560 - DNA, 23 bp, Homo sapiens
gatctctcaggagcacaggcagc

SEQ ID NO: 325561 - DNA, 19 bp, Homo sapiens
gatctgacatgattccttc

SEQ ID NO: 325562 - DNA, 18 bp, Homo sapiens
tcattatttattaaattt

SEQ ID NO: 325563 - DNA, 16 bp, Homo sapiens
tcattatttgataaca

SEQ ID NO: 325564 - DNA, 18 bp, Homo sapiens
tcattatttgataacatt

SEQ ID NO: 325565 - DNA, 12 bp, Homo sapiens
tcattcactgtc

SEQ ID NO: 325566 - DNA, 17 bp, Homo sapiens
tcattccaacagtgagt

SEQ ID NO: 325567 - DNA, 19 bp, Homo sapiens
tcattccatgtgcccagtt

SEQ ID NO: 325568 - DNA, 18 bp, Homo sapiens
tcattcccactgcacttg

SEQ ID NO: 325569 - DNA, 15 bp, Homo sapiens
tcattccgttaggaa

SEQ ID NO: 325570 - DNA, 17 bp, Homo sapiens
tcattccgttaggaata

SEQ ID NO: 325571 - DNA, 17 bp, Homo sapiens
tcattcctaacacagca

SEQ ID NO: 325572 - DNA, 12 bp, Homo sapiens
tcattcctctgt

SEQ ID NO: 325573 - DNA, 14 bp, Homo sapiens
tcattctagcacct

SEQ ID NO: 325574 - DNA, 18 bp, Homo sapiens
tcattctatgacaataaa

SEQ ID NO: 325575 - DNA, 16 bp, Homo sapiens
tcattctccttgtaaa

SEQ ID NO: 325576 - DNA, 23 bp, Homo sapiens
tcattcttacaattgcactgctg

SEQ ID NO: 325577 - DNA, 17 bp, Homo sapiens
tcattcttgaaagctgt

SEQ ID NO: 325578 - DNA, 11 bp, Homo sapiens
tcattcttttc

SEQ ID NO: 325579 - DNA, 22 bp, Homo sapiens
tcattgacttcaagatgcctct

SEQ ID NO: 325580 - DNA, 18 bp, Homo sapiens
tcattgagaaataaagca

SEQ ID NO: 325581 - DNA, 23 bp, Homo sapiens
tcattgagggaaaacataatatc

SEQ ID NO: 325582 - DNA, 14 bp, Homo sapiens
tcattgccagtggt

SEQ ID NO: 325583 - DNA, 14 bp, Homo sapiens
tcattgccttccta

SEQ ID NO: 325584 - DNA, 20 bp, Homo sapiens
tcattgctacacttacaagt

SEQ ID NO: 325585 - DNA, 11 bp, Homo sapiens
tcattgcttta

SEQ ID NO: 325586 - DNA, 15 bp, Homo sapiens
tcattgctttactgg

SEQ ID NO: 325587 - DNA, 18 bp, Homo sapiens
tcattggataaatttgaa

SEQ ID NO: 325588 - DNA, 12 bp, Homo sapiens
tcattggatgca

SEQ ID NO: 325589 - DNA, 23 bp, Homo sapiens
tcattgggctgttttctcaacaa

SEQ ID NO: 325590 - DNA, 16 bp, Homo sapiens
tcattgtaatgttact

SEQ ID NO: 325591 - DNA, 15 bp, Homo sapiens
tcattgtatatatgt

SEQ ID NO: 325592 - DNA, 17 bp, Homo sapiens
tcattgtatatatgtgt

SEQ ID NO: 325593 - DNA, 22 bp, Homo sapiens
tcattgtatatatgtgtgttta

SEQ ID NO: 325594 - DNA, 14 bp, Homo sapiens
tcattgtatgatgt

SEQ ID NO: 325595 - DNA, 15 bp, Homo sapiens
tcattgtcgctcagc

SEQ ID NO: 325596 - DNA, 14 bp, Homo sapiens
tcattgtgtgtctt

SEQ ID NO: 325597 - DNA, 13 bp, Homo sapiens
tcatttaaaatga

SEQ ID NO: 325598 - DNA, 16 bp, Homo sapiens
tcatttaaaatgatta

SEQ ID NO: 325599 - DNA, 18 bp, Homo sapiens
tcatttatcaagcagaga

SEQ ID NO: 325600 - DNA, 11 bp, Homo sapiens
tcatttatgat

SEQ ID NO: 325601 - DNA, 15 bp, Homo sapiens
tcatttcagagccct

SEQ ID NO: 325602 - DNA, 21 bp, Homo sapiens
tcatttccagcaaaatatatg

SEQ ID NO: 325603 - DNA, 23 bp, Homo sapiens
tcatttccagcaaaatatatgtt

SEQ ID NO: 325604 - DNA, 19 bp, Homo sapiens
tcatttcctctgagctgtt

SEQ ID NO: 325605 - DNA, 21 bp, Homo sapiens
tcatttcctctgagctgttat

SEQ ID NO: 325606 - DNA, 23 bp, Homo sapiens
tcatttctcactgtgtacataat

SEQ ID NO: 325607 - DNA, 16 bp, Homo sapiens
tcatttctgtctcccc

SEQ ID NO: 325608 - DNA, 16 bp, Homo sapiens
tcatttctttcaagac

SEQ ID NO: 325609 - DNA, 22 bp, Homo sapiens
tcatttctttttgggagagact

SEQ ID NO: 325610 - DNA, 18 bp, Homo sapiens
tcatttgaggccaggagt

SEQ ID NO: 325611 - DNA, 16 bp, Homo sapiens
tcatttgcagctgctg

SEQ ID NO: 325612 - DNA, 12 bp, Homo sapiens
tcatttgctaat

SEQ ID NO: 325613 - DNA, 12 bp, Homo sapiens
tcatttgtgtca

SEQ ID NO: 325614 - DNA, 14 bp, Homo sapiens
tcattttagtgact

SEQ ID NO: 325615 - DNA, 19 bp, Homo sapiens
tcattttccccccactctc

SEQ ID NO: 325616 - DNA, 13 bp, Homo sapiens
tcattttcctttc

SEQ ID NO: 325617 - DNA, 14 bp, Homo sapiens
tcattttcctttct

SEQ ID NO: 325618 - DNA, 16 bp, Homo sapiens
tcattttcctttctgt

SEQ ID NO: 325619 - DNA, 17 bp, Homo sapiens
tcattttcctttctgta

SEQ ID NO: 325620 - DNA, 18 bp, Homo sapiens
tcattttggttttgtgtt

SEQ ID NO: 325621 - DNA, 20 bp, Homo sapiens
tcattttgtatgtatgtgta

SEQ ID NO: 325622 - DNA, 13 bp, Homo sapiens
tcattttgtgtaa

SEQ ID NO: 325623 - DNA, 17 bp, Homo sapiens
tcatttttgccatacat

SEQ ID NO: 325624 - DNA, 19 bp, Homo sapiens
tccaaaaacagtgattaaa

SEQ ID NO: 325625 - DNA, 12 bp, Homo sapiens
tccaaaaatact

SEQ ID NO: 325626 - DNA, 16 bp, Homo sapiens
tccaaaccaaataaaa

SEQ ID NO: 325627 - DNA, 12 bp, Homo sapiens
tccaaaccactt

SEQ ID NO: 325628 - DNA, 14 bp, Homo sapiens
tccaaactcctgcc

SEQ ID NO: 325629 - DNA, 15 bp, Homo sapiens
tccaaagactgtact

SEQ ID NO: 325630 - DNA, 15 bp, Homo sapiens
tccaaagctttcctg

SEQ ID NO: 325631 - DNA, 15 bp, Homo sapiens
tccaaaggaggctgg

SEQ ID NO: 325632 - DNA, 16 bp, Homo sapiens
tccaaaggggctgctg

SEQ ID NO: 325633 - DNA, 18 bp, Homo sapiens
tccaaaggggctgctggg

SEQ ID NO: 325634 - DNA, 16 bp, Homo sapiens
tccaaaggttgtacat

SEQ ID NO: 325635 - DNA, 17 bp, Homo sapiens
tccaaataagaaaccta

SEQ ID NO: 325636 - DNA, 17 bp, Homo sapiens
tccaaatacattccagt

SEQ ID NO: 325637 - DNA, 18 bp, Homo sapiens
tccaaatcttgaatttct

SEQ ID NO: 325638 - DNA, 16 bp, Homo sapiens
tccaaatgcattcatg

SEQ ID NO: 325639 - DNA, 18 bp, Homo sapiens
tccaaatgcattcatgtt

SEQ ID NO: 325640 - DNA, 19 bp, Homo sapiens
tccaaatgcattcatgttt

SEQ ID NO: 325641 - DNA, 17 bp, Homo sapiens
tccaaatgctgtgcaaa

SEQ ID NO: 325642 - DNA, 17 bp, Homo sapiens
tccaaatgtcctccaga

SEQ ID NO: 325643 - DNA, 14 bp, Homo sapiens
tccaaattctctga

SEQ ID NO: 325644 - DNA, 15 bp, Homo sapiens
tccaaattgatgggt

SEQ ID NO: 325645 - DNA, 18 bp, Homo sapiens
tccaaattgatgggtggg

SEQ ID NO: 325646 - DNA, 17 bp, Homo sapiens
tccaaatttgaatggat

SEQ ID NO: 325647 - DNA, 20 bp, Homo sapiens
tccaacaactccaggaaaac

SEQ ID NO: 325648 - DNA, 14 bp, Homo sapiens
tccaacacaagttg

SEQ ID NO: 325649 - DNA, 16 bp, Homo sapiens
tccaacaccacagaca

SEQ ID NO: 325650 - DNA, 16 bp, Homo sapiens
tccaacactttgagca

SEQ ID NO: 325651 - DNA, 21 bp, Homo sapiens
tccaacactttgagcattttt

SEQ ID NO: 325652 - DNA, 13 bp, Homo sapiens
tccaacagtgagt

SEQ ID NO: 325653 - DNA, 15 bp, Homo sapiens
tccaacccaaagtat

SEQ ID NO: 325654 - DNA, 15 bp, Homo sapiens
tccaacccatgcatg

SEQ ID NO: 325655 - DNA, 18 bp, Homo sapiens
tccaacccatgcatggcc

SEQ ID NO: 325656 - DNA, 22 bp, Homo sapiens
tccaacccatgcatggcctccc

SEQ ID NO: 325657 - DNA, 23 bp, Homo sapiens
tccaacctctttcctctctggcc

SEQ ID NO: 325658 - DNA, 14 bp, Homo sapiens
tccaactcaggtta

SEQ ID NO: 325659 - DNA, 12 bp, Homo sapiens
tccaactgctgc

SEQ ID NO: 325660 - DNA, 15 bp, Homo sapiens
tccaacttaggctac

SEQ ID NO: 325661 - DNA, 15 bp, Homo sapiens
tccaacttcatttga

SEQ ID NO: 325662 - DNA, 12 bp, Homo sapiens
tccaagaaactt

SEQ ID NO: 325663 - DNA, 22 bp, Homo sapiens
tccaagaagccctccttgccac

SEQ ID NO: 325664 - DNA, 13 bp, Homo sapiens
tccaagaatgttt

SEQ ID NO: 325665 - DNA, 15 bp, Homo sapiens
tccaagacattgtca

SEQ ID NO: 325666 - DNA, 16 bp, Homo sapiens
tccaagacattgtcaa

SEQ ID NO: 325667 - DNA, 17 bp, Homo sapiens
tccaagacattgtcaat

SEQ ID NO: 325668 - DNA, 18 bp, Homo sapiens
tccaagaccttacaacca

SEQ ID NO: 325669 - DNA, 12 bp, Homo sapiens
tccaagagaatt

SEQ ID NO: 325670 - DNA, 17 bp, Homo sapiens
tccaagcatcagcaaga

SEQ ID NO: 325671 - DNA, 18 bp, Homo sapiens
tccaagcctaaaattaaa

SEQ ID NO: 325672 - DNA, 23 bp, Homo sapiens
gattaatccattttaacaaacaa

SEQ ID NO: 325673 - DNA, 23 bp, Homo sapiens
gattaatgtgtatttactgtact

SEQ ID NO: 325674 - DNA, 12 bp, Homo sapiens
gattacaaatag

SEQ ID NO: 325675 - DNA, 18 bp, Homo sapiens
gattacaggcatgtgcca

SEQ ID NO: 325676 - DNA, 20 bp, Homo sapiens
gattacagggatgagccacc

SEQ ID NO: 325677 - DNA, 18 bp, Homo sapiens
gattactgtcaataaaca

SEQ ID NO: 325678 - DNA, 22 bp, Homo sapiens
gattagaagccaagacagtggc

SEQ ID NO: 325679 - DNA, 14 bp, Homo sapiens
gattagagggaggt

SEQ ID NO: 325680 - DNA, 20 bp, Homo sapiens
gattagagggaggtgtttaa

SEQ ID NO: 325681 - DNA, 14 bp, Homo sapiens
gattatagatactt

SEQ ID NO: 325682 - DNA, 17 bp, Homo sapiens
gattatattgagacaaa

SEQ ID NO: 325683 - DNA, 14 bp, Homo sapiens
gattatgggtcaca

SEQ ID NO: 325684 - DNA, 15 bp, Homo sapiens
gattatggttttgtg

SEQ ID NO: 325685 - DNA, 23 bp, Homo sapiens
gattattaactaatatgggcatt

SEQ ID NO: 325686 - DNA, 20 bp, Homo sapiens
gattattagccaggtaatgt

SEQ ID NO: 325687 - DNA, 14 bp, Homo sapiens
gattattatctaaa

SEQ ID NO: 325688 - DNA, 13 bp, Homo sapiens
gattattcattta

SEQ ID NO: 325689 - DNA, 19 bp, Homo sapiens
gattattcatttaaaatga

SEQ ID NO: 325690 - DNA, 14 bp, Homo sapiens
gattcaaatgcatg

SEQ ID NO: 325691 - DNA, 15 bp, Homo sapiens
gattcaaccctggct

SEQ ID NO: 325692 - DNA, 18 bp, Homo sapiens
gattcaataaaatgcact

SEQ ID NO: 325693 - DNA, 20 bp, Homo sapiens
gattcaatcattttgggaaa

SEQ ID NO: 325694 - DNA, 14 bp, Homo sapiens
gattcacatctgca

SEQ ID NO: 325695 - DNA, 13 bp, Homo sapiens
gattcacctgtaa

SEQ ID NO: 325696 - DNA, 16 bp, Homo sapiens
gattcacctgtaaaac

SEQ ID NO: 325697 - DNA, 22 bp, Homo sapiens
gattcacctgtaaaactttatt

SEQ ID NO: 325698 - DNA, 15 bp, Homo sapiens
gattcataacaatgt

SEQ ID NO: 325699 - DNA, 12 bp, Homo sapiens
gattccaaataa

SEQ ID NO: 325700 - DNA, 13 bp, Homo sapiens
gattccaaataaa

SEQ ID NO: 325701 - DNA, 20 bp, Homo sapiens
gattccagagagtggctcct

SEQ ID NO: 325702 - DNA, 22 bp, Homo sapiens
gattccagagagtggctcctcc

SEQ ID NO: 325703 - DNA, 20 bp, Homo sapiens
gattccagttgcgtgtctgt

SEQ ID NO: 325704 - DNA, 14 bp, Homo sapiens
gattccatctcctt

SEQ ID NO: 325705 - DNA, 15 bp, Homo sapiens
gattccatctccttg

SEQ ID NO: 325706 - DNA, 20 bp, Homo sapiens
gattccattttatacaagaa

SEQ ID NO: 325707 - DNA, 16 bp, Homo sapiens
gattccattttggaaa

SEQ ID NO: 325708 - DNA, 18 bp, Homo sapiens
gattccattttggaaaat

SEQ ID NO: 325709 - DNA, 13 bp, Homo sapiens
gattcccagagca

SEQ ID NO: 325710 - DNA, 23 bp, Homo sapiens
tccagacagagtggatctggagt

SEQ ID NO: 325711 - DNA, 13 bp, Homo sapiens
tccagacatcatg

SEQ ID NO: 325712 - DNA, 21 bp, Homo sapiens
tccagacatcatgaattttac

SEQ ID NO: 325713 - DNA, 9 bp, Homo sapiens
tccagaccc

SEQ ID NO: 325714 - DNA, 14 bp, Homo sapiens
tccagacccccacc

SEQ ID NO: 325715 - DNA, 17 bp, Homo sapiens
tccagacccccacccct

SEQ ID NO: 325716 - DNA, 21 bp, Homo sapiens
tccagacccccaccccttccc

SEQ ID NO: 325717 - DNA, 22 bp, Homo sapiens
tccagacccccaccccttcccc

SEQ ID NO: 325718 - DNA, 15 bp, Homo sapiens
tccagacccccagca

SEQ ID NO: 325719 - DNA, 11 bp, Homo sapiens
tccagacccct

SEQ ID NO: 325720 - DNA, 13 bp, Homo sapiens
tccagacccctgg

SEQ ID NO: 325721 - DNA, 16 bp, Homo sapiens
tccagacccctggctt

SEQ ID NO: 325722 - DNA, 13 bp, Homo sapiens
tccagacctgggc

SEQ ID NO: 325723 - DNA, 15 bp, Homo sapiens
tccagacctgggccc

SEQ ID NO: 325724 - DNA, 14 bp, Homo sapiens
tccagagaccacac

SEQ ID NO: 325725 - DNA, 20 bp, Homo sapiens
tccagagagaagcaccccac

SEQ ID NO: 325726 - DNA, 22 bp, Homo sapiens
tccagagagaagcaccccacca

SEQ ID NO: 325727 - DNA, 19 bp, Homo sapiens
tccagagagagaagtgccc

SEQ ID NO: 325728 - DNA, 21 bp, Homo sapiens
tccagagagagaagtgcccct

SEQ ID NO: 325729 - DNA, 23 bp, Homo sapiens
tccagagagagaagtgcccctgc

SEQ ID NO: 325730 - DNA, 16 bp, Homo sapiens
tccagagagtggctcc

SEQ ID NO: 325731 - DNA, 16 bp, Homo sapiens
tccagagccagcctgg

SEQ ID NO: 325732 - DNA, 17 bp, Homo sapiens
tccagaggggtcacgtg

SEQ ID NO: 325733 - DNA, 13 bp, Homo sapiens
tccagaggtgagg

SEQ ID NO: 325734 - DNA, 15 bp, Homo sapiens
tccagagtctgagcc

SEQ ID NO: 325735 - DNA, 17 bp, Homo sapiens
tccagagtctgagcccc

SEQ ID NO: 325736 - DNA, 22 bp, Homo sapiens
tccagagtctgagcccccggct

SEQ ID NO: 325737 - DNA, 14 bp, Homo sapiens
tccagatccagact

SEQ ID NO: 325738 - DNA, 17 bp, Homo sapiens
tccagatccagactgta

SEQ ID NO: 325739 - DNA, 13 bp, Homo sapiens
tccagatgtctaa

SEQ ID NO: 325740 - DNA, 17 bp, Homo sapiens
tccagattgacgacaag

SEQ ID NO: 325741 - DNA, 22 bp, Homo sapiens
tccagattggcacccctttcta

SEQ ID NO: 325742 - DNA, 18 bp, Homo sapiens
tccagcaattctcctgcc

SEQ ID NO: 325743 - DNA, 16 bp, Homo sapiens
tccagcacctttgtaa

SEQ ID NO: 325744 - DNA, 14 bp, Homo sapiens
tccagcagctgcgg

SEQ ID NO: 325745 - DNA, 15 bp, Homo sapiens
tccagcagtgaaact

SEQ ID NO: 325746 - DNA, 22 bp, Homo sapiens
tccagcagtgaaacttgtgcta

SEQ ID NO: 325747 - DNA, 13 bp, Homo sapiens
tccagccaacccc

SEQ ID NO: 325748 - DNA, 16 bp, Homo sapiens
tccagccaacccctgt

SEQ ID NO: 325749 - DNA, 18 bp, Homo sapiens
tccagccacccagccagg

SEQ ID NO: 325750 - DNA, 21 bp, Homo sapiens
tccagccacccagccaggagg

SEQ ID NO: 325751 - DNA, 17 bp, Homo sapiens
tccagcccacagtgctc

SEQ ID NO: 325752 - DNA, 18 bp, Homo sapiens
tccagcccacagtgctca

SEQ ID NO: 325753 - DNA, 20 bp, Homo sapiens
tccagcccagacccccagtg

SEQ ID NO: 325754 - DNA, 21 bp, Homo sapiens
tccagcccagacccccagtgt

SEQ ID NO: 325755 - DNA, 21 bp, Homo sapiens
tccagcccgagtggtctcctc

SEQ ID NO: 325756 - DNA, 19 bp, Homo sapiens
tccagccctattctgccac

SEQ ID NO: 325757 - DNA, 22 bp, Homo sapiens
tccagccgcaaatccatacccc

SEQ ID NO: 325758 - DNA, 19 bp, Homo sapiens
tccagccgccattgccacc

SEQ ID NO: 325759 - DNA, 22 bp, Homo sapiens
tccagccgccattgccaccagg

SEQ ID NO: 325760 - DNA, 15 bp, Homo sapiens
tccagcctcccctcc

SEQ ID NO: 325761 - DNA, 19 bp, Homo sapiens
tccagcctgggcagccagg

SEQ ID NO: 325762 - DNA, 22 bp, Homo sapiens
tccagcctgggcagccaggctg

SEQ ID NO: 325763 - DNA, 23 bp, Homo sapiens
tccagcgagtaccccagccactc

SEQ ID NO: 325764 - DNA, 19 bp, Homo sapiens
tccagcggttgcctttttt

SEQ ID NO: 325765 - DNA, 23 bp, Homo sapiens
tccagcggttgccttttttatca

SEQ ID NO: 325766 - DNA, 15 bp, Homo sapiens
tccagctccctagac

SEQ ID NO: 325767 - DNA, 16 bp, Homo sapiens
tccagctccctagact

SEQ ID NO: 325768 - DNA, 18 bp, Homo sapiens
tccagctccttaaactga

SEQ ID NO: 325769 - DNA, 16 bp, Homo sapiens
tccagctctgcccccg

SEQ ID NO: 325770 - DNA, 15 bp, Homo sapiens
tccagctctttcctc

SEQ ID NO: 325771 - DNA, 21 bp, Homo sapiens
tccagctctttcctccttcca

SEQ ID NO: 325772 - DNA, 12 bp, Homo sapiens
tccagctgacat

SEQ ID NO: 325773 - DNA, 16 bp, Homo sapiens
tccagcttcggagggc

SEQ ID NO: 325774 - DNA, 20 bp, Homo sapiens
tccagcttctggtactctcc

SEQ ID NO: 325775 - DNA, 14 bp, Homo sapiens
tccagcttttgtag

SEQ ID NO: 325776 - DNA, 16 bp, Homo sapiens
tccaggaaaactgttt

SEQ ID NO: 325777 - DNA, 17 bp, Homo sapiens
tccaggaagcacaggcc

SEQ ID NO: 325778 - DNA, 19 bp, Homo sapiens
tccaggaagcacaggccag

SEQ ID NO: 325779 - DNA, 15 bp, Homo sapiens
tccaggaaggcagct

SEQ ID NO: 325780 - DNA, 19 bp, Homo sapiens
tccaggaaggcagctgctc

SEQ ID NO: 325781 - DNA, 17 bp, Homo sapiens
tccaggaaggggctgga

SEQ ID NO: 325782 - DNA, 13 bp, Homo sapiens
tccaggacccctg

SEQ ID NO: 325783 - DNA, 18 bp, Homo sapiens
tccaggagaccttccaca

SEQ ID NO: 325784 - DNA, 15 bp, Homo sapiens
tccaggagccccagc

SEQ ID NO: 325785 - DNA, 22 bp, Homo sapiens
tccaggagccccagccagccct

SEQ ID NO: 325786 - DNA, 22 bp, Homo sapiens
tccaggaggccggggggagcag

SEQ ID NO: 325787 - DNA, 23 bp, Homo sapiens
tccaggatcctcctggagcagca

SEQ ID NO: 325788 - DNA, 17 bp, Homo sapiens
tccaggatcctgcagga

SEQ ID NO: 325789 - DNA, 19 bp, Homo sapiens
tccaggatcctgcaggaac

SEQ ID NO: 325790 - DNA, 20 bp, Homo sapiens
tccaggatgttattcttcct

SEQ ID NO: 325791 - DNA, 16 bp, Homo sapiens
tccaggattgtccaca

SEQ ID NO: 325792 - DNA, 23 bp, Homo sapiens
tccaggattgtccacaaatgtcc

SEQ ID NO: 325793 - DNA, 19 bp, Homo sapiens
tccaggcatgctggcctcc

SEQ ID NO: 325794 - DNA, 21 bp, Homo sapiens
tccaggcatgggtcccttccc

SEQ ID NO: 325795 - DNA, 17 bp, Homo sapiens
tccaggccactgtggcc

SEQ ID NO: 325796 - DNA, 19 bp, Homo sapiens
tccaggccactgtggccag

SEQ ID NO: 325797 - DNA, 22 bp, Homo sapiens
tccaggccactgtggccagagc

SEQ ID NO: 325798 - DNA, 23 bp, Homo sapiens
tccaggccactgtggccagagct

SEQ ID NO: 325799 - DNA, 15 bp, Homo sapiens
tccaggccagctcct

SEQ ID NO: 325800 - DNA, 23 bp, Homo sapiens
tccaggccagctccttttctgtg

SEQ ID NO: 325801 - DNA, 20 bp, Homo sapiens
taccctcaaagtaggtatac

SEQ ID NO: 325802 - DNA, 13 bp, Homo sapiens
taccctcccaccc

SEQ ID NO: 325803 - DNA, 14 bp, Homo sapiens
taccctcccacccc

SEQ ID NO: 325804 - DNA, 15 bp, Homo sapiens
taccctcccaccccc

SEQ ID NO: 325805 - DNA, 19 bp, Homo sapiens
taccctccctgtcccctga

SEQ ID NO: 325806 - DNA, 18 bp, Homo sapiens
taccctcctctatttctt

SEQ ID NO: 325807 - DNA, 14 bp, Homo sapiens
taccctctctttca

SEQ ID NO: 325808 - DNA, 21 bp, Homo sapiens
taccctcttctcagctccact

SEQ ID NO: 325809 - DNA, 15 bp, Homo sapiens
taccctggcagagaa

SEQ ID NO: 325810 - DNA, 22 bp, Homo sapiens
taccctggcagagaagagacca

SEQ ID NO: 325811 - DNA, 22 bp, Homo sapiens
taccctttcctcctttatcaca

SEQ ID NO: 325812 - DNA, 19 bp, Homo sapiens
taccgaggagctaaacatg

SEQ ID NO: 325813 - DNA, 16 bp, Homo sapiens
taccgagtatctgtaa

SEQ ID NO: 325814 - DNA, 18 bp, Homo sapiens
taccgagtctcttctcca

SEQ ID NO: 325815 - DNA, 22 bp, Homo sapiens
taccgagtctcttctccactgg

SEQ ID NO: 325816 - DNA, 14 bp, Homo sapiens
taccgttcacttcc

SEQ ID NO: 325817 - DNA, 19 bp, Homo sapiens
tacctaaaaggaaatctca

SEQ ID NO: 325818 - DNA, 22 bp, Homo sapiens
tacctaaaaggaaatctcaccc

SEQ ID NO: 325819 - DNA, 15 bp, Homo sapiens
tacctaaacagatat

SEQ ID NO: 325820 - DNA, 19 bp, Homo sapiens
tacctaaacagatataaat

SEQ ID NO: 325821 - DNA, 19 bp, Homo sapiens
tacctaagtgacatttgta

SEQ ID NO: 325822 - DNA, 20 bp, Homo sapiens
tacctaattagagcagatga

SEQ ID NO: 325823 - DNA, 17 bp, Homo sapiens
tacctaccacagtgtct

SEQ ID NO: 325824 - DNA, 18 bp, Homo sapiens
tacctaccacagtgtctg

SEQ ID NO: 325825 - DNA, 18 bp, Homo sapiens
tacctattgctgtaaata

SEQ ID NO: 325826 - DNA, 22 bp, Homo sapiens
tacctcaacccccatttctatt

SEQ ID NO: 325827 - DNA, 18 bp, Homo sapiens
tacctcactggtgcattt

SEQ ID NO: 325828 - DNA, 13 bp, Homo sapiens
tacctcatttgca

SEQ ID NO: 325829 - DNA, 15 bp, Homo sapiens
tacctccaagcaagt

SEQ ID NO: 325830 - DNA, 19 bp, Homo sapiens
tacctccctcctgatgttt

SEQ ID NO: 325831 - DNA, 18 bp, Homo sapiens
tacctctaacaccacact

SEQ ID NO: 325832 - DNA, 23 bp, Homo sapiens
tacctctaacaccacactgacca

SEQ ID NO: 325833 - DNA, 23 bp, Homo sapiens
tacctctccagcctcagctctca

SEQ ID NO: 325834 - DNA, 21 bp, Homo sapiens
tacctctcttatagaatattt

SEQ ID NO: 325835 - DNA, 23 bp, Homo sapiens
tacctctcttatagaatatttat

SEQ ID NO: 325836 - DNA, 17 bp, Homo sapiens
tacctctgatacctcaa

SEQ ID NO: 325837 - DNA, 20 bp, Homo sapiens
tacctcttccaggaagcaca

SEQ ID NO: 325838 - DNA, 16 bp, Homo sapiens
tacctctttgaaagaa

SEQ ID NO: 325839 - DNA, 15 bp, Homo sapiens
tacctgatcccactc

SEQ ID NO: 325840 - DNA, 15 bp, Homo sapiens
tacctgcctaaaata

SEQ ID NO: 325841 - DNA, 18 bp, Homo sapiens
tacctgctgccccagctg

SEQ ID NO: 325842 - DNA, 10 bp, Homo sapiens
tacctggaaa

SEQ ID NO: 325843 - DNA, 18 bp, Homo sapiens
tacctgggaaaggaccca

SEQ ID NO: 325844 - DNA, 19 bp, Homo sapiens
tacctgggaaaggacccac

SEQ ID NO: 325845 - DNA, 16 bp, Homo sapiens
tacctgtagtgagaaa

SEQ ID NO: 325846 - DNA, 19 bp, Homo sapiens
tacctgtgcctgagaattt

SEQ ID NO: 325847 - DNA, 21 bp, Homo sapiens
tacctgttcagtgtcccgggc

SEQ ID NO: 325848 - DNA, 14 bp, Homo sapiens
taccttcaaagctg

SEQ ID NO: 325849 - DNA, 15 bp, Homo sapiens
taccttcaatactta

SEQ ID NO: 325850 - DNA, 14 bp, Homo sapiens
taccttcatttcat

SEQ ID NO: 325851 - DNA, 19 bp, Homo sapiens
taccttgaccctagaattc

SEQ ID NO: 325852 - DNA, 20 bp, Homo sapiens
tacctttaaatatcattctt

SEQ ID NO: 325853 - DNA, 22 bp, Homo sapiens
tacctttattaatgaactgtga

SEQ ID NO: 325854 - DNA, 21 bp, Homo sapiens
tacctttctgacaataaataa

SEQ ID NO: 325855 - DNA, 12 bp, Homo sapiens
tacctttctgag

SEQ ID NO: 325856 - DNA, 16 bp, Homo sapiens
tacctttctgagtctc

SEQ ID NO: 325857 - DNA, 14 bp, Homo sapiens
tacgactttatttt

SEQ ID NO: 325858 - DNA, 16 bp, Homo sapiens
tacgatgttaaaacaa

SEQ ID NO: 325859 - DNA, 23 bp, Homo sapiens
tacgcactacatgtggtttatag

SEQ ID NO: 325860 - DNA, 16 bp, Homo sapiens
tacgcagaggaatttt

SEQ ID NO: 325861 - DNA, 13 bp, Homo sapiens
tacgctcctgtct

SEQ ID NO: 325862 - DNA, 13 bp, Homo sapiens
tacgctctctgtc

SEQ ID NO: 325863 - DNA, 15 bp, Homo sapiens
tacggagggaccagg

SEQ ID NO: 325864 - DNA, 15 bp, Homo sapiens
tacggtgagactctg

SEQ ID NO: 325865 - DNA, 14 bp, Homo sapiens
tacggtgatattgt

SEQ ID NO: 325866 - DNA, 16 bp, Homo sapiens
tacggtgatattgtgc

SEQ ID NO: 325867 - DNA, 20 bp, Homo sapiens
tacgtataaatatgaaatga

SEQ ID NO: 325868 - DNA, 15 bp, Homo sapiens
tacgtcccgctgctg

SEQ ID NO: 325869 - DNA, 14 bp, Homo sapiens
tacgtctggtgttc

SEQ ID NO: 325870 - DNA, 16 bp, Homo sapiens
tacgtgggagaggcag

SEQ ID NO: 325871 - DNA, 18 bp, Homo sapiens
tacgtgggagaggcagaa

SEQ ID NO: 325872 - DNA, 22 bp, Homo sapiens
tacgttgcatccacaggattcc

SEQ ID NO: 325873 - DNA, 18 bp, Homo sapiens
tactaaagatatcagagc

SEQ ID NO: 325874 - DNA, 20 bp, Homo sapiens
tactaaagatatcagagctc

SEQ ID NO: 325875 - DNA, 13 bp, Homo sapiens
tactaaagcagtg

SEQ ID NO: 325876 - DNA, 16 bp, Homo sapiens
tactaaagcagtgttt

SEQ ID NO: 325877 - DNA, 13 bp, Homo sapiens
tactaacatccca

SEQ ID NO: 325878 - DNA, 16 bp, Homo sapiens
tactaaccaccatttc

SEQ ID NO: 325879 - DNA, 17 bp, Homo sapiens
tactaaccatttcttat

SEQ ID NO: 325880 - DNA, 15 bp, Homo sapiens
tactaacctggagac

SEQ ID NO: 325881 - DNA, 16 bp, Homo sapiens
tactaagaataaataa

SEQ ID NO: 325882 - DNA, 18 bp, Homo sapiens
tactaagatgaaattgcc

SEQ ID NO: 325883 - DNA, 19 bp, Homo sapiens
tactaagatgaaattgcca

SEQ ID NO: 325884 - DNA, 19 bp, Homo sapiens
tactaagccaggaggcttt

SEQ ID NO: 325885 - DNA, 13 bp, Homo sapiens
tactaataaaaag

SEQ ID NO: 325886 - DNA, 15 bp, Homo sapiens
tactaataaaaaggt

SEQ ID NO: 325887 - DNA, 16 bp, Homo sapiens
tactaatttattgccg

SEQ ID NO: 325888 - DNA, 13 bp, Homo sapiens
tactacaaaattt

SEQ ID NO: 325889 - DNA, 16 bp, Homo sapiens
tactacatttgcatgc

SEQ ID NO: 325890 - DNA, 18 bp, Homo sapiens
tactactagatgtcttta

SEQ ID NO: 325891 - DNA, 16 bp, Homo sapiens
tactactattctgtta

SEQ ID NO: 325892 - DNA, 22 bp, Homo sapiens
tactactattctgttaaaatca

SEQ ID NO: 325893 - DNA, 12 bp, Homo sapiens
tactactgtaga

SEQ ID NO: 325894 - DNA, 21 bp, Homo sapiens
tactagaaagctctgcatgtg

SEQ ID NO: 325895 - DNA, 16 bp, Homo sapiens
tactagaaccttctaa

SEQ ID NO: 325896 - DNA, 22 bp, Homo sapiens
tactagaaccttctaatccatg

SEQ ID NO: 325897 - DNA, 14 bp, Homo sapiens
tactagatgtcttt

SEQ ID NO: 325898 - DNA, 21 bp, Homo sapiens
tactataaatatattgtatat

SEQ ID NO: 325899 - DNA, 13 bp, Homo sapiens
tactataacatat

SEQ ID NO: 325900 - DNA, 16 bp, Homo sapiens
tactataatttacctg

SEQ ID NO: 325901 - DNA, 14 bp, Homo sapiens
tactatatttacaa

SEQ ID NO: 325902 - DNA, 21 bp, Homo sapiens
tactatatttacaaataaaat

SEQ ID NO: 325903 - DNA, 14 bp, Homo sapiens
tactatatttatgg

SEQ ID NO: 325904 - DNA, 14 bp, Homo sapiens
tactatgacactgt

SEQ ID NO: 325905 - DNA, 16 bp, Homo sapiens
tactatggctgagttc

SEQ ID NO: 325906 - DNA, 15 bp, Homo sapiens
tactatgtgctgggt

SEQ ID NO: 325907 - DNA, 20 bp, Homo sapiens
tactattaagcagtaaaaac

SEQ ID NO: 325908 - DNA, 14 bp, Homo sapiens
tactattggacaga

SEQ ID NO: 325909 - DNA, 13 bp, Homo sapiens
tactatttaactg

SEQ ID NO: 325910 - DNA, 22 bp, Homo sapiens
tataaggaaagcaataaatgaa

SEQ ID NO: 325911 - DNA, 23 bp, Homo sapiens
tataaggaaagcaataaatgaat

SEQ ID NO: 325912 - DNA, 10 bp, Homo sapiens
tataaggact

SEQ ID NO: 325913 - DNA, 14 bp, Homo sapiens
tataaggactgcat

SEQ ID NO: 325914 - DNA, 21 bp, Homo sapiens
tataagggagtaggctgtatt

SEQ ID NO: 325915 - DNA, 22 bp, Homo sapiens
tataagttaaagagacaaatag

SEQ ID NO: 325916 - DNA, 12 bp, Homo sapiens
tataagttgacc

SEQ ID NO: 325917 - DNA, 22 bp, Homo sapiens
tataagttgacctttatttatt

SEQ ID NO: 325918 - DNA, 22 bp, Homo sapiens
tataagtttattgtaaaagtga

SEQ ID NO: 325919 - DNA, 22 bp, Homo sapiens
tataatacttaaaaatatgtga

SEQ ID NO: 325920 - DNA, 15 bp, Homo sapiens
tataatccctttaca

SEQ ID NO: 325921 - DNA, 12 bp, Homo sapiens
tataatggttta

SEQ ID NO: 325922 - DNA, 18 bp, Homo sapiens
tataatggtttactgctg

SEQ ID NO: 325923 - DNA, 21 bp, Homo sapiens
tataatggtttactgctgtca

SEQ ID NO: 325924 - DNA, 16 bp, Homo sapiens
tataatgttagtagaa

SEQ ID NO: 325925 - DNA, 19 bp, Homo sapiens
tataattatcggaagcagt

SEQ ID NO: 325926 - DNA, 17 bp, Homo sapiens
tataattatgttattga

SEQ ID NO: 325927 - DNA, 16 bp, Homo sapiens
tataattctatactgt

SEQ ID NO: 325928 - DNA, 20 bp, Homo sapiens
tataattctatactgttgat

SEQ ID NO: 325929 - DNA, 13 bp, Homo sapiens
tataattctgtaa

SEQ ID NO: 325930 - DNA, 17 bp, Homo sapiens
tataattgttatacatt

SEQ ID NO: 325931 - DNA, 18 bp, Homo sapiens
tataatttacctgaagtc

SEQ ID NO: 325932 - DNA, 21 bp, Homo sapiens
tataatttagtcccttaaaaa

SEQ ID NO: 325933 - DNA, 17 bp, Homo sapiens
tataattttaaaattgc

SEQ ID NO: 325934 - DNA, 20 bp, Homo sapiens
tataatttttttatgttttg

SEQ ID NO: 325935 - DNA, 15 bp, Homo sapiens
tatacacaaagatat

SEQ ID NO: 325936 - DNA, 19 bp, Homo sapiens
tatacacccagttctgaat

SEQ ID NO: 325937 - DNA, 19 bp, Homo sapiens
tatacacggattattattt

SEQ ID NO: 325938 - DNA, 12 bp, Homo sapiens
tatacagatgaa

SEQ ID NO: 325939 - DNA, 13 bp, Homo sapiens
tatacagatgaaa

SEQ ID NO: 325940 - DNA, 15 bp, Homo sapiens
tatacagatgaaaat

SEQ ID NO: 325941 - DNA, 19 bp, Homo sapiens
tatacagatgaaaatttga

SEQ ID NO: 325942 - DNA, 21 bp, Homo sapiens
tatacagatgaaaatttgaga

SEQ ID NO: 325943 - DNA, 22 bp, Homo sapiens
tatacagtttttgtaaccatat

SEQ ID NO: 325944 - DNA, 15 bp, Homo sapiens
tatacatatacacaa

SEQ ID NO: 325945 - DNA, 14 bp, Homo sapiens
tatacatcaccttt

SEQ ID NO: 325946 - DNA, 18 bp, Homo sapiens
tatacatgaatcatagcc

SEQ ID NO: 325947 - DNA, 14 bp, Homo sapiens
tatacatgtatagt

SEQ ID NO: 325948 - DNA, 15 bp, Homo sapiens
tatacattcctgaga

SEQ ID NO: 325949 - DNA, 17 bp, Homo sapiens
tatacattctttatctt

SEQ ID NO: 325950 - DNA, 22 bp, Homo sapiens
tatacattttgttatagaatac

SEQ ID NO: 325951 - DNA, 13 bp, Homo sapiens
tataccacctgta

SEQ ID NO: 325952 - DNA, 14 bp, Homo sapiens
tataccacctgtac

SEQ ID NO: 325953 - DNA, 19 bp, Homo sapiens
tataccacctgtacataca

SEQ ID NO: 325954 - DNA, 13 bp, Homo sapiens
tataccagcaaaa

SEQ ID NO: 325955 - DNA, 17 bp, Homo sapiens
tataccagcaaaagtgc

SEQ ID NO: 325956 - DNA, 17 bp, Homo sapiens
tataccagcaatatatc

SEQ ID NO: 325957 - DNA, 15 bp, Homo sapiens
tatacccactgcatc

SEQ ID NO: 325958 - DNA, 14 bp, Homo sapiens
tatacctggctttt

SEQ ID NO: 325959 - DNA, 10 bp, Homo sapiens
tatactaata

SEQ ID NO: 325960 - DNA, 15 bp, Homo sapiens
tatactaataaaaag

SEQ ID NO: 325961 - DNA, 17 bp, Homo sapiens
tatactaataaaaaggt

SEQ ID NO: 325962 - DNA, 18 bp, Homo sapiens
tatactaataaaaaggtt

SEQ ID NO: 325963 - DNA, 16 bp, Homo sapiens
tatactatatttatgg

SEQ ID NO: 325964 - DNA, 22 bp, Homo sapiens
tatactgaagtcttttctgtca

SEQ ID NO: 325965 - DNA, 13 bp, Homo sapiens
tatactgcatatc

SEQ ID NO: 325966 - DNA, 18 bp, Homo sapiens
tatactgggttcttgttt

SEQ ID NO: 325967 - DNA, 19 bp, Homo sapiens
tatactgtgtcatggtgat

SEQ ID NO: 325968 - DNA, 22 bp, Homo sapiens
tatactgtgtgggatacttagt

SEQ ID NO: 325969 - DNA, 19 bp, Homo sapiens
tatactgtttgtaatatac

SEQ ID NO: 325970 - DNA, 12 bp, Homo sapiens
tatacttcaaaa

SEQ ID NO: 325971 - DNA, 18 bp, Homo sapiens
tatacttgtggttttcaa

SEQ ID NO: 325972 - DNA, 18 bp, Homo sapiens
gagtcggccccacatggg

SEQ ID NO: 325973 - DNA, 23 bp, Homo sapiens
gagtcggctgggcagggccgcag

SEQ ID NO: 325974 - DNA, 16 bp, Homo sapiens
gagtctcattcctctg

SEQ ID NO: 325975 - DNA, 22 bp, Homo sapiens
gagtctcattctgttgcccagg

SEQ ID NO: 325976 - DNA, 22 bp, Homo sapiens
gagtctccctccgactccagat

SEQ ID NO: 325977 - DNA, 12 bp, Homo sapiens
gagtctcctgtg

SEQ ID NO: 325978 - DNA, 17 bp, Homo sapiens
gagtctcttctccactg

SEQ ID NO: 325979 - DNA, 18 bp, Homo sapiens
gagtctcttctccactgg

SEQ ID NO: 325980 - DNA, 16 bp, Homo sapiens
gagtctgaaggagagg

SEQ ID NO: 325981 - DNA, 14 bp, Homo sapiens
gagtctgacaggaa

SEQ ID NO: 325982 - DNA, 13 bp, Homo sapiens
gagtctgagcccc

SEQ ID NO: 325983 - DNA, 18 bp, Homo sapiens
gagtctgctatattttca

SEQ ID NO: 325984 - DNA, 18 bp, Homo sapiens
gagtctgcttgtcttaga

SEQ ID NO: 325985 - DNA, 12 bp, Homo sapiens
gagtctggagac

SEQ ID NO: 325986 - DNA, 20 bp, Homo sapiens
gagtctggagaccaggactc

SEQ ID NO: 325987 - DNA, 22 bp, Homo sapiens
gagtctggagaccaggactctg

SEQ ID NO: 325988 - DNA, 17 bp, Homo sapiens
gagtctggcaaacatgt

SEQ ID NO: 325989 - DNA, 13 bp, Homo sapiens
gagtctgggcctc

SEQ ID NO: 325990 - DNA, 14 bp, Homo sapiens
gagtctgggcctct

SEQ ID NO: 325991 - DNA, 20 bp, Homo sapiens
gagtctgtgaataaagccac

SEQ ID NO: 325992 - DNA, 12 bp, Homo sapiens
gagtctgtgtgt

SEQ ID NO: 325993 - DNA, 20 bp, Homo sapiens
gagtctgtgtgtagccagga

SEQ ID NO: 325994 - DNA, 23 bp, Homo sapiens
gagtctgtgtgtagccaggaagc

SEQ ID NO: 325995 - DNA, 16 bp, Homo sapiens
gagtcttaattttcta

SEQ ID NO: 325996 - DNA, 18 bp, Homo sapiens
gagtcttcacatttagaa

SEQ ID NO: 325997 - DNA, 18 bp, Homo sapiens
gagtgaaagggctatggc

SEQ ID NO: 325998 - DNA, 22 bp, Homo sapiens
gagtgaaagggctatggcaagg

SEQ ID NO: 325999 - DNA, 21 bp, Homo sapiens
gagtgaacaactatttataaa

SEQ ID NO: 326000 - DNA, 19 bp, Homo sapiens
gagtgacagtggattgcat

SEQ ID NO: 326001 - DNA, 22 bp, Homo sapiens
gagtgacctggcatcttggaaa

SEQ ID NO: 326002 - DNA, 14 bp, Homo sapiens
gagtgagaatctgg

SEQ ID NO: 326003 - DNA, 17 bp, Homo sapiens
gagtgagagcacaaaga

SEQ ID NO: 326004 - DNA, 18 bp, Homo sapiens
gagtgaggcttccaggct

SEQ ID NO: 326005 - DNA, 19 bp, Homo sapiens
gagtgcaatgacacagtct

SEQ ID NO: 326006 - DNA, 17 bp, Homo sapiens
gagtgcagaacacctgg

SEQ ID NO: 326007 - DNA, 16 bp, Homo sapiens
gagtgcatggccacag

SEQ ID NO: 326008 - DNA, 18 bp, Homo sapiens
gagtgcatggccacagcc

SEQ ID NO: 326009 - DNA, 12 bp, Homo sapiens
gagtgccccaga

SEQ ID NO: 326010 - DNA, 22 bp, Homo sapiens
gagtgcccttaaaataatgatt

SEQ ID NO: 326011 - DNA, 21 bp, Homo sapiens
gagtgcgctcttggtccctgg

SEQ ID NO: 326012 - DNA, 13 bp, Homo sapiens
gagtgctggctcc

SEQ ID NO: 326013 - DNA, 14 bp, Homo sapiens
gagtgctggctcca

SEQ ID NO: 326014 - DNA, 13 bp, Homo sapiens
gagtggaaggtga

SEQ ID NO: 326015 - DNA, 13 bp, Homo sapiens
gagtggaatgcag

SEQ ID NO: 326016 - DNA, 14 bp, Homo sapiens
gagtggaatgcagg

SEQ ID NO: 326017 - DNA, 16 bp, Homo sapiens
gagtggaatgcaggga

SEQ ID NO: 326018 - DNA, 21 bp, Homo sapiens
gagtggaatgcagggaagagg

SEQ ID NO: 326019 - DNA, 13 bp, Homo sapiens
gagtggactcttc

SEQ ID NO: 326020 - DNA, 18 bp, Homo sapiens
gagtggactcttccctct

SEQ ID NO: 326021 - DNA, 12 bp, Homo sapiens
gagtggaggcat

SEQ ID NO: 326022 - DNA, 18 bp, Homo sapiens
gagtggatagatgccctg

SEQ ID NO: 326023 - DNA, 16 bp, Homo sapiens
gagtggcagccatgcc

SEQ ID NO: 326024 - DNA, 20 bp, Homo sapiens
gagtggcagctgtcccctct

SEQ ID NO: 326025 - DNA, 23 bp, Homo sapiens
gagtggcccctcacctgggcctt

SEQ ID NO: 326026 - DNA, 13 bp, Homo sapiens
gagtggcctggcc

SEQ ID NO: 326027 - DNA, 15 bp, Homo sapiens
gagtggcctggccag

SEQ ID NO: 326028 - DNA, 13 bp, Homo sapiens
gagtggctgacag

SEQ ID NO: 326029 - DNA, 23 bp, Homo sapiens
gagtggctgacagagcaggtctg

SEQ ID NO: 326030 - DNA, 16 bp, Homo sapiens
gagtgggagaggaagc

SEQ ID NO: 326031 - DNA, 16 bp, Homo sapiens
gagtgggcacctcaga

SEQ ID NO: 326032 - DNA, 20 bp, Homo sapiens
gagtggggagacacctcaga

SEQ ID NO: 326033 - DNA, 15 bp, Homo sapiens
gagtgggtggaggca

SEQ ID NO: 326034 - DNA, 21 bp, Homo sapiens
gagtgggtgggacacagagac

SEQ ID NO: 326035 - DNA, 17 bp, Homo sapiens
gagtggtccacattctg

SEQ ID NO: 326036 - DNA, 23 bp, Homo sapiens
gagtggtccacattctgctgccc

SEQ ID NO: 326037 - DNA, 20 bp, Homo sapiens
gagtggtctcctctcagctt

SEQ ID NO: 326038 - DNA, 14 bp, Homo sapiens
gagtggtctttctg

SEQ ID NO: 326039 - DNA, 15 bp, Homo sapiens
gagtggttgttgcca

SEQ ID NO: 326040 - DNA, 18 bp, Homo sapiens
gagtgtacttaactattc

SEQ ID NO: 326041 - DNA, 21 bp, Homo sapiens
gagtgtatgtagggcataatg

SEQ ID NO: 326042 - DNA, 21 bp, Homo sapiens
gagtgtcaaacgtgcccccca

SEQ ID NO: 326043 - DNA, 16 bp, Homo sapiens
gagtgtgagggcagca

SEQ ID NO: 326044 - DNA, 17 bp, Homo sapiens
gagtgtgagggcagcac

SEQ ID NO: 326045 - DNA, 14 bp, Homo sapiens
gagtgtgctcggga

SEQ ID NO: 326046 - DNA, 19 bp, Homo sapiens
gagtgtggagctgcttcca

SEQ ID NO: 326047 - DNA, 16 bp, Homo sapiens
gagtgtgtattgttcc

SEQ ID NO: 326048 - DNA, 21 bp, Homo sapiens
gagtgtgtgggggtctgggag

SEQ ID NO: 326049 - DNA, 19 bp, Homo sapiens
gagtgttcccaatgctttg

SEQ ID NO: 326050 - DNA, 22 bp, Homo sapiens
gagtgttctgtgggcttggcct

SEQ ID NO: 326051 - DNA, 12 bp, Homo sapiens
gagttacagaca

SEQ ID NO: 326052 - DNA, 18 bp, Homo sapiens
gagttacttgtctgaggc

SEQ ID NO: 326053 - DNA, 15 bp, Homo sapiens
gagttatatgacttc

SEQ ID NO: 326054 - DNA, 14 bp, Homo sapiens
gagttcaaatactt

SEQ ID NO: 326055 - DNA, 15 bp, Homo sapiens
gagttcaatgatcta

SEQ ID NO: 326056 - DNA, 18 bp, Homo sapiens
gagttcaatgatctaggt

SEQ ID NO: 326057 - DNA, 21 bp, Homo sapiens
gagttcaatgatctaggttta

SEQ ID NO: 326058 - DNA, 13 bp, Homo sapiens
gagttcagagggt

SEQ ID NO: 326059 - DNA, 17 bp, Homo sapiens
gagttcagggaggggct

SEQ ID NO: 326060 - DNA, 19 bp, Homo sapiens
gagttcagggaggggctga

SEQ ID NO: 326061 - DNA, 23 bp, Homo sapiens
gagttcatcttgaattgtaagga

SEQ ID NO: 326062 - DNA, 12 bp, Homo sapiens
gagttctttgca

SEQ ID NO: 326063 - DNA, 19 bp, Homo sapiens
gagttctttgctgcccctg

SEQ ID NO: 326064 - DNA, 22 bp, Homo sapiens
gagttgaaagagttaagaatgt

SEQ ID NO: 326065 - DNA, 14 bp, Homo sapiens
gagttgagcacagg

SEQ ID NO: 326066 - DNA, 18 bp, Homo sapiens
gagttgaggggcttccct

SEQ ID NO: 326067 - DNA, 17 bp, Homo sapiens
gagttggagtactatat

SEQ ID NO: 326068 - DNA, 20 bp, Homo sapiens
gagttggcgttgtgggcagg

SEQ ID NO: 326069 - DNA, 23 bp, Homo sapiens
gagttggcgttgtgggcaggcta

SEQ ID NO: 326070 - DNA, 17 bp, Homo sapiens
gagtttaccatttgtaa

SEQ ID NO: 326071 - DNA, 22 bp, Homo sapiens
gagtttaccatttgtaataaag

SEQ ID NO: 326072 - DNA, 22 bp, Homo sapiens
gagtttatttttttgatggcta

SEQ ID NO: 326073 - DNA, 20 bp, Homo sapiens
gagtttgagacaagccctgg

SEQ ID NO: 326074 - DNA, 16 bp, Homo sapiens
tattcttgatgtaaaa

SEQ ID NO: 326075 - DNA, 21 bp, Homo sapiens
tattcttgctgggcatacttt

SEQ ID NO: 326076 - DNA, 18 bp, Homo sapiens
tattcttgctttcacaaa

SEQ ID NO: 326077 - DNA, 19 bp, Homo sapiens
tattcttgctttcacaaat

SEQ ID NO: 326078 - DNA, 14 bp, Homo sapiens
tattctttacaaaa

SEQ ID NO: 326079 - DNA, 15 bp, Homo sapiens
tattgaaaaaaattg

SEQ ID NO: 326080 - DNA, 17 bp, Homo sapiens
tattgaaaacttcaaag

SEQ ID NO: 326081 - DNA, 18 bp, Homo sapiens
tattgaaaacttcaaagc

SEQ ID NO: 326082 - DNA, 16 bp, Homo sapiens
tattgaagtttcagct

SEQ ID NO: 326083 - DNA, 11 bp, Homo sapiens
tattgaataac

SEQ ID NO: 326084 - DNA, 14 bp, Homo sapiens
tattgaatataatg

SEQ ID NO: 326085 - DNA, 14 bp, Homo sapiens
tattgaatcttaat

SEQ ID NO: 326086 - DNA, 13 bp, Homo sapiens
tattgaatgttat

SEQ ID NO: 326087 - DNA, 13 bp, Homo sapiens
tattgaattattt

SEQ ID NO: 326088 - DNA, 22 bp, Homo sapiens
tattgaattattttgttactgt

SEQ ID NO: 326089 - DNA, 18 bp, Homo sapiens
tattgagacactgtcaag

SEQ ID NO: 326090 - DNA, 17 bp, Homo sapiens
tattgaggcattcaagg

SEQ ID NO: 326091 - DNA, 22 bp, Homo sapiens
tattgatgtacagtctgtcatg

SEQ ID NO: 326092 - DNA, 20 bp, Homo sapiens
tattgattgaaaaaagagaa

SEQ ID NO: 326093 - DNA, 16 bp, Homo sapiens
tattgattttctttct

SEQ ID NO: 326094 - DNA, 23 bp, Homo sapiens
tattgcagctaagctcaaatgta

SEQ ID NO: 326095 - DNA, 15 bp, Homo sapiens
tattgcagttataga

SEQ ID NO: 326096 - DNA, 15 bp, Homo sapiens
tattgcattaatttt

SEQ ID NO: 326097 - DNA, 14 bp, Homo sapiens
tattgccacctctg

SEQ ID NO: 326098 - DNA, 22 bp, Homo sapiens
tattgccaggaatgtttcagct

SEQ ID NO: 326099 - DNA, 21 bp, Homo sapiens
tattgccagtatataagctgt

SEQ ID NO: 326100 - DNA, 21 bp, Homo sapiens
tattgccatcgggtgccaaat

SEQ ID NO: 326101 - DNA, 13 bp, Homo sapiens
tattgctattaaa

SEQ ID NO: 326102 - DNA, 18 bp, Homo sapiens
tattgctccattttcttg

SEQ ID NO: 326103 - DNA, 21 bp, Homo sapiens
tattgctgtaaataaaaatag

SEQ ID NO: 326104 - DNA, 18 bp, Homo sapiens
tattggaagtgttcaaga

SEQ ID NO: 326105 - DNA, 18 bp, Homo sapiens
tattggacagacacagag

SEQ ID NO: 326106 - DNA, 14 bp, Homo sapiens
tattggccactggg

SEQ ID NO: 326107 - DNA, 12 bp, Homo sapiens
tattggcctgga

SEQ ID NO: 326108 - DNA, 20 bp, Homo sapiens
tattgggcacagcctagggt

SEQ ID NO: 326109 - DNA, 16 bp, Homo sapiens
tattgggttcattatt

SEQ ID NO: 326110 - DNA, 13 bp, Homo sapiens
tattggttctatt

SEQ ID NO: 326111 - DNA, 17 bp, Homo sapiens
tattggttttaaaaaag

SEQ ID NO: 326112 - DNA, 16 bp, Homo sapiens
tattgtaaactttttc

SEQ ID NO: 326113 - DNA, 14 bp, Homo sapiens
tattgtaagtggaa

SEQ ID NO: 326114 - DNA, 11 bp, Homo sapiens
tattgtacctc

SEQ ID NO: 326115 - DNA, 13 bp, Homo sapiens
tattgtacctctc

SEQ ID NO: 326116 - DNA, 15 bp, Homo sapiens
tattgtagcatttct

SEQ ID NO: 326117 - DNA, 13 bp, Homo sapiens
tattgtcaaagtg

SEQ ID NO: 326118 - DNA, 23 bp, Homo sapiens
tattgtccatatcagacctctga

SEQ ID NO: 326119 - DNA, 19 bp, Homo sapiens
tattgtgaaatttgttaat

SEQ ID NO: 326120 - DNA, 15 bp, Homo sapiens
tattgtgaagtacat

SEQ ID NO: 326121 - DNA, 19 bp, Homo sapiens
tattgtgaagtacatatta

SEQ ID NO: 326122 - DNA, 22 bp, Homo sapiens
tattgtgggacttattacaatt

SEQ ID NO: 326123 - DNA, 23 bp, Homo sapiens
tattgtgtgaaggtaactaagaa

SEQ ID NO: 326124 - DNA, 20 bp, Homo sapiens
tattgttaaaaccttactta

SEQ ID NO: 326125 - DNA, 17 bp, Homo sapiens
tattgttaactcttgtc

SEQ ID NO: 326126 - DNA, 20 bp, Homo sapiens
tattgttaatattaatttat

SEQ ID NO: 326127 - DNA, 21 bp, Homo sapiens
tcaaactaaaagacatttgtt

SEQ ID NO: 326128 - DNA, 22 bp, Homo sapiens
tcaaactcgtctgatgttttga

SEQ ID NO: 326129 - DNA, 14 bp, Homo sapiens
tcaaactgtagaaa

SEQ ID NO: 326130 - DNA, 21 bp, Homo sapiens
tcaaagaaagaaagtttagaa

SEQ ID NO: 326131 - DNA, 18 bp, Homo sapiens
tcaaagaacccccctccc

SEQ ID NO: 326132 - DNA, 20 bp, Homo sapiens
tcaaagagagaaaataaaga

SEQ ID NO: 326133 - DNA, 11 bp, Homo sapiens
tcaaagatgta

SEQ ID NO: 326134 - DNA, 13 bp, Homo sapiens
tcaaagatgtact

SEQ ID NO: 326135 - DNA, 18 bp, Homo sapiens
tcaaagatgtactgagag

SEQ ID NO: 326136 - DNA, 19 bp, Homo sapiens
tcaaagcaagggctccagc

SEQ ID NO: 326137 - DNA, 13 bp, Homo sapiens
tcaaagcatcaaa

SEQ ID NO: 326138 - DNA, 17 bp, Homo sapiens
tcaaagcatcaaataat

SEQ ID NO: 326139 - DNA, 19 bp, Homo sapiens
tcaaagctaggaaaggcag

SEQ ID NO: 326140 - DNA, 21 bp, Homo sapiens
tcaaagctaggaaaggcagaa

SEQ ID NO: 326141 - DNA, 22 bp, Homo sapiens
tcaaagctaggaaaggcagaaa

SEQ ID NO: 326142 - DNA, 22 bp, Homo sapiens
tcaaagctccttaaagttctgg

SEQ ID NO: 326143 - DNA, 12 bp, Homo sapiens
tcaaagctgagt

SEQ ID NO: 326144 - DNA, 20 bp, Homo sapiens
tcaaagcttgaagatcgtta

SEQ ID NO: 326145 - DNA, 22 bp, Homo sapiens
tcaaaggagagtcacagaacaa

SEQ ID NO: 326146 - DNA, 20 bp, Homo sapiens
tcaaaggattttggaaaaga

SEQ ID NO: 326147 - DNA, 18 bp, Homo sapiens
tcaaagtggtacaggaag

SEQ ID NO: 326148 - DNA, 22 bp, Homo sapiens
tcaaagtttcctaatcagaaat

SEQ ID NO: 326149 - DNA, 14 bp, Homo sapiens
tcaaataaaaataa

SEQ ID NO: 326150 - DNA, 23 bp, Homo sapiens
tcaaataaaccttgtttctttct

SEQ ID NO: 326151 - DNA, 11 bp, Homo sapiens
tcaaataaact

SEQ ID NO: 326152 - DNA, 16 bp, Homo sapiens
tcaaatagcctttctt

SEQ ID NO: 326153 - DNA, 14 bp, Homo sapiens
tcaaatcagagcag

SEQ ID NO: 326154 - DNA, 15 bp, Homo sapiens
tcaaatcagagcagt

SEQ ID NO: 326155 - DNA, 17 bp, Homo sapiens
tcaaatcagagcagtga

SEQ ID NO: 326156 - DNA, 15 bp, Homo sapiens
tcaaatctattcaga

SEQ ID NO: 326157 - DNA, 17 bp, Homo sapiens
tcaaatctattcagaca

SEQ ID NO: 326158 - DNA, 20 bp, Homo sapiens
tcaaatctgtatatgttgta

SEQ ID NO: 326159 - DNA, 22 bp, Homo sapiens
tcaaatgagtttaaaaaaataa

SEQ ID NO: 326160 - DNA, 12 bp, Homo sapiens
tcaaatgcaaaa

SEQ ID NO: 326161 - DNA, 10 bp, Homo sapiens
tcaaatgcat

SEQ ID NO: 326162 - DNA, 11 bp, Homo sapiens
tcaaatgcatg

SEQ ID NO: 326163 - DNA, 20 bp, Homo sapiens
tcaaatgctactcagtatat

SEQ ID NO: 326164 - DNA, 18 bp, Homo sapiens
tcaaatggatgtaatata

SEQ ID NO: 326165 - DNA, 20 bp, Homo sapiens
tcaaatgttagagtttaatt

SEQ ID NO: 326166 - DNA, 20 bp, Homo sapiens
tcaaattggactttcaaaat

SEQ ID NO: 326167 - DNA, 13 bp, Homo sapiens
tcaaattgtatct

SEQ ID NO: 326168 - DNA, 12 bp, Homo sapiens
tcaaatttcaca

SEQ ID NO: 326169 - DNA, 20 bp, Homo sapiens
tcaaatttgtagggtttcta

SEQ ID NO: 326170 - DNA, 22 bp, Homo sapiens
tcaaatttttctgggaagaaaa

SEQ ID NO: 326171 - DNA, 21 bp, Homo sapiens
acctgcaagccccagggcctg

SEQ ID NO: 326172 - DNA, 23 bp, Homo sapiens
acctgcaagccccagggcctggg

SEQ ID NO: 326173 - DNA, 15 bp, Homo sapiens
acctgcagcccctcc

SEQ ID NO: 326174 - DNA, 18 bp, Homo sapiens
acctgcaggactcgggct

SEQ ID NO: 326175 - DNA, 19 bp, Homo sapiens
acctgcaggactcgggcta

SEQ ID NO: 326176 - DNA, 15 bp, Homo sapiens
acctgcagttcctga

SEQ ID NO: 326177 - DNA, 17 bp, Homo sapiens
acctgcatatctctagt

SEQ ID NO: 326178 - DNA, 17 bp, Homo sapiens
acctgcatgcagcaaca

SEQ ID NO: 326179 - DNA, 18 bp, Homo sapiens
acctgccactaggctggg

SEQ ID NO: 326180 - DNA, 21 bp, Homo sapiens
acctgccactaggctgggtgc

SEQ ID NO: 326181 - DNA, 19 bp, Homo sapiens
acctgcccagttagcccgg

SEQ ID NO: 326182 - DNA, 22 bp, Homo sapiens
acctgcccagttagcccggcca

SEQ ID NO: 326183 - DNA, 20 bp, Homo sapiens
acctgcccccttctcccaca

SEQ ID NO: 326184 - DNA, 17 bp, Homo sapiens
acctgccctgccctgcc

SEQ ID NO: 326185 - DNA, 18 bp, Homo sapiens
acctgccctgccctgcca

SEQ ID NO: 326186 - DNA, 20 bp, Homo sapiens
acctgccctgcctgagggcc

SEQ ID NO: 326187 - DNA, 17 bp, Homo sapiens
acctgcctatccatcct

SEQ ID NO: 326188 - DNA, 19 bp, Homo sapiens
acctgcctatccatcctgc

SEQ ID NO: 326189 - DNA, 18 bp, Homo sapiens
acctgcctcctgcctgcc

SEQ ID NO: 326190 - DNA, 21 bp, Homo sapiens
acctgcctctgaactgctgct

SEQ ID NO: 326191 - DNA, 22 bp, Homo sapiens
acctgcctctgaactgctgctg

SEQ ID NO: 326192 - DNA, 22 bp, Homo sapiens
acctgcctgccccacacggact

SEQ ID NO: 326193 - DNA, 12 bp, Homo sapiens
acctgctctcct

SEQ ID NO: 326194 - DNA, 18 bp, Homo sapiens
acctgctctcctcttgcc

SEQ ID NO: 326195 - DNA, 16 bp, Homo sapiens
acctgctgccccagct

SEQ ID NO: 326196 - DNA, 10 bp, Homo sapiens
acctgctgct

SEQ ID NO: 326197 - DNA, 16 bp, Homo sapiens
acctgctggcccctca

SEQ ID NO: 326198 - DNA, 15 bp, Homo sapiens
acctgctttgactga

SEQ ID NO: 326199 - DNA, 15 bp, Homo sapiens
acctggaaccagagc

SEQ ID NO: 326200 - DNA, 17 bp, Homo sapiens
acctggaaccagagcca

SEQ ID NO: 326201 - DNA, 19 bp, Homo sapiens
acctggaaccagagccaca

SEQ ID NO: 326202 - DNA, 18 bp, Homo sapiens
acctggaagagctgggta

SEQ ID NO: 326203 - DNA, 13 bp, Homo sapiens
acctggagacagg

SEQ ID NO: 326204 - DNA, 14 bp, Homo sapiens
acctggagacagga

SEQ ID NO: 326205 - DNA, 10 bp, Homo sapiens
acctggaggg

SEQ ID NO: 326206 - DNA, 19 bp, Homo sapiens
tcatagcattaactaatct

SEQ ID NO: 326207 - DNA, 21 bp, Homo sapiens
tcatagcattaactaatctat

SEQ ID NO: 326208 - DNA, 12 bp, Homo sapiens
tcatagctgaga

SEQ ID NO: 326209 - DNA, 20 bp, Homo sapiens
tcatagtactctttgtagca

SEQ ID NO: 326210 - DNA, 15 bp, Homo sapiens
tcatagtttctgtaa

SEQ ID NO: 326211 - DNA, 13 bp, Homo sapiens
tcatataatgcaa

SEQ ID NO: 326212 - DNA, 16 bp, Homo sapiens
tcatataccagcaata

SEQ ID NO: 326213 - DNA, 17 bp, Homo sapiens
tcatataccagcaatat

SEQ ID NO: 326214 - DNA, 18 bp, Homo sapiens
tcatatatggggggccaa

SEQ ID NO: 326215 - DNA, 18 bp, Homo sapiens
tcatatccagctgagtga

SEQ ID NO: 326216 - DNA, 16 bp, Homo sapiens
tcatatctctcccttc

SEQ ID NO: 326217 - DNA, 24 bp, Homo sapiens
tcatatctctcccttctttacctt

SEQ ID NO: 326218 - DNA, 23 bp, Homo sapiens
tcatatctgtatgcctcatttta

SEQ ID NO: 326219 - DNA, 16 bp, Homo sapiens
tcatatgagtatcttt

SEQ ID NO: 326220 - DNA, 23 bp, Homo sapiens
tcatatgagtcctcaagcttctc

SEQ ID NO: 326221 - DNA, 21 bp, Homo sapiens
tcatatgtaccatgtacatga

SEQ ID NO: 326222 - DNA, 17 bp, Homo sapiens
tcatatgtatctaaatg

SEQ ID NO: 326223 - DNA, 18 bp, Homo sapiens
tcatatgttgctcagtct

SEQ ID NO: 326224 - DNA, 16 bp, Homo sapiens
tcatatgttgtaggaa

SEQ ID NO: 326225 - DNA, 23 bp, Homo sapiens
tcatattgagatcagcattcaaa

SEQ ID NO: 326226 - DNA, 14 bp, Homo sapiens
tcatattgatgaaa

SEQ ID NO: 326227 - DNA, 15 bp, Homo sapiens
tcatattgatgaaaa

SEQ ID NO: 326228 - DNA, 22 bp, Homo sapiens
tcatattgtgccaatatgtatt

SEQ ID NO: 326229 - DNA, 15 bp, Homo sapiens
tcatatttacttctt

SEQ ID NO: 326230 - DNA, 16 bp, Homo sapiens
tcatatttacttctta

SEQ ID NO: 326231 - DNA, 23 bp, Homo sapiens
tcatatttacttcttatacattt

SEQ ID NO: 326232 - DNA, 23 bp, Homo sapiens
tcatattttcagtgctttctcaa

SEQ ID NO: 326233 - DNA, 13 bp, Homo sapiens
tcatatttttaca

SEQ ID NO: 326234 - DNA, 14 bp, Homo sapiens
tcatcaaaaagagt

SEQ ID NO: 326235 - DNA, 17 bp, Homo sapiens
tcatcaaataaaccttg

SEQ ID NO: 326236 - DNA, 18 bp, Homo sapiens
tcatcaacaaaagggaga

SEQ ID NO: 326237 - DNA, 22 bp, Homo sapiens
tcatcaacaaaagggagaacat

SEQ ID NO: 326238 - DNA, 17 bp, Homo sapiens
tcatcaattctctatca

SEQ ID NO: 326239 - DNA, 20 bp, Homo sapiens
tcatcactccctggatgtgt

SEQ ID NO: 326240 - DNA, 15 bp, Homo sapiens
tcatcagaagataac

SEQ ID NO: 326241 - DNA, 15 bp, Homo sapiens
tcatcagatggaaat

SEQ ID NO: 326242 - DNA, 18 bp, Homo sapiens
tcatcagatggaaatatt

SEQ ID NO: 326243 - DNA, 12 bp, Homo sapiens
tcatcagcccag

SEQ ID NO: 326244 - DNA, 23 bp, Homo sapiens
tcatcaggccgggtgcagtggct

SEQ ID NO: 326245 - DNA, 24 bp, Homo sapiens
tcatcaggccgggtgcagtggctc

SEQ ID NO: 326246 - DNA, 12 bp, Homo sapiens
tcatcagtgtta

SEQ ID NO: 326247 - DNA, 15 bp, Homo sapiens
tcatcataaaataaa

SEQ ID NO: 326248 - DNA, 17 bp, Homo sapiens
tcatcatctttttgtgt

SEQ ID NO: 326249 - DNA, 19 bp, Homo sapiens
tcatcattgtatatatgtg

SEQ ID NO: 326250 - DNA, 22 bp, Homo sapiens
tcatccaatcctcactgggtgg

SEQ ID NO: 326251 - DNA, 17 bp, Homo sapiens
tcatccacacaacacca

SEQ ID NO: 326252 - DNA, 20 bp, Homo sapiens
tcatccacacaacaccagga

SEQ ID NO: 326253 - DNA, 18 bp, Homo sapiens
tcatccatagacacagta

SEQ ID NO: 326254 - DNA, 14 bp, Homo sapiens
tcatccatatttct

SEQ ID NO: 326255 - DNA, 19 bp, Homo sapiens
tcatcccaatgggggaagt

SEQ ID NO: 326256 - DNA, 13 bp, Homo sapiens
tcatcccagcacc

SEQ ID NO: 326257 - DNA, 23 bp, Homo sapiens
tcatcccagcacctgccagggcc

SEQ ID NO: 326258 - DNA, 15 bp, Homo sapiens
tcatcccctcgtcct

SEQ ID NO: 326259 - DNA, 18 bp, Homo sapiens
tcatcccctcgtcctgtc

SEQ ID NO: 326260 - DNA, 23 bp, Homo sapiens
tcatccctgccaagaactctggg

SEQ ID NO: 326261 - DNA, 15 bp, Homo sapiens
tcatcctattgttga

SEQ ID NO: 326262 - DNA, 14 bp, Homo sapiens
tcatcctcctggac

SEQ ID NO: 326263 - DNA, 20 bp, Homo sapiens
tcatcctggcctccttttgc

SEQ ID NO: 326264 - DNA, 18 bp, Homo sapiens
tcatccttagcaacagcc

SEQ ID NO: 326265 - DNA, 14 bp, Homo sapiens
tcatccttctggaa

SEQ ID NO: 326266 - DNA, 15 bp, Homo sapiens
tcatccttttttctc

SEQ ID NO: 326267 - DNA, 17 bp, Homo sapiens
tcatccttttttctctt

SEQ ID NO: 326268 - DNA, 19 bp, Homo sapiens
tcatccttttttctcttct

SEQ ID NO: 326269 - DNA, 20 bp, Homo sapiens
tcatctaccattttctggtt

SEQ ID NO: 326270 - DNA, 22 bp, Homo sapiens
tcatctccagtatcctgctggt

SEQ ID NO: 326271 - DNA, 18 bp, Homo sapiens
tcatctctgcctttgagt

SEQ ID NO: 326272 - DNA, 15 bp, Homo sapiens
tcatctctgctgaac

SEQ ID NO: 326273 - DNA, 17 bp, Homo sapiens
tcatctctgctgaacat

SEQ ID NO: 326274 - DNA, 15 bp, Homo sapiens
tcatctcttgatgaa

SEQ ID NO: 326275 - DNA, 11 bp, Homo sapiens
tcatctgagga

SEQ ID NO: 326276 - DNA, 21 bp, Homo sapiens
tcatctgggccaccagctcca

SEQ ID NO: 326277 - DNA, 19 bp, Homo sapiens
tcatctgtgtgaaaatggg

SEQ ID NO: 326278 - DNA, 18 bp, Homo sapiens
tcatctgttatcctgcta

SEQ ID NO: 326279 - DNA, 12 bp, Homo sapiens
tcatcttctctt

SEQ ID NO: 326280 - DNA, 14 bp, Homo sapiens
tcatcttctctttt

SEQ ID NO: 326281 - DNA, 19 bp, Homo sapiens
tcatcttgagcctgagcct

SEQ ID NO: 326282 - DNA, 19 bp, Homo sapiens
tcatctttcctttgctctg

SEQ ID NO: 326283 - DNA, 20 bp, Homo sapiens
tcatctttcctttgctctgg

SEQ ID NO: 326284 - DNA, 11 bp, Homo sapiens
tcatctttgct

SEQ ID NO: 326285 - DNA, 13 bp, Homo sapiens
tcatctttttgtg

SEQ ID NO: 326286 - DNA, 19 bp, Homo sapiens
tcatctttttgtgtgcagg

SEQ ID NO: 326287 - DNA, 19 bp, Homo sapiens
tcatgaaagcacctgccct

SEQ ID NO: 326288 - DNA, 22 bp, Homo sapiens
tcatgaaagcacctgccctctg

SEQ ID NO: 326289 - DNA, 23 bp, Homo sapiens
tcatgaacatgttcctgaattct

SEQ ID NO: 326290 - DNA, 12 bp, Homo sapiens
tcatgaatgtaa

SEQ ID NO: 326291 - DNA, 21 bp, Homo sapiens
tcatgaatgtaaatttgtact

SEQ ID NO: 326292 - DNA, 19 bp, Homo sapiens
tcatgaattcatactctgt

SEQ ID NO: 326293 - DNA, 13 bp, Homo sapiens
tcatgaattttac

SEQ ID NO: 326294 - DNA, 19 bp, Homo sapiens
tcatgacatgttatatatt

SEQ ID NO: 326295 - DNA, 16 bp, Homo sapiens
tcatgacatttctcaa

SEQ ID NO: 326296 - DNA, 19 bp, Homo sapiens
tcatgacatttctcaaagt

SEQ ID NO: 326297 - DNA, 18 bp, Homo sapiens
tcatgacttttccatgta

SEQ ID NO: 326298 - DNA, 14 bp, Homo sapiens
tcatgattagacaa

SEQ ID NO: 326299 - DNA, 11 bp, Homo sapiens
tcatgattttt

SEQ ID NO: 326300 - DNA, 12 bp, Homo sapiens
tcatgcaggaac

SEQ ID NO: 326301 - DNA, 12 bp, Homo sapiens
tcatgccagcag

SEQ ID NO: 326302 - DNA, 15 bp, Homo sapiens
tcatgcctggccccc

SEQ ID NO: 326303 - DNA, 14 bp, Homo sapiens
tcatgcctgtaatc

SEQ ID NO: 326304 - DNA, 14 bp, Homo sapiens
tcatgcctttgtaa

SEQ ID NO: 326305 - DNA, 14 bp, Homo sapiens
tcatgcggcccagc

SEQ ID NO: 326306 - DNA, 16 bp, Homo sapiens
tcatgcggcccagcca

SEQ ID NO: 326307 - DNA, 15 bp, Homo sapiens
tcatgcttataagca

SEQ ID NO: 326308 - DNA, 13 bp, Homo sapiens
tcatgcttcagtt

SEQ ID NO: 326309 - DNA, 19 bp, Homo sapiens
tcatgcttcagttgtactt

SEQ ID NO: 326310 - DNA, 15 bp, Homo sapiens
tcatgctttctcctt

SEQ ID NO: 326311 - DNA, 18 bp, Homo sapiens
tcatgcttttctcatggt

SEQ ID NO: 326312 - DNA, 14 bp, Homo sapiens
tcatggatttggtt

SEQ ID NO: 326313 - DNA, 15 bp, Homo sapiens
tcatggcagtgggac

SEQ ID NO: 326314 - DNA, 22 bp, Homo sapiens
tcatggcattcgcagtgcccag

SEQ ID NO: 326315 - DNA, 20 bp, Homo sapiens
tcatggcctattatattaaa

SEQ ID NO: 326316 - DNA, 18 bp, Homo sapiens
tcatggctcaaggattca

SEQ ID NO: 326317 - DNA, 15 bp, Homo sapiens
tcatggctcactgca

SEQ ID NO: 326318 - DNA, 18 bp, Homo sapiens
tcatggctcactgcagcc

SEQ ID NO: 326319 - DNA, 19 bp, Homo sapiens
tcatggctcactgcagcct

SEQ ID NO: 326320 - DNA, 20 bp, Homo sapiens
tcatggctgttatctgtctt

SEQ ID NO: 326321 - DNA, 18 bp, Homo sapiens
tcatggcttaatgtttat

SEQ ID NO: 326322 - DNA, 18 bp, Homo sapiens
tcatggctttgtatccaa

SEQ ID NO: 326323 - DNA, 17 bp, Homo sapiens
tcatgggaacgcagcct

SEQ ID NO: 326324 - DNA, 20 bp, Homo sapiens
tcatgggaacgcagcctcca

SEQ ID NO: 326325 - DNA, 21 bp, Homo sapiens
tcatgggaacgcagcctccag

SEQ ID NO: 326326 - DNA, 22 bp, Homo sapiens
tcatgggaacgcagcctccagt

SEQ ID NO: 326327 - DNA, 17 bp, Homo sapiens
tcatgggcccctctgac

SEQ ID NO: 326328 - DNA, 18 bp, Homo sapiens
tcatgggggatttttcat

SEQ ID NO: 326329 - DNA, 22 bp, Homo sapiens
tcatgggtcccgggttagcctg

SEQ ID NO: 326330 - DNA, 14 bp, Homo sapiens
tcatggtgaaaatg

SEQ ID NO: 326331 - DNA, 20 bp, Homo sapiens
tcatggtgatgcaagtcact

SEQ ID NO: 326332 - DNA, 17 bp, Homo sapiens
tcatgtagaactcagca

SEQ ID NO: 326333 - DNA, 22 bp, Homo sapiens
tcatgtagaactcagcagttga

SEQ ID NO: 326334 - DNA, 17 bp, Homo sapiens
tcatgtaggttgtctaa

SEQ ID NO: 326335 - DNA, 21 bp, Homo sapiens
tcatgtctctacccactatgc

SEQ ID NO: 326336 - DNA, 16 bp, Homo sapiens
actgctttcaacttaa

SEQ ID NO: 326337 - DNA, 15 bp, Homo sapiens
actggaaacctgtta

SEQ ID NO: 326338 - DNA, 22 bp, Homo sapiens
actggaaacctgttatgccaaa

SEQ ID NO: 326339 - DNA, 18 bp, Homo sapiens
actggaacggtgaaggtg

SEQ ID NO: 326340 - DNA, 17 bp, Homo sapiens
actggaagttttgcatt

SEQ ID NO: 326341 - DNA, 22 bp, Homo sapiens
actggactatagcagggctggg

SEQ ID NO: 326342 - DNA, 15 bp, Homo sapiens
actggacttgaatgg

SEQ ID NO: 326343 - DNA, 15 bp, Homo sapiens
actggagaaaatgga

SEQ ID NO: 326344 - DNA, 18 bp, Homo sapiens
actggagaattgaaaagg

SEQ ID NO: 326345 - DNA, 18 bp, Homo sapiens
actggaggaccacactca

SEQ ID NO: 326346 - DNA, 15 bp, Homo sapiens
actggagtcagatga

SEQ ID NO: 326347 - DNA, 18 bp, Homo sapiens
actggagtcagatgagca

SEQ ID NO: 326348 - DNA, 19 bp, Homo sapiens
actggagtgaggcttccag

SEQ ID NO: 326349 - DNA, 22 bp, Homo sapiens
tcatgttctgagctataacatt

SEQ ID NO: 326350 - DNA, 12 bp, Homo sapiens
tcatgtttccct

SEQ ID NO: 326351 - DNA, 15 bp, Homo sapiens
tcatgttttgtgact

SEQ ID NO: 326352 - DNA, 13 bp, Homo sapiens
tcattaaacagaa

SEQ ID NO: 326353 - DNA, 17 bp, Homo sapiens
tcattaaacatgaattt

SEQ ID NO: 326354 - DNA, 20 bp, Homo sapiens
tcattaaacatgaatttaat

SEQ ID NO: 326355 - DNA, 22 bp, Homo sapiens
tcattaaacatgaatttaatgt

SEQ ID NO: 326356 - DNA, 14 bp, Homo sapiens
tcattaaagaaaaa

SEQ ID NO: 326357 - DNA, 19 bp, Homo sapiens
tcattaaatggtgatttct

SEQ ID NO: 326358 - DNA, 23 bp, Homo sapiens
tcattaataggaaagatttaatg

SEQ ID NO: 326359 - DNA, 17 bp, Homo sapiens
tcattacagatttagtt

SEQ ID NO: 326360 - DNA, 15 bp, Homo sapiens
tcattacttgattaa

SEQ ID NO: 326361 - DNA, 15 bp, Homo sapiens
tcattataaacgtga

SEQ ID NO: 326362 - DNA, 18 bp, Homo sapiens
tcattatagcatgtaata

SEQ ID NO: 326363 - DNA, 12 bp, Homo sapiens
tcattatgtaga

SEQ ID NO: 326364 - DNA, 14 bp, Homo sapiens
tcattattggaatt

SEQ ID NO: 326365 - DNA, 11 bp, Homo sapiens
tcattatttat

SEQ ID NO: 326366 - DNA, 14 bp, Homo sapiens
tcattatttcatca

SEQ ID NO: 326367 - DNA, 23 bp, Homo sapiens
tcattattttgtggttctatttt

SEQ ID NO: 326368 - DNA, 17 bp, Homo sapiens
tcattcaagcctgtgaa

SEQ ID NO: 326369 - DNA, 20 bp, Homo sapiens
tcattcactgtcctggcttt

SEQ ID NO: 326370 - DNA, 17 bp, Homo sapiens
tcattcagtattaaagg

SEQ ID NO: 326371 - DNA, 16 bp, Homo sapiens
tcattcatattcctgc

SEQ ID NO: 326372 - DNA, 15 bp, Homo sapiens
tcattcattttgtgt

SEQ ID NO: 326373 - DNA, 17 bp, Homo sapiens
tcattcccactgcactt

SEQ ID NO: 326374 - DNA, 22 bp, Homo sapiens
tcattcccactgcacttggtgc

SEQ ID NO: 326375 - DNA, 22 bp, Homo sapiens
tcattccgaaaaaaaaatgttc

SEQ ID NO: 326376 - DNA, 16 bp, Homo sapiens
tcattcctaatgcatt

SEQ ID NO: 326377 - DNA, 17 bp, Homo sapiens
tcattcctaatgcatta

SEQ ID NO: 326378 - DNA, 18 bp, Homo sapiens
tcattcttgaaagctgtg

SEQ ID NO: 326379 - DNA, 22 bp, Homo sapiens
tcattctttataaaccataaaa

SEQ ID NO: 326380 - DNA, 13 bp, Homo sapiens
tcattctttgtat

SEQ ID NO: 326381 - DNA, 16 bp, Homo sapiens
tcattctttgtatctt

SEQ ID NO: 326382 - DNA, 15 bp, Homo sapiens
tcattcttttcagct

SEQ ID NO: 326383 - DNA, 23 bp, Homo sapiens
tcattcttttcagcttgtttcta

SEQ ID NO: 326384 - DNA, 18 bp, Homo sapiens
tcattgatcacagatgtg

SEQ ID NO: 326385 - DNA, 23 bp, Homo sapiens
tcattgctttgaagcagttgtgt

SEQ ID NO: 326386 - DNA, 17 bp, Homo sapiens
tcattgggttttatcag

SEQ ID NO: 326387 - DNA, 23 bp, Homo sapiens
tcattggttaaaatattactgat

SEQ ID NO: 326388 - DNA, 16 bp, Homo sapiens
tcattgtaaacaaact

SEQ ID NO: 326389 - DNA, 12 bp, Homo sapiens
tcattgtagaaa

SEQ ID NO: 326390 - DNA, 22 bp, Homo sapiens
tcattgtagaaacacagttttg

SEQ ID NO: 326391 - DNA, 16 bp, Homo sapiens
tcattgtatatatgtg

SEQ ID NO: 326392 - DNA, 15 bp, Homo sapiens
tcattgtatgatgtg

SEQ ID NO: 326393 - DNA, 16 bp, Homo sapiens
tcattgtccatgccta

SEQ ID NO: 326394 - DNA, 20 bp, Homo sapiens
tcattgtccatgcctacaga

SEQ ID NO: 326395 - DNA, 23 bp, Homo sapiens
tcattgtccatgcctacagataa

SEQ ID NO: 326396 - DNA, 16 bp, Homo sapiens
tcattgtcgctcagca

SEQ ID NO: 326397 - DNA, 20 bp, Homo sapiens
tcattgtgtgtcttcaggag

SEQ ID NO: 326398 - DNA, 23 bp, Homo sapiens
tcatttaaaaaaaaaatttgttt

SEQ ID NO: 326399 - DNA, 18 bp, Homo sapiens
tcatttaaaatgtaaact

SEQ ID NO: 326400 - DNA, 22 bp, Homo sapiens
tcatttaaaatgtaaactcttc

SEQ ID NO: 326401 - DNA, 17 bp, Homo sapiens
tcatttacgtaaaaaga

SEQ ID NO: 326402 - DNA, 15 bp, Homo sapiens
tcatttatcaagcag

SEQ ID NO: 326403 - DNA, 17 bp, Homo sapiens
tcatttatgatacaaaa

SEQ ID NO: 326404 - DNA, 16 bp, Homo sapiens
tcatttattttaagca

SEQ ID NO: 326405 - DNA, 16 bp, Homo sapiens
tcatttccagcaaaat

SEQ ID NO: 326406 - DNA, 20 bp, Homo sapiens
tcatttccagcaaaatatat

SEQ ID NO: 326407 - DNA, 20 bp, Homo sapiens
tcatttcctctgagctgtta

SEQ ID NO: 326408 - DNA, 15 bp, Homo sapiens
tcatttctctttttt

SEQ ID NO: 326409 - DNA, 13 bp, Homo sapiens
tcatttctgtctc

SEQ ID NO: 326410 - DNA, 23 bp, Homo sapiens
tcatttctttttgggagagactt

SEQ ID NO: 326411 - DNA, 13 bp, Homo sapiens
tcatttgaaagtg

SEQ ID NO: 326412 - DNA, 16 bp, Homo sapiens
tcatttgatgctaaat

SEQ ID NO: 326413 - DNA, 15 bp, Homo sapiens
tcatttgcagctgct

SEQ ID NO: 326414 - DNA, 17 bp, Homo sapiens
tcatttgcagctgctgg

SEQ ID NO: 326415 - DNA, 13 bp, Homo sapiens
tcatttgctaatg

SEQ ID NO: 326416 - DNA, 14 bp, Homo sapiens
tcatttgctaatga

SEQ ID NO: 326417 - DNA, 15 bp, Homo sapiens
tcatttggtggctct

SEQ ID NO: 326418 - DNA, 13 bp, Homo sapiens
tcatttgttcatt

SEQ ID NO: 326419 - DNA, 16 bp, Homo sapiens
tcatttgttcattaaa

SEQ ID NO: 326420 - DNA, 18 bp, Homo sapiens
tcatttgttcattaaacg

SEQ ID NO: 326421 - DNA, 15 bp, Homo sapiens
tcattttagtgactg

SEQ ID NO: 326422 - DNA, 17 bp, Homo sapiens
tcattttagtgactgta

SEQ ID NO: 326423 - DNA, 12 bp, Homo sapiens
tcattttattca

SEQ ID NO: 326424 - DNA, 16 bp, Homo sapiens
tcattttattcacata

SEQ ID NO: 326425 - DNA, 21 bp, Homo sapiens
tcattttattctgtcaatgaa

SEQ ID NO: 326426 - DNA, 21 bp, Homo sapiens
tcattttattttttccctcct

SEQ ID NO: 326427 - DNA, 15 bp, Homo sapiens
tcattttccccccac

SEQ ID NO: 326428 - DNA, 14 bp, Homo sapiens
tcattttcctggga

SEQ ID NO: 326429 - DNA, 15 bp, Homo sapiens
tcattttcctttctg

SEQ ID NO: 326430 - DNA, 15 bp, Homo sapiens
tcattttctctcctc

SEQ ID NO: 326431 - DNA, 21 bp, Homo sapiens
tcattttggcaagaagactgt

SEQ ID NO: 326432 - DNA, 22 bp, Homo sapiens
tcattttggtaaaatacttctt

SEQ ID NO: 326433 - DNA, 18 bp, Homo sapiens
tcatttttcattttctct

SEQ ID NO: 326434 - DNA, 13 bp, Homo sapiens
tcattttttctta

SEQ ID NO: 326435 - DNA, 14 bp, Homo sapiens
tccaaaaaattaaa

SEQ ID NO: 326436 - DNA, 22 bp, Homo sapiens
tccaaaaagattttcagaaaat

SEQ ID NO: 326437 - DNA, 12 bp, Homo sapiens
tccaaaatcatt

SEQ ID NO: 326438 - DNA, 12 bp, Homo sapiens
tccaaaattctt

SEQ ID NO: 326439 - DNA, 22 bp, Homo sapiens
tccaaaccactttttgcagctt

SEQ ID NO: 326440 - DNA, 17 bp, Homo sapiens
tccaaactcctgcctgt

SEQ ID NO: 326441 - DNA, 15 bp, Homo sapiens
tccaaagaacttgat

SEQ ID NO: 326442 - DNA, 16 bp, Homo sapiens
tccaaagactgtactg

SEQ ID NO: 326443 - DNA, 22 bp, Homo sapiens
tccaaagcattgcagaacatga

SEQ ID NO: 326444 - DNA, 12 bp, Homo sapiens
tccaaagcctgg

SEQ ID NO: 326445 - DNA, 17 bp, Homo sapiens
tccaaagctttcctgga

SEQ ID NO: 326446 - DNA, 19 bp, Homo sapiens
tccaaagctttcctggaga

SEQ ID NO: 326447 - DNA, 19 bp, Homo sapiens
tccaaaggaggctggcagg

SEQ ID NO: 326448 - DNA, 17 bp, Homo sapiens
tccaaaggggctgctgg

SEQ ID NO: 326449 - DNA, 20 bp, Homo sapiens
tccaaatcttgaatttctgc

SEQ ID NO: 326450 - DNA, 14 bp, Homo sapiens
tccaaatgcattca

SEQ ID NO: 326451 - DNA, 23 bp, Homo sapiens
tccaaatgctgtcgggcaagata

SEQ ID NO: 326452 - DNA, 18 bp, Homo sapiens
tccaaatgctgtgcaaac

SEQ ID NO: 326453 - DNA, 22 bp, Homo sapiens
tccaaatgctgtgcaaacagtg

SEQ ID NO: 326454 - DNA, 19 bp, Homo sapiens
tccaaatgtcctccagaag

SEQ ID NO: 326455 - DNA, 22 bp, Homo sapiens
tccaaatgtcctccagaagcct

SEQ ID NO: 326456 - DNA, 20 bp, Homo sapiens
tccaacaccacagacacaca

SEQ ID NO: 326457 - DNA, 22 bp, Homo sapiens
tccaacaccacagacacacaca

SEQ ID NO: 326458 - DNA, 22 bp, Homo sapiens
tccaacactttgagcattttta

SEQ ID NO: 326459 - DNA, 12 bp, Homo sapiens
tccaaccaggca

SEQ ID NO: 326460 - DNA, 19 bp, Homo sapiens
tccaacccaaagtattctt

SEQ ID NO: 326461 - DNA, 21 bp, Homo sapiens
tccaacccatgcatggcctcc

SEQ ID NO: 326462 - DNA, 20 bp, Homo sapiens
tccaaccccggggcatggac

SEQ ID NO: 326463 - DNA, 16 bp, Homo sapiens
tccaacccctttgctg

SEQ ID NO: 326464 - DNA, 18 bp, Homo sapiens
tccaacgtggggcagcac

SEQ ID NO: 326465 - DNA, 16 bp, Homo sapiens
tccaacgttaaaagac

SEQ ID NO: 326466 - DNA, 19 bp, Homo sapiens
acggtcatgatgtctgcaa

SEQ ID NO: 326467 - DNA, 19 bp, Homo sapiens
acggtcctttaggcagcct

SEQ ID NO: 326468 - DNA, 15 bp, Homo sapiens
acggtttctgttctg

SEQ ID NO: 326469 - DNA, 18 bp, Homo sapiens
acggtttctgttctgccc

SEQ ID NO: 326470 - DNA, 21 bp, Homo sapiens
acgtacccaaggtcacatagc

SEQ ID NO: 326471 - DNA, 16 bp, Homo sapiens
acgtactcctcagacg

SEQ ID NO: 326472 - DNA, 14 bp, Homo sapiens
acgtactctggtta

SEQ ID NO: 326473 - DNA, 23 bp, Homo sapiens
acgtacttaactgtgtgaagaaa

SEQ ID NO: 326474 - DNA, 15 bp, Homo sapiens
acgtagtgagccttg

SEQ ID NO: 326475 - DNA, 18 bp, Homo sapiens
acgtataaatatgaaatg

SEQ ID NO: 326476 - DNA, 13 bp, Homo sapiens
acgtatgtatttc

SEQ ID NO: 326477 - DNA, 17 bp, Homo sapiens
acgtcactgccagagct

SEQ ID NO: 326478 - DNA, 11 bp, Homo sapiens
acgtcattcag

SEQ ID NO: 326479 - DNA, 13 bp, Homo sapiens
acgtccccctggg

SEQ ID NO: 326480 - DNA, 12 bp, Homo sapiens
acgtccctccac

SEQ ID NO: 326481 - DNA, 22 bp, Homo sapiens
acgtccctccacgttcacccct

SEQ ID NO: 326482 - DNA, 13 bp, Homo sapiens
acgtcctggaatg

SEQ ID NO: 326483 - DNA, 15 bp, Homo sapiens
acgtcctggaatgaa

SEQ ID NO: 326484 - DNA, 18 bp, Homo sapiens
acgtcctggaatgaagca

SEQ ID NO: 326485 - DNA, 16 bp, Homo sapiens
acgtctgaccctctcc

SEQ ID NO: 326486 - DNA, 12 bp, Homo sapiens
acgtctgccagg

SEQ ID NO: 326487 - DNA, 15 bp, Homo sapiens
acgtctgccaggccc

SEQ ID NO: 326488 - DNA, 18 bp, Homo sapiens
acgtctgccaggcccatc

SEQ ID NO: 326489 - DNA, 19 bp, Homo sapiens
acgtctgccaggcccatct

SEQ ID NO: 326490 - DNA, 17 bp, Homo sapiens
tcagcagttaccgagga

SEQ ID NO: 326491 - DNA, 14 bp, Homo sapiens
tcagcagttcactt

SEQ ID NO: 326492 - DNA, 20 bp, Homo sapiens
tcagcagttgacatccaaat

SEQ ID NO: 326493 - DNA, 21 bp, Homo sapiens
tcagcatcaaacatgaaaaca

SEQ ID NO: 326494 - DNA, 18 bp, Homo sapiens
tcagcattattcttcaga

SEQ ID NO: 326495 - DNA, 16 bp, Homo sapiens
tcagcattcaaaatag

SEQ ID NO: 326496 - DNA, 23 bp, Homo sapiens
tcagcattcaaaatagttctatt

SEQ ID NO: 326497 - DNA, 20 bp, Homo sapiens
tcagcattctcactcctacc

SEQ ID NO: 326498 - DNA, 18 bp, Homo sapiens
tcagcatttactttgttt

SEQ ID NO: 326499 - DNA, 16 bp, Homo sapiens
tcagccaaatgcaggg

SEQ ID NO: 326500 - DNA, 23 bp, Homo sapiens
tcagccaagacaaggaggtagag

SEQ ID NO: 326501 - DNA, 16 bp, Homo sapiens
tcagccagctgcccac

SEQ ID NO: 326502 - DNA, 13 bp, Homo sapiens
tcagccagcttgg

SEQ ID NO: 326503 - DNA, 14 bp, Homo sapiens
tcagccattcctgt

SEQ ID NO: 326504 - DNA, 19 bp, Homo sapiens
tcagccattcctgttctct

SEQ ID NO: 326505 - DNA, 12 bp, Homo sapiens
tcagcccacccc

SEQ ID NO: 326506 - DNA, 14 bp, Homo sapiens
tcagcccacccccc

SEQ ID NO: 326507 - DNA, 20 bp, Homo sapiens
tcagcccaggtcagctgtta

SEQ ID NO: 326508 - DNA, 15 bp, Homo sapiens
tcagccccagcccag

SEQ ID NO: 326509 - DNA, 22 bp, Homo sapiens
tcagccccagcccagcccagct

SEQ ID NO: 326510 - DNA, 14 bp, Homo sapiens
tcagccccagggcc

SEQ ID NO: 326511 - DNA, 12 bp, Homo sapiens
tcagcccctctt

SEQ ID NO: 326512 - DNA, 21 bp, Homo sapiens
tcagcccctgctgctcctcgg

SEQ ID NO: 326513 - DNA, 20 bp, Homo sapiens
tcagcccgctggagcatgag

SEQ ID NO: 326514 - DNA, 13 bp, Homo sapiens
tcagccctccctg

SEQ ID NO: 326515 - DNA, 16 bp, Homo sapiens
tcagccctccctgccc

SEQ ID NO: 326516 - DNA, 14 bp, Homo sapiens
tcagccctgccctt

SEQ ID NO: 326517 - DNA, 23 bp, Homo sapiens
tcagccctgcccttcagcatcct

SEQ ID NO: 326518 - DNA, 20 bp, Homo sapiens
tcagccgagccgggcctggg

SEQ ID NO: 326519 - DNA, 22 bp, Homo sapiens
tcagccgagccgggcctggggc

SEQ ID NO: 326520 - DNA, 18 bp, Homo sapiens
tcagcctaggggtcaggg

SEQ ID NO: 326521 - DNA, 20 bp, Homo sapiens
tcagcctcccgagtagctgg

SEQ ID NO: 326522 - DNA, 20 bp, Homo sapiens
tcagcctccctagtagctgg

SEQ ID NO: 326523 - DNA, 22 bp, Homo sapiens
tcagcctcttaaagctgcctgt

SEQ ID NO: 326524 - DNA, 10 bp, Homo sapiens
tcagcctgag

SEQ ID NO: 326525 - DNA, 19 bp, Homo sapiens
tcagcctgagtctcctgtg

SEQ ID NO: 326526 - DNA, 15 bp, Homo sapiens
tcagccttacatttg

SEQ ID NO: 326527 - DNA, 20 bp, Homo sapiens
tcagccttccaagtagctgg

SEQ ID NO: 326528 - DNA, 16 bp, Homo sapiens
tcagcgctccctgtcg

SEQ ID NO: 326529 - DNA, 19 bp, Homo sapiens
tcagcgctccctgtcgcct

SEQ ID NO: 326530 - DNA, 13 bp, Homo sapiens
tcagcgctgccca

SEQ ID NO: 326531 - DNA, 14 bp, Homo sapiens
tcagcgctgcccac

SEQ ID NO: 326532 - DNA, 17 bp, Homo sapiens
tcagcgctgcccacacc

SEQ ID NO: 326533 - DNA, 15 bp, Homo sapiens
tcagctactgatttt

SEQ ID NO: 326534 - DNA, 16 bp, Homo sapiens
tcagctattaagaaaa

SEQ ID NO: 326535 - DNA, 21 bp, Homo sapiens
tcagctccactctgaagtccc

SEQ ID NO: 326536 - DNA, 19 bp, Homo sapiens
tcagctcccttcccctgcc

SEQ ID NO: 326537 - DNA, 21 bp, Homo sapiens
tcagctcccttcccctgcctg

SEQ ID NO: 326538 - DNA, 12 bp, Homo sapiens
tcagctctccac

SEQ ID NO: 326539 - DNA, 13 bp, Homo sapiens
tcagctctctgca

SEQ ID NO: 326540 - DNA, 15 bp, Homo sapiens
tcagctctctgcaga

SEQ ID NO: 326541 - DNA, 14 bp, Homo sapiens
tcagctctctggga

SEQ ID NO: 326542 - DNA, 15 bp, Homo sapiens
tcagctctggccaca

SEQ ID NO: 326543 - DNA, 11 bp, Homo sapiens
tcagctctggg

SEQ ID NO: 326544 - DNA, 18 bp, Homo sapiens
tcagctctgggagaggat

SEQ ID NO: 326545 - DNA, 17 bp, Homo sapiens
tcagctgacacataatt

SEQ ID NO: 326546 - DNA, 16 bp, Homo sapiens
tcagctgcccccgctc

SEQ ID NO: 326547 - DNA, 24 bp, Homo sapiens
tcagctgcctcacttcctacaaga

SEQ ID NO: 326548 - DNA, 17 bp, Homo sapiens
tcagctgcctgaaacag

SEQ ID NO: 326549 - DNA, 22 bp, Homo sapiens
tcagctgcctgaaacagccatg

SEQ ID NO: 326550 - DNA, 17 bp, Homo sapiens
tcagctgctttgttacc

SEQ ID NO: 326551 - DNA, 21 bp, Homo sapiens
tcagctggcggaacctggctg

SEQ ID NO: 326552 - DNA, 11 bp, Homo sapiens
tcagctggtgg

SEQ ID NO: 326553 - DNA, 21 bp, Homo sapiens
tcagctggtggatggtgactt

SEQ ID NO: 326554 - DNA, 12 bp, Homo sapiens
tcagctgtactt

SEQ ID NO: 326555 - DNA, 17 bp, Homo sapiens
tcagctgtacttcgtct

SEQ ID NO: 326556 - DNA, 15 bp, Homo sapiens
tcagctgttcagatt

SEQ ID NO: 326557 - DNA, 21 bp, Homo sapiens
tcagcttaaaataaacagttg

SEQ ID NO: 326558 - DNA, 22 bp, Homo sapiens
tcagcttatgggatccttgtct

SEQ ID NO: 326559 - DNA, 16 bp, Homo sapiens
tcagcttcatttgtgt

SEQ ID NO: 326560 - DNA, 13 bp, Homo sapiens
tcagcttcttaat

SEQ ID NO: 326561 - DNA, 18 bp, Homo sapiens
tcagcttggttcctgccc

SEQ ID NO: 326562 - DNA, 20 bp, Homo sapiens
tcagcttgtttctatactgt

SEQ ID NO: 326563 - DNA, 17 bp, Homo sapiens
tcagctttcagagccag

SEQ ID NO: 326564 - DNA, 20 bp, Homo sapiens
tcagctttcagagccagtga

SEQ ID NO: 326565 - DNA, 15 bp, Homo sapiens
tcagctttccctggc

SEQ ID NO: 326566 - DNA, 17 bp, Homo sapiens
tcagctttgactttatc

SEQ ID NO: 326567 - DNA, 15 bp, Homo sapiens
tcagctttgccttcc

SEQ ID NO: 326568 - DNA, 16 bp, Homo sapiens
tcagctttgccttcca

SEQ ID NO: 326569 - DNA, 22 bp, Homo sapiens
tcaggaaaggaagatgtaagaa

SEQ ID NO: 326570 - DNA, 17 bp, Homo sapiens
tcaggaacagtggctgg

SEQ ID NO: 326571 - DNA, 16 bp, Homo sapiens
tcaggaacctggacca

SEQ ID NO: 326572 - DNA, 18 bp, Homo sapiens
tcaggaagcctcctgctg

SEQ ID NO: 326573 - DNA, 14 bp, Homo sapiens
tcaggaagggagag

SEQ ID NO: 326574 - DNA, 18 bp, Homo sapiens
tcaggaagggagaggagg

SEQ ID NO: 326575 - DNA, 19 bp, Homo sapiens
tcaggaagggagaggaggg

SEQ ID NO: 326576 - DNA, 12 bp, Homo sapiens
tcaggaatgggc

SEQ ID NO: 326577 - DNA, 21 bp, Homo sapiens
tcaggaatgggccaagccagg

SEQ ID NO: 326578 - DNA, 22 bp, Homo sapiens
tcaggaatgggccaagccaggg

SEQ ID NO: 326579 - DNA, 15 bp, Homo sapiens
tcaggacccaggccc

SEQ ID NO: 326580 - DNA, 17 bp, Homo sapiens
tcaggacccaggccctc

SEQ ID NO: 326581 - DNA, 19 bp, Homo sapiens
tcaggacccaggccctcca

SEQ ID NO: 326582 - DNA, 22 bp, Homo sapiens
tcaggacccaggccctccatgg

SEQ ID NO: 326583 - DNA, 15 bp, Homo sapiens
tcaggaccccatctg

SEQ ID NO: 326584 - DNA, 19 bp, Homo sapiens
tcaggaccccatctgctga

SEQ ID NO: 326585 - DNA, 20 bp, Homo sapiens
tcaggaccccatctgctgag

SEQ ID NO: 326586 - DNA, 22 bp, Homo sapiens
tcaggagaaggcctgcccccct

SEQ ID NO: 326587 - DNA, 20 bp, Homo sapiens
tcaggagagagcttcctgtt

SEQ ID NO: 326588 - DNA, 16 bp, Homo sapiens
tcaggagagtaaaaat

SEQ ID NO: 326589 - DNA, 16 bp, Homo sapiens
tcaggagatgatgtga

SEQ ID NO: 326590 - DNA, 11 bp, Homo sapiens
tcaggagcaca

SEQ ID NO: 326591 - DNA, 18 bp, Homo sapiens
tcaggagcacaggcagct

SEQ ID NO: 326592 - DNA, 19 bp, Homo sapiens
tcaggaggagacagtcagg

SEQ ID NO: 326593 - DNA, 13 bp, Homo sapiens
tcaggagggattg

SEQ ID NO: 326594 - DNA, 22 bp, Homo sapiens
tcaggaggtgcctgagagcaga

SEQ ID NO: 326595 - DNA, 16 bp, Homo sapiens
tcaggatgaacccagg

SEQ ID NO: 326596 - DNA, 23 bp, Homo sapiens
tcaggatgcacggtttctgttct

SEQ ID NO: 326597 - DNA, 15 bp, Homo sapiens
tcaggcaagcccctc

SEQ ID NO: 326598 - DNA, 15 bp, Homo sapiens
tcaggcaaggcagct

SEQ ID NO: 326599 - DNA, 14 bp, Homo sapiens
tcaggcactggtgg

SEQ ID NO: 326600 - DNA, 20 bp, Homo sapiens
tcaggcagaggatgttctgg

SEQ ID NO: 326601 - DNA, 22 bp, Homo sapiens
tcaggcagaggatgttctggac

SEQ ID NO: 326602 - DNA, 24 bp, Homo sapiens
tcaggcagaggatgttctggacct

SEQ ID NO: 326603 - DNA, 16 bp, Homo sapiens
tcaggcagtagcagct

SEQ ID NO: 326604 - DNA, 16 bp, Homo sapiens
tcaggcataggcctgg

SEQ ID NO: 326605 - DNA, 20 bp, Homo sapiens
tcaggcataggcctgggtgc

SEQ ID NO: 326606 - DNA, 22 bp, Homo sapiens
tcaggcataggcctgggtgctg

SEQ ID NO: 326607 - DNA, 20 bp, Homo sapiens
tcaggcccacattgcccaca

SEQ ID NO: 326608 - DNA, 13 bp, Homo sapiens
tcaggccctggaa

SEQ ID NO: 326609 - DNA, 22 bp, Homo sapiens
tcaggccgggtgcagtggctcc

SEQ ID NO: 326610 - DNA, 23 bp, Homo sapiens
tcaggcctcacctggcttcccag

SEQ ID NO: 326611 - DNA, 17 bp, Homo sapiens
tcaggcctccctctctc

SEQ ID NO: 326612 - DNA, 18 bp, Homo sapiens
tcaggcctccctctctct

SEQ ID NO: 326613 - DNA, 14 bp, Homo sapiens
tcaggcctgccaat

SEQ ID NO: 326614 - DNA, 17 bp, Homo sapiens
tcaggcctgccaatgcc

SEQ ID NO: 326615 - DNA, 22 bp, Homo sapiens
tcaggcctgccaatgccacagc

SEQ ID NO: 326616 - DNA, 12 bp, Homo sapiens
tcaggcgcagcc

SEQ ID NO: 326617 - DNA, 16 bp, Homo sapiens
tcaggcgcagccctag

SEQ ID NO: 326618 - DNA, 16 bp, Homo sapiens
tcaggctctgaatctc

SEQ ID NO: 326619 - DNA, 17 bp, Homo sapiens
tcaggctgcagaggcac

SEQ ID NO: 326620 - DNA, 15 bp, Homo sapiens
tcaggctgctggagg

SEQ ID NO: 326621 - DNA, 17 bp, Homo sapiens
tccaagtaccaatgctg

SEQ ID NO: 326622 - DNA, 20 bp, Homo sapiens
tccaagtccaacctgcctgt

SEQ ID NO: 326623 - DNA, 16 bp, Homo sapiens
tccaagtctctctgtg

SEQ ID NO: 326624 - DNA, 15 bp, Homo sapiens
tccaagtgtgtgtgc

SEQ ID NO: 326625 - DNA, 17 bp, Homo sapiens
tccaagtgtttcttgtt

SEQ ID NO: 326626 - DNA, 14 bp, Homo sapiens
tccaagttcacagt

SEQ ID NO: 326627 - DNA, 20 bp, Homo sapiens
tccaagttcttcacctctat

SEQ ID NO: 326628 - DNA, 14 bp, Homo sapiens
tccaatcctcactg

SEQ ID NO: 326629 - DNA, 17 bp, Homo sapiens
tccaatcctcactgggt

SEQ ID NO: 326630 - DNA, 22 bp, Homo sapiens
tccaatcctggctctgtggctt

SEQ ID NO: 326631 - DNA, 14 bp, Homo sapiens
tccaatcctttcca

SEQ ID NO: 326632 - DNA, 23 bp, Homo sapiens
tccaatgtggtggcaataaatgt

SEQ ID NO: 326633 - DNA, 16 bp, Homo sapiens
tccaattaaaattaag

SEQ ID NO: 326634 - DNA, 15 bp, Homo sapiens
tccaattatgtgaca

SEQ ID NO: 326635 - DNA, 16 bp, Homo sapiens
tccaattatgtgacaa

SEQ ID NO: 326636 - DNA, 15 bp, Homo sapiens
tccaattccaaaatt

SEQ ID NO: 326637 - DNA, 14 bp, Homo sapiens
tccacaaatgtcct

SEQ ID NO: 326638 - DNA, 19 bp, Homo sapiens
tccacaaatgtcctcagag

SEQ ID NO: 326639 - DNA, 17 bp, Homo sapiens
tccacaacctcctcctc

SEQ ID NO: 326640 - DNA, 10 bp, Homo sapiens
tccacacacc

SEQ ID NO: 326641 - DNA, 14 bp, Homo sapiens
tccacacatttaaa

SEQ ID NO: 326642 - DNA, 15 bp, Homo sapiens
tccacacatttaaaa

SEQ ID NO: 326643 - DNA, 19 bp, Homo sapiens
tccacacatttaaaacatt

SEQ ID NO: 326644 - DNA, 17 bp, Homo sapiens
tccacaccagtggcctc

SEQ ID NO: 326645 - DNA, 15 bp, Homo sapiens
tccacacccatgact

SEQ ID NO: 326646 - DNA, 19 bp, Homo sapiens
tccacacccatgactgccc

SEQ ID NO: 326647 - DNA, 21 bp, Homo sapiens
tccacacccatgactgcccct

SEQ ID NO: 326648 - DNA, 19 bp, Homo sapiens
tccacacctccacccgtcc

SEQ ID NO: 326649 - DNA, 21 bp, Homo sapiens
tccacacctccacccgtcctg

SEQ ID NO: 326650 - DNA, 23 bp, Homo sapiens
tccacacgtttgatttcttcctg

SEQ ID NO: 326651 - DNA, 18 bp, Homo sapiens
tccacagaaaccctgttt

SEQ ID NO: 326652 - DNA, 13 bp, Homo sapiens
tccacaggggcag

SEQ ID NO: 326653 - DNA, 19 bp, Homo sapiens
tccacaggggcaggcctgg

SEQ ID NO: 326654 - DNA, 13 bp, Homo sapiens
tccacagtattgt

SEQ ID NO: 326655 - DNA, 16 bp, Homo sapiens
tccacagtattgttct

SEQ ID NO: 326656 - DNA, 23 bp, Homo sapiens
tccacagtattgttcttgtaaaa

SEQ ID NO: 326657 - DNA, 13 bp, Homo sapiens
tccacagtgctgc

SEQ ID NO: 326658 - DNA, 14 bp, Homo sapiens
tccacatcccagca

SEQ ID NO: 326659 - DNA, 17 bp, Homo sapiens
tccacatctaacaaagt

SEQ ID NO: 326660 - DNA, 14 bp, Homo sapiens
tccacatgctctga

SEQ ID NO: 326661 - DNA, 12 bp, Homo sapiens
tccacattctac

SEQ ID NO: 326662 - DNA, 18 bp, Homo sapiens
tccacattctacttcagc

SEQ ID NO: 326663 - DNA, 15 bp, Homo sapiens
tccacattctgctgc

SEQ ID NO: 326664 - DNA, 19 bp, Homo sapiens
tccacattctgctgccccc

SEQ ID NO: 326665 - DNA, 20 bp, Homo sapiens
tccaccaagggtatctgctg

SEQ ID NO: 326666 - DNA, 16 bp, Homo sapiens
tccaccacaagagctc

SEQ ID NO: 326667 - DNA, 19 bp, Homo sapiens
tccaccaggaacctcttca

SEQ ID NO: 326668 - DNA, 16 bp, Homo sapiens
tccaccaggattaatc

SEQ ID NO: 326669 - DNA, 20 bp, Homo sapiens
tccacccaaaccccttccca

SEQ ID NO: 326670 - DNA, 13 bp, Homo sapiens
tccacccacctgg

SEQ ID NO: 326671 - DNA, 11 bp, Homo sapiens
tccacccagcc

SEQ ID NO: 326672 - DNA, 12 bp, Homo sapiens
tccacccagccc

SEQ ID NO: 326673 - DNA, 13 bp, Homo sapiens
tccacccagcccc

SEQ ID NO: 326674 - DNA, 15 bp, Homo sapiens
tccacccaggctgca

SEQ ID NO: 326675 - DNA, 16 bp, Homo sapiens
tccacccaggctgcac

SEQ ID NO: 326676 - DNA, 18 bp, Homo sapiens
tccacccaggctgcactg

SEQ ID NO: 326677 - DNA, 20 bp, Homo sapiens
tccacccaggctgcactgca

SEQ ID NO: 326678 - DNA, 21 bp, Homo sapiens
tccacccaggctgcactgcag

SEQ ID NO: 326679 - DNA, 22 bp, Homo sapiens
tccacccaggctgcactgcagt

SEQ ID NO: 326680 - DNA, 16 bp, Homo sapiens
tccacccagtgctgcc

SEQ ID NO: 326681 - DNA, 17 bp, Homo sapiens
tccacccagtgctgcca

SEQ ID NO: 326682 - DNA, 15 bp, Homo sapiens
tccacccccaagaaa

SEQ ID NO: 326683 - DNA, 18 bp, Homo sapiens
tccacccccaccactctt

SEQ ID NO: 326684 - DNA, 23 bp, Homo sapiens
tccacccccgccacggccaccct

SEQ ID NO: 326685 - DNA, 23 bp, Homo sapiens
tccacccccgcctccctcccctg

SEQ ID NO: 326686 - DNA, 15 bp, Homo sapiens
tccaccccctccctg

SEQ ID NO: 326687 - DNA, 20 bp, Homo sapiens
tccaccccctccctggcctg

SEQ ID NO: 326688 - DNA, 16 bp, Homo sapiens
tccaccccctcctgtc

SEQ ID NO: 326689 - DNA, 22 bp, Homo sapiens
tccaccccggctccccctgcca

SEQ ID NO: 326690 - DNA, 20 bp, Homo sapiens
tccacccctcaagccaggag

SEQ ID NO: 326691 - DNA, 16 bp, Homo sapiens
tccacccgtttccaag

SEQ ID NO: 326692 - DNA, 21 bp, Homo sapiens
tccacccgtttccaagcctgg

SEQ ID NO: 326693 - DNA, 23 bp, Homo sapiens
tccacccgtttccaagcctgggc

SEQ ID NO: 326694 - DNA, 20 bp, Homo sapiens
tccaccctcatttctgccag

SEQ ID NO: 326695 - DNA, 17 bp, Homo sapiens
tccaccctcccctcttc

SEQ ID NO: 326696 - DNA, 17 bp, Homo sapiens
tccaccctgcagccagg

SEQ ID NO: 326697 - DNA, 13 bp, Homo sapiens
tccacccttggcc

SEQ ID NO: 326698 - DNA, 14 bp, Homo sapiens
tccacccttggcct

SEQ ID NO: 326699 - DNA, 17 bp, Homo sapiens
tccaccgagccagcttg

SEQ ID NO: 326700 - DNA, 15 bp, Homo sapiens
tccaccggtgcctcc

SEQ ID NO: 326701 - DNA, 17 bp, Homo sapiens
tccacctcacaactcct

SEQ ID NO: 326702 - DNA, 18 bp, Homo sapiens
tccacctcacaactcctt

SEQ ID NO: 326703 - DNA, 22 bp, Homo sapiens
tccacctcccccaaaccctgct

SEQ ID NO: 326704 - DNA, 19 bp, Homo sapiens
tccacctcctctcttggac

SEQ ID NO: 326705 - DNA, 14 bp, Homo sapiens
tccacctgagctgc

SEQ ID NO: 326706 - DNA, 13 bp, Homo sapiens
tccacctgcctat

SEQ ID NO: 326707 - DNA, 16 bp, Homo sapiens
tccacctgggagatgc

SEQ ID NO: 326708 - DNA, 13 bp, Homo sapiens
tccacctgtctca

SEQ ID NO: 326709 - DNA, 14 bp, Homo sapiens
tccacctgtgctgc

SEQ ID NO: 326710 - DNA, 15 bp, Homo sapiens
tccacctgtgctgct

SEQ ID NO: 326711 - DNA, 16 bp, Homo sapiens
tccacctgtgctgctg

SEQ ID NO: 326712 - DNA, 17 bp, Homo sapiens
tccaccttaaattaaac

SEQ ID NO: 326713 - DNA, 18 bp, Homo sapiens
tccaccttaaattaaaca

SEQ ID NO: 326714 - DNA, 18 bp, Homo sapiens
tccaccttcccatgccct

SEQ ID NO: 326715 - DNA, 20 bp, Homo sapiens
tccacgaagccttaagccat

SEQ ID NO: 326716 - DNA, 19 bp, Homo sapiens
tccacgcacatgcgacccc

SEQ ID NO: 326717 - DNA, 19 bp, Homo sapiens
tccacgctgtctccagacc

SEQ ID NO: 326718 - DNA, 20 bp, Homo sapiens
tccacgctgtctccagaccc

SEQ ID NO: 326719 - DNA, 21 bp, Homo sapiens
tccacgctgtctccagacccc

SEQ ID NO: 326720 - DNA, 20 bp, Homo sapiens
tccacggctctaggtggggc

SEQ ID NO: 326721 - DNA, 22 bp, Homo sapiens
tccacgggtctcacttatacca

SEQ ID NO: 326722 - DNA, 21 bp, Homo sapiens
tccacggtgcgtggctgtggc

SEQ ID NO: 326723 - DNA, 15 bp, Homo sapiens
tccacgtaattcaat

SEQ ID NO: 326724 - DNA, 21 bp, Homo sapiens
tccactaatattcagtcctgt

SEQ ID NO: 326725 - DNA, 14 bp, Homo sapiens
tccactaccctccc

SEQ ID NO: 326726 - DNA, 19 bp, Homo sapiens
tccactaccctccctcgca

SEQ ID NO: 326727 - DNA, 13 bp, Homo sapiens
tccactcactcca

SEQ ID NO: 326728 - DNA, 14 bp, Homo sapiens
tccactcactccag

SEQ ID NO: 326729 - DNA, 21 bp, Homo sapiens
tccactcactccagcccaaca

SEQ ID NO: 326730 - DNA, 14 bp, Homo sapiens
tccactcactgcat

SEQ ID NO: 326731 - DNA, 22 bp, Homo sapiens
tccactcagcttggttcctgcc

SEQ ID NO: 326732 - DNA, 12 bp, Homo sapiens
tccactcagggc

SEQ ID NO: 326733 - DNA, 13 bp, Homo sapiens
tccactcagggct

SEQ ID NO: 326734 - DNA, 21 bp, Homo sapiens
ctgcctgccccacacggactc

SEQ ID NO: 326735 - DNA, 23 bp, Homo sapiens
ctgcctgcccgcacagcagcctg

SEQ ID NO: 326736 - DNA, 16 bp, Homo sapiens
ctgcctgcctcatgct

SEQ ID NO: 326737 - DNA, 15 bp, Homo sapiens
ctgcctgcctccggc

SEQ ID NO: 326738 - DNA, 16 bp, Homo sapiens
ctgcctgcctgggaac

SEQ ID NO: 326739 - DNA, 22 bp, Homo sapiens
ctgcctggacttggcccctgcc

SEQ ID NO: 326740 - DNA, 14 bp, Homo sapiens
ctgcctggagaaag

SEQ ID NO: 326741 - DNA, 13 bp, Homo sapiens
ctgcctggccagg

SEQ ID NO: 326742 - DNA, 14 bp, Homo sapiens
ctgcctggcccagg

SEQ ID NO: 326743 - DNA, 11 bp, Homo sapiens
ctgcctggcct

SEQ ID NO: 326744 - DNA, 16 bp, Homo sapiens
ctgcctggcctggctc

SEQ ID NO: 326745 - DNA, 14 bp, Homo sapiens
ctgcctggcgggca

SEQ ID NO: 326746 - DNA, 17 bp, Homo sapiens
ctgcctggcgggcagcc

SEQ ID NO: 326747 - DNA, 20 bp, Homo sapiens
ctgcctggcgggcagcccct

SEQ ID NO: 326748 - DNA, 11 bp, Homo sapiens
ctgcctgggaa

SEQ ID NO: 326749 - DNA, 12 bp, Homo sapiens
ctgcctgggcct

SEQ ID NO: 326750 - DNA, 13 bp, Homo sapiens
ctgcctgggcctg

SEQ ID NO: 326751 - DNA, 14 bp, Homo sapiens
ctgcctgggcctgt

SEQ ID NO: 326752 - DNA, 17 bp, Homo sapiens
ctgcctgggcctgtgca

SEQ ID NO: 326753 - DNA, 21 bp, Homo sapiens
ctgcctgggcctgtgcagcag

SEQ ID NO: 326754 - DNA, 22 bp, Homo sapiens
ctgcctgggcctgtgcagcagc

SEQ ID NO: 326755 - DNA, 18 bp, Homo sapiens
ctgcctgtagttaggaaa

SEQ ID NO: 326756 - DNA, 19 bp, Homo sapiens
ctgcctgtccctctcaggc

SEQ ID NO: 326757 - DNA, 23 bp, Homo sapiens
ctgcctgtccctctcaggcatgc

SEQ ID NO: 326758 - DNA, 13 bp, Homo sapiens
ctgcctgtctgtc

SEQ ID NO: 326759 - DNA, 14 bp, Homo sapiens
ctgcctgtgagtga

SEQ ID NO: 326760 - DNA, 13 bp, Homo sapiens
ctgcctgtggcct

SEQ ID NO: 326761 - DNA, 18 bp, Homo sapiens
ctgcctgttaagtctgag

SEQ ID NO: 326762 - DNA, 22 bp, Homo sapiens
ctgcctgttaagtctgagaagg

SEQ ID NO: 326763 - DNA, 21 bp, Homo sapiens
ctgcctgttataactctgcac

SEQ ID NO: 326764 - DNA, 21 bp, Homo sapiens
ctgccttaaccttctggggga

SEQ ID NO: 326765 - DNA, 21 bp, Homo sapiens
ctgccttaatgacattcccct

SEQ ID NO: 326766 - DNA, 22 bp, Homo sapiens
ctgccttaatgacattcccctc

SEQ ID NO: 326767 - DNA, 15 bp, Homo sapiens
ctgccttagaggagc

SEQ ID NO: 326768 - DNA, 17 bp, Homo sapiens
ctgccttatcttgcacc

SEQ ID NO: 326769 - DNA, 18 bp, Homo sapiens
ctgccttcagccctggcc

SEQ ID NO: 326770 - DNA, 22 bp, Homo sapiens
ctgccttcagtatcaaggctgc

SEQ ID NO: 326771 - DNA, 17 bp, Homo sapiens
ctgccttccagcccaga

SEQ ID NO: 326772 - DNA, 12 bp, Homo sapiens
ctgccttccagg

SEQ ID NO: 326773 - DNA, 13 bp, Homo sapiens
ctgccttccaggc

SEQ ID NO: 326774 - DNA, 22 bp, Homo sapiens
ctgccttccaggcgtagggcca

SEQ ID NO: 326775 - DNA, 16 bp, Homo sapiens
ctgccttcctcatccc

SEQ ID NO: 326776 - DNA, 13 bp, Homo sapiens
ctgccttcgttaa

SEQ ID NO: 326777 - DNA, 19 bp, Homo sapiens
ctgccttcgttaactgtgt

SEQ ID NO: 326778 - DNA, 17 bp, Homo sapiens
ctgccttctcctctctg

SEQ ID NO: 326779 - DNA, 16 bp, Homo sapiens
ctgccttctcttctat

SEQ ID NO: 326780 - DNA, 19 bp, Homo sapiens
ctgccttctgacggccctg

SEQ ID NO: 326781 - DNA, 21 bp, Homo sapiens
ctgccttctgacggccctgca

SEQ ID NO: 326782 - DNA, 22 bp, Homo sapiens
ctgccttctgacggccctgcaa

SEQ ID NO: 326783 - DNA, 16 bp, Homo sapiens
ctgccttgatggagaa

SEQ ID NO: 326784 - DNA, 23 bp, Homo sapiens
ctgccttggactgtgtttttcct

SEQ ID NO: 326785 - DNA, 15 bp, Homo sapiens
ctgccttgtccctct

SEQ ID NO: 326786 - DNA, 18 bp, Homo sapiens
ctgccttgtccctctcac

SEQ ID NO: 326787 - DNA, 19 bp, Homo sapiens
ctgcgaccacaagaaggat

SEQ ID NO: 326788 - DNA, 13 bp, Homo sapiens
ctgcgaccgccag

SEQ ID NO: 326789 - DNA, 18 bp, Homo sapiens
ctgcgaccgccagattct

SEQ ID NO: 326790 - DNA, 12 bp, Homo sapiens
ctgcgccctccc

SEQ ID NO: 326791 - DNA, 21 bp, Homo sapiens
ctgcgccctccctccctccac

SEQ ID NO: 326792 - DNA, 23 bp, Homo sapiens
ctgcgccctccctccctccacac

SEQ ID NO: 326793 - DNA, 18 bp, Homo sapiens
ctgcgcccttaccttccc

SEQ ID NO: 326794 - DNA, 16 bp, Homo sapiens
gtgatagagcctttga

SEQ ID NO: 326795 - DNA, 20 bp, Homo sapiens
gtgataggcccaaggtcccc

SEQ ID NO: 326796 - DNA, 16 bp, Homo sapiens
gtgatatgtgtaatat

SEQ ID NO: 326797 - DNA, 17 bp, Homo sapiens
gtgatcaccacatcttt

SEQ ID NO: 326798 - DNA, 13 bp, Homo sapiens
gtgatcagcagag

SEQ ID NO: 326799 - DNA, 14 bp, Homo sapiens
gtgatcagcagaga

SEQ ID NO: 326800 - DNA, 14 bp, Homo sapiens
gtgatccacctgcc

SEQ ID NO: 326801 - DNA, 19 bp, Homo sapiens
gtgatcctctattttgtga

SEQ ID NO: 326802 - DNA, 13 bp, Homo sapiens
gtgatctccatat

SEQ ID NO: 326803 - DNA, 14 bp, Homo sapiens
gtgatgaactttct

SEQ ID NO: 326804 - DNA, 19 bp, Homo sapiens
gtgatgagctgaaaagtga

SEQ ID NO: 326805 - DNA, 12 bp, Homo sapiens
gtgatgatgctg

SEQ ID NO: 326806 - DNA, 17 bp, Homo sapiens
gtgatgatttgggggag

SEQ ID NO: 326807 - DNA, 11 bp, Homo sapiens
gtgatgcaagt

SEQ ID NO: 326808 - DNA, 15 bp, Homo sapiens
gtgatgcaagtcact

SEQ ID NO: 326809 - DNA, 16 bp, Homo sapiens
gtgatggaacacacac

SEQ ID NO: 326810 - DNA, 12 bp, Homo sapiens
gtgatggcatta

SEQ ID NO: 326811 - DNA, 21 bp, Homo sapiens
gtgatggcgcgggaggcacca

SEQ ID NO: 326812 - DNA, 11 bp, Homo sapiens
gtgatgggagt

SEQ ID NO: 326813 - DNA, 14 bp, Homo sapiens
gtgatgggagtaag

SEQ ID NO: 326814 - DNA, 20 bp, Homo sapiens
gtgatggtctcacagagcca

SEQ ID NO: 326815 - DNA, 14 bp, Homo sapiens
gtgatgtgatttat

SEQ ID NO: 326816 - DNA, 18 bp, Homo sapiens
gtgatgtgcctgtaatct

SEQ ID NO: 326817 - DNA, 22 bp, Homo sapiens
gtgatgtttaacaggaagatct

SEQ ID NO: 326818 - DNA, 19 bp, Homo sapiens
gtgattatttgttatttgt

SEQ ID NO: 326819 - DNA, 20 bp, Homo sapiens
gtgattgacattttgtagct

SEQ ID NO: 326820 - DNA, 12 bp, Homo sapiens
gtgattgctttt

SEQ ID NO: 326821 - DNA, 15 bp, Homo sapiens
gtgatttacatgctg

SEQ ID NO: 326822 - DNA, 18 bp, Homo sapiens
gtgatttagaactgtatg

SEQ ID NO: 326823 - DNA, 14 bp, Homo sapiens
gtgatttatttgga

SEQ ID NO: 326824 - DNA, 15 bp, Homo sapiens
gtgatttatttggag

SEQ ID NO: 326825 - DNA, 12 bp, Homo sapiens
gtgatttccatt

SEQ ID NO: 326826 - DNA, 16 bp, Homo sapiens
gtgatttccatttctg

SEQ ID NO: 326827 - DNA, 20 bp, Homo sapiens
gtgatttggaagagaggcac

SEQ ID NO: 326828 - DNA, 23 bp, Homo sapiens
gtgatttggaagagaggcacctg

SEQ ID NO: 326829 - DNA, 15 bp, Homo sapiens
gtgatttttttttag

SEQ ID NO: 326830 - DNA, 14 bp, Homo sapiens
gtgcaaagaaaaga

SEQ ID NO: 326831 - DNA, 12 bp, Homo sapiens
gtgcaacagcac

SEQ ID NO: 326832 - DNA, 14 bp, Homo sapiens
gtgcaactcttgta

SEQ ID NO: 326833 - DNA, 15 bp, Homo sapiens
gtgcaactcttgtat

SEQ ID NO: 326834 - DNA, 18 bp, Homo sapiens
gtgcaagtgtctgtgtgc

SEQ ID NO: 326835 - DNA, 20 bp, Homo sapiens
gtgcaagtgtgtgcatgtgt

SEQ ID NO: 326836 - DNA, 12 bp, Homo sapiens
gtgcaatatgag

SEQ ID NO: 326837 - DNA, 23 bp, Homo sapiens
gtgcaatatgaggggactgcatg

SEQ ID NO: 326838 - DNA, 16 bp, Homo sapiens
gtgcaattgtgaggga

SEQ ID NO: 326839 - DNA, 20 bp, Homo sapiens
gtgcacagacgtccctccac

SEQ ID NO: 326840 - DNA, 15 bp, Homo sapiens
gtgcacccactctgc

SEQ ID NO: 326841 - DNA, 14 bp, Homo sapiens
gtgcaccgtgcagc

SEQ ID NO: 326842 - DNA, 14 bp, Homo sapiens
gtgcacggggccag

SEQ ID NO: 326843 - DNA, 15 bp, Homo sapiens
gtgcacgtggagagc

SEQ ID NO: 326844 - DNA, 20 bp, Homo sapiens
gtgcactctgctaatcatgt

SEQ ID NO: 326845 - DNA, 17 bp, Homo sapiens
gtgcactggccccaccc

SEQ ID NO: 326846 - DNA, 22 bp, Homo sapiens
gtgcagaaaaaaaaaaagaaac

SEQ ID NO: 326847 - DNA, 13 bp, Homo sapiens
gtgcagacaggcc

SEQ ID NO: 326848 - DNA, 15 bp, Homo sapiens
gtgcagactggaggg

SEQ ID NO: 326849 - DNA, 12 bp, Homo sapiens
gtgcagcagccc

SEQ ID NO: 326850 - DNA, 18 bp, Homo sapiens
gtgcagcagcccagcttc

SEQ ID NO: 326851 - DNA, 19 bp, Homo sapiens
gtgcagccccaggaccaag

SEQ ID NO: 326852 - DNA, 20 bp, Homo sapiens
gtgcagcccgtgtggcccct

SEQ ID NO: 326853 - DNA, 19 bp, Homo sapiens
gtgcagcccttcctcctga

SEQ ID NO: 326854 - DNA, 17 bp, Homo sapiens
gtgcagccttcccctcc

SEQ ID NO: 326855 - DNA, 18 bp, Homo sapiens
gtgcagccttcccctccc

SEQ ID NO: 326856 - DNA, 22 bp, Homo sapiens
gtgcagcggtggaaggagcctg

SEQ ID NO: 326857 - DNA, 14 bp, Homo sapiens
gtgcaggcgcgcac

SEQ ID NO: 326858 - DNA, 11 bp, Homo sapiens
gtgcaggtgct

SEQ ID NO: 326859 - DNA, 16 bp, Homo sapiens
gtgcaggtgctgcctt

SEQ ID NO: 326860 - DNA, 14 bp, Homo sapiens
gtgcagtagtgtca

SEQ ID NO: 326861 - DNA, 24 bp, Homo sapiens
gtgcagttcccccaacctcagact

SEQ ID NO: 326862 - DNA, 14 bp, Homo sapiens
gtgcatctcagccc

SEQ ID NO: 326863 - DNA, 15 bp, Homo sapiens
gtgcatctcagccca

SEQ ID NO: 326864 - DNA, 18 bp, Homo sapiens
gtgcatctcagcccacat

SEQ ID NO: 326865 - DNA, 12 bp, Homo sapiens
gttcctgcagca

SEQ ID NO: 326866 - DNA, 19 bp, Homo sapiens
gttcctgcccccgccctgc

SEQ ID NO: 326867 - DNA, 14 bp, Homo sapiens
gttcctgccttctc

SEQ ID NO: 326868 - DNA, 15 bp, Homo sapiens
gttcctgccttctct

SEQ ID NO: 326869 - DNA, 12 bp, Homo sapiens
gttcctgctttc

SEQ ID NO: 326870 - DNA, 15 bp, Homo sapiens
gttcctgctttctct

SEQ ID NO: 326871 - DNA, 22 bp, Homo sapiens
gttcctggcctcagccagctgc

SEQ ID NO: 326872 - DNA, 19 bp, Homo sapiens
gttcctggggtgccctcca

SEQ ID NO: 326873 - DNA, 23 bp, Homo sapiens
gttccttaagtggctgtgattaa

SEQ ID NO: 326874 - DNA, 17 bp, Homo sapiens
gttccttccctgggaag

SEQ ID NO: 326875 - DNA, 13 bp, Homo sapiens
gttccttcctgcg

SEQ ID NO: 326876 - DNA, 21 bp, Homo sapiens
gttccttcgagggttccaggc

SEQ ID NO: 326877 - DNA, 16 bp, Homo sapiens
gttcgagactccatct

SEQ ID NO: 326878 - DNA, 12 bp, Homo sapiens
gttcgcttggct

SEQ ID NO: 326879 - DNA, 19 bp, Homo sapiens
gttcgcttggctccatgct

SEQ ID NO: 326880 - DNA, 19 bp, Homo sapiens
gttcgtatagaaaaagcac

SEQ ID NO: 326881 - DNA, 17 bp, Homo sapiens
gttcgtggaaagggtgc

SEQ ID NO: 326882 - DNA, 21 bp, Homo sapiens
gttcgtggagccacaggcaga

SEQ ID NO: 326883 - DNA, 14 bp, Homo sapiens
gttctaaagatgga

SEQ ID NO: 326884 - DNA, 20 bp, Homo sapiens
gttctaaagatggaaaaacc

SEQ ID NO: 326885 - DNA, 20 bp, Homo sapiens
gttctaacagatcagaacat

SEQ ID NO: 326886 - DNA, 18 bp, Homo sapiens
gttctaattttggatgga

SEQ ID NO: 326887 - DNA, 17 bp, Homo sapiens
gttctagacgcccctcc

SEQ ID NO: 326888 - DNA, 19 bp, Homo sapiens
gttctagacgcccctccca

SEQ ID NO: 326889 - DNA, 15 bp, Homo sapiens
gttctagacttcccc

SEQ ID NO: 326890 - DNA, 21 bp, Homo sapiens
gttctagacttccccatcccg

SEQ ID NO: 326891 - DNA, 22 bp, Homo sapiens
gttctaggggagaagagccctg

SEQ ID NO: 326892 - DNA, 23 bp, Homo sapiens
gttctaggggagaagagccctgg

SEQ ID NO: 326893 - DNA, 21 bp, Homo sapiens
gttctagtctcctttgcactg

SEQ ID NO: 326894 - DNA, 21 bp, Homo sapiens
gttctagttagcaggaaatag

SEQ ID NO: 326895 - DNA, 19 bp, Homo sapiens
gttctatagcagtcatcat

SEQ ID NO: 326896 - DNA, 17 bp, Homo sapiens
gttctatccccaagctg

SEQ ID NO: 326897 - DNA, 21 bp, Homo sapiens
gttctatccccaagctggcca

SEQ ID NO: 326898 - DNA, 23 bp, Homo sapiens
gttctatttaagtgtactaatta

SEQ ID NO: 326899 - DNA, 22 bp, Homo sapiens
gttctatttctatctgcaaata

SEQ ID NO: 326900 - DNA, 15 bp, Homo sapiens
gttctattttacttt

SEQ ID NO: 326901 - DNA, 19 bp, Homo sapiens
gttctcactgttccctctg

SEQ ID NO: 326902 - DNA, 16 bp, Homo sapiens
gttctcagagccaagt

SEQ ID NO: 326903 - DNA, 11 bp, Homo sapiens
gttctcagcaa

SEQ ID NO: 326904 - DNA, 20 bp, Homo sapiens
gttctcagcaagtgtacagt

SEQ ID NO: 326905 - DNA, 16 bp, Homo sapiens
gttctcatccacagag

SEQ ID NO: 326906 - DNA, 19 bp, Homo sapiens
gttctcatgtttgtgcatg

SEQ ID NO: 326907 - DNA, 22 bp, Homo sapiens
gttctccagaatgtaagaaaac

SEQ ID NO: 326908 - DNA, 18 bp, Homo sapiens
gttctccaggtgattctg

SEQ ID NO: 326909 - DNA, 15 bp, Homo sapiens
gttctcccatggggg

SEQ ID NO: 326910 - DNA, 18 bp, Homo sapiens
gttctcctctcccctcta

SEQ ID NO: 326911 - DNA, 14 bp, Homo sapiens
gttctcctgcttgt

SEQ ID NO: 326912 - DNA, 16 bp, Homo sapiens
gttctgaataatttct

SEQ ID NO: 326913 - DNA, 16 bp, Homo sapiens
gttctgacattaacag

SEQ ID NO: 326914 - DNA, 17 bp, Homo sapiens
gttctgacattaacagt

SEQ ID NO: 326915 - DNA, 18 bp, Homo sapiens
gttctgcaaatagaaaac

SEQ ID NO: 326916 - DNA, 23 bp, Homo sapiens
gttctgccacttgcactgtgctt

SEQ ID NO: 326917 - DNA, 14 bp, Homo sapiens
gttctgctggcctg

SEQ ID NO: 326918 - DNA, 16 bp, Homo sapiens
gttctgctggcctgga

SEQ ID NO: 326919 - DNA, 21 bp, Homo sapiens
gttctgcttcaataaatcttt

SEQ ID NO: 326920 - DNA, 15 bp, Homo sapiens
gttctggactctgcc

SEQ ID NO: 326921 - DNA, 20 bp, Homo sapiens
gttctggctgccccaacctg

SEQ ID NO: 326922 - DNA, 19 bp, Homo sapiens
gttctggctttacatttta

SEQ ID NO: 326923 - DNA, 18 bp, Homo sapiens
gttctgggtggttgccct

SEQ ID NO: 326924 - DNA, 16 bp, Homo sapiens
gttctggtggccccag

SEQ ID NO: 326925 - DNA, 21 bp, Homo sapiens
gttctggttagctcagcccca

SEQ ID NO: 326926 - DNA, 22 bp, Homo sapiens
gttctgtaaaatggaaaactta

SEQ ID NO: 326927 - DNA, 14 bp, Homo sapiens
gttctgtaggagag

SEQ ID NO: 326928 - DNA, 22 bp, Homo sapiens
gttctgtaggagagactggcca

SEQ ID NO: 326929 - DNA, 16 bp, Homo sapiens
gttctgtataaaatgc

SEQ ID NO: 326930 - DNA, 15 bp, Homo sapiens
gttctgtgcctcccc

SEQ ID NO: 326931 - DNA, 22 bp, Homo sapiens
gttctgtgcctccccccagacc

SEQ ID NO: 326932 - DNA, 18 bp, Homo sapiens
gttctgtgggcttggcct

SEQ ID NO: 326933 - DNA, 16 bp, Homo sapiens
gttctgttttgcctga

SEQ ID NO: 326934 - DNA, 13 bp, Homo sapiens
gttctgttttgtt

SEQ ID NO: 326935 - DNA, 22 bp, Homo sapiens
gttcttaggcaccatagaagaa

SEQ ID NO: 326936 - DNA, 17 bp, Homo sapiens
gttcttcacctctatcc

SEQ ID NO: 326937 - DNA, 18 bp, Homo sapiens
gttcttcacctctatcca

SEQ ID NO: 326938 - DNA, 23 bp, Homo sapiens
gttcttcaggagatgatgtgatg

SEQ ID NO: 326939 - DNA, 13 bp, Homo sapiens
gttcttccccaca

SEQ ID NO: 326940 - DNA, 14 bp, Homo sapiens
gttcttcgggaaga

SEQ ID NO: 326941 - DNA, 15 bp, Homo sapiens
gttcttgctgagcac

SEQ ID NO: 326942 - DNA, 16 bp, Homo sapiens
gttcttgggctaggta

SEQ ID NO: 326943 - DNA, 22 bp, Homo sapiens
gttcttgggggaggccacccca

SEQ ID NO: 326944 - DNA, 16 bp, Homo sapiens
gttcttgtaaaactgt

SEQ ID NO: 326945 - DNA, 21 bp, Homo sapiens
gttcttgtaaaactgtgacat

SEQ ID NO: 326946 - DNA, 12 bp, Homo sapiens
gttcttgtcatc

SEQ ID NO: 326947 - DNA, 18 bp, Homo sapiens
gttcttgttctgttttgt

SEQ ID NO: 326948 - DNA, 17 bp, Homo sapiens
gttcttgttttgttata

SEQ ID NO: 326949 - DNA, 13 bp, Homo sapiens
gttctttaatgtt

SEQ ID NO: 326950 - DNA, 15 bp, Homo sapiens
gttctttaggagatt

SEQ ID NO: 326951 - DNA, 21 bp, Homo sapiens
gttctttgagggactgcctct

SEQ ID NO: 326952 - DNA, 14 bp, Homo sapiens
gttctttgctgccc

SEQ ID NO: 326953 - DNA, 12 bp, Homo sapiens
gttctttgttcc

SEQ ID NO: 326954 - DNA, 18 bp, Homo sapiens
gttctttgttcctgcttt

SEQ ID NO: 326955 - DNA, 14 bp, Homo sapiens
gttcttttgataca

SEQ ID NO: 326956 - DNA, 19 bp, Homo sapiens
gttcttttgatacatttat

SEQ ID NO: 326957 - DNA, 16 bp, Homo sapiens
gttgaaaaatctagtt

SEQ ID NO: 326958 - DNA, 18 bp, Homo sapiens
gttgaaaattcaaaaagt

SEQ ID NO: 326959 - DNA, 18 bp, Homo sapiens
gttgaattaattcctggg

SEQ ID NO: 326960 - DNA, 21 bp, Homo sapiens
gttgaattttttttaacattc

SEQ ID NO: 326961 - DNA, 20 bp, Homo sapiens
gttgacacggccatgaccac

SEQ ID NO: 326962 - DNA, 22 bp, Homo sapiens
gttgacctttgaggtctaaaca

SEQ ID NO: 326963 - DNA, 13 bp, Homo sapiens
gttgacgtgacca

SEQ ID NO: 326964 - DNA, 20 bp, Homo sapiens
gttgacttattttctctgtg

SEQ ID NO: 326965 - DNA, 15 bp, Homo sapiens
gttgagccaggcctg

SEQ ID NO: 326966 - DNA, 16 bp, Homo sapiens
gttgaggctaaaacaa

SEQ ID NO: 326967 - DNA, 19 bp, Homo sapiens
gttgagtacagtgaggagg

SEQ ID NO: 326968 - DNA, 18 bp, Homo sapiens
gttgagtcttcacattta

SEQ ID NO: 326969 - DNA, 20 bp, Homo sapiens
gttgataggagacttgtaca

SEQ ID NO: 326970 - DNA, 14 bp, Homo sapiens
gttgatcagatctg

SEQ ID NO: 326971 - DNA, 17 bp, Homo sapiens
gttgatcagatcttaca

SEQ ID NO: 326972 - DNA, 16 bp, Homo sapiens
gttgatcatgcaggaa

SEQ ID NO: 326973 - DNA, 17 bp, Homo sapiens
gttgattctgtccccca

SEQ ID NO: 326974 - DNA, 15 bp, Homo sapiens
ctgggcctgatggag

SEQ ID NO: 326975 - DNA, 19 bp, Homo sapiens
ctgggcctgatggagagga

SEQ ID NO: 326976 - DNA, 21 bp, Homo sapiens
ctgggcctgatggagaggaga

SEQ ID NO: 326977 - DNA, 20 bp, Homo sapiens
ctgggcctgcttttccagga

SEQ ID NO: 326978 - DNA, 12 bp, Homo sapiens
ctgggcctgggc

SEQ ID NO: 326979 - DNA, 16 bp, Homo sapiens
ctgggcctgggctagg

SEQ ID NO: 326980 - DNA, 15 bp, Homo sapiens
ctgggcctgtgcagc

SEQ ID NO: 326981 - DNA, 18 bp, Homo sapiens
ctgggcctgtgcagcagc

SEQ ID NO: 326982 - DNA, 23 bp, Homo sapiens
ctgggccttctcagctctccacc

SEQ ID NO: 326983 - DNA, 18 bp, Homo sapiens
ctgggcctttcctgtgcc

SEQ ID NO: 326984 - DNA, 23 bp, Homo sapiens
ctgggcctttcctgtgccaacct

SEQ ID NO: 326985 - DNA, 14 bp, Homo sapiens
ctgggcgccctgga

SEQ ID NO: 326986 - DNA, 15 bp, Homo sapiens
ctgggctaggggaca

SEQ ID NO: 326987 - DNA, 14 bp, Homo sapiens
ctgggctcctggaa

SEQ ID NO: 326988 - DNA, 17 bp, Homo sapiens
ctgggctcctggaacca

SEQ ID NO: 326989 - DNA, 20 bp, Homo sapiens
ctgggctctgccaccctacc

SEQ ID NO: 326990 - DNA, 13 bp, Homo sapiens
ctgggctgagccc

SEQ ID NO: 326991 - DNA, 14 bp, Homo sapiens
ctgggctgagccta

SEQ ID NO: 326992 - DNA, 15 bp, Homo sapiens
ctgggctgaggaggc

SEQ ID NO: 326993 - DNA, 16 bp, Homo sapiens
ctgggctggactggag

SEQ ID NO: 326994 - DNA, 20 bp, Homo sapiens
ctgggctgttggctgggggc

SEQ ID NO: 326995 - DNA, 14 bp, Homo sapiens
gtttcagctgcagt

SEQ ID NO: 326996 - DNA, 16 bp, Homo sapiens
gtttcaggacagctgc

SEQ ID NO: 326997 - DNA, 19 bp, Homo sapiens
gtttcaggatacatgtgcc

SEQ ID NO: 326998 - DNA, 23 bp, Homo sapiens
gtttcagggggcctttaaagact

SEQ ID NO: 326999 - DNA, 20 bp, Homo sapiens
gtttcaggtggaacaggagg

SEQ ID NO: 327000 - DNA, 16 bp, Homo sapiens
gtttcagtaataaaac

SEQ ID NO: 327001 - DNA, 17 bp, Homo sapiens
gtttcagtaatagctga

SEQ ID NO: 327002 - DNA, 17 bp, Homo sapiens
gtttcataggagacaca

SEQ ID NO: 327003 - DNA, 18 bp, Homo sapiens
gtttcatttatgatacaa

SEQ ID NO: 327004 - DNA, 15 bp, Homo sapiens
gtttccaagcctggg

SEQ ID NO: 327005 - DNA, 24 bp, Homo sapiens
gtttccaagcctgggccactggca

SEQ ID NO: 327006 - DNA, 16 bp, Homo sapiens
gtttccacacaggccc

SEQ ID NO: 327007 - DNA, 13 bp, Homo sapiens
gtttccagctgcc

SEQ ID NO: 327008 - DNA, 18 bp, Homo sapiens
gtttccattttttgttcc

SEQ ID NO: 327009 - DNA, 15 bp, Homo sapiens
gtttcccataatttt

SEQ ID NO: 327010 - DNA, 21 bp, Homo sapiens
gtttcccataattttcttcat

SEQ ID NO: 327011 - DNA, 22 bp, Homo sapiens
gtttcctcaggctgctggagga

SEQ ID NO: 327012 - DNA, 20 bp, Homo sapiens
gtttcctcattcctgaaaga

SEQ ID NO: 327013 - DNA, 14 bp, Homo sapiens
gtttcgttgcatgg

SEQ ID NO: 327014 - DNA, 16 bp, Homo sapiens
gtttcgttgcatggta

SEQ ID NO: 327015 - DNA, 17 bp, Homo sapiens
gtttctaaaactatggt

SEQ ID NO: 327016 - DNA, 17 bp, Homo sapiens
gtttctagaggcctcag

SEQ ID NO: 327017 - DNA, 20 bp, Homo sapiens
gtttctagaggcctcagttt

SEQ ID NO: 327018 - DNA, 21 bp, Homo sapiens
gtttctagggtgggccccagc

SEQ ID NO: 327019 - DNA, 21 bp, Homo sapiens
gtttctatactgtttgtaata

SEQ ID NO: 327020 - DNA, 15 bp, Homo sapiens
gtttctatggattca

SEQ ID NO: 327021 - DNA, 19 bp, Homo sapiens
gtttctctgagctttgtta

SEQ ID NO: 327022 - DNA, 14 bp, Homo sapiens
gtttctgcagaggc

SEQ ID NO: 327023 - DNA, 22 bp, Homo sapiens
gtttctgcagaggcagcaggag

SEQ ID NO: 327024 - DNA, 15 bp, Homo sapiens
gtttctgcagccctt

SEQ ID NO: 327025 - DNA, 17 bp, Homo sapiens
gtttctggttggaggcc

SEQ ID NO: 327026 - DNA, 17 bp, Homo sapiens
gtttctgtaattggctt

SEQ ID NO: 327027 - DNA, 13 bp, Homo sapiens
gtttctgttctgc

SEQ ID NO: 327028 - DNA, 13 bp, Homo sapiens
gtttcttcttgtg

SEQ ID NO: 327029 - DNA, 14 bp, Homo sapiens
gtttcttgcttctg

SEQ ID NO: 327030 - DNA, 14 bp, Homo sapiens
gtttcttgggaaaa

SEQ ID NO: 327031 - DNA, 15 bp, Homo sapiens
gtttcttgggaaaat

SEQ ID NO: 327032 - DNA, 22 bp, Homo sapiens
gtttgaacctttttttttgaaa

SEQ ID NO: 327033 - DNA, 21 bp, Homo sapiens
gtttgagacaagccctggcaa

SEQ ID NO: 327034 - DNA, 22 bp, Homo sapiens
gtttgagacaagccctggcaac

SEQ ID NO: 327035 - DNA, 16 bp, Homo sapiens
gtttgcagaggagcaa

SEQ ID NO: 327036 - DNA, 11 bp, Homo sapiens
gtttgcaggcc

SEQ ID NO: 327037 - DNA, 19 bp, Homo sapiens
gtttgccctgttcaaagta

SEQ ID NO: 327038 - DNA, 20 bp, Homo sapiens
gtttgccctgttcaaagtac

SEQ ID NO: 327039 - DNA, 14 bp, Homo sapiens
gtttgcctgagggc

SEQ ID NO: 327040 - DNA, 15 bp, Homo sapiens
gtttgctcagaacac

SEQ ID NO: 327041 - DNA, 15 bp, Homo sapiens
gtttgcttattgttc

SEQ ID NO: 327042 - DNA, 13 bp, Homo sapiens
gtttgcttctaaa

SEQ ID NO: 327043 - DNA, 16 bp, Homo sapiens
gtttggcttataaaca

SEQ ID NO: 327044 - DNA, 13 bp, Homo sapiens
gtttgggagagac

SEQ ID NO: 327045 - DNA, 20 bp, Homo sapiens
gtttggggagcagagacact

SEQ ID NO: 327046 - DNA, 11 bp, Homo sapiens
gtttggggcga

SEQ ID NO: 327047 - DNA, 18 bp, Homo sapiens
gtttggggcgaggcagag

SEQ ID NO: 327048 - DNA, 14 bp, Homo sapiens
gtttggttctgggg

SEQ ID NO: 327049 - DNA, 18 bp, Homo sapiens
gtttgtaaataagagatt

SEQ ID NO: 327050 - DNA, 21 bp, Homo sapiens
gtttgtagtttttgctgaagg

SEQ ID NO: 327051 - DNA, 22 bp, Homo sapiens
gtttgtataccatgatgcatgg

SEQ ID NO: 327052 - DNA, 14 bp, Homo sapiens
gtttgtatgatgta

SEQ ID NO: 327053 - DNA, 16 bp, Homo sapiens
gtttgtcctttaacta

SEQ ID NO: 327054 - DNA, 13 bp, Homo sapiens
gtttgtctgtgtg

SEQ ID NO: 327055 - DNA, 14 bp, Homo sapiens
gtttgtgagccttg

SEQ ID NO: 327056 - DNA, 23 bp, Homo sapiens
gtttgtgagccttgctgccaagt

SEQ ID NO: 327057 - DNA, 13 bp, Homo sapiens
gtttgtggcctca

SEQ ID NO: 327058 - DNA, 22 bp, Homo sapiens
gtttgtggctgggggcaggagg

SEQ ID NO: 327059 - DNA, 22 bp, Homo sapiens
gtttgtgttctgtttgttaaaa

SEQ ID NO: 327060 - DNA, 14 bp, Homo sapiens
gtttgttaaaactg

SEQ ID NO: 327061 - DNA, 15 bp, Homo sapiens
gtttgttaaaactgg

SEQ ID NO: 327062 - DNA, 17 bp, Homo sapiens
gtttgttacataggtat

SEQ ID NO: 327063 - DNA, 19 bp, Homo sapiens
gtttgttggatcttcaatg

SEQ ID NO: 327064 - DNA, 12 bp, Homo sapiens
gtttgtttgtgt

SEQ ID NO: 327065 - DNA, 11 bp, Homo sapiens
gtttgtttgtt

SEQ ID NO: 327066 - DNA, 12 bp, Homo sapiens
gtttgtttgttt

SEQ ID NO: 327067 - DNA, 16 bp, Homo sapiens
gttttaaaaaagcatt

SEQ ID NO: 327068 - DNA, 14 bp, Homo sapiens
gttttaaactcatt

SEQ ID NO: 327069 - DNA, 13 bp, Homo sapiens
gttttaaagaagt

SEQ ID NO: 327070 - DNA, 23 bp, Homo sapiens
gttttaaatttaaaacaatgaat

SEQ ID NO: 327071 - DNA, 17 bp, Homo sapiens
gttttaacggcctgcat

SEQ ID NO: 327072 - DNA, 19 bp, Homo sapiens
gttttaactagaatttatt

SEQ ID NO: 327073 - DNA, 18 bp, Homo sapiens
gttttaaggaagaaaaat

SEQ ID NO: 327074 - DNA, 20 bp, Homo sapiens
gttttacatcttttgggaag

SEQ ID NO: 327075 - DNA, 17 bp, Homo sapiens
gttttacttttcacagt

SEQ ID NO: 327076 - DNA, 18 bp, Homo sapiens
gttttagacctcatctcc

SEQ ID NO: 327077 - DNA, 14 bp, Homo sapiens
gttttagttgagtc

SEQ ID NO: 327078 - DNA, 14 bp, Homo sapiens
gttttagttgcaga

SEQ ID NO: 327079 - DNA, 21 bp, Homo sapiens
gttttagttgcagaaacattt

SEQ ID NO: 327080 - DNA, 13 bp, Homo sapiens
gttttatatacct

SEQ ID NO: 327081 - DNA, 17 bp, Homo sapiens
gttttatctctgtctac

SEQ ID NO: 327082 - DNA, 22 bp, Homo sapiens
gttttattcacttgtgtttgta

SEQ ID NO: 327083 - DNA, 20 bp, Homo sapiens
gttttattgagttctgaagg

SEQ ID NO: 327084 - DNA, 13 bp, Homo sapiens
gttttattgtgtt

SEQ ID NO: 327085 - DNA, 17 bp, Homo sapiens
gttttattttggaattg

SEQ ID NO: 327086 - DNA, 16 bp, Homo sapiens
gttttcaaaatacttc

SEQ ID NO: 327087 - DNA, 16 bp, Homo sapiens
gttttcaacctagaaa

SEQ ID NO: 327088 - DNA, 22 bp, Homo sapiens
gttttcacaccagtcacacatt

SEQ ID NO: 327089 - DNA, 17 bp, Homo sapiens
gttttcaccatctttct

SEQ ID NO: 327090 - DNA, 22 bp, Homo sapiens
gttttcagtcaagttccgtctc

SEQ ID NO: 327091 - DNA, 18 bp, Homo sapiens
gttttcatcctggcctcc

SEQ ID NO: 327092 - DNA, 23 bp, Homo sapiens
gttttcatggtgaaaatgtactg

SEQ ID NO: 327093 - DNA, 16 bp, Homo sapiens
gttttccagtattgaa

SEQ ID NO: 327094 - DNA, 17 bp, Homo sapiens
gttttccatgaaaacgt

SEQ ID NO: 327095 - DNA, 21 bp, Homo sapiens
gttttccctgacctccctcta

SEQ ID NO: 327096 - DNA, 16 bp, Homo sapiens
gttttcctaaatgcag

SEQ ID NO: 327097 - DNA, 19 bp, Homo sapiens
gttttcgaagctcagccca

SEQ ID NO: 327098 - DNA, 23 bp, Homo sapiens
gttttcgtcacaggagtctttgt

SEQ ID NO: 327099 - DNA, 19 bp, Homo sapiens
gttttctcagaacagctga

SEQ ID NO: 327100 - DNA, 13 bp, Homo sapiens
gttttctgctctg

SEQ ID NO: 327101 - DNA, 14 bp, Homo sapiens
gttttctgtgcact

SEQ ID NO: 327102 - DNA, 15 bp, Homo sapiens
gttttctgtgcactg

SEQ ID NO: 327103 - DNA, 22 bp, Homo sapiens
gttttcttcaagggaagaaaca

SEQ ID NO: 327104 - DNA, 17 bp, Homo sapiens
gttttctttgctgtgcc

SEQ ID NO: 327105 - DNA, 18 bp, Homo sapiens
gttttcttttctgtggtt

SEQ ID NO: 327106 - DNA, 18 bp, Homo sapiens
gttttgaaagaaaaatac

SEQ ID NO: 327107 - DNA, 13 bp, Homo sapiens
gttttgaaatgct

SEQ ID NO: 327108 - DNA, 13 bp, Homo sapiens
gttttgagaaaaa

SEQ ID NO: 327109 - DNA, 14 bp, Homo sapiens
gttttgatgccatt

SEQ ID NO: 327110 - DNA, 19 bp, Homo sapiens
gttttgctaggtataaaaa

SEQ ID NO: 327111 - DNA, 11 bp, Homo sapiens
gttttgctgct

SEQ ID NO: 327112 - DNA, 21 bp, Homo sapiens
gttttgcttttatccactggc

SEQ ID NO: 327113 - DNA, 14 bp, Homo sapiens
gttttggttttttt

SEQ ID NO: 327114 - DNA, 19 bp, Homo sapiens
gttttgtataaataataaa

SEQ ID NO: 327115 - DNA, 17 bp, Homo sapiens
gttttgtcaaactgtag

SEQ ID NO: 327116 - DNA, 15 bp, Homo sapiens
gttttgtctgagcct

SEQ ID NO: 327117 - DNA, 21 bp, Homo sapiens
gtttttaaaaaggcctttggg

SEQ ID NO: 327118 - DNA, 16 bp, Homo sapiens
gtttttaaaagtttca

SEQ ID NO: 327119 - DNA, 17 bp, Homo sapiens
gtttttaagaaaaacat

SEQ ID NO: 327120 - DNA, 23 bp, Homo sapiens
gtttttaagaaaaacatgtcatg

SEQ ID NO: 327121 - DNA, 13 bp, Homo sapiens
gtttttaagctgt

SEQ ID NO: 327122 - DNA, 21 bp, Homo sapiens
ctgtaggaaacagaaaagaga

SEQ ID NO: 327123 - DNA, 23 bp, Homo sapiens
ctgtaggagagactggccagagg

SEQ ID NO: 327124 - DNA, 19 bp, Homo sapiens
ctgtaggcgcccctggggt

SEQ ID NO: 327125 - DNA, 12 bp, Homo sapiens
ctgtctcagcct

SEQ ID NO: 327126 - DNA, 14 bp, Homo sapiens
gtttttaagctgtt

SEQ ID NO: 327127 - DNA, 15 bp, Homo sapiens
gtttttaagctgttt

SEQ ID NO: 327128 - DNA, 22 bp, Homo sapiens
gtttttactcaaccaaattaaa

SEQ ID NO: 327129 - DNA, 15 bp, Homo sapiens
gtttttatatattat

SEQ ID NO: 327130 - DNA, 18 bp, Homo sapiens
gtttttatattacttttg

SEQ ID NO: 327131 - DNA, 21 bp, Homo sapiens
gtttttatctgaaatcaatta

SEQ ID NO: 327132 - DNA, 17 bp, Homo sapiens
gtttttcactttagcaa

SEQ ID NO: 327133 - DNA, 19 bp, Homo sapiens
gtttttccatgtgttttgc

SEQ ID NO: 327134 - DNA, 19 bp, Homo sapiens
gtttttctacttttaaaga

SEQ ID NO: 327135 - DNA, 11 bp, Homo sapiens
gtttttctcaa

SEQ ID NO: 327136 - DNA, 15 bp, Homo sapiens
gtttttctcaaataa

SEQ ID NO: 327137 - DNA, 17 bp, Homo sapiens
gtttttctgccagggag

SEQ ID NO: 327138 - DNA, 12 bp, Homo sapiens
gtttttctttaa

SEQ ID NO: 327139 - DNA, 20 bp, Homo sapiens
gtttttcttttcttggacac

SEQ ID NO: 327140 - DNA, 18 bp, Homo sapiens
gtttttctttttccacaa

SEQ ID NO: 327141 - DNA, 20 bp, Homo sapiens
gtttttgaagaagggaaatt

SEQ ID NO: 327142 - DNA, 18 bp, Homo sapiens
gtttttgatagctttatt

SEQ ID NO: 327143 - DNA, 22 bp, Homo sapiens
gtttttgatgtgcgtgctgtct

SEQ ID NO: 327144 - DNA, 12 bp, Homo sapiens
gtttttgctctc

SEQ ID NO: 327145 - DNA, 19 bp, Homo sapiens
gtttttgtatgaagtactt

SEQ ID NO: 327146 - DNA, 16 bp, Homo sapiens
gttttttaggaatcag

SEQ ID NO: 327147 - DNA, 15 bp, Homo sapiens
gttttttatgctaat

SEQ ID NO: 327148 - DNA, 21 bp, Homo sapiens
gttttttcctgagcttggcca

SEQ ID NO: 327149 - DNA, 20 bp, Homo sapiens
gtttttttagggtttctgat

SEQ ID NO: 327150 - DNA, 20 bp, Homo sapiens
gttttttttttttgtatttc

SEQ ID NO: 327151 - DNA, 21 bp, Homo sapiens
gttttttttttttgtatttct

SEQ ID NO: 327152 - DNA, 17 bp, Homo sapiens
taaaaaaaaaaggatga

SEQ ID NO: 327153 - DNA, 21 bp, Homo sapiens
taaaaaaaaaagttacagaaa

SEQ ID NO: 327154 - DNA, 20 bp, Homo sapiens
taaaaaaaaaatcagtgttt

SEQ ID NO: 327155 - DNA, 18 bp, Homo sapiens
taaaaaaaaacattcaaa

SEQ ID NO: 327156 - DNA, 15 bp, Homo sapiens
taaaaaaataacatc

SEQ ID NO: 327157 - DNA, 17 bp, Homo sapiens
taaaaaaataacatctc

SEQ ID NO: 327158 - DNA, 14 bp, Homo sapiens
taaaaaacatttgt

SEQ ID NO: 327159 - DNA, 11 bp, Homo sapiens
taaaaaagaaa

SEQ ID NO: 327160 - DNA, 12 bp, Homo sapiens
taaaaaagaaaa

SEQ ID NO: 327161 - DNA, 16 bp, Homo sapiens
taaaaaagaaaacatt

SEQ ID NO: 327162 - DNA, 16 bp, Homo sapiens
taaaaaagaagaggtt

SEQ ID NO: 327163 - DNA, 13 bp, Homo sapiens
taaaaaataacat

SEQ ID NO: 327164 - DNA, 15 bp, Homo sapiens
taaaaaataacatat

SEQ ID NO: 327165 - DNA, 13 bp, Homo sapiens
taaaaaataagta

SEQ ID NO: 327166 - DNA, 13 bp, Homo sapiens
taaaaaatgtcca

SEQ ID NO: 327167 - DNA, 13 bp, Homo sapiens
taaaaacatttta

SEQ ID NO: 327168 - DNA, 20 bp, Homo sapiens
taaaaagccactagactctt

SEQ ID NO: 327169 - DNA, 12 bp, Homo sapiens
taaaaaggcctt

SEQ ID NO: 327170 - DNA, 13 bp, Homo sapiens
taaaaaggccttt

SEQ ID NO: 327171 - DNA, 16 bp, Homo sapiens
taaaaaggcctttggg

SEQ ID NO: 327172 - DNA, 19 bp, Homo sapiens
taaaaaggcctttgggatt

SEQ ID NO: 327173 - DNA, 16 bp, Homo sapiens
taaaaagtatatgtta

SEQ ID NO: 327174 - DNA, 16 bp, Homo sapiens
taaaaagtctgcatta

SEQ ID NO: 327175 - DNA, 16 bp, Homo sapiens
taaaaagttaactctt

SEQ ID NO: 327176 - DNA, 15 bp, Homo sapiens
taaaaagttgcacat

SEQ ID NO: 327177 - DNA, 16 bp, Homo sapiens
taaaaataaaatgatg

SEQ ID NO: 327178 - DNA, 17 bp, Homo sapiens
taaaaataaaatgatgt

SEQ ID NO: 327179 - DNA, 19 bp, Homo sapiens
taaaaataaaatgcattta

SEQ ID NO: 327180 - DNA, 14 bp, Homo sapiens
taaaaataaatcta

SEQ ID NO: 327181 - DNA, 21 bp, Homo sapiens
taaaaatagctataaatagtg

SEQ ID NO: 327182 - DNA, 13 bp, Homo sapiens
taaaaatatatat

SEQ ID NO: 327183 - DNA, 23 bp, Homo sapiens
taaaaatatggaacttctaatat

SEQ ID NO: 327184 - DNA, 16 bp, Homo sapiens
taaaaatatgtgagca

SEQ ID NO: 327185 - DNA, 20 bp, Homo sapiens
taaaaatatgtgagcatgaa

SEQ ID NO: 327186 - DNA, 14 bp, Homo sapiens
taaaaatattgtgt

SEQ ID NO: 327187 - DNA, 18 bp, Homo sapiens
taaaaatccctcttcctc

SEQ ID NO: 327188 - DNA, 14 bp, Homo sapiens
taaaaatctttcag

SEQ ID NO: 327189 - DNA, 21 bp, Homo sapiens
taaaaatctttcagaatacaa

SEQ ID NO: 327190 - DNA, 13 bp, Homo sapiens
taaaaatgtaaat

SEQ ID NO: 327191 - DNA, 19 bp, Homo sapiens
taaaaatgtaaatattcta

SEQ ID NO: 327192 - DNA, 15 bp, Homo sapiens
taaaaattctgaatg

SEQ ID NO: 327193 - DNA, 17 bp, Homo sapiens
taaaaattctgaatgta

SEQ ID NO: 327194 - DNA, 16 bp, Homo sapiens
taaaaatttgtttaaa

SEQ ID NO: 327195 - DNA, 12 bp, Homo sapiens
taaaacaaaaaa

SEQ ID NO: 327196 - DNA, 13 bp, Homo sapiens
taaaacaaaaaac

SEQ ID NO: 327197 - DNA, 20 bp, Homo sapiens
taaaacaaaacaaacaacct

SEQ ID NO: 327198 - DNA, 20 bp, Homo sapiens
taaaacaaaaccaagccttg

SEQ ID NO: 327199 - DNA, 15 bp, Homo sapiens
taaaacaaaatctga

SEQ ID NO: 327200 - DNA, 16 bp, Homo sapiens
taaaacaaaatctgaa

SEQ ID NO: 327201 - DNA, 23 bp, Homo sapiens
taaaacaaaatctgaactctcaa

SEQ ID NO: 327202 - DNA, 17 bp, Homo sapiens
taaaacaaaatttgttt

SEQ ID NO: 327203 - DNA, 19 bp, Homo sapiens
taaaacaagaaagtttccc

SEQ ID NO: 327204 - DNA, 20 bp, Homo sapiens
taaaacaagaaagtttcccc

SEQ ID NO: 327205 - DNA, 17 bp, Homo sapiens
taaaacacaacatcttt

SEQ ID NO: 327206 - DNA, 22 bp, Homo sapiens
taaaacacaacatctttttcta

SEQ ID NO: 327207 - DNA, 23 bp, Homo sapiens
taaaacacaacatctttttctac

SEQ ID NO: 327208 - DNA, 19 bp, Homo sapiens
taaaacacttccataatct

SEQ ID NO: 327209 - DNA, 23 bp, Homo sapiens
taaaacagctgtctctaacttat

SEQ ID NO: 327210 - DNA, 16 bp, Homo sapiens
taaaaccagttttgct

SEQ ID NO: 327211 - DNA, 23 bp, Homo sapiens
taaaacctaaaattaagaagtac

SEQ ID NO: 327212 - DNA, 20 bp, Homo sapiens
taaaacctttcaaatttcac

SEQ ID NO: 327213 - DNA, 21 bp, Homo sapiens
taaaacctttcaaatttcaca

SEQ ID NO: 327214 - DNA, 14 bp, Homo sapiens
taaaactatttaaa

SEQ ID NO: 327215 - DNA, 15 bp, Homo sapiens
taaaactatttaaaa

SEQ ID NO: 327216 - DNA, 19 bp, Homo sapiens
taaaactatttaaaattgg

SEQ ID NO: 327217 - DNA, 16 bp, Homo sapiens
taaaactggcatctga

SEQ ID NO: 327218 - DNA, 13 bp, Homo sapiens
taaaactgtccct

SEQ ID NO: 327219 - DNA, 11 bp, Homo sapiens
taaaactgtga

SEQ ID NO: 327220 - DNA, 16 bp, Homo sapiens
taaaactgtgacattc

SEQ ID NO: 327221 - DNA, 22 bp, Homo sapiens
taaaactgtgacattccacaga

SEQ ID NO: 327222 - DNA, 18 bp, Homo sapiens
taaaacttactatggtat

SEQ ID NO: 327223 - DNA, 14 bp, Homo sapiens
taaaactttgctgc

SEQ ID NO: 327224 - DNA, 15 bp, Homo sapiens
taaaactttgctgcc

SEQ ID NO: 327225 - DNA, 16 bp, Homo sapiens
taaaactttgctgcca

SEQ ID NO: 327226 - DNA, 15 bp, Homo sapiens
taaaagaaagggttc

SEQ ID NO: 327227 - DNA, 14 bp, Homo sapiens
taaaagacaaacac

SEQ ID NO: 327228 - DNA, 13 bp, Homo sapiens
taaaagactttga

SEQ ID NO: 327229 - DNA, 14 bp, Homo sapiens
taaaagactttgat

SEQ ID NO: 327230 - DNA, 17 bp, Homo sapiens
taaaagaggaaattaaa

SEQ ID NO: 327231 - DNA, 17 bp, Homo sapiens
taaaagataagtttgtt

SEQ ID NO: 327232 - DNA, 16 bp, Homo sapiens
taaaagattctttaaa

SEQ ID NO: 327233 - DNA, 11 bp, Homo sapiens
taaaagcagca

SEQ ID NO: 327234 - DNA, 20 bp, Homo sapiens
taaaagcatactctatgtga

SEQ ID NO: 327235 - DNA, 12 bp, Homo sapiens
taaaagctatga

SEQ ID NO: 327236 - DNA, 15 bp, Homo sapiens
taaaaggaggacagg

SEQ ID NO: 327237 - DNA, 18 bp, Homo sapiens
taaaaggataggaaaaga

SEQ ID NO: 327238 - DNA, 17 bp, Homo sapiens
taaaagggcaaatctgc

SEQ ID NO: 327239 - DNA, 19 bp, Homo sapiens
taaaaggtgacccttctgt

SEQ ID NO: 327240 - DNA, 18 bp, Homo sapiens
taaaagttaagtgtcatt

SEQ ID NO: 327241 - DNA, 15 bp, Homo sapiens
taaaagtttgtcctt

SEQ ID NO: 327242 - DNA, 20 bp, Homo sapiens
taaaagtttgtcctttaact

SEQ ID NO: 327243 - DNA, 17 bp, Homo sapiens
taaaagttttatgtact

SEQ ID NO: 327244 - DNA, 18 bp, Homo sapiens
taaaagttttatgtactt

SEQ ID NO: 327245 - DNA, 14 bp, Homo sapiens
taaaataaacagtt

SEQ ID NO: 327246 - DNA, 16 bp, Homo sapiens
taaaataaacagttgt

SEQ ID NO: 327247 - DNA, 18 bp, Homo sapiens
taaaataaacgaaacatt

SEQ ID NO: 327248 - DNA, 11 bp, Homo sapiens
taaaataaata

SEQ ID NO: 327249 - DNA, 17 bp, Homo sapiens
taaaataaatatactaa

SEQ ID NO: 327250 - DNA, 19 bp, Homo sapiens
taaaataaatatactaata

SEQ ID NO: 327251 - DNA, 21 bp, Homo sapiens
taaaataaatatactaataaa

SEQ ID NO: 327252 - DNA, 15 bp, Homo sapiens
taaaataagtaacat

SEQ ID NO: 327253 - DNA, 16 bp, Homo sapiens
taaaataagtaacata

SEQ ID NO: 327254 - DNA, 18 bp, Homo sapiens
taaaatacaagtaaagct

SEQ ID NO: 327255 - DNA, 16 bp, Homo sapiens
taaaatacatttaaaa

SEQ ID NO: 327256 - DNA, 20 bp, Homo sapiens
ctgtgttcttgctgagcacc

SEQ ID NO: 327257 - DNA, 14 bp, Homo sapiens
ctgtgttgactgct

SEQ ID NO: 327258 - DNA, 14 bp, Homo sapiens
ctgtgttgtctcta

SEQ ID NO: 327259 - DNA, 22 bp, Homo sapiens
ctgtgttgtctctagagcaggg

SEQ ID NO: 327260 - DNA, 23 bp, Homo sapiens
ctgtgttgtgattccccggagct

SEQ ID NO: 327261 - DNA, 14 bp, Homo sapiens
ctgtgttgttcata

SEQ ID NO: 327262 - DNA, 18 bp, Homo sapiens
ctgtgttttgtctgagcc

SEQ ID NO: 327263 - DNA, 12 bp, Homo sapiens
ctgttaaccaaa

SEQ ID NO: 327264 - DNA, 20 bp, Homo sapiens
ctgttaaccctccacctcct

SEQ ID NO: 327265 - DNA, 23 bp, Homo sapiens
ctgttaactagtgtttctgcaga

SEQ ID NO: 327266 - DNA, 21 bp, Homo sapiens
ctgttaaggtggaaaatggac

SEQ ID NO: 327267 - DNA, 24 bp, Homo sapiens
ctgttaattctagatcagagagca

SEQ ID NO: 327268 - DNA, 19 bp, Homo sapiens
ctgttaccatgtcactgtg

SEQ ID NO: 327269 - DNA, 18 bp, Homo sapiens
ctgttacccagagaatat

SEQ ID NO: 327270 - DNA, 18 bp, Homo sapiens
ctgttacctaggttaaca

SEQ ID NO: 327271 - DNA, 19 bp, Homo sapiens
ctgttacctaggttaacaa

SEQ ID NO: 327272 - DNA, 15 bp, Homo sapiens
ctgttactttctttc

SEQ ID NO: 327273 - DNA, 20 bp, Homo sapiens
taaagataaaaggataggaa

SEQ ID NO: 327274 - DNA, 15 bp, Homo sapiens
taaagataatattac

SEQ ID NO: 327275 - DNA, 19 bp, Homo sapiens
taaagataatattactgtt

SEQ ID NO: 327276 - DNA, 14 bp, Homo sapiens
taaagatattattc

SEQ ID NO: 327277 - DNA, 14 bp, Homo sapiens
taaagatggctatt

SEQ ID NO: 327278 - DNA, 14 bp, Homo sapiens
taaagatgtcaaat

SEQ ID NO: 327279 - DNA, 21 bp, Homo sapiens
taaagcaaaaaatgaatgtct

SEQ ID NO: 327280 - DNA, 16 bp, Homo sapiens
taaagcaataagttca

SEQ ID NO: 327281 - DNA, 18 bp, Homo sapiens
taaagcactattgtttag

SEQ ID NO: 327282 - DNA, 13 bp, Homo sapiens
taaagcagccagc

SEQ ID NO: 327283 - DNA, 18 bp, Homo sapiens
taaagcaggccttttgat

SEQ ID NO: 327284 - DNA, 17 bp, Homo sapiens
taaagcataagtataca

SEQ ID NO: 327285 - DNA, 21 bp, Homo sapiens
taaagcatcacacagtggcac

SEQ ID NO: 327286 - DNA, 23 bp, Homo sapiens
taaagcgatatacagatgaaaat

SEQ ID NO: 327287 - DNA, 23 bp, Homo sapiens
taaagctaaaatgattttatctg

SEQ ID NO: 327288 - DNA, 23 bp, Homo sapiens
taaagctgcctgtagttaggaaa

SEQ ID NO: 327289 - DNA, 16 bp, Homo sapiens
taaagctggacaagaa

SEQ ID NO: 327290 - DNA, 18 bp, Homo sapiens
taaagctggacaagaagc

SEQ ID NO: 327291 - DNA, 20 bp, Homo sapiens
taaagctggacaagaagctg

SEQ ID NO: 327292 - DNA, 15 bp, Homo sapiens
taaagctgtttctaa

SEQ ID NO: 327293 - DNA, 19 bp, Homo sapiens
taaaggacaaacagtgaat

SEQ ID NO: 327294 - DNA, 21 bp, Homo sapiens
taaaggacaaacagtgaattt

SEQ ID NO: 327295 - DNA, 22 bp, Homo sapiens
taaaggacaaacagtgaattta

SEQ ID NO: 327296 - DNA, 21 bp, Homo sapiens
taaaggcagcaaccattcatc

SEQ ID NO: 327297 - DNA, 16 bp, Homo sapiens
taaaggctgagtttag

SEQ ID NO: 327298 - DNA, 20 bp, Homo sapiens
taaaggtggtgaggcaataa

SEQ ID NO: 327299 - DNA, 21 bp, Homo sapiens
taaaggtttcactgttcatga

SEQ ID NO: 327300 - DNA, 14 bp, Homo sapiens
taaagtacctgtag

SEQ ID NO: 327301 - DNA, 17 bp, Homo sapiens
taaagtactactgtaga

SEQ ID NO: 327302 - DNA, 17 bp, Homo sapiens
taaagtatcatgcattc

SEQ ID NO: 327303 - DNA, 13 bp, Homo sapiens
taaagtatgtaaa

SEQ ID NO: 327304 - DNA, 13 bp, Homo sapiens
taaagtatgtgaa

SEQ ID NO: 327305 - DNA, 15 bp, Homo sapiens
taaagtattccacct

SEQ ID NO: 327306 - DNA, 15 bp, Homo sapiens
taaagtcttgctgtg

SEQ ID NO: 327307 - DNA, 15 bp, Homo sapiens
taaagtgtagcaccc

SEQ ID NO: 327308 - DNA, 17 bp, Homo sapiens
taaagtgtgttgttgct

SEQ ID NO: 327309 - DNA, 19 bp, Homo sapiens
taaagtgttggtctttcta

SEQ ID NO: 327310 - DNA, 16 bp, Homo sapiens
taaagtttaaatacca

SEQ ID NO: 327311 - DNA, 19 bp, Homo sapiens
taaagtttaaataccagta

SEQ ID NO: 327312 - DNA, 23 bp, Homo sapiens
taaagtttaaataccagtacttg

SEQ ID NO: 327313 - DNA, 16 bp, Homo sapiens
taaagtttacagtaaa

SEQ ID NO: 327314 - DNA, 23 bp, Homo sapiens
taaagtttacagtaaataaattg

SEQ ID NO: 327315 - DNA, 22 bp, Homo sapiens
taaagttttgccccatgataaa

SEQ ID NO: 327316 - DNA, 17 bp, Homo sapiens
taaataaaaatagctat

SEQ ID NO: 327317 - DNA, 12 bp, Homo sapiens
taaataaaacta

SEQ ID NO: 327318 - DNA, 20 bp, Homo sapiens
taaataaaagcagcatctgc

SEQ ID NO: 327319 - DNA, 17 bp, Homo sapiens
taaataaaagtgatcaa

SEQ ID NO: 327320 - DNA, 13 bp, Homo sapiens
taaataaactctt

SEQ ID NO: 327321 - DNA, 20 bp, Homo sapiens
taaataaactcttcaaggcc

SEQ ID NO: 327322 - DNA, 14 bp, Homo sapiens
taaataaagtatca

SEQ ID NO: 327323 - DNA, 21 bp, Homo sapiens
taaataaagtatcatgcattc

SEQ ID NO: 327324 - DNA, 16 bp, Homo sapiens
taaataaatcattaat

SEQ ID NO: 327325 - DNA, 15 bp, Homo sapiens
taaataaattgtttg

SEQ ID NO: 327326 - DNA, 13 bp, Homo sapiens
taaataacacaga

SEQ ID NO: 327327 - DNA, 20 bp, Homo sapiens
taaataacacagatattgtt

SEQ ID NO: 327328 - DNA, 23 bp, Homo sapiens
taaataacctatttttttctcta

SEQ ID NO: 327329 - DNA, 20 bp, Homo sapiens
taaataatattatattgtat

SEQ ID NO: 327330 - DNA, 12 bp, Homo sapiens
taaataatgaaa

SEQ ID NO: 327331 - DNA, 16 bp, Homo sapiens
taaataattttacatg

SEQ ID NO: 327332 - DNA, 18 bp, Homo sapiens
taaatacaaaataaaatt

SEQ ID NO: 327333 - DNA, 19 bp, Homo sapiens
taaatacaagttctattta

SEQ ID NO: 327334 - DNA, 19 bp, Homo sapiens
taaatacacatagcatgta

SEQ ID NO: 327335 - DNA, 16 bp, Homo sapiens
taaatacagacactaa

SEQ ID NO: 327336 - DNA, 12 bp, Homo sapiens
taaatacatgtg

SEQ ID NO: 327337 - DNA, 18 bp, Homo sapiens
taaatactttaacttcca

SEQ ID NO: 327338 - DNA, 18 bp, Homo sapiens
taaatagagtatatgcac

SEQ ID NO: 327339 - DNA, 23 bp, Homo sapiens
taaatagatacttttgataatag

SEQ ID NO: 327340 - DNA, 13 bp, Homo sapiens
taaatagcatctg

SEQ ID NO: 327341 - DNA, 16 bp, Homo sapiens
taaatagctaaatggc

SEQ ID NO: 327342 - DNA, 15 bp, Homo sapiens
taaatagctatatcc

SEQ ID NO: 327343 - DNA, 17 bp, Homo sapiens
taaatagctatatccat

SEQ ID NO: 327344 - DNA, 21 bp, Homo sapiens
taaatagtaggaccaatgttg

SEQ ID NO: 327345 - DNA, 18 bp, Homo sapiens
taaatagtatttgagagt

SEQ ID NO: 327346 - DNA, 13 bp, Homo sapiens
taaatagttctat

SEQ ID NO: 327347 - DNA, 16 bp, Homo sapiens
taaatataattctgta

SEQ ID NO: 327348 - DNA, 19 bp, Homo sapiens
taaatataattctgtaaat

SEQ ID NO: 327349 - DNA, 12 bp, Homo sapiens
taaatatacaac

SEQ ID NO: 327350 - DNA, 12 bp, Homo sapiens
taaatatactaa

SEQ ID NO: 327351 - DNA, 14 bp, Homo sapiens
taaatatactaata

SEQ ID NO: 327352 - DNA, 15 bp, Homo sapiens
taaatatactaataa

SEQ ID NO: 327353 - DNA, 20 bp, Homo sapiens
taaatatactaataaaaagg

SEQ ID NO: 327354 - DNA, 20 bp, Homo sapiens
taaatatagttgtctttctt

SEQ ID NO: 327355 - DNA, 21 bp, Homo sapiens
taaatatagttgtctttcttt

SEQ ID NO: 327356 - DNA, 20 bp, Homo sapiens
taaatatatatttatcatat

SEQ ID NO: 327357 - DNA, 19 bp, Homo sapiens
taaatatatgtatgtaaaa

SEQ ID NO: 327358 - DNA, 20 bp, Homo sapiens
taaatatatgttttgagaaa

SEQ ID NO: 327359 - DNA, 22 bp, Homo sapiens
taaatatatgttttgagaaaaa

SEQ ID NO: 327360 - DNA, 22 bp, Homo sapiens
taaatatatttaagataattat

SEQ ID NO: 327361 - DNA, 20 bp, Homo sapiens
taaatatcattatagcatgt

SEQ ID NO: 327362 - DNA, 16 bp, Homo sapiens
taaatatcattctttg

SEQ ID NO: 327363 - DNA, 23 bp, Homo sapiens
taaatatcattctttgtatctta

SEQ ID NO: 327364 - DNA, 12 bp, Homo sapiens
taaatatccaaa

SEQ ID NO: 327365 - DNA, 13 bp, Homo sapiens
taaatatccaaag

SEQ ID NO: 327366 - DNA, 14 bp, Homo sapiens
taaatatcccagag

SEQ ID NO: 327367 - DNA, 17 bp, Homo sapiens
taaatatcttctgattt

SEQ ID NO: 327368 - DNA, 15 bp, Homo sapiens
taaatattatgattt

SEQ ID NO: 327369 - DNA, 13 bp, Homo sapiens
taaatattctata

SEQ ID NO: 327370 - DNA, 15 bp, Homo sapiens
taaatattctatatg

SEQ ID NO: 327371 - DNA, 12 bp, Homo sapiens
taaatattcttg

SEQ ID NO: 327372 - DNA, 21 bp, Homo sapiens
taaatattggtttgttattct

SEQ ID NO: 327373 - DNA, 11 bp, Homo sapiens
taaatatttaa

SEQ ID NO: 327374 - DNA, 12 bp, Homo sapiens
taaatatttcct

SEQ ID NO: 327375 - DNA, 15 bp, Homo sapiens
taaatatttccttaa

SEQ ID NO: 327376 - DNA, 14 bp, Homo sapiens
taaatcatattgat

SEQ ID NO: 327377 - DNA, 19 bp, Homo sapiens
taaatcatattgatgaaaa

SEQ ID NO: 327378 - DNA, 20 bp, Homo sapiens
taaatcatattgatgaaaag

SEQ ID NO: 327379 - DNA, 16 bp, Homo sapiens
taaatcatttcagtat

SEQ ID NO: 327380 - DNA, 19 bp, Homo sapiens
taaatcatttcagtatcat

SEQ ID NO: 327381 - DNA, 14 bp, Homo sapiens
taaatccattttct

SEQ ID NO: 327382 - DNA, 19 bp, Homo sapiens
taaatccattttctaaact

SEQ ID NO: 327383 - DNA, 16 bp, Homo sapiens
taaatcctaccaaagt

SEQ ID NO: 327384 - DNA, 19 bp, Homo sapiens
taaatctactcttaaatat

SEQ ID NO: 327385 - DNA, 15 bp, Homo sapiens
taaatctctaatatg

SEQ ID NO: 327386 - DNA, 22 bp, Homo sapiens
aaatgtactacatttgcatgcc

SEQ ID NO: 327387 - DNA, 15 bp, Homo sapiens
aaatgtactgagatt

SEQ ID NO: 327388 - DNA, 15 bp, Homo sapiens
aaatgtagaagaaag

SEQ ID NO: 327389 - DNA, 17 bp, Homo sapiens
aaatgtagaagaaagca

SEQ ID NO: 327390 - DNA, 20 bp, Homo sapiens
aaatgtagaagaaagcaaaa

SEQ ID NO: 327391 - DNA, 21 bp, Homo sapiens
aaatgtatatgttatttttgg

SEQ ID NO: 327392 - DNA, 17 bp, Homo sapiens
aaatgtatcttattcac

SEQ ID NO: 327393 - DNA, 21 bp, Homo sapiens
aaatgtattttgaaaacactt

SEQ ID NO: 327394 - DNA, 12 bp, Homo sapiens
aaatgtcattat

SEQ ID NO: 327395 - DNA, 18 bp, Homo sapiens
aaatgtcattatgtagaa

SEQ ID NO: 327396 - DNA, 16 bp, Homo sapiens
aaatgtctgtggcctt

SEQ ID NO: 327397 - DNA, 22 bp, Homo sapiens
aaatgtctgtggccttgttctc

SEQ ID NO: 327398 - DNA, 17 bp, Homo sapiens
aaatgtgagctataatg

SEQ ID NO: 327399 - DNA, 15 bp, Homo sapiens
aaatgtgatttttct

SEQ ID NO: 327400 - DNA, 16 bp, Homo sapiens
aaatgtgatttttctg

SEQ ID NO: 327401 - DNA, 17 bp, Homo sapiens
aaatgtgatttttctga

SEQ ID NO: 327402 - DNA, 16 bp, Homo sapiens
aaatgtgctgcaaaga

SEQ ID NO: 327403 - DNA, 15 bp, Homo sapiens
aaatgtggctcctgg

SEQ ID NO: 327404 - DNA, 20 bp, Homo sapiens
aaatgtgggattatgggtca

SEQ ID NO: 327405 - DNA, 22 bp, Homo sapiens
aaatgtgggattatgggtcaca

SEQ ID NO: 327406 - DNA, 23 bp, Homo sapiens
aaatgtgtcccagtgaacagttt

SEQ ID NO: 327407 - DNA, 20 bp, Homo sapiens
aaatgtgtctgcaacatgga

SEQ ID NO: 327408 - DNA, 16 bp, Homo sapiens
aaatgttaataaaggt

SEQ ID NO: 327409 - DNA, 21 bp, Homo sapiens
aaatgttattttttaattatt

SEQ ID NO: 327410 - DNA, 15 bp, Homo sapiens
aaatgttctttgggg

SEQ ID NO: 327411 - DNA, 13 bp, Homo sapiens
aaatgtttaatat

SEQ ID NO: 327412 - DNA, 21 bp, Homo sapiens
aaatgtttatattgtttttat

SEQ ID NO: 327413 - DNA, 23 bp, Homo sapiens
aaatgtttgccctgttcaaagta

SEQ ID NO: 327414 - DNA, 16 bp, Homo sapiens
aaatgtttttctgcca

SEQ ID NO: 327415 - DNA, 23 bp, Homo sapiens
aaatgtttttctgccagggagct

SEQ ID NO: 327416 - DNA, 13 bp, Homo sapiens
aaattaaaacgaa

SEQ ID NO: 327417 - DNA, 12 bp, Homo sapiens
aaattaaacaat

SEQ ID NO: 327418 - DNA, 23 bp, Homo sapiens
aaattaaatctgtccctgagagt

SEQ ID NO: 327419 - DNA, 16 bp, Homo sapiens
taaatggagcttgtac

SEQ ID NO: 327420 - DNA, 18 bp, Homo sapiens
taaatggcacctgtatac

SEQ ID NO: 327421 - DNA, 19 bp, Homo sapiens
taaatggcacctgtatacc

SEQ ID NO: 327422 - DNA, 11 bp, Homo sapiens
taaatgggcac

SEQ ID NO: 327423 - DNA, 17 bp, Homo sapiens
taaatgggtgaaaaatg

SEQ ID NO: 327424 - DNA, 21 bp, Homo sapiens
taaatggtgagaattaaaata

SEQ ID NO: 327425 - DNA, 21 bp, Homo sapiens
taaatgtactacatttgcatg

SEQ ID NO: 327426 - DNA, 16 bp, Homo sapiens
taaatgtaggtatgaa

SEQ ID NO: 327427 - DNA, 17 bp, Homo sapiens
taaatgttaccaaaaat

SEQ ID NO: 327428 - DNA, 15 bp, Homo sapiens
taaatgttatgactc

SEQ ID NO: 327429 - DNA, 12 bp, Homo sapiens
taaatgtttaaa

SEQ ID NO: 327430 - DNA, 15 bp, Homo sapiens
taaatgtttgttgaa

SEQ ID NO: 327431 - DNA, 12 bp, Homo sapiens
taaattaaacaa

SEQ ID NO: 327432 - DNA, 14 bp, Homo sapiens
taaattaaacaatt

SEQ ID NO: 327433 - DNA, 22 bp, Homo sapiens
taaattaaacaatttattttat

SEQ ID NO: 327434 - DNA, 15 bp, Homo sapiens
taaattaacttctat

SEQ ID NO: 327435 - DNA, 14 bp, Homo sapiens
taaattaagacttt

SEQ ID NO: 327436 - DNA, 17 bp, Homo sapiens
taaattaagactttaaa

SEQ ID NO: 327437 - DNA, 17 bp, Homo sapiens
taaattaatacataagt

SEQ ID NO: 327438 - DNA, 22 bp, Homo sapiens
taaattaatacataagttaata

SEQ ID NO: 327439 - DNA, 19 bp, Homo sapiens
taaattaatacttcatttg

SEQ ID NO: 327440 - DNA, 19 bp, Homo sapiens
taaattattactttaaatt

SEQ ID NO: 327441 - DNA, 14 bp, Homo sapiens
taaattattcagtt

SEQ ID NO: 327442 - DNA, 13 bp, Homo sapiens
taaattattgtaa

SEQ ID NO: 327443 - DNA, 15 bp, Homo sapiens
taaattattgtaaac

SEQ ID NO: 327444 - DNA, 18 bp, Homo sapiens
taaattattgtaaacttt

SEQ ID NO: 327445 - DNA, 18 bp, Homo sapiens
taaattcaacacttattt

SEQ ID NO: 327446 - DNA, 23 bp, Homo sapiens
taaattcaacacttattttctga

SEQ ID NO: 327447 - DNA, 22 bp, Homo sapiens
taaattccccatatttgtgttc

SEQ ID NO: 327448 - DNA, 16 bp, Homo sapiens
taaattcctcctgtct

SEQ ID NO: 327449 - DNA, 14 bp, Homo sapiens
taaattctctctaa

SEQ ID NO: 327450 - DNA, 15 bp, Homo sapiens
taaattctgctcctg

SEQ ID NO: 327451 - DNA, 16 bp, Homo sapiens
taaattctgctcctga

SEQ ID NO: 327452 - DNA, 19 bp, Homo sapiens
taaattcttagtaaaatgc

SEQ ID NO: 327453 - DNA, 11 bp, Homo sapiens
taaattctttt

SEQ ID NO: 327454 - DNA, 13 bp, Homo sapiens
taaattgaaagca

SEQ ID NO: 327455 - DNA, 16 bp, Homo sapiens
taaattgcataaagca

SEQ ID NO: 327456 - DNA, 18 bp, Homo sapiens
taaattgcatgctgcttt

SEQ ID NO: 327457 - DNA, 19 bp, Homo sapiens
taaattgcatgctgcttta

SEQ ID NO: 327458 - DNA, 15 bp, Homo sapiens
taaattgcctccctt

SEQ ID NO: 327459 - DNA, 17 bp, Homo sapiens
taaattgcctcccttcc

SEQ ID NO: 327460 - DNA, 13 bp, Homo sapiens
taaattgccttct

SEQ ID NO: 327461 - DNA, 23 bp, Homo sapiens
taaattgcttttgttgtgacttt

SEQ ID NO: 327462 - DNA, 13 bp, Homo sapiens
taaattggctcct

SEQ ID NO: 327463 - DNA, 14 bp, Homo sapiens
taaattggctcctt

SEQ ID NO: 327464 - DNA, 16 bp, Homo sapiens
taaattggtgataagt

SEQ ID NO: 327465 - DNA, 19 bp, Homo sapiens
taaattgttataacttcat

SEQ ID NO: 327466 - DNA, 15 bp, Homo sapiens
taaatttaactttaa

SEQ ID NO: 327467 - DNA, 19 bp, Homo sapiens
taaatttaatatactgcat

SEQ ID NO: 327468 - DNA, 20 bp, Homo sapiens
taaatttaatatactgcata

SEQ ID NO: 327469 - DNA, 16 bp, Homo sapiens
taaatttacgtatatt

SEQ ID NO: 327470 - DNA, 19 bp, Homo sapiens
taaatttcacaatataaag

SEQ ID NO: 327471 - DNA, 14 bp, Homo sapiens
taaatttgaatgtt

SEQ ID NO: 327472 - DNA, 13 bp, Homo sapiens
taaatttgttgtc

SEQ ID NO: 327473 - DNA, 18 bp, Homo sapiens
taaatttgttgtcatgtg

SEQ ID NO: 327474 - DNA, 14 bp, Homo sapiens
taaattttaatgta

SEQ ID NO: 327475 - DNA, 23 bp, Homo sapiens
taaattttataaggctgactctt

SEQ ID NO: 327476 - DNA, 15 bp, Homo sapiens
taaattttatctcag

SEQ ID NO: 327477 - DNA, 23 bp, Homo sapiens
taaattttccattaatttcaaca

SEQ ID NO: 327478 - DNA, 17 bp, Homo sapiens
taaattttgagttctac

SEQ ID NO: 327479 - DNA, 18 bp, Homo sapiens
taaattttgagttctaca

SEQ ID NO: 327480 - DNA, 19 bp, Homo sapiens
taaattttgagttctacat

SEQ ID NO: 327481 - DNA, 15 bp, Homo sapiens
taacaaaagatgaaa

SEQ ID NO: 327482 - DNA, 19 bp, Homo sapiens
taacaaactgaaaaatcta

SEQ ID NO: 327483 - DNA, 13 bp, Homo sapiens
taacaaagtgaga

SEQ ID NO: 327484 - DNA, 18 bp, Homo sapiens
taacaaatctaatctctt

SEQ ID NO: 327485 - DNA, 16 bp, Homo sapiens
taacaaatgttttcat

SEQ ID NO: 327486 - DNA, 23 bp, Homo sapiens
taacaaatgttttcatttacagg

SEQ ID NO: 327487 - DNA, 11 bp, Homo sapiens
taacaacaatt

SEQ ID NO: 327488 - DNA, 19 bp, Homo sapiens
taacaacagcttcttgctt

SEQ ID NO: 327489 - DNA, 16 bp, Homo sapiens
taacaaccctgttgag

SEQ ID NO: 327490 - DNA, 17 bp, Homo sapiens
taacaactaatcaagag

SEQ ID NO: 327491 - DNA, 15 bp, Homo sapiens
taacaagaaaacata

SEQ ID NO: 327492 - DNA, 18 bp, Homo sapiens
taacaagaaactcacccc

SEQ ID NO: 327493 - DNA, 18 bp, Homo sapiens
taacaagccaaacattct

SEQ ID NO: 327494 - DNA, 12 bp, Homo sapiens
taacaaggaatg

SEQ ID NO: 327495 - DNA, 20 bp, Homo sapiens
taacaaggaatgcctgtgcc

SEQ ID NO: 327496 - DNA, 16 bp, Homo sapiens
taacaataactactgt

SEQ ID NO: 327497 - DNA, 19 bp, Homo sapiens
taacaataactactgtgtt

SEQ ID NO: 327498 - DNA, 13 bp, Homo sapiens
taacaatatatga

SEQ ID NO: 327499 - DNA, 18 bp, Homo sapiens
taacaatgccttgttgta

SEQ ID NO: 327500 - DNA, 17 bp, Homo sapiens
taacacaagtcctgtga

SEQ ID NO: 327501 - DNA, 23 bp, Homo sapiens
taacacaagtcctgtgaatttct

SEQ ID NO: 327502 - DNA, 16 bp, Homo sapiens
taacacagagagacag

SEQ ID NO: 327503 - DNA, 16 bp, Homo sapiens
taacacataaagtaaa

SEQ ID NO: 327504 - DNA, 11 bp, Homo sapiens
taacacattat

SEQ ID NO: 327505 - DNA, 19 bp, Homo sapiens
taacactatgtttatttac

SEQ ID NO: 327506 - DNA, 14 bp, Homo sapiens
taacagagtagttt

SEQ ID NO: 327507 - DNA, 22 bp, Homo sapiens
taacagagtttgatatgggctt

SEQ ID NO: 327508 - DNA, 20 bp, Homo sapiens
taacagatcagaacatgaaa

SEQ ID NO: 327509 - DNA, 18 bp, Homo sapiens
taacagatcctttcaaaa

SEQ ID NO: 327510 - DNA, 22 bp, Homo sapiens
taacagcattcttgtcacaata

SEQ ID NO: 327511 - DNA, 12 bp, Homo sapiens
taacagctgagg

SEQ ID NO: 327512 - DNA, 15 bp, Homo sapiens
taacagctgaggtct

SEQ ID NO: 327513 - DNA, 13 bp, Homo sapiens
taacagctttctc

SEQ ID NO: 327514 - DNA, 17 bp, Homo sapiens
taacagctttctccaga

SEQ ID NO: 327515 - DNA, 21 bp, Homo sapiens
taacaggaagatcttaaattt

SEQ ID NO: 327516 - DNA, 15 bp, Homo sapiens
taacaggatgaaagt

SEQ ID NO: 327517 - DNA, 15 bp, Homo sapiens
cttcacgctggcttc

SEQ ID NO: 327518 - DNA, 19 bp, Homo sapiens
cttcacgctggcttccagc

SEQ ID NO: 327519 - DNA, 18 bp, Homo sapiens
cttcacggactctttgct

SEQ ID NO: 327520 - DNA, 20 bp, Homo sapiens
cttcacggtttcacttttaa

SEQ ID NO: 327521 - DNA, 17 bp, Homo sapiens
cttcactctgacagtat

SEQ ID NO: 327522 - DNA, 14 bp, Homo sapiens
cttcactgaatatc

SEQ ID NO: 327523 - DNA, 16 bp, Homo sapiens
cttcactgaatatcat

SEQ ID NO: 327524 - DNA, 24 bp, Homo sapiens
cttcactgcagatttctcacctgt

SEQ ID NO: 327525 - DNA, 13 bp, Homo sapiens
cttcactgccatg

SEQ ID NO: 327526 - DNA, 15 bp, Homo sapiens
cttcactggagaccg

SEQ ID NO: 327527 - DNA, 16 bp, Homo sapiens
cttcactgtctgttgt

SEQ ID NO: 327528 - DNA, 20 bp, Homo sapiens
cttcactgttgcttaattgt

SEQ ID NO: 327529 - DNA, 20 bp, Homo sapiens
cttcacttaaaatcaaattt

SEQ ID NO: 327530 - DNA, 15 bp, Homo sapiens
cttcacttctgacca

SEQ ID NO: 327531 - DNA, 17 bp, Homo sapiens
cttcacttctgaccaca

SEQ ID NO: 327532 - DNA, 21 bp, Homo sapiens
cttcacttctgaccacacttc

SEQ ID NO: 327533 - DNA, 15 bp, Homo sapiens
cttcagaaaagacac

SEQ ID NO: 327534 - DNA, 17 bp, Homo sapiens
cttcagaagtttgcttc

SEQ ID NO: 327535 - DNA, 20 bp, Homo sapiens
cttcagacacacggggcacc

SEQ ID NO: 327536 - DNA, 12 bp, Homo sapiens
cttcagactctc

SEQ ID NO: 327537 - DNA, 12 bp, Homo sapiens
cttcagagaagt

SEQ ID NO: 327538 - DNA, 11 bp, Homo sapiens
cttcagagagc

SEQ ID NO: 327539 - DNA, 13 bp, Homo sapiens
cttcagagctctt

SEQ ID NO: 327540 - DNA, 13 bp, Homo sapiens
cttcagagggaaa

SEQ ID NO: 327541 - DNA, 14 bp, Homo sapiens
cttcagagtgaatc

SEQ ID NO: 327542 - DNA, 18 bp, Homo sapiens
cttcagagttctctgtaa

SEQ ID NO: 327543 - DNA, 16 bp, Homo sapiens
cttcagatattttgca

SEQ ID NO: 327544 - DNA, 17 bp, Homo sapiens
cttcagatattttgcac

SEQ ID NO: 327545 - DNA, 15 bp, Homo sapiens
cttcagatcctgctg

SEQ ID NO: 327546 - DNA, 17 bp, Homo sapiens
cttcagatcctgctgcc

SEQ ID NO: 327547 - DNA, 18 bp, Homo sapiens
cttcagatggaaactctt

SEQ ID NO: 327548 - DNA, 11 bp, Homo sapiens
cttcagcaacc

SEQ ID NO: 327549 - DNA, 13 bp, Homo sapiens
cttcagcaaccct

SEQ ID NO: 327550 - DNA, 15 bp, Homo sapiens
cttcagcagctagag

SEQ ID NO: 327551 - DNA, 11 bp, Homo sapiens
cttcagcaggg

SEQ ID NO: 327552 - DNA, 15 bp, Homo sapiens
cttcagcatcctcag

SEQ ID NO: 327553 - DNA, 13 bp, Homo sapiens
cttcagcccctgg

SEQ ID NO: 327554 - DNA, 22 bp, Homo sapiens
cttcagccctaacatagtgtct

SEQ ID NO: 327555 - DNA, 23 bp, Homo sapiens
cttcagcgagacccttgcattag

SEQ ID NO: 327556 - DNA, 19 bp, Homo sapiens
cttcagctggtggatggtg

SEQ ID NO: 327557 - DNA, 14 bp, Homo sapiens
cttcagcttgcttc

SEQ ID NO: 327558 - DNA, 16 bp, Homo sapiens
cttcaggacccttcta

SEQ ID NO: 327559 - DNA, 21 bp, Homo sapiens
cttcaggatgcacggtttctg

SEQ ID NO: 327560 - DNA, 19 bp, Homo sapiens
cttcagggcactgctgctg

SEQ ID NO: 327561 - DNA, 16 bp, Homo sapiens
cttcagggcagggctc

SEQ ID NO: 327562 - DNA, 17 bp, Homo sapiens
cttcagggcagggctct

SEQ ID NO: 327563 - DNA, 18 bp, Homo sapiens
cttcagggcagggctctg

SEQ ID NO: 327564 - DNA, 20 bp, Homo sapiens
cttcagggcagggctctgat

SEQ ID NO: 327565 - DNA, 15 bp, Homo sapiens
cttcagggggccagg

SEQ ID NO: 327566 - DNA, 23 bp, Homo sapiens
cttcaggggtcacctcctccaag

SEQ ID NO: 327567 - DNA, 14 bp, Homo sapiens
cttcagggttctcc

SEQ ID NO: 327568 - DNA, 20 bp, Homo sapiens
cttcagggttctcctctccc

SEQ ID NO: 327569 - DNA, 18 bp, Homo sapiens
cttcaggttgttctgtat

SEQ ID NO: 327570 - DNA, 15 bp, Homo sapiens
cttcagtctctgcag

SEQ ID NO: 327571 - DNA, 18 bp, Homo sapiens
cttcagtctctgcagtgt

SEQ ID NO: 327572 - DNA, 20 bp, Homo sapiens
cttcagtgagcccctcccca

SEQ ID NO: 327573 - DNA, 17 bp, Homo sapiens
cttcagtggagaattat

SEQ ID NO: 327574 - DNA, 14 bp, Homo sapiens
cttcagttgttttc

SEQ ID NO: 327575 - DNA, 22 bp, Homo sapiens
cttcagtttgaaggctgcacac

SEQ ID NO: 327576 - DNA, 18 bp, Homo sapiens
cttcatagcagattttaa

SEQ ID NO: 327577 - DNA, 13 bp, Homo sapiens
cttcataggcaga

SEQ ID NO: 327578 - DNA, 15 bp, Homo sapiens
cttcataggcagagc

SEQ ID NO: 327579 - DNA, 13 bp, Homo sapiens
cttcatatctctc

SEQ ID NO: 327580 - DNA, 21 bp, Homo sapiens
cttcatccatagacacagtat

SEQ ID NO: 327581 - DNA, 22 bp, Homo sapiens
cttcatccatagacacagtatt

SEQ ID NO: 327582 - DNA, 19 bp, Homo sapiens
cttcatcccactccaactc

SEQ ID NO: 327583 - DNA, 17 bp, Homo sapiens
cttcatcttgagcctga

SEQ ID NO: 327584 - DNA, 16 bp, Homo sapiens
cttcatgcctttgtaa

SEQ ID NO: 327585 - DNA, 18 bp, Homo sapiens
cttcatgcttttctcatg

SEQ ID NO: 327586 - DNA, 13 bp, Homo sapiens
cttcattaaagtc

SEQ ID NO: 327587 - DNA, 13 bp, Homo sapiens
cttcattcccact

SEQ ID NO: 327588 - DNA, 15 bp, Homo sapiens
cttcatttattttga

SEQ ID NO: 327589 - DNA, 19 bp, Homo sapiens
cttcatttcatcctgttgg

SEQ ID NO: 327590 - DNA, 14 bp, Homo sapiens
cttcatttcattgt

SEQ ID NO: 327591 - DNA, 15 bp, Homo sapiens
cttcatttcattgta

SEQ ID NO: 327592 - DNA, 16 bp, Homo sapiens
cttcatttcattgtat

SEQ ID NO: 327593 - DNA, 18 bp, Homo sapiens
cttcatttcattgtatga

SEQ ID NO: 327594 - DNA, 19 bp, Homo sapiens
cttcatttcattgtatgat

SEQ ID NO: 327595 - DNA, 14 bp, Homo sapiens
cttcatttttccta

SEQ ID NO: 327596 - DNA, 15 bp, Homo sapiens
cttccaaaattctta

SEQ ID NO: 327597 - DNA, 19 bp, Homo sapiens
cttccaaagagtcatcatg

SEQ ID NO: 327598 - DNA, 21 bp, Homo sapiens
cttccaaatttgaatggatta

SEQ ID NO: 327599 - DNA, 17 bp, Homo sapiens
cttccaactgctgcccc

SEQ ID NO: 327600 - DNA, 12 bp, Homo sapiens
cttccaaggaga

SEQ ID NO: 327601 - DNA, 14 bp, Homo sapiens
cttccaaggagacc

SEQ ID NO: 327602 - DNA, 20 bp, Homo sapiens
cttccaaggagaccaagtcc

SEQ ID NO: 327603 - DNA, 22 bp, Homo sapiens
cttccacccattcccccatgtg

SEQ ID NO: 327604 - DNA, 19 bp, Homo sapiens
cttccacctcacaactcct

SEQ ID NO: 327605 - DNA, 13 bp, Homo sapiens
cttccacctccct

SEQ ID NO: 327606 - DNA, 15 bp, Homo sapiens
cttccacctcctaga

SEQ ID NO: 327607 - DNA, 16 bp, Homo sapiens
cttccacctcctagag

SEQ ID NO: 327608 - DNA, 16 bp, Homo sapiens
cttccacgctgtctcc

SEQ ID NO: 327609 - DNA, 21 bp, Homo sapiens
cttccacgctgtctccagacc

SEQ ID NO: 327610 - DNA, 13 bp, Homo sapiens
cttccactgcctc

SEQ ID NO: 327611 - DNA, 19 bp, Homo sapiens
cttccactgcctctgcctt

SEQ ID NO: 327612 - DNA, 22 bp, Homo sapiens
cttccagaaagcaggagcagct

SEQ ID NO: 327613 - DNA, 20 bp, Homo sapiens
cttccagaagatgccctcca

SEQ ID NO: 327614 - DNA, 22 bp, Homo sapiens
cttccagattgggggccctggg

SEQ ID NO: 327615 - DNA, 12 bp, Homo sapiens
cttccagcccag

SEQ ID NO: 327616 - DNA, 15 bp, Homo sapiens
cttccagcctgagat

SEQ ID NO: 327617 - DNA, 23 bp, Homo sapiens
cttccagcgggccctctgccgac

SEQ ID NO: 327618 - DNA, 16 bp, Homo sapiens
cttccaggaagcacag

SEQ ID NO: 327619 - DNA, 17 bp, Homo sapiens
cttccaggaagcacagg

SEQ ID NO: 327620 - DNA, 15 bp, Homo sapiens
cttccaggacccctg

SEQ ID NO: 327621 - DNA, 22 bp, Homo sapiens
cttccaggataaggagactgag

SEQ ID NO: 327622 - DNA, 16 bp, Homo sapiens
cttccaggccatcaga

SEQ ID NO: 327623 - DNA, 20 bp, Homo sapiens
cttccaggttccatccacca

SEQ ID NO: 327624 - DNA, 23 bp, Homo sapiens
cttccaggttctggttagctcag

SEQ ID NO: 327625 - DNA, 17 bp, Homo sapiens
cttccagttggactgtg

SEQ ID NO: 327626 - DNA, 19 bp, Homo sapiens
cttccagttggactgtggc

SEQ ID NO: 327627 - DNA, 11 bp, Homo sapiens
cttccataatg

SEQ ID NO: 327628 - DNA, 14 bp, Homo sapiens
cttccatacagctc

SEQ ID NO: 327629 - DNA, 18 bp, Homo sapiens
cttccatcagctctctgc

SEQ ID NO: 327630 - DNA, 15 bp, Homo sapiens
cttccatccctaccc

SEQ ID NO: 327631 - DNA, 17 bp, Homo sapiens
cttccatgagaacagca

SEQ ID NO: 327632 - DNA, 21 bp, Homo sapiens
cttccatgagaacagcagggt

SEQ ID NO: 327633 - DNA, 23 bp, Homo sapiens
cttccatggcttcctgagaaagc

SEQ ID NO: 327634 - DNA, 20 bp, Homo sapiens
cttccatggtggtttcagaa

SEQ ID NO: 327635 - DNA, 15 bp, Homo sapiens
cttccatgtcgcctc

SEQ ID NO: 327636 - DNA, 17 bp, Homo sapiens
cttccatgtcgcctctg

SEQ ID NO: 327637 - DNA, 18 bp, Homo sapiens
cttccattctttcttcct

SEQ ID NO: 327638 - DNA, 17 bp, Homo sapiens
cttcccaaaccaagtgc

SEQ ID NO: 327639 - DNA, 17 bp, Homo sapiens
cttcccaaactcccagg

SEQ ID NO: 327640 - DNA, 19 bp, Homo sapiens
cttcccaaactcccaggac

SEQ ID NO: 327641 - DNA, 13 bp, Homo sapiens
cttcccaacaata

SEQ ID NO: 327642 - DNA, 19 bp, Homo sapiens
cttcccaacaatactttgt

SEQ ID NO: 327643 - DNA, 21 bp, Homo sapiens
cttcccaacaatactttgtgt

SEQ ID NO: 327644 - DNA, 18 bp, Homo sapiens
cttcccaacagccttagc

SEQ ID NO: 327645 - DNA, 22 bp, Homo sapiens
cttcccaacgtactcctcagac

SEQ ID NO: 327646 - DNA, 20 bp, Homo sapiens
cttcccaactcactgtgctc

SEQ ID NO: 327647 - DNA, 15 bp, Homo sapiens
cttcccaacttccct

SEQ ID NO: 327648 - DNA, 14 bp, Homo sapiens
cttctgtgtctgtc

SEQ ID NO: 327649 - DNA, 19 bp, Homo sapiens
cttctgtttttctcaaata

SEQ ID NO: 327650 - DNA, 14 bp, Homo sapiens
cttcttaaaggcct

SEQ ID NO: 327651 - DNA, 16 bp, Homo sapiens
cttcttaaaggcctgg

SEQ ID NO: 327652 - DNA, 17 bp, Homo sapiens
cttcttaaaggcctgga

SEQ ID NO: 327653 - DNA, 19 bp, Homo sapiens
cttcttaaaggcctggaac

SEQ ID NO: 327654 - DNA, 20 bp, Homo sapiens
cttcttaatataactgcctt

SEQ ID NO: 327655 - DNA, 16 bp, Homo sapiens
cttcttcacccagcta

SEQ ID NO: 327656 - DNA, 23 bp, Homo sapiens
cttcttcatccatagacacagta

SEQ ID NO: 327657 - DNA, 20 bp, Homo sapiens
cttcttgaaacagcctgggt

SEQ ID NO: 327658 - DNA, 21 bp, Homo sapiens
cttcttgcggcaccgcccacc

SEQ ID NO: 327659 - DNA, 17 bp, Homo sapiens
cttcttgcttgtaaaaa

SEQ ID NO: 327660 - DNA, 15 bp, Homo sapiens
cttcttgggccccag

SEQ ID NO: 327661 - DNA, 19 bp, Homo sapiens
cttcttgggccccagaccc

SEQ ID NO: 327662 - DNA, 18 bp, Homo sapiens
cttcttgtaatatttctt

SEQ ID NO: 327663 - DNA, 20 bp, Homo sapiens
cttcttgtaatatttcttca

SEQ ID NO: 327664 - DNA, 15 bp, Homo sapiens
cttcttgtgtcctga

SEQ ID NO: 327665 - DNA, 18 bp, Homo sapiens
cttcttgtgtttgaaaca

SEQ ID NO: 327666 - DNA, 18 bp, Homo sapiens
cttctttaaggaagaata

SEQ ID NO: 327667 - DNA, 20 bp, Homo sapiens
cttctttaccttcatttcat

SEQ ID NO: 327668 - DNA, 23 bp, Homo sapiens
cttctttctctcagccttacatt

SEQ ID NO: 327669 - DNA, 22 bp, Homo sapiens
cttctttgactataacaaaatc

SEQ ID NO: 327670 - DNA, 22 bp, Homo sapiens
cttctttgcaacaataataaat

SEQ ID NO: 327671 - DNA, 17 bp, Homo sapiens
cttctttttttgtgatg

SEQ ID NO: 327672 - DNA, 23 bp, Homo sapiens
cttgaaagttttccagtattgaa

SEQ ID NO: 327673 - DNA, 14 bp, Homo sapiens
cttgaacccgggag

SEQ ID NO: 327674 - DNA, 14 bp, Homo sapiens
cttgaacctgggaa

SEQ ID NO: 327675 - DNA, 18 bp, Homo sapiens
cttgaacctgggaagtgg

SEQ ID NO: 327676 - DNA, 16 bp, Homo sapiens
cttgaactcctgacct

SEQ ID NO: 327677 - DNA, 14 bp, Homo sapiens
cttgaagaatattg

SEQ ID NO: 327678 - DNA, 19 bp, Homo sapiens
cttgaagtgatcatttcac

SEQ ID NO: 327679 - DNA, 23 bp, Homo sapiens
cttgaatgatgccatgaggaaca

SEQ ID NO: 327680 - DNA, 23 bp, Homo sapiens
cttgaatggaaggtccgagtctt

SEQ ID NO: 327681 - DNA, 19 bp, Homo sapiens
cttgaatggtgcaatgaat

SEQ ID NO: 327682 - DNA, 21 bp, Homo sapiens
cttgaatggtgcaatgaatta

SEQ ID NO: 327683 - DNA, 23 bp, Homo sapiens
cttgaatggttaataaaactgca

SEQ ID NO: 327684 - DNA, 17 bp, Homo sapiens
cttgaatgtacaaagat

SEQ ID NO: 327685 - DNA, 10 bp, Homo sapiens
cttgaatgtc

SEQ ID NO: 327686 - DNA, 12 bp, Homo sapiens
cttgaatttctg

SEQ ID NO: 327687 - DNA, 19 bp, Homo sapiens
cttgacaaaacctaacttg

SEQ ID NO: 327688 - DNA, 18 bp, Homo sapiens
cttgacaagtacatcacc

SEQ ID NO: 327689 - DNA, 22 bp, Homo sapiens
cttgacaattcccgggcccttc

SEQ ID NO: 327690 - DNA, 23 bp, Homo sapiens
cttgacagatgtctgggaaagca

SEQ ID NO: 327691 - DNA, 15 bp, Homo sapiens
cttgaccctagaatt

SEQ ID NO: 327692 - DNA, 18 bp, Homo sapiens
cttgaccgtactctcaca

SEQ ID NO: 327693 - DNA, 12 bp, Homo sapiens
cttgacctccta

SEQ ID NO: 327694 - DNA, 13 bp, Homo sapiens
cttgaccttcctc

SEQ ID NO: 327695 - DNA, 22 bp, Homo sapiens
cttgaccttcctctggggctct

SEQ ID NO: 327696 - DNA, 15 bp, Homo sapiens
cttgacctttccagc

SEQ ID NO: 327697 - DNA, 20 bp, Homo sapiens
cttgacgcgtggtcacagga

SEQ ID NO: 327698 - DNA, 17 bp, Homo sapiens
cttgactctaaatgcag

SEQ ID NO: 327699 - DNA, 14 bp, Homo sapiens
cttgactcttgaat

SEQ ID NO: 327700 - DNA, 22 bp, Homo sapiens
cttgactgaagcgaacatcttc

SEQ ID NO: 327701 - DNA, 17 bp, Homo sapiens
cttgacttgattagtgc

SEQ ID NO: 327702 - DNA, 11 bp, Homo sapiens
cttgagaaacc

SEQ ID NO: 327703 - DNA, 12 bp, Homo sapiens
cttgagaaacct

SEQ ID NO: 327704 - DNA, 13 bp, Homo sapiens
cttgagaaacctt

SEQ ID NO: 327705 - DNA, 11 bp, Homo sapiens
cttgagaactt

SEQ ID NO: 327706 - DNA, 20 bp, Homo sapiens
cttgagacccccaagcttcc

SEQ ID NO: 327707 - DNA, 22 bp, Homo sapiens
cttgagacccccaagcttccac

SEQ ID NO: 327708 - DNA, 17 bp, Homo sapiens
cttgagaccctcttctc

SEQ ID NO: 327709 - DNA, 23 bp, Homo sapiens
cttgagaccctcttctctgggcc

SEQ ID NO: 327710 - DNA, 21 bp, Homo sapiens
cttgagagaaaaagtgcccct

SEQ ID NO: 327711 - DNA, 18 bp, Homo sapiens
cttgagagcgctggcctc

SEQ ID NO: 327712 - DNA, 20 bp, Homo sapiens
cttgagaggcatgacagctg

SEQ ID NO: 327713 - DNA, 13 bp, Homo sapiens
cttgagatgtatt

SEQ ID NO: 327714 - DNA, 22 bp, Homo sapiens
cttgagatgtattatgcaaagt

SEQ ID NO: 327715 - DNA, 21 bp, Homo sapiens
cttgagcaaggcaagaagtgg

SEQ ID NO: 327716 - DNA, 21 bp, Homo sapiens
cttgagcaccaggtgttaaaa

SEQ ID NO: 327717 - DNA, 13 bp, Homo sapiens
cttgagcagaccg

SEQ ID NO: 327718 - DNA, 14 bp, Homo sapiens
cttgagcagtggct

SEQ ID NO: 327719 - DNA, 13 bp, Homo sapiens
cttgagccagtaa

SEQ ID NO: 327720 - DNA, 13 bp, Homo sapiens
cttgagcccagga

SEQ ID NO: 327721 - DNA, 14 bp, Homo sapiens
cttgagcccaggag

SEQ ID NO: 327722 - DNA, 16 bp, Homo sapiens
cttgagccctcctgga

SEQ ID NO: 327723 - DNA, 14 bp, Homo sapiens
cttgagcggagccc

SEQ ID NO: 327724 - DNA, 13 bp, Homo sapiens
cttgagctgagat

SEQ ID NO: 327725 - DNA, 15 bp, Homo sapiens
cttgagctgcctgct

SEQ ID NO: 327726 - DNA, 13 bp, Homo sapiens
cttgaggacacat

SEQ ID NO: 327727 - DNA, 18 bp, Homo sapiens
cttgaggacacatgtcca

SEQ ID NO: 327728 - DNA, 16 bp, Homo sapiens
cttgaggattttgagt

SEQ ID NO: 327729 - DNA, 14 bp, Homo sapiens
cttgaggtcttttg

SEQ ID NO: 327730 - DNA, 14 bp, Homo sapiens
cttgagtaatttaa

SEQ ID NO: 327731 - DNA, 18 bp, Homo sapiens
cttgagtgacatgcggct

SEQ ID NO: 327732 - DNA, 19 bp, Homo sapiens
cttgagtgggccccctctc

SEQ ID NO: 327733 - DNA, 13 bp, Homo sapiens
cttgagtgtgcaa

SEQ ID NO: 327734 - DNA, 21 bp, Homo sapiens
cttgagttggagtactatatt

SEQ ID NO: 327735 - DNA, 19 bp, Homo sapiens
cttgagtttcatttttcat

SEQ ID NO: 327736 - DNA, 17 bp, Homo sapiens
cttgataatgttgtggt

SEQ ID NO: 327737 - DNA, 19 bp, Homo sapiens
cttgatcatgaatcactgc

SEQ ID NO: 327738 - DNA, 13 bp, Homo sapiens
cttgatctcctga

SEQ ID NO: 327739 - DNA, 23 bp, Homo sapiens
cttgatgcctcccggctttgcag

SEQ ID NO: 327740 - DNA, 16 bp, Homo sapiens
cttgatggagaaggaa

SEQ ID NO: 327741 - DNA, 19 bp, Homo sapiens
cttgatggagaaggaaaag

SEQ ID NO: 327742 - DNA, 18 bp, Homo sapiens
cttgatgtaaaatcttgt

SEQ ID NO: 327743 - DNA, 22 bp, Homo sapiens
cttgatgtaaaatcttgtcatg

SEQ ID NO: 327744 - DNA, 23 bp, Homo sapiens
cttgatgtaaaatcttgtcatgt

SEQ ID NO: 327745 - DNA, 20 bp, Homo sapiens
cttgatgtctttgttaagac

SEQ ID NO: 327746 - DNA, 12 bp, Homo sapiens
cttgatgtgaag

SEQ ID NO: 327747 - DNA, 15 bp, Homo sapiens
cttgattaagatttt

SEQ ID NO: 327748 - DNA, 21 bp, Homo sapiens
cttgattgatttttaaagttt

SEQ ID NO: 327749 - DNA, 18 bp, Homo sapiens
cttgatttgcatggattt

SEQ ID NO: 327750 - DNA, 19 bp, Homo sapiens
cttgattttcaagctttca

SEQ ID NO: 327751 - DNA, 15 bp, Homo sapiens
cttgcaacacacaga

SEQ ID NO: 327752 - DNA, 17 bp, Homo sapiens
cttgcaacacacagaca

SEQ ID NO: 327753 - DNA, 19 bp, Homo sapiens
cttgcaacacacagacaca

SEQ ID NO: 327754 - DNA, 20 bp, Homo sapiens
cttgcaacttcatgtcaact

SEQ ID NO: 327755 - DNA, 17 bp, Homo sapiens
cttgcaatcttctactt

SEQ ID NO: 327756 - DNA, 16 bp, Homo sapiens
cttgcacaggccactt

SEQ ID NO: 327757 - DNA, 22 bp, Homo sapiens
cttgcacaggccacttgctcag

SEQ ID NO: 327758 - DNA, 16 bp, Homo sapiens
cttgcactgtgcttgc

SEQ ID NO: 327759 - DNA, 17 bp, Homo sapiens
cttgcactgtgcttgct

SEQ ID NO: 327760 - DNA, 19 bp, Homo sapiens
cttgcactgtgcttgctcc

SEQ ID NO: 327761 - DNA, 13 bp, Homo sapiens
cttgcacttgttt

SEQ ID NO: 327762 - DNA, 23 bp, Homo sapiens
cttgcaggggtcccccctcaaga

SEQ ID NO: 327763 - DNA, 18 bp, Homo sapiens
cttgcagttcagcaccac

SEQ ID NO: 327764 - DNA, 21 bp, Homo sapiens
cttgcataataagctaaagag

SEQ ID NO: 327765 - DNA, 19 bp, Homo sapiens
cttgcatctacctgctcct

SEQ ID NO: 327766 - DNA, 22 bp, Homo sapiens
cttgcatttctttatttctgtc

SEQ ID NO: 327767 - DNA, 16 bp, Homo sapiens
cttgcattttagctaa

SEQ ID NO: 327768 - DNA, 17 bp, Homo sapiens
cttgccaagaaaatgaa

SEQ ID NO: 327769 - DNA, 12 bp, Homo sapiens
cttgccaaggcc

SEQ ID NO: 327770 - DNA, 15 bp, Homo sapiens
cttgccaatggtgta

SEQ ID NO: 327771 - DNA, 13 bp, Homo sapiens
cttgccagctcag

SEQ ID NO: 327772 - DNA, 15 bp, Homo sapiens
cttgccagctcagca

SEQ ID NO: 327773 - DNA, 20 bp, Homo sapiens
cttgccaggaggctggcagt

SEQ ID NO: 327774 - DNA, 15 bp, Homo sapiens
cttgcccaactccca

SEQ ID NO: 327775 - DNA, 16 bp, Homo sapiens
cttgcccaactcccag

SEQ ID NO: 327776 - DNA, 18 bp, Homo sapiens
cttgcccaactcccagcc

SEQ ID NO: 327777 - DNA, 17 bp, Homo sapiens
cttgcccagactacagg

SEQ ID NO: 327778 - DNA, 15 bp, Homo sapiens
cttttgcaaacagaa

SEQ ID NO: 327779 - DNA, 13 bp, Homo sapiens
cttttgcagcttc

SEQ ID NO: 327780 - DNA, 17 bp, Homo sapiens
cttttgccattaaactt

SEQ ID NO: 327781 - DNA, 18 bp, Homo sapiens
cttttgcccgttgaggta

SEQ ID NO: 327782 - DNA, 15 bp, Homo sapiens
cttttgcctggctgt

SEQ ID NO: 327783 - DNA, 20 bp, Homo sapiens
cttttgcttaggaaattgct

SEQ ID NO: 327784 - DNA, 15 bp, Homo sapiens
cttttggcactgaga

SEQ ID NO: 327785 - DNA, 12 bp, Homo sapiens
cttttggccttg

SEQ ID NO: 327786 - DNA, 15 bp, Homo sapiens
cttttggcctttgta

SEQ ID NO: 327787 - DNA, 15 bp, Homo sapiens
cttttgggaaatgct

SEQ ID NO: 327788 - DNA, 17 bp, Homo sapiens
cttttgggtttgcctta

SEQ ID NO: 327789 - DNA, 21 bp, Homo sapiens
cttttgtagatggcactttag

SEQ ID NO: 327790 - DNA, 18 bp, Homo sapiens
cttttgtccccagggccc

SEQ ID NO: 327791 - DNA, 15 bp, Homo sapiens
cttttgtgccaggag

SEQ ID NO: 327792 - DNA, 16 bp, Homo sapiens
cttttgtgccaggagt

SEQ ID NO: 327793 - DNA, 17 bp, Homo sapiens
cttttgtgggtttctct

SEQ ID NO: 327794 - DNA, 15 bp, Homo sapiens
cttttgtgtattctg

SEQ ID NO: 327795 - DNA, 23 bp, Homo sapiens
cttttgtgtgatgcgccttgctg

SEQ ID NO: 327796 - DNA, 17 bp, Homo sapiens
cttttgttctctcttgg

SEQ ID NO: 327797 - DNA, 13 bp, Homo sapiens
cttttgttgtgac

SEQ ID NO: 327798 - DNA, 14 bp, Homo sapiens
cttttgttgtttat

SEQ ID NO: 327799 - DNA, 21 bp, Homo sapiens
cttttgtttaaatataaatgt

SEQ ID NO: 327800 - DNA, 13 bp, Homo sapiens
cttttgtttcagg

SEQ ID NO: 327801 - DNA, 19 bp, Homo sapiens
ctttttaaattttccatta

SEQ ID NO: 327802 - DNA, 12 bp, Homo sapiens
ctttttcaatgg

SEQ ID NO: 327803 - DNA, 17 bp, Homo sapiens
ctttttccttcctgccc

SEQ ID NO: 327804 - DNA, 18 bp, Homo sapiens
ctttttccttcctgccct

SEQ ID NO: 327805 - DNA, 20 bp, Homo sapiens
ctttttccttcctgccctgt

SEQ ID NO: 327806 - DNA, 19 bp, Homo sapiens
ctttttctcgagtccaaaa

SEQ ID NO: 327807 - DNA, 18 bp, Homo sapiens
ctttttcttaccctctct

SEQ ID NO: 327808 - DNA, 22 bp, Homo sapiens
ctttttcttaccctctctttca

SEQ ID NO: 327809 - DNA, 13 bp, Homo sapiens
ctttttcttttct

SEQ ID NO: 327810 - DNA, 11 bp, Homo sapiens
ctttttgaatg

SEQ ID NO: 327811 - DNA, 13 bp, Homo sapiens
ctttttgcagctt

SEQ ID NO: 327812 - DNA, 22 bp, Homo sapiens
ctttttggcattatctctttct

SEQ ID NO: 327813 - DNA, 20 bp, Homo sapiens
ctttttgggagagacttgtt

SEQ ID NO: 327814 - DNA, 12 bp, Homo sapiens
ctttttgtaaat

SEQ ID NO: 327815 - DNA, 15 bp, Homo sapiens
cttttttacacaaat

SEQ ID NO: 327816 - DNA, 19 bp, Homo sapiens
cttttttacacacctacta

SEQ ID NO: 327817 - DNA, 16 bp, Homo sapiens
cttttttagctctctt

SEQ ID NO: 327818 - DNA, 21 bp, Homo sapiens
cttttttatggcgattcccat

SEQ ID NO: 327819 - DNA, 23 bp, Homo sapiens
cttttttatgtgccgtgttattg

SEQ ID NO: 327820 - DNA, 13 bp, Homo sapiens
cttttttcttccc

SEQ ID NO: 327821 - DNA, 21 bp, Homo sapiens
ctttttttaaaaagttgatag

SEQ ID NO: 327822 - DNA, 23 bp, Homo sapiens
ctttttttttcacctgaaacact

SEQ ID NO: 327823 - DNA, 22 bp, Homo sapiens
ctttttttttttttaaagacag

SEQ ID NO: 327824 - DNA, 23 bp, Homo sapiens
ctttttttttttttaaagacaga

SEQ ID NO: 327825 - DNA, 23 bp, Homo sapiens
cttttttttttttttcagttttt

SEQ ID NO: 327826 - DNA, 18 bp, Homo sapiens
gaaaaaaaaaaaagaaaa

SEQ ID NO: 327827 - DNA, 15 bp, Homo sapiens
gaaaaaaaaaacaaa

SEQ ID NO: 327828 - DNA, 13 bp, Homo sapiens
gaaaaaaaaagaa

SEQ ID NO: 327829 - DNA, 20 bp, Homo sapiens
gaaaaaaaataacacagaga

SEQ ID NO: 327830 - DNA, 13 bp, Homo sapiens
gaaaaaaactttt

SEQ ID NO: 327831 - DNA, 17 bp, Homo sapiens
gaaaaaaacttttataa

SEQ ID NO: 327832 - DNA, 21 bp, Homo sapiens
gaaaaaaagggaaaacaaata

SEQ ID NO: 327833 - DNA, 20 bp, Homo sapiens
gaaaaaaatagttttacatt

SEQ ID NO: 327834 - DNA, 16 bp, Homo sapiens
gaaaaaaattggcatt

SEQ ID NO: 327835 - DNA, 11 bp, Homo sapiens
gaaaaaacaag

SEQ ID NO: 327836 - DNA, 23 bp, Homo sapiens
gaaaaaagaaattccctggacca

SEQ ID NO: 327837 - DNA, 14 bp, Homo sapiens
gaaaaaagaagttt

SEQ ID NO: 327838 - DNA, 13 bp, Homo sapiens
gaaaaaagagaaa

SEQ ID NO: 327839 - DNA, 15 bp, Homo sapiens
gaaaaaagagaaaaa

SEQ ID NO: 327840 - DNA, 11 bp, Homo sapiens
gaaaaaattag

SEQ ID NO: 327841 - DNA, 19 bp, Homo sapiens
gaaaaacaagtttgctagt

SEQ ID NO: 327842 - DNA, 23 bp, Homo sapiens
gaaaaacaccgcttctgcctttt

SEQ ID NO: 327843 - DNA, 18 bp, Homo sapiens
gaaaaacacggcagctgt

SEQ ID NO: 327844 - DNA, 16 bp, Homo sapiens
gaaaaacagaacattt

SEQ ID NO: 327845 - DNA, 17 bp, Homo sapiens
gaaaaacagaacatttc

SEQ ID NO: 327846 - DNA, 21 bp, Homo sapiens
gaaaaacagaggatgctgaag

SEQ ID NO: 327847 - DNA, 22 bp, Homo sapiens
gaaaaacagaggatgctgaagt

SEQ ID NO: 327848 - DNA, 13 bp, Homo sapiens
gaaaaacatgtca

SEQ ID NO: 327849 - DNA, 20 bp, Homo sapiens
gaaaaactggctttttccca

SEQ ID NO: 327850 - DNA, 14 bp, Homo sapiens
gaaaaagaaattct

SEQ ID NO: 327851 - DNA, 11 bp, Homo sapiens
gaaaaagagag

SEQ ID NO: 327852 - DNA, 18 bp, Homo sapiens
gaaaaagagagagcaggg

SEQ ID NO: 327853 - DNA, 23 bp, Homo sapiens
gaaaaagcctaagaaaaaggaaa

SEQ ID NO: 327854 - DNA, 19 bp, Homo sapiens
gaaaaataacttcaagcaa

SEQ ID NO: 327855 - DNA, 11 bp, Homo sapiens
gaaaaatcttg

SEQ ID NO: 327856 - DNA, 22 bp, Homo sapiens
gaaaaatcttgtgctagaatac

SEQ ID NO: 327857 - DNA, 20 bp, Homo sapiens
gaaaaatgagaattttatat

SEQ ID NO: 327858 - DNA, 19 bp, Homo sapiens
gaaaacaaatatttcactt

SEQ ID NO: 327859 - DNA, 18 bp, Homo sapiens
gaaaacaacaaaaaataa

SEQ ID NO: 327860 - DNA, 20 bp, Homo sapiens
gaaaacagatgagaagacta

SEQ ID NO: 327861 - DNA, 18 bp, Homo sapiens
gaaaacagcaagggagag

SEQ ID NO: 327862 - DNA, 23 bp, Homo sapiens
gaaaacaggaaaaaaacttttat

SEQ ID NO: 327863 - DNA, 15 bp, Homo sapiens
gaaaacagtgaatct

SEQ ID NO: 327864 - DNA, 17 bp, Homo sapiens
gaaaacattgatgaatg

SEQ ID NO: 327865 - DNA, 18 bp, Homo sapiens
gaaaacattgatgaatga

SEQ ID NO: 327866 - DNA, 16 bp, Homo sapiens
gaaaaccatctggcct

SEQ ID NO: 327867 - DNA, 19 bp, Homo sapiens
gaaaaccatctggcctggc

SEQ ID NO: 327868 - DNA, 21 bp, Homo sapiens
gaaaaccatctggcctggcct

SEQ ID NO: 327869 - DNA, 14 bp, Homo sapiens
gaaaacctcaaggg

SEQ ID NO: 327870 - DNA, 15 bp, Homo sapiens
gaaaacctcaagggc

SEQ ID NO: 327871 - DNA, 19 bp, Homo sapiens
gaaaacgttttattgtgtt

SEQ ID NO: 327872 - DNA, 17 bp, Homo sapiens
gaaaacgttttgtttga

SEQ ID NO: 327873 - DNA, 16 bp, Homo sapiens
gaaaactcaccatttc

SEQ ID NO: 327874 - DNA, 18 bp, Homo sapiens
gaaaactcaccatttcat

SEQ ID NO: 327875 - DNA, 16 bp, Homo sapiens
gaaaactgaaaatcta

SEQ ID NO: 327876 - DNA, 22 bp, Homo sapiens
gaaaactgaccatcagtatatt

SEQ ID NO: 327877 - DNA, 16 bp, Homo sapiens
gaaaactgtaaataca

SEQ ID NO: 327878 - DNA, 14 bp, Homo sapiens
gaaaacttatttga

SEQ ID NO: 327879 - DNA, 12 bp, Homo sapiens
gaaaacttcaaa

SEQ ID NO: 327880 - DNA, 22 bp, Homo sapiens
gaaaagaaaccccaaactcagg

SEQ ID NO: 327881 - DNA, 18 bp, Homo sapiens
gaaaagaatgtacattac

SEQ ID NO: 327882 - DNA, 14 bp, Homo sapiens
gaaaagaccctgag

SEQ ID NO: 327883 - DNA, 18 bp, Homo sapiens
tactcacttttcacttgt

SEQ ID NO: 327884 - DNA, 21 bp, Homo sapiens
tactcagagcagagcaaatga

SEQ ID NO: 327885 - DNA, 22 bp, Homo sapiens
tactcagaggctgacactgaca

SEQ ID NO: 327886 - DNA, 17 bp, Homo sapiens
tactcaggccactccaa

SEQ ID NO: 327887 - DNA, 21 bp, Homo sapiens
tactcagggattccttctaag

SEQ ID NO: 327888 - DNA, 12 bp, Homo sapiens
tactccagcctg

SEQ ID NO: 327889 - DNA, 13 bp, Homo sapiens
tactccagcctgg

SEQ ID NO: 327890 - DNA, 14 bp, Homo sapiens
tactccagcctggg

SEQ ID NO: 327891 - DNA, 15 bp, Homo sapiens
tactcccccagccct

SEQ ID NO: 327892 - DNA, 23 bp, Homo sapiens
tactcccctgatcccccaggttc

SEQ ID NO: 327893 - DNA, 15 bp, Homo sapiens
tactcccttcctggc

SEQ ID NO: 327894 - DNA, 13 bp, Homo sapiens
tactcctcagacg

SEQ ID NO: 327895 - DNA, 12 bp, Homo sapiens
tactcctctgca

SEQ ID NO: 327896 - DNA, 22 bp, Homo sapiens
tactcctctgcagtgccttggg

SEQ ID NO: 327897 - DNA, 17 bp, Homo sapiens
tactcctctttacactg

SEQ ID NO: 327898 - DNA, 17 bp, Homo sapiens
tactcctgcaaaatttt

SEQ ID NO: 327899 - DNA, 21 bp, Homo sapiens
tactccttaagaacacaaagc

SEQ ID NO: 327900 - DNA, 12 bp, Homo sapiens
tactctcctaga

SEQ ID NO: 327901 - DNA, 13 bp, Homo sapiens
tactctgagccca

SEQ ID NO: 327902 - DNA, 13 bp, Homo sapiens
tactctgtctccc

SEQ ID NO: 327903 - DNA, 15 bp, Homo sapiens
tactctgtgctaagt

SEQ ID NO: 327904 - DNA, 21 bp, Homo sapiens
tactctgttgcctcctctctc

SEQ ID NO: 327905 - DNA, 19 bp, Homo sapiens
tactcttgatgtgaagata

SEQ ID NO: 327906 - DNA, 18 bp, Homo sapiens
tactcttgttgcccaggc

SEQ ID NO: 327907 - DNA, 22 bp, Homo sapiens
tactgaacaatcaaagcacttg

SEQ ID NO: 327908 - DNA, 19 bp, Homo sapiens
tagaaatgatgatgtggaa

SEQ ID NO: 327909 - DNA, 16 bp, Homo sapiens
tagaaatgtattttga

SEQ ID NO: 327910 - DNA, 17 bp, Homo sapiens
tagaaatgtattttgaa

SEQ ID NO: 327911 - DNA, 18 bp, Homo sapiens
tagaaattacaagtttca

SEQ ID NO: 327912 - DNA, 19 bp, Homo sapiens
tagaaattacaagtttcag

SEQ ID NO: 327913 - DNA, 12 bp, Homo sapiens
tagaacagaaaa

SEQ ID NO: 327914 - DNA, 23 bp, Homo sapiens
tagaacagaaaacaacaaaaaat

SEQ ID NO: 327915 - DNA, 20 bp, Homo sapiens
tagaacagatggctgtgaaa

SEQ ID NO: 327916 - DNA, 13 bp, Homo sapiens
tagaacatatttt

SEQ ID NO: 327917 - DNA, 13 bp, Homo sapiens
tagaaccttctaa

SEQ ID NO: 327918 - DNA, 17 bp, Homo sapiens
tagaactcagcagttga

SEQ ID NO: 327919 - DNA, 19 bp, Homo sapiens
tagaactcagttttaacta

SEQ ID NO: 327920 - DNA, 22 bp, Homo sapiens
tagaactcagttttaactagaa

SEQ ID NO: 327921 - DNA, 20 bp, Homo sapiens
tagaactgtatgtcagacat

SEQ ID NO: 327922 - DNA, 21 bp, Homo sapiens
tagaactgtcccacaaaatat

SEQ ID NO: 327923 - DNA, 18 bp, Homo sapiens
tagaactgttcatttcca

SEQ ID NO: 327924 - DNA, 19 bp, Homo sapiens
tagaactgttcatttccac

SEQ ID NO: 327925 - DNA, 11 bp, Homo sapiens
tagaagaaaac

SEQ ID NO: 327926 - DNA, 13 bp, Homo sapiens
tagaagaaagcaa

SEQ ID NO: 327927 - DNA, 18 bp, Homo sapiens
tagaagagggagaaggag

SEQ ID NO: 327928 - DNA, 19 bp, Homo sapiens
tagaagatgaatcagtatg

SEQ ID NO: 327929 - DNA, 19 bp, Homo sapiens
tagaagatggactctgaaa

SEQ ID NO: 327930 - DNA, 18 bp, Homo sapiens
tagaagccaagacagtgg

SEQ ID NO: 327931 - DNA, 18 bp, Homo sapiens
tagaaggagagcccaggc

SEQ ID NO: 327932 - DNA, 16 bp, Homo sapiens
tagaaggtcggaggct

SEQ ID NO: 327933 - DNA, 16 bp, Homo sapiens
tagaaggtttgggaac

SEQ ID NO: 327934 - DNA, 15 bp, Homo sapiens
tagaataaaattgta

SEQ ID NO: 327935 - DNA, 19 bp, Homo sapiens
tagaataaaattgtaaaat

SEQ ID NO: 327936 - DNA, 18 bp, Homo sapiens
tagaatagcatgttgtag

SEQ ID NO: 327937 - DNA, 18 bp, Homo sapiens
tagaatatcctatactgg

SEQ ID NO: 327938 - DNA, 20 bp, Homo sapiens
tagaatatttattacctctg

SEQ ID NO: 327939 - DNA, 18 bp, Homo sapiens
tagaatcaagtctgtgaa

SEQ ID NO: 327940 - DNA, 15 bp, Homo sapiens
tagaatcaatcagta

SEQ ID NO: 327941 - DNA, 14 bp, Homo sapiens
tagaatgctgtaga

SEQ ID NO: 327942 - DNA, 15 bp, Homo sapiens
tagaatgctgtagaa

SEQ ID NO: 327943 - DNA, 21 bp, Homo sapiens
tagaatgttactttggaatga

SEQ ID NO: 327944 - DNA, 15 bp, Homo sapiens
tagaattgatttcca

SEQ ID NO: 327945 - DNA, 23 bp, Homo sapiens
tagaatttattcaattcctctgg

SEQ ID NO: 327946 - DNA, 18 bp, Homo sapiens
tagaatttgaaaggaaaa

SEQ ID NO: 327947 - DNA, 21 bp, Homo sapiens
tagaatttgaaaggaaaaaca

SEQ ID NO: 327948 - DNA, 15 bp, Homo sapiens
tagacaaaggcccag

SEQ ID NO: 327949 - DNA, 17 bp, Homo sapiens
tagacaaaggcccagaa

SEQ ID NO: 327950 - DNA, 17 bp, Homo sapiens
tagacaatggctatatt

SEQ ID NO: 327951 - DNA, 12 bp, Homo sapiens
tagacaatgtgg

SEQ ID NO: 327952 - DNA, 20 bp, Homo sapiens
tagacaatgtggaattacat

SEQ ID NO: 327953 - DNA, 19 bp, Homo sapiens
tagacacagtattgacttc

SEQ ID NO: 327954 - DNA, 18 bp, Homo sapiens
tagacacccattttcaca

SEQ ID NO: 327955 - DNA, 16 bp, Homo sapiens
tagacactgaaggcaa

SEQ ID NO: 327956 - DNA, 13 bp, Homo sapiens
tagacagaaacag

SEQ ID NO: 327957 - DNA, 21 bp, Homo sapiens
tagacagtattgccacctctg

SEQ ID NO: 327958 - DNA, 18 bp, Homo sapiens
tagacatccccctccttg

SEQ ID NO: 327959 - DNA, 16 bp, Homo sapiens
tagaccaggatttcta

SEQ ID NO: 327960 - DNA, 17 bp, Homo sapiens
tagaccaggatttctaa

SEQ ID NO: 327961 - DNA, 23 bp, Homo sapiens
tagaccatttatctgggattatg

SEQ ID NO: 327962 - DNA, 18 bp, Homo sapiens
tagacccgccaggtcaag

SEQ ID NO: 327963 - DNA, 17 bp, Homo sapiens
tagaccctcccccacca

SEQ ID NO: 327964 - DNA, 16 bp, Homo sapiens
tagacctccagctgtt

SEQ ID NO: 327965 - DNA, 16 bp, Homo sapiens
tagacctgattttcaa

SEQ ID NO: 327966 - DNA, 15 bp, Homo sapiens
tagacgcccctccca

SEQ ID NO: 327967 - DNA, 13 bp, Homo sapiens
tagactaggagac

SEQ ID NO: 327968 - DNA, 17 bp, Homo sapiens
tagactgcctgggttcc

SEQ ID NO: 327969 - DNA, 17 bp, Homo sapiens
tagactggagtgaggct

SEQ ID NO: 327970 - DNA, 18 bp, Homo sapiens
tagactggccatgcaagt

SEQ ID NO: 327971 - DNA, 20 bp, Homo sapiens
tagactggccatgcaagtgg

SEQ ID NO: 327972 - DNA, 19 bp, Homo sapiens
tagacttcgaaaacagatg

SEQ ID NO: 327973 - DNA, 20 bp, Homo sapiens
tagacttcgactcaggatcc

SEQ ID NO: 327974 - DNA, 17 bp, Homo sapiens
tagacttctggttgtat

SEQ ID NO: 327975 - DNA, 16 bp, Homo sapiens
tagacttgaggaaacc

SEQ ID NO: 327976 - DNA, 21 bp, Homo sapiens
tagacttggagctgtcctcca

SEQ ID NO: 327977 - DNA, 19 bp, Homo sapiens
tagactttaattcttctct

SEQ ID NO: 327978 - DNA, 19 bp, Homo sapiens
tagactttagaaataaatg

SEQ ID NO: 327979 - DNA, 12 bp, Homo sapiens
tagactttctgt

SEQ ID NO: 327980 - DNA, 23 bp, Homo sapiens
tagagaagtaagcagagttcttt

SEQ ID NO: 327981 - DNA, 15 bp, Homo sapiens
tagagaagtatccaa

SEQ ID NO: 327982 - DNA, 14 bp, Homo sapiens
tagagacagaagca

SEQ ID NO: 327983 - DNA, 21 bp, Homo sapiens
tagagacagaagcaggctgga

SEQ ID NO: 327984 - DNA, 20 bp, Homo sapiens
tagagacagggactgtataa

SEQ ID NO: 327985 - DNA, 19 bp, Homo sapiens
tagagactgtagattgctt

SEQ ID NO: 327986 - DNA, 18 bp, Homo sapiens
tagagagaggaggcagcc

SEQ ID NO: 327987 - DNA, 22 bp, Homo sapiens
tagagaggggcctctggctgcc

SEQ ID NO: 327988 - DNA, 15 bp, Homo sapiens
tagagagggggctct

SEQ ID NO: 327989 - DNA, 14 bp, Homo sapiens
tagagatatttaaa

SEQ ID NO: 327990 - DNA, 16 bp, Homo sapiens
tagagatatttaaaag

SEQ ID NO: 327991 - DNA, 16 bp, Homo sapiens
tagagatgagctttct

SEQ ID NO: 327992 - DNA, 15 bp, Homo sapiens
tagagatgcctccct

SEQ ID NO: 327993 - DNA, 16 bp, Homo sapiens
tagagatgcctccctg

SEQ ID NO: 327994 - DNA, 17 bp, Homo sapiens
tagagatgctactgtca

SEQ ID NO: 327995 - DNA, 14 bp, Homo sapiens
tagagatggaggag

SEQ ID NO: 327996 - DNA, 12 bp, Homo sapiens
tagagatgtttt

SEQ ID NO: 327997 - DNA, 20 bp, Homo sapiens
tagagatgtttttaaaagtt

SEQ ID NO: 327998 - DNA, 20 bp, Homo sapiens
tagagattgccccagagccc

SEQ ID NO: 327999 - DNA, 21 bp, Homo sapiens
tagagcaaagacttaatcata

SEQ ID NO: 328000 - DNA, 20 bp, Homo sapiens
tagagcacctagtccagtga

SEQ ID NO: 328001 - DNA, 14 bp, Homo sapiens
tagagcagggcaag

SEQ ID NO: 328002 - DNA, 13 bp, Homo sapiens
tagagccagcctt

SEQ ID NO: 328003 - DNA, 13 bp, Homo sapiens
tagagcccctcct

SEQ ID NO: 328004 - DNA, 12 bp, Homo sapiens
tagagcctttga

SEQ ID NO: 328005 - DNA, 15 bp, Homo sapiens
tagagctccagttct

SEQ ID NO: 328006 - DNA, 18 bp, Homo sapiens
tagagctgatccagagca

SEQ ID NO: 328007 - DNA, 15 bp, Homo sapiens
tagagcttctggcac

SEQ ID NO: 328008 - DNA, 16 bp, Homo sapiens
tagaggacgaaggcct

SEQ ID NO: 328009 - DNA, 16 bp, Homo sapiens
tagaggagcctggagt

SEQ ID NO: 328010 - DNA, 18 bp, Homo sapiens
tagaggccagccccaccc

SEQ ID NO: 328011 - DNA, 19 bp, Homo sapiens
tagaggcgagccaggcaag

SEQ ID NO: 328012 - DNA, 16 bp, Homo sapiens
tagaggggaaggaaat

SEQ ID NO: 328013 - DNA, 22 bp, Homo sapiens
tagaggggaaggaaatctcctc

SEQ ID NO: 328014 - DNA, 17 bp, Homo sapiens
tagaggtgagttttaaa

SEQ ID NO: 328015 - DNA, 22 bp, Homo sapiens
tagaggtgagttttaaagaagt

SEQ ID NO: 328016 - DNA, 16 bp, Homo sapiens
tagaggttttgttgtt

SEQ ID NO: 328017 - DNA, 19 bp, Homo sapiens
tagaggttttgttgtttta

SEQ ID NO: 328018 - DNA, 22 bp, Homo sapiens
tagagtagggtagaaggaaagc

SEQ ID NO: 328019 - DNA, 14 bp, Homo sapiens
tagagtatatgcac

SEQ ID NO: 328020 - DNA, 22 bp, Homo sapiens
tagagtcatctccatcagctgt

SEQ ID NO: 328021 - DNA, 13 bp, Homo sapiens
tagagtcctcact

SEQ ID NO: 328022 - DNA, 22 bp, Homo sapiens
tagagtgagtttccagctgctc

SEQ ID NO: 328023 - DNA, 20 bp, Homo sapiens
tagagtgcccttaaaataat

SEQ ID NO: 328024 - DNA, 22 bp, Homo sapiens
gaaaggatggcagcctcagggc

SEQ ID NO: 328025 - DNA, 23 bp, Homo sapiens
gaaaggatggcagcctcagggct

SEQ ID NO: 328026 - DNA, 22 bp, Homo sapiens
gaaaggattaagatacactcct

SEQ ID NO: 328027 - DNA, 12 bp, Homo sapiens
gaaaggcagaaa

SEQ ID NO: 328028 - DNA, 13 bp, Homo sapiens
gaaaggcatctaa

SEQ ID NO: 328029 - DNA, 23 bp, Homo sapiens
gaaaggcttccagatgtctaaaa

SEQ ID NO: 328030 - DNA, 17 bp, Homo sapiens
gaaagggagcagagaag

SEQ ID NO: 328031 - DNA, 15 bp, Homo sapiens
gaaagggcagcccct

SEQ ID NO: 328032 - DNA, 23 bp, Homo sapiens
gaaagggtctgataaacacagag

SEQ ID NO: 328033 - DNA, 19 bp, Homo sapiens
gaaagggtgctgcttccct

SEQ ID NO: 328034 - DNA, 17 bp, Homo sapiens
gaaagggttctgtaaaa

SEQ ID NO: 328035 - DNA, 17 bp, Homo sapiens
gaaaggtaatctgaaac

SEQ ID NO: 328036 - DNA, 19 bp, Homo sapiens
gaaaggtcctgtggggagc

SEQ ID NO: 328037 - DNA, 18 bp, Homo sapiens
gaaaggtgaaacacacac

SEQ ID NO: 328038 - DNA, 14 bp, Homo sapiens
tagctctgagccct

SEQ ID NO: 328039 - DNA, 15 bp, Homo sapiens
tagctctgagccctc

SEQ ID NO: 328040 - DNA, 22 bp, Homo sapiens
tagctcttagtcctccctgctc

SEQ ID NO: 328041 - DNA, 20 bp, Homo sapiens
tagctgacgccaataataaa

SEQ ID NO: 328042 - DNA, 21 bp, Homo sapiens
tagctgacgccaataataaaa

SEQ ID NO: 328043 - DNA, 13 bp, Homo sapiens
tagctgagctgga

SEQ ID NO: 328044 - DNA, 14 bp, Homo sapiens
tagctgataaagaa

SEQ ID NO: 328045 - DNA, 16 bp, Homo sapiens
tagctgcaaaggacag

SEQ ID NO: 328046 - DNA, 17 bp, Homo sapiens
tagctgccaaaaagaac

SEQ ID NO: 328047 - DNA, 12 bp, Homo sapiens
tagctgccaagt

SEQ ID NO: 328048 - DNA, 16 bp, Homo sapiens
tagctgccagtgctgg

SEQ ID NO: 328049 - DNA, 16 bp, Homo sapiens
tagctggcaggacaca

SEQ ID NO: 328050 - DNA, 12 bp, Homo sapiens
tagctggggctt

SEQ ID NO: 328051 - DNA, 14 bp, Homo sapiens
tagctggggcttca

SEQ ID NO: 328052 - DNA, 18 bp, Homo sapiens
tagctgtaaatacatgtg

SEQ ID NO: 328053 - DNA, 21 bp, Homo sapiens
tagctgtaaatacatgtgtgg

SEQ ID NO: 328054 - DNA, 22 bp, Homo sapiens
tagctgtatatttgaaactgct

SEQ ID NO: 328055 - DNA, 13 bp, Homo sapiens
tagcttaaaaaaa

SEQ ID NO: 328056 - DNA, 16 bp, Homo sapiens
tagcttcatcttgagc

SEQ ID NO: 328057 - DNA, 12 bp, Homo sapiens
tagcttccatga

SEQ ID NO: 328058 - DNA, 14 bp, Homo sapiens
tagcttcctccaga

SEQ ID NO: 328059 - DNA, 13 bp, Homo sapiens
tagcttctgacct

SEQ ID NO: 328060 - DNA, 18 bp, Homo sapiens
tagcttctgacctcagca

SEQ ID NO: 328061 - DNA, 13 bp, Homo sapiens
tagcttgtatagt

SEQ ID NO: 328062 - DNA, 24 bp, Homo sapiens
tagctttacattttcagtaccaaa

SEQ ID NO: 328063 - DNA, 20 bp, Homo sapiens
tagctttattttttaagtat

SEQ ID NO: 328064 - DNA, 13 bp, Homo sapiens
tagctttccacat

SEQ ID NO: 328065 - DNA, 13 bp, Homo sapiens
tagctttctcagg

SEQ ID NO: 328066 - DNA, 14 bp, Homo sapiens
tagcttttattgta

SEQ ID NO: 328067 - DNA, 17 bp, Homo sapiens
tagctttttaaaacatt

SEQ ID NO: 328068 - DNA, 18 bp, Homo sapiens
tagctttttaaaacatta

SEQ ID NO: 328069 - DNA, 21 bp, Homo sapiens
taggaaacagaaaagagaaga

SEQ ID NO: 328070 - DNA, 21 bp, Homo sapiens
taggaaagatttaatgttaca

SEQ ID NO: 328071 - DNA, 11 bp, Homo sapiens
taggaaagcac

SEQ ID NO: 328072 - DNA, 22 bp, Homo sapiens
taggaaagcaccgcagcatgtg

SEQ ID NO: 328073 - DNA, 13 bp, Homo sapiens
taggaaaggcaga

SEQ ID NO: 328074 - DNA, 14 bp, Homo sapiens
taggaaaggcagaa

SEQ ID NO: 328075 - DNA, 18 bp, Homo sapiens
taggaaaggcagaaacac

SEQ ID NO: 328076 - DNA, 14 bp, Homo sapiens
taggaaataaaacc

SEQ ID NO: 328077 - DNA, 16 bp, Homo sapiens
taggaaataaaacctt

SEQ ID NO: 328078 - DNA, 20 bp, Homo sapiens
taggaaataaaacctttcaa

SEQ ID NO: 328079 - DNA, 17 bp, Homo sapiens
taggaacagagtatata

SEQ ID NO: 328080 - DNA, 22 bp, Homo sapiens
taggaacccggcatgccgagtg

SEQ ID NO: 328081 - DNA, 13 bp, Homo sapiens
taggaagtgactt

SEQ ID NO: 328082 - DNA, 17 bp, Homo sapiens
taggaagtgacttgaat

SEQ ID NO: 328083 - DNA, 20 bp, Homo sapiens
taggaagtgtaacagctgag

SEQ ID NO: 328084 - DNA, 22 bp, Homo sapiens
taggaagtgtaacagctgaggt

SEQ ID NO: 328085 - DNA, 20 bp, Homo sapiens
taggaatcccagaggtggga

SEQ ID NO: 328086 - DNA, 14 bp, Homo sapiens
taggaatctgcctt

SEQ ID NO: 328087 - DNA, 17 bp, Homo sapiens
taggaatctgccttcca

SEQ ID NO: 328088 - DNA, 21 bp, Homo sapiens
taggaatctgccttccagccc

SEQ ID NO: 328089 - DNA, 18 bp, Homo sapiens
taggaattaagttatctt

SEQ ID NO: 328090 - DNA, 23 bp, Homo sapiens
taggacatgttcccttctccttc

SEQ ID NO: 328091 - DNA, 15 bp, Homo sapiens
taggaccaatgttgt

SEQ ID NO: 328092 - DNA, 14 bp, Homo sapiens
taggaccagttttg

SEQ ID NO: 328093 - DNA, 18 bp, Homo sapiens
taggaccagttttgtatc

SEQ ID NO: 328094 - DNA, 17 bp, Homo sapiens
taggagaccagaagtga

SEQ ID NO: 328095 - DNA, 12 bp, Homo sapiens
taggagacttgt

SEQ ID NO: 328096 - DNA, 21 bp, Homo sapiens
taggagactttaatcccggtt

SEQ ID NO: 328097 - DNA, 14 bp, Homo sapiens
taggagagaaggta

SEQ ID NO: 328098 - DNA, 22 bp, Homo sapiens
taggagagactgaaagcagcag

SEQ ID NO: 328099 - DNA, 18 bp, Homo sapiens
taggagagactggccaga

SEQ ID NO: 328100 - DNA, 16 bp, Homo sapiens
taggagagccaacctc

SEQ ID NO: 328101 - DNA, 14 bp, Homo sapiens
taggagcagcctta

SEQ ID NO: 328102 - DNA, 16 bp, Homo sapiens
taggaggacagaacca

SEQ ID NO: 328103 - DNA, 16 bp, Homo sapiens
taggaggatgctgtgc

SEQ ID NO: 328104 - DNA, 20 bp, Homo sapiens
taggaggctctaattctcta

SEQ ID NO: 328105 - DNA, 18 bp, Homo sapiens
taggataatttttaaaag

SEQ ID NO: 328106 - DNA, 15 bp, Homo sapiens
taggatcccactggc

SEQ ID NO: 328107 - DNA, 21 bp, Homo sapiens
taggattaagttcgaggtggc

SEQ ID NO: 328108 - DNA, 18 bp, Homo sapiens
taggcaacctttattttt

SEQ ID NO: 328109 - DNA, 12 bp, Homo sapiens
taggcagagccc

SEQ ID NO: 328110 - DNA, 20 bp, Homo sapiens
taggcagattgaaaaggaca

SEQ ID NO: 328111 - DNA, 19 bp, Homo sapiens
taggcagcctctctgctat

SEQ ID NO: 328112 - DNA, 13 bp, Homo sapiens
taggcagcctgcc

SEQ ID NO: 328113 - DNA, 14 bp, Homo sapiens
taggcagcctgccg

SEQ ID NO: 328114 - DNA, 12 bp, Homo sapiens
taggcaggaagt

SEQ ID NO: 328115 - DNA, 19 bp, Homo sapiens
taggcaggaagtcaggagc

SEQ ID NO: 328116 - DNA, 22 bp, Homo sapiens
taggcaggaagtcaggagccag

SEQ ID NO: 328117 - DNA, 23 bp, Homo sapiens
taggcaggaagtcaggagccagc

SEQ ID NO: 328118 - DNA, 24 bp, Homo sapiens
taggcagttagagatgcctccctg

SEQ ID NO: 328119 - DNA, 19 bp, Homo sapiens
taggcatactctccaggat

SEQ ID NO: 328120 - DNA, 16 bp, Homo sapiens
taggccatctgtaaat

SEQ ID NO: 328121 - DNA, 23 bp, Homo sapiens
taggccatgatgtcgttcatttt

SEQ ID NO: 328122 - DNA, 23 bp, Homo sapiens
taggcccccaaattgccttcagc

SEQ ID NO: 328123 - DNA, 17 bp, Homo sapiens
taggccggccagctccc

SEQ ID NO: 328124 - DNA, 16 bp, Homo sapiens
taggcctgggtgctgg

SEQ ID NO: 328125 - DNA, 21 bp, Homo sapiens
taggcgggcggtcaggggttc

SEQ ID NO: 328126 - DNA, 20 bp, Homo sapiens
taggctcactctttccccca

SEQ ID NO: 328127 - DNA, 11 bp, Homo sapiens
taggctctgca

SEQ ID NO: 328128 - DNA, 13 bp, Homo sapiens
taggctgagatgc

SEQ ID NO: 328129 - DNA, 16 bp, Homo sapiens
taggctgggcccagag

SEQ ID NO: 328130 - DNA, 17 bp, Homo sapiens
taggctgggcccagagg

SEQ ID NO: 328131 - DNA, 16 bp, Homo sapiens
taggctgtattttctt

SEQ ID NO: 328132 - DNA, 22 bp, Homo sapiens
taggctgtcgtccccctccagt

SEQ ID NO: 328133 - DNA, 22 bp, Homo sapiens
taggcttacaatgtgcactgaa

SEQ ID NO: 328134 - DNA, 18 bp, Homo sapiens
taggcttttaagaaacac

SEQ ID NO: 328135 - DNA, 19 bp, Homo sapiens
tagggaaatccaactccag

SEQ ID NO: 328136 - DNA, 12 bp, Homo sapiens
tagggaactgta

SEQ ID NO: 328137 - DNA, 19 bp, Homo sapiens
tagggagatggagaaaatg

SEQ ID NO: 328138 - DNA, 22 bp, Homo sapiens
tagggaggaccttatctgtgcg

SEQ ID NO: 328139 - DNA, 18 bp, Homo sapiens
tagggagtacctgctgcc

SEQ ID NO: 328140 - DNA, 22 bp, Homo sapiens
tagggatctggggaaggaccaa

SEQ ID NO: 328141 - DNA, 15 bp, Homo sapiens
tagggattcaggctg

SEQ ID NO: 328142 - DNA, 11 bp, Homo sapiens
tagggctgggt

SEQ ID NO: 328143 - DNA, 18 bp, Homo sapiens
taggggccgagggaaatg

SEQ ID NO: 328144 - DNA, 24 bp, Homo sapiens
taggggccgagtccaggagcccca

SEQ ID NO: 328145 - DNA, 16 bp, Homo sapiens
taggggtaatatattg

SEQ ID NO: 328146 - DNA, 14 bp, Homo sapiens
taggggtcaaagaa

SEQ ID NO: 328147 - DNA, 14 bp, Homo sapiens
taggggtcactgta

SEQ ID NO: 328148 - DNA, 22 bp, Homo sapiens
taggggttttttggttcctttt

SEQ ID NO: 328149 - DNA, 17 bp, Homo sapiens
tagggtcctggccctct

SEQ ID NO: 328150 - DNA, 13 bp, Homo sapiens
tagggtccttgaa

SEQ ID NO: 328151 - DNA, 16 bp, Homo sapiens
tagggtcttgggggtc

SEQ ID NO: 328152 - DNA, 18 bp, Homo sapiens
tagggtttgtttgctgct

SEQ ID NO: 328153 - DNA, 19 bp, Homo sapiens
tagggtttgtttgctgctt

SEQ ID NO: 328154 - DNA, 15 bp, Homo sapiens
tagggttttggcctg

SEQ ID NO: 328155 - DNA, 20 bp, Homo sapiens
taggtaatcaatgaatattg

SEQ ID NO: 328156 - DNA, 13 bp, Homo sapiens
taggtagatccag

SEQ ID NO: 328157 - DNA, 16 bp, Homo sapiens
taggtataaaaaataa

SEQ ID NO: 328158 - DNA, 17 bp, Homo sapiens
taggtataaaaaataag

SEQ ID NO: 328159 - DNA, 13 bp, Homo sapiens
taggtatacaaaa

SEQ ID NO: 328160 - DNA, 21 bp, Homo sapiens
taggtcaaggcctgtccctgg

SEQ ID NO: 328161 - DNA, 15 bp, Homo sapiens
taggtcactcctggg

SEQ ID NO: 328162 - DNA, 13 bp, Homo sapiens
taggtcagatgga

SEQ ID NO: 328163 - DNA, 19 bp, Homo sapiens
taggtcctcacttggggga

SEQ ID NO: 328164 - DNA, 12 bp, Homo sapiens
taggtctccacc

SEQ ID NO: 328165 - DNA, 20 bp, Homo sapiens
taggtctccacccctcaagc

SEQ ID NO: 328166 - DNA, 16 bp, Homo sapiens
taggtctcctcagggt

SEQ ID NO: 328167 - DNA, 15 bp, Homo sapiens
taggtctgcacacat

SEQ ID NO: 328168 - DNA, 19 bp, Homo sapiens
taggtctgcacacataaca

SEQ ID NO: 328169 - DNA, 19 bp, Homo sapiens
gaagtgggattcaggaatg

SEQ ID NO: 328170 - DNA, 17 bp, Homo sapiens
gaagtgtggctggtgtc

SEQ ID NO: 328171 - DNA, 18 bp, Homo sapiens
gaagtgtggctggtgtcc

SEQ ID NO: 328172 - DNA, 18 bp, Homo sapiens
gaagtgttcaagaaataa

SEQ ID NO: 328173 - DNA, 14 bp, Homo sapiens
gaagtgttgattgc

SEQ ID NO: 328174 - DNA, 23 bp, Homo sapiens
gaagttaagcagcctttctgtgg

SEQ ID NO: 328175 - DNA, 16 bp, Homo sapiens
gaagttctggcaagat

SEQ ID NO: 328176 - DNA, 18 bp, Homo sapiens
gaagttgctgagaaatgg

SEQ ID NO: 328177 - DNA, 23 bp, Homo sapiens
gaagttggacagcaaaaccattg

SEQ ID NO: 328178 - DNA, 21 bp, Homo sapiens
gaagttggtcttactttgtgc

SEQ ID NO: 328179 - DNA, 15 bp, Homo sapiens
gaagttgttagtgat

SEQ ID NO: 328180 - DNA, 13 bp, Homo sapiens
gaagtttcattta

SEQ ID NO: 328181 - DNA, 18 bp, Homo sapiens
gaagtttctacattctct

SEQ ID NO: 328182 - DNA, 17 bp, Homo sapiens
aaattaacagtcctaac

SEQ ID NO: 328183 - DNA, 18 bp, Homo sapiens
aaattaacagtcctaact

SEQ ID NO: 328184 - DNA, 17 bp, Homo sapiens
aaattaacttctatttt

SEQ ID NO: 328185 - DNA, 13 bp, Homo sapiens
aaattaagaagag

SEQ ID NO: 328186 - DNA, 22 bp, Homo sapiens
aaattaagactttaaaagatga

SEQ ID NO: 328187 - DNA, 22 bp, Homo sapiens
aaattaaggcaactgaacaaaa

SEQ ID NO: 328188 - DNA, 23 bp, Homo sapiens
aaattaaggcaactgaacaaaaa

SEQ ID NO: 328189 - DNA, 14 bp, Homo sapiens
aaattaaggtctgg

SEQ ID NO: 328190 - DNA, 18 bp, Homo sapiens
aaattacaagtttcagta

SEQ ID NO: 328191 - DNA, 15 bp, Homo sapiens
aaattaggaataaat

SEQ ID NO: 328192 - DNA, 16 bp, Homo sapiens
aaattaggaataaata

SEQ ID NO: 328193 - DNA, 19 bp, Homo sapiens
aaattaggatttcatgatt

SEQ ID NO: 328194 - DNA, 17 bp, Homo sapiens
aaattaggccttatgta

SEQ ID NO: 328195 - DNA, 19 bp, Homo sapiens
aaattaggccttatgtaag

SEQ ID NO: 328196 - DNA, 20 bp, Homo sapiens
aaattagggctacattgtaa

SEQ ID NO: 328197 - DNA, 19 bp, Homo sapiens
aaattagggctctaatttc

SEQ ID NO: 328198 - DNA, 20 bp, Homo sapiens
aaattagggctctaatttcc

SEQ ID NO: 328199 - DNA, 21 bp, Homo sapiens
aaattagggctctaatttcct

SEQ ID NO: 328200 - DNA, 23 bp, Homo sapiens
aaattagggctctaatttcctta

SEQ ID NO: 328201 - DNA, 17 bp, Homo sapiens
aaattagtaatgtacta

SEQ ID NO: 328202 - DNA, 13 bp, Homo sapiens
aaattagtgagat

SEQ ID NO: 328203 - DNA, 20 bp, Homo sapiens
aaattataaggactgcatgg

SEQ ID NO: 328204 - DNA, 17 bp, Homo sapiens
aaattatatgatatgca

SEQ ID NO: 328205 - DNA, 18 bp, Homo sapiens
aaattatcaagctaataa

SEQ ID NO: 328206 - DNA, 19 bp, Homo sapiens
aaattatcaagctaataaa

SEQ ID NO: 328207 - DNA, 17 bp, Homo sapiens
aaattatctttaaaact

SEQ ID NO: 328208 - DNA, 16 bp, Homo sapiens
aaattatggtgaaatt

SEQ ID NO: 328209 - DNA, 18 bp, Homo sapiens
aaattatgtcaaatggat

SEQ ID NO: 328210 - DNA, 19 bp, Homo sapiens
aaattatgtcaaatggatg

SEQ ID NO: 328211 - DNA, 12 bp, Homo sapiens
aaattattactt

SEQ ID NO: 328212 - DNA, 16 bp, Homo sapiens
aaattattataagcat

SEQ ID NO: 328213 - DNA, 20 bp, Homo sapiens
aaattattcagttaagaaaa

SEQ ID NO: 328214 - DNA, 19 bp, Homo sapiens
aaattattgtaaacttttt

SEQ ID NO: 328215 - DNA, 20 bp, Homo sapiens
aaattattgtaaactttttc

SEQ ID NO: 328216 - DNA, 23 bp, Homo sapiens
aaattattgtaaactttttcaat

SEQ ID NO: 328217 - DNA, 18 bp, Homo sapiens
aaattatttaatatgcat

SEQ ID NO: 328218 - DNA, 20 bp, Homo sapiens
aaattatttaatatgcatct

SEQ ID NO: 328219 - DNA, 14 bp, Homo sapiens
aaattatttctaaa

SEQ ID NO: 328220 - DNA, 15 bp, Homo sapiens
aaattatttgccttt

SEQ ID NO: 328221 - DNA, 13 bp, Homo sapiens
aaattatttgtgt

SEQ ID NO: 328222 - DNA, 16 bp, Homo sapiens
aaattattttaaacaa

SEQ ID NO: 328223 - DNA, 17 bp, Homo sapiens
aaattattttaaacaaa

SEQ ID NO: 328224 - DNA, 21 bp, Homo sapiens
aaattcaaaaagtgtttattt

SEQ ID NO: 328225 - DNA, 20 bp, Homo sapiens
aaattcaacacttattttct

SEQ ID NO: 328226 - DNA, 17 bp, Homo sapiens
aaattcaagaaaataaa

SEQ ID NO: 328227 - DNA, 18 bp, Homo sapiens
aaattcatataaagtgca

SEQ ID NO: 328228 - DNA, 14 bp, Homo sapiens
aaattcatgctgct

SEQ ID NO: 328229 - DNA, 17 bp, Homo sapiens
aaattcattaaagaaaa

SEQ ID NO: 328230 - DNA, 16 bp, Homo sapiens
aaattccacccctcct

SEQ ID NO: 328231 - DNA, 15 bp, Homo sapiens
aaattcctgcttaat

SEQ ID NO: 328232 - DNA, 14 bp, Homo sapiens
aaattcctgttgtc

SEQ ID NO: 328233 - DNA, 19 bp, Homo sapiens
aaattctagtctctgattt

SEQ ID NO: 328234 - DNA, 22 bp, Homo sapiens
aaattctgccttattatttctt

SEQ ID NO: 328235 - DNA, 14 bp, Homo sapiens
aaattctgctgctt

SEQ ID NO: 328236 - DNA, 21 bp, Homo sapiens
aaattcttattggccaaatgc

SEQ ID NO: 328237 - DNA, 18 bp, Homo sapiens
aaattcttcaatttgaaa

SEQ ID NO: 328238 - DNA, 14 bp, Homo sapiens
aaattcttgcactg

SEQ ID NO: 328239 - DNA, 23 bp, Homo sapiens
aaattcttgcactgtatccaagt

SEQ ID NO: 328240 - DNA, 19 bp, Homo sapiens
aaattgaggttcagcaagg

SEQ ID NO: 328241 - DNA, 16 bp, Homo sapiens
aaattgatgggtgggc

SEQ ID NO: 328242 - DNA, 12 bp, Homo sapiens
aaattgcaaaga

SEQ ID NO: 328243 - DNA, 13 bp, Homo sapiens
aaattgcaaagaa

SEQ ID NO: 328244 - DNA, 15 bp, Homo sapiens
aaattgcaaagaaaa

SEQ ID NO: 328245 - DNA, 22 bp, Homo sapiens
aaattgcaaagaaaattctcaa

SEQ ID NO: 328246 - DNA, 17 bp, Homo sapiens
aaattgcagcagttgct

SEQ ID NO: 328247 - DNA, 17 bp, Homo sapiens
aaattgcataaagcata

SEQ ID NO: 328248 - DNA, 21 bp, Homo sapiens
aaattgccattggacagttgt

SEQ ID NO: 328249 - DNA, 14 bp, Homo sapiens
aaattgcctccctt

SEQ ID NO: 328250 - DNA, 22 bp, Homo sapiens
aaattgcctccttatttatcaa

SEQ ID NO: 328251 - DNA, 12 bp, Homo sapiens
aaattgccttca

SEQ ID NO: 328252 - DNA, 21 bp, Homo sapiens
aaattgccttctagacactga

SEQ ID NO: 328253 - DNA, 11 bp, Homo sapiens
aaattgctgag

SEQ ID NO: 328254 - DNA, 23 bp, Homo sapiens
aaattggactttcaaaattaaat

SEQ ID NO: 328255 - DNA, 14 bp, Homo sapiens
aaattggcattaaa

SEQ ID NO: 328256 - DNA, 18 bp, Homo sapiens
aaattggcattaaaactt

SEQ ID NO: 328257 - DNA, 16 bp, Homo sapiens
aaattggctcctttcc

SEQ ID NO: 328258 - DNA, 17 bp, Homo sapiens
aaattggctcctttccc

SEQ ID NO: 328259 - DNA, 19 bp, Homo sapiens
aaattgggtgtgccctggc

SEQ ID NO: 328260 - DNA, 15 bp, Homo sapiens
aaattggtgataagt

SEQ ID NO: 328261 - DNA, 20 bp, Homo sapiens
aaattgtatacattttgtta

SEQ ID NO: 328262 - DNA, 13 bp, Homo sapiens
aaattgtatgaaa

SEQ ID NO: 328263 - DNA, 15 bp, Homo sapiens
aaattgttcctcttt

SEQ ID NO: 328264 - DNA, 15 bp, Homo sapiens
aaatttaaaaaactc

SEQ ID NO: 328265 - DNA, 19 bp, Homo sapiens
aaatttaaaaaactcctgt

SEQ ID NO: 328266 - DNA, 17 bp, Homo sapiens
aaatttaaaaagatgga

SEQ ID NO: 328267 - DNA, 13 bp, Homo sapiens
aaatttaaaaatc

SEQ ID NO: 328268 - DNA, 16 bp, Homo sapiens
aaatttaaaacaaaca

SEQ ID NO: 328269 - DNA, 16 bp, Homo sapiens
aaatttaagcattgtt

SEQ ID NO: 328270 - DNA, 17 bp, Homo sapiens
aaatttaagcattgttt

SEQ ID NO: 328271 - DNA, 22 bp, Homo sapiens
aaatttaagtcgggaaattctg

SEQ ID NO: 328272 - DNA, 14 bp, Homo sapiens
aaatttaatatact

SEQ ID NO: 328273 - DNA, 16 bp, Homo sapiens
aaatttacgtatattt

SEQ ID NO: 328274 - DNA, 13 bp, Homo sapiens
aaatttattatgt

SEQ ID NO: 328275 - DNA, 21 bp, Homo sapiens
aaatttattcttatcttagga

SEQ ID NO: 328276 - DNA, 22 bp, Homo sapiens
aaatttccagtacctttgtcac

SEQ ID NO: 328277 - DNA, 13 bp, Homo sapiens
aaatttcttccac

SEQ ID NO: 328278 - DNA, 19 bp, Homo sapiens
aaatttgaatggattaaat

SEQ ID NO: 328279 - DNA, 21 bp, Homo sapiens
aaatttgaatggattaaatgg

SEQ ID NO: 328280 - DNA, 22 bp, Homo sapiens
aaatttgatggtgaatattaca

SEQ ID NO: 328281 - DNA, 22 bp, Homo sapiens
aaatttgctttgggattttctt

SEQ ID NO: 328282 - DNA, 15 bp, Homo sapiens
aaatttggttctaat

SEQ ID NO: 328283 - DNA, 11 bp, Homo sapiens
aaatttgtact

SEQ ID NO: 328284 - DNA, 12 bp, Homo sapiens
aaatttgtacta

SEQ ID NO: 328285 - DNA, 17 bp, Homo sapiens
aaatttgttaatatata

SEQ ID NO: 328286 - DNA, 19 bp, Homo sapiens
aaatttgttatacttcaaa

SEQ ID NO: 328287 - DNA, 18 bp, Homo sapiens
aaatttgttgaaattatg

SEQ ID NO: 328288 - DNA, 21 bp, Homo sapiens
aaatttgttgtcatgtgtatg

SEQ ID NO: 328289 - DNA, 18 bp, Homo sapiens
aaattttatttcctggac

SEQ ID NO: 328290 - DNA, 19 bp, Homo sapiens
aaattttctagactttctg

SEQ ID NO: 328291 - DNA, 20 bp, Homo sapiens
aaattttctagactttctgt

SEQ ID NO: 328292 - DNA, 19 bp, Homo sapiens
aaatttttaaatcatttca

SEQ ID NO: 328293 - DNA, 24 bp, Homo sapiens
aaatttttaaatcatttcatgtta

SEQ ID NO: 328294 - DNA, 15 bp, Homo sapiens
aaatttttatttttc

SEQ ID NO: 328295 - DNA, 12 bp, Homo sapiens
aacaaaaacttt

SEQ ID NO: 328296 - DNA, 21 bp, Homo sapiens
aacaaaaactttccatgacag

SEQ ID NO: 328297 - DNA, 14 bp, Homo sapiens
aacaaaaatttgaa

SEQ ID NO: 328298 - DNA, 13 bp, Homo sapiens
aacaaaagatgaa

SEQ ID NO: 328299 - DNA, 21 bp, Homo sapiens
gacaatcatgaaatatgcatc

SEQ ID NO: 328300 - DNA, 18 bp, Homo sapiens
gacaatgacactggaagg

SEQ ID NO: 328301 - DNA, 19 bp, Homo sapiens
gacaatgatgtgagtaccc

SEQ ID NO: 328302 - DNA, 19 bp, Homo sapiens
gacaatgcagatgccagag

SEQ ID NO: 328303 - DNA, 18 bp, Homo sapiens
gacaatggctatattaat

SEQ ID NO: 328304 - DNA, 13 bp, Homo sapiens
gacaatgtggaat

SEQ ID NO: 328305 - DNA, 23 bp, Homo sapiens
gacaatgtggaattacataacag

SEQ ID NO: 328306 - DNA, 13 bp, Homo sapiens
gacaattgtcagt

SEQ ID NO: 328307 - DNA, 13 bp, Homo sapiens
gacacaactattt

SEQ ID NO: 328308 - DNA, 23 bp, Homo sapiens
gacacaatgttgcactgaaaacc

SEQ ID NO: 328309 - DNA, 15 bp, Homo sapiens
gacacaattagagaa

SEQ ID NO: 328310 - DNA, 16 bp, Homo sapiens
gacacaattagagaag

SEQ ID NO: 328311 - DNA, 13 bp, Homo sapiens
gacacacacacac

SEQ ID NO: 328312 - DNA, 20 bp, Homo sapiens
gacacacacacacacacaaa

SEQ ID NO: 328313 - DNA, 15 bp, Homo sapiens
gacacacacacgcac

SEQ ID NO: 328314 - DNA, 13 bp, Homo sapiens
gacacacacagct

SEQ ID NO: 328315 - DNA, 12 bp, Homo sapiens
gacacacagcct

SEQ ID NO: 328316 - DNA, 18 bp, Homo sapiens
gacacacagcctttctgt

SEQ ID NO: 328317 - DNA, 20 bp, Homo sapiens
gacacacagcctttctgtat

SEQ ID NO: 328318 - DNA, 21 bp, Homo sapiens
gacacaccccacaccccagcc

SEQ ID NO: 328319 - DNA, 15 bp, Homo sapiens
gacacacgcacacac

SEQ ID NO: 328320 - DNA, 22 bp, Homo sapiens
gacacactgtaaacccctgggt

SEQ ID NO: 328321 - DNA, 10 bp, Homo sapiens
gacacagacc

SEQ ID NO: 328322 - DNA, 22 bp, Homo sapiens
gacacagaccggccgcatgtct

SEQ ID NO: 328323 - DNA, 11 bp, Homo sapiens
gacacagcagc

SEQ ID NO: 328324 - DNA, 20 bp, Homo sapiens
gacacagcagcttcaccaga

SEQ ID NO: 328325 - DNA, 21 bp, Homo sapiens
gacacagcagcttcaccagag

SEQ ID NO: 328326 - DNA, 23 bp, Homo sapiens
gacacagcagcttcaccagagca

SEQ ID NO: 328327 - DNA, 19 bp, Homo sapiens
gacacagctgagctggcct

SEQ ID NO: 328328 - DNA, 15 bp, Homo sapiens
aacagtcacccttct

SEQ ID NO: 328329 - DNA, 23 bp, Homo sapiens
aacagtcagccagcttggtggtt

SEQ ID NO: 328330 - DNA, 14 bp, Homo sapiens
aacagtcatttaaa

SEQ ID NO: 328331 - DNA, 18 bp, Homo sapiens
aacagtccattgaaaggg

SEQ ID NO: 328332 - DNA, 20 bp, Homo sapiens
aacagtgatttttttttaga

SEQ ID NO: 328333 - DNA, 13 bp, Homo sapiens
aacagtggctggg

SEQ ID NO: 328334 - DNA, 17 bp, Homo sapiens
aacagtgtttatgacga

SEQ ID NO: 328335 - DNA, 18 bp, Homo sapiens
aacagtgtttcccataat

SEQ ID NO: 328336 - DNA, 17 bp, Homo sapiens
aacagttaaacttgcaa

SEQ ID NO: 328337 - DNA, 20 bp, Homo sapiens
aacagttaactttcagaaga

SEQ ID NO: 328338 - DNA, 19 bp, Homo sapiens
aacagttaagcagccgcca

SEQ ID NO: 328339 - DNA, 18 bp, Homo sapiens
aacagttgagtttcttct

SEQ ID NO: 328340 - DNA, 22 bp, Homo sapiens
aacagttgtaccactgctaata

SEQ ID NO: 328341 - DNA, 19 bp, Homo sapiens
aacagtttggatgtcctca

SEQ ID NO: 328342 - DNA, 13 bp, Homo sapiens
aacagttttccat

SEQ ID NO: 328343 - DNA, 18 bp, Homo sapiens
aacagttttccatgaaaa

SEQ ID NO: 328344 - DNA, 13 bp, Homo sapiens
aacataaaaagtt

SEQ ID NO: 328345 - DNA, 22 bp, Homo sapiens
aacataaaaagttaaaaaaaat

SEQ ID NO: 328346 - DNA, 12 bp, Homo sapiens
aacataaaacaa

SEQ ID NO: 328347 - DNA, 13 bp, Homo sapiens
aacataaagaaat

SEQ ID NO: 328348 - DNA, 20 bp, Homo sapiens
aacataactgtaacatatat

SEQ ID NO: 328349 - DNA, 14 bp, Homo sapiens
aacataatctagtt

SEQ ID NO: 328350 - DNA, 15 bp, Homo sapiens
aacatagttgaaaaa

SEQ ID NO: 328351 - DNA, 24 bp, Homo sapiens
aacatagttgaaaaaagaagtttg

SEQ ID NO: 328352 - DNA, 17 bp, Homo sapiens
aacatataatatatgtt

SEQ ID NO: 328353 - DNA, 13 bp, Homo sapiens
aacatataatgtt

SEQ ID NO: 328354 - DNA, 11 bp, Homo sapiens
aacatattctt

SEQ ID NO: 328355 - DNA, 18 bp, Homo sapiens
aacatcaatgttcattgt

SEQ ID NO: 328356 - DNA, 15 bp, Homo sapiens
aacatcagacctgtc

SEQ ID NO: 328357 - DNA, 14 bp, Homo sapiens
aacatcagcttgac

SEQ ID NO: 328358 - DNA, 21 bp, Homo sapiens
aacatctcgagccccctggat

SEQ ID NO: 328359 - DNA, 18 bp, Homo sapiens
aacatctgaaaagaaatg

SEQ ID NO: 328360 - DNA, 12 bp, Homo sapiens
aacatcttcata

SEQ ID NO: 328361 - DNA, 15 bp, Homo sapiens
aacatcttcatataa

SEQ ID NO: 328362 - DNA, 21 bp, Homo sapiens
aacatctttttcctccctttc

SEQ ID NO: 328363 - DNA, 14 bp, Homo sapiens
aacatgagtgctga

SEQ ID NO: 328364 - DNA, 14 bp, Homo sapiens
aacatgagtttatg

SEQ ID NO: 328365 - DNA, 20 bp, Homo sapiens
aacatgcagttcattatttt

SEQ ID NO: 328366 - DNA, 21 bp, Homo sapiens
aacatgcagttcattattttg

SEQ ID NO: 328367 - DNA, 22 bp, Homo sapiens
aacatgcagttcattattttgt

SEQ ID NO: 328368 - DNA, 21 bp, Homo sapiens
aacatgcctgccccaaacaaa

SEQ ID NO: 328369 - DNA, 22 bp, Homo sapiens
aacatgcctgccccaaacaaat

SEQ ID NO: 328370 - DNA, 17 bp, Homo sapiens
aacatgctgtgtaagct

SEQ ID NO: 328371 - DNA, 21 bp, Homo sapiens
aacatggccaatagtcatatg

SEQ ID NO: 328372 - DNA, 20 bp, Homo sapiens
aacatggttttgaaatgctt

SEQ ID NO: 328373 - DNA, 14 bp, Homo sapiens
aacatgtatgtgga

SEQ ID NO: 328374 - DNA, 20 bp, Homo sapiens
aacatgtcggagtagaaatt

SEQ ID NO: 328375 - DNA, 13 bp, Homo sapiens
aacatgtgtttta

SEQ ID NO: 328376 - DNA, 15 bp, Homo sapiens
aacattactgccttc

SEQ ID NO: 328377 - DNA, 15 bp, Homo sapiens
aacattagaagaaaa

SEQ ID NO: 328378 - DNA, 21 bp, Homo sapiens
aacattagaagaaaacatata

SEQ ID NO: 328379 - DNA, 16 bp, Homo sapiens
aacattatttattcag

SEQ ID NO: 328380 - DNA, 23 bp, Homo sapiens
aacattatttattcagcttcatt

SEQ ID NO: 328381 - DNA, 20 bp, Homo sapiens
aacattcaaaagcacaaacc

SEQ ID NO: 328382 - DNA, 18 bp, Homo sapiens
aacattcagatttaccat

SEQ ID NO: 328383 - DNA, 13 bp, Homo sapiens
aacattcctccag

SEQ ID NO: 328384 - DNA, 19 bp, Homo sapiens
aacattcctccagcctccc

SEQ ID NO: 328385 - DNA, 21 bp, Homo sapiens
aacattcctccagcctcccct

SEQ ID NO: 328386 - DNA, 21 bp, Homo sapiens
aacattcgatctcattcagta

SEQ ID NO: 328387 - DNA, 16 bp, Homo sapiens
aacattgaaagtgagc

SEQ ID NO: 328388 - DNA, 16 bp, Homo sapiens
aacattgaagtaatga

SEQ ID NO: 328389 - DNA, 18 bp, Homo sapiens
aacattgaagtaatgaat

SEQ ID NO: 328390 - DNA, 19 bp, Homo sapiens
aacattgaccaagaactgc

SEQ ID NO: 328391 - DNA, 22 bp, Homo sapiens
aacattgaccaagaactgcatg

SEQ ID NO: 328392 - DNA, 23 bp, Homo sapiens
aacattgaccaagaactgcatgg

SEQ ID NO: 328393 - DNA, 15 bp, Homo sapiens
aacattgatgaatga

SEQ ID NO: 328394 - DNA, 11 bp, Homo sapiens
aacattgcatg

SEQ ID NO: 328395 - DNA, 20 bp, Homo sapiens
aacattgcatgtatttaaga

SEQ ID NO: 328396 - DNA, 15 bp, Homo sapiens
aacatttaggagaag

SEQ ID NO: 328397 - DNA, 23 bp, Homo sapiens
aacatttgatgtctagataacat

SEQ ID NO: 328398 - DNA, 17 bp, Homo sapiens
aacatttgctgaatatg

SEQ ID NO: 328399 - DNA, 21 bp, Homo sapiens
aacatttggaaaccatgcact

SEQ ID NO: 328400 - DNA, 13 bp, Homo sapiens
aacattttaaaat

SEQ ID NO: 328401 - DNA, 19 bp, Homo sapiens
aacattttaaataaaagaa

SEQ ID NO: 328402 - DNA, 16 bp, Homo sapiens
aacattttgtcatata

SEQ ID NO: 328403 - DNA, 11 bp, Homo sapiens
aacattttgtt

SEQ ID NO: 328404 - DNA, 20 bp, Homo sapiens
aacattttttgtttcttggt

SEQ ID NO: 328405 - DNA, 17 bp, Homo sapiens
aaccaaagaaagtgggt

SEQ ID NO: 328406 - DNA, 22 bp, Homo sapiens
aaccaacaccatcacagcttgt

SEQ ID NO: 328407 - DNA, 13 bp, Homo sapiens
aaccaacccatgt

SEQ ID NO: 328408 - DNA, 21 bp, Homo sapiens
aaccaagatctataaagcgat

SEQ ID NO: 328409 - DNA, 18 bp, Homo sapiens
aaccaatgattcataaca

SEQ ID NO: 328410 - DNA, 22 bp, Homo sapiens
aaccaatgattcataacaatgt

SEQ ID NO: 328411 - DNA, 17 bp, Homo sapiens
aaccaattcctcatttg

SEQ ID NO: 328412 - DNA, 19 bp, Homo sapiens
aaccacaaggtccactccc

SEQ ID NO: 328413 - DNA, 23 bp, Homo sapiens
aaccacaaggtccactccctgct

SEQ ID NO: 328414 - DNA, 17 bp, Homo sapiens
aaccacactgttgagtt

SEQ ID NO: 328415 - DNA, 19 bp, Homo sapiens
aaccacacttaaatccagt

SEQ ID NO: 328416 - DNA, 14 bp, Homo sapiens
aaccacagccctgt

SEQ ID NO: 328417 - DNA, 21 bp, Homo sapiens
aaccaccgcatatgcatgcca

SEQ ID NO: 328418 - DNA, 13 bp, Homo sapiens
aaccacctctggc

SEQ ID NO: 328419 - DNA, 23 bp, Homo sapiens
aaccacctctggccctgttgtgg

SEQ ID NO: 328420 - DNA, 18 bp, Homo sapiens
aaccacgtctgtcttcac

SEQ ID NO: 328421 - DNA, 18 bp, Homo sapiens
aaccactaatttgtcact

SEQ ID NO: 328422 - DNA, 12 bp, Homo sapiens
aaccactgcttc

SEQ ID NO: 328423 - DNA, 21 bp, Homo sapiens
aaccactgggatcagctggtg

SEQ ID NO: 328424 - DNA, 16 bp, Homo sapiens
aaccactgtaaaatga

SEQ ID NO: 328425 - DNA, 13 bp, Homo sapiens
aaccacttaaaaa

SEQ ID NO: 328426 - DNA, 14 bp, Homo sapiens
aaccactttttgca

SEQ ID NO: 328427 - DNA, 15 bp, Homo sapiens
aaccagaataaaata

SEQ ID NO: 328428 - DNA, 17 bp, Homo sapiens
aaccagaatgattttga

SEQ ID NO: 328429 - DNA, 22 bp, Homo sapiens
gacctggcactggatgcagaaa

SEQ ID NO: 328430 - DNA, 14 bp, Homo sapiens
gacctgggccctgg

SEQ ID NO: 328431 - DNA, 15 bp, Homo sapiens
gacctggggtgggga

SEQ ID NO: 328432 - DNA, 19 bp, Homo sapiens
gacctggggtggggaggca

SEQ ID NO: 328433 - DNA, 21 bp, Homo sapiens
gacctggggtggggaggcaga

SEQ ID NO: 328434 - DNA, 12 bp, Homo sapiens
gacctgtaatca

SEQ ID NO: 328435 - DNA, 17 bp, Homo sapiens
gacctgtcttccaagga

SEQ ID NO: 328436 - DNA, 20 bp, Homo sapiens
gacctgtcttccaaggagac

SEQ ID NO: 328437 - DNA, 15 bp, Homo sapiens
gacctgtgaccagca

SEQ ID NO: 328438 - DNA, 20 bp, Homo sapiens
gacctgtggggatttctccc

SEQ ID NO: 328439 - DNA, 20 bp, Homo sapiens
gaccttcaccaagcttagaa

SEQ ID NO: 328440 - DNA, 17 bp, Homo sapiens
gaccttcctctggggct

SEQ ID NO: 328441 - DNA, 15 bp, Homo sapiens
gaccttctgaagatc

SEQ ID NO: 328442 - DNA, 16 bp, Homo sapiens
gaccttgatgtcttga

SEQ ID NO: 328443 - DNA, 19 bp, Homo sapiens
gaccttgatgtcttgagag

SEQ ID NO: 328444 - DNA, 23 bp, Homo sapiens
gaccttgcaacttcatgtcaact

SEQ ID NO: 328445 - DNA, 20 bp, Homo sapiens
gaccttgcctcccctcctct

SEQ ID NO: 328446 - DNA, 15 bp, Homo sapiens
gaccttggagagctc

SEQ ID NO: 328447 - DNA, 18 bp, Homo sapiens
gaccttggggtacaattg

SEQ ID NO: 328448 - DNA, 22 bp, Homo sapiens
gacctttaagagaaatgagctg

SEQ ID NO: 328449 - DNA, 19 bp, Homo sapiens
gacctttatttattaaact

SEQ ID NO: 328450 - DNA, 21 bp, Homo sapiens
gaccttttggcctttgtaaga

SEQ ID NO: 328451 - DNA, 21 bp, Homo sapiens
gacgagggatgggatttcatg

SEQ ID NO: 328452 - DNA, 19 bp, Homo sapiens
gacgatgtcaaccttgtgt

SEQ ID NO: 328453 - DNA, 14 bp, Homo sapiens
gacgcacacagctt

SEQ ID NO: 328454 - DNA, 22 bp, Homo sapiens
gacgcagataactggttactca

SEQ ID NO: 328455 - DNA, 16 bp, Homo sapiens
gacgcaggaatggaaa

SEQ ID NO: 328456 - DNA, 22 bp, Homo sapiens
gacgcagggagaccctgggaga

SEQ ID NO: 328457 - DNA, 23 bp, Homo sapiens
gacgcagggagaccctgggagag

SEQ ID NO: 328458 - DNA, 23 bp, Homo sapiens
gacgccacagcccagccacggac

SEQ ID NO: 328459 - DNA, 18 bp, Homo sapiens
gacgcctgccctccccag

SEQ ID NO: 328460 - DNA, 20 bp, Homo sapiens
gacgcctgccctccccagag

SEQ ID NO: 328461 - DNA, 23 bp, Homo sapiens
gacgcctgccctccccagagcac

SEQ ID NO: 328462 - DNA, 13 bp, Homo sapiens
gacgcctggctcc

SEQ ID NO: 328463 - DNA, 14 bp, Homo sapiens
gacgcctggctcca

SEQ ID NO: 328464 - DNA, 16 bp, Homo sapiens
gacgcctggctccagg

SEQ ID NO: 328465 - DNA, 20 bp, Homo sapiens
gacgcctggctccaggctcc

SEQ ID NO: 328466 - DNA, 12 bp, Homo sapiens
gacgctggctcc

SEQ ID NO: 328467 - DNA, 14 bp, Homo sapiens
gacggagttcagag

SEQ ID NO: 328468 - DNA, 18 bp, Homo sapiens
gacggagttcagagggtg

SEQ ID NO: 328469 - DNA, 15 bp, Homo sapiens
gacggatggaaggag

SEQ ID NO: 328470 - DNA, 21 bp, Homo sapiens
gacggatggaaggagagaggt

SEQ ID NO: 328471 - DNA, 19 bp, Homo sapiens
gacggcacccacccagcac

SEQ ID NO: 328472 - DNA, 18 bp, Homo sapiens
gacggcagccccatcctt

SEQ ID NO: 328473 - DNA, 23 bp, Homo sapiens
gacggcctgatgctccctcccct

SEQ ID NO: 328474 - DNA, 20 bp, Homo sapiens
gacggctgtgtatttctgta

SEQ ID NO: 328475 - DNA, 20 bp, Homo sapiens
aactacaaagctgaagaaaa

SEQ ID NO: 328476 - DNA, 19 bp, Homo sapiens
aactaccagtgggcatgta

SEQ ID NO: 328477 - DNA, 20 bp, Homo sapiens
aactaccagtgggcatgtat

SEQ ID NO: 328478 - DNA, 22 bp, Homo sapiens
aactaccagtgggcatgtatta

SEQ ID NO: 328479 - DNA, 15 bp, Homo sapiens
aactactgtacattt

SEQ ID NO: 328480 - DNA, 13 bp, Homo sapiens
aactactgtgttc

SEQ ID NO: 328481 - DNA, 17 bp, Homo sapiens
aactactgtgttcctgg

SEQ ID NO: 328482 - DNA, 13 bp, Homo sapiens
aactactttctta

SEQ ID NO: 328483 - DNA, 19 bp, Homo sapiens
aactagataacttaaataa

SEQ ID NO: 328484 - DNA, 12 bp, Homo sapiens
aactagatctcc

SEQ ID NO: 328485 - DNA, 17 bp, Homo sapiens
aactagttaaaagcctt

SEQ ID NO: 328486 - DNA, 12 bp, Homo sapiens
aactagttctta

SEQ ID NO: 328487 - DNA, 19 bp, Homo sapiens
aactatccaattaaaatta

SEQ ID NO: 328488 - DNA, 17 bp, Homo sapiens
aactatgaactacaaag

SEQ ID NO: 328489 - DNA, 17 bp, Homo sapiens
aactatggttcccaata

SEQ ID NO: 328490 - DNA, 23 bp, Homo sapiens
aactatggttcccaataaaagtg

SEQ ID NO: 328491 - DNA, 15 bp, Homo sapiens
aactattggaaagta

SEQ ID NO: 328492 - DNA, 17 bp, Homo sapiens
aactatttaaaattggc

SEQ ID NO: 328493 - DNA, 19 bp, Homo sapiens
aactatttaaaattggcac

SEQ ID NO: 328494 - DNA, 19 bp, Homo sapiens
aactatttgtctttcagga

SEQ ID NO: 328495 - DNA, 19 bp, Homo sapiens
aactcaaaacttaacatat

SEQ ID NO: 328496 - DNA, 14 bp, Homo sapiens
aactcaaacacaga

SEQ ID NO: 328497 - DNA, 14 bp, Homo sapiens
aactcaaaggactg

SEQ ID NO: 328498 - DNA, 20 bp, Homo sapiens
aactcacctgctggcccctc

SEQ ID NO: 328499 - DNA, 21 bp, Homo sapiens
aactcacctgctggcccctca

SEQ ID NO: 328500 - DNA, 14 bp, Homo sapiens
aactcactgctcaa

SEQ ID NO: 328501 - DNA, 14 bp, Homo sapiens
aactcactgtgctc

SEQ ID NO: 328502 - DNA, 18 bp, Homo sapiens
aactcagatcactactgc

SEQ ID NO: 328503 - DNA, 19 bp, Homo sapiens
aactcagatcactactgca

SEQ ID NO: 328504 - DNA, 21 bp, Homo sapiens
aactcagatcactactgcagt

SEQ ID NO: 328505 - DNA, 16 bp, Homo sapiens
aactcagatgtccaaa

SEQ ID NO: 328506 - DNA, 18 bp, Homo sapiens
aactcatacctttaaagg

SEQ ID NO: 328507 - DNA, 18 bp, Homo sapiens
aactcatcataaaataaa

SEQ ID NO: 328508 - DNA, 18 bp, Homo sapiens
aactcatgaacaaaatga

SEQ ID NO: 328509 - DNA, 19 bp, Homo sapiens
aactccaaggcaaatgtcc

SEQ ID NO: 328510 - DNA, 13 bp, Homo sapiens
aactccaggaaaa

SEQ ID NO: 328511 - DNA, 17 bp, Homo sapiens
aactccaggggcaccta

SEQ ID NO: 328512 - DNA, 15 bp, Homo sapiens
aactccatacagcct

SEQ ID NO: 328513 - DNA, 19 bp, Homo sapiens
aactccatacagcctctac

SEQ ID NO: 328514 - DNA, 11 bp, Homo sapiens
aactccatgac

SEQ ID NO: 328515 - DNA, 23 bp, Homo sapiens
aactccatgaccaggccaccatc

SEQ ID NO: 328516 - DNA, 13 bp, Homo sapiens
aactccatgccta

SEQ ID NO: 328517 - DNA, 20 bp, Homo sapiens
aactccatggggttcgagac

SEQ ID NO: 328518 - DNA, 12 bp, Homo sapiens
aactcccaggac

SEQ ID NO: 328519 - DNA, 20 bp, Homo sapiens
aactccctagttacccaccc

SEQ ID NO: 328520 - DNA, 15 bp, Homo sapiens
aactccgtttccaaa

SEQ ID NO: 328521 - DNA, 22 bp, Homo sapiens
aactcctactgcttcctctgaa

SEQ ID NO: 328522 - DNA, 16 bp, Homo sapiens
aactcctcattgtaaa

SEQ ID NO: 328523 - DNA, 21 bp, Homo sapiens
aactcctgattttgtagttaa

SEQ ID NO: 328524 - DNA, 15 bp, Homo sapiens
aactcctgggctcaa

SEQ ID NO: 328525 - DNA, 19 bp, Homo sapiens
aactccttattttgtatta

SEQ ID NO: 328526 - DNA, 13 bp, Homo sapiens
aactccttcctct

SEQ ID NO: 328527 - DNA, 11 bp, Homo sapiens
aactccttggc

SEQ ID NO: 328528 - DNA, 15 bp, Homo sapiens
aactcgatgcactga

SEQ ID NO: 328529 - DNA, 17 bp, Homo sapiens
aactcgatgcactgacc

SEQ ID NO: 328530 - DNA, 21 bp, Homo sapiens
aactctaattcccattttgca

SEQ ID NO: 328531 - DNA, 22 bp, Homo sapiens
aactctaccctggtaggaaagc

SEQ ID NO: 328532 - DNA, 23 bp, Homo sapiens
aactctatgggtatcaaacagct

SEQ ID NO: 328533 - DNA, 15 bp, Homo sapiens
aactctccactccat

SEQ ID NO: 328534 - DNA, 20 bp, Homo sapiens
aactctccccagtgcctgcc

SEQ ID NO: 328535 - DNA, 23 bp, Homo sapiens
aactctgcaactgaatacttgaa

SEQ ID NO: 328536 - DNA, 21 bp, Homo sapiens
aactctgcactccatggccac

SEQ ID NO: 328537 - DNA, 22 bp, Homo sapiens
aactctgcactccatggccacc

SEQ ID NO: 328538 - DNA, 18 bp, Homo sapiens
aactctgcatagacaaag

SEQ ID NO: 328539 - DNA, 16 bp, Homo sapiens
aactctgcattctagt

SEQ ID NO: 328540 - DNA, 10 bp, Homo sapiens
aactctggcc

SEQ ID NO: 328541 - DNA, 16 bp, Homo sapiens
aactctgtggcattat

SEQ ID NO: 328542 - DNA, 18 bp, Homo sapiens
aactctgttcccccaccc

SEQ ID NO: 328543 - DNA, 16 bp, Homo sapiens
aactcttcaaggccaa

SEQ ID NO: 328544 - DNA, 19 bp, Homo sapiens
aactcttcaccttggttta

SEQ ID NO: 328545 - DNA, 13 bp, Homo sapiens
aactcttcatctt

SEQ ID NO: 328546 - DNA, 22 bp, Homo sapiens
aactcttcctggaatgcattca

SEQ ID NO: 328547 - DNA, 19 bp, Homo sapiens
aactgaaaacataaaaagt

SEQ ID NO: 328548 - DNA, 16 bp, Homo sapiens
aactgaaagtgtttta

SEQ ID NO: 328549 - DNA, 17 bp, Homo sapiens
aactgaagacctccaca

SEQ ID NO: 328550 - DNA, 20 bp, Homo sapiens
aactgaagcaaataccaaag

SEQ ID NO: 328551 - DNA, 19 bp, Homo sapiens
aactgaaggcaacctggaa

SEQ ID NO: 328552 - DNA, 16 bp, Homo sapiens
aactgaagtttcacat

SEQ ID NO: 328553 - DNA, 14 bp, Homo sapiens
aactgacataatgt

SEQ ID NO: 328554 - DNA, 14 bp, Homo sapiens
aactgaccagcctc

SEQ ID NO: 328555 - DNA, 18 bp, Homo sapiens
aactgactaaccattgat

SEQ ID NO: 328556 - DNA, 14 bp, Homo sapiens
aactgacttctgct

SEQ ID NO: 328557 - DNA, 18 bp, Homo sapiens
aactgagccaaaaacaat

SEQ ID NO: 328558 - DNA, 14 bp, Homo sapiens
gctgctccccaccc

SEQ ID NO: 328559 - DNA, 12 bp, Homo sapiens
gctgctcccctc

SEQ ID NO: 328560 - DNA, 13 bp, Homo sapiens
gctgctcctcgca

SEQ ID NO: 328561 - DNA, 18 bp, Homo sapiens
gctgctctagctggcagg

SEQ ID NO: 328562 - DNA, 18 bp, Homo sapiens
gctgctctgcccagagct

SEQ ID NO: 328563 - DNA, 20 bp, Homo sapiens
gctgctctgcccagagctgg

SEQ ID NO: 328564 - DNA, 14 bp, Homo sapiens
gctgctctgcccct

SEQ ID NO: 328565 - DNA, 20 bp, Homo sapiens
gctgctctgccccttgggca

SEQ ID NO: 328566 - DNA, 21 bp, Homo sapiens
gctgctctgctatatgcctta

SEQ ID NO: 328567 - DNA, 13 bp, Homo sapiens
gctgctcttgcat

SEQ ID NO: 328568 - DNA, 22 bp, Homo sapiens
gctgctgagggaccttggagag

SEQ ID NO: 328569 - DNA, 20 bp, Homo sapiens
gctgctgatgtaggagctgg

SEQ ID NO: 328570 - DNA, 14 bp, Homo sapiens
gctgctgcaccaac

SEQ ID NO: 328571 - DNA, 15 bp, Homo sapiens
gctgctgcctccctg

SEQ ID NO: 328572 - DNA, 17 bp, Homo sapiens
gctgctgcctccctggg

SEQ ID NO: 328573 - DNA, 23 bp, Homo sapiens
gctgctgcctttagtcgctgagg

SEQ ID NO: 328574 - DNA, 12 bp, Homo sapiens
gctgctgcgccc

SEQ ID NO: 328575 - DNA, 13 bp, Homo sapiens
gctgctgctgatg

SEQ ID NO: 328576 - DNA, 14 bp, Homo sapiens
gctgctgctgctgc

SEQ ID NO: 328577 - DNA, 13 bp, Homo sapiens
gctgctgctttcc

SEQ ID NO: 328578 - DNA, 22 bp, Homo sapiens
gctgctggaggaaaactgagac

SEQ ID NO: 328579 - DNA, 16 bp, Homo sapiens
gctgctggcacagact

SEQ ID NO: 328580 - DNA, 14 bp, Homo sapiens
gctgctggccaggg

SEQ ID NO: 328581 - DNA, 12 bp, Homo sapiens
gctgctggggca

SEQ ID NO: 328582 - DNA, 19 bp, Homo sapiens
gctgctgtaactgctgagc

SEQ ID NO: 328583 - DNA, 23 bp, Homo sapiens
gctgctgtaactgctgagccact

SEQ ID NO: 328584 - DNA, 12 bp, Homo sapiens
gctgctgtgcca

SEQ ID NO: 328585 - DNA, 15 bp, Homo sapiens
gctgctgtggcatca

SEQ ID NO: 328586 - DNA, 20 bp, Homo sapiens
gctgctgttactgttaacca

SEQ ID NO: 328587 - DNA, 13 bp, Homo sapiens
gctgcttccagga

SEQ ID NO: 328588 - DNA, 22 bp, Homo sapiens
gctgcttccctctgcctgtccc

SEQ ID NO: 328589 - DNA, 16 bp, Homo sapiens
gctgcttctccacctc

SEQ ID NO: 328590 - DNA, 18 bp, Homo sapiens
gctgcttctccacctccc

SEQ ID NO: 328591 - DNA, 19 bp, Homo sapiens
gctgcttgaaacttcagcc

SEQ ID NO: 328592 - DNA, 21 bp, Homo sapiens
gctgcttgtgcctcccttccc

SEQ ID NO: 328593 - DNA, 22 bp, Homo sapiens
gctgcttgtgcctcccttccca

SEQ ID NO: 328594 - DNA, 14 bp, Homo sapiens
gctgctttgcttct

SEQ ID NO: 328595 - DNA, 12 bp, Homo sapiens
gctgctttgtta

SEQ ID NO: 328596 - DNA, 19 bp, Homo sapiens
gctgctttgttaccttaaa

SEQ ID NO: 328597 - DNA, 13 bp, Homo sapiens
gctgcttttgatg

SEQ ID NO: 328598 - DNA, 17 bp, Homo sapiens
gctgctttttggcacag

SEQ ID NO: 328599 - DNA, 18 bp, Homo sapiens
gctgctttttggcacagt

SEQ ID NO: 328600 - DNA, 14 bp, Homo sapiens
gctggaagaacatc

SEQ ID NO: 328601 - DNA, 16 bp, Homo sapiens
gctggaagaacatcaa

SEQ ID NO: 328602 - DNA, 15 bp, Homo sapiens
gctggaaggcagggc

SEQ ID NO: 328603 - DNA, 23 bp, Homo sapiens
gctggaaggcagggcagagggaa

SEQ ID NO: 328604 - DNA, 18 bp, Homo sapiens
gctggaatccagaaggaa

SEQ ID NO: 328605 - DNA, 16 bp, Homo sapiens
gctggacaagaagctg

SEQ ID NO: 328606 - DNA, 17 bp, Homo sapiens
gctggacaagaagctgc

SEQ ID NO: 328607 - DNA, 20 bp, Homo sapiens
gctggaccagtggtgccttg

SEQ ID NO: 328608 - DNA, 23 bp, Homo sapiens
gctggacctatgtcctaaggaca

SEQ ID NO: 328609 - DNA, 12 bp, Homo sapiens
gctggactggag

SEQ ID NO: 328610 - DNA, 16 bp, Homo sapiens
gctggactggaggtgg

SEQ ID NO: 328611 - DNA, 14 bp, Homo sapiens
gctggactggctgt

SEQ ID NO: 328612 - DNA, 19 bp, Homo sapiens
gctggacttttgcagcttc

SEQ ID NO: 328613 - DNA, 18 bp, Homo sapiens
gctggagaggaaaagcca

SEQ ID NO: 328614 - DNA, 23 bp, Homo sapiens
gctggagccaatggtgagggctg

SEQ ID NO: 328615 - DNA, 12 bp, Homo sapiens
gctggagcggct

SEQ ID NO: 328616 - DNA, 14 bp, Homo sapiens
gctggaggaatcag

SEQ ID NO: 328617 - DNA, 13 bp, Homo sapiens
gctggaggcagac

SEQ ID NO: 328618 - DNA, 16 bp, Homo sapiens
gctggaggtaaggcct

SEQ ID NO: 328619 - DNA, 17 bp, Homo sapiens
gctggagtcctgttctc

SEQ ID NO: 328620 - DNA, 22 bp, Homo sapiens
gctggagtcctgttctcagagc

SEQ ID NO: 328621 - DNA, 19 bp, Homo sapiens
gctggagtgcagtggtgcg

SEQ ID NO: 328622 - DNA, 14 bp, Homo sapiens
gctggagtgctggc

SEQ ID NO: 328623 - DNA, 18 bp, Homo sapiens
gctggagtgctggctcca

SEQ ID NO: 328624 - DNA, 15 bp, Homo sapiens
gctggataaaatgag

SEQ ID NO: 328625 - DNA, 18 bp, Homo sapiens
gctggatgtcaccaagaa

SEQ ID NO: 328626 - DNA, 19 bp, Homo sapiens
gctggatttgggagctctg

SEQ ID NO: 328627 - DNA, 17 bp, Homo sapiens
gctggcaaactgtgaat

SEQ ID NO: 328628 - DNA, 23 bp, Homo sapiens
gctggcacatttccccagacctg

SEQ ID NO: 328629 - DNA, 18 bp, Homo sapiens
gctggcaccgccttctct

SEQ ID NO: 328630 - DNA, 13 bp, Homo sapiens
gctggcagcgcct

SEQ ID NO: 328631 - DNA, 23 bp, Homo sapiens
gctggcagcgcctcccgccgcct

SEQ ID NO: 328632 - DNA, 17 bp, Homo sapiens
gctggcagcgctcctgg

SEQ ID NO: 328633 - DNA, 14 bp, Homo sapiens
gctggcagctctcc

SEQ ID NO: 328634 - DNA, 15 bp, Homo sapiens
gctggcagctctcca

SEQ ID NO: 328635 - DNA, 18 bp, Homo sapiens
gctggcaggagacactgg

SEQ ID NO: 328636 - DNA, 20 bp, Homo sapiens
gctggcagtacagagtgcag

SEQ ID NO: 328637 - DNA, 18 bp, Homo sapiens
gctggccagcaaggcagg

SEQ ID NO: 328638 - DNA, 14 bp, Homo sapiens
gctggccagcctgg

SEQ ID NO: 328639 - DNA, 15 bp, Homo sapiens
gctggccagcctggg

SEQ ID NO: 328640 - DNA, 23 bp, Homo sapiens
gctggccagcctggggcctggca

SEQ ID NO: 328641 - DNA, 14 bp, Homo sapiens
gctggcccggggag

SEQ ID NO: 328642 - DNA, 13 bp, Homo sapiens
gctggccctgccc

SEQ ID NO: 328643 - DNA, 15 bp, Homo sapiens
gctggccctgccctc

SEQ ID NO: 328644 - DNA, 16 bp, Homo sapiens
gctggccctgccctcc

SEQ ID NO: 328645 - DNA, 20 bp, Homo sapiens
gctggccctgccctccccca

SEQ ID NO: 328646 - DNA, 19 bp, Homo sapiens
gctggccctggctcccaca

SEQ ID NO: 328647 - DNA, 15 bp, Homo sapiens
gctggccgagggtcc

SEQ ID NO: 328648 - DNA, 19 bp, Homo sapiens
gctggccgagggtcctggc

SEQ ID NO: 328649 - DNA, 17 bp, Homo sapiens
gctggccgggcacagct

SEQ ID NO: 328650 - DNA, 23 bp, Homo sapiens
gctggccgggttggaggcctcac

SEQ ID NO: 328651 - DNA, 19 bp, Homo sapiens
gctggccggtccaccccgt

SEQ ID NO: 328652 - DNA, 20 bp, Homo sapiens
gctggccggtccaccccgtc

SEQ ID NO: 328653 - DNA, 16 bp, Homo sapiens
gctggcctcagactca

SEQ ID NO: 328654 - DNA, 21 bp, Homo sapiens
gctggcctcccaataaagctg

SEQ ID NO: 328655 - DNA, 23 bp, Homo sapiens
gctggcctcccaataaagctgga

SEQ ID NO: 328656 - DNA, 13 bp, Homo sapiens
gctggcctcttcc

SEQ ID NO: 328657 - DNA, 16 bp, Homo sapiens
gctggccttcctgccc

SEQ ID NO: 328658 - DNA, 15 bp, Homo sapiens
gctggcggcgcagag

SEQ ID NO: 328659 - DNA, 19 bp, Homo sapiens
gctggctccacgccctggg

SEQ ID NO: 328660 - DNA, 21 bp, Homo sapiens
gctggctccacgccctgggga

SEQ ID NO: 328661 - DNA, 16 bp, Homo sapiens
gctggctcccagggcc

SEQ ID NO: 328662 - DNA, 13 bp, Homo sapiens
gctggctccccaa

SEQ ID NO: 328663 - DNA, 21 bp, Homo sapiens
gctggctccccaaagggtgtg

SEQ ID NO: 328664 - DNA, 17 bp, Homo sapiens
gctggctgaggcttggg

SEQ ID NO: 328665 - DNA, 12 bp, Homo sapiens
gctggctgagtg

SEQ ID NO: 328666 - DNA, 16 bp, Homo sapiens
gctggcttctccctgg

SEQ ID NO: 328667 - DNA, 22 bp, Homo sapiens
gctgggaagctgtactcagagc

SEQ ID NO: 328668 - DNA, 23 bp, Homo sapiens
gctgggaagctgtactcagagca

SEQ ID NO: 328669 - DNA, 17 bp, Homo sapiens
gctgggactgagccagt

SEQ ID NO: 328670 - DNA, 19 bp, Homo sapiens
gctgggagaaggtgcttgg

SEQ ID NO: 328671 - DNA, 20 bp, Homo sapiens
gctgggagaaggtgcttggg

SEQ ID NO: 328672 - DNA, 21 bp, Homo sapiens
gctgggagaaggtgcttgggc

SEQ ID NO: 328673 - DNA, 23 bp, Homo sapiens
gctgggcactgggccggcagcct

SEQ ID NO: 328674 - DNA, 17 bp, Homo sapiens
gctgggcagaggggaga

SEQ ID NO: 328675 - DNA, 13 bp, Homo sapiens
gccccccacccca

SEQ ID NO: 328676 - DNA, 14 bp, Homo sapiens
gccccccaccccag

SEQ ID NO: 328677 - DNA, 23 bp, Homo sapiens
gccccccagagagagctctgcac

SEQ ID NO: 328678 - DNA, 19 bp, Homo sapiens
gccccccagagccagggct

SEQ ID NO: 328679 - DNA, 13 bp, Homo sapiens
gccccccagctca

SEQ ID NO: 328680 - DNA, 15 bp, Homo sapiens
gccccccagctcagg

SEQ ID NO: 328681 - DNA, 22 bp, Homo sapiens
gccccccagtgtccccaggggc

SEQ ID NO: 328682 - DNA, 23 bp, Homo sapiens
gccccccccttgaatctgcaggg

SEQ ID NO: 328683 - DNA, 14 bp, Homo sapiens
gcccccctcctcca

SEQ ID NO: 328684 - DNA, 13 bp, Homo sapiens
gcccccgagctgg

SEQ ID NO: 328685 - DNA, 16 bp, Homo sapiens
gcccccgccccctccc

SEQ ID NO: 328686 - DNA, 20 bp, Homo sapiens
gcccccgccctcgctccggg

SEQ ID NO: 328687 - DNA, 20 bp, Homo sapiens
gcccccgcgggttctagacg

SEQ ID NO: 328688 - DNA, 16 bp, Homo sapiens
gcccccgctcatgggc

SEQ ID NO: 328689 - DNA, 20 bp, Homo sapiens
gcccccggaggcgcccacct

SEQ ID NO: 328690 - DNA, 12 bp, Homo sapiens
gccccctccccc

SEQ ID NO: 328691 - DNA, 13 bp, Homo sapiens
gccccctcccccg

SEQ ID NO: 328692 - DNA, 16 bp, Homo sapiens
gccccctctcctgaag

SEQ ID NO: 328693 - DNA, 17 bp, Homo sapiens
gccccctctcctgaagc

SEQ ID NO: 328694 - DNA, 21 bp, Homo sapiens
gccccctgcacccacccctgc

SEQ ID NO: 328695 - DNA, 13 bp, Homo sapiens
gccccctggatgg

SEQ ID NO: 328696 - DNA, 16 bp, Homo sapiens
gccccctggatgtccc

SEQ ID NO: 328697 - DNA, 15 bp, Homo sapiens
gccccctggcccctc

SEQ ID NO: 328698 - DNA, 11 bp, Homo sapiens
gccccctgggg

SEQ ID NO: 328699 - DNA, 23 bp, Homo sapiens
gccccctggggggcacagccaga

SEQ ID NO: 328700 - DNA, 21 bp, Homo sapiens
gccccctgtgcccacccaggg

SEQ ID NO: 328701 - DNA, 23 bp, Homo sapiens
gccccctgtgcccacccagggcc

SEQ ID NO: 328702 - DNA, 19 bp, Homo sapiens
gcccccttcaccccttcag

SEQ ID NO: 328703 - DNA, 15 bp, Homo sapiens
gcccccttctcccac

SEQ ID NO: 328704 - DNA, 20 bp, Homo sapiens
gcccccttctcccacactgc

SEQ ID NO: 328705 - DNA, 16 bp, Homo sapiens
gccccctttcagatgt

SEQ ID NO: 328706 - DNA, 18 bp, Homo sapiens
gccccctttcagatgtct

SEQ ID NO: 328707 - DNA, 13 bp, Homo sapiens
gccccgccccaca

SEQ ID NO: 328708 - DNA, 15 bp, Homo sapiens
gccccgcccccaccc

SEQ ID NO: 328709 - DNA, 20 bp, Homo sapiens
gccccgcccccacccctaca

SEQ ID NO: 328710 - DNA, 14 bp, Homo sapiens
gccccgccccccag

SEQ ID NO: 328711 - DNA, 17 bp, Homo sapiens
gccccgccccccagagc

SEQ ID NO: 328712 - DNA, 19 bp, Homo sapiens
gccccgccccccagagcca

SEQ ID NO: 328713 - DNA, 22 bp, Homo sapiens
gccccgccccccagagccaggg

SEQ ID NO: 328714 - DNA, 21 bp, Homo sapiens
gccccgcgcgtgcccccagcg

SEQ ID NO: 328715 - DNA, 22 bp, Homo sapiens
gccccgctcaggtagccaccac

SEQ ID NO: 328716 - DNA, 23 bp, Homo sapiens
gccccgctcaggtagccaccacc

SEQ ID NO: 328717 - DNA, 23 bp, Homo sapiens
gccccggacggacgttggttctg

SEQ ID NO: 328718 - DNA, 23 bp, Homo sapiens
gccccggggctggcaagcaggga

SEQ ID NO: 328719 - DNA, 15 bp, Homo sapiens
gccccgtcaccatct

SEQ ID NO: 328720 - DNA, 21 bp, Homo sapiens
gccccgtcaccatctcaggcc

SEQ ID NO: 328721 - DNA, 15 bp, Homo sapiens
gccccgtcccctggg

SEQ ID NO: 328722 - DNA, 19 bp, Homo sapiens
gccccgtcccctgggccac

SEQ ID NO: 328723 - DNA, 19 bp, Homo sapiens
gccccgtcggactgccccc

SEQ ID NO: 328724 - DNA, 22 bp, Homo sapiens
gccccgtcggactgcccccaga

SEQ ID NO: 328725 - DNA, 22 bp, Homo sapiens
gccccgtgcagactggagggga

SEQ ID NO: 328726 - DNA, 13 bp, Homo sapiens
gccccgtgtctgg

SEQ ID NO: 328727 - DNA, 13 bp, Homo sapiens
gccccgttccctg

SEQ ID NO: 328728 - DNA, 15 bp, Homo sapiens
gccccgttccctgtc

SEQ ID NO: 328729 - DNA, 17 bp, Homo sapiens
gccccgttccctgtcag

SEQ ID NO: 328730 - DNA, 23 bp, Homo sapiens
gcccctaccttgagaccctcttc

SEQ ID NO: 328731 - DNA, 17 bp, Homo sapiens
gcccctatcctgcaccc

SEQ ID NO: 328732 - DNA, 23 bp, Homo sapiens
gcccctcacctcaggaccccaga

SEQ ID NO: 328733 - DNA, 16 bp, Homo sapiens
gcccctcacctgggcc

SEQ ID NO: 328734 - DNA, 20 bp, Homo sapiens
gcccctcacctgggcctttc

SEQ ID NO: 328735 - DNA, 13 bp, Homo sapiens
gcccctcagagcc

SEQ ID NO: 328736 - DNA, 14 bp, Homo sapiens
gcccctcagccctt

SEQ ID NO: 328737 - DNA, 21 bp, Homo sapiens
gcccctcagcccttgccccca

SEQ ID NO: 328738 - DNA, 17 bp, Homo sapiens
gcccctccagaccctgc

SEQ ID NO: 328739 - DNA, 18 bp, Homo sapiens
gcccctccagaccctgcc

SEQ ID NO: 328740 - DNA, 23 bp, Homo sapiens
gcccctccagaccctgcctgagc

SEQ ID NO: 328741 - DNA, 12 bp, Homo sapiens
gcccctccagga

SEQ ID NO: 328742 - DNA, 16 bp, Homo sapiens
gcccctccagtgttgc

SEQ ID NO: 328743 - DNA, 21 bp, Homo sapiens
gcccctcccaagcgttcctgg

SEQ ID NO: 328744 - DNA, 15 bp, Homo sapiens
gcccctcccacacac

SEQ ID NO: 328745 - DNA, 17 bp, Homo sapiens
gcccctcccacatcccc

SEQ ID NO: 328746 - DNA, 12 bp, Homo sapiens
gcccctcccacc

SEQ ID NO: 328747 - DNA, 13 bp, Homo sapiens
gcccctcccatgg

SEQ ID NO: 328748 - DNA, 18 bp, Homo sapiens
gcccctcccatggcccag

SEQ ID NO: 328749 - DNA, 23 bp, Homo sapiens
gcccctcccatggcccagcagct

SEQ ID NO: 328750 - DNA, 15 bp, Homo sapiens
gcccctccccagcca

SEQ ID NO: 328751 - DNA, 14 bp, Homo sapiens
gcccctccctacct

SEQ ID NO: 328752 - DNA, 15 bp, Homo sapiens
gcccctccctacctc

SEQ ID NO: 328753 - DNA, 19 bp, Homo sapiens
gcccctccctctgccccaa

SEQ ID NO: 328754 - DNA, 20 bp, Homo sapiens
gcccctccctctgccccaag

SEQ ID NO: 328755 - DNA, 12 bp, Homo sapiens
gcccctcccttc

SEQ ID NO: 328756 - DNA, 13 bp, Homo sapiens
gcccctccgtccc

SEQ ID NO: 328757 - DNA, 20 bp, Homo sapiens
gcccctccgtccccagggtg

SEQ ID NO: 328758 - DNA, 21 bp, Homo sapiens
gcccctcctcgggcgcctgcg

SEQ ID NO: 328759 - DNA, 17 bp, Homo sapiens
gcccctcctctcctcgt

SEQ ID NO: 328760 - DNA, 20 bp, Homo sapiens
gcccctcctctgagcagcct

SEQ ID NO: 328761 - DNA, 14 bp, Homo sapiens
gcccctcctctgtg

SEQ ID NO: 328762 - DNA, 17 bp, Homo sapiens
gcccctcctctgtgctc

SEQ ID NO: 328763 - DNA, 20 bp, Homo sapiens
gcccctcctctgtgctccct

SEQ ID NO: 328764 - DNA, 14 bp, Homo sapiens
gcccctccttctcc

SEQ ID NO: 328765 - DNA, 18 bp, Homo sapiens
gcccctccttctcccctc

SEQ ID NO: 328766 - DNA, 22 bp, Homo sapiens
gcccctccttctcccctccaga

SEQ ID NO: 328767 - DNA, 23 bp, Homo sapiens
gcccctcggcattcacacacagc

SEQ ID NO: 328768 - DNA, 13 bp, Homo sapiens
gcccctcggctac

SEQ ID NO: 328769 - DNA, 22 bp, Homo sapiens
gcccctcgtgacctacagggaa

SEQ ID NO: 328770 - DNA, 12 bp, Homo sapiens
gcccctctgccc

SEQ ID NO: 328771 - DNA, 18 bp, Homo sapiens
gcccctctgcccagcttg

SEQ ID NO: 328772 - DNA, 20 bp, Homo sapiens
gcccctctgcccagcttggg

SEQ ID NO: 328773 - DNA, 14 bp, Homo sapiens
gcccctctgctgtc

SEQ ID NO: 328774 - DNA, 21 bp, Homo sapiens
gcccctctgctgtcctgcagt

SEQ ID NO: 328775 - DNA, 19 bp, Homo sapiens
gcccctcttgccccccacc

SEQ ID NO: 328776 - DNA, 15 bp, Homo sapiens
gcccctgaggactgg

SEQ ID NO: 328777 - DNA, 15 bp, Homo sapiens
gcccctgcaggggag

SEQ ID NO: 328778 - DNA, 15 bp, Homo sapiens
gcccctgccccgtca

SEQ ID NO: 328779 - DNA, 19 bp, Homo sapiens
gcccctgcccgagagctct

SEQ ID NO: 328780 - DNA, 19 bp, Homo sapiens
gcccctgccgcctgtgccc

SEQ ID NO: 328781 - DNA, 20 bp, Homo sapiens
gcccctgctgcctccccaac

SEQ ID NO: 328782 - DNA, 16 bp, Homo sapiens
gcccctggcccatctc

SEQ ID NO: 328783 - DNA, 17 bp, Homo sapiens
gcccctggcccatctca

SEQ ID NO: 328784 - DNA, 18 bp, Homo sapiens
gcccctgtaggttgctta

SEQ ID NO: 328785 - DNA, 11 bp, Homo sapiens
gcccctgtcta

SEQ ID NO: 328786 - DNA, 16 bp, Homo sapiens
gcccctgtgtgggagg

SEQ ID NO: 328787 - DNA, 17 bp, Homo sapiens
gcccctgtgtgggaggg

SEQ ID NO: 328788 - DNA, 14 bp, Homo sapiens
gcccctgtgttggg

SEQ ID NO: 328789 - DNA, 18 bp, Homo sapiens
gccccttctacactctcc

SEQ ID NO: 328790 - DNA, 21 bp, Homo sapiens
gccccttctacactctcctgg

SEQ ID NO: 328791 - DNA, 18 bp, Homo sapiens
gccccttctgtttccata

SEQ ID NO: 328792 - DNA, 15 bp, Homo sapiens
gccccttgaccccac

SEQ ID NO: 328793 - DNA, 20 bp, Homo sapiens
gcccctttttactccccttg

SEQ ID NO: 328794 - DNA, 21 bp, Homo sapiens
gcccctttttactccccttga

SEQ ID NO: 328795 - DNA, 14 bp, Homo sapiens
gcccgacagcctgg

SEQ ID NO: 328796 - DNA, 15 bp, Homo sapiens
gcccgacagcctggc

SEQ ID NO: 328797 - DNA, 19 bp, Homo sapiens
gcccgacagcctggcacag

SEQ ID NO: 328798 - DNA, 17 bp, Homo sapiens
gcccgacagttctgaac

SEQ ID NO: 328799 - DNA, 19 bp, Homo sapiens
gcccgaccccatctcattc

SEQ ID NO: 328800 - DNA, 14 bp, Homo sapiens
gcccgactagcagg

SEQ ID NO: 328801 - DNA, 19 bp, Homo sapiens
gcccgagagctcttagttt

SEQ ID NO: 328802 - DNA, 20 bp, Homo sapiens
gcccgagcgcgtgccttccc

SEQ ID NO: 328803 - DNA, 21 bp, Homo sapiens
gcccgagcgcgtgccttcccc

SEQ ID NO: 328804 - DNA, 12 bp, Homo sapiens
gcccgagctggt

SEQ ID NO: 328805 - DNA, 17 bp, Homo sapiens
gccctgacccctgcacc

SEQ ID NO: 328806 - DNA, 16 bp, Homo sapiens
gccctgaccttggctg

SEQ ID NO: 328807 - DNA, 17 bp, Homo sapiens
gccctgatttgctgttt

SEQ ID NO: 328808 - DNA, 23 bp, Homo sapiens
gccctgcaatgtatcccttctca

SEQ ID NO: 328809 - DNA, 16 bp, Homo sapiens
gccctgcaccttgggc

SEQ ID NO: 328810 - DNA, 18 bp, Homo sapiens
gccctgcaggaggcctgg

SEQ ID NO: 328811 - DNA, 13 bp, Homo sapiens
gccctgcagtgtt

SEQ ID NO: 328812 - DNA, 14 bp, Homo sapiens
gccctgccacctgt

SEQ ID NO: 328813 - DNA, 18 bp, Homo sapiens
gccctgccacctgtctgt

SEQ ID NO: 328814 - DNA, 20 bp, Homo sapiens
gccctgccacctgtctgtct

SEQ ID NO: 328815 - DNA, 14 bp, Homo sapiens
gccctgccaggctg

SEQ ID NO: 328816 - DNA, 15 bp, Homo sapiens
gccctgccaggctgt

SEQ ID NO: 328817 - DNA, 19 bp, Homo sapiens
gccctgccaggctgtcagc

SEQ ID NO: 328818 - DNA, 13 bp, Homo sapiens
gccctgccccaca

SEQ ID NO: 328819 - DNA, 15 bp, Homo sapiens
gccctgccccacaca

SEQ ID NO: 328820 - DNA, 16 bp, Homo sapiens
gccctgccccacacag

SEQ ID NO: 328821 - DNA, 13 bp, Homo sapiens
gccctgccctcac

SEQ ID NO: 328822 - DNA, 19 bp, Homo sapiens
gccctgccctcactccact

SEQ ID NO: 328823 - DNA, 12 bp, Homo sapiens
gccctgccctcc

SEQ ID NO: 328824 - DNA, 13 bp, Homo sapiens
gccctgccctgca

SEQ ID NO: 328825 - DNA, 17 bp, Homo sapiens
gccctgccctgccacct

SEQ ID NO: 328826 - DNA, 15 bp, Homo sapiens
gccctgcccttcagc

SEQ ID NO: 328827 - DNA, 14 bp, Homo sapiens
gccctgcctccctt

SEQ ID NO: 328828 - DNA, 20 bp, Homo sapiens
gccctgcctccctttctggg

SEQ ID NO: 328829 - DNA, 13 bp, Homo sapiens
gccctgcctgagg

SEQ ID NO: 328830 - DNA, 20 bp, Homo sapiens
gccctgcctgagggcccctc

SEQ ID NO: 328831 - DNA, 17 bp, Homo sapiens
gccctgcctgcccactt

SEQ ID NO: 328832 - DNA, 14 bp, Homo sapiens
gccctgccttcagc

SEQ ID NO: 328833 - DNA, 20 bp, Homo sapiens
gccctgcgttggagccactc

SEQ ID NO: 328834 - DNA, 21 bp, Homo sapiens
gccctgcgttggagccactcc

SEQ ID NO: 328835 - DNA, 22 bp, Homo sapiens
gccctgcgttggagccactcct

SEQ ID NO: 328836 - DNA, 23 bp, Homo sapiens
gccctgcgttggagccactcctg

SEQ ID NO: 328837 - DNA, 18 bp, Homo sapiens
gccctgctgctgcctgcc

SEQ ID NO: 328838 - DNA, 20 bp, Homo sapiens
gccctgctttgggctgccct

SEQ ID NO: 328839 - DNA, 22 bp, Homo sapiens
gccctgctttgggctgccctgg

SEQ ID NO: 328840 - DNA, 19 bp, Homo sapiens
gccctggcaacatagtgag

SEQ ID NO: 328841 - DNA, 13 bp, Homo sapiens
gccctggccagag

SEQ ID NO: 328842 - DNA, 20 bp, Homo sapiens
gccctggcccagagctggaa

SEQ ID NO: 328843 - DNA, 18 bp, Homo sapiens
gccctggctggggacttg

SEQ ID NO: 328844 - DNA, 20 bp, Homo sapiens
gccctgggcacccacctcca

SEQ ID NO: 328845 - DNA, 22 bp, Homo sapiens
gccctgggcacccacctccacc

SEQ ID NO: 328846 - DNA, 12 bp, Homo sapiens
gccctgggccag

SEQ ID NO: 328847 - DNA, 12 bp, Homo sapiens
gccctgggctgg

SEQ ID NO: 328848 - DNA, 13 bp, Homo sapiens
gccctgggctgga

SEQ ID NO: 328849 - DNA, 14 bp, Homo sapiens
gccctgggctggac

SEQ ID NO: 328850 - DNA, 18 bp, Homo sapiens
gccctggggagtgagctt

SEQ ID NO: 328851 - DNA, 20 bp, Homo sapiens
gccctggggagtgagcttgg

SEQ ID NO: 328852 - DNA, 19 bp, Homo sapiens
gccctggggtccccactcc

SEQ ID NO: 328853 - DNA, 20 bp, Homo sapiens
gccctggggtctctgagcag

SEQ ID NO: 328854 - DNA, 23 bp, Homo sapiens
gccctggggtctctgagcagtgg

SEQ ID NO: 328855 - DNA, 24 bp, Homo sapiens
gccctggggtggcgtctgcctagg

SEQ ID NO: 328856 - DNA, 16 bp, Homo sapiens
gccctggtgctgccac

SEQ ID NO: 328857 - DNA, 17 bp, Homo sapiens
gccctggtgctgccaca

SEQ ID NO: 328858 - DNA, 20 bp, Homo sapiens
gccctggttctccatcccca

SEQ ID NO: 328859 - DNA, 18 bp, Homo sapiens
gccctggtttcactggcc

SEQ ID NO: 328860 - DNA, 17 bp, Homo sapiens
gccctgtcgagacactt

SEQ ID NO: 328861 - DNA, 11 bp, Homo sapiens
gccctgtggga

SEQ ID NO: 328862 - DNA, 21 bp, Homo sapiens
gccctgtgggagtccactttc

SEQ ID NO: 328863 - DNA, 21 bp, Homo sapiens
gccctgttctgggtgcagctg

SEQ ID NO: 328864 - DNA, 20 bp, Homo sapiens
gcccttaaaataatgattta

SEQ ID NO: 328865 - DNA, 13 bp, Homo sapiens
gcccttaagggaa

SEQ ID NO: 328866 - DNA, 13 bp, Homo sapiens
gcccttaccttcc

SEQ ID NO: 328867 - DNA, 17 bp, Homo sapiens
gcccttagccttgctgt

SEQ ID NO: 328868 - DNA, 20 bp, Homo sapiens
gcccttagccttgctgtaga

SEQ ID NO: 328869 - DNA, 21 bp, Homo sapiens
gcccttagccttgctgtagag

SEQ ID NO: 328870 - DNA, 14 bp, Homo sapiens
gcccttcactgcca

SEQ ID NO: 328871 - DNA, 21 bp, Homo sapiens
gcccttcagcatcctcagttc

SEQ ID NO: 328872 - DNA, 17 bp, Homo sapiens
gcccttcaggacccttc

SEQ ID NO: 328873 - DNA, 22 bp, Homo sapiens
gcccttcaggacccttctactt

SEQ ID NO: 328874 - DNA, 17 bp, Homo sapiens
gcccttcagtccctgag

SEQ ID NO: 328875 - DNA, 12 bp, Homo sapiens
gcccttccatgt

SEQ ID NO: 328876 - DNA, 16 bp, Homo sapiens
gcccttcccaggccag

SEQ ID NO: 328877 - DNA, 16 bp, Homo sapiens
gcccttccctgctttg

SEQ ID NO: 328878 - DNA, 12 bp, Homo sapiens
gcccttcctctc

SEQ ID NO: 328879 - DNA, 15 bp, Homo sapiens
gcccttcctctccac

SEQ ID NO: 328880 - DNA, 17 bp, Homo sapiens
gcccttcctctccactg

SEQ ID NO: 328881 - DNA, 18 bp, Homo sapiens
gcccttcctctccactgc

SEQ ID NO: 328882 - DNA, 22 bp, Homo sapiens
gcccttcctggactggcccttg

SEQ ID NO: 328883 - DNA, 22 bp, Homo sapiens
gcccttcttttgaccccttcct

SEQ ID NO: 328884 - DNA, 20 bp, Homo sapiens
gcccttgcagttcagcacca

SEQ ID NO: 328885 - DNA, 22 bp, Homo sapiens
gcccttgcagttcagcaccacc

SEQ ID NO: 328886 - DNA, 11 bp, Homo sapiens
gcccttgccca

SEQ ID NO: 328887 - DNA, 15 bp, Homo sapiens
gcccttgcccaactc

SEQ ID NO: 328888 - DNA, 20 bp, Homo sapiens
gcccttgcccaactcccagc

SEQ ID NO: 328889 - DNA, 17 bp, Homo sapiens
gcccttgggacagccag

SEQ ID NO: 328890 - DNA, 12 bp, Homo sapiens
gcccttgggcag

SEQ ID NO: 328891 - DNA, 13 bp, Homo sapiens
gcccttggggcct

SEQ ID NO: 328892 - DNA, 16 bp, Homo sapiens
gcccttggggcctggc

SEQ ID NO: 328893 - DNA, 18 bp, Homo sapiens
gcccttggggcctggctt

SEQ ID NO: 328894 - DNA, 20 bp, Homo sapiens
gcccttggggcctggcttgc

SEQ ID NO: 328895 - DNA, 15 bp, Homo sapiens
gcccttgtcctgcca

SEQ ID NO: 328896 - DNA, 18 bp, Homo sapiens
gcccttgtcctgccagct

SEQ ID NO: 328897 - DNA, 15 bp, Homo sapiens
gccctttccccactc

SEQ ID NO: 328898 - DNA, 12 bp, Homo sapiens
gccctttctgtg

SEQ ID NO: 328899 - DNA, 13 bp, Homo sapiens
gccctttctgtgt

SEQ ID NO: 328900 - DNA, 15 bp, Homo sapiens
gccctttgcaggccc

SEQ ID NO: 328901 - DNA, 16 bp, Homo sapiens
gccctttgcaggccca

SEQ ID NO: 328902 - DNA, 13 bp, Homo sapiens
gcccttttctggc

SEQ ID NO: 328903 - DNA, 17 bp, Homo sapiens
gcccttttctggctcct

SEQ ID NO: 328904 - DNA, 21 bp, Homo sapiens
gcccttttctggctcctgtgt

SEQ ID NO: 328905 - DNA, 18 bp, Homo sapiens
gccgaaccccccactccc

SEQ ID NO: 328906 - DNA, 23 bp, Homo sapiens
gccgaccgcctgcttcacacccc

SEQ ID NO: 328907 - DNA, 14 bp, Homo sapiens
gccgactggctgtg

SEQ ID NO: 328908 - DNA, 13 bp, Homo sapiens
gccgagagaggcg

SEQ ID NO: 328909 - DNA, 15 bp, Homo sapiens
gccgagccgggcctg

SEQ ID NO: 328910 - DNA, 13 bp, Homo sapiens
gccgagcctaatg

SEQ ID NO: 328911 - DNA, 19 bp, Homo sapiens
gccgagcctaatgaaaggg

SEQ ID NO: 328912 - DNA, 22 bp, Homo sapiens
gccgagctcgtgtatcctgggg

SEQ ID NO: 328913 - DNA, 16 bp, Homo sapiens
gccgagctctcctggg

SEQ ID NO: 328914 - DNA, 18 bp, Homo sapiens
gccgagctctcctgggcc

SEQ ID NO: 328915 - DNA, 19 bp, Homo sapiens
gccgagctctcctgggcca

SEQ ID NO: 328916 - DNA, 22 bp, Homo sapiens
gccgagctctcctgggccaggg

SEQ ID NO: 328917 - DNA, 15 bp, Homo sapiens
gccgaggactttgat

SEQ ID NO: 328918 - DNA, 18 bp, Homo sapiens
gccgaggagccaggcaac

SEQ ID NO: 328919 - DNA, 19 bp, Homo sapiens
gccgagggaaatgctgttg

SEQ ID NO: 328920 - DNA, 16 bp, Homo sapiens
gccgagggtcctggct

SEQ ID NO: 328921 - DNA, 15 bp, Homo sapiens
gccgagtccaggagc

SEQ ID NO: 328922 - DNA, 13 bp, Homo sapiens
gccgatgagctgg

SEQ ID NO: 328923 - DNA, 21 bp, Homo sapiens
gccgatgggagtctccctccg

SEQ ID NO: 328924 - DNA, 20 bp, Homo sapiens
gccgatttcctaagctgttg

SEQ ID NO: 328925 - DNA, 16 bp, Homo sapiens
gccgcaccaccagcca

SEQ ID NO: 328926 - DNA, 21 bp, Homo sapiens
gccgcacctaaagcagccagc

SEQ ID NO: 328927 - DNA, 13 bp, Homo sapiens
gccgcagggcgct

SEQ ID NO: 328928 - DNA, 18 bp, Homo sapiens
gccgcagggcgctccggc

SEQ ID NO: 328929 - DNA, 14 bp, Homo sapiens
gccgcatggcccct

SEQ ID NO: 328930 - DNA, 17 bp, Homo sapiens
gccgcatggcccctcca

SEQ ID NO: 328931 - DNA, 14 bp, Homo sapiens
gccgcatgtctgca

SEQ ID NO: 328932 - DNA, 17 bp, Homo sapiens
gccgcatgtctgcatgg

SEQ ID NO: 328933 - DNA, 19 bp, Homo sapiens
gccgccactaggtgtcccc

SEQ ID NO: 328934 - DNA, 20 bp, Homo sapiens
gccgccactaggtgtcccca

SEQ ID NO: 328935 - DNA, 18 bp, Homo sapiens
gccgccattgccaccagg

SEQ ID NO: 328936 - DNA, 23 bp, Homo sapiens
cgctgccaccacgtctgccaggc

SEQ ID NO: 328937 - DNA, 17 bp, Homo sapiens
cgctgccagcacagagc

SEQ ID NO: 328938 - DNA, 14 bp, Homo sapiens
cgctgcccacacca

SEQ ID NO: 328939 - DNA, 19 bp, Homo sapiens
cgctgcccacaccaccgcc

SEQ ID NO: 328940 - DNA, 21 bp, Homo sapiens
cgctgcccacaccaccgccct

SEQ ID NO: 328941 - DNA, 10 bp, Homo sapiens
cgctgcccag

SEQ ID NO: 328942 - DNA, 20 bp, Homo sapiens
cgctgcccagccctcccagc

SEQ ID NO: 328943 - DNA, 10 bp, Homo sapiens
cgctgcctgg

SEQ ID NO: 328944 - DNA, 12 bp, Homo sapiens
cgctgcctggcg

SEQ ID NO: 328945 - DNA, 11 bp, Homo sapiens
cgctgctgcta

SEQ ID NO: 328946 - DNA, 15 bp, Homo sapiens
cgctgctgctgctgc

SEQ ID NO: 328947 - DNA, 12 bp, Homo sapiens
cgctgctgtgct

SEQ ID NO: 328948 - DNA, 18 bp, Homo sapiens
cgctggaatccagaagga

SEQ ID NO: 328949 - DNA, 20 bp, Homo sapiens
cgctggagcatgagctctgt

SEQ ID NO: 328950 - DNA, 14 bp, Homo sapiens
cgctggcttccagc

SEQ ID NO: 328951 - DNA, 18 bp, Homo sapiens
cgctgggacacagaccgg

SEQ ID NO: 328952 - DNA, 19 bp, Homo sapiens
cgctgggagaaaagccaga

SEQ ID NO: 328953 - DNA, 23 bp, Homo sapiens
cgctggtagagatggaggaggag

SEQ ID NO: 328954 - DNA, 23 bp, Homo sapiens
cgctgtcacccagcaaggcacag

SEQ ID NO: 328955 - DNA, 20 bp, Homo sapiens
cgctgtctccagacccccac

SEQ ID NO: 328956 - DNA, 15 bp, Homo sapiens
cgctgtgagtgagtg

SEQ ID NO: 328957 - DNA, 13 bp, Homo sapiens
cgctgtgccacca

SEQ ID NO: 328958 - DNA, 14 bp, Homo sapiens
cgctgtgccaccac

SEQ ID NO: 328959 - DNA, 15 bp, Homo sapiens
cgctgtgccaccacc

SEQ ID NO: 328960 - DNA, 18 bp, Homo sapiens
cgctgtgccaccacccct

SEQ ID NO: 328961 - DNA, 20 bp, Homo sapiens
cgctgtgccaccacccctcc

SEQ ID NO: 328962 - DNA, 15 bp, Homo sapiens
cgctgtgctccagca

SEQ ID NO: 328963 - DNA, 16 bp, Homo sapiens
cgctgtgctccagcag

SEQ ID NO: 328964 - DNA, 19 bp, Homo sapiens
cgctgtgctccagcagtgc

SEQ ID NO: 328965 - DNA, 14 bp, Homo sapiens
cgctgtgggcaggt

SEQ ID NO: 328966 - DNA, 14 bp, Homo sapiens
cgctgtgtccccgc

SEQ ID NO: 328967 - DNA, 17 bp, Homo sapiens
cgcttcacccctgcact

SEQ ID NO: 328968 - DNA, 16 bp, Homo sapiens
cgcttcataggcagag

SEQ ID NO: 328969 - DNA, 18 bp, Homo sapiens
cgcttgagcccaggagtt

SEQ ID NO: 328970 - DNA, 23 bp, Homo sapiens
cgcttgccgggcctgggcctcct

SEQ ID NO: 328971 - DNA, 22 bp, Homo sapiens
cgctttattgcccatgggatat

SEQ ID NO: 328972 - DNA, 17 bp, Homo sapiens
cgctttctacactgtat

SEQ ID NO: 328973 - DNA, 17 bp, Homo sapiens
cgctttctcctgtgccc

SEQ ID NO: 328974 - DNA, 21 bp, Homo sapiens
cgctttgctgctaccgccctg

SEQ ID NO: 328975 - DNA, 14 bp, Homo sapiens
cggaaacagaactc

SEQ ID NO: 328976 - DNA, 14 bp, Homo sapiens
cggaaagactgaaa

SEQ ID NO: 328977 - DNA, 14 bp, Homo sapiens
cggaacctggctgc

SEQ ID NO: 328978 - DNA, 17 bp, Homo sapiens
cggaactgcatgctgct

SEQ ID NO: 328979 - DNA, 18 bp, Homo sapiens
cggaactgcatgctgctg

SEQ ID NO: 328980 - DNA, 19 bp, Homo sapiens
cggaacttactgtgtaaat

SEQ ID NO: 328981 - DNA, 20 bp, Homo sapiens
cggaagcagtgccttccata

SEQ ID NO: 328982 - DNA, 22 bp, Homo sapiens
cggaagcagtgccttccataat

SEQ ID NO: 328983 - DNA, 14 bp, Homo sapiens
cggaagcctgtcct

SEQ ID NO: 328984 - DNA, 15 bp, Homo sapiens
cggaagcctgtcctc

SEQ ID NO: 328985 - DNA, 15 bp, Homo sapiens
cggaagctcctggta

SEQ ID NO: 328986 - DNA, 18 bp, Homo sapiens
cggaaggacctatgtttg

SEQ ID NO: 328987 - DNA, 19 bp, Homo sapiens
cggaaggacctatgtttgc

SEQ ID NO: 328988 - DNA, 21 bp, Homo sapiens
cggaaggggacgctttgaagg

SEQ ID NO: 328989 - DNA, 18 bp, Homo sapiens
cggaagtacttccctcag

SEQ ID NO: 328990 - DNA, 20 bp, Homo sapiens
cggaagtacttccctcaggc

SEQ ID NO: 328991 - DNA, 21 bp, Homo sapiens
cggaatcctgtcctcagcttc

SEQ ID NO: 328992 - DNA, 16 bp, Homo sapiens
cggaattgagaggtgg

SEQ ID NO: 328993 - DNA, 13 bp, Homo sapiens
cggacaagtttta

SEQ ID NO: 328994 - DNA, 21 bp, Homo sapiens
cggacaggaagcacagcaggt

SEQ ID NO: 328995 - DNA, 12 bp, Homo sapiens
cggacccacccc

SEQ ID NO: 328996 - DNA, 13 bp, Homo sapiens
cggacccacccca

SEQ ID NO: 328997 - DNA, 16 bp, Homo sapiens
cggacccaccccaact

SEQ ID NO: 328998 - DNA, 20 bp, Homo sapiens
cggacccaccccaactctcc

SEQ ID NO: 328999 - DNA, 21 bp, Homo sapiens
cggaccttggcagcccaggcc

SEQ ID NO: 329000 - DNA, 14 bp, Homo sapiens
cggacctttcagct

SEQ ID NO: 329001 - DNA, 15 bp, Homo sapiens
cggacgctggctccc

SEQ ID NO: 329002 - DNA, 14 bp, Homo sapiens
cggacgctggctcg

SEQ ID NO: 329003 - DNA, 18 bp, Homo sapiens
cggacgtttccatcaggt

SEQ ID NO: 329004 - DNA, 20 bp, Homo sapiens
cggactccatggcccttcct

SEQ ID NO: 329005 - DNA, 14 bp, Homo sapiens
cggactctttgctg

SEQ ID NO: 329006 - DNA, 16 bp, Homo sapiens
cggactctttgctgtt

SEQ ID NO: 329007 - DNA, 18 bp, Homo sapiens
cggactgcccccagaaag

SEQ ID NO: 329008 - DNA, 17 bp, Homo sapiens
cggagaaaggaagggct

SEQ ID NO: 329009 - DNA, 21 bp, Homo sapiens
cggagaacatctgccttgctg

SEQ ID NO: 329010 - DNA, 15 bp, Homo sapiens
cggagcacagccctg

SEQ ID NO: 329011 - DNA, 17 bp, Homo sapiens
cggagcacagccctggg

SEQ ID NO: 329012 - DNA, 18 bp, Homo sapiens
cggagcacagccctggga

SEQ ID NO: 329013 - DNA, 21 bp, Homo sapiens
cggagccaatgaacagctcct

SEQ ID NO: 329014 - DNA, 21 bp, Homo sapiens
cggagcccgatattctccctg

SEQ ID NO: 329015 - DNA, 15 bp, Homo sapiens
cggagcggctgagga

SEQ ID NO: 329016 - DNA, 20 bp, Homo sapiens
cggagctaacactggcccct

SEQ ID NO: 329017 - DNA, 22 bp, Homo sapiens
cggagctgcatggacgcctggc

SEQ ID NO: 329018 - DNA, 22 bp, Homo sapiens
cggaggacttgggggcagagca

SEQ ID NO: 329019 - DNA, 12 bp, Homo sapiens
cggaggcagcag

SEQ ID NO: 329020 - DNA, 16 bp, Homo sapiens
cggaggccacatgagt

SEQ ID NO: 329021 - DNA, 21 bp, Homo sapiens
cggaggccacatgagtcccag

SEQ ID NO: 329022 - DNA, 11 bp, Homo sapiens
cggaggccagg

SEQ ID NO: 329023 - DNA, 17 bp, Homo sapiens
cggaggccaggccctcc

SEQ ID NO: 329024 - DNA, 13 bp, Homo sapiens
cggaggccatggg

SEQ ID NO: 329025 - DNA, 15 bp, Homo sapiens
cggaggcgcccacct

SEQ ID NO: 329026 - DNA, 18 bp, Homo sapiens
cggaggcgcccacctgcc

SEQ ID NO: 329027 - DNA, 16 bp, Homo sapiens
cggaggcttgggaccg

SEQ ID NO: 329028 - DNA, 18 bp, Homo sapiens
cggagggaaccctgacta

SEQ ID NO: 329029 - DNA, 17 bp, Homo sapiens
cggaggggcttggagca

SEQ ID NO: 329030 - DNA, 16 bp, Homo sapiens
cggagttcctaacagg

SEQ ID NO: 329031 - DNA, 20 bp, Homo sapiens
cggagttcctaacaggatga

SEQ ID NO: 329032 - DNA, 15 bp, Homo sapiens
cggatctagccatgg

SEQ ID NO: 329033 - DNA, 12 bp, Homo sapiens
cggatctccagg

SEQ ID NO: 329034 - DNA, 13 bp, Homo sapiens
cggatctccaggc

SEQ ID NO: 329035 - DNA, 21 bp, Homo sapiens
cggatctccaggcccagcctg

SEQ ID NO: 329036 - DNA, 16 bp, Homo sapiens
cggatggaaggagaga

SEQ ID NO: 329037 - DNA, 19 bp, Homo sapiens
cggatggaaggagagaggt

SEQ ID NO: 329038 - DNA, 19 bp, Homo sapiens
cggattccggccctggctg

SEQ ID NO: 329039 - DNA, 12 bp, Homo sapiens
cggcaacctgta

SEQ ID NO: 329040 - DNA, 16 bp, Homo sapiens
cggcaatttccggcca

SEQ ID NO: 329041 - DNA, 18 bp, Homo sapiens
cggcacagggtctgctct

SEQ ID NO: 329042 - DNA, 20 bp, Homo sapiens
cggcacccacaagtgccact

SEQ ID NO: 329043 - DNA, 15 bp, Homo sapiens
cggcacccacccagc

SEQ ID NO: 329044 - DNA, 13 bp, Homo sapiens
cggcaccgcccac

SEQ ID NO: 329045 - DNA, 14 bp, Homo sapiens
cggcaccgcccacc

SEQ ID NO: 329046 - DNA, 21 bp, Homo sapiens
cggcaccgcccacccacaccc

SEQ ID NO: 329047 - DNA, 15 bp, Homo sapiens
cggcagaactctctg

SEQ ID NO: 329048 - DNA, 17 bp, Homo sapiens
cggcagaggcagggccc

SEQ ID NO: 329049 - DNA, 22 bp, Homo sapiens
cggcagaggcagggccctgggg

SEQ ID NO: 329050 - DNA, 24 bp, Homo sapiens
cggcagaggcagggccctggggtc

SEQ ID NO: 329051 - DNA, 19 bp, Homo sapiens
cggcagccccatccttccc

SEQ ID NO: 329052 - DNA, 18 bp, Homo sapiens
cggcagccccccagtgtc

SEQ ID NO: 329053 - DNA, 22 bp, Homo sapiens
cggcagccccccagtgtcccca

SEQ ID NO: 329054 - DNA, 14 bp, Homo sapiens
cggcagctcttctg

SEQ ID NO: 329055 - DNA, 16 bp, Homo sapiens
cggcagctcttctggg

SEQ ID NO: 329056 - DNA, 23 bp, Homo sapiens
cggcagctcttctgggcagagcc

SEQ ID NO: 329057 - DNA, 11 bp, Homo sapiens
cggcaggccct

SEQ ID NO: 329058 - DNA, 12 bp, Homo sapiens
cggcaggccctg

SEQ ID NO: 329059 - DNA, 14 bp, Homo sapiens
cggcaggccctgca

SEQ ID NO: 329060 - DNA, 23 bp, Homo sapiens
cggcaggggcccctcctctgtgc

SEQ ID NO: 329061 - DNA, 20 bp, Homo sapiens
cggcattcacacacagcctg

SEQ ID NO: 329062 - DNA, 21 bp, Homo sapiens
cggcattcacacacagcctgg

SEQ ID NO: 329063 - DNA, 15 bp, Homo sapiens
cggccaaggacactg

SEQ ID NO: 329064 - DNA, 16 bp, Homo sapiens
cggccaaggacactga

SEQ ID NO: 329065 - DNA, 16 bp, Homo sapiens
cggccacagctgctgg

SEQ ID NO: 329066 - DNA, 17 bp, Homo sapiens
cggccacagctgctgga

SEQ ID NO: 329067 - DNA, 22 bp, Homo sapiens
cctcttccccagaaaggagact

SEQ ID NO: 329068 - DNA, 12 bp, Homo sapiens
cctcttccccct

SEQ ID NO: 329069 - DNA, 13 bp, Homo sapiens
cctcttccctgtc

SEQ ID NO: 329070 - DNA, 15 bp, Homo sapiens
cctcttcctccctca

SEQ ID NO: 329071 - DNA, 15 bp, Homo sapiens
cctcttccttctcta

SEQ ID NO: 329072 - DNA, 24 bp, Homo sapiens
cctcttccttctctactcatgcca

SEQ ID NO: 329073 - DNA, 18 bp, Homo sapiens
cctcttctcaagtgcctt

SEQ ID NO: 329074 - DNA, 21 bp, Homo sapiens
cctcttctctgggcccagaga

SEQ ID NO: 329075 - DNA, 14 bp, Homo sapiens
cctcttgagcagtg

SEQ ID NO: 329076 - DNA, 23 bp, Homo sapiens
cctcttgccactgcctcttcctc

SEQ ID NO: 329077 - DNA, 23 bp, Homo sapiens
cctcttgccccccaccccagcct

SEQ ID NO: 329078 - DNA, 15 bp, Homo sapiens
cctcttgcctctctc

SEQ ID NO: 329079 - DNA, 12 bp, Homo sapiens
cctcttgctcaa

SEQ ID NO: 329080 - DNA, 15 bp, Homo sapiens
cctctttcccctcct

SEQ ID NO: 329081 - DNA, 21 bp, Homo sapiens
cctctttcctgtgccaggact

SEQ ID NO: 329082 - DNA, 15 bp, Homo sapiens
cctctttctctctgt

SEQ ID NO: 329083 - DNA, 17 bp, Homo sapiens
cctctttctctctgtgt

SEQ ID NO: 329084 - DNA, 18 bp, Homo sapiens
cctctttctctctgtgtg

SEQ ID NO: 329085 - DNA, 16 bp, Homo sapiens
cctctttgagtgaagc

SEQ ID NO: 329086 - DNA, 20 bp, Homo sapiens
cctctttgtgtttttgttgt

SEQ ID NO: 329087 - DNA, 15 bp, Homo sapiens
cctctttgttttgtt

SEQ ID NO: 329088 - DNA, 17 bp, Homo sapiens
cctcttttccctctcta

SEQ ID NO: 329089 - DNA, 15 bp, Homo sapiens
cctcttttggccttg

SEQ ID NO: 329090 - DNA, 21 bp, Homo sapiens
cctgaaaagatgttgtgtctt

SEQ ID NO: 329091 - DNA, 23 bp, Homo sapiens
cctgaaaatgtttttctgccagg

SEQ ID NO: 329092 - DNA, 14 bp, Homo sapiens
cctgaaagcctgtc

SEQ ID NO: 329093 - DNA, 17 bp, Homo sapiens
cctgaaagcctgtctct

SEQ ID NO: 329094 - DNA, 16 bp, Homo sapiens
cctgaaatgtttccag

SEQ ID NO: 329095 - DNA, 18 bp, Homo sapiens
cctgaacacttattgctt

SEQ ID NO: 329096 - DNA, 19 bp, Homo sapiens
cctgaacacttattgcttt

SEQ ID NO: 329097 - DNA, 15 bp, Homo sapiens
cctgaaccccatggg

SEQ ID NO: 329098 - DNA, 16 bp, Homo sapiens
cctgaaccccatgggc

SEQ ID NO: 329099 - DNA, 17 bp, Homo sapiens
cctgaagcctctgccct

SEQ ID NO: 329100 - DNA, 22 bp, Homo sapiens
cctgaagcctctgccctgcctc

SEQ ID NO: 329101 - DNA, 21 bp, Homo sapiens
cctgaaggaacattccttagt

SEQ ID NO: 329102 - DNA, 22 bp, Homo sapiens
cctgaagtcaaaccttaagata

SEQ ID NO: 329103 - DNA, 22 bp, Homo sapiens
cctgaagtctttgtacagacaa

SEQ ID NO: 329104 - DNA, 20 bp, Homo sapiens
cctgaatggttccatgcctg

SEQ ID NO: 329105 - DNA, 21 bp, Homo sapiens
cctgaatggttccatgcctga

SEQ ID NO: 329106 - DNA, 15 bp, Homo sapiens
cctgacaaatatttt

SEQ ID NO: 329107 - DNA, 13 bp, Homo sapiens
cctgacaatggca

SEQ ID NO: 329108 - DNA, 16 bp, Homo sapiens
cctgacaatggcagct

SEQ ID NO: 329109 - DNA, 17 bp, Homo sapiens
cctgacaatggcagcta

SEQ ID NO: 329110 - DNA, 15 bp, Homo sapiens
cctgacactgagccc

SEQ ID NO: 329111 - DNA, 15 bp, Homo sapiens
cctgacccctgcacc

SEQ ID NO: 329112 - DNA, 22 bp, Homo sapiens
cctgacccgtctaatatataaa

SEQ ID NO: 329113 - DNA, 14 bp, Homo sapiens
cctgaccctgcaga

SEQ ID NO: 329114 - DNA, 16 bp, Homo sapiens
cctgacctcactgtga

SEQ ID NO: 329115 - DNA, 19 bp, Homo sapiens
cctgacctcctggactgta

SEQ ID NO: 329116 - DNA, 20 bp, Homo sapiens
cctgacctcctggactgtag

SEQ ID NO: 329117 - DNA, 16 bp, Homo sapiens
cctgacctctgaagag

SEQ ID NO: 329118 - DNA, 20 bp, Homo sapiens
cctgacctctgaagagctga

SEQ ID NO: 329119 - DNA, 15 bp, Homo sapiens
cctgacctgtccagg

SEQ ID NO: 329120 - DNA, 21 bp, Homo sapiens
cctgaccttagcgttctggac

SEQ ID NO: 329121 - DNA, 18 bp, Homo sapiens
cctgacgccctgcgttgg

SEQ ID NO: 329122 - DNA, 20 bp, Homo sapiens
cctgacggcgcccccagtgt

SEQ ID NO: 329123 - DNA, 21 bp, Homo sapiens
cctgacggcgcccccagtgtg

SEQ ID NO: 329124 - DNA, 14 bp, Homo sapiens
cctgacttcccagc

SEQ ID NO: 329125 - DNA, 19 bp, Homo sapiens
cctgacttcccagctggca

SEQ ID NO: 329126 - DNA, 21 bp, Homo sapiens
cctgacttcccagctggcagc

SEQ ID NO: 329127 - DNA, 15 bp, Homo sapiens
cctgagaaagcccac

SEQ ID NO: 329128 - DNA, 18 bp, Homo sapiens
cctgagaaagcccacctg

SEQ ID NO: 329129 - DNA, 19 bp, Homo sapiens
cctgagaaggcgaggagag

SEQ ID NO: 329130 - DNA, 15 bp, Homo sapiens
cctgagaatttaatt

SEQ ID NO: 329131 - DNA, 21 bp, Homo sapiens
cctgagaccagttgggagcac

SEQ ID NO: 329132 - DNA, 14 bp, Homo sapiens
cctgagactccaga

SEQ ID NO: 329133 - DNA, 13 bp, Homo sapiens
cctgagattctgg

SEQ ID NO: 329134 - DNA, 17 bp, Homo sapiens
cctgagattctgggaaa

SEQ ID NO: 329135 - DNA, 22 bp, Homo sapiens
cctgagattctgggaaaggtgc

SEQ ID NO: 329136 - DNA, 21 bp, Homo sapiens
cctgagcagtctacttctgtg

SEQ ID NO: 329137 - DNA, 21 bp, Homo sapiens
cctgagccacagtggggccca

SEQ ID NO: 329138 - DNA, 15 bp, Homo sapiens
cctgagccccctgca

SEQ ID NO: 329139 - DNA, 17 bp, Homo sapiens
cctgagccccctgcacc

SEQ ID NO: 329140 - DNA, 18 bp, Homo sapiens
cctgagccccctgcaccc

SEQ ID NO: 329141 - DNA, 20 bp, Homo sapiens
cctgagccccctgcacccac

SEQ ID NO: 329142 - DNA, 15 bp, Homo sapiens
cctgagcctgcccca

SEQ ID NO: 329143 - DNA, 23 bp, Homo sapiens
cctgagccttagaatctgtagag

SEQ ID NO: 329144 - DNA, 14 bp, Homo sapiens
cctgagctccaccc

SEQ ID NO: 329145 - DNA, 16 bp, Homo sapiens
cctgagctccaccctc

SEQ ID NO: 329146 - DNA, 19 bp, Homo sapiens
cctgagctccaccctcccc

SEQ ID NO: 329147 - DNA, 22 bp, Homo sapiens
cctgagctccaccctcccctct

SEQ ID NO: 329148 - DNA, 12 bp, Homo sapiens
cctgagctcccc

SEQ ID NO: 329149 - DNA, 14 bp, Homo sapiens
cctgagctggggcc

SEQ ID NO: 329150 - DNA, 17 bp, Homo sapiens
cctgagctttccgggga

SEQ ID NO: 329151 - DNA, 16 bp, Homo sapiens
cctgagctttggacac

SEQ ID NO: 329152 - DNA, 17 bp, Homo sapiens
cctgagctttggacaca

SEQ ID NO: 329153 - DNA, 15 bp, Homo sapiens
cctgagctttggacg

SEQ ID NO: 329154 - DNA, 20 bp, Homo sapiens
cctgaggacctttctgagga

SEQ ID NO: 329155 - DNA, 16 bp, Homo sapiens
cctgaggactggagac

SEQ ID NO: 329156 - DNA, 15 bp, Homo sapiens
cctgaggatgagctg

SEQ ID NO: 329157 - DNA, 20 bp, Homo sapiens
cctgaggcccagcagagccg

SEQ ID NO: 329158 - DNA, 14 bp, Homo sapiens
cctgaggccttcca

SEQ ID NO: 329159 - DNA, 12 bp, Homo sapiens
cctgagggaagc

SEQ ID NO: 329160 - DNA, 13 bp, Homo sapiens
cctgagggaagcc

SEQ ID NO: 329161 - DNA, 16 bp, Homo sapiens
cctgagggaagcccac

SEQ ID NO: 329162 - DNA, 19 bp, Homo sapiens
cctgagggaagcccacccg

SEQ ID NO: 329163 - DNA, 20 bp, Homo sapiens
cctgagggaagcccacccgc

SEQ ID NO: 329164 - DNA, 14 bp, Homo sapiens
cctgagggcccctc

SEQ ID NO: 329165 - DNA, 21 bp, Homo sapiens
cctgagggcccctctgcccag

SEQ ID NO: 329166 - DNA, 18 bp, Homo sapiens
cctgaggggcatctgccc

SEQ ID NO: 329167 - DNA, 13 bp, Homo sapiens
cctgagggtggag

SEQ ID NO: 329168 - DNA, 14 bp, Homo sapiens
cctgaggtcatgca

SEQ ID NO: 329169 - DNA, 15 bp, Homo sapiens
cctgaggtcatgcat

SEQ ID NO: 329170 - DNA, 23 bp, Homo sapiens
cctgagtcagggcccagaggctg

SEQ ID NO: 329171 - DNA, 19 bp, Homo sapiens
cctgagtcggccccacatg

SEQ ID NO: 329172 - DNA, 12 bp, Homo sapiens
cctgagtgaaca

SEQ ID NO: 329173 - DNA, 19 bp, Homo sapiens
cctgagtgatcccatttct

SEQ ID NO: 329174 - DNA, 14 bp, Homo sapiens
cctgataagggaga

SEQ ID NO: 329175 - DNA, 18 bp, Homo sapiens
cctgataagggagaggga

SEQ ID NO: 329176 - DNA, 19 bp, Homo sapiens
cctgataagggagagggaa

SEQ ID NO: 329177 - DNA, 17 bp, Homo sapiens
cctgataataattgatc

SEQ ID NO: 329178 - DNA, 16 bp, Homo sapiens
cctgatagctacccac

SEQ ID NO: 329179 - DNA, 23 bp, Homo sapiens
cctgatagctacccacagagcaa

SEQ ID NO: 329180 - DNA, 14 bp, Homo sapiens
cctgatcccactcc

SEQ ID NO: 329181 - DNA, 22 bp, Homo sapiens
cctgatgaaaaatatgtgcttg

SEQ ID NO: 329182 - DNA, 13 bp, Homo sapiens
cctgatgcccctt

SEQ ID NO: 329183 - DNA, 18 bp, Homo sapiens
cctgatgcgtctacccag

SEQ ID NO: 329184 - DNA, 14 bp, Homo sapiens
cctgatgctccctc

SEQ ID NO: 329185 - DNA, 16 bp, Homo sapiens
cctgatgctccctccc

SEQ ID NO: 329186 - DNA, 19 bp, Homo sapiens
cctgatgctccctcccctg

SEQ ID NO: 329187 - DNA, 20 bp, Homo sapiens
cctgatgctccctcccctgc

SEQ ID NO: 329188 - DNA, 23 bp, Homo sapiens
cctgatgctccctcccctgccct

SEQ ID NO: 329189 - DNA, 14 bp, Homo sapiens
cctgatgctgcccc

SEQ ID NO: 329190 - DNA, 19 bp, Homo sapiens
cctgatgcttttgtctaat

SEQ ID NO: 329191 - DNA, 12 bp, Homo sapiens
cctgatggagag

SEQ ID NO: 329192 - DNA, 16 bp, Homo sapiens
cctgatggagaggaga

SEQ ID NO: 329193 - DNA, 21 bp, Homo sapiens
cctgatggcacttagctatca

SEQ ID NO: 329194 - DNA, 20 bp, Homo sapiens
cctgatggtcagctcccttc

SEQ ID NO: 329195 - DNA, 21 bp, Homo sapiens
cctgatggtcagctcccttct

SEQ ID NO: 329196 - DNA, 23 bp, Homo sapiens
cctgatggtcagctcccttctct

SEQ ID NO: 329197 - DNA, 14 bp, Homo sapiens
cctgattgctctgg

SEQ ID NO: 329198 - DNA, 14 bp, Homo sapiens
cctgcaaactcact

SEQ ID NO: 329199 - DNA, 17 bp, Homo sapiens
cctgcaaactcactgct

SEQ ID NO: 329200 - DNA, 18 bp, Homo sapiens
cctgcaacaccttgtttc

SEQ ID NO: 329201 - DNA, 15 bp, Homo sapiens
gccacgtgctggaga

SEQ ID NO: 329202 - DNA, 23 bp, Homo sapiens
gccactaccttctgacctcccca

SEQ ID NO: 329203 - DNA, 16 bp, Homo sapiens
gccactacctttgtcc

SEQ ID NO: 329204 - DNA, 21 bp, Homo sapiens
gccactagactcttcactgtt

SEQ ID NO: 329205 - DNA, 19 bp, Homo sapiens
gccactaggtgtccccaac

SEQ ID NO: 329206 - DNA, 20 bp, Homo sapiens
gccactcatattctgggctc

SEQ ID NO: 329207 - DNA, 16 bp, Homo sapiens
gccactccagacccct

SEQ ID NO: 329208 - DNA, 19 bp, Homo sapiens
gccactccagacccctggc

SEQ ID NO: 329209 - DNA, 20 bp, Homo sapiens
gccactccagacccctggct

SEQ ID NO: 329210 - DNA, 13 bp, Homo sapiens
gccactccctgag

SEQ ID NO: 329211 - DNA, 20 bp, Homo sapiens
gccactccctgagctttggg

SEQ ID NO: 329212 - DNA, 12 bp, Homo sapiens
gccactccctgc

SEQ ID NO: 329213 - DNA, 13 bp, Homo sapiens
gccactccctgcc

SEQ ID NO: 329214 - DNA, 20 bp, Homo sapiens
gccactccctgccaactcca

SEQ ID NO: 329215 - DNA, 22 bp, Homo sapiens
gccactcctgtcccgccttcct

SEQ ID NO: 329216 - DNA, 13 bp, Homo sapiens
gccactctcagag

SEQ ID NO: 329217 - DNA, 20 bp, Homo sapiens
gccactctgctctgcacatt

SEQ ID NO: 329218 - DNA, 15 bp, Homo sapiens
gccactgccaggcac

SEQ ID NO: 329219 - DNA, 18 bp, Homo sapiens
gccactgccaggcacctg

SEQ ID NO: 329220 - DNA, 21 bp, Homo sapiens
gccactgccaggcacctggcc

SEQ ID NO: 329221 - DNA, 21 bp, Homo sapiens
gccactgcccgagctggtgca

SEQ ID NO: 329222 - DNA, 18 bp, Homo sapiens
gccactgccctctccaca

SEQ ID NO: 329223 - DNA, 23 bp, Homo sapiens
gccactgccctctccacacccat

SEQ ID NO: 329224 - DNA, 22 bp, Homo sapiens
gccactgggattcatggctttg

SEQ ID NO: 329225 - DNA, 18 bp, Homo sapiens
gccactgggccccattct

SEQ ID NO: 329226 - DNA, 17 bp, Homo sapiens
gccactgtggccagagc

SEQ ID NO: 329227 - DNA, 15 bp, Homo sapiens
gccacttctccccag

SEQ ID NO: 329228 - DNA, 20 bp, Homo sapiens
gccacttcttaaaggcctgg

SEQ ID NO: 329229 - DNA, 19 bp, Homo sapiens
gccacttgcactgtgcttg

SEQ ID NO: 329230 - DNA, 16 bp, Homo sapiens
gccacttggtttttgg

SEQ ID NO: 329231 - DNA, 20 bp, Homo sapiens
gccacttggtttttggctct

SEQ ID NO: 329232 - DNA, 23 bp, Homo sapiens
gccacttttgactagggattcag

SEQ ID NO: 329233 - DNA, 14 bp, Homo sapiens
gccagaaccccgag

SEQ ID NO: 329234 - DNA, 13 bp, Homo sapiens
gccagaacttcga

SEQ ID NO: 329235 - DNA, 16 bp, Homo sapiens
gccagaaggagggcag

SEQ ID NO: 329236 - DNA, 17 bp, Homo sapiens
gccagaccagagctctg

SEQ ID NO: 329237 - DNA, 19 bp, Homo sapiens
gccagaccagagctctgga

SEQ ID NO: 329238 - DNA, 14 bp, Homo sapiens
gccagactggctgc

SEQ ID NO: 329239 - DNA, 20 bp, Homo sapiens
gccagactggctgcacagcc

SEQ ID NO: 329240 - DNA, 12 bp, Homo sapiens
gccagagaggag

SEQ ID NO: 329241 - DNA, 13 bp, Homo sapiens
gccagagaggagc

SEQ ID NO: 329242 - DNA, 19 bp, Homo sapiens
gccagagaggagcacctga

SEQ ID NO: 329243 - DNA, 23 bp, Homo sapiens
gccagagaggagcacctgaaccc

SEQ ID NO: 329244 - DNA, 19 bp, Homo sapiens
gccagagagggcccagctg

SEQ ID NO: 329245 - DNA, 17 bp, Homo sapiens
gccagagccttaataaa

SEQ ID NO: 329246 - DNA, 14 bp, Homo sapiens
gccagagctcccag

SEQ ID NO: 329247 - DNA, 16 bp, Homo sapiens
gccagagctcccagga

SEQ ID NO: 329248 - DNA, 18 bp, Homo sapiens
gccagagctcccaggacg

SEQ ID NO: 329249 - DNA, 20 bp, Homo sapiens
gccagagctggaaggcaggg

SEQ ID NO: 329250 - DNA, 23 bp, Homo sapiens
gccagagctggaaggcagggcag

SEQ ID NO: 329251 - DNA, 21 bp, Homo sapiens
gccagagctgggtggggacag

SEQ ID NO: 329252 - DNA, 15 bp, Homo sapiens
gccagagtggcctgg

SEQ ID NO: 329253 - DNA, 19 bp, Homo sapiens
gccagagtggcctggccag

SEQ ID NO: 329254 - DNA, 14 bp, Homo sapiens
gccagatggggcct

SEQ ID NO: 329255 - DNA, 17 bp, Homo sapiens
gccagatggggcctctg

SEQ ID NO: 329256 - DNA, 14 bp, Homo sapiens
gccagcaaggcagg

SEQ ID NO: 329257 - DNA, 15 bp, Homo sapiens
gccagcaaggcaggt

SEQ ID NO: 329258 - DNA, 14 bp, Homo sapiens
gccagcagggcggg

SEQ ID NO: 329259 - DNA, 17 bp, Homo sapiens
gccagcagggctgtgat

SEQ ID NO: 329260 - DNA, 17 bp, Homo sapiens
gccagccaccctaactg

SEQ ID NO: 329261 - DNA, 21 bp, Homo sapiens
gccagccagtcttgcctaggc

SEQ ID NO: 329262 - DNA, 12 bp, Homo sapiens
gccagccagtgg

SEQ ID NO: 329263 - DNA, 17 bp, Homo sapiens
gccagcccaaagctgga

SEQ ID NO: 329264 - DNA, 19 bp, Homo sapiens
gccagcccaaagctggagc

SEQ ID NO: 329265 - DNA, 14 bp, Homo sapiens
gccagcccagctcc

SEQ ID NO: 329266 - DNA, 16 bp, Homo sapiens
gccagcccctcccacc

SEQ ID NO: 329267 - DNA, 19 bp, Homo sapiens
gccagccctaggctaccct

SEQ ID NO: 329268 - DNA, 15 bp, Homo sapiens
gccagccctccctgg

SEQ ID NO: 329269 - DNA, 17 bp, Homo sapiens
gccagccctccctggct

SEQ ID NO: 329270 - DNA, 21 bp, Homo sapiens
gccagccctccctggctgtga

SEQ ID NO: 329271 - DNA, 16 bp, Homo sapiens
gccagcccttcccagg

SEQ ID NO: 329272 - DNA, 18 bp, Homo sapiens
gccagcccttcccaggcc

SEQ ID NO: 329273 - DNA, 20 bp, Homo sapiens
gccagcccttcccaggccag

SEQ ID NO: 329274 - DNA, 21 bp, Homo sapiens
gccagccgtgatgctcaggct

SEQ ID NO: 329275 - DNA, 18 bp, Homo sapiens
gccagcctcagtgccact

SEQ ID NO: 329276 - DNA, 20 bp, Homo sapiens
gccagcctgggactcccagt

SEQ ID NO: 329277 - DNA, 16 bp, Homo sapiens
gccagcctggggcctg

SEQ ID NO: 329278 - DNA, 17 bp, Homo sapiens
gccagcctggggcctgg

SEQ ID NO: 329279 - DNA, 21 bp, Homo sapiens
gccagccttcctctgcagctg

SEQ ID NO: 329280 - DNA, 22 bp, Homo sapiens
gccagcgaggcgaggctgcctc

SEQ ID NO: 329281 - DNA, 13 bp, Homo sapiens
gccagcgcatgtg

SEQ ID NO: 329282 - DNA, 15 bp, Homo sapiens
gccagcgcatgtgtc

SEQ ID NO: 329283 - DNA, 16 bp, Homo sapiens
gccagcgtggcgcagt

SEQ ID NO: 329284 - DNA, 17 bp, Homo sapiens
gccagctccacagggtg

SEQ ID NO: 329285 - DNA, 18 bp, Homo sapiens
gccagctccacagggtgg

SEQ ID NO: 329286 - DNA, 21 bp, Homo sapiens
gccagctcccccttgcccgcc

SEQ ID NO: 329287 - DNA, 22 bp, Homo sapiens
gccagctcccccttgcccgcca

SEQ ID NO: 329288 - DNA, 18 bp, Homo sapiens
gccagctccttttctgtg

SEQ ID NO: 329289 - DNA, 15 bp, Homo sapiens
gccagctgccttcct

SEQ ID NO: 329290 - DNA, 13 bp, Homo sapiens
gccagctggagaa

SEQ ID NO: 329291 - DNA, 13 bp, Homo sapiens
gccaggaagaatg

SEQ ID NO: 329292 - DNA, 20 bp, Homo sapiens
gccaggacaccgggcagggc

SEQ ID NO: 329293 - DNA, 16 bp, Homo sapiens
gccaggacagctgcag

SEQ ID NO: 329294 - DNA, 21 bp, Homo sapiens
gccaggacagctgcaggtgcc

SEQ ID NO: 329295 - DNA, 14 bp, Homo sapiens
gccaggagaccctg

SEQ ID NO: 329296 - DNA, 16 bp, Homo sapiens
gccaggagaccctgtc

SEQ ID NO: 329297 - DNA, 10 bp, Homo sapiens
gccaggagca

SEQ ID NO: 329298 - DNA, 16 bp, Homo sapiens
gccaggagcctcctga

SEQ ID NO: 329299 - DNA, 19 bp, Homo sapiens
gccaggaggcggcagctct

SEQ ID NO: 329300 - DNA, 23 bp, Homo sapiens
gccaggaggctttaagctccagc

SEQ ID NO: 329301 - DNA, 19 bp, Homo sapiens
gccaggaggttggtgactg

SEQ ID NO: 329302 - DNA, 23 bp, Homo sapiens
gccaggaggttggtgactgaaac

SEQ ID NO: 329303 - DNA, 16 bp, Homo sapiens
gccaggagtctgtgct

SEQ ID NO: 329304 - DNA, 22 bp, Homo sapiens
gccaggagtgggtgggacacag

SEQ ID NO: 329305 - DNA, 22 bp, Homo sapiens
gccaggatggcgtgtcccctgc

SEQ ID NO: 329306 - DNA, 15 bp, Homo sapiens
gccaggcacctggcc

SEQ ID NO: 329307 - DNA, 17 bp, Homo sapiens
gccaggcacctggcctg

SEQ ID NO: 329308 - DNA, 20 bp, Homo sapiens
gccaggcacctggcctgctg

SEQ ID NO: 329309 - DNA, 21 bp, Homo sapiens
gccaggcacctggcctgctgg

SEQ ID NO: 329310 - DNA, 23 bp, Homo sapiens
gccaggcacctggcctgctggga

SEQ ID NO: 329311 - DNA, 19 bp, Homo sapiens
gccaggcactgccttctcc

SEQ ID NO: 329312 - DNA, 10 bp, Homo sapiens
gccaggcagg

SEQ ID NO: 329313 - DNA, 14 bp, Homo sapiens
gccaggcaggaggc

SEQ ID NO: 329314 - DNA, 20 bp, Homo sapiens
gccaggcagggagtgtctgc

SEQ ID NO: 329315 - DNA, 14 bp, Homo sapiens
gccaggccatggcc

SEQ ID NO: 329316 - DNA, 17 bp, Homo sapiens
gccaggcccatctcagg

SEQ ID NO: 329317 - DNA, 19 bp, Homo sapiens
gcccacaccaccgccctcc

SEQ ID NO: 329318 - DNA, 20 bp, Homo sapiens
gcccacaccaccgccctcct

SEQ ID NO: 329319 - DNA, 12 bp, Homo sapiens
gcccacacctgc

SEQ ID NO: 329320 - DNA, 18 bp, Homo sapiens
gcccacagacagatccca

SEQ ID NO: 329321 - DNA, 18 bp, Homo sapiens
gcccacagagtctgtgtg

SEQ ID NO: 329322 - DNA, 17 bp, Homo sapiens
gcccacagcccgcatgc

SEQ ID NO: 329323 - DNA, 17 bp, Homo sapiens
gcccacaggtgtcccca

SEQ ID NO: 329324 - DNA, 18 bp, Homo sapiens
gcccacaggtgtccccag

SEQ ID NO: 329325 - DNA, 15 bp, Homo sapiens
gcccacagtgctcag

SEQ ID NO: 329326 - DNA, 18 bp, Homo sapiens
gcccaccacaactaacaa

SEQ ID NO: 329327 - DNA, 12 bp, Homo sapiens
gcccaccagacc

SEQ ID NO: 329328 - DNA, 14 bp, Homo sapiens
gcccaccagacctg

SEQ ID NO: 329329 - DNA, 18 bp, Homo sapiens
gcccaccatgcacccctg

SEQ ID NO: 329330 - DNA, 15 bp, Homo sapiens
gcccacccacacccc

SEQ ID NO: 329331 - DNA, 17 bp, Homo sapiens
gcccacccagggcccgg

SEQ ID NO: 329332 - DNA, 14 bp, Homo sapiens
gcccacccccctca

SEQ ID NO: 329333 - DNA, 16 bp, Homo sapiens
gcccaccccgctgcct

SEQ ID NO: 329334 - DNA, 17 bp, Homo sapiens
gcccaccccgctgcctg

SEQ ID NO: 329335 - DNA, 18 bp, Homo sapiens
gcccaccccgctgcctgg

SEQ ID NO: 329336 - DNA, 21 bp, Homo sapiens
gcccaccccgctgcctggcgg

SEQ ID NO: 329337 - DNA, 19 bp, Homo sapiens
gcccacccgtggagatggg

SEQ ID NO: 329338 - DNA, 20 bp, Homo sapiens
gcccacccgtgttctcctcc

SEQ ID NO: 329339 - DNA, 19 bp, Homo sapiens
gcccaccctgctcctcctg

SEQ ID NO: 329340 - DNA, 18 bp, Homo sapiens
gcccaccctgctgccttc

SEQ ID NO: 329341 - DNA, 22 bp, Homo sapiens
gcccaccctgggatgggccacc

SEQ ID NO: 329342 - DNA, 17 bp, Homo sapiens
gcccaccctgggcctcc

SEQ ID NO: 329343 - DNA, 18 bp, Homo sapiens
ccgtctggcgagccctta

SEQ ID NO: 329344 - DNA, 17 bp, Homo sapiens
ccgtcttcaatctctgt

SEQ ID NO: 329345 - DNA, 21 bp, Homo sapiens
ccgtcttcaatctctgttctg

SEQ ID NO: 329346 - DNA, 23 bp, Homo sapiens
ccgtctttggttcctcatggctg

SEQ ID NO: 329347 - DNA, 16 bp, Homo sapiens
ccgtgaagcagtgcct

SEQ ID NO: 329348 - DNA, 21 bp, Homo sapiens
ccgtgagcagtgtgtctcctg

SEQ ID NO: 329349 - DNA, 13 bp, Homo sapiens
ccgtgagccaaga

SEQ ID NO: 329350 - DNA, 17 bp, Homo sapiens
ccgtgatgctcaggctt

SEQ ID NO: 329351 - DNA, 19 bp, Homo sapiens
ccgtgatttggaagagagg

SEQ ID NO: 329352 - DNA, 22 bp, Homo sapiens
ccgtgatttggaagagaggcac

SEQ ID NO: 329353 - DNA, 15 bp, Homo sapiens
ccgtgcacggggcca

SEQ ID NO: 329354 - DNA, 17 bp, Homo sapiens
ccgtgcagactggaggg

SEQ ID NO: 329355 - DNA, 19 bp, Homo sapiens
ccgtgcagactggagggga

SEQ ID NO: 329356 - DNA, 12 bp, Homo sapiens
ccgtgcagctgg

SEQ ID NO: 329357 - DNA, 16 bp, Homo sapiens
ccgtgcccgcccacct

SEQ ID NO: 329358 - DNA, 15 bp, Homo sapiens
ccgtgccttcagctc

SEQ ID NO: 329359 - DNA, 19 bp, Homo sapiens
ccgtgcggcccgtgcgcag

SEQ ID NO: 329360 - DNA, 20 bp, Homo sapiens
ccgtgcggcccgtgcgcagc

SEQ ID NO: 329361 - DNA, 20 bp, Homo sapiens
ccgtggattgcacgtggcct

SEQ ID NO: 329362 - DNA, 23 bp, Homo sapiens
ccgtggattgcacgtggcctctt

SEQ ID NO: 329363 - DNA, 11 bp, Homo sapiens
ccgtggcttcc

SEQ ID NO: 329364 - DNA, 23 bp, Homo sapiens
ccgtggcttcccgctcagccctc

SEQ ID NO: 329365 - DNA, 15 bp, Homo sapiens
ccgtggctttggttt

SEQ ID NO: 329366 - DNA, 24 bp, Homo sapiens
ccgtggtcagagggactgtcagct

SEQ ID NO: 329367 - DNA, 23 bp, Homo sapiens
ccgtgtattcaggaccccatctg

SEQ ID NO: 329368 - DNA, 11 bp, Homo sapiens
ccgtgtcccaa

SEQ ID NO: 329369 - DNA, 16 bp, Homo sapiens
ccgtgtcccaaggagc

SEQ ID NO: 329370 - DNA, 15 bp, Homo sapiens
ccgtgtctggatgca

SEQ ID NO: 329371 - DNA, 14 bp, Homo sapiens
ccgtgtgccccaag

SEQ ID NO: 329372 - DNA, 13 bp, Homo sapiens
ccgttaatttaaa

SEQ ID NO: 329373 - DNA, 19 bp, Homo sapiens
ccgttcccacctctgagga

SEQ ID NO: 329374 - DNA, 13 bp, Homo sapiens
ccgttccctgtca

SEQ ID NO: 329375 - DNA, 15 bp, Homo sapiens
ccgttccctgtcaga

SEQ ID NO: 329376 - DNA, 23 bp, Homo sapiens
ccgttctgctggcctggatctcc

SEQ ID NO: 329377 - DNA, 16 bp, Homo sapiens
ccgttgacgtgaccaa

SEQ ID NO: 329378 - DNA, 23 bp, Homo sapiens
cctaggagctggggagggagaga

SEQ ID NO: 329379 - DNA, 13 bp, Homo sapiens
cctaggagttgag

SEQ ID NO: 329380 - DNA, 16 bp, Homo sapiens
cctaggattcctcccc

SEQ ID NO: 329381 - DNA, 17 bp, Homo sapiens
cctaggattcctccccc

SEQ ID NO: 329382 - DNA, 22 bp, Homo sapiens
cctaggccaaatgcacaagctc

SEQ ID NO: 329383 - DNA, 20 bp, Homo sapiens
cctaggcgcggttcaggtca

SEQ ID NO: 329384 - DNA, 14 bp, Homo sapiens
cctaggcgggcggt

SEQ ID NO: 329385 - DNA, 15 bp, Homo sapiens
cctaggggtcaggga

SEQ ID NO: 329386 - DNA, 22 bp, Homo sapiens
cctagggttgcttgggccactg

SEQ ID NO: 329387 - DNA, 19 bp, Homo sapiens
cctaggtctccacccctca

SEQ ID NO: 329388 - DNA, 21 bp, Homo sapiens
cctaggtctccacccctcaag

SEQ ID NO: 329389 - DNA, 19 bp, Homo sapiens
cctaggtgggtcaactcca

SEQ ID NO: 329390 - DNA, 22 bp, Homo sapiens
cctaggtgggtcaactccaagg

SEQ ID NO: 329391 - DNA, 17 bp, Homo sapiens
cctagtactctctgctc

SEQ ID NO: 329392 - DNA, 18 bp, Homo sapiens
cctagtactctctgctct

SEQ ID NO: 329393 - DNA, 23 bp, Homo sapiens
cctagtactctctgctctagcca

SEQ ID NO: 329394 - DNA, 16 bp, Homo sapiens
cctagtatacccactg

SEQ ID NO: 329395 - DNA, 14 bp, Homo sapiens
cctagtatctggct

SEQ ID NO: 329396 - DNA, 21 bp, Homo sapiens
cctagtcagatggatgtagat

SEQ ID NO: 329397 - DNA, 16 bp, Homo sapiens
cctagtcagccacatg

SEQ ID NO: 329398 - DNA, 18 bp, Homo sapiens
cctagtgacccggaggcc

SEQ ID NO: 329399 - DNA, 20 bp, Homo sapiens
cctagtgacccggaggccac

SEQ ID NO: 329400 - DNA, 18 bp, Homo sapiens
cctagtggcttcagcccc

SEQ ID NO: 329401 - DNA, 17 bp, Homo sapiens
cctagtgggagcccagc

SEQ ID NO: 329402 - DNA, 12 bp, Homo sapiens
cctagtggggag

SEQ ID NO: 329403 - DNA, 20 bp, Homo sapiens
cctagtgtctattccctgga

SEQ ID NO: 329404 - DNA, 17 bp, Homo sapiens
cctagttacccacccta

SEQ ID NO: 329405 - DNA, 20 bp, Homo sapiens
cctataaatggacttgcttc

SEQ ID NO: 329406 - DNA, 19 bp, Homo sapiens
cctataacccctgcctgga

SEQ ID NO: 329407 - DNA, 13 bp, Homo sapiens
cctatagagaggg

SEQ ID NO: 329408 - DNA, 21 bp, Homo sapiens
cctatagagagggggctctcc

SEQ ID NO: 329409 - DNA, 15 bp, Homo sapiens
cctatcacctcccct

SEQ ID NO: 329410 - DNA, 16 bp, Homo sapiens
cctatcacctcccctc

SEQ ID NO: 329411 - DNA, 23 bp, Homo sapiens
cctatcatcagttaggattaggt

SEQ ID NO: 329412 - DNA, 12 bp, Homo sapiens
cctatccatcct

SEQ ID NO: 329413 - DNA, 23 bp, Homo sapiens
cctatccatcctgcgagctcctt

SEQ ID NO: 329414 - DNA, 17 bp, Homo sapiens
cctatcctgcaccctct

SEQ ID NO: 329415 - DNA, 18 bp, Homo sapiens
cctatcctgcaccctctg

SEQ ID NO: 329416 - DNA, 16 bp, Homo sapiens
cctatcctgttcttcc

SEQ ID NO: 329417 - DNA, 16 bp, Homo sapiens
cctatccttggagagc

SEQ ID NO: 329418 - DNA, 18 bp, Homo sapiens
cctatccttggagagcag

SEQ ID NO: 329419 - DNA, 13 bp, Homo sapiens
cctatccttggca

SEQ ID NO: 329420 - DNA, 14 bp, Homo sapiens
cctatccttggcac

SEQ ID NO: 329421 - DNA, 19 bp, Homo sapiens
cctatccttggcaccaaag

SEQ ID NO: 329422 - DNA, 17 bp, Homo sapiens
cctatcgatctggaaag

SEQ ID NO: 329423 - DNA, 16 bp, Homo sapiens
cctatctcgtgggaga

SEQ ID NO: 329424 - DNA, 21 bp, Homo sapiens
cctatgagatggccatgctca

SEQ ID NO: 329425 - DNA, 20 bp, Homo sapiens
cctatgccacctgcagcgtc

SEQ ID NO: 329426 - DNA, 15 bp, Homo sapiens
cctatgcccaggtac

SEQ ID NO: 329427 - DNA, 20 bp, Homo sapiens
cctatgcccaggtaccaccc

SEQ ID NO: 329428 - DNA, 15 bp, Homo sapiens
cctatgcctgtggtg

SEQ ID NO: 329429 - DNA, 21 bp, Homo sapiens
cctatggaaagggtgtggctt

SEQ ID NO: 329430 - DNA, 18 bp, Homo sapiens
cctatggagcctctgcag

SEQ ID NO: 329431 - DNA, 23 bp, Homo sapiens
cctatgtactctacgccaaagtg

SEQ ID NO: 329432 - DNA, 24 bp, Homo sapiens
cctatgtactctacgccaaagtgc

SEQ ID NO: 329433 - DNA, 19 bp, Homo sapiens
cctatgtacttaatccttt

SEQ ID NO: 329434 - DNA, 15 bp, Homo sapiens
cctatgtcatttcta

SEQ ID NO: 329435 - DNA, 14 bp, Homo sapiens
cctatgtcctaagg

SEQ ID NO: 329436 - DNA, 20 bp, Homo sapiens
cctatgtcctaaggacacac

SEQ ID NO: 329437 - DNA, 24 bp, Homo sapiens
cctatgtcctaaggacacactaat

SEQ ID NO: 329438 - DNA, 16 bp, Homo sapiens
cctatgtggcagctgg

SEQ ID NO: 329439 - DNA, 16 bp, Homo sapiens
cctattaatcttcagc

SEQ ID NO: 329440 - DNA, 19 bp, Homo sapiens
cctattgccaggaatgttt

SEQ ID NO: 329441 - DNA, 12 bp, Homo sapiens
cctatttaagcc

SEQ ID NO: 329442 - DNA, 17 bp, Homo sapiens
cctattttcttttccat

SEQ ID NO: 329443 - DNA, 16 bp, Homo sapiens
cctcaacaagggagag

SEQ ID NO: 329444 - DNA, 17 bp, Homo sapiens
cctcaacaagggagaga

SEQ ID NO: 329445 - DNA, 18 bp, Homo sapiens
cctcaaccctccctcagc

SEQ ID NO: 329446 - DNA, 21 bp, Homo sapiens
cctcaaccctccctcagcccc

SEQ ID NO: 329447 - DNA, 21 bp, Homo sapiens
cctcaactcacctaatgttta

SEQ ID NO: 329448 - DNA, 13 bp, Homo sapiens
cctcaagcaacca

SEQ ID NO: 329449 - DNA, 12 bp, Homo sapiens
cctcaagcaagg

SEQ ID NO: 329450 - DNA, 19 bp, Homo sapiens
cctcaagccaggagaccct

SEQ ID NO: 329451 - DNA, 13 bp, Homo sapiens
cctcaaggacttg

SEQ ID NO: 329452 - DNA, 12 bp, Homo sapiens
cctcaagggctt

SEQ ID NO: 329453 - DNA, 15 bp, Homo sapiens
cctcaagtcttgaca

SEQ ID NO: 329454 - DNA, 12 bp, Homo sapiens
cctcaagttcaa

SEQ ID NO: 329455 - DNA, 13 bp, Homo sapiens
cctcaagttcaat

SEQ ID NO: 329456 - DNA, 14 bp, Homo sapiens
cctcaatgccctgc

SEQ ID NO: 329457 - DNA, 13 bp, Homo sapiens
cctcacaactcct

SEQ ID NO: 329458 - DNA, 14 bp, Homo sapiens
cctcacaactcctt

SEQ ID NO: 329459 - DNA, 15 bp, Homo sapiens
cctcacaagcctctt

SEQ ID NO: 329460 - DNA, 22 bp, Homo sapiens
cctcacacacacagctgggcaa

SEQ ID NO: 329461 - DNA, 18 bp, Homo sapiens
cctcacagcctaggacca

SEQ ID NO: 329462 - DNA, 18 bp, Homo sapiens
cctcacagcctctccctt

SEQ ID NO: 329463 - DNA, 19 bp, Homo sapiens
cctcaccaataacttcaga

SEQ ID NO: 329464 - DNA, 14 bp, Homo sapiens
cctcacccagaagg

SEQ ID NO: 329465 - DNA, 14 bp, Homo sapiens
cctcaccccagtgc

SEQ ID NO: 329466 - DNA, 20 bp, Homo sapiens
cctcacccccacccctgtac

SEQ ID NO: 329467 - DNA, 19 bp, Homo sapiens
cctcaccccgttacagctc

SEQ ID NO: 329468 - DNA, 16 bp, Homo sapiens
cctcacccgctgccca

SEQ ID NO: 329469 - DNA, 17 bp, Homo sapiens
cctcacccgctgcccag

SEQ ID NO: 329470 - DNA, 14 bp, Homo sapiens
cctcaccctgcctt

SEQ ID NO: 329471 - DNA, 15 bp, Homo sapiens
cctcaccctgcctta

SEQ ID NO: 329472 - DNA, 12 bp, Homo sapiens
cctcaccctgct

SEQ ID NO: 329473 - DNA, 13 bp, Homo sapiens
cctcacctcagga

SEQ ID NO: 329474 - DNA, 20 bp, Homo sapiens
cctcacctctggactggcta

SEQ ID NO: 329475 - DNA, 19 bp, Homo sapiens
cctcacctggcttcccagg

SEQ ID NO: 329476 - DNA, 18 bp, Homo sapiens
cctcacctgggcacctgg

SEQ ID NO: 329477 - DNA, 18 bp, Homo sapiens
cctcacctgggcctttcc

SEQ ID NO: 329478 - DNA, 14 bp, Homo sapiens
cctcacctgtctag

SEQ ID NO: 329479 - DNA, 17 bp, Homo sapiens
cctcaccttgcaacaca

SEQ ID NO: 329480 - DNA, 18 bp, Homo sapiens
cctcaccttgcaacacac

SEQ ID NO: 329481 - DNA, 22 bp, Homo sapiens
cctcaccttgcaacacacagac

SEQ ID NO: 329482 - DNA, 15 bp, Homo sapiens
cctcacgctctggac

SEQ ID NO: 329483 - DNA, 18 bp, Homo sapiens
cctcacggggttggctgt

SEQ ID NO: 329484 - DNA, 17 bp, Homo sapiens
cctcactattcaagtat

SEQ ID NO: 329485 - DNA, 17 bp, Homo sapiens
cctcactccactcccct

SEQ ID NO: 329486 - DNA, 22 bp, Homo sapiens
cctcactccactcccctcatcc

SEQ ID NO: 329487 - DNA, 23 bp, Homo sapiens
cctcactccactcccctcatcca

SEQ ID NO: 329488 - DNA, 15 bp, Homo sapiens
cctcactctgccagg

SEQ ID NO: 329489 - DNA, 16 bp, Homo sapiens
cctcactctgccaggg

SEQ ID NO: 329490 - DNA, 22 bp, Homo sapiens
cctcactctgccagggcagtgc

SEQ ID NO: 329491 - DNA, 15 bp, Homo sapiens
cctcactcttcctca

SEQ ID NO: 329492 - DNA, 20 bp, Homo sapiens
cctcactgcccgcacaccct

SEQ ID NO: 329493 - DNA, 22 bp, Homo sapiens
cctcactgcccgcacaccctca

SEQ ID NO: 329494 - DNA, 14 bp, Homo sapiens
cctcactgccctcc

SEQ ID NO: 329495 - DNA, 14 bp, Homo sapiens
cctcactggatgaa

SEQ ID NO: 329496 - DNA, 13 bp, Homo sapiens
cctcactggctgg

SEQ ID NO: 329497 - DNA, 16 bp, Homo sapiens
cctcactggctggggc

SEQ ID NO: 329498 - DNA, 12 bp, Homo sapiens
cctcactgggtg

SEQ ID NO: 329499 - DNA, 17 bp, Homo sapiens
cctcactggtgcattta

SEQ ID NO: 329500 - DNA, 20 bp, Homo sapiens
cctcagaccaactctctcct

SEQ ID NO: 329501 - DNA, 22 bp, Homo sapiens
cctcagacttaccaggaagcag

SEQ ID NO: 329502 - DNA, 15 bp, Homo sapiens
cctcagagccccgca

SEQ ID NO: 329503 - DNA, 17 bp, Homo sapiens
cctcagagccctgccct

SEQ ID NO: 329504 - DNA, 15 bp, Homo sapiens
cctcagagtccaggc

SEQ ID NO: 329505 - DNA, 19 bp, Homo sapiens
cctcagagtccaggcccca

SEQ ID NO: 329506 - DNA, 17 bp, Homo sapiens
cctcagatgaaaataaa

SEQ ID NO: 329507 - DNA, 21 bp, Homo sapiens
cctcagatgaaaataaaataa

SEQ ID NO: 329508 - DNA, 22 bp, Homo sapiens
cctcctcacctctggactggct

SEQ ID NO: 329509 - DNA, 20 bp, Homo sapiens
cctcctcagtctttggggga

SEQ ID NO: 329510 - DNA, 15 bp, Homo sapiens
cctcctccacaccag

SEQ ID NO: 329511 - DNA, 20 bp, Homo sapiens
cctcctccacagtgctgctt

SEQ ID NO: 329512 - DNA, 12 bp, Homo sapiens
cctcctccactc

SEQ ID NO: 329513 - DNA, 15 bp, Homo sapiens
cctcctccactcact

SEQ ID NO: 329514 - DNA, 15 bp, Homo sapiens
cctcctccactccac

SEQ ID NO: 329515 - DNA, 12 bp, Homo sapiens
cctcctccagta

SEQ ID NO: 329516 - DNA, 14 bp, Homo sapiens
cctcctcccatctc

SEQ ID NO: 329517 - DNA, 15 bp, Homo sapiens
cctcctcccatctcc

SEQ ID NO: 329518 - DNA, 13 bp, Homo sapiens
cctcctcccctcc

SEQ ID NO: 329519 - DNA, 18 bp, Homo sapiens
cctcctcccctcctcttc

SEQ ID NO: 329520 - DNA, 16 bp, Homo sapiens
cctcctcctcctcctg

SEQ ID NO: 329521 - DNA, 14 bp, Homo sapiens
cctcctcctgttcc

SEQ ID NO: 329522 - DNA, 16 bp, Homo sapiens
cctcctcgctgtgcca

SEQ ID NO: 329523 - DNA, 14 bp, Homo sapiens
cctcctcgggcgcc

SEQ ID NO: 329524 - DNA, 20 bp, Homo sapiens
cctcctcgggcgcctgcgct

SEQ ID NO: 329525 - DNA, 21 bp, Homo sapiens
cctcctctaacaggggctggt

SEQ ID NO: 329526 - DNA, 14 bp, Homo sapiens
cctcctctcctcgt

SEQ ID NO: 329527 - DNA, 12 bp, Homo sapiens
cctcctctgccc

SEQ ID NO: 329528 - DNA, 14 bp, Homo sapiens
cctcctctgccccc

SEQ ID NO: 329529 - DNA, 23 bp, Homo sapiens
cctcctctgccccctcccccgca

SEQ ID NO: 329530 - DNA, 15 bp, Homo sapiens
cctcctctgtcctca

SEQ ID NO: 329531 - DNA, 13 bp, Homo sapiens
cctcctctgtgct

SEQ ID NO: 329532 - DNA, 15 bp, Homo sapiens
cctcctctgtgctcc

SEQ ID NO: 329533 - DNA, 14 bp, Homo sapiens
cctcctcttcaccc

SEQ ID NO: 329534 - DNA, 22 bp, Homo sapiens
cctcctcttcaccccggcaggc

SEQ ID NO: 329535 - DNA, 22 bp, Homo sapiens
cctcctcttcccttagcctctc

SEQ ID NO: 329536 - DNA, 16 bp, Homo sapiens
cctcctcttggagctg

SEQ ID NO: 329537 - DNA, 20 bp, Homo sapiens
cctcctgaaacttacacaca

SEQ ID NO: 329538 - DNA, 12 bp, Homo sapiens
cctcctgaaccc

SEQ ID NO: 329539 - DNA, 15 bp, Homo sapiens
cctcctgaagcctct

SEQ ID NO: 329540 - DNA, 13 bp, Homo sapiens
cctcctgagcctg

SEQ ID NO: 329541 - DNA, 14 bp, Homo sapiens
cctcctgagcctgt

SEQ ID NO: 329542 - DNA, 18 bp, Homo sapiens
cctcctgagcctgtgggt

SEQ ID NO: 329543 - DNA, 20 bp, Homo sapiens
cctcctgatggccaagagca

SEQ ID NO: 329544 - DNA, 15 bp, Homo sapiens
cctcctgcaggctgg

SEQ ID NO: 329545 - DNA, 21 bp, Homo sapiens
cctcctgcaggctggctgttg

SEQ ID NO: 329546 - DNA, 17 bp, Homo sapiens
cctcctgccccctgcca

SEQ ID NO: 329547 - DNA, 22 bp, Homo sapiens
cctcctgctggctgaggcttgg

SEQ ID NO: 329548 - DNA, 23 bp, Homo sapiens
cctcctgctggctgaggcttggg

SEQ ID NO: 329549 - DNA, 15 bp, Homo sapiens
cctcctggaatggag

SEQ ID NO: 329550 - DNA, 12 bp, Homo sapiens
cctcctggaccc

SEQ ID NO: 329551 - DNA, 18 bp, Homo sapiens
cctcctggacccagcagg

SEQ ID NO: 329552 - DNA, 19 bp, Homo sapiens
cctcctggacccagcaggg

SEQ ID NO: 329553 - DNA, 21 bp, Homo sapiens
cctcctggacccagcaggggc

SEQ ID NO: 329554 - DNA, 20 bp, Homo sapiens
cctcctggagcagcagctga

SEQ ID NO: 329555 - DNA, 15 bp, Homo sapiens
cctcctggctcacag

SEQ ID NO: 329556 - DNA, 23 bp, Homo sapiens
cctcctgggaaggagggagctgc

SEQ ID NO: 329557 - DNA, 20 bp, Homo sapiens
cctcctgggcatgtttgtct

SEQ ID NO: 329558 - DNA, 22 bp, Homo sapiens
cctcctgggcatgtttgtctgt

SEQ ID NO: 329559 - DNA, 18 bp, Homo sapiens
cctcctgggcccaggcag

SEQ ID NO: 329560 - DNA, 19 bp, Homo sapiens
cctcctggtaacagctatg

SEQ ID NO: 329561 - DNA, 21 bp, Homo sapiens
cctcctgtctcctctgtcagt

SEQ ID NO: 329562 - DNA, 16 bp, Homo sapiens
cctcctgtttgcaggc

SEQ ID NO: 329563 - DNA, 18 bp, Homo sapiens
cctccttagccctgtctg

SEQ ID NO: 329564 - DNA, 16 bp, Homo sapiens
cctccttatttatcaa

SEQ ID NO: 329565 - DNA, 17 bp, Homo sapiens
cctccttccacctccct

SEQ ID NO: 329566 - DNA, 12 bp, Homo sapiens
cctccttcccgc

SEQ ID NO: 329567 - DNA, 13 bp, Homo sapiens
cctccttcccgcc

SEQ ID NO: 329568 - DNA, 21 bp, Homo sapiens
cctccttcccgccgcccgacc

SEQ ID NO: 329569 - DNA, 12 bp, Homo sapiens
cctccttctccc

SEQ ID NO: 329570 - DNA, 20 bp, Homo sapiens
cctccttctcccctccagac

SEQ ID NO: 329571 - DNA, 21 bp, Homo sapiens
cctccttctcccctccagacc

SEQ ID NO: 329572 - DNA, 16 bp, Homo sapiens
cctccttctccctttt

SEQ ID NO: 329573 - DNA, 19 bp, Homo sapiens
cctccttcttgccctgagc

SEQ ID NO: 329574 - DNA, 11 bp, Homo sapiens
cctccttgcca

SEQ ID NO: 329575 - DNA, 17 bp, Homo sapiens
cctccttgcctcctgtg

SEQ ID NO: 329576 - DNA, 19 bp, Homo sapiens
cctccttgcctcctgtgta

SEQ ID NO: 329577 - DNA, 16 bp, Homo sapiens
cctccttgtccaggtc

SEQ ID NO: 329578 - DNA, 12 bp, Homo sapiens
cctcctttccca

SEQ ID NO: 329579 - DNA, 23 bp, Homo sapiens
cctcctttgtcttttttttcatc

SEQ ID NO: 329580 - DNA, 15 bp, Homo sapiens
cctcgaaccaaggca

SEQ ID NO: 329581 - DNA, 22 bp, Homo sapiens
cctcgaaccaaggcagcctcca

SEQ ID NO: 329582 - DNA, 15 bp, Homo sapiens
cctcgaacccacact

SEQ ID NO: 329583 - DNA, 23 bp, Homo sapiens
cctcgaacccacactgcaacagg

SEQ ID NO: 329584 - DNA, 16 bp, Homo sapiens
cctcgaattctcagac

SEQ ID NO: 329585 - DNA, 21 bp, Homo sapiens
cctcgcatccgcctctgagcc

SEQ ID NO: 329586 - DNA, 15 bp, Homo sapiens
cctcgcccctccagt

SEQ ID NO: 329587 - DNA, 13 bp, Homo sapiens
cctcgcctgacaa

SEQ ID NO: 329588 - DNA, 18 bp, Homo sapiens
cctcgcggcgcagcccct

SEQ ID NO: 329589 - DNA, 17 bp, Homo sapiens
cctcgcttcataggcag

SEQ ID NO: 329590 - DNA, 12 bp, Homo sapiens
cctcggagcctg

SEQ ID NO: 329591 - DNA, 18 bp, Homo sapiens
cctcggcattcacacaca

SEQ ID NO: 329592 - DNA, 20 bp, Homo sapiens
cctcggcattcacacacagc

SEQ ID NO: 329593 - DNA, 21 bp, Homo sapiens
cctcggcattcacacacagcc

SEQ ID NO: 329594 - DNA, 23 bp, Homo sapiens
cctcggcattcacacacagcctg

SEQ ID NO: 329595 - DNA, 13 bp, Homo sapiens
cctcggccagagc

SEQ ID NO: 329596 - DNA, 14 bp, Homo sapiens
cctcggccagagct

SEQ ID NO: 329597 - DNA, 15 bp, Homo sapiens
cctcggccagagctc

SEQ ID NO: 329598 - DNA, 18 bp, Homo sapiens
cctcggccagagctccca

SEQ ID NO: 329599 - DNA, 20 bp, Homo sapiens
cctcggccagagctcccagg

SEQ ID NO: 329600 - DNA, 21 bp, Homo sapiens
cctcggccagagctcccagga

SEQ ID NO: 329601 - DNA, 22 bp, Homo sapiens
cctcggccagagctcccaggac

SEQ ID NO: 329602 - DNA, 22 bp, Homo sapiens
cctcggcctcccaaagtgctgg

SEQ ID NO: 329603 - DNA, 13 bp, Homo sapiens
cctcggctgtgtg

SEQ ID NO: 329604 - DNA, 21 bp, Homo sapiens
cctcggcttgtgggctggtgc

SEQ ID NO: 329605 - DNA, 14 bp, Homo sapiens
cctcgggcaagggc

SEQ ID NO: 329606 - DNA, 20 bp, Homo sapiens
cctcgggccgcctcctccag

SEQ ID NO: 329607 - DNA, 14 bp, Homo sapiens
cctcgggcgcctgc

SEQ ID NO: 329608 - DNA, 16 bp, Homo sapiens
cctcgggcgcctgcgc

SEQ ID NO: 329609 - DNA, 23 bp, Homo sapiens
cctcgggcgcctgcgctcctctg

SEQ ID NO: 329610 - DNA, 21 bp, Homo sapiens
cctcgtccacaggggcaggcc

SEQ ID NO: 329611 - DNA, 23 bp, Homo sapiens
cctcgtccacaggggcaggcctg

SEQ ID NO: 329612 - DNA, 22 bp, Homo sapiens
cctcgtccggcctgcagcccag

SEQ ID NO: 329613 - DNA, 16 bp, Homo sapiens
cctcgtcctgtcccag

SEQ ID NO: 329614 - DNA, 16 bp, Homo sapiens
cctcgtctccctggcc

SEQ ID NO: 329615 - DNA, 18 bp, Homo sapiens
cctcgtctccctggccac

SEQ ID NO: 329616 - DNA, 16 bp, Homo sapiens
cctcgtgacctacagg

SEQ ID NO: 329617 - DNA, 13 bp, Homo sapiens
cctcgtgctttaa

SEQ ID NO: 329618 - DNA, 21 bp, Homo sapiens
cctcgtggacacctgccctgc

SEQ ID NO: 329619 - DNA, 15 bp, Homo sapiens
cctctaacaccacac

SEQ ID NO: 329620 - DNA, 16 bp, Homo sapiens
cctctaacaccacact

SEQ ID NO: 329621 - DNA, 18 bp, Homo sapiens
cctctaacaccacactga

SEQ ID NO: 329622 - DNA, 24 bp, Homo sapiens
cctctaacaccacactgaccacac

SEQ ID NO: 329623 - DNA, 21 bp, Homo sapiens
cctctaacaggggctggtggg

SEQ ID NO: 329624 - DNA, 23 bp, Homo sapiens
cctctaacaggggctggtgggca

SEQ ID NO: 329625 - DNA, 18 bp, Homo sapiens
cctctaaggccaaggcct

SEQ ID NO: 329626 - DNA, 23 bp, Homo sapiens
cctctaaggccaaggcctcagga

SEQ ID NO: 329627 - DNA, 22 bp, Homo sapiens
cctctaatgctcacgctcccaa

SEQ ID NO: 329628 - DNA, 16 bp, Homo sapiens
cctctactttccaggc

SEQ ID NO: 329629 - DNA, 16 bp, Homo sapiens
cctctatttagcatga

SEQ ID NO: 329630 - DNA, 22 bp, Homo sapiens
cctctcaacagatctgtgggcc

SEQ ID NO: 329631 - DNA, 14 bp, Homo sapiens
cctctcactgtgtc

SEQ ID NO: 329632 - DNA, 14 bp, Homo sapiens
cctctcaggcatgc

SEQ ID NO: 329633 - DNA, 18 bp, Homo sapiens
gccttatgagaacatggt

SEQ ID NO: 329634 - DNA, 21 bp, Homo sapiens
gccttatgagaacatggtgtg

SEQ ID NO: 329635 - DNA, 17 bp, Homo sapiens
gccttcagaaaagacac

SEQ ID NO: 329636 - DNA, 18 bp, Homo sapiens
gccttcagaaaagacact

SEQ ID NO: 329637 - DNA, 12 bp, Homo sapiens
gccttcagccct

SEQ ID NO: 329638 - DNA, 19 bp, Homo sapiens
gccttcagtatcaaggctg

SEQ ID NO: 329639 - DNA, 22 bp, Homo sapiens
gccttcagtatcaaggctgcct

SEQ ID NO: 329640 - DNA, 23 bp, Homo sapiens
gccttcagtatcaaggctgcctg

SEQ ID NO: 329641 - DNA, 22 bp, Homo sapiens
gccttcattaaatgtttgttga

SEQ ID NO: 329642 - DNA, 22 bp, Homo sapiens
gccttccacgctgtctccagac

SEQ ID NO: 329643 - DNA, 15 bp, Homo sapiens
gccttccagcccaga

SEQ ID NO: 329644 - DNA, 17 bp, Homo sapiens
gccttccagcccagacc

SEQ ID NO: 329645 - DNA, 15 bp, Homo sapiens
gccttccataattat

SEQ ID NO: 329646 - DNA, 16 bp, Homo sapiens
gccttccataattatg

SEQ ID NO: 329647 - DNA, 15 bp, Homo sapiens
gccttccccgtgcgg

SEQ ID NO: 329648 - DNA, 21 bp, Homo sapiens
gccttccccttgaacctcatt

SEQ ID NO: 329649 - DNA, 16 bp, Homo sapiens
gccttccccttttgcc

SEQ ID NO: 329650 - DNA, 18 bp, Homo sapiens
gccttccccttttgcctg

SEQ ID NO: 329651 - DNA, 24 bp, Homo sapiens
gccttccctcactcttcctcatcc

SEQ ID NO: 329652 - DNA, 19 bp, Homo sapiens
gccttccctccccacagtc

SEQ ID NO: 329653 - DNA, 20 bp, Homo sapiens
gccttccgtgggtcatccca

SEQ ID NO: 329654 - DNA, 15 bp, Homo sapiens
gccttcctcctccac

SEQ ID NO: 329655 - DNA, 16 bp, Homo sapiens
gccttcctcctccaca

SEQ ID NO: 329656 - DNA, 19 bp, Homo sapiens
gccttcctcctccacagtg

SEQ ID NO: 329657 - DNA, 13 bp, Homo sapiens
gccttcctctgca

SEQ ID NO: 329658 - DNA, 16 bp, Homo sapiens
gccttcctctgcagct

SEQ ID NO: 329659 - DNA, 13 bp, Homo sapiens
gccttccttgacc

SEQ ID NO: 329660 - DNA, 17 bp, Homo sapiens
gccttctagattcactg

SEQ ID NO: 329661 - DNA, 23 bp, Homo sapiens
gccttctcagctctccaccccca

SEQ ID NO: 329662 - DNA, 14 bp, Homo sapiens
gccttctcctcccc

SEQ ID NO: 329663 - DNA, 14 bp, Homo sapiens
gccttctcctctct

SEQ ID NO: 329664 - DNA, 21 bp, Homo sapiens
gccttctcttctatcctgcaa

SEQ ID NO: 329665 - DNA, 16 bp, Homo sapiens
gccttctgaactccat

SEQ ID NO: 329666 - DNA, 20 bp, Homo sapiens
gccttctgacggccctgcaa

SEQ ID NO: 329667 - DNA, 17 bp, Homo sapiens
gccttgagctgcctgct

SEQ ID NO: 329668 - DNA, 21 bp, Homo sapiens
gccttgagctgcctgctctgc

SEQ ID NO: 329669 - DNA, 21 bp, Homo sapiens
gccttgagtgacatgcggctg

SEQ ID NO: 329670 - DNA, 16 bp, Homo sapiens
gccttgcccagcaagg

SEQ ID NO: 329671 - DNA, 17 bp, Homo sapiens
gccttgcccgccagcct

SEQ ID NO: 329672 - DNA, 18 bp, Homo sapiens
gccttgcccgccagcctc

SEQ ID NO: 329673 - DNA, 14 bp, Homo sapiens
gccttgctgcacct

SEQ ID NO: 329674 - DNA, 18 bp, Homo sapiens
gccttgctgtagagactt

SEQ ID NO: 329675 - DNA, 12 bp, Homo sapiens
gccttgctgtca

SEQ ID NO: 329676 - DNA, 17 bp, Homo sapiens
gccttgctttgggcttt

SEQ ID NO: 329677 - DNA, 17 bp, Homo sapiens
gccttggaatctatagt

SEQ ID NO: 329678 - DNA, 20 bp, Homo sapiens
gccttggcctcccctgctga

SEQ ID NO: 329679 - DNA, 15 bp, Homo sapiens
gccttggcctgacct

SEQ ID NO: 329680 - DNA, 22 bp, Homo sapiens
gccttgggcctttcagtcccaa

SEQ ID NO: 329681 - DNA, 15 bp, Homo sapiens
gccttgggctgctcc

SEQ ID NO: 329682 - DNA, 19 bp, Homo sapiens
gccttggggaatttcctct

SEQ ID NO: 329683 - DNA, 22 bp, Homo sapiens
gccttggggccagactggctgc

SEQ ID NO: 329684 - DNA, 16 bp, Homo sapiens
gccttgggggtctgct

SEQ ID NO: 329685 - DNA, 22 bp, Homo sapiens
gccttgggttccaaccaggcag

SEQ ID NO: 329686 - DNA, 15 bp, Homo sapiens
gccttggttcctcca

SEQ ID NO: 329687 - DNA, 17 bp, Homo sapiens
gccttggttcctccagc

SEQ ID NO: 329688 - DNA, 17 bp, Homo sapiens
gccttgtagatggagca

SEQ ID NO: 329689 - DNA, 15 bp, Homo sapiens
gccttgtccctctca

SEQ ID NO: 329690 - DNA, 23 bp, Homo sapiens
gccttgtccctctcactccccag

SEQ ID NO: 329691 - DNA, 17 bp, Homo sapiens
gccttgtgacattcact

SEQ ID NO: 329692 - DNA, 19 bp, Homo sapiens
gccttgtgacattcactca

SEQ ID NO: 329693 - DNA, 12 bp, Homo sapiens
gccttgtgccct

SEQ ID NO: 329694 - DNA, 12 bp, Homo sapiens
gccttgtgtaca

SEQ ID NO: 329695 - DNA, 18 bp, Homo sapiens
gcctttagcgtgtaaatg

SEQ ID NO: 329696 - DNA, 16 bp, Homo sapiens
gcctttaggcaggaag

SEQ ID NO: 329697 - DNA, 19 bp, Homo sapiens
gcctttcacagcttcttta

SEQ ID NO: 329698 - DNA, 22 bp, Homo sapiens
gcctttcaggaagggagaggag

SEQ ID NO: 329699 - DNA, 22 bp, Homo sapiens
gcctttcccattggtctgcatg

SEQ ID NO: 329700 - DNA, 13 bp, Homo sapiens
gcctttcctctct

SEQ ID NO: 329701 - DNA, 22 bp, Homo sapiens
gcctttctcgtggtagaagcca

SEQ ID NO: 329702 - DNA, 12 bp, Homo sapiens
gcctttctgtgg

SEQ ID NO: 329703 - DNA, 15 bp, Homo sapiens
gcctttgatcttcag

SEQ ID NO: 329704 - DNA, 23 bp, Homo sapiens
gcctttgcagttggactctcagg

SEQ ID NO: 329705 - DNA, 22 bp, Homo sapiens
gcctttgctgtttagcttcctc

SEQ ID NO: 329706 - DNA, 21 bp, Homo sapiens
gcctttggaagtctgcgccct

SEQ ID NO: 329707 - DNA, 15 bp, Homo sapiens
gcctttggggctggt

SEQ ID NO: 329708 - DNA, 19 bp, Homo sapiens
gcctttgggtcgacatagt

SEQ ID NO: 329709 - DNA, 22 bp, Homo sapiens
gcctttgtaagacacacagcct

SEQ ID NO: 329710 - DNA, 21 bp, Homo sapiens
gcctttgtttcggtgccctgt

SEQ ID NO: 329711 - DNA, 23 bp, Homo sapiens
gcctttgtttcggtgccctgtgt

SEQ ID NO: 329712 - DNA, 14 bp, Homo sapiens
gccttttaaattct

SEQ ID NO: 329713 - DNA, 15 bp, Homo sapiens
gcgaactgtgcagtt

SEQ ID NO: 329714 - DNA, 13 bp, Homo sapiens
gcgaagctgagcg

SEQ ID NO: 329715 - DNA, 12 bp, Homo sapiens
gcgaatggacca

SEQ ID NO: 329716 - DNA, 17 bp, Homo sapiens
gcgacgctcccctgaga

SEQ ID NO: 329717 - DNA, 16 bp, Homo sapiens
gcgacggagagaaaaa

SEQ ID NO: 329718 - DNA, 19 bp, Homo sapiens
gcgacggctcctccccgat

SEQ ID NO: 329719 - DNA, 14 bp, Homo sapiens
gcgagccaggcaag

SEQ ID NO: 329720 - DNA, 13 bp, Homo sapiens
gcgagcccttagc

SEQ ID NO: 329721 - DNA, 14 bp, Homo sapiens
gcgagctgctctgc

SEQ ID NO: 329722 - DNA, 18 bp, Homo sapiens
gcgaggcgaggctgcctc

SEQ ID NO: 329723 - DNA, 14 bp, Homo sapiens
gcgaggcgggggag

SEQ ID NO: 329724 - DNA, 20 bp, Homo sapiens
gcgaggcgggggagcctgga

SEQ ID NO: 329725 - DNA, 22 bp, Homo sapiens
gcgaggcgggggagcctggagc

SEQ ID NO: 329726 - DNA, 15 bp, Homo sapiens
gcgaggctgcctctg

SEQ ID NO: 329727 - DNA, 16 bp, Homo sapiens
gcgaggctgcctctgg

SEQ ID NO: 329728 - DNA, 14 bp, Homo sapiens
cctgccctccccca

SEQ ID NO: 329729 - DNA, 22 bp, Homo sapiens
cctgccctcgtctccctggcca

SEQ ID NO: 329730 - DNA, 15 bp, Homo sapiens
cctgccctgccacct

SEQ ID NO: 329731 - DNA, 14 bp, Homo sapiens
cctgccctgcctga

SEQ ID NO: 329732 - DNA, 21 bp, Homo sapiens
cctgccctgttgtgtatagat

SEQ ID NO: 329733 - DNA, 16 bp, Homo sapiens
cctgcccttcagcatc

SEQ ID NO: 329734 - DNA, 14 bp, Homo sapiens
cctgcccttttcct

SEQ ID NO: 329735 - DNA, 15 bp, Homo sapiens
cctgccgcctgtgcc

SEQ ID NO: 329736 - DNA, 15 bp, Homo sapiens
cctgccggccttggc

SEQ ID NO: 329737 - DNA, 14 bp, Homo sapiens
cctgccgtgcatgg

SEQ ID NO: 329738 - DNA, 21 bp, Homo sapiens
cctgcctagcactcacatgct

SEQ ID NO: 329739 - DNA, 9 bp, Homo sapiens
cctgcctca

SEQ ID NO: 329740 - DNA, 14 bp, Homo sapiens
cctgcctcatgctc

SEQ ID NO: 329741 - DNA, 15 bp, Homo sapiens
cctgcctccctttct

SEQ ID NO: 329742 - DNA, 19 bp, Homo sapiens
cctgcctccctttctggga

SEQ ID NO: 329743 - DNA, 12 bp, Homo sapiens
cctgcctccggc

SEQ ID NO: 329744 - DNA, 21 bp, Homo sapiens
cctgcctccggccctgcccca

SEQ ID NO: 329745 - DNA, 13 bp, Homo sapiens
cctgcctcctgcc

SEQ ID NO: 329746 - DNA, 13 bp, Homo sapiens
cctgcctctcaga

SEQ ID NO: 329747 - DNA, 19 bp, Homo sapiens
cctgcctctgaactgctgc

SEQ ID NO: 329748 - DNA, 20 bp, Homo sapiens
cctgcctctgaactgctgct

SEQ ID NO: 329749 - DNA, 23 bp, Homo sapiens
cctgcctctgaactgctgctggt

SEQ ID NO: 329750 - DNA, 14 bp, Homo sapiens
cctgcctgagccca

SEQ ID NO: 329751 - DNA, 20 bp, Homo sapiens
cctgcctgagggcccctctg

SEQ ID NO: 329752 - DNA, 10 bp, Homo sapiens
cctgcctgga

SEQ ID NO: 329753 - DNA, 14 bp, Homo sapiens
cctgcctggccagg

SEQ ID NO: 329754 - DNA, 23 bp, Homo sapiens
cctgcctggccaggcagatctgt

SEQ ID NO: 329755 - DNA, 18 bp, Homo sapiens
cctgcctgtctgtctctc

SEQ ID NO: 329756 - DNA, 12 bp, Homo sapiens
cctgcctgtgtg

SEQ ID NO: 329757 - DNA, 14 bp, Homo sapiens
cctgcctgtgtgct

SEQ ID NO: 329758 - DNA, 12 bp, Homo sapiens
cctgcctgtgtt

SEQ ID NO: 329759 - DNA, 14 bp, Homo sapiens
cctgccttctcttc

SEQ ID NO: 329760 - DNA, 19 bp, Homo sapiens
cctgcgaaacccagcgttc

SEQ ID NO: 329761 - DNA, 14 bp, Homo sapiens
cctgcgcaggccct

SEQ ID NO: 329762 - DNA, 17 bp, Homo sapiens
cctgcgccctccctccc

SEQ ID NO: 329763 - DNA, 14 bp, Homo sapiens
cctgcgcctgcacc

SEQ ID NO: 329764 - DNA, 13 bp, Homo sapiens
gctaacgggcgcc

SEQ ID NO: 329765 - DNA, 14 bp, Homo sapiens
gctaactggcccca

SEQ ID NO: 329766 - DNA, 21 bp, Homo sapiens
gctaagatgagatttgccagc

SEQ ID NO: 329767 - DNA, 23 bp, Homo sapiens
gctaagatgagatttgccagcac

SEQ ID NO: 329768 - DNA, 18 bp, Homo sapiens
gctaagattatctgggga

SEQ ID NO: 329769 - DNA, 15 bp, Homo sapiens
gctaaggcaccagcc

SEQ ID NO: 329770 - DNA, 13 bp, Homo sapiens
gctaagttctaag

SEQ ID NO: 329771 - DNA, 19 bp, Homo sapiens
gctaataaaatatcattca

SEQ ID NO: 329772 - DNA, 23 bp, Homo sapiens
gctaataaaatatcattcagcaa

SEQ ID NO: 329773 - DNA, 11 bp, Homo sapiens
gctaataaatc

SEQ ID NO: 329774 - DNA, 17 bp, Homo sapiens
gctaataaatctcttct

SEQ ID NO: 329775 - DNA, 21 bp, Homo sapiens
gctaataaatgaccagtttac

SEQ ID NO: 329776 - DNA, 22 bp, Homo sapiens
gctaataaatgaccagtttacc

SEQ ID NO: 329777 - DNA, 17 bp, Homo sapiens
gctaatcaatacccttg

SEQ ID NO: 329778 - DNA, 14 bp, Homo sapiens
gctaatcagcattc

SEQ ID NO: 329779 - DNA, 17 bp, Homo sapiens
gctaatcagcattctca

SEQ ID NO: 329780 - DNA, 18 bp, Homo sapiens
gctaatctgtagggctgg

SEQ ID NO: 329781 - DNA, 21 bp, Homo sapiens
gctaatctgtagggctggacc

SEQ ID NO: 329782 - DNA, 22 bp, Homo sapiens
gctaatctgtagggctggacct

SEQ ID NO: 329783 - DNA, 12 bp, Homo sapiens
gctaatgaattt

SEQ ID NO: 329784 - DNA, 20 bp, Homo sapiens
gctaatgaattttaaaagca

SEQ ID NO: 329785 - DNA, 23 bp, Homo sapiens
gctaatgaattttaaaagcatat

SEQ ID NO: 329786 - DNA, 13 bp, Homo sapiens
gctaatgtaatca

SEQ ID NO: 329787 - DNA, 19 bp, Homo sapiens
gctaatgtaggactgtata

SEQ ID NO: 329788 - DNA, 15 bp, Homo sapiens
gctaattaggaagct

SEQ ID NO: 329789 - DNA, 14 bp, Homo sapiens
gctaattcaattta

SEQ ID NO: 329790 - DNA, 15 bp, Homo sapiens
gctaattctgggaag

SEQ ID NO: 329791 - DNA, 13 bp, Homo sapiens
gctaatttctgtc

SEQ ID NO: 329792 - DNA, 13 bp, Homo sapiens
gctaattttctca

SEQ ID NO: 329793 - DNA, 22 bp, Homo sapiens
gctaattttctcaaaagcattt

SEQ ID NO: 329794 - DNA, 20 bp, Homo sapiens
gctacaaatactcttaggaa

SEQ ID NO: 329795 - DNA, 15 bp, Homo sapiens
gctacaacttcagca

SEQ ID NO: 329796 - DNA, 22 bp, Homo sapiens
gctacaggaagcaccccatgcc

SEQ ID NO: 329797 - DNA, 23 bp, Homo sapiens
gctacaggaagcaccccatgcca

SEQ ID NO: 329798 - DNA, 16 bp, Homo sapiens
gctacaggggaggctg

SEQ ID NO: 329799 - DNA, 13 bp, Homo sapiens
gctacattcctca

SEQ ID NO: 329800 - DNA, 16 bp, Homo sapiens
gctacattcctcagct

SEQ ID NO: 329801 - DNA, 13 bp, Homo sapiens
gctacattgtaat

SEQ ID NO: 329802 - DNA, 20 bp, Homo sapiens
gctaccccccgtctcctgcc

SEQ ID NO: 329803 - DNA, 17 bp, Homo sapiens
gctacccttgccaaggc

SEQ ID NO: 329804 - DNA, 14 bp, Homo sapiens
gctaccgccctggg

SEQ ID NO: 329805 - DNA, 22 bp, Homo sapiens
gctaccgccctgggctggactg

SEQ ID NO: 329806 - DNA, 22 bp, Homo sapiens
gctacctctaacaccacactga

SEQ ID NO: 329807 - DNA, 22 bp, Homo sapiens
gctacctctgatcaaagcacct

SEQ ID NO: 329808 - DNA, 23 bp, Homo sapiens
gctacctgaacacttattgcttt

SEQ ID NO: 329809 - DNA, 23 bp, Homo sapiens
gctacggttccctgcctaggagc

SEQ ID NO: 329810 - DNA, 17 bp, Homo sapiens
gctactaacctggagac

SEQ ID NO: 329811 - DNA, 14 bp, Homo sapiens
gctactaatgatgt

SEQ ID NO: 329812 - DNA, 16 bp, Homo sapiens
gctactaatgatgttt

SEQ ID NO: 329813 - DNA, 19 bp, Homo sapiens
gctactccactgacctgga

SEQ ID NO: 329814 - DNA, 21 bp, Homo sapiens
gctactccactgacctggaag

SEQ ID NO: 329815 - DNA, 12 bp, Homo sapiens
gctactctgtcc

SEQ ID NO: 329816 - DNA, 20 bp, Homo sapiens
gctactgatttcctttggag

SEQ ID NO: 329817 - DNA, 22 bp, Homo sapiens
gctactggacttgaatggttaa

SEQ ID NO: 329818 - DNA, 12 bp, Homo sapiens
gctactggcagc

SEQ ID NO: 329819 - DNA, 19 bp, Homo sapiens
gctactggcagctcctctc

SEQ ID NO: 329820 - DNA, 17 bp, Homo sapiens
gctacttgggagcctga

SEQ ID NO: 329821 - DNA, 18 bp, Homo sapiens
gctacttgggagcctgag

SEQ ID NO: 329822 - DNA, 19 bp, Homo sapiens
gctacttgggagcctgagg

SEQ ID NO: 329823 - DNA, 23 bp, Homo sapiens
gctacttgggagcctgaggcagg

SEQ ID NO: 329824 - DNA, 15 bp, Homo sapiens
gctagaaaaaacata

SEQ ID NO: 329825 - DNA, 18 bp, Homo sapiens
gctagaaaaatgttcttt

SEQ ID NO: 329826 - DNA, 21 bp, Homo sapiens
gctagacgagcaggcttcttc

SEQ ID NO: 329827 - DNA, 22 bp, Homo sapiens
gctagacgagcaggcttcttcc

SEQ ID NO: 329828 - DNA, 15 bp, Homo sapiens
gctagactaggagac

SEQ ID NO: 329829 - DNA, 20 bp, Homo sapiens
gctagagaggggcctctggc

SEQ ID NO: 329830 - DNA, 12 bp, Homo sapiens
gctagagctaac

SEQ ID NO: 329831 - DNA, 19 bp, Homo sapiens
gctagaggccagccccacc

SEQ ID NO: 329832 - DNA, 16 bp, Homo sapiens
gctagaggcctgagga

SEQ ID NO: 329833 - DNA, 13 bp, Homo sapiens
gctagagtcctca

SEQ ID NO: 329834 - DNA, 22 bp, Homo sapiens
gctagatgagaattcagctgcc

SEQ ID NO: 329835 - DNA, 14 bp, Homo sapiens
gctagcatccctga

SEQ ID NO: 329836 - DNA, 14 bp, Homo sapiens
gctagccatatatt

SEQ ID NO: 329837 - DNA, 19 bp, Homo sapiens
gctagcccagtccctggag

SEQ ID NO: 329838 - DNA, 16 bp, Homo sapiens
gctagccccagggtga

SEQ ID NO: 329839 - DNA, 17 bp, Homo sapiens
gctagccctggggtggc

SEQ ID NO: 329840 - DNA, 22 bp, Homo sapiens
gctagccctggggtggcgtctg

SEQ ID NO: 329841 - DNA, 13 bp, Homo sapiens
gctagcgagccgc

SEQ ID NO: 329842 - DNA, 13 bp, Homo sapiens
gctagctgtagaa

SEQ ID NO: 329843 - DNA, 15 bp, Homo sapiens
gctaggaaaggcaga

SEQ ID NO: 329844 - DNA, 12 bp, Homo sapiens
gctaggactgag

SEQ ID NO: 329845 - DNA, 14 bp, Homo sapiens
gctaggactgagga

SEQ ID NO: 329846 - DNA, 18 bp, Homo sapiens
gctaggccggccagctcc

SEQ ID NO: 329847 - DNA, 17 bp, Homo sapiens
gctaggggacatcagag

SEQ ID NO: 329848 - DNA, 23 bp, Homo sapiens
gctaggggccgagtccaggagcc

SEQ ID NO: 329849 - DNA, 24 bp, Homo sapiens
gctaggggccgagtccaggagccc

SEQ ID NO: 329850 - DNA, 13 bp, Homo sapiens
gctagggtgcctg

SEQ ID NO: 329851 - DNA, 14 bp, Homo sapiens
gctaggtgggccag

SEQ ID NO: 329852 - DNA, 17 bp, Homo sapiens
gctaggtgggccagccc

SEQ ID NO: 329853 - DNA, 18 bp, Homo sapiens
gctaggtgggccagcccc

SEQ ID NO: 329854 - DNA, 21 bp, Homo sapiens
gctaggtgggccagcccctcc

SEQ ID NO: 329855 - DNA, 18 bp, Homo sapiens
gctaggttaataggagga

SEQ ID NO: 329856 - DNA, 20 bp, Homo sapiens
gctagtaccctatagagagg

SEQ ID NO: 329857 - DNA, 21 bp, Homo sapiens
gctagtaccctatagagaggg

SEQ ID NO: 329858 - DNA, 15 bp, Homo sapiens
gctagtctttcacag

SEQ ID NO: 329859 - DNA, 14 bp, Homo sapiens
gctagtgacttgtg

SEQ ID NO: 329860 - DNA, 23 bp, Homo sapiens
gctagtgatacactgtatctaaa

SEQ ID NO: 329861 - DNA, 16 bp, Homo sapiens
gctagtgtgagtggca

SEQ ID NO: 329862 - DNA, 19 bp, Homo sapiens
gctagtgtgagtggcagcc

SEQ ID NO: 329863 - DNA, 22 bp, Homo sapiens
gctagtgtgagtggcagccatg

SEQ ID NO: 329864 - DNA, 22 bp, Homo sapiens
gctagttttacagattgcctcc

SEQ ID NO: 329865 - DNA, 15 bp, Homo sapiens
gctataaatatataa

SEQ ID NO: 329866 - DNA, 14 bp, Homo sapiens
gctataagaagtag

SEQ ID NO: 329867 - DNA, 16 bp, Homo sapiens
gctataattctatact

SEQ ID NO: 329868 - DNA, 16 bp, Homo sapiens
gctatagctacaggaa

SEQ ID NO: 329869 - DNA, 19 bp, Homo sapiens
gctatagtgtataccacct

SEQ ID NO: 329870 - DNA, 23 bp, Homo sapiens
gctatagtgtataccacctgtac

SEQ ID NO: 329871 - DNA, 19 bp, Homo sapiens
gctatatgccttaagccaa

SEQ ID NO: 329872 - DNA, 23 bp, Homo sapiens
gctatccacagaacctttgtcaa

SEQ ID NO: 329873 - DNA, 20 bp, Homo sapiens
cctgggcaagtgaggcaaga

SEQ ID NO: 329874 - DNA, 22 bp, Homo sapiens
cctgggcaagtgaggcaagaga

SEQ ID NO: 329875 - DNA, 18 bp, Homo sapiens
cctgggcacccacctcca

SEQ ID NO: 329876 - DNA, 20 bp, Homo sapiens
cctgggcacccacctccacc

SEQ ID NO: 329877 - DNA, 20 bp, Homo sapiens
cctgggcacctggggagtgg

SEQ ID NO: 329878 - DNA, 17 bp, Homo sapiens
cctgggcagccaggctg

SEQ ID NO: 329879 - DNA, 12 bp, Homo sapiens
cctgggcaggcg

SEQ ID NO: 329880 - DNA, 22 bp, Homo sapiens
cctgggcaggcggtccccatcc

SEQ ID NO: 329881 - DNA, 12 bp, Homo sapiens
cctgggcagtgc

SEQ ID NO: 329882 - DNA, 19 bp, Homo sapiens
cctgggcatccccagcccc

SEQ ID NO: 329883 - DNA, 22 bp, Homo sapiens
cctgggcatccccagccccctg

SEQ ID NO: 329884 - DNA, 15 bp, Homo sapiens
cctgggccacccttc

SEQ ID NO: 329885 - DNA, 18 bp, Homo sapiens
cctgggccacccttcacg

SEQ ID NO: 329886 - DNA, 14 bp, Homo sapiens
cctgggcccaggca

SEQ ID NO: 329887 - DNA, 15 bp, Homo sapiens
cctgggcccaggcag

SEQ ID NO: 329888 - DNA, 20 bp, Homo sapiens
cctgggcccctccctacctc

SEQ ID NO: 329889 - DNA, 22 bp, Homo sapiens
cctgggcccctccctacctcaa

SEQ ID NO: 329890 - DNA, 14 bp, Homo sapiens
cctgggccctaggc

SEQ ID NO: 329891 - DNA, 18 bp, Homo sapiens
cctgggccctaggcatac

SEQ ID NO: 329892 - DNA, 13 bp, Homo sapiens
cctgggcctcccg

SEQ ID NO: 329893 - DNA, 16 bp, Homo sapiens
cctgggcctcccgtcc

SEQ ID NO: 329894 - DNA, 18 bp, Homo sapiens
cctgggcctcctgggaag

SEQ ID NO: 329895 - DNA, 20 bp, Homo sapiens
cctgggcctgcttttccagg

SEQ ID NO: 329896 - DNA, 16 bp, Homo sapiens
cctgggcctgtgcagc

SEQ ID NO: 329897 - DNA, 17 bp, Homo sapiens
cctgggcctgtgcagca

SEQ ID NO: 329898 - DNA, 18 bp, Homo sapiens
cctgggcctgtgcagcag

SEQ ID NO: 329899 - DNA, 20 bp, Homo sapiens
cctgggcctgtgcagcagcc

SEQ ID NO: 329900 - DNA, 22 bp, Homo sapiens
cctgggcctgtgcagcagccca

SEQ ID NO: 329901 - DNA, 23 bp, Homo sapiens
cctgggcctgtgcagcagcccag

SEQ ID NO: 329902 - DNA, 17 bp, Homo sapiens
cctgggcctttcctgtg

SEQ ID NO: 329903 - DNA, 20 bp, Homo sapiens
cctgggcctttcctgtgcca

SEQ ID NO: 329904 - DNA, 12 bp, Homo sapiens
cctgggcgccct

SEQ ID NO: 329905 - DNA, 16 bp, Homo sapiens
cctgggcgccctggaa

SEQ ID NO: 329906 - DNA, 18 bp, Homo sapiens
cctgggcgccctggaagc

SEQ ID NO: 329907 - DNA, 19 bp, Homo sapiens
cctgggcgccctggaagcc

SEQ ID NO: 329908 - DNA, 13 bp, Homo sapiens
cctgggctgggag

SEQ ID NO: 329909 - DNA, 16 bp, Homo sapiens
cctgggctgggagaag

SEQ ID NO: 329910 - DNA, 21 bp, Homo sapiens
cctgggctgggagaaggtgct

SEQ ID NO: 329911 - DNA, 14 bp, Homo sapiens
cctgggctgggcgc

SEQ ID NO: 329912 - DNA, 12 bp, Homo sapiens
cctgggctttct

SEQ ID NO: 329913 - DNA, 16 bp, Homo sapiens
cctggggaagaggcct

SEQ ID NO: 329914 - DNA, 19 bp, Homo sapiens
cctggggaccaggagctag

SEQ ID NO: 329915 - DNA, 15 bp, Homo sapiens
cctggggactctgct

SEQ ID NO: 329916 - DNA, 19 bp, Homo sapiens
cctggggactctgcttggc

SEQ ID NO: 329917 - DNA, 13 bp, Homo sapiens
cctggggaggctg

SEQ ID NO: 329918 - DNA, 18 bp, Homo sapiens
cctggggaggctgagact

SEQ ID NO: 329919 - DNA, 22 bp, Homo sapiens
cctggggagtgggacagagtct

SEQ ID NO: 329920 - DNA, 19 bp, Homo sapiens
cctggggatgtaaccaagc

SEQ ID NO: 329921 - DNA, 19 bp, Homo sapiens
cctggggcagtcacctgcc

SEQ ID NO: 329922 - DNA, 12 bp, Homo sapiens
cctggggccccg

SEQ ID NO: 329923 - DNA, 12 bp, Homo sapiens
cctggggcctgg

SEQ ID NO: 329924 - DNA, 18 bp, Homo sapiens
cctggggcctggacctgc

SEQ ID NO: 329925 - DNA, 19 bp, Homo sapiens
cctggggcctggacctgcc

SEQ ID NO: 329926 - DNA, 15 bp, Homo sapiens
cctggggcctggcag

SEQ ID NO: 329927 - DNA, 15 bp, Homo sapiens
cctggggctcctttc

SEQ ID NO: 329928 - DNA, 12 bp, Homo sapiens
cctggggctggg

SEQ ID NO: 329929 - DNA, 14 bp, Homo sapiens
cctgggggcagtga

SEQ ID NO: 329930 - DNA, 21 bp, Homo sapiens
cctgggggcagtgactggcag

SEQ ID NO: 329931 - DNA, 22 bp, Homo sapiens
cctgggggcagtgactggcagg

SEQ ID NO: 329932 - DNA, 19 bp, Homo sapiens
cctgggggccttgggtgag

SEQ ID NO: 329933 - DNA, 19 bp, Homo sapiens
cctggggggcacagccaga

SEQ ID NO: 329934 - DNA, 15 bp, Homo sapiens
cctggggggggcaag

SEQ ID NO: 329935 - DNA, 23 bp, Homo sapiens
cctgggggtcccaggatcccctg

SEQ ID NO: 329936 - DNA, 20 bp, Homo sapiens
cctggggtactactctccag

SEQ ID NO: 329937 - DNA, 16 bp, Homo sapiens
cctggggtccccactc

SEQ ID NO: 329938 - DNA, 16 bp, Homo sapiens
cctggggtctctgagc

SEQ ID NO: 329939 - DNA, 18 bp, Homo sapiens
cctggggtctctgagcag

SEQ ID NO: 329940 - DNA, 20 bp, Homo sapiens
cctggggtctctgagcagtg

SEQ ID NO: 329941 - DNA, 15 bp, Homo sapiens
cctggggtgccctcc

SEQ ID NO: 329942 - DNA, 22 bp, Homo sapiens
cctggggtgccctccactgccc

SEQ ID NO: 329943 - DNA, 24 bp, Homo sapiens
cctggggtggggaggcagagggtc

SEQ ID NO: 329944 - DNA, 22 bp, Homo sapiens
cctggggtggttggaggcctgg

SEQ ID NO: 329945 - DNA, 21 bp, Homo sapiens
cctgggtaacaaagtgagacc

SEQ ID NO: 329946 - DNA, 19 bp, Homo sapiens
cctgggtcaccttcctggg

SEQ ID NO: 329947 - DNA, 15 bp, Homo sapiens
cctgggtctgtgtct

SEQ ID NO: 329948 - DNA, 18 bp, Homo sapiens
cctgggtgctctggctgg

SEQ ID NO: 329949 - DNA, 23 bp, Homo sapiens
cctgggtggggcagggcctggcc

SEQ ID NO: 329950 - DNA, 17 bp, Homo sapiens
cctggtcaacccgctgc

SEQ ID NO: 329951 - DNA, 18 bp, Homo sapiens
cctggtcaacccgctgct

SEQ ID NO: 329952 - DNA, 21 bp, Homo sapiens
cctggtcaacccgctgcttcc

SEQ ID NO: 329953 - DNA, 23 bp, Homo sapiens
cctggtcacaggactctgcctcc

SEQ ID NO: 329954 - DNA, 24 bp, Homo sapiens
cctggtcaccacaattagagcttg

SEQ ID NO: 329955 - DNA, 15 bp, Homo sapiens
cctggtcagcagagc

SEQ ID NO: 329956 - DNA, 16 bp, Homo sapiens
cctggtcagcagagcc

SEQ ID NO: 329957 - DNA, 14 bp, Homo sapiens
cctggtccagggaa

SEQ ID NO: 329958 - DNA, 21 bp, Homo sapiens
cctggtccagggaagctggcc

SEQ ID NO: 329959 - DNA, 15 bp, Homo sapiens
cctggtccctcgtcc

SEQ ID NO: 329960 - DNA, 15 bp, Homo sapiens
cctggtctggagccc

SEQ ID NO: 329961 - DNA, 18 bp, Homo sapiens
cctggtctggagccccta

SEQ ID NO: 329962 - DNA, 21 bp, Homo sapiens
cctggtctggagcccctatcc

SEQ ID NO: 329963 - DNA, 16 bp, Homo sapiens
cctggtctgttttctg

SEQ ID NO: 329964 - DNA, 19 bp, Homo sapiens
cctggtgacaggcagacac

SEQ ID NO: 329965 - DNA, 17 bp, Homo sapiens
cctggtgaggcccagcc

SEQ ID NO: 329966 - DNA, 14 bp, Homo sapiens
cctggtgcgctgtg

SEQ ID NO: 329967 - DNA, 16 bp, Homo sapiens
cctggtgcgctgtgct

SEQ ID NO: 329968 - DNA, 17 bp, Homo sapiens
cctggtgcgctgtgctc

SEQ ID NO: 329969 - DNA, 18 bp, Homo sapiens
cctggtgcgctgtgctcc

SEQ ID NO: 329970 - DNA, 22 bp, Homo sapiens
cctggtgcgctgtgctccagca

SEQ ID NO: 329971 - DNA, 23 bp, Homo sapiens
cctggtgcgctgtgctccagcag

SEQ ID NO: 329972 - DNA, 9 bp, Homo sapiens
cctggtgct

SEQ ID NO: 329973 - DNA, 12 bp, Homo sapiens
cctggtgctgct

SEQ ID NO: 329974 - DNA, 13 bp, Homo sapiens
cctggtgctggat

SEQ ID NO: 329975 - DNA, 17 bp, Homo sapiens
cctggtggcatggaaga

SEQ ID NO: 329976 - DNA, 17 bp, Homo sapiens
cctggtggcctctgccc

SEQ ID NO: 329977 - DNA, 16 bp, Homo sapiens
cctggtggggctgagc

SEQ ID NO: 329978 - DNA, 19 bp, Homo sapiens
cctggtggggtgtgcatgc

SEQ ID NO: 329979 - DNA, 13 bp, Homo sapiens
cctggtgtggaag

SEQ ID NO: 329980 - DNA, 13 bp, Homo sapiens
cctggttccctct

SEQ ID NO: 329981 - DNA, 20 bp, Homo sapiens
cctggttccggaatcctgtc

SEQ ID NO: 329982 - DNA, 20 bp, Homo sapiens
cctggttccttcctatgccc

SEQ ID NO: 329983 - DNA, 20 bp, Homo sapiens
cctggttttaccccagctcc

SEQ ID NO: 329984 - DNA, 17 bp, Homo sapiens
cctgtaaattattttaa

SEQ ID NO: 329985 - DNA, 23 bp, Homo sapiens
cctgtaaattattttaaattata

SEQ ID NO: 329986 - DNA, 19 bp, Homo sapiens
cctgtaatagcctcacctt

SEQ ID NO: 329987 - DNA, 20 bp, Homo sapiens
cctgtaatcatataataaat

SEQ ID NO: 329988 - DNA, 22 bp, Homo sapiens
cctgtaatcccagcactttggg

SEQ ID NO: 329989 - DNA, 16 bp, Homo sapiens
cctgtaatctttttct

SEQ ID NO: 329990 - DNA, 18 bp, Homo sapiens
cctgtaatctttttctcc

SEQ ID NO: 329991 - DNA, 21 bp, Homo sapiens
cctgtaatctttttctccacc

SEQ ID NO: 329992 - DNA, 18 bp, Homo sapiens
cctgtaatttttttctta

SEQ ID NO: 329993 - DNA, 15 bp, Homo sapiens
cctgtacccagccac

SEQ ID NO: 329994 - DNA, 17 bp, Homo sapiens
cctgtacccagccacct

SEQ ID NO: 329995 - DNA, 15 bp, Homo sapiens
cctgtacccagctcc

SEQ ID NO: 329996 - DNA, 22 bp, Homo sapiens
cctgtagacctagggaggacct

SEQ ID NO: 329997 - DNA, 23 bp, Homo sapiens
cctgtagacctagggaggacctt

SEQ ID NO: 329998 - DNA, 14 bp, Homo sapiens
cctgtagactagtg

SEQ ID NO: 329999 - DNA, 13 bp, Homo sapiens
cctgtagagccag

SEQ ID NO: 330000 - DNA, 18 bp, Homo sapiens
cctgtagagccagccttg

SEQ ID NO: 330001 - DNA, 20 bp, Homo sapiens
cctgtagagccagccttggt

SEQ ID NO: 330002 - DNA, 21 bp, Homo sapiens
cctgtaggaaacagaaaagag

SEQ ID NO: 330003 - DNA, 14 bp, Homo sapiens
cctgtagtcccagc

SEQ ID NO: 330004 - DNA, 15 bp, Homo sapiens
cctgtagtcccagct

SEQ ID NO: 330005 - DNA, 14 bp, Homo sapiens
cctgtagttaggaa

SEQ ID NO: 330006 - DNA, 13 bp, Homo sapiens
gctatccagccgc

SEQ ID NO: 330007 - DNA, 16 bp, Homo sapiens
gctatcccttctcaga

SEQ ID NO: 330008 - DNA, 20 bp, Homo sapiens
gctatcctgccaaaatcatt

SEQ ID NO: 330009 - DNA, 22 bp, Homo sapiens
gctatctagatagctgactcat

SEQ ID NO: 330010 - DNA, 13 bp, Homo sapiens
gctatgagaataa

SEQ ID NO: 330011 - DNA, 13 bp, Homo sapiens
gctatgcacacca

SEQ ID NO: 330012 - DNA, 17 bp, Homo sapiens
gctatgcacaccaaatt

SEQ ID NO: 330013 - DNA, 18 bp, Homo sapiens
gctatgcacaccaaattg

SEQ ID NO: 330014 - DNA, 13 bp, Homo sapiens
gctatgggagccc

SEQ ID NO: 330015 - DNA, 14 bp, Homo sapiens
gctatgggagcccc

SEQ ID NO: 330016 - DNA, 17 bp, Homo sapiens
gctatgggagccccagg

SEQ ID NO: 330017 - DNA, 18 bp, Homo sapiens
gctatgggagccccaggg

SEQ ID NO: 330018 - DNA, 18 bp, Homo sapiens
gctattaaaagaatccaa

SEQ ID NO: 330019 - DNA, 15 bp, Homo sapiens
gctattcccaggcag

SEQ ID NO: 330020 - DNA, 16 bp, Homo sapiens
gctattcccaggcagg

SEQ ID NO: 330021 - DNA, 15 bp, Homo sapiens
gctattccctggaga

SEQ ID NO: 330022 - DNA, 16 bp, Homo sapiens
gctattgacaagtcat

SEQ ID NO: 330023 - DNA, 12 bp, Homo sapiens
cctgtccagcct

SEQ ID NO: 330024 - DNA, 14 bp, Homo sapiens
cctgtccagcctgg

SEQ ID NO: 330025 - DNA, 22 bp, Homo sapiens
cctgtccagcctgggcagccag

SEQ ID NO: 330026 - DNA, 23 bp, Homo sapiens
cctgtccatccccagttggggct

SEQ ID NO: 330027 - DNA, 22 bp, Homo sapiens
cctgtcccaccaactctgcact

SEQ ID NO: 330028 - DNA, 16 bp, Homo sapiens
cctgtcccattctaga

SEQ ID NO: 330029 - DNA, 14 bp, Homo sapiens
cctgtcccccaagg

SEQ ID NO: 330030 - DNA, 16 bp, Homo sapiens
cctgtccccctcccct

SEQ ID NO: 330031 - DNA, 13 bp, Homo sapiens
cctgtcccgcctt

SEQ ID NO: 330032 - DNA, 16 bp, Homo sapiens
cctgtcccgccttcct

SEQ ID NO: 330033 - DNA, 13 bp, Homo sapiens
cctgtccctctcc

SEQ ID NO: 330034 - DNA, 11 bp, Homo sapiens
cctgtccctgc

SEQ ID NO: 330035 - DNA, 17 bp, Homo sapiens
cctgtccctggccatct

SEQ ID NO: 330036 - DNA, 19 bp, Homo sapiens
cctgtccctggccatctct

SEQ ID NO: 330037 - DNA, 16 bp, Homo sapiens
cctgtccctgtccccc

SEQ ID NO: 330038 - DNA, 19 bp, Homo sapiens
cctgtccgccctcttcccc

SEQ ID NO: 330039 - DNA, 22 bp, Homo sapiens
cctgtccgccctcttcccctct

SEQ ID NO: 330040 - DNA, 17 bp, Homo sapiens
cctgtcctcaccgtctc

SEQ ID NO: 330041 - DNA, 23 bp, Homo sapiens
cctgtcctgatggtcagctccct

SEQ ID NO: 330042 - DNA, 20 bp, Homo sapiens
cctgtcctggtacagcaggg

SEQ ID NO: 330043 - DNA, 21 bp, Homo sapiens
cctgtcctggtacagcagggt

SEQ ID NO: 330044 - DNA, 22 bp, Homo sapiens
cctgtccttcccacggccactg

SEQ ID NO: 330045 - DNA, 17 bp, Homo sapiens
cctgtcgagacacttgc

SEQ ID NO: 330046 - DNA, 18 bp, Homo sapiens
cctgtcgagacacttgcc

SEQ ID NO: 330047 - DNA, 22 bp, Homo sapiens
cctgtctaatgaaacctgtgtc

SEQ ID NO: 330048 - DNA, 18 bp, Homo sapiens
cctgtctcatccccaggg

SEQ ID NO: 330049 - DNA, 13 bp, Homo sapiens
cctgtctcccctc

SEQ ID NO: 330050 - DNA, 14 bp, Homo sapiens
cctgtctcccctct

SEQ ID NO: 330051 - DNA, 17 bp, Homo sapiens
cctgtctcccctctgct

SEQ ID NO: 330052 - DNA, 19 bp, Homo sapiens
cctgtctcccctctgctgg

SEQ ID NO: 330053 - DNA, 20 bp, Homo sapiens
cctgtctcccctctgctggc

SEQ ID NO: 330054 - DNA, 17 bp, Homo sapiens
cctgtctcctctgtcag

SEQ ID NO: 330055 - DNA, 21 bp, Homo sapiens
cctgtctctacaaaaaaaatc

SEQ ID NO: 330056 - DNA, 20 bp, Homo sapiens
cctgtctgcgccgctgtgct

SEQ ID NO: 330057 - DNA, 21 bp, Homo sapiens
cctgtctgcgccgctgtgctg

SEQ ID NO: 330058 - DNA, 22 bp, Homo sapiens
cctgtctggaagacgtggctct

SEQ ID NO: 330059 - DNA, 19 bp, Homo sapiens
cctgtctgtctctccatct

SEQ ID NO: 330060 - DNA, 22 bp, Homo sapiens
cctgtctgtctgtctgtcccaa

SEQ ID NO: 330061 - DNA, 20 bp, Homo sapiens
cctgtcttcagatcctgctg

SEQ ID NO: 330062 - DNA, 15 bp, Homo sapiens
cctgtcttccaagga

SEQ ID NO: 330063 - DNA, 22 bp, Homo sapiens
cctgtcttctttctcctgtggt

SEQ ID NO: 330064 - DNA, 23 bp, Homo sapiens
cctgtctttgctgtttatatata

SEQ ID NO: 330065 - DNA, 20 bp, Homo sapiens
cctgtgaataaaaaccctgt

SEQ ID NO: 330066 - DNA, 17 bp, Homo sapiens
cctgtgacaaaggatga

SEQ ID NO: 330067 - DNA, 22 bp, Homo sapiens
cctgtgaccctctcactttggt

SEQ ID NO: 330068 - DNA, 20 bp, Homo sapiens
cctgtgaccggggtcctgag

SEQ ID NO: 330069 - DNA, 14 bp, Homo sapiens
cctgtgcagcagcc

SEQ ID NO: 330070 - DNA, 17 bp, Homo sapiens
cctgtgcagcagcccag

SEQ ID NO: 330071 - DNA, 22 bp, Homo sapiens
cctgtgcagcagcccagcttcc

SEQ ID NO: 330072 - DNA, 15 bp, Homo sapiens
cctgtgccaacctga

SEQ ID NO: 330073 - DNA, 17 bp, Homo sapiens
cctgtgccaggactctc

SEQ ID NO: 330074 - DNA, 17 bp, Homo sapiens
cctgtgcccatcatctc

SEQ ID NO: 330075 - DNA, 21 bp, Homo sapiens
cctgtgcccatcatctctgcc

SEQ ID NO: 330076 - DNA, 18 bp, Homo sapiens
cctgtgcctaacaccagc

SEQ ID NO: 330077 - DNA, 19 bp, Homo sapiens
cctgtgctacagagaaaat

SEQ ID NO: 330078 - DNA, 13 bp, Homo sapiens
cctgtgctacctc

SEQ ID NO: 330079 - DNA, 19 bp, Homo sapiens
cctgtgctagttttacaga

SEQ ID NO: 330080 - DNA, 19 bp, Homo sapiens
cctgtgctgaggactccct

SEQ ID NO: 330081 - DNA, 15 bp, Homo sapiens
cctgtgctgcatgcg

SEQ ID NO: 330082 - DNA, 13 bp, Homo sapiens
cctgtgctgctgc

SEQ ID NO: 330083 - DNA, 15 bp, Homo sapiens
cctgtgctgggccag

SEQ ID NO: 330084 - DNA, 17 bp, Homo sapiens
cctgtgctgggccagtg

SEQ ID NO: 330085 - DNA, 20 bp, Homo sapiens
cctgtgctgggccagtggct

SEQ ID NO: 330086 - DNA, 21 bp, Homo sapiens
cctgtgctgggccagtggctg

SEQ ID NO: 330087 - DNA, 20 bp, Homo sapiens
cctgtggaagggactaggag

SEQ ID NO: 330088 - DNA, 18 bp, Homo sapiens
cctgtggagcccgcaccc

SEQ ID NO: 330089 - DNA, 20 bp, Homo sapiens
cctgtggcagaaaagaggag

SEQ ID NO: 330090 - DNA, 14 bp, Homo sapiens
cctgtggccagagc

SEQ ID NO: 330091 - DNA, 16 bp, Homo sapiens
cctgtggccaggaggt

SEQ ID NO: 330092 - DNA, 13 bp, Homo sapiens
cctgtggccttgc

SEQ ID NO: 330093 - DNA, 22 bp, Homo sapiens
cctgtggccttgcccgccagcc

SEQ ID NO: 330094 - DNA, 14 bp, Homo sapiens
cctgtgggagcctg

SEQ ID NO: 330095 - DNA, 13 bp, Homo sapiens
cctgtgggagtcc

SEQ ID NO: 330096 - DNA, 14 bp, Homo sapiens
cctgtgggagtcca

SEQ ID NO: 330097 - DNA, 15 bp, Homo sapiens
cctgtgggagtccac

SEQ ID NO: 330098 - DNA, 21 bp, Homo sapiens
cctgtggggcctgatggtgct

SEQ ID NO: 330099 - DNA, 18 bp, Homo sapiens
cctgtggtaccctggcag

SEQ ID NO: 330100 - DNA, 21 bp, Homo sapiens
cctgtggtaccctggcagaga

SEQ ID NO: 330101 - DNA, 14 bp, Homo sapiens
cctgtggtgaagtg

SEQ ID NO: 330102 - DNA, 17 bp, Homo sapiens
cctgtggtgaagtgtgg

SEQ ID NO: 330103 - DNA, 20 bp, Homo sapiens
cctgtggtgatgtgcctgta

SEQ ID NO: 330104 - DNA, 16 bp, Homo sapiens
cctgtggttacagtgc

SEQ ID NO: 330105 - DNA, 23 bp, Homo sapiens
cctgtggttacagtgcagacagg

SEQ ID NO: 330106 - DNA, 15 bp, Homo sapiens
cctgtgtccagcagc

SEQ ID NO: 330107 - DNA, 18 bp, Homo sapiens
cctgtgtcccctgacctg

SEQ ID NO: 330108 - DNA, 19 bp, Homo sapiens
cctgtgtggagagggaatg

SEQ ID NO: 330109 - DNA, 23 bp, Homo sapiens
cctgtgtggagagggaatgtgaa

SEQ ID NO: 330110 - DNA, 18 bp, Homo sapiens
cctgtgtgggagggcgag

SEQ ID NO: 330111 - DNA, 19 bp, Homo sapiens
cctgtgtgttcttttgata

SEQ ID NO: 330112 - DNA, 22 bp, Homo sapiens
cctgtgtgttcttttgatacat

SEQ ID NO: 330113 - DNA, 23 bp, Homo sapiens
cctgtgtgttcttttgatacatt

SEQ ID NO: 330114 - DNA, 20 bp, Homo sapiens
cctgtgtgttgccaggcagg

SEQ ID NO: 330115 - DNA, 21 bp, Homo sapiens
cctgtgttagtgtctgtccat

SEQ ID NO: 330116 - DNA, 15 bp, Homo sapiens
cctgtgttggggggc

SEQ ID NO: 330117 - DNA, 17 bp, Homo sapiens
cctgtgttggggggcaa

SEQ ID NO: 330118 - DNA, 21 bp, Homo sapiens
cctgttaacactgtaatatct

SEQ ID NO: 330119 - DNA, 14 bp, Homo sapiens
cctgttaaccctcc

SEQ ID NO: 330120 - DNA, 21 bp, Homo sapiens
cctgttacctaattagagcag

SEQ ID NO: 330121 - DNA, 22 bp, Homo sapiens
cctgttacctaattagagcaga

SEQ ID NO: 330122 - DNA, 14 bp, Homo sapiens
cctgttcaaagtac

SEQ ID NO: 330123 - DNA, 14 bp, Homo sapiens
cctgttcctgcctt

SEQ ID NO: 330124 - DNA, 17 bp, Homo sapiens
cctgttcctgccttctc

SEQ ID NO: 330125 - DNA, 21 bp, Homo sapiens
cctgttcctgccttctcttct

SEQ ID NO: 330126 - DNA, 13 bp, Homo sapiens
cctgttctgaact

SEQ ID NO: 330127 - DNA, 14 bp, Homo sapiens
cctgttctgaactg

SEQ ID NO: 330128 - DNA, 13 bp, Homo sapiens
cctgttctgtagg

SEQ ID NO: 330129 - DNA, 15 bp, Homo sapiens
cctgttctgtaggag

SEQ ID NO: 330130 - DNA, 18 bp, Homo sapiens
cctgttctgtgtctgctg

SEQ ID NO: 330131 - DNA, 12 bp, Homo sapiens
cctgttgctttt

SEQ ID NO: 330132 - DNA, 11 bp, Homo sapiens
cctgtttctaa

SEQ ID NO: 330133 - DNA, 14 bp, Homo sapiens
cctgtttctgcagc

SEQ ID NO: 330134 - DNA, 18 bp, Homo sapiens
cctgtttctgcagccctt

SEQ ID NO: 330135 - DNA, 19 bp, Homo sapiens
cctgttttattgagttctg

SEQ ID NO: 330136 - DNA, 15 bp, Homo sapiens
ccttaaaaaataaag

SEQ ID NO: 330137 - DNA, 11 bp, Homo sapiens
ccttaaaatgc

SEQ ID NO: 330138 - DNA, 13 bp, Homo sapiens
ccttaaattaaac

SEQ ID NO: 330139 - DNA, 21 bp, Homo sapiens
ccttaaattaaacaatttatt

SEQ ID NO: 330140 - DNA, 23 bp, Homo sapiens
ccttaaccctaaaattttaaggc

SEQ ID NO: 330141 - DNA, 22 bp, Homo sapiens
ccttaagggttgaaggcagtct

SEQ ID NO: 330142 - DNA, 23 bp, Homo sapiens
ccttaagtcttactgttttgtgc

SEQ ID NO: 330143 - DNA, 16 bp, Homo sapiens
gctcccaccagcccac

SEQ ID NO: 330144 - DNA, 18 bp, Homo sapiens
gctcccaccagcccacat

SEQ ID NO: 330145 - DNA, 14 bp, Homo sapiens
gctcccagacccag

SEQ ID NO: 330146 - DNA, 16 bp, Homo sapiens
gctcccagacccaggg

SEQ ID NO: 330147 - DNA, 18 bp, Homo sapiens
gctcccagacccagggca

SEQ ID NO: 330148 - DNA, 20 bp, Homo sapiens
gctcccagacccagggcagt

SEQ ID NO: 330149 - DNA, 22 bp, Homo sapiens
gctcccagcatttgtccaccca

SEQ ID NO: 330150 - DNA, 22 bp, Homo sapiens
gctcccaggacgcagggagacc

SEQ ID NO: 330151 - DNA, 14 bp, Homo sapiens
gctcccagggccat

SEQ ID NO: 330152 - DNA, 17 bp, Homo sapiens
ccttaccctactggctg

SEQ ID NO: 330153 - DNA, 19 bp, Homo sapiens
ccttaccctactggctgta

SEQ ID NO: 330154 - DNA, 16 bp, Homo sapiens
ccttacggtcatgatg

SEQ ID NO: 330155 - DNA, 20 bp, Homo sapiens
ccttactctgagcccaggcc

SEQ ID NO: 330156 - DNA, 22 bp, Homo sapiens
ccttactctgagcccaggccgt

SEQ ID NO: 330157 - DNA, 18 bp, Homo sapiens
ccttagaacctttcttac

SEQ ID NO: 330158 - DNA, 16 bp, Homo sapiens
ccttagaatgagggaa

SEQ ID NO: 330159 - DNA, 16 bp, Homo sapiens
ccttagactccttctc

SEQ ID NO: 330160 - DNA, 17 bp, Homo sapiens
ccttagagattgcccca

SEQ ID NO: 330161 - DNA, 14 bp, Homo sapiens
ccttagcagctcag

SEQ ID NO: 330162 - DNA, 16 bp, Homo sapiens
ccttagcagctcaggc

SEQ ID NO: 330163 - DNA, 22 bp, Homo sapiens
ccttagcagctcaggcgcagcc

SEQ ID NO: 330164 - DNA, 20 bp, Homo sapiens
ccttagccctgtctgctagg

SEQ ID NO: 330165 - DNA, 14 bp, Homo sapiens
ccttagcctctccc

SEQ ID NO: 330166 - DNA, 19 bp, Homo sapiens
ccttagccttgctgtagag

SEQ ID NO: 330167 - DNA, 15 bp, Homo sapiens
ccttagcgttctgga

SEQ ID NO: 330168 - DNA, 21 bp, Homo sapiens
ccttagctacaatcctacctt

SEQ ID NO: 330169 - DNA, 16 bp, Homo sapiens
ccttatcaagtgtctt

SEQ ID NO: 330170 - DNA, 21 bp, Homo sapiens
ccttatctgtgcgtgaaacac

SEQ ID NO: 330171 - DNA, 16 bp, Homo sapiens
ccttattgatctttgc

SEQ ID NO: 330172 - DNA, 20 bp, Homo sapiens
ccttattgatctttgcccat

SEQ ID NO: 330173 - DNA, 15 bp, Homo sapiens
ccttattttgtatta

SEQ ID NO: 330174 - DNA, 19 bp, Homo sapiens
ccttatttttatttatttt

SEQ ID NO: 330175 - DNA, 14 bp, Homo sapiens
ccttcaaccattcc

SEQ ID NO: 330176 - DNA, 13 bp, Homo sapiens
ccttcacatctcc

SEQ ID NO: 330177 - DNA, 12 bp, Homo sapiens
ccttcacccctt

SEQ ID NO: 330178 - DNA, 14 bp, Homo sapiens
ccttcacctctgaa

SEQ ID NO: 330179 - DNA, 14 bp, Homo sapiens
ccttcacgctggct

SEQ ID NO: 330180 - DNA, 15 bp, Homo sapiens
ccttcacgctggctt

SEQ ID NO: 330181 - DNA, 18 bp, Homo sapiens
ccttcactccctgtcata

SEQ ID NO: 330182 - DNA, 13 bp, Homo sapiens
ccttcactctgac

SEQ ID NO: 330183 - DNA, 13 bp, Homo sapiens
ccttcactggaga

SEQ ID NO: 330184 - DNA, 16 bp, Homo sapiens
ccttcactggagaccg

SEQ ID NO: 330185 - DNA, 23 bp, Homo sapiens
ccttcagaaaagacacttcaatg

SEQ ID NO: 330186 - DNA, 18 bp, Homo sapiens
ccttcagactttgcttcc

SEQ ID NO: 330187 - DNA, 21 bp, Homo sapiens
ccttcagactttgcttcccat

SEQ ID NO: 330188 - DNA, 13 bp, Homo sapiens
ccttcagatccta

SEQ ID NO: 330189 - DNA, 19 bp, Homo sapiens
ccttcagattatttccagt

SEQ ID NO: 330190 - DNA, 17 bp, Homo sapiens
ccttcagcagctagagc

SEQ ID NO: 330191 - DNA, 21 bp, Homo sapiens
ccttcagccgagcccagacct

SEQ ID NO: 330192 - DNA, 16 bp, Homo sapiens
ccttcaggacccttct

SEQ ID NO: 330193 - DNA, 12 bp, Homo sapiens
ccttcagggcca

SEQ ID NO: 330194 - DNA, 15 bp, Homo sapiens
ccttcagggccagaa

SEQ ID NO: 330195 - DNA, 18 bp, Homo sapiens
ccttcagggccagaagga

SEQ ID NO: 330196 - DNA, 21 bp, Homo sapiens
ccttcagtatcaaggctgcct

SEQ ID NO: 330197 - DNA, 23 bp, Homo sapiens
ccttcagtgagcccctccccagc

SEQ ID NO: 330198 - DNA, 14 bp, Homo sapiens
ccttcataaattat

SEQ ID NO: 330199 - DNA, 17 bp, Homo sapiens
ccttcattaaatgtttg

SEQ ID NO: 330200 - DNA, 16 bp, Homo sapiens
ccttcatttcatcctg

SEQ ID NO: 330201 - DNA, 17 bp, Homo sapiens
ccttccaaaaattatta

SEQ ID NO: 330202 - DNA, 18 bp, Homo sapiens
ccttccaaaaattattat

SEQ ID NO: 330203 - DNA, 21 bp, Homo sapiens
ccttccacctcacaactcctt

SEQ ID NO: 330204 - DNA, 15 bp, Homo sapiens
ccttccactgcctct

SEQ ID NO: 330205 - DNA, 16 bp, Homo sapiens
ccttccactgcctctg

SEQ ID NO: 330206 - DNA, 17 bp, Homo sapiens
ccttccactgcctctgc

SEQ ID NO: 330207 - DNA, 22 bp, Homo sapiens
ccttccagcccagacccccagt

SEQ ID NO: 330208 - DNA, 16 bp, Homo sapiens
ccttccaggacccctg

SEQ ID NO: 330209 - DNA, 15 bp, Homo sapiens
ccttccaggccatca

SEQ ID NO: 330210 - DNA, 20 bp, Homo sapiens
ccttccaggcgtagggccag

SEQ ID NO: 330211 - DNA, 15 bp, Homo sapiens
ccttccataattatg

SEQ ID NO: 330212 - DNA, 23 bp, Homo sapiens
ccttccatccttgactgaagcga

SEQ ID NO: 330213 - DNA, 20 bp, Homo sapiens
ccttccatgtcgcctctgca

SEQ ID NO: 330214 - DNA, 23 bp, Homo sapiens
ccttccatgtcgcctctgcattc

SEQ ID NO: 330215 - DNA, 22 bp, Homo sapiens
ccttccattgctcccagtgcca

SEQ ID NO: 330216 - DNA, 15 bp, Homo sapiens
ccttcccacccctat

SEQ ID NO: 330217 - DNA, 13 bp, Homo sapiens
ccttcccacggcc

SEQ ID NO: 330218 - DNA, 17 bp, Homo sapiens
ccttcccacggccactg

SEQ ID NO: 330219 - DNA, 13 bp, Homo sapiens
ccttcccaggcca

SEQ ID NO: 330220 - DNA, 15 bp, Homo sapiens
ccttcccatgccctg

SEQ ID NO: 330221 - DNA, 17 bp, Homo sapiens
ccttcccatttctctac

SEQ ID NO: 330222 - DNA, 18 bp, Homo sapiens
ccttcccatttctctaca

SEQ ID NO: 330223 - DNA, 14 bp, Homo sapiens
ccttccccactccc

SEQ ID NO: 330224 - DNA, 15 bp, Homo sapiens
ccttccccactcccg

SEQ ID NO: 330225 - DNA, 13 bp, Homo sapiens
ccttccccactct

SEQ ID NO: 330226 - DNA, 20 bp, Homo sapiens
ccttccccactgcctgccca

SEQ ID NO: 330227 - DNA, 14 bp, Homo sapiens
ccttcccccagccc

SEQ ID NO: 330228 - DNA, 20 bp, Homo sapiens
ccttcccccagcccaataaa

SEQ ID NO: 330229 - DNA, 12 bp, Homo sapiens
ccttcccctccc

SEQ ID NO: 330230 - DNA, 19 bp, Homo sapiens
ccttcccctccctggctcc

SEQ ID NO: 330231 - DNA, 22 bp, Homo sapiens
ccttcccctccctggctcccat

SEQ ID NO: 330232 - DNA, 22 bp, Homo sapiens
ccttcccctgcgccctccctcc

SEQ ID NO: 330233 - DNA, 19 bp, Homo sapiens
ccttccccttttgcctggc

SEQ ID NO: 330234 - DNA, 22 bp, Homo sapiens
ccttccccttttgcctggctgt

SEQ ID NO: 330235 - DNA, 15 bp, Homo sapiens
ccttcccgcagcacc

SEQ ID NO: 330236 - DNA, 21 bp, Homo sapiens
ccttcccgcagcaccagcctg

SEQ ID NO: 330237 - DNA, 20 bp, Homo sapiens
ccttccctagttctttgcat

SEQ ID NO: 330238 - DNA, 15 bp, Homo sapiens
ccttccctcactctt

SEQ ID NO: 330239 - DNA, 12 bp, Homo sapiens
ccttccctctcc

SEQ ID NO: 330240 - DNA, 13 bp, Homo sapiens
ccttccctgcttt

SEQ ID NO: 330241 - DNA, 14 bp, Homo sapiens
ccttccctgctttg

SEQ ID NO: 330242 - DNA, 15 bp, Homo sapiens
ccttccctggccccg

SEQ ID NO: 330243 - DNA, 13 bp, Homo sapiens
ccttccctggtcc

SEQ ID NO: 330244 - DNA, 16 bp, Homo sapiens
ccttcctatgcccagg

SEQ ID NO: 330245 - DNA, 12 bp, Homo sapiens
ccttcctcatcc

SEQ ID NO: 330246 - DNA, 13 bp, Homo sapiens
ccttcctcatccc

SEQ ID NO: 330247 - DNA, 14 bp, Homo sapiens
ccttcctcctccac

SEQ ID NO: 330248 - DNA, 17 bp, Homo sapiens
ccttcctcctccacagt

SEQ ID NO: 330249 - DNA, 20 bp, Homo sapiens
ccttcctcctccacagtgct

SEQ ID NO: 330250 - DNA, 13 bp, Homo sapiens
ccttcctcctgaa

SEQ ID NO: 330251 - DNA, 14 bp, Homo sapiens
ccttcctctccact

SEQ ID NO: 330252 - DNA, 17 bp, Homo sapiens
ccttcctctccactgcc

SEQ ID NO: 330253 - DNA, 12 bp, Homo sapiens
ccttcctctgca

SEQ ID NO: 330254 - DNA, 16 bp, Homo sapiens
ccttcctctgcagctg

SEQ ID NO: 330255 - DNA, 13 bp, Homo sapiens
ccttcctgactgg

SEQ ID NO: 330256 - DNA, 14 bp, Homo sapiens
ccttcctgccctgt

SEQ ID NO: 330257 - DNA, 17 bp, Homo sapiens
ccttcctggactggccc

SEQ ID NO: 330258 - DNA, 23 bp, Homo sapiens
ccttcctgggcagcccagagaga

SEQ ID NO: 330259 - DNA, 18 bp, Homo sapiens
ccttcctgtcctgctcac

SEQ ID NO: 330260 - DNA, 13 bp, Homo sapiens
ccttcctgtcttc

SEQ ID NO: 330261 - DNA, 15 bp, Homo sapiens
ccttcctgttctgaa

SEQ ID NO: 330262 - DNA, 17 bp, Homo sapiens
ccttcctgttctgaact

SEQ ID NO: 330263 - DNA, 20 bp, Homo sapiens
ccttcctgttctgtgtctgc

SEQ ID NO: 330264 - DNA, 16 bp, Homo sapiens
ccttcctttccctggg

SEQ ID NO: 330265 - DNA, 20 bp, Homo sapiens
ccttcgatacaccgggcctg

SEQ ID NO: 330266 - DNA, 22 bp, Homo sapiens
ccttctaatccatgtgctgctg

SEQ ID NO: 330267 - DNA, 14 bp, Homo sapiens
ccttctacactctc

SEQ ID NO: 330268 - DNA, 15 bp, Homo sapiens
ccttctacactctcc

SEQ ID NO: 330269 - DNA, 16 bp, Homo sapiens
ccttctacactctcct

SEQ ID NO: 330270 - DNA, 17 bp, Homo sapiens
ccttctacactctcctg

SEQ ID NO: 330271 - DNA, 16 bp, Homo sapiens
ccttctactttttcct

SEQ ID NO: 330272 - DNA, 19 bp, Homo sapiens
ccttctactttttccttcc

SEQ ID NO: 330273 - DNA, 21 bp, Homo sapiens
ccttctactttttccttcctg

SEQ ID NO: 330274 - DNA, 20 bp, Homo sapiens
ccttctaggcatctcctctc

SEQ ID NO: 330275 - DNA, 14 bp, Homo sapiens
ccttctcacagcac

SEQ ID NO: 330276 - DNA, 17 bp, Homo sapiens
ccttctcagctctccac

SEQ ID NO: 330277 - DNA, 15 bp, Homo sapiens
ccttctcccagcaca

SEQ ID NO: 330278 - DNA, 14 bp, Homo sapiens
ccttctccccaatc

SEQ ID NO: 330279 - DNA, 12 bp, Homo sapiens
ccttctcccctc

SEQ ID NO: 330280 - DNA, 13 bp, Homo sapiens
ccttctcccctcc

SEQ ID NO: 330281 - DNA, 15 bp, Homo sapiens
ccttctcccctccag

SEQ ID NO: 330282 - DNA, 23 bp, Homo sapiens
gctctccaaaggggctgctgggg

SEQ ID NO: 330283 - DNA, 18 bp, Homo sapiens
gctgagagccccagctga

SEQ ID NO: 330284 - DNA, 22 bp, Homo sapiens
gctgagatgagccccacgtgga

SEQ ID NO: 330285 - DNA, 13 bp, Homo sapiens
gctgagatgtgga

SEQ ID NO: 330286 - DNA, 11 bp, Homo sapiens
ggggcctggcg

SEQ ID NO: 330287 - DNA, 19 bp, Homo sapiens
ggggcctggcttgctccag

SEQ ID NO: 330288 - DNA, 14 bp, Homo sapiens
ggggcgagggaggg

SEQ ID NO: 330289 - DNA, 22 bp, Homo sapiens
ggggcgctcaggacccaggccc

SEQ ID NO: 330290 - DNA, 18 bp, Homo sapiens
ggggctaactggccccag

SEQ ID NO: 330291 - DNA, 16 bp, Homo sapiens
ggggctcgagtgcccc

SEQ ID NO: 330292 - DNA, 15 bp, Homo sapiens
ggggctcgccccacc

SEQ ID NO: 330293 - DNA, 17 bp, Homo sapiens
ggggctcgccccaccca

SEQ ID NO: 330294 - DNA, 23 bp, Homo sapiens
ggggctctagggttgctggagcc

SEQ ID NO: 330295 - DNA, 21 bp, Homo sapiens
ggggctctgcttcctcagccc

SEQ ID NO: 330296 - DNA, 14 bp, Homo sapiens
ggggctgaggggca

SEQ ID NO: 330297 - DNA, 12 bp, Homo sapiens
ggggctgctggg

SEQ ID NO: 330298 - DNA, 13 bp, Homo sapiens
ggggctggccctg

SEQ ID NO: 330299 - DNA, 17 bp, Homo sapiens
ggggctggccctgccct

SEQ ID NO: 330300 - DNA, 14 bp, Homo sapiens
ggggctgggcagag

SEQ ID NO: 330301 - DNA, 23 bp, Homo sapiens
ggggctgggggtgaggggccagg

SEQ ID NO: 330302 - DNA, 22 bp, Homo sapiens
ggggctgtacacaccctccagc

SEQ ID NO: 330303 - DNA, 24 bp, Homo sapiens
ggggcttcaccagtctgtctactg

SEQ ID NO: 330304 - DNA, 18 bp, Homo sapiens
ggggcttggagcagagac

SEQ ID NO: 330305 - DNA, 24 bp, Homo sapiens
ggggcttggagcagagacggcagc

SEQ ID NO: 330306 - DNA, 19 bp, Homo sapiens
ggggcttggggtagagagg

SEQ ID NO: 330307 - DNA, 21 bp, Homo sapiens
ggggcttggggtagagaggac

SEQ ID NO: 330308 - DNA, 18 bp, Homo sapiens
ggggctttggtggcccct

SEQ ID NO: 330309 - DNA, 22 bp, Homo sapiens
ggggcttttgtgccaggagtgg

SEQ ID NO: 330310 - DNA, 14 bp, Homo sapiens
gggggaggagcacc

SEQ ID NO: 330311 - DNA, 15 bp, Homo sapiens
gggggaggccacccc

SEQ ID NO: 330312 - DNA, 18 bp, Homo sapiens
gggggaggccgaggcagg

SEQ ID NO: 330313 - DNA, 12 bp, Homo sapiens
gggggatatgaa

SEQ ID NO: 330314 - DNA, 20 bp, Homo sapiens
gggggcaaggtgggggagcc

SEQ ID NO: 330315 - DNA, 15 bp, Homo sapiens
gggggcacagccaga

SEQ ID NO: 330316 - DNA, 16 bp, Homo sapiens
gggggcacagccagaa

SEQ ID NO: 330317 - DNA, 22 bp, Homo sapiens
gggggcatctgagtccagctcc

SEQ ID NO: 330318 - DNA, 17 bp, Homo sapiens
gggggcatgggtggagg

SEQ ID NO: 330319 - DNA, 15 bp, Homo sapiens
gggggccaacaccag

SEQ ID NO: 330320 - DNA, 14 bp, Homo sapiens
gggggccaaggtcc

SEQ ID NO: 330321 - DNA, 21 bp, Homo sapiens
gggggccatgaggcctcagtg

SEQ ID NO: 330322 - DNA, 16 bp, Homo sapiens
gggggcctctgcctcc

SEQ ID NO: 330323 - DNA, 15 bp, Homo sapiens
gggggcctgctgtgg

SEQ ID NO: 330324 - DNA, 12 bp, Homo sapiens
gggggcgctcag

SEQ ID NO: 330325 - DNA, 23 bp, Homo sapiens
gggggcgctcaggacccaggccc

SEQ ID NO: 330326 - DNA, 16 bp, Homo sapiens
gggggctaactggccc

SEQ ID NO: 330327 - DNA, 20 bp, Homo sapiens
gggggcttggggtagagagg

SEQ ID NO: 330328 - DNA, 17 bp, Homo sapiens
gggggtactagaagctg

SEQ ID NO: 330329 - DNA, 18 bp, Homo sapiens
gggggtcaggaggcaggg

SEQ ID NO: 330330 - DNA, 18 bp, Homo sapiens
gggggtcccaggatcccc

SEQ ID NO: 330331 - DNA, 15 bp, Homo sapiens
gggggtcggaagcct

SEQ ID NO: 330332 - DNA, 15 bp, Homo sapiens
gggggttgggttcca

SEQ ID NO: 330333 - DNA, 16 bp, Homo sapiens
ggggtaccacatggtc

SEQ ID NO: 330334 - DNA, 22 bp, Homo sapiens
ggggtaggaaaccaccctgagg

SEQ ID NO: 330335 - DNA, 15 bp, Homo sapiens
ggggtccccggacgc

SEQ ID NO: 330336 - DNA, 16 bp, Homo sapiens
ggggtcctgaggctgg

SEQ ID NO: 330337 - DNA, 17 bp, Homo sapiens
ggggtcgtgaggcaaga

SEQ ID NO: 330338 - DNA, 15 bp, Homo sapiens
ggggtctatacattc

SEQ ID NO: 330339 - DNA, 12 bp, Homo sapiens
ggggtctccctg

SEQ ID NO: 330340 - DNA, 17 bp, Homo sapiens
ggggtctccctgagcct

SEQ ID NO: 330341 - DNA, 20 bp, Homo sapiens
ggggtctctgagcagtgggg

SEQ ID NO: 330342 - DNA, 16 bp, Homo sapiens
ggggtctgcctcccac

SEQ ID NO: 330343 - DNA, 22 bp, Homo sapiens
ggggtctgctctgtgcctggga

SEQ ID NO: 330344 - DNA, 12 bp, Homo sapiens
ggggtctgggag

SEQ ID NO: 330345 - DNA, 18 bp, Homo sapiens
ggggtctgggaggcaggt

SEQ ID NO: 330346 - DNA, 17 bp, Homo sapiens
ggggtctgtgctgtgcc

SEQ ID NO: 330347 - DNA, 14 bp, Homo sapiens
ggggtgaagctggg

SEQ ID NO: 330348 - DNA, 13 bp, Homo sapiens
ggggtgaggacca

SEQ ID NO: 330349 - DNA, 13 bp, Homo sapiens
ggggtgcctgagc

SEQ ID NO: 330350 - DNA, 22 bp, Homo sapiens
ggggtgcctggtgcgctgtgct

SEQ ID NO: 330351 - DNA, 21 bp, Homo sapiens
ggggtgcgctcacctgcagcc

SEQ ID NO: 330352 - DNA, 12 bp, Homo sapiens
ggggtgggaggc

SEQ ID NO: 330353 - DNA, 16 bp, Homo sapiens
ggggtgggaggctccc

SEQ ID NO: 330354 - DNA, 14 bp, Homo sapiens
ggggtgggcctctg

SEQ ID NO: 330355 - DNA, 16 bp, Homo sapiens
ggggtggggaggcaga

SEQ ID NO: 330356 - DNA, 19 bp, Homo sapiens
ggggtggggcttggaaggg

SEQ ID NO: 330357 - DNA, 15 bp, Homo sapiens
ggggtggggtgcctg

SEQ ID NO: 330358 - DNA, 16 bp, Homo sapiens
ggggttattttctggt

SEQ ID NO: 330359 - DNA, 22 bp, Homo sapiens
ggggttcacgtcactgccagag

SEQ ID NO: 330360 - DNA, 21 bp, Homo sapiens
ggggttgggattgggggctgg

SEQ ID NO: 330361 - DNA, 19 bp, Homo sapiens
ggggtttccacacaggccc

SEQ ID NO: 330362 - DNA, 20 bp, Homo sapiens
ggggtttctggttggaggcc

SEQ ID NO: 330363 - DNA, 15 bp, Homo sapiens
ctccctgcctgctcc

SEQ ID NO: 330364 - DNA, 14 bp, Homo sapiens
ctccctgctcagct

SEQ ID NO: 330365 - DNA, 16 bp, Homo sapiens
ctccctggactctgtg

SEQ ID NO: 330366 - DNA, 13 bp, Homo sapiens
ctccctggcctgt

SEQ ID NO: 330367 - DNA, 14 bp, Homo sapiens
ctccctggctccca

SEQ ID NO: 330368 - DNA, 16 bp, Homo sapiens
ctccctggctgtgagc

SEQ ID NO: 330369 - DNA, 19 bp, Homo sapiens
ctccctgggcctgtctcag

SEQ ID NO: 330370 - DNA, 20 bp, Homo sapiens
ctccctgggcctgtctcaga

SEQ ID NO: 330371 - DNA, 19 bp, Homo sapiens
ctccctggggaccaggagc

SEQ ID NO: 330372 - DNA, 20 bp, Homo sapiens
ctccctggggaccaggagct

SEQ ID NO: 330373 - DNA, 21 bp, Homo sapiens
ctccctggggaccaggagcta

SEQ ID NO: 330374 - DNA, 22 bp, Homo sapiens
ctccctggggaccaggagctag

SEQ ID NO: 330375 - DNA, 11 bp, Homo sapiens
ctccctgggtt

SEQ ID NO: 330376 - DNA, 13 bp, Homo sapiens
ctccctgtcgcct

SEQ ID NO: 330377 - DNA, 23 bp, Homo sapiens
ctccctgtctccagggcccccac

SEQ ID NO: 330378 - DNA, 19 bp, Homo sapiens
ctccctgttatctgctaga

SEQ ID NO: 330379 - DNA, 23 bp, Homo sapiens
ctcccttcaaccattccccatgg

SEQ ID NO: 330380 - DNA, 15 bp, Homo sapiens
ctcccttcatccttc

SEQ ID NO: 330381 - DNA, 19 bp, Homo sapiens
ctcccttccccactctgct

SEQ ID NO: 330382 - DNA, 19 bp, Homo sapiens
ctcccttcctctctcctta

SEQ ID NO: 330383 - DNA, 12 bp, Homo sapiens
ctcccttctgat

SEQ ID NO: 330384 - DNA, 17 bp, Homo sapiens
ctcccttctttgcttct

SEQ ID NO: 330385 - DNA, 24 bp, Homo sapiens
ctcccttgctcagtgcctcctggc

SEQ ID NO: 330386 - DNA, 17 bp, Homo sapiens
ctcccttggatttttga

SEQ ID NO: 330387 - DNA, 14 bp, Homo sapiens
ctcccttgggctgg

SEQ ID NO: 330388 - DNA, 16 bp, Homo sapiens
ctcccttgggctggaa

SEQ ID NO: 330389 - DNA, 14 bp, Homo sapiens
ctccctttctggga

SEQ ID NO: 330390 - DNA, 17 bp, Homo sapiens
ctccctttgtggacttt

SEQ ID NO: 330391 - DNA, 16 bp, Homo sapiens
ctccgaggctccccgc

SEQ ID NO: 330392 - DNA, 18 bp, Homo sapiens
ctccgaggctccccgcct

SEQ ID NO: 330393 - DNA, 21 bp, Homo sapiens
ctccgaggctccccgcctcca

SEQ ID NO: 330394 - DNA, 21 bp, Homo sapiens
ctccgagggcggccagggaca

SEQ ID NO: 330395 - DNA, 15 bp, Homo sapiens
ctccgcagttcctgt

SEQ ID NO: 330396 - DNA, 16 bp, Homo sapiens
ctccgcccagcctctc

SEQ ID NO: 330397 - DNA, 14 bp, Homo sapiens
ctccgcctggcacc

SEQ ID NO: 330398 - DNA, 16 bp, Homo sapiens
ctccgcgggggacagg

SEQ ID NO: 330399 - DNA, 20 bp, Homo sapiens
ctccgcgggggacaggaaca

SEQ ID NO: 330400 - DNA, 16 bp, Homo sapiens
ctccggaatgaccagc

SEQ ID NO: 330401 - DNA, 17 bp, Homo sapiens
ctccggcagaggcaggg

SEQ ID NO: 330402 - DNA, 19 bp, Homo sapiens
ctccggcagaggcagggcc

SEQ ID NO: 330403 - DNA, 21 bp, Homo sapiens
ctccggcagaggcagggccct

SEQ ID NO: 330404 - DNA, 19 bp, Homo sapiens
ctccggccagcgagtggtc

SEQ ID NO: 330405 - DNA, 19 bp, Homo sapiens
ctccggccatactgccttt

SEQ ID NO: 330406 - DNA, 18 bp, Homo sapiens
ctccggccctgccccaca

SEQ ID NO: 330407 - DNA, 14 bp, Homo sapiens
ctccggcctcccct

SEQ ID NO: 330408 - DNA, 19 bp, Homo sapiens
ctccgggcaggggagccag

SEQ ID NO: 330409 - DNA, 17 bp, Homo sapiens
ctccggggtctgtgctg

SEQ ID NO: 330410 - DNA, 21 bp, Homo sapiens
ctccggggtctgtgctgtgcc

SEQ ID NO: 330411 - DNA, 22 bp, Homo sapiens
ctccgggtgcgtgaccggcccg

SEQ ID NO: 330412 - DNA, 20 bp, Homo sapiens
ctccgtatttatttttttat

SEQ ID NO: 330413 - DNA, 14 bp, Homo sapiens
ctccgtccacccag

SEQ ID NO: 330414 - DNA, 14 bp, Homo sapiens
ctccgtccccaggg

SEQ ID NO: 330415 - DNA, 14 bp, Homo sapiens
ctccgtgtggagca

SEQ ID NO: 330416 - DNA, 13 bp, Homo sapiens
gtagagagtgccc

SEQ ID NO: 330417 - DNA, 15 bp, Homo sapiens
gtagagatggaggag

SEQ ID NO: 330418 - DNA, 17 bp, Homo sapiens
gtagatacaatcagctg

SEQ ID NO: 330419 - DNA, 13 bp, Homo sapiens
gtagatagaaata

SEQ ID NO: 330420 - DNA, 13 bp, Homo sapiens
gtagatccagatc

SEQ ID NO: 330421 - DNA, 21 bp, Homo sapiens
gtagatccagatccagactgt

SEQ ID NO: 330422 - DNA, 17 bp, Homo sapiens
gtagatcgcttgagccc

SEQ ID NO: 330423 - DNA, 20 bp, Homo sapiens
gtagatgtagcattgttcca

SEQ ID NO: 330424 - DNA, 16 bp, Homo sapiens
gtagattgcttctgta

SEQ ID NO: 330425 - DNA, 17 bp, Homo sapiens
gtagattgtgtaaattc

SEQ ID NO: 330426 - DNA, 15 bp, Homo sapiens
gtagatttgttttgt

SEQ ID NO: 330427 - DNA, 21 bp, Homo sapiens
gtagcagggtctttgtgtgct

SEQ ID NO: 330428 - DNA, 18 bp, Homo sapiens
gtagcatggactctgggt

SEQ ID NO: 330429 - DNA, 23 bp, Homo sapiens
gtagcatgttctatgtgttttta

SEQ ID NO: 330430 - DNA, 16 bp, Homo sapiens
gtagcattgttccaca

SEQ ID NO: 330431 - DNA, 12 bp, Homo sapiens
gtagccactctc

SEQ ID NO: 330432 - DNA, 14 bp, Homo sapiens
gtagccaggaagcc

SEQ ID NO: 330433 - DNA, 22 bp, Homo sapiens
gtagccaggaagccccgctcag

SEQ ID NO: 330434 - DNA, 16 bp, Homo sapiens
gtagccatggctcagg

SEQ ID NO: 330435 - DNA, 17 bp, Homo sapiens
gtagccatggctcaggc

SEQ ID NO: 330436 - DNA, 18 bp, Homo sapiens
gtagccatggctcaggca

SEQ ID NO: 330437 - DNA, 22 bp, Homo sapiens
gtagccatggctcaggcaagcc

SEQ ID NO: 330438 - DNA, 23 bp, Homo sapiens
gtagccatggctcaggcaagccc

SEQ ID NO: 330439 - DNA, 17 bp, Homo sapiens
gtagccattttgtaact

SEQ ID NO: 330440 - DNA, 18 bp, Homo sapiens
gtagccattttgtaactg

SEQ ID NO: 330441 - DNA, 14 bp, Homo sapiens
gtagccctttctgt

SEQ ID NO: 330442 - DNA, 23 bp, Homo sapiens
gtagcctccgtttatgggccttg

SEQ ID NO: 330443 - DNA, 20 bp, Homo sapiens
gtagcctgcgtcatggctca

SEQ ID NO: 330444 - DNA, 22 bp, Homo sapiens
gtagcctggcttttctggctgg

SEQ ID NO: 330445 - DNA, 15 bp, Homo sapiens
gtagcgagctgctct

SEQ ID NO: 330446 - DNA, 21 bp, Homo sapiens
gtagctagaatatcctatact

SEQ ID NO: 330447 - DNA, 18 bp, Homo sapiens
gtagctagtttaaaatta

SEQ ID NO: 330448 - DNA, 20 bp, Homo sapiens
gtagctagtttaaaattatt

SEQ ID NO: 330449 - DNA, 14 bp, Homo sapiens
gtagctattctttg

SEQ ID NO: 330450 - DNA, 12 bp, Homo sapiens
gtagctatttat

SEQ ID NO: 330451 - DNA, 23 bp, Homo sapiens
gtagctcctcaactcacctaatg

SEQ ID NO: 330452 - DNA, 12 bp, Homo sapiens
gtagctctgagc

SEQ ID NO: 330453 - DNA, 15 bp, Homo sapiens
gtagctctgagccct

SEQ ID NO: 330454 - DNA, 19 bp, Homo sapiens
gtagctgccaaaaagaaca

SEQ ID NO: 330455 - DNA, 18 bp, Homo sapiens
gtagctgggatgacaggc

SEQ ID NO: 330456 - DNA, 15 bp, Homo sapiens
gtagctgtggggagc

SEQ ID NO: 330457 - DNA, 16 bp, Homo sapiens
gtagctgtggggagct

SEQ ID NO: 330458 - DNA, 19 bp, Homo sapiens
gtagctgtggggagctggt

SEQ ID NO: 330459 - DNA, 19 bp, Homo sapiens
gtagcttaaaaaaaggaaa

SEQ ID NO: 330460 - DNA, 11 bp, Homo sapiens
gtagcttctga

SEQ ID NO: 330461 - DNA, 21 bp, Homo sapiens
gtagctttttaccgttcactt

SEQ ID NO: 330462 - DNA, 14 bp, Homo sapiens
gtaggaaacagaaa

SEQ ID NO: 330463 - DNA, 19 bp, Homo sapiens
gtaggaaaccaccctgagg

SEQ ID NO: 330464 - DNA, 16 bp, Homo sapiens
gtaggaatctgccttc

SEQ ID NO: 330465 - DNA, 16 bp, Homo sapiens
gtaggaccaatgttgt

SEQ ID NO: 330466 - DNA, 17 bp, Homo sapiens
gtaggagagactggcca

SEQ ID NO: 330467 - DNA, 17 bp, Homo sapiens
gtaggagtaaagataaa

SEQ ID NO: 330468 - DNA, 17 bp, Homo sapiens
gtaggcaaggctgccgg

SEQ ID NO: 330469 - DNA, 21 bp, Homo sapiens
gtaggcaaggctgccggctgc

SEQ ID NO: 330470 - DNA, 22 bp, Homo sapiens
gtaggcaaggctgccggctgca

SEQ ID NO: 330471 - DNA, 22 bp, Homo sapiens
gtaggcccttgtcctgccagct

SEQ ID NO: 330472 - DNA, 23 bp, Homo sapiens
gtaggcccttgtcctgccagctg

SEQ ID NO: 330473 - DNA, 20 bp, Homo sapiens
gtaggcgcccctggggtggg

SEQ ID NO: 330474 - DNA, 17 bp, Homo sapiens
gtaggcggcgatttttg

SEQ ID NO: 330475 - DNA, 14 bp, Homo sapiens
gtaggctaaaaaca

SEQ ID NO: 330476 - DNA, 22 bp, Homo sapiens
gtaggctaaaaacattttaaaa

SEQ ID NO: 330477 - DNA, 13 bp, Homo sapiens
gtaggctccacct

SEQ ID NO: 330478 - DNA, 17 bp, Homo sapiens
gtaggctgtattttctt

SEQ ID NO: 330479 - DNA, 19 bp, Homo sapiens
gtaggctgtattttctttt

SEQ ID NO: 330480 - DNA, 15 bp, Homo sapiens
gtagggaactctggg

SEQ ID NO: 330481 - DNA, 15 bp, Homo sapiens
gtagggaggtcagtg

SEQ ID NO: 330482 - DNA, 17 bp, Homo sapiens
gtagggccagggctctg

SEQ ID NO: 330483 - DNA, 22 bp, Homo sapiens
gtagggtcaggccacggcagcc

SEQ ID NO: 330484 - DNA, 17 bp, Homo sapiens
gtagggttgccagtcct

SEQ ID NO: 330485 - DNA, 15 bp, Homo sapiens
gtaggtatacaaaag

SEQ ID NO: 330486 - DNA, 18 bp, Homo sapiens
gtaggtatacaaaagact

SEQ ID NO: 330487 - DNA, 16 bp, Homo sapiens
gtaggtccaagggcca

SEQ ID NO: 330488 - DNA, 14 bp, Homo sapiens
gtaggttgtctaaa

SEQ ID NO: 330489 - DNA, 16 bp, Homo sapiens
gtagtaacacataaag

SEQ ID NO: 330490 - DNA, 13 bp, Homo sapiens
gtagtggaagagc

SEQ ID NO: 330491 - DNA, 15 bp, Homo sapiens
gtagtggaagagcag

SEQ ID NO: 330492 - DNA, 18 bp, Homo sapiens
gtagtggaagagcagcct

SEQ ID NO: 330493 - DNA, 19 bp, Homo sapiens
gtagtggaagagcagcctg

SEQ ID NO: 330494 - DNA, 22 bp, Homo sapiens
gtagttgagacgctgttgcaaa

SEQ ID NO: 330495 - DNA, 18 bp, Homo sapiens
gtagttgatgaccaatct

SEQ ID NO: 330496 - DNA, 24 bp, Homo sapiens
gtagttgatgaccaatctctgtga

SEQ ID NO: 330497 - DNA, 21 bp, Homo sapiens
gtagtttatggcagaagggaa

SEQ ID NO: 330498 - DNA, 15 bp, Homo sapiens
gtataaaaaataagt

SEQ ID NO: 330499 - DNA, 19 bp, Homo sapiens
gtataaaactttcctcgcc

SEQ ID NO: 330500 - DNA, 14 bp, Homo sapiens
gtataaaagacaaa

SEQ ID NO: 330501 - DNA, 19 bp, Homo sapiens
gtataaaatggtgttttca

SEQ ID NO: 330502 - DNA, 14 bp, Homo sapiens
gtataaacaagcct

SEQ ID NO: 330503 - DNA, 15 bp, Homo sapiens
gtataacaaactatg

SEQ ID NO: 330504 - DNA, 21 bp, Homo sapiens
gtataacaagccaaacattct

SEQ ID NO: 330505 - DNA, 20 bp, Homo sapiens
gtataacttcttaaaagttg

SEQ ID NO: 330506 - DNA, 23 bp, Homo sapiens
gtataaggaaatatcataatgta

SEQ ID NO: 330507 - DNA, 20 bp, Homo sapiens
gtataaggaaatccagcccc

SEQ ID NO: 330508 - DNA, 16 bp, Homo sapiens
gtataatttagtccct

SEQ ID NO: 330509 - DNA, 17 bp, Homo sapiens
gtatacaaacaggtgct

SEQ ID NO: 330510 - DNA, 18 bp, Homo sapiens
gtataccacctgtacata

SEQ ID NO: 330511 - DNA, 21 bp, Homo sapiens
gtataccacctgtacatacat

SEQ ID NO: 330512 - DNA, 11 bp, Homo sapiens
gtatagaaaaa

SEQ ID NO: 330513 - DNA, 15 bp, Homo sapiens
gtatagagatatgca

SEQ ID NO: 330514 - DNA, 18 bp, Homo sapiens
gtataggtagatccagat

SEQ ID NO: 330515 - DNA, 18 bp, Homo sapiens
gtatagtgcctaaaattg

SEQ ID NO: 330516 - DNA, 14 bp, Homo sapiens
gtatagtgtaaaat

SEQ ID NO: 330517 - DNA, 16 bp, Homo sapiens
gtatagtgtaaaataa

SEQ ID NO: 330518 - DNA, 15 bp, Homo sapiens
gtatataaagttaca

SEQ ID NO: 330519 - DNA, 11 bp, Homo sapiens
gtatataaatg

SEQ ID NO: 330520 - DNA, 16 bp, Homo sapiens
gtatataagctgttta

SEQ ID NO: 330521 - DNA, 17 bp, Homo sapiens
gtatatatacataacag

SEQ ID NO: 330522 - DNA, 14 bp, Homo sapiens
gtatatatagaatc

SEQ ID NO: 330523 - DNA, 12 bp, Homo sapiens
gtatatatgtac

SEQ ID NO: 330524 - DNA, 14 bp, Homo sapiens
gtatatattttgaa

SEQ ID NO: 330525 - DNA, 19 bp, Homo sapiens
gtatatcagaaaagggaag

SEQ ID NO: 330526 - DNA, 21 bp, Homo sapiens
gtatatgtctcaggtccctgc

SEQ ID NO: 330527 - DNA, 18 bp, Homo sapiens
gtatatgttgtaataaaa

SEQ ID NO: 330528 - DNA, 15 bp, Homo sapiens
gtatattcatatatt

SEQ ID NO: 330529 - DNA, 15 bp, Homo sapiens
gtatatttatataat

SEQ ID NO: 330530 - DNA, 17 bp, Homo sapiens
gtatatttcattgaata

SEQ ID NO: 330531 - DNA, 19 bp, Homo sapiens
gtatcaaactcgtctgatg

SEQ ID NO: 330532 - DNA, 22 bp, Homo sapiens
gtatcaaactcgtctgatgttt

SEQ ID NO: 330533 - DNA, 16 bp, Homo sapiens
gtatcaaaggcagaaa

SEQ ID NO: 330534 - DNA, 14 bp, Homo sapiens
gtatcaagcccctg

SEQ ID NO: 330535 - DNA, 18 bp, Homo sapiens
gtatcaaggctgcctgga

SEQ ID NO: 330536 - DNA, 21 bp, Homo sapiens
gtatcaccctcagctggcgga

SEQ ID NO: 330537 - DNA, 20 bp, Homo sapiens
gtatcactgtctttcctaga

SEQ ID NO: 330538 - DNA, 22 bp, Homo sapiens
gtatcaggcctgccagacggca

SEQ ID NO: 330539 - DNA, 14 bp, Homo sapiens
gtatcatctccatc

SEQ ID NO: 330540 - DNA, 23 bp, Homo sapiens
gtatcatgattgattgaatcatt

SEQ ID NO: 330541 - DNA, 16 bp, Homo sapiens
gtatcattcaactctc

SEQ ID NO: 330542 - DNA, 16 bp, Homo sapiens
gtatccaactgcatcc

SEQ ID NO: 330543 - DNA, 14 bp, Homo sapiens
gtatccagaggtga

SEQ ID NO: 330544 - DNA, 16 bp, Homo sapiens
gtatccagaggtgagg

SEQ ID NO: 330545 - DNA, 16 bp, Homo sapiens
gtatccatgggggcag

SEQ ID NO: 330546 - DNA, 21 bp, Homo sapiens
gtcaatgaggttatgagaaaa

SEQ ID NO: 330547 - DNA, 17 bp, Homo sapiens
gtcaatgctatggactg

SEQ ID NO: 330548 - DNA, 22 bp, Homo sapiens
gtcaatgctatggactgcacaa

SEQ ID NO: 330549 - DNA, 15 bp, Homo sapiens
gtcaattacaggaag

SEQ ID NO: 330550 - DNA, 14 bp, Homo sapiens
gtcacaaagagttc

SEQ ID NO: 330551 - DNA, 21 bp, Homo sapiens
gtcacaaatcctaaaagaagc

SEQ ID NO: 330552 - DNA, 15 bp, Homo sapiens
gtcacaacctctctg

SEQ ID NO: 330553 - DNA, 14 bp, Homo sapiens
gtcacactgctggg

SEQ ID NO: 330554 - DNA, 17 bp, Homo sapiens
gtcacagaggcagtggc

SEQ ID NO: 330555 - DNA, 20 bp, Homo sapiens
gtcacagaggcagtggcagc

SEQ ID NO: 330556 - DNA, 21 bp, Homo sapiens
ctgagaaaacgaaactgctct

SEQ ID NO: 330557 - DNA, 17 bp, Homo sapiens
ctgagaaagcccacctg

SEQ ID NO: 330558 - DNA, 19 bp, Homo sapiens
ctgagaaagcccacctggg

SEQ ID NO: 330559 - DNA, 22 bp, Homo sapiens
ctgagaaagcccacctgggctg

SEQ ID NO: 330560 - DNA, 23 bp, Homo sapiens
ctgagaaagcccacctgggctgg

SEQ ID NO: 330561 - DNA, 13 bp, Homo sapiens
ctgagaaatgggg

SEQ ID NO: 330562 - DNA, 18 bp, Homo sapiens
ctgagaagagtcgagtga

SEQ ID NO: 330563 - DNA, 22 bp, Homo sapiens
ctgagaagcctcatgggagtca

SEQ ID NO: 330564 - DNA, 22 bp, Homo sapiens
ctgagaaggccagccctccctg

SEQ ID NO: 330565 - DNA, 17 bp, Homo sapiens
ctgagaaggccctgtgc

SEQ ID NO: 330566 - DNA, 21 bp, Homo sapiens
ctgagaaggctaaagaagaca

SEQ ID NO: 330567 - DNA, 16 bp, Homo sapiens
ctgagaaggggaggac

SEQ ID NO: 330568 - DNA, 18 bp, Homo sapiens
ctgagaagtcaaacattt

SEQ ID NO: 330569 - DNA, 14 bp, Homo sapiens
ctgagaccagcctg

SEQ ID NO: 330570 - DNA, 14 bp, Homo sapiens
ctgagaccagttgg

SEQ ID NO: 330571 - DNA, 19 bp, Homo sapiens
ctgagaccagttgggagca

SEQ ID NO: 330572 - DNA, 17 bp, Homo sapiens
ctgagacgcaaggatca

SEQ ID NO: 330573 - DNA, 12 bp, Homo sapiens
ctgagactccag

SEQ ID NO: 330574 - DNA, 14 bp, Homo sapiens
ctgagactccagaa

SEQ ID NO: 330575 - DNA, 22 bp, Homo sapiens
ctgagactccagaatctgctgt

SEQ ID NO: 330576 - DNA, 20 bp, Homo sapiens
ctgagactgtcggagaggct

SEQ ID NO: 330577 - DNA, 16 bp, Homo sapiens
ctgagagaccatctcc

SEQ ID NO: 330578 - DNA, 15 bp, Homo sapiens
ctgagagcagaatga

SEQ ID NO: 330579 - DNA, 16 bp, Homo sapiens
ctgagagcagaatgaa

SEQ ID NO: 330580 - DNA, 17 bp, Homo sapiens
ctgagagcatgtggggg

SEQ ID NO: 330581 - DNA, 13 bp, Homo sapiens
ctgagagccccag

SEQ ID NO: 330582 - DNA, 13 bp, Homo sapiens
ctgagagccccca

SEQ ID NO: 330583 - DNA, 21 bp, Homo sapiens
ctgagaggaggggtaaatata

SEQ ID NO: 330584 - DNA, 22 bp, Homo sapiens
ctgagaggaggggtaaatatat

SEQ ID NO: 330585 - DNA, 16 bp, Homo sapiens
ctgagagggctgtggc

SEQ ID NO: 330586 - DNA, 20 bp, Homo sapiens
ctgagagtatttaggcagat

SEQ ID NO: 330587 - DNA, 14 bp, Homo sapiens
ctgagatgagcccc

SEQ ID NO: 330588 - DNA, 16 bp, Homo sapiens
ctgagatgagccccac

SEQ ID NO: 330589 - DNA, 12 bp, Homo sapiens
ctgagattctgg

SEQ ID NO: 330590 - DNA, 17 bp, Homo sapiens
ctgagattctgggaaag

SEQ ID NO: 330591 - DNA, 21 bp, Homo sapiens
ctgagattctgggaaaggtgc

SEQ ID NO: 330592 - DNA, 22 bp, Homo sapiens
ctgagattctgggaaaggtgct

SEQ ID NO: 330593 - DNA, 20 bp, Homo sapiens
ctgagcaaatgtggctcctg

SEQ ID NO: 330594 - DNA, 18 bp, Homo sapiens
ctgagcaactgtgcagca

SEQ ID NO: 330595 - DNA, 17 bp, Homo sapiens
ctgagcagactggtgag

SEQ ID NO: 330596 - DNA, 21 bp, Homo sapiens
ctgagcagactggtgagcaga

SEQ ID NO: 330597 - DNA, 19 bp, Homo sapiens
ctgagcagcctctgccagg

SEQ ID NO: 330598 - DNA, 20 bp, Homo sapiens
ctgagcagcctctgccaggc

SEQ ID NO: 330599 - DNA, 20 bp, Homo sapiens
ctgagcagtctacttctgtg

SEQ ID NO: 330600 - DNA, 13 bp, Homo sapiens
ctgagcagtgggg

SEQ ID NO: 330601 - DNA, 14 bp, Homo sapiens
ctgagcagtgggga

SEQ ID NO: 330602 - DNA, 17 bp, Homo sapiens
ctgagcagttttccagg

SEQ ID NO: 330603 - DNA, 21 bp, Homo sapiens
ctgagcagttttccaggaggc

SEQ ID NO: 330604 - DNA, 15 bp, Homo sapiens
ctgagccaaagagaa

SEQ ID NO: 330605 - DNA, 16 bp, Homo sapiens
ctgagccacagtgggg

SEQ ID NO: 330606 - DNA, 20 bp, Homo sapiens
ctgagccaccgcgagggcct

SEQ ID NO: 330607 - DNA, 18 bp, Homo sapiens
ctgagccagtcccagggg

SEQ ID NO: 330608 - DNA, 19 bp, Homo sapiens
ctgagccagtcccaggggc

SEQ ID NO: 330609 - DNA, 23 bp, Homo sapiens
ctgagcccaggagctgagtcacc

SEQ ID NO: 330610 - DNA, 17 bp, Homo sapiens
ctgagccccacctctcc

SEQ ID NO: 330611 - DNA, 15 bp, Homo sapiens
ctgagcccccacctg

SEQ ID NO: 330612 - DNA, 14 bp, Homo sapiens
ctgagcccccggct

SEQ ID NO: 330613 - DNA, 17 bp, Homo sapiens
ctgagcccccggctagt

SEQ ID NO: 330614 - DNA, 20 bp, Homo sapiens
ctgagccccctctcctgaag

SEQ ID NO: 330615 - DNA, 20 bp, Homo sapiens
ctgagccccctgcacccacc

SEQ ID NO: 330616 - DNA, 13 bp, Homo sapiens
ctgagccccctgt

SEQ ID NO: 330617 - DNA, 18 bp, Homo sapiens
ctgagccccctgtgccca

SEQ ID NO: 330618 - DNA, 19 bp, Homo sapiens
ctgagccccctgtgcccac

SEQ ID NO: 330619 - DNA, 13 bp, Homo sapiens
ctgagcccctacc

SEQ ID NO: 330620 - DNA, 15 bp, Homo sapiens
ctgagcccctacccc

SEQ ID NO: 330621 - DNA, 16 bp, Homo sapiens
ctgagcccctgggact

SEQ ID NO: 330622 - DNA, 19 bp, Homo sapiens
ctgagcccctgggactgct

SEQ ID NO: 330623 - DNA, 20 bp, Homo sapiens
ctgagccctccctcttccca

SEQ ID NO: 330624 - DNA, 22 bp, Homo sapiens
ctgagccctccctcttcccagc

SEQ ID NO: 330625 - DNA, 13 bp, Homo sapiens
ctgagccctcctt

SEQ ID NO: 330626 - DNA, 21 bp, Homo sapiens
ctgagccctccttcttgccct

SEQ ID NO: 330627 - DNA, 12 bp, Homo sapiens
ctgagccctgcc

SEQ ID NO: 330628 - DNA, 14 bp, Homo sapiens
ctgagccctgccct

SEQ ID NO: 330629 - DNA, 15 bp, Homo sapiens
ctgagcccttgcaca

SEQ ID NO: 330630 - DNA, 19 bp, Homo sapiens
ctgagcccttgcacaggcc

SEQ ID NO: 330631 - DNA, 18 bp, Homo sapiens
ctgagccgtgcagctggg

SEQ ID NO: 330632 - DNA, 22 bp, Homo sapiens
ctgagccgtgcagctgggattt

SEQ ID NO: 330633 - DNA, 23 bp, Homo sapiens
ctgagcctactgtctccttccca

SEQ ID NO: 330634 - DNA, 10 bp, Homo sapiens
ctgagcctct

SEQ ID NO: 330635 - DNA, 13 bp, Homo sapiens
ctgagcctgaggc

SEQ ID NO: 330636 - DNA, 19 bp, Homo sapiens
ctgagcctgaggccttcca

SEQ ID NO: 330637 - DNA, 16 bp, Homo sapiens
ctgagcctgtctctcc

SEQ ID NO: 330638 - DNA, 14 bp, Homo sapiens
ctgagcctgtgggt

SEQ ID NO: 330639 - DNA, 15 bp, Homo sapiens
ctgagccttgtaatt

SEQ ID NO: 330640 - DNA, 21 bp, Homo sapiens
ctgagccttgtaattctaaat

SEQ ID NO: 330641 - DNA, 20 bp, Homo sapiens
ctgagcggccgcctgtcctt

SEQ ID NO: 330642 - DNA, 21 bp, Homo sapiens
ctgagcggccgcctgtccttg

SEQ ID NO: 330643 - DNA, 17 bp, Homo sapiens
ctgagcgggtctagtgg

SEQ ID NO: 330644 - DNA, 21 bp, Homo sapiens
ctgagcgggtctagtggaaag

SEQ ID NO: 330645 - DNA, 14 bp, Homo sapiens
ctgagctccaccct

SEQ ID NO: 330646 - DNA, 15 bp, Homo sapiens
ctgagctccaccctc

SEQ ID NO: 330647 - DNA, 18 bp, Homo sapiens
ctgagctccccaccaccc

SEQ ID NO: 330648 - DNA, 20 bp, Homo sapiens
ctgagctccccaccacccca

SEQ ID NO: 330649 - DNA, 20 bp, Homo sapiens
ctgagctcccccttcccagt

SEQ ID NO: 330650 - DNA, 13 bp, Homo sapiens
ctgagctggccta

SEQ ID NO: 330651 - DNA, 14 bp, Homo sapiens
ctgagctgttatct

SEQ ID NO: 330652 - DNA, 18 bp, Homo sapiens
ctgagcttagccttgtgc

SEQ ID NO: 330653 - DNA, 19 bp, Homo sapiens
ctgagcttagccttgtgcc

SEQ ID NO: 330654 - DNA, 21 bp, Homo sapiens
ctgagcttagccttgtgccct

SEQ ID NO: 330655 - DNA, 23 bp, Homo sapiens
ctgagcttagccttgtgccctgc

SEQ ID NO: 330656 - DNA, 22 bp, Homo sapiens
ctgagcttcagtataaaagaca

SEQ ID NO: 330657 - DNA, 22 bp, Homo sapiens
ctgagcttcggttctccagaat

SEQ ID NO: 330658 - DNA, 23 bp, Homo sapiens
ctgagcttcggttctccagaatg

SEQ ID NO: 330659 - DNA, 15 bp, Homo sapiens
ctgagcttgagctcc

SEQ ID NO: 330660 - DNA, 18 bp, Homo sapiens
ctgagcttgagctcccct

SEQ ID NO: 330661 - DNA, 23 bp, Homo sapiens
ctgagcttgagctcccctggagc

SEQ ID NO: 330662 - DNA, 23 bp, Homo sapiens
ctgagcttgattctaaaggggac

SEQ ID NO: 330663 - DNA, 17 bp, Homo sapiens
ctgagcttggccagaag

SEQ ID NO: 330664 - DNA, 21 bp, Homo sapiens
ctgagctttggacacacacag

SEQ ID NO: 330665 - DNA, 23 bp, Homo sapiens
ctgagctttggacgcacacagct

SEQ ID NO: 330666 - DNA, 16 bp, Homo sapiens
ctgagctttggggaca

SEQ ID NO: 330667 - DNA, 22 bp, Homo sapiens
ctgagctttggggacagttggc

SEQ ID NO: 330668 - DNA, 12 bp, Homo sapiens
ctgagctttgtt

SEQ ID NO: 330669 - DNA, 14 bp, Homo sapiens
ctgagcttttcatg

SEQ ID NO: 330670 - DNA, 18 bp, Homo sapiens
ctgaggaatgaatagaaa

SEQ ID NO: 330671 - DNA, 17 bp, Homo sapiens
ctgaggacacaccccac

SEQ ID NO: 330672 - DNA, 15 bp, Homo sapiens
ctgaggacaggcccc

SEQ ID NO: 330673 - DNA, 17 bp, Homo sapiens
ctgaggacaggccccca

SEQ ID NO: 330674 - DNA, 20 bp, Homo sapiens
ctgaggacggggcagagctg

SEQ ID NO: 330675 - DNA, 22 bp, Homo sapiens
ctgatgctccctcccctgccct

SEQ ID NO: 330676 - DNA, 23 bp, Homo sapiens
ctgatgctgagattcttcaggct

SEQ ID NO: 330677 - DNA, 12 bp, Homo sapiens
ctgatgctgccc

SEQ ID NO: 330678 - DNA, 19 bp, Homo sapiens
ctgatgctgccccgttccc

SEQ ID NO: 330679 - DNA, 17 bp, Homo sapiens
ctgatgcttaataaacg

SEQ ID NO: 330680 - DNA, 21 bp, Homo sapiens
ctgatgcttaataaacgcagc

SEQ ID NO: 330681 - DNA, 15 bp, Homo sapiens
ctgatggaattgtta

SEQ ID NO: 330682 - DNA, 21 bp, Homo sapiens
ctgatggaccgggtgggcctg

SEQ ID NO: 330683 - DNA, 13 bp, Homo sapiens
ctgatggagagga

SEQ ID NO: 330684 - DNA, 16 bp, Homo sapiens
ctgatggagaggagaa

SEQ ID NO: 330685 - DNA, 13 bp, Homo sapiens
ctgatggccaaga

SEQ ID NO: 330686 - DNA, 16 bp, Homo sapiens
ctgatggccaagagca

SEQ ID NO: 330687 - DNA, 15 bp, Homo sapiens
ctgatggccaagggg

SEQ ID NO: 330688 - DNA, 18 bp, Homo sapiens
ctgatggccaagggggtg

SEQ ID NO: 330689 - DNA, 16 bp, Homo sapiens
ctgatggcttgacatg

SEQ ID NO: 330690 - DNA, 17 bp, Homo sapiens
ctgatgggtcctgctgc

SEQ ID NO: 330691 - DNA, 18 bp, Homo sapiens
ctgatgggtcctgctgct

SEQ ID NO: 330692 - DNA, 17 bp, Homo sapiens
ctgatgtcatcttgagc

SEQ ID NO: 330693 - DNA, 18 bp, Homo sapiens
ctgatgtctctaaagcac

SEQ ID NO: 330694 - DNA, 24 bp, Homo sapiens
ctgatgtgtgcccagatcgttctg

SEQ ID NO: 330695 - DNA, 16 bp, Homo sapiens
ctgatgttaggctggg

SEQ ID NO: 330696 - DNA, 21 bp, Homo sapiens
ctgatgttaggctgggcccag

SEQ ID NO: 330697 - DNA, 21 bp, Homo sapiens
gtcattcttacaattgcactg

SEQ ID NO: 330698 - DNA, 13 bp, Homo sapiens
gtcatttctttta

SEQ ID NO: 330699 - DNA, 19 bp, Homo sapiens
gtcatttgctaatgaattt

SEQ ID NO: 330700 - DNA, 21 bp, Homo sapiens
gtcatttgctgagcatgtact

SEQ ID NO: 330701 - DNA, 16 bp, Homo sapiens
gtcatttgttaaaata

SEQ ID NO: 330702 - DNA, 16 bp, Homo sapiens
gtcattttcctttctg

SEQ ID NO: 330703 - DNA, 20 bp, Homo sapiens
gtcattttcctttctgtatt

SEQ ID NO: 330704 - DNA, 14 bp, Homo sapiens
gtccaaaggaggct

SEQ ID NO: 330705 - DNA, 20 bp, Homo sapiens
gtccaaataacaagtaccaa

SEQ ID NO: 330706 - DNA, 22 bp, Homo sapiens
gtccaacagtttgatgctgagt

SEQ ID NO: 330707 - DNA, 18 bp, Homo sapiens
gtccaacgtggggcagca

SEQ ID NO: 330708 - DNA, 14 bp, Homo sapiens
gtccaagtgtttct

SEQ ID NO: 330709 - DNA, 17 bp, Homo sapiens
gtccaagtgtttcttgt

SEQ ID NO: 330710 - DNA, 15 bp, Homo sapiens
gtccaagttcacagt

SEQ ID NO: 330711 - DNA, 20 bp, Homo sapiens
gtccaagttcttcacctcta

SEQ ID NO: 330712 - DNA, 19 bp, Homo sapiens
gtccacccacttagtccac

SEQ ID NO: 330713 - DNA, 12 bp, Homo sapiens
gtccacccaggc

SEQ ID NO: 330714 - DNA, 21 bp, Homo sapiens
gtccaccccaattaactgaag

SEQ ID NO: 330715 - DNA, 20 bp, Homo sapiens
gtccacccccattgtgaatg

SEQ ID NO: 330716 - DNA, 17 bp, Homo sapiens
gtccacccgtttccaag

SEQ ID NO: 330717 - DNA, 20 bp, Homo sapiens
gtccacccgtttccaagcct

SEQ ID NO: 330718 - DNA, 22 bp, Homo sapiens
gtccaccctcatttctgccagc

SEQ ID NO: 330719 - DNA, 23 bp, Homo sapiens
gtccaccctcatttctgccagcg

SEQ ID NO: 330720 - DNA, 19 bp, Homo sapiens
gtccaccctgcagccagga

SEQ ID NO: 330721 - DNA, 16 bp, Homo sapiens
gtccacctgtgctgct

SEQ ID NO: 330722 - DNA, 16 bp, Homo sapiens
gtccactccctgctcc

SEQ ID NO: 330723 - DNA, 19 bp, Homo sapiens
gtccactctcggggccctt

SEQ ID NO: 330724 - DNA, 13 bp, Homo sapiens
gtccactctgagt

SEQ ID NO: 330725 - DNA, 16 bp, Homo sapiens
gtccactttcccttcc

SEQ ID NO: 330726 - DNA, 16 bp, Homo sapiens
gtccactttcctctct

SEQ ID NO: 330727 - DNA, 19 bp, Homo sapiens
gtccagagacatgggcctc

SEQ ID NO: 330728 - DNA, 23 bp, Homo sapiens
gtccagagagagaagtgcccctg

SEQ ID NO: 330729 - DNA, 19 bp, Homo sapiens
gtccagagcttcagggctg

SEQ ID NO: 330730 - DNA, 15 bp, Homo sapiens
gtccagagcttttca

SEQ ID NO: 330731 - DNA, 13 bp, Homo sapiens
gtccagattgtag

SEQ ID NO: 330732 - DNA, 20 bp, Homo sapiens
gtccagccgccattgccacc

SEQ ID NO: 330733 - DNA, 15 bp, Homo sapiens
gtccagctctcccct

SEQ ID NO: 330734 - DNA, 18 bp, Homo sapiens
gtccagctctcccctgcg

SEQ ID NO: 330735 - DNA, 15 bp, Homo sapiens
gtccaggagccccag

SEQ ID NO: 330736 - DNA, 17 bp, Homo sapiens
gtccaggagccccagcc

SEQ ID NO: 330737 - DNA, 22 bp, Homo sapiens
gtccaggagccccagccagccc

SEQ ID NO: 330738 - DNA, 18 bp, Homo sapiens
gtccaggcatgggtccct

SEQ ID NO: 330739 - DNA, 23 bp, Homo sapiens
gtccaggcatgggtcccttcccc

SEQ ID NO: 330740 - DNA, 18 bp, Homo sapiens
gtccaggccactgtggcc

SEQ ID NO: 330741 - DNA, 20 bp, Homo sapiens
gtccaggccactgtggccag

SEQ ID NO: 330742 - DNA, 21 bp, Homo sapiens
gtccaggccactgtggccaga

SEQ ID NO: 330743 - DNA, 14 bp, Homo sapiens
gtccaggccaggcc

SEQ ID NO: 330744 - DNA, 17 bp, Homo sapiens
gtccaggccccaaaacc

SEQ ID NO: 330745 - DNA, 23 bp, Homo sapiens
gtccagggaagagaaagtgattt

SEQ ID NO: 330746 - DNA, 19 bp, Homo sapiens
gtccaggtcgggctcagct

SEQ ID NO: 330747 - DNA, 16 bp, Homo sapiens
gtccaggtctcactgc

SEQ ID NO: 330748 - DNA, 17 bp, Homo sapiens
gtccaggtctcactgct

SEQ ID NO: 330749 - DNA, 20 bp, Homo sapiens
gtccaggtctcactgctttg

SEQ ID NO: 330750 - DNA, 17 bp, Homo sapiens
gtccatatcagacctct

SEQ ID NO: 330751 - DNA, 19 bp, Homo sapiens
gtccatatcagacctctga

SEQ ID NO: 330752 - DNA, 17 bp, Homo sapiens
gtccatccccagttggg

SEQ ID NO: 330753 - DNA, 17 bp, Homo sapiens
gtccatctctctccctt

SEQ ID NO: 330754 - DNA, 17 bp, Homo sapiens
gtccatctgtctgtcct

SEQ ID NO: 330755 - DNA, 18 bp, Homo sapiens
gtccatctgtctgtccta

SEQ ID NO: 330756 - DNA, 16 bp, Homo sapiens
gtccatgatgtccttg

SEQ ID NO: 330757 - DNA, 15 bp, Homo sapiens
gtccatgcctacaga

SEQ ID NO: 330758 - DNA, 20 bp, Homo sapiens
gtccatgcctacagataatt

SEQ ID NO: 330759 - DNA, 13 bp, Homo sapiens
gtccatggcacca

SEQ ID NO: 330760 - DNA, 15 bp, Homo sapiens
gtccatggcaccagc

SEQ ID NO: 330761 - DNA, 17 bp, Homo sapiens
gtccatggcaccagccc

SEQ ID NO: 330762 - DNA, 22 bp, Homo sapiens
gtccatggcaccagccccctgg

SEQ ID NO: 330763 - DNA, 13 bp, Homo sapiens
gtccatgtgtgtg

SEQ ID NO: 330764 - DNA, 16 bp, Homo sapiens
gtccattatctgctgt

SEQ ID NO: 330765 - DNA, 13 bp, Homo sapiens
gtccattgcaaaa

SEQ ID NO: 330766 - DNA, 23 bp, Homo sapiens
gtccattgcaaaaggttaagcca

SEQ ID NO: 330767 - DNA, 15 bp, Homo sapiens
gtccatttcatgtga

SEQ ID NO: 330768 - DNA, 16 bp, Homo sapiens
gtccatttcatgtgat

SEQ ID NO: 330769 - DNA, 15 bp, Homo sapiens
gtcccaacttgtaaa

SEQ ID NO: 330770 - DNA, 23 bp, Homo sapiens
gtcccaaggagctgatttccagg

SEQ ID NO: 330771 - DNA, 17 bp, Homo sapiens
gtcccacaaaatatttc

SEQ ID NO: 330772 - DNA, 20 bp, Homo sapiens
gtcccaccggttgcttctgg

SEQ ID NO: 330773 - DNA, 21 bp, Homo sapiens
gtcccaccggttgcttctggg

SEQ ID NO: 330774 - DNA, 23 bp, Homo sapiens
gtcccacctcaaatgggtctggg

SEQ ID NO: 330775 - DNA, 18 bp, Homo sapiens
gtcccagaaccacactgt

SEQ ID NO: 330776 - DNA, 20 bp, Homo sapiens
gtcccagaaccacactgttg

SEQ ID NO: 330777 - DNA, 19 bp, Homo sapiens
gtcccagagcaggaggccc

SEQ ID NO: 330778 - DNA, 14 bp, Homo sapiens
gtcccagcacattt

SEQ ID NO: 330779 - DNA, 20 bp, Homo sapiens
gtcccagcacatttcctctc

SEQ ID NO: 330780 - DNA, 22 bp, Homo sapiens
gtcccagcacatttcctctcta

SEQ ID NO: 330781 - DNA, 17 bp, Homo sapiens
gtcccagcacctggcac

SEQ ID NO: 330782 - DNA, 15 bp, Homo sapiens
gtcccagccaccccg

SEQ ID NO: 330783 - DNA, 23 bp, Homo sapiens
gtcccagccaccccgggctctct

SEQ ID NO: 330784 - DNA, 20 bp, Homo sapiens
gtcccagctaaagaggtggg

SEQ ID NO: 330785 - DNA, 18 bp, Homo sapiens
gtcccagctacttgggag

SEQ ID NO: 330786 - DNA, 17 bp, Homo sapiens
gtcccaggatcccctgc

SEQ ID NO: 330787 - DNA, 22 bp, Homo sapiens
gtcccaggggtctccctgagcc

SEQ ID NO: 330788 - DNA, 17 bp, Homo sapiens
gtcccagtctctggcag

SEQ ID NO: 330789 - DNA, 15 bp, Homo sapiens
gtcccagtgccattg

SEQ ID NO: 330790 - DNA, 14 bp, Homo sapiens
gtcccattctagat

SEQ ID NO: 330791 - DNA, 22 bp, Homo sapiens
gtccccaacgtcccctccgccg

SEQ ID NO: 330792 - DNA, 11 bp, Homo sapiens
gtccccactcc

SEQ ID NO: 330793 - DNA, 14 bp, Homo sapiens
gtccccactccctg

SEQ ID NO: 330794 - DNA, 15 bp, Homo sapiens
gtccccactccctgt

SEQ ID NO: 330795 - DNA, 18 bp, Homo sapiens
gtccccagccctgtcctg

SEQ ID NO: 330796 - DNA, 14 bp, Homo sapiens
gtccccagcccttc

SEQ ID NO: 330797 - DNA, 19 bp, Homo sapiens
gtccccagcccttctgcct

SEQ ID NO: 330798 - DNA, 12 bp, Homo sapiens
gtccccagggcc

SEQ ID NO: 330799 - DNA, 16 bp, Homo sapiens
gtccccaggggcacac

SEQ ID NO: 330800 - DNA, 11 bp, Homo sapiens
gtccccagggt

SEQ ID NO: 330801 - DNA, 12 bp, Homo sapiens
gtccccagggtg

SEQ ID NO: 330802 - DNA, 16 bp, Homo sapiens
gtccccatccccacca

SEQ ID NO: 330803 - DNA, 19 bp, Homo sapiens
gtccccatccccaccagct

SEQ ID NO: 330804 - DNA, 15 bp, Homo sapiens
gtcccccaacttgag

SEQ ID NO: 330805 - DNA, 16 bp, Homo sapiens
ctgccacctggggcag

SEQ ID NO: 330806 - DNA, 13 bp, Homo sapiens
ctgccacctgtct

SEQ ID NO: 330807 - DNA, 16 bp, Homo sapiens
ctgccacctgtctgtc

SEQ ID NO: 330808 - DNA, 18 bp, Homo sapiens
ctgccactaggctgggtg

SEQ ID NO: 330809 - DNA, 20 bp, Homo sapiens
ctgccactctctgggactct

SEQ ID NO: 330810 - DNA, 20 bp, Homo sapiens
ctgccactgactgcagggac

SEQ ID NO: 330811 - DNA, 16 bp, Homo sapiens
ctgccacttgcactgt

SEQ ID NO: 330812 - DNA, 16 bp, Homo sapiens
ctgccagaagtgtgtt

SEQ ID NO: 330813 - DNA, 21 bp, Homo sapiens
ctgccagaagtgtgttttggt

SEQ ID NO: 330814 - DNA, 14 bp, Homo sapiens
ctgccagcacagag

SEQ ID NO: 330815 - DNA, 16 bp, Homo sapiens
ctgccagctccacagg

SEQ ID NO: 330816 - DNA, 14 bp, Homo sapiens
ctgccagctgcctt

SEQ ID NO: 330817 - DNA, 16 bp, Homo sapiens
ctgccagctgccttcc

SEQ ID NO: 330818 - DNA, 23 bp, Homo sapiens
ctgccagctgccttcctcatccc

SEQ ID NO: 330819 - DNA, 13 bp, Homo sapiens
ctgccaggagcag

SEQ ID NO: 330820 - DNA, 14 bp, Homo sapiens
ctgccaggagcagc

SEQ ID NO: 330821 - DNA, 16 bp, Homo sapiens
ctgccaggagcagcct

SEQ ID NO: 330822 - DNA, 17 bp, Homo sapiens
ctgccaggattttgtat

SEQ ID NO: 330823 - DNA, 22 bp, Homo sapiens
ctgccaggattttgtattgcca

SEQ ID NO: 330824 - DNA, 16 bp, Homo sapiens
ctgccaggcacctggc

SEQ ID NO: 330825 - DNA, 18 bp, Homo sapiens
ctgccaggcacctggcct

SEQ ID NO: 330826 - DNA, 20 bp, Homo sapiens
ctgccaggcacctggcctgc

SEQ ID NO: 330827 - DNA, 21 bp, Homo sapiens
ctgccaggcacctggcctgct

SEQ ID NO: 330828 - DNA, 22 bp, Homo sapiens
ctgccaggcacctggcctgctg

SEQ ID NO: 330829 - DNA, 12 bp, Homo sapiens
ctgccaggccca

SEQ ID NO: 330830 - DNA, 23 bp, Homo sapiens
ctgccaggcccatctcaggtgcc

SEQ ID NO: 330831 - DNA, 20 bp, Homo sapiens
ctgccaggctgtcagcgcct

SEQ ID NO: 330832 - DNA, 16 bp, Homo sapiens
ctgccagggcagtgct

SEQ ID NO: 330833 - DNA, 17 bp, Homo sapiens
ctgccagggcagtgcta

SEQ ID NO: 330834 - DNA, 20 bp, Homo sapiens
ctgccagtccccctgcccca

SEQ ID NO: 330835 - DNA, 20 bp, Homo sapiens
ctgccagtgaagtccttcag

SEQ ID NO: 330836 - DNA, 16 bp, Homo sapiens
ctgccagtgacagaca

SEQ ID NO: 330837 - DNA, 16 bp, Homo sapiens
ctgccagtgctggtca

SEQ ID NO: 330838 - DNA, 17 bp, Homo sapiens
ctgccagtgctggtcac

SEQ ID NO: 330839 - DNA, 15 bp, Homo sapiens
ctgccataattctaa

SEQ ID NO: 330840 - DNA, 22 bp, Homo sapiens
ctgccatcagcccctgctgctc

SEQ ID NO: 330841 - DNA, 17 bp, Homo sapiens
gtctagaatcctgcttt

SEQ ID NO: 330842 - DNA, 14 bp, Homo sapiens
gtctagcaaagcca

SEQ ID NO: 330843 - DNA, 20 bp, Homo sapiens
gtctaggactttagggatct

SEQ ID NO: 330844 - DNA, 22 bp, Homo sapiens
gtctaggactttagggatctgg

SEQ ID NO: 330845 - DNA, 19 bp, Homo sapiens
gtctaggtctcctcagggt

SEQ ID NO: 330846 - DNA, 20 bp, Homo sapiens
gtctataatcccagcacttt

SEQ ID NO: 330847 - DNA, 18 bp, Homo sapiens
gtctatcaagtcaatcat

SEQ ID NO: 330848 - DNA, 14 bp, Homo sapiens
gtctattctgagcc

SEQ ID NO: 330849 - DNA, 13 bp, Homo sapiens
gtctattttttta

SEQ ID NO: 330850 - DNA, 16 bp, Homo sapiens
gtctcaaaccctggct

SEQ ID NO: 330851 - DNA, 20 bp, Homo sapiens
gtctcaaacctccaaaagcc

SEQ ID NO: 330852 - DNA, 16 bp, Homo sapiens
gtctcaaactcctgac

SEQ ID NO: 330853 - DNA, 20 bp, Homo sapiens
gtctcaagagggcactggtg

SEQ ID NO: 330854 - DNA, 23 bp, Homo sapiens
gtctcacaatagcgtgagctaac

SEQ ID NO: 330855 - DNA, 16 bp, Homo sapiens
gtctcaccacacataa

SEQ ID NO: 330856 - DNA, 13 bp, Homo sapiens
gtctcactcctga

SEQ ID NO: 330857 - DNA, 17 bp, Homo sapiens
gtctcactcctgagtgg

SEQ ID NO: 330858 - DNA, 16 bp, Homo sapiens
gtctcactctttcttc

SEQ ID NO: 330859 - DNA, 23 bp, Homo sapiens
gtctcactttggactgggacagt

SEQ ID NO: 330860 - DNA, 13 bp, Homo sapiens
gtctcagcctccc

SEQ ID NO: 330861 - DNA, 14 bp, Homo sapiens
gtctcagccttccg

SEQ ID NO: 330862 - DNA, 12 bp, Homo sapiens
gtctcagtccag

SEQ ID NO: 330863 - DNA, 13 bp, Homo sapiens
gtctcatccccag

SEQ ID NO: 330864 - DNA, 17 bp, Homo sapiens
gtctcattttgtatgta

SEQ ID NO: 330865 - DNA, 15 bp, Homo sapiens
gtctccaccaggaac

SEQ ID NO: 330866 - DNA, 21 bp, Homo sapiens
gtctccaccaggaacctcttc

SEQ ID NO: 330867 - DNA, 13 bp, Homo sapiens
gtctccacccctc

SEQ ID NO: 330868 - DNA, 14 bp, Homo sapiens
gtctccacccctca

SEQ ID NO: 330869 - DNA, 15 bp, Homo sapiens
gtctccagaccccca

SEQ ID NO: 330870 - DNA, 20 bp, Homo sapiens
gtctccagacccccacccct

SEQ ID NO: 330871 - DNA, 18 bp, Homo sapiens
gtctccatttttcccagg

SEQ ID NO: 330872 - DNA, 20 bp, Homo sapiens
gtctccatttttcccaggac

SEQ ID NO: 330873 - DNA, 14 bp, Homo sapiens
gtctcccctctgct

SEQ ID NO: 330874 - DNA, 15 bp, Homo sapiens
gtctcccctctgctg

SEQ ID NO: 330875 - DNA, 12 bp, Homo sapiens
gtctcccttggc

SEQ ID NO: 330876 - DNA, 18 bp, Homo sapiens
gtctcccttggccacggc

SEQ ID NO: 330877 - DNA, 16 bp, Homo sapiens
gtctcctactctgtgt

SEQ ID NO: 330878 - DNA, 18 bp, Homo sapiens
gtctcctactctgtgtaa

SEQ ID NO: 330879 - DNA, 22 bp, Homo sapiens
gtctcctcagggtggggggtga

SEQ ID NO: 330880 - DNA, 22 bp, Homo sapiens
gtctcctccccgtagccactct

SEQ ID NO: 330881 - DNA, 12 bp, Homo sapiens
gtctcctccctc

SEQ ID NO: 330882 - DNA, 15 bp, Homo sapiens
gtctcctccctcagc

SEQ ID NO: 330883 - DNA, 16 bp, Homo sapiens
gtctcctctcagcttc

SEQ ID NO: 330884 - DNA, 15 bp, Homo sapiens
gtctcctctccagcc

SEQ ID NO: 330885 - DNA, 20 bp, Homo sapiens
gtctcctctgattatcaggt

SEQ ID NO: 330886 - DNA, 13 bp, Homo sapiens
gtctcctctgtca

SEQ ID NO: 330887 - DNA, 14 bp, Homo sapiens
gtctcctctgtcag

SEQ ID NO: 330888 - DNA, 19 bp, Homo sapiens
gtctccttactctgagccc

SEQ ID NO: 330889 - DNA, 20 bp, Homo sapiens
gtctccttactctgagccca

SEQ ID NO: 330890 - DNA, 22 bp, Homo sapiens
gtctccttactctgagcccagg

SEQ ID NO: 330891 - DNA, 15 bp, Homo sapiens
gtctccttcccactg

SEQ ID NO: 330892 - DNA, 16 bp, Homo sapiens
gtctccttcccactgt

SEQ ID NO: 330893 - DNA, 19 bp, Homo sapiens
gtctccttcccactgtcct

SEQ ID NO: 330894 - DNA, 14 bp, Homo sapiens
gtctcgctctgtcg

SEQ ID NO: 330895 - DNA, 16 bp, Homo sapiens
gtctcgctttgttgcc

SEQ ID NO: 330896 - DNA, 20 bp, Homo sapiens
gtctcgtcaggaggtgcctg

SEQ ID NO: 330897 - DNA, 18 bp, Homo sapiens
gtctctatcttgcatcta

SEQ ID NO: 330898 - DNA, 14 bp, Homo sapiens
gtctctcccacccc

SEQ ID NO: 330899 - DNA, 23 bp, Homo sapiens
gtctctctctctttttcttttct

SEQ ID NO: 330900 - DNA, 21 bp, Homo sapiens
gtctctctgtgaatacaatta

SEQ ID NO: 330901 - DNA, 22 bp, Homo sapiens
gtctctctgtgaatacaattaa

SEQ ID NO: 330902 - DNA, 15 bp, Homo sapiens
gtctctgaacatcct

SEQ ID NO: 330903 - DNA, 13 bp, Homo sapiens
gtctctgagcccc

SEQ ID NO: 330904 - DNA, 21 bp, Homo sapiens
gtctctgagccccctgtgccc

SEQ ID NO: 330905 - DNA, 23 bp, Homo sapiens
gtctctgagccccctgtgcccac

SEQ ID NO: 330906 - DNA, 14 bp, Homo sapiens
gtctctgccaccca

SEQ ID NO: 330907 - DNA, 13 bp, Homo sapiens
gtctctgccatgt

SEQ ID NO: 330908 - DNA, 16 bp, Homo sapiens
gtctctgccatgtggc

SEQ ID NO: 330909 - DNA, 18 bp, Homo sapiens
gtctctgccggctctttc

SEQ ID NO: 330910 - DNA, 13 bp, Homo sapiens
gtctctgctggcc

SEQ ID NO: 330911 - DNA, 17 bp, Homo sapiens
gtctctgctggcccagc

SEQ ID NO: 330912 - DNA, 20 bp, Homo sapiens
gtctctgctggcccagccaa

SEQ ID NO: 330913 - DNA, 19 bp, Homo sapiens
gtctctgtcgtggacacgc

SEQ ID NO: 330914 - DNA, 20 bp, Homo sapiens
gtctctgttcagatgtgcat

SEQ ID NO: 330915 - DNA, 11 bp, Homo sapiens
gtctcttcaga

SEQ ID NO: 330916 - DNA, 16 bp, Homo sapiens
gtctcttccagcccag

SEQ ID NO: 330917 - DNA, 14 bp, Homo sapiens
gtctcttctccact

SEQ ID NO: 330918 - DNA, 15 bp, Homo sapiens
gtctcttctccactg

SEQ ID NO: 330919 - DNA, 16 bp, Homo sapiens
gtctcttctccactgg

SEQ ID NO: 330920 - DNA, 13 bp, Homo sapiens
gtctcttgaggga

SEQ ID NO: 330921 - DNA, 17 bp, Homo sapiens
gtctctttccactttgt

SEQ ID NO: 330922 - DNA, 20 bp, Homo sapiens
gtctctttctttccaaaggt

SEQ ID NO: 330923 - DNA, 16 bp, Homo sapiens
gtctctttttcttcct

SEQ ID NO: 330924 - DNA, 21 bp, Homo sapiens
gtctctttttttggcccaggc

SEQ ID NO: 330925 - DNA, 19 bp, Homo sapiens
gtctgaaaatgttgttatg

SEQ ID NO: 330926 - DNA, 23 bp, Homo sapiens
gtctgaaggaatagccagagagg

SEQ ID NO: 330927 - DNA, 14 bp, Homo sapiens
gtctgaaggagagg

SEQ ID NO: 330928 - DNA, 15 bp, Homo sapiens
gtctgaaggagagga

SEQ ID NO: 330929 - DNA, 17 bp, Homo sapiens
gtctgaaggagaggagt

SEQ ID NO: 330930 - DNA, 16 bp, Homo sapiens
gtctgaagtcactgca

SEQ ID NO: 330931 - DNA, 17 bp, Homo sapiens
gtctgaagtcactgcac

SEQ ID NO: 330932 - DNA, 16 bp, Homo sapiens
gtctgacacatgctct

SEQ ID NO: 330933 - DNA, 17 bp, Homo sapiens
gtctgacacatgctctc

SEQ ID NO: 330934 - DNA, 18 bp, Homo sapiens
gtctgacacatgctctca

SEQ ID NO: 330935 - DNA, 15 bp, Homo sapiens
gtctgacaggaagac

SEQ ID NO: 330936 - DNA, 13 bp, Homo sapiens
aaagctaggaaag

SEQ ID NO: 330937 - DNA, 17 bp, Homo sapiens
aaagctaggaaaggcag

SEQ ID NO: 330938 - DNA, 19 bp, Homo sapiens
aaagctaggaaaggcagaa

SEQ ID NO: 330939 - DNA, 14 bp, Homo sapiens
aaagctatatatga

SEQ ID NO: 330940 - DNA, 19 bp, Homo sapiens
aaagctatatgttatggct

SEQ ID NO: 330941 - DNA, 15 bp, Homo sapiens
aaagctcactttact

SEQ ID NO: 330942 - DNA, 15 bp, Homo sapiens
aaagctgaagaaaat

SEQ ID NO: 330943 - DNA, 22 bp, Homo sapiens
aaagctgattactgtcaataaa

SEQ ID NO: 330944 - DNA, 16 bp, Homo sapiens
aaagctgcctgtagtt

SEQ ID NO: 330945 - DNA, 17 bp, Homo sapiens
aaagctgcctgtagtta

SEQ ID NO: 330946 - DNA, 23 bp, Homo sapiens
aaagctgcctgtagttaggaaat

SEQ ID NO: 330947 - DNA, 12 bp, Homo sapiens
aaagctgtgaaa

SEQ ID NO: 330948 - DNA, 17 bp, Homo sapiens
aaagctgtgtctctgta

SEQ ID NO: 330949 - DNA, 20 bp, Homo sapiens
aaagctttaaaaaataaagc

SEQ ID NO: 330950 - DNA, 13 bp, Homo sapiens
aaagctttttgaa

SEQ ID NO: 330951 - DNA, 18 bp, Homo sapiens
aaaggaaaactcaccatt

SEQ ID NO: 330952 - DNA, 17 bp, Homo sapiens
aaaggaaatctcacccc

SEQ ID NO: 330953 - DNA, 23 bp, Homo sapiens
aaaggaaatctcaccccatccca

SEQ ID NO: 330954 - DNA, 16 bp, Homo sapiens
aaaggaataggtagga

SEQ ID NO: 330955 - DNA, 15 bp, Homo sapiens
aaaggacaaacagtg

SEQ ID NO: 330956 - DNA, 17 bp, Homo sapiens
aaaggacaaacagtgaa

SEQ ID NO: 330957 - DNA, 24 bp, Homo sapiens
aaaggacaggaggaggagatggcc

SEQ ID NO: 330958 - DNA, 20 bp, Homo sapiens
aaaggactgttttttcctga

SEQ ID NO: 330959 - DNA, 18 bp, Homo sapiens
aaaggagaactgtgctct

SEQ ID NO: 330960 - DNA, 21 bp, Homo sapiens
aaaggatagatcaaagtcaaa

SEQ ID NO: 330961 - DNA, 15 bp, Homo sapiens
aaaggataggaaaag

SEQ ID NO: 330962 - DNA, 16 bp, Homo sapiens
aaaggatatttaagaa

SEQ ID NO: 330963 - DNA, 21 bp, Homo sapiens
aaaggatatttaagaaaatac

SEQ ID NO: 330964 - DNA, 19 bp, Homo sapiens
aaaggatgaagaacacagc

SEQ ID NO: 330965 - DNA, 23 bp, Homo sapiens
aaaggatggcagcctcagggctt

SEQ ID NO: 330966 - DNA, 21 bp, Homo sapiens
aaaggattaagatacactcct

SEQ ID NO: 330967 - DNA, 13 bp, Homo sapiens
aaaggatttgaaa

SEQ ID NO: 330968 - DNA, 14 bp, Homo sapiens
aaaggatttgaaaa

SEQ ID NO: 330969 - DNA, 23 bp, Homo sapiens
aaaggatttgaaacttggtgtgt

SEQ ID NO: 330970 - DNA, 16 bp, Homo sapiens
aaaggcaaaaccttac

SEQ ID NO: 330971 - DNA, 13 bp, Homo sapiens
aaaggcagaaaca

SEQ ID NO: 330972 - DNA, 16 bp, Homo sapiens
aaaggcagtattccct

SEQ ID NO: 330973 - DNA, 11 bp, Homo sapiens
aaaggcctctt

SEQ ID NO: 330974 - DNA, 14 bp, Homo sapiens
aaaggcctttggga

SEQ ID NO: 330975 - DNA, 12 bp, Homo sapiens
aaaggctggcaa

SEQ ID NO: 330976 - DNA, 19 bp, Homo sapiens
aaaggctggctgaaaatca

SEQ ID NO: 330977 - DNA, 22 bp, Homo sapiens
aaaggctggctgaaaatcacta

SEQ ID NO: 330978 - DNA, 23 bp, Homo sapiens
aaaggctggctgaaaatcactat

SEQ ID NO: 330979 - DNA, 14 bp, Homo sapiens
aaagggaacatgca

SEQ ID NO: 330980 - DNA, 14 bp, Homo sapiens
gtctggagaccagg

SEQ ID NO: 330981 - DNA, 23 bp, Homo sapiens
gtctggagaccaggactctgcct

SEQ ID NO: 330982 - DNA, 15 bp, Homo sapiens
gtctggagcccctat

SEQ ID NO: 330983 - DNA, 10 bp, Homo sapiens
gtctggaggg

SEQ ID NO: 330984 - DNA, 22 bp, Homo sapiens
gtctggccaatatggagaaacc

SEQ ID NO: 330985 - DNA, 13 bp, Homo sapiens
gtctggcctgcca

SEQ ID NO: 330986 - DNA, 21 bp, Homo sapiens
gtctggcgagcccttagcctt

SEQ ID NO: 330987 - DNA, 18 bp, Homo sapiens
gtctggctgtggcccctc

SEQ ID NO: 330988 - DNA, 21 bp, Homo sapiens
gtctggctgtggcccctcctt

SEQ ID NO: 330989 - DNA, 13 bp, Homo sapiens
gtctgggaagggg

SEQ ID NO: 330990 - DNA, 18 bp, Homo sapiens
gtctgggacttccttgct

SEQ ID NO: 330991 - DNA, 19 bp, Homo sapiens
gtctgggagaggcagagtg

SEQ ID NO: 330992 - DNA, 13 bp, Homo sapiens
gtctgggaggcag

SEQ ID NO: 330993 - DNA, 16 bp, Homo sapiens
gtctgggagtgttctg

SEQ ID NO: 330994 - DNA, 16 bp, Homo sapiens
gtctgggatgtagaac

SEQ ID NO: 330995 - DNA, 17 bp, Homo sapiens
gtctgggatgtagaact

SEQ ID NO: 330996 - DNA, 14 bp, Homo sapiens
gtctgggggtcagg

SEQ ID NO: 330997 - DNA, 18 bp, Homo sapiens
gtctggttttaacaattt

SEQ ID NO: 330998 - DNA, 20 bp, Homo sapiens
gtctgtatcggagacagtga

SEQ ID NO: 330999 - DNA, 23 bp, Homo sapiens
gtctgtatttatgtgtgaggagc

SEQ ID NO: 331000 - DNA, 17 bp, Homo sapiens
gtctgtccatctgtctg

SEQ ID NO: 331001 - DNA, 13 bp, Homo sapiens
gtctgtcctaccc

SEQ ID NO: 331002 - DNA, 14 bp, Homo sapiens
gtctgtctgtctgt

SEQ ID NO: 331003 - DNA, 22 bp, Homo sapiens
gtctgtcttcacagctctgtgt

SEQ ID NO: 331004 - DNA, 15 bp, Homo sapiens
gtctgtgagtctgtc

SEQ ID NO: 331005 - DNA, 17 bp, Homo sapiens
gtctgtgagtctgtcct

SEQ ID NO: 331006 - DNA, 18 bp, Homo sapiens
gtctgtgagtctgtcctt

SEQ ID NO: 331007 - DNA, 20 bp, Homo sapiens
gtctgtgatgtcagtagtgc

SEQ ID NO: 331008 - DNA, 13 bp, Homo sapiens
gtctgtgccatgg

SEQ ID NO: 331009 - DNA, 13 bp, Homo sapiens
gtctgtgcctgga

SEQ ID NO: 331010 - DNA, 16 bp, Homo sapiens
gtctgtgcctggagct

SEQ ID NO: 331011 - DNA, 17 bp, Homo sapiens
gtctgtgctgtgcctgc

SEQ ID NO: 331012 - DNA, 12 bp, Homo sapiens
gtctgtgggact

SEQ ID NO: 331013 - DNA, 14 bp, Homo sapiens
gtctgtgtgctgta

SEQ ID NO: 331014 - DNA, 15 bp, Homo sapiens
gtctgtgtgctgtaa

SEQ ID NO: 331015 - DNA, 17 bp, Homo sapiens
gtctgtgtgctgtggtt

SEQ ID NO: 331016 - DNA, 18 bp, Homo sapiens
gtcttaaataaaactatt

SEQ ID NO: 331017 - DNA, 16 bp, Homo sapiens
gtcttaattttctaaa

SEQ ID NO: 331018 - DNA, 20 bp, Homo sapiens
gtcttacaaggcaggccttt

SEQ ID NO: 331019 - DNA, 17 bp, Homo sapiens
gtcttactactttaaat

SEQ ID NO: 331020 - DNA, 17 bp, Homo sapiens
gtcttactttgtgcaaa

SEQ ID NO: 331021 - DNA, 13 bp, Homo sapiens
gtcttagagagag

SEQ ID NO: 331022 - DNA, 14 bp, Homo sapiens
gtcttagagagaga

SEQ ID NO: 331023 - DNA, 20 bp, Homo sapiens
gtcttagctttacattttca

SEQ ID NO: 331024 - DNA, 15 bp, Homo sapiens
gtcttcaaccctgcc

SEQ ID NO: 331025 - DNA, 17 bp, Homo sapiens
gtcttcaaccctgccct

SEQ ID NO: 331026 - DNA, 21 bp, Homo sapiens
gtcttcaaccctgccctgcac

SEQ ID NO: 331027 - DNA, 23 bp, Homo sapiens
gtcttcaaccctgccctgcacct

SEQ ID NO: 331028 - DNA, 14 bp, Homo sapiens
gtcttcaagggctg

SEQ ID NO: 331029 - DNA, 15 bp, Homo sapiens
gtcttcaagggctgc

SEQ ID NO: 331030 - DNA, 14 bp, Homo sapiens
gtcttcaagggctt

SEQ ID NO: 331031 - DNA, 15 bp, Homo sapiens
gtcttcaatctctgt

SEQ ID NO: 331032 - DNA, 21 bp, Homo sapiens
gtcttcaatttgtataaaatg

SEQ ID NO: 331033 - DNA, 17 bp, Homo sapiens
gtcttcacagctctgtg

SEQ ID NO: 331034 - DNA, 16 bp, Homo sapiens
gtcttcatccttagca

SEQ ID NO: 331035 - DNA, 16 bp, Homo sapiens
gtcttcatttcattgt

SEQ ID NO: 331036 - DNA, 11 bp, Homo sapiens
gtcttccacaa

SEQ ID NO: 331037 - DNA, 13 bp, Homo sapiens
gtcttccataatg

SEQ ID NO: 331038 - DNA, 14 bp, Homo sapiens
gtcttccatcagca

SEQ ID NO: 331039 - DNA, 16 bp, Homo sapiens
gtcttccatcagcagt

SEQ ID NO: 331040 - DNA, 16 bp, Homo sapiens
gtcttccctacctcag

SEQ ID NO: 331041 - DNA, 17 bp, Homo sapiens
gtcttccctagggctgg

SEQ ID NO: 331042 - DNA, 19 bp, Homo sapiens
gtcttccctagggctgggt

SEQ ID NO: 331043 - DNA, 15 bp, Homo sapiens
gtcttccctgcttca

SEQ ID NO: 331044 - DNA, 13 bp, Homo sapiens
gtcttctaatttc

SEQ ID NO: 331045 - DNA, 21 bp, Homo sapiens
gtcttctagagagcttagtgt

SEQ ID NO: 331046 - DNA, 14 bp, Homo sapiens
gtcttctctccact

SEQ ID NO: 331047 - DNA, 13 bp, Homo sapiens
gtcttctgcctgt

SEQ ID NO: 331048 - DNA, 15 bp, Homo sapiens
gtcttcttgtgtcct

SEQ ID NO: 331049 - DNA, 16 bp, Homo sapiens
gtcttcttgtgtcctg

SEQ ID NO: 331050 - DNA, 16 bp, Homo sapiens
gtcttctttctcctgt

SEQ ID NO: 331051 - DNA, 22 bp, Homo sapiens
gtcttgaactcctgacctcagg

SEQ ID NO: 331052 - DNA, 21 bp, Homo sapiens
gtcttgactctaaatgcagtt

SEQ ID NO: 331053 - DNA, 22 bp, Homo sapiens
gtcttgactctaaatgcagttt

SEQ ID NO: 331054 - DNA, 19 bp, Homo sapiens
gtcttgagagcgctggcct

SEQ ID NO: 331055 - DNA, 19 bp, Homo sapiens
gtcttgagtgggccccctc

SEQ ID NO: 331056 - DNA, 17 bp, Homo sapiens
gtcttgagtttcatttt

SEQ ID NO: 331057 - DNA, 20 bp, Homo sapiens
gtcttgagtttcatttttca

SEQ ID NO: 331058 - DNA, 14 bp, Homo sapiens
gtcttgatctcctg

SEQ ID NO: 331059 - DNA, 22 bp, Homo sapiens
gtcttgcaaagcctttaaattg

SEQ ID NO: 331060 - DNA, 12 bp, Homo sapiens
gtcttgctgtgg

SEQ ID NO: 331061 - DNA, 16 bp, Homo sapiens
gtcttgggctactggc

SEQ ID NO: 331062 - DNA, 22 bp, Homo sapiens
gtcttgggctactggcagctcc

SEQ ID NO: 331063 - DNA, 22 bp, Homo sapiens
gtcttggtgccttttgtgtgat

SEQ ID NO: 331064 - DNA, 14 bp, Homo sapiens
gtcttgtattttct

SEQ ID NO: 331065 - DNA, 15 bp, Homo sapiens
gtcttgtcatctttt

SEQ ID NO: 331066 - DNA, 13 bp, Homo sapiens
gtcttgtgactag

SEQ ID NO: 331067 - DNA, 12 bp, Homo sapiens
tccattcttggt

SEQ ID NO: 331068 - DNA, 19 bp, Homo sapiens
tccattctttctgataact

SEQ ID NO: 331069 - DNA, 15 bp, Homo sapiens
tccattctttcttcc

SEQ ID NO: 331070 - DNA, 14 bp, Homo sapiens
tccattgtgtgagt

SEQ ID NO: 331071 - DNA, 21 bp, Homo sapiens
tccatttacctggaaaccaga

SEQ ID NO: 331072 - DNA, 16 bp, Homo sapiens
tccatttacttgatca

SEQ ID NO: 331073 - DNA, 12 bp, Homo sapiens
tccattttctaa

SEQ ID NO: 331074 - DNA, 19 bp, Homo sapiens
tccattttctaaactgttt

SEQ ID NO: 331075 - DNA, 14 bp, Homo sapiens
tccattttcttgtc

SEQ ID NO: 331076 - DNA, 15 bp, Homo sapiens
tccattttcttgtca

SEQ ID NO: 331077 - DNA, 13 bp, Homo sapiens
tccattttggaaa

SEQ ID NO: 331078 - DNA, 16 bp, Homo sapiens
tcccaaaatgtgcctc

SEQ ID NO: 331079 - DNA, 15 bp, Homo sapiens
tcccaaactcccagg

SEQ ID NO: 331080 - DNA, 19 bp, Homo sapiens
tcccaaactcccaggacct

SEQ ID NO: 331081 - DNA, 21 bp, Homo sapiens
tcccaaagaagttctggtatg

SEQ ID NO: 331082 - DNA, 18 bp, Homo sapiens
tcccaaagcagtgcatgc

SEQ ID NO: 331083 - DNA, 14 bp, Homo sapiens
tcccaaagtgctgg

SEQ ID NO: 331084 - DNA, 14 bp, Homo sapiens
tcccaaataaattt

SEQ ID NO: 331085 - DNA, 23 bp, Homo sapiens
tcccaaatatgcccctccccagt

SEQ ID NO: 331086 - DNA, 18 bp, Homo sapiens
tcccaacagaggcctccc

SEQ ID NO: 331087 - DNA, 23 bp, Homo sapiens
tcccaacctcaatgccctgccat

SEQ ID NO: 331088 - DNA, 19 bp, Homo sapiens
tcccaactcactgtgctcc

SEQ ID NO: 331089 - DNA, 20 bp, Homo sapiens
tcccaactcactgtgctcct

SEQ ID NO: 331090 - DNA, 14 bp, Homo sapiens
tcccaactctggcc

SEQ ID NO: 331091 - DNA, 14 bp, Homo sapiens
tcccaactttggaa

SEQ ID NO: 331092 - DNA, 21 bp, Homo sapiens
tcccaagcgttcctggccttc

SEQ ID NO: 331093 - DNA, 14 bp, Homo sapiens
tcccaagctcagag

SEQ ID NO: 331094 - DNA, 22 bp, Homo sapiens
tcccaagctggagtgcagtggt

SEQ ID NO: 331095 - DNA, 15 bp, Homo sapiens
tcccaaggagctgat

SEQ ID NO: 331096 - DNA, 22 bp, Homo sapiens
tcccaaggctctgagcaaatgt

SEQ ID NO: 331097 - DNA, 20 bp, Homo sapiens
tcccaagggtgccctttggg

SEQ ID NO: 331098 - DNA, 16 bp, Homo sapiens
tcccaaggtcctctca

SEQ ID NO: 331099 - DNA, 20 bp, Homo sapiens
tcccaagtaggtgggattac

SEQ ID NO: 331100 - DNA, 11 bp, Homo sapiens
tcccaataaaa

SEQ ID NO: 331101 - DNA, 14 bp, Homo sapiens
tcccaataaaagtg

SEQ ID NO: 331102 - DNA, 17 bp, Homo sapiens
tcccaataaaagtgact

SEQ ID NO: 331103 - DNA, 13 bp, Homo sapiens
tcccaataaagct

SEQ ID NO: 331104 - DNA, 14 bp, Homo sapiens
tcccaataaagctg

SEQ ID NO: 331105 - DNA, 20 bp, Homo sapiens
tcccaataaagtcctcttcc

SEQ ID NO: 331106 - DNA, 13 bp, Homo sapiens
tcccaatcagctt

SEQ ID NO: 331107 - DNA, 14 bp, Homo sapiens
tcccaatcagcttt

SEQ ID NO: 331108 - DNA, 14 bp, Homo sapiens
tcccaattaggaag

SEQ ID NO: 331109 - DNA, 17 bp, Homo sapiens
tcccacaatggctggga

SEQ ID NO: 331110 - DNA, 17 bp, Homo sapiens
tcccacaccccagcgcc

SEQ ID NO: 331111 - DNA, 22 bp, Homo sapiens
tcccacactgctaggtgggcca

SEQ ID NO: 331112 - DNA, 16 bp, Homo sapiens
tcccacagcttcctga

SEQ ID NO: 331113 - DNA, 17 bp, Homo sapiens
tcccacaggcccttcct

SEQ ID NO: 331114 - DNA, 22 bp, Homo sapiens
tcccacaggcccttcctctcca

SEQ ID NO: 331115 - DNA, 14 bp, Homo sapiens
tcccacatcccact

SEQ ID NO: 331116 - DNA, 17 bp, Homo sapiens
tcccacatcccactgga

SEQ ID NO: 331117 - DNA, 17 bp, Homo sapiens
tcccacatcccccgtgt

SEQ ID NO: 331118 - DNA, 13 bp, Homo sapiens
gcaaataccaaag

SEQ ID NO: 331119 - DNA, 21 bp, Homo sapiens
gcaaatagaaaacaggaaaaa

SEQ ID NO: 331120 - DNA, 15 bp, Homo sapiens
gcaaatagtttcaaa

SEQ ID NO: 331121 - DNA, 19 bp, Homo sapiens
gcaaatataagctgggaaa

SEQ ID NO: 331122 - DNA, 14 bp, Homo sapiens
gcaaatcagacaca

SEQ ID NO: 331123 - DNA, 13 bp, Homo sapiens
gcaaatcagtctc

SEQ ID NO: 331124 - DNA, 19 bp, Homo sapiens
gcaaatctcctttgtccat

SEQ ID NO: 331125 - DNA, 23 bp, Homo sapiens
gcaaatgccaggacagctgcagg

SEQ ID NO: 331126 - DNA, 13 bp, Homo sapiens
gcaaatgtccaag

SEQ ID NO: 331127 - DNA, 21 bp, Homo sapiens
gcaaatgtccaagcatcagca

SEQ ID NO: 331128 - DNA, 15 bp, Homo sapiens
gcaaatgtggctcct

SEQ ID NO: 331129 - DNA, 22 bp, Homo sapiens
gcaaattagggctacattgtaa

SEQ ID NO: 331130 - DNA, 19 bp, Homo sapiens
gcaaattgtagcccagttg

SEQ ID NO: 331131 - DNA, 20 bp, Homo sapiens
gcaaatttcatctttccaaa

SEQ ID NO: 331132 - DNA, 24 bp, Homo sapiens
gcaaatttctagatatgagaaata

SEQ ID NO: 331133 - DNA, 22 bp, Homo sapiens
gcaaatttttttgtatttttag

SEQ ID NO: 331134 - DNA, 17 bp, Homo sapiens
gcaacaacaacagaaca

SEQ ID NO: 331135 - DNA, 15 bp, Homo sapiens
gcaacaataataaat

SEQ ID NO: 331136 - DNA, 16 bp, Homo sapiens
gcaacacccaagtcca

SEQ ID NO: 331137 - DNA, 21 bp, Homo sapiens
gcaacacctgtggataaaaca

SEQ ID NO: 331138 - DNA, 18 bp, Homo sapiens
gcaacagcactggctctc

SEQ ID NO: 331139 - DNA, 16 bp, Homo sapiens
gcaacaggaccaggag

SEQ ID NO: 331140 - DNA, 21 bp, Homo sapiens
gcaacagtgccccctccgtcc

SEQ ID NO: 331141 - DNA, 18 bp, Homo sapiens
gcaacagtgttctgagcc

SEQ ID NO: 331142 - DNA, 19 bp, Homo sapiens
gcaacagtgttctgagccc

SEQ ID NO: 331143 - DNA, 20 bp, Homo sapiens
gcaacagtgttctgagcccc

SEQ ID NO: 331144 - DNA, 19 bp, Homo sapiens
gcaacatctcgagccccct

SEQ ID NO: 331145 - DNA, 15 bp, Homo sapiens
gcaacatggattcca

SEQ ID NO: 331146 - DNA, 21 bp, Homo sapiens
gcaacatggattccaaagcat

SEQ ID NO: 331147 - DNA, 23 bp, Homo sapiens
gcaacatttacagtccttcaaaa

SEQ ID NO: 331148 - DNA, 22 bp, Homo sapiens
gcaaccctacagtatataagct

SEQ ID NO: 331149 - DNA, 12 bp, Homo sapiens
gcaaccctccta

SEQ ID NO: 331150 - DNA, 22 bp, Homo sapiens
gcaaccctggtgaccagcacca

SEQ ID NO: 331151 - DNA, 21 bp, Homo sapiens
gcaacccttaccccttagcct

SEQ ID NO: 331152 - DNA, 21 bp, Homo sapiens
gcaaccttaaagcaataagtt

SEQ ID NO: 331153 - DNA, 19 bp, Homo sapiens
gcaacgcctgccttctggg

SEQ ID NO: 331154 - DNA, 21 bp, Homo sapiens
gcaacgtgcgtgtctctgcca

SEQ ID NO: 331155 - DNA, 15 bp, Homo sapiens
gcaactattaataat

SEQ ID NO: 331156 - DNA, 22 bp, Homo sapiens
gcaactcatgaacaaaatgaag

SEQ ID NO: 331157 - DNA, 17 bp, Homo sapiens
gcaactctccactccat

SEQ ID NO: 331158 - DNA, 22 bp, Homo sapiens
gcaactggactatagcagggct

SEQ ID NO: 331159 - DNA, 21 bp, Homo sapiens
gcaactgttagctgggaagaa

SEQ ID NO: 331160 - DNA, 16 bp, Homo sapiens
gcaacttcagtcctgg

SEQ ID NO: 331161 - DNA, 17 bp, Homo sapiens
gcaacttcagtcctggg

SEQ ID NO: 331162 - DNA, 19 bp, Homo sapiens
gcaacttgtctttttctgg

SEQ ID NO: 331163 - DNA, 19 bp, Homo sapiens
gcaagaaattcattaaaga

SEQ ID NO: 331164 - DNA, 14 bp, Homo sapiens
gcaagaaggaattg

SEQ ID NO: 331165 - DNA, 15 bp, Homo sapiens
gcaagacctgttggt

SEQ ID NO: 331166 - DNA, 19 bp, Homo sapiens
gcaagacgtcctggaatga

SEQ ID NO: 331167 - DNA, 16 bp, Homo sapiens
gcaagagaaggagatg

SEQ ID NO: 331168 - DNA, 22 bp, Homo sapiens
gcaagagaaggagatgtaatga

SEQ ID NO: 331169 - DNA, 19 bp, Homo sapiens
gcaagagaattgcttgaac

SEQ ID NO: 331170 - DNA, 13 bp, Homo sapiens
gcaagagatgaga

SEQ ID NO: 331171 - DNA, 14 bp, Homo sapiens
gcaagagctcagga

SEQ ID NO: 331172 - DNA, 16 bp, Homo sapiens
gcaagagctcaggaga

SEQ ID NO: 331173 - DNA, 12 bp, Homo sapiens
gcaagagtgggc

SEQ ID NO: 331174 - DNA, 15 bp, Homo sapiens
gcaagatatttatat

SEQ ID NO: 331175 - DNA, 16 bp, Homo sapiens
gcaagatatttatata

SEQ ID NO: 331176 - DNA, 20 bp, Homo sapiens
gcaagattggaaagacagga

SEQ ID NO: 331177 - DNA, 22 bp, Homo sapiens
gcaagcagggaaagctccacgg

SEQ ID NO: 331178 - DNA, 11 bp, Homo sapiens
gcaagcatgtt

SEQ ID NO: 331179 - DNA, 15 bp, Homo sapiens
gcaagccacagaaat

SEQ ID NO: 331180 - DNA, 17 bp, Homo sapiens
gcaagccccagggcctg

SEQ ID NO: 331181 - DNA, 19 bp, Homo sapiens
gcaagccccagggcctggg

SEQ ID NO: 331182 - DNA, 17 bp, Homo sapiens
gcaagcccctcagccct

SEQ ID NO: 331183 - DNA, 18 bp, Homo sapiens
gcaagcccctcagccctt

SEQ ID NO: 331184 - DNA, 23 bp, Homo sapiens
gcaagcccctcagcccttgcccc

SEQ ID NO: 331185 - DNA, 15 bp, Homo sapiens
gcaagcctgagtggt

SEQ ID NO: 331186 - DNA, 19 bp, Homo sapiens
gcaagcgagcacagtatta

SEQ ID NO: 331187 - DNA, 17 bp, Homo sapiens
gcaagctcagggtgctc

SEQ ID NO: 331188 - DNA, 15 bp, Homo sapiens
gcaagctggcaggag

SEQ ID NO: 331189 - DNA, 21 bp, Homo sapiens
gcaagcttatttagcacattt

SEQ ID NO: 331190 - DNA, 21 bp, Homo sapiens
gcaaggacattgccccaagat

SEQ ID NO: 331191 - DNA, 21 bp, Homo sapiens
gcaaggatgatccagggattg

SEQ ID NO: 331192 - DNA, 18 bp, Homo sapiens
gcaaggcacaggctcctg

SEQ ID NO: 331193 - DNA, 17 bp, Homo sapiens
gcaaggcagctcccagg

SEQ ID NO: 331194 - DNA, 15 bp, Homo sapiens
gcaaggcaggttgga

SEQ ID NO: 331195 - DNA, 19 bp, Homo sapiens
gcaaggccagccctggttc

SEQ ID NO: 331196 - DNA, 22 bp, Homo sapiens
gcaaggcctcgctcttgacaga

SEQ ID NO: 331197 - DNA, 10 bp, Homo sapiens
tcccccttcc

SEQ ID NO: 331198 - DNA, 15 bp, Homo sapiens
tcccccttcccctgc

SEQ ID NO: 331199 - DNA, 14 bp, Homo sapiens
tccccgagccgagc

SEQ ID NO: 331200 - DNA, 21 bp, Homo sapiens
tccccgagccgagctctcctg

SEQ ID NO: 331201 - DNA, 15 bp, Homo sapiens
tccccgatccccgac

SEQ ID NO: 331202 - DNA, 15 bp, Homo sapiens
tccccgcccgccctc

SEQ ID NO: 331203 - DNA, 18 bp, Homo sapiens
tccccgcccgccctcctc

SEQ ID NO: 331204 - DNA, 16 bp, Homo sapiens
tccccgcctccactct

SEQ ID NO: 331205 - DNA, 15 bp, Homo sapiens
tccccgcgggcagtg

SEQ ID NO: 331206 - DNA, 13 bp, Homo sapiens
tccccgctggctg

SEQ ID NO: 331207 - DNA, 15 bp, Homo sapiens
tccccgctggctggg

SEQ ID NO: 331208 - DNA, 13 bp, Homo sapiens
tccccggagctgg

SEQ ID NO: 331209 - DNA, 21 bp, Homo sapiens
tccccggccctaccagcgccc

SEQ ID NO: 331210 - DNA, 13 bp, Homo sapiens
tccccggctcgag

SEQ ID NO: 331211 - DNA, 15 bp, Homo sapiens
tccccgtagccactc

SEQ ID NO: 331212 - DNA, 20 bp, Homo sapiens
tccccgtgcggcccgtgcgc

SEQ ID NO: 331213 - DNA, 13 bp, Homo sapiens
tcccctaatgcct

SEQ ID NO: 331214 - DNA, 20 bp, Homo sapiens
tcccctaccaggctgtaaat

SEQ ID NO: 331215 - DNA, 14 bp, Homo sapiens
tcccctcacccaaa

SEQ ID NO: 331216 - DNA, 21 bp, Homo sapiens
tcccctcacccgctgcccagc

SEQ ID NO: 331217 - DNA, 22 bp, Homo sapiens
tcccctcattgcatttattgca

SEQ ID NO: 331218 - DNA, 14 bp, Homo sapiens
tcccctcccagtcc

SEQ ID NO: 331219 - DNA, 14 bp, Homo sapiens
tcccctccctcctc

SEQ ID NO: 331220 - DNA, 13 bp, Homo sapiens
tcccctccctgcc

SEQ ID NO: 331221 - DNA, 16 bp, Homo sapiens
tcccctccctggctcc

SEQ ID NO: 331222 - DNA, 13 bp, Homo sapiens
tcccctccctggg

SEQ ID NO: 331223 - DNA, 13 bp, Homo sapiens
tcccctccctgtc

SEQ ID NO: 331224 - DNA, 14 bp, Homo sapiens
tcccctccctgtca

SEQ ID NO: 331225 - DNA, 19 bp, Homo sapiens
tcccctcctctcctgccca

SEQ ID NO: 331226 - DNA, 15 bp, Homo sapiens
tcccctccttccagc

SEQ ID NO: 331227 - DNA, 14 bp, Homo sapiens
tcccctccttctcc

SEQ ID NO: 331228 - DNA, 20 bp, Homo sapiens
tcccctccttgcctcctgtg

SEQ ID NO: 331229 - DNA, 15 bp, Homo sapiens
tcccctcgcttcata

SEQ ID NO: 331230 - DNA, 21 bp, Homo sapiens
tcccctcgcttcataggcaga

SEQ ID NO: 331231 - DNA, 22 bp, Homo sapiens
tcccctcgcttcataggcagag

SEQ ID NO: 331232 - DNA, 19 bp, Homo sapiens
tcccctcgtcctgtcccag

SEQ ID NO: 331233 - DNA, 17 bp, Homo sapiens
tcccctctccctgggga

SEQ ID NO: 331234 - DNA, 13 bp, Homo sapiens
tcccctctcctga

SEQ ID NO: 331235 - DNA, 17 bp, Homo sapiens
tcccctctcctgagcct

SEQ ID NO: 331236 - DNA, 23 bp, Homo sapiens
tcccctcttccctgtcttcccca

SEQ ID NO: 331237 - DNA, 12 bp, Homo sapiens
tcccctcttcct

SEQ ID NO: 331238 - DNA, 15 bp, Homo sapiens
tcccctgagaggttt

SEQ ID NO: 331239 - DNA, 10 bp, Homo sapiens
tcccctgagg

SEQ ID NO: 331240 - DNA, 20 bp, Homo sapiens
tcccctgaggttaaggggat

SEQ ID NO: 331241 - DNA, 13 bp, Homo sapiens
tcccctgcactgt

SEQ ID NO: 331242 - DNA, 15 bp, Homo sapiens
tcccctgcactgtaa

SEQ ID NO: 331243 - DNA, 22 bp, Homo sapiens
tcccctgcactgtaaaatgtgg

SEQ ID NO: 331244 - DNA, 13 bp, Homo sapiens
tcccctgccccgt

SEQ ID NO: 331245 - DNA, 16 bp, Homo sapiens
tcccctgcccgcccca

SEQ ID NO: 331246 - DNA, 16 bp, Homo sapiens
tcccctgccctgctgc

SEQ ID NO: 331247 - DNA, 15 bp, Homo sapiens
tcccctgccctggtc

SEQ ID NO: 331248 - DNA, 12 bp, Homo sapiens
tcccctgcctgg

SEQ ID NO: 331249 - DNA, 19 bp, Homo sapiens
tcccctgcgcaggccctcc

SEQ ID NO: 331250 - DNA, 17 bp, Homo sapiens
tcccctgcgccctccct

SEQ ID NO: 331251 - DNA, 20 bp, Homo sapiens
tcccctgcgccctccctccc

SEQ ID NO: 331252 - DNA, 16 bp, Homo sapiens
tcccctggagccagca

SEQ ID NO: 331253 - DNA, 20 bp, Homo sapiens
tcccctggagccagcagggc

SEQ ID NO: 331254 - DNA, 17 bp, Homo sapiens
tcccctgggccaccctt

SEQ ID NO: 331255 - DNA, 17 bp, Homo sapiens
tcccctggtctcctccc

SEQ ID NO: 331256 - DNA, 20 bp, Homo sapiens
tcccctgtggtgatgtgcct

SEQ ID NO: 331257 - DNA, 21 bp, Homo sapiens
tcccctgtggtgatgtgcctg

SEQ ID NO: 331258 - DNA, 17 bp, Homo sapiens
tcccctgtggtttgtta

SEQ ID NO: 331259 - DNA, 12 bp, Homo sapiens
tccccttccaac

SEQ ID NO: 331260 - DNA, 22 bp, Homo sapiens
tccccttccaactatgtccaga

SEQ ID NO: 331261 - DNA, 20 bp, Homo sapiens
tccccttccccaattactat

SEQ ID NO: 331262 - DNA, 15 bp, Homo sapiens
tccccttcccctgct

SEQ ID NO: 331263 - DNA, 16 bp, Homo sapiens
tccccttcccctgctg

SEQ ID NO: 331264 - DNA, 17 bp, Homo sapiens
tccccttcccctgctga

SEQ ID NO: 331265 - DNA, 19 bp, Homo sapiens
tccccttgaacctcattaa

SEQ ID NO: 331266 - DNA, 15 bp, Homo sapiens
tccccttgagctgag

SEQ ID NO: 331267 - DNA, 16 bp, Homo sapiens
tccccttgagctgaga

SEQ ID NO: 331268 - DNA, 21 bp, Homo sapiens
tccccttgcactggtcatcag

SEQ ID NO: 331269 - DNA, 16 bp, Homo sapiens
tccccttggcttcctc

SEQ ID NO: 331270 - DNA, 23 bp, Homo sapiens
tccccttgggatgggcacaggct

SEQ ID NO: 331271 - DNA, 22 bp, Homo sapiens
tccccttgggcggctgagagcc

SEQ ID NO: 331272 - DNA, 18 bp, Homo sapiens
tcccctttggttttacta

SEQ ID NO: 331273 - DNA, 15 bp, Homo sapiens
tccccttttccttca

SEQ ID NO: 331274 - DNA, 17 bp, Homo sapiens
tccccttttgcctggct

SEQ ID NO: 331275 - DNA, 21 bp, Homo sapiens
tccccttttgcctggctgtgg

SEQ ID NO: 331276 - DNA, 15 bp, Homo sapiens
tcccgaatcctgagg

SEQ ID NO: 331277 - DNA, 21 bp, Homo sapiens
tcccgaatggagtccagacct

SEQ ID NO: 331278 - DNA, 19 bp, Homo sapiens
tcccgcagcaccagcctga

SEQ ID NO: 331279 - DNA, 21 bp, Homo sapiens
tcccgcagcaccagcctgagc

SEQ ID NO: 331280 - DNA, 15 bp, Homo sapiens
tcccgccgcctcggg

SEQ ID NO: 331281 - DNA, 18 bp, Homo sapiens
tcccgccgcctcgggccg

SEQ ID NO: 331282 - DNA, 22 bp, Homo sapiens
tcccgccgcctcgggccgcctc

SEQ ID NO: 331283 - DNA, 13 bp, Homo sapiens
tcccgcctcagcc

SEQ ID NO: 331284 - DNA, 17 bp, Homo sapiens
tcccgcctcagcctctc

SEQ ID NO: 331285 - DNA, 14 bp, Homo sapiens
tcccgctcagccct

SEQ ID NO: 331286 - DNA, 15 bp, Homo sapiens
tcccgctcagccctc

SEQ ID NO: 331287 - DNA, 22 bp, Homo sapiens
tcccgctgctgtgctctgggga

SEQ ID NO: 331288 - DNA, 14 bp, Homo sapiens
tcccggagcacagc

SEQ ID NO: 331289 - DNA, 18 bp, Homo sapiens
tcccggagcacagccctg

SEQ ID NO: 331290 - DNA, 22 bp, Homo sapiens
tcccggagcacagccctgggag

SEQ ID NO: 331291 - DNA, 13 bp, Homo sapiens
tcccggagcccca

SEQ ID NO: 331292 - DNA, 19 bp, Homo sapiens
tcccggccccgcgcgtgcc

SEQ ID NO: 331293 - DNA, 13 bp, Homo sapiens
tcccggcctcttc

SEQ ID NO: 331294 - DNA, 15 bp, Homo sapiens
tcccggctgcctgcc

SEQ ID NO: 331295 - DNA, 23 bp, Homo sapiens
tcccggctttgcagggagaccag

SEQ ID NO: 331296 - DNA, 21 bp, Homo sapiens
tcccgggcccgttgaggatga

SEQ ID NO: 331297 - DNA, 13 bp, Homo sapiens
tcccgggccctcc

SEQ ID NO: 331298 - DNA, 14 bp, Homo sapiens
tcccggggcagggc

SEQ ID NO: 331299 - DNA, 16 bp, Homo sapiens
tcccggggcagggcag

SEQ ID NO: 331300 - DNA, 24 bp, Homo sapiens
tcccggggccatggaagctggcag

SEQ ID NO: 331301 - DNA, 22 bp, Homo sapiens
tcccgggttcacgccattctcc

SEQ ID NO: 331302 - DNA, 16 bp, Homo sapiens
tcccggttcaccttgc

SEQ ID NO: 331303 - DNA, 20 bp, Homo sapiens
tcccggttcagacccctgcc

SEQ ID NO: 331304 - DNA, 21 bp, Homo sapiens
tcccggttcagacccctgcct

SEQ ID NO: 331305 - DNA, 15 bp, Homo sapiens
tcccgtccgtccgcc

SEQ ID NO: 331306 - DNA, 18 bp, Homo sapiens
tcccgtccgtccgcccgc

SEQ ID NO: 331307 - DNA, 23 bp, Homo sapiens
tcccgtccgtccgcccgcccacc

SEQ ID NO: 331308 - DNA, 22 bp, Homo sapiens
tcccgtgcaaaacatgctacct

SEQ ID NO: 331309 - DNA, 14 bp, Homo sapiens
tcccgtgcacctac

SEQ ID NO: 331310 - DNA, 21 bp, Homo sapiens
tcccgttttacagataaggaa

SEQ ID NO: 331311 - DNA, 18 bp, Homo sapiens
tccctaaagaaaaaaaat

SEQ ID NO: 331312 - DNA, 18 bp, Homo sapiens
tccctaaagccctcttca

SEQ ID NO: 331313 - DNA, 22 bp, Homo sapiens
tccctaagcatgtgtcccagga

SEQ ID NO: 331314 - DNA, 15 bp, Homo sapiens
tccctaagccaaggg

SEQ ID NO: 331315 - DNA, 15 bp, Homo sapiens
tccctaatcctccaa

SEQ ID NO: 331316 - DNA, 14 bp, Homo sapiens
tccctaattctctt

SEQ ID NO: 331317 - DNA, 18 bp, Homo sapiens
tccctaccactgagccct

SEQ ID NO: 331318 - DNA, 22 bp, Homo sapiens
tccctaccactgagcccttgca

SEQ ID NO: 331319 - DNA, 24 bp, Homo sapiens
tccctaccactgagcccttgcaca

SEQ ID NO: 331320 - DNA, 18 bp, Homo sapiens
tccctacccacagggcct

SEQ ID NO: 331321 - DNA, 17 bp, Homo sapiens
tccctaccctcttctca

SEQ ID NO: 331322 - DNA, 18 bp, Homo sapiens
tccctaccctcttctcag

SEQ ID NO: 331323 - DNA, 21 bp, Homo sapiens
tccctaccgagtctcttctcc

SEQ ID NO: 331324 - DNA, 19 bp, Homo sapiens
tccctaccttgaaagaaga

SEQ ID NO: 331325 - DNA, 15 bp, Homo sapiens
tccctacttcctgtg

SEQ ID NO: 331326 - DNA, 16 bp, Homo sapiens
tccctacttcctgtga

SEQ ID NO: 331327 - DNA, 17 bp, Homo sapiens
tccctacttcctgtgac

SEQ ID NO: 331328 - DNA, 18 bp, Homo sapiens
tccctagaaagccatatt

SEQ ID NO: 331329 - DNA, 23 bp, Homo sapiens
tccctagaaagccatattccagc

SEQ ID NO: 331330 - DNA, 17 bp, Homo sapiens
tccctagagggttcctg

SEQ ID NO: 331331 - DNA, 20 bp, Homo sapiens
tccctagagggttcctgtag

SEQ ID NO: 331332 - DNA, 22 bp, Homo sapiens
tccctagtccccctgttttctg

SEQ ID NO: 331333 - DNA, 14 bp, Homo sapiens
tccctagttaccca

SEQ ID NO: 331334 - DNA, 20 bp, Homo sapiens
tccctatcactgaagctttt

SEQ ID NO: 331335 - DNA, 21 bp, Homo sapiens
tccctatcactgaagcttttt

SEQ ID NO: 331336 - DNA, 22 bp, Homo sapiens
tccctatgtcccagcccctggt

SEQ ID NO: 331337 - DNA, 18 bp, Homo sapiens
tccctcaacaagggagag

SEQ ID NO: 331338 - DNA, 18 bp, Homo sapiens
tccctcagctctctggga

SEQ ID NO: 331339 - DNA, 16 bp, Homo sapiens
tccctcaggcctatgc

SEQ ID NO: 331340 - DNA, 21 bp, Homo sapiens
tccctcagtgtgaagcctgtc

SEQ ID NO: 331341 - DNA, 15 bp, Homo sapiens
tccctccaaggtcct

SEQ ID NO: 331342 - DNA, 15 bp, Homo sapiens
tccctccacacctcc

SEQ ID NO: 331343 - DNA, 20 bp, Homo sapiens
tccctccacacctccacccg

SEQ ID NO: 331344 - DNA, 20 bp, Homo sapiens
tccctccaccccagtccccg

SEQ ID NO: 331345 - DNA, 18 bp, Homo sapiens
tccctccacgttcacccc

SEQ ID NO: 331346 - DNA, 15 bp, Homo sapiens
tccctccactcctcc

SEQ ID NO: 331347 - DNA, 18 bp, Homo sapiens
tccctccactcctcccaa

SEQ ID NO: 331348 - DNA, 15 bp, Homo sapiens
tccctcccattcccc

SEQ ID NO: 331349 - DNA, 14 bp, Homo sapiens
tccctccccacccc

SEQ ID NO: 331350 - DNA, 15 bp, Homo sapiens
tccctccccagtgtt

SEQ ID NO: 331351 - DNA, 16 bp, Homo sapiens
tccctcccctgccatt

SEQ ID NO: 331352 - DNA, 15 bp, Homo sapiens
tccctcccctgccct

SEQ ID NO: 331353 - DNA, 15 bp, Homo sapiens
tccctccctccacac

SEQ ID NO: 331354 - DNA, 16 bp, Homo sapiens
tccctccctcctggct

SEQ ID NO: 331355 - DNA, 19 bp, Homo sapiens
tccctccctcctggctcac

SEQ ID NO: 331356 - DNA, 22 bp, Homo sapiens
tccctccgggcaggggagccag

SEQ ID NO: 331357 - DNA, 12 bp, Homo sapiens
tccctcctccca

SEQ ID NO: 331358 - DNA, 16 bp, Homo sapiens
tccctcctgacaaata

SEQ ID NO: 331359 - DNA, 17 bp, Homo sapiens
tccctcctgatgttttt

SEQ ID NO: 331360 - DNA, 20 bp, Homo sapiens
tccctcctgatgtttttccc

SEQ ID NO: 331361 - DNA, 13 bp, Homo sapiens
tccctcctgcagg

SEQ ID NO: 331362 - DNA, 16 bp, Homo sapiens
tccctcctgcaggctg

SEQ ID NO: 331363 - DNA, 18 bp, Homo sapiens
tccctcctggagcatccc

SEQ ID NO: 331364 - DNA, 14 bp, Homo sapiens
tccctcctggctca

SEQ ID NO: 331365 - DNA, 15 bp, Homo sapiens
tccctcctggctcac

SEQ ID NO: 331366 - DNA, 23 bp, Homo sapiens
tccctcctggctcacagccacca

SEQ ID NO: 331367 - DNA, 17 bp, Homo sapiens
tccctcctgttgccaca

SEQ ID NO: 331368 - DNA, 20 bp, Homo sapiens
tccctcgaacccacactgca

SEQ ID NO: 331369 - DNA, 23 bp, Homo sapiens
tccctcgcatccgcctctgagcc

SEQ ID NO: 331370 - DNA, 14 bp, Homo sapiens
tccctcggaagccg

SEQ ID NO: 331371 - DNA, 15 bp, Homo sapiens
tccctcggtcacctg

SEQ ID NO: 331372 - DNA, 17 bp, Homo sapiens
tccctcggtcagcaccg

SEQ ID NO: 331373 - DNA, 15 bp, Homo sapiens
tccctcgtccacagg

SEQ ID NO: 331374 - DNA, 18 bp, Homo sapiens
tccctcgtccacaggggc

SEQ ID NO: 331375 - DNA, 15 bp, Homo sapiens
tccctctcactcccc

SEQ ID NO: 331376 - DNA, 19 bp, Homo sapiens
tccctctcaggcatgcctg

SEQ ID NO: 331377 - DNA, 20 bp, Homo sapiens
tccctctcaggcatgcctgt

SEQ ID NO: 331378 - DNA, 23 bp, Homo sapiens
tccctctcaggcatgcctgtgtg

SEQ ID NO: 331379 - DNA, 20 bp, Homo sapiens
tccctctcctatgtggcagc

SEQ ID NO: 331380 - DNA, 16 bp, Homo sapiens
tccctctcctgtagcc

SEQ ID NO: 331381 - DNA, 15 bp, Homo sapiens
tccctctcgctcccc

SEQ ID NO: 331382 - DNA, 18 bp, Homo sapiens
tccctctctcttctgctc

SEQ ID NO: 331383 - DNA, 19 bp, Homo sapiens
tccctctctcttctgctcc

SEQ ID NO: 331384 - DNA, 11 bp, Homo sapiens
tccctctctgc

SEQ ID NO: 331385 - DNA, 17 bp, Homo sapiens
tccctctcttccgggag

SEQ ID NO: 331386 - DNA, 22 bp, Homo sapiens
tccctctcttccgggagctggt

SEQ ID NO: 331387 - DNA, 19 bp, Homo sapiens
tccctctgccccaagcagc

SEQ ID NO: 331388 - DNA, 22 bp, Homo sapiens
tccctctgccccaagcagccag

SEQ ID NO: 331389 - DNA, 11 bp, Homo sapiens
tccctctgctc

SEQ ID NO: 331390 - DNA, 13 bp, Homo sapiens
tccctctgctcca

SEQ ID NO: 331391 - DNA, 18 bp, Homo sapiens
tccctctgctcctggagc

SEQ ID NO: 331392 - DNA, 19 bp, Homo sapiens
tccctctggcactccagaa

SEQ ID NO: 331393 - DNA, 17 bp, Homo sapiens
tccctgaaacattgcat

SEQ ID NO: 331394 - DNA, 22 bp, Homo sapiens
tccctgaaactgagtctgtgga

SEQ ID NO: 331395 - DNA, 17 bp, Homo sapiens
aagagtatcaaaggcag

SEQ ID NO: 331396 - DNA, 14 bp, Homo sapiens
aagagtattccatt

SEQ ID NO: 331397 - DNA, 12 bp, Homo sapiens
aagagtcctgag

SEQ ID NO: 331398 - DNA, 22 bp, Homo sapiens
aagagtcgagtgatatggcttg

SEQ ID NO: 331399 - DNA, 17 bp, Homo sapiens
aagagtgggctttccag

SEQ ID NO: 331400 - DNA, 23 bp, Homo sapiens
aagagttttagagaaaataaatt

SEQ ID NO: 331401 - DNA, 21 bp, Homo sapiens
aagataaaaactgcccattgt

SEQ ID NO: 331402 - DNA, 20 bp, Homo sapiens
aagataatgttctttaatgt

SEQ ID NO: 331403 - DNA, 12 bp, Homo sapiens
aagataattata

SEQ ID NO: 331404 - DNA, 14 bp, Homo sapiens
aagataatttgcat

SEQ ID NO: 331405 - DNA, 15 bp, Homo sapiens
aagataatttgcata

SEQ ID NO: 331406 - DNA, 15 bp, Homo sapiens
aagatacactcctgc

SEQ ID NO: 331407 - DNA, 17 bp, Homo sapiens
aagatacacttgtaaat

SEQ ID NO: 331408 - DNA, 15 bp, Homo sapiens
aagatacatcacagt

SEQ ID NO: 331409 - DNA, 17 bp, Homo sapiens
aagataccatcagcaaa

SEQ ID NO: 331410 - DNA, 21 bp, Homo sapiens
aagatacgactttattttctg

SEQ ID NO: 331411 - DNA, 17 bp, Homo sapiens
aagatacttgatgcact

SEQ ID NO: 331412 - DNA, 18 bp, Homo sapiens
aagatagcatcccatctc

SEQ ID NO: 331413 - DNA, 13 bp, Homo sapiens
aagataggctctg

SEQ ID NO: 331414 - DNA, 15 bp, Homo sapiens
aagataggctctgca

SEQ ID NO: 331415 - DNA, 17 bp, Homo sapiens
aagataggtttgagttc

SEQ ID NO: 331416 - DNA, 17 bp, Homo sapiens
aagatatcagagctctt

SEQ ID NO: 331417 - DNA, 18 bp, Homo sapiens
aagatatcagagctctta

SEQ ID NO: 331418 - DNA, 23 bp, Homo sapiens
aagatattatttatcgaaagtaa

SEQ ID NO: 331419 - DNA, 22 bp, Homo sapiens
aagatcaaaagcttattcatct

SEQ ID NO: 331420 - DNA, 22 bp, Homo sapiens
aagatcaaaataaaaagtgaca

SEQ ID NO: 331421 - DNA, 13 bp, Homo sapiens
aagatcacaaata

SEQ ID NO: 331422 - DNA, 18 bp, Homo sapiens
aagatcactttgctctga

SEQ ID NO: 331423 - DNA, 20 bp, Homo sapiens
aagatccaaatgctgtgcaa

SEQ ID NO: 331424 - DNA, 16 bp, Homo sapiens
aagatcgttctctgcc

SEQ ID NO: 331425 - DNA, 21 bp, Homo sapiens
aagatcttgagagctgctgag

SEQ ID NO: 331426 - DNA, 19 bp, Homo sapiens
aagatgaaaccgtccctga

SEQ ID NO: 331427 - DNA, 22 bp, Homo sapiens
aagatgagattggcatggcttt

SEQ ID NO: 331428 - DNA, 18 bp, Homo sapiens
aagatgagctgcagcccc

SEQ ID NO: 331429 - DNA, 17 bp, Homo sapiens
aagatgatctactcaga

SEQ ID NO: 331430 - DNA, 16 bp, Homo sapiens
aagatgccatctgtgt

SEQ ID NO: 331431 - DNA, 14 bp, Homo sapiens
aagatgctggcccc

SEQ ID NO: 331432 - DNA, 15 bp, Homo sapiens
aagatgctggcccca

SEQ ID NO: 331433 - DNA, 18 bp, Homo sapiens
aagatggaaaaaaaaaac

SEQ ID NO: 331434 - DNA, 20 bp, Homo sapiens
aagatggaaaaaaaaaacaa

SEQ ID NO: 331435 - DNA, 22 bp, Homo sapiens
aagatggactctgaaaaacatt

SEQ ID NO: 331436 - DNA, 14 bp, Homo sapiens
aagatggattctca

SEQ ID NO: 331437 - DNA, 17 bp, Homo sapiens
aagatggattctcagat

SEQ ID NO: 331438 - DNA, 22 bp, Homo sapiens
aagatggcccagctccccaaga

SEQ ID NO: 331439 - DNA, 18 bp, Homo sapiens
aagatgggcagctagttc

SEQ ID NO: 331440 - DNA, 22 bp, Homo sapiens
aagatgtattaacctacctgtg

SEQ ID NO: 331441 - DNA, 17 bp, Homo sapiens
aagatgtattcagagcc

SEQ ID NO: 331442 - DNA, 14 bp, Homo sapiens
aagatgtcaaatat

SEQ ID NO: 331443 - DNA, 15 bp, Homo sapiens
aagatgtcaaatatc

SEQ ID NO: 331444 - DNA, 23 bp, Homo sapiens
aagatgtcccccaggggcccagg

SEQ ID NO: 331445 - DNA, 15 bp, Homo sapiens
aagatgtgtcttcaa

SEQ ID NO: 331446 - DNA, 17 bp, Homo sapiens
aagatgtgtcttcaatt

SEQ ID NO: 331447 - DNA, 15 bp, Homo sapiens
aagatgttgttttag

SEQ ID NO: 331448 - DNA, 16 bp, Homo sapiens
aagattaaaattagtg

SEQ ID NO: 331449 - DNA, 21 bp, Homo sapiens
aagattatcctgttactgaat

SEQ ID NO: 331450 - DNA, 22 bp, Homo sapiens
aagattatgtattggcatttat

SEQ ID NO: 331451 - DNA, 18 bp, Homo sapiens
aagattattttttatgag

SEQ ID NO: 331452 - DNA, 20 bp, Homo sapiens
aagattcatatttacttctt

SEQ ID NO: 331453 - DNA, 18 bp, Homo sapiens
aagattctaaaacattct

SEQ ID NO: 331454 - DNA, 21 bp, Homo sapiens
aagattctactcttgtcattt

SEQ ID NO: 331455 - DNA, 19 bp, Homo sapiens
aagattgcaaggaaggaaa

SEQ ID NO: 331456 - DNA, 13 bp, Homo sapiens
aagattgcctctt

SEQ ID NO: 331457 - DNA, 16 bp, Homo sapiens
aagattggaaagacag

SEQ ID NO: 331458 - DNA, 19 bp, Homo sapiens
aagattggaaagacaggaa

SEQ ID NO: 331459 - DNA, 12 bp, Homo sapiens
aagatttaagca

SEQ ID NO: 331460 - DNA, 23 bp, Homo sapiens
aagatttaccttttctgttgtac

SEQ ID NO: 331461 - DNA, 21 bp, Homo sapiens
aagatttagaaaaaagtttac

SEQ ID NO: 331462 - DNA, 23 bp, Homo sapiens
aagatttattttgttaaaatctc

SEQ ID NO: 331463 - DNA, 19 bp, Homo sapiens
aagatttccctaaaaattc

SEQ ID NO: 331464 - DNA, 17 bp, Homo sapiens
aagattttattttcaag

SEQ ID NO: 331465 - DNA, 13 bp, Homo sapiens
aagattttctttc

SEQ ID NO: 331466 - DNA, 15 bp, Homo sapiens
aagattttgaatgct

SEQ ID NO: 331467 - DNA, 20 bp, Homo sapiens
aagatttttgttaagctcag

SEQ ID NO: 331468 - DNA, 15 bp, Homo sapiens
aagcaaaaaataaaa

SEQ ID NO: 331469 - DNA, 17 bp, Homo sapiens
aagcaaaaaataaaata

SEQ ID NO: 331470 - DNA, 22 bp, Homo sapiens
aagcaaaaactagtaaagacat

SEQ ID NO: 331471 - DNA, 13 bp, Homo sapiens
aagcaaaatatta

SEQ ID NO: 331472 - DNA, 14 bp, Homo sapiens
aagcaaaatattat

SEQ ID NO: 331473 - DNA, 23 bp, Homo sapiens
aagcaaacacacagactctgtga

SEQ ID NO: 331474 - DNA, 20 bp, Homo sapiens
aagcaaatatttatgacctc

SEQ ID NO: 331475 - DNA, 21 bp, Homo sapiens
aagcaaatatttatgacctca

SEQ ID NO: 331476 - DNA, 16 bp, Homo sapiens
aagcaaatcagacaca

SEQ ID NO: 331477 - DNA, 17 bp, Homo sapiens
aagcaaatcagacacaa

SEQ ID NO: 331478 - DNA, 16 bp, Homo sapiens
aagcaaccttaaagca

SEQ ID NO: 331479 - DNA, 23 bp, Homo sapiens
aagcaaccttaaagcaataagtt

SEQ ID NO: 331480 - DNA, 18 bp, Homo sapiens
aagcaagacgtcctggaa

SEQ ID NO: 331481 - DNA, 17 bp, Homo sapiens
aagcaagagagatgttt

SEQ ID NO: 331482 - DNA, 16 bp, Homo sapiens
aagcaagctctcttgc

SEQ ID NO: 331483 - DNA, 15 bp, Homo sapiens
aagcaaggccagccc

SEQ ID NO: 331484 - DNA, 20 bp, Homo sapiens
aagcaagggctccagcatcc

SEQ ID NO: 331485 - DNA, 13 bp, Homo sapiens
aagcaagtagctt

SEQ ID NO: 331486 - DNA, 18 bp, Homo sapiens
aagcaatcctcctgagtg

SEQ ID NO: 331487 - DNA, 21 bp, Homo sapiens
aagcaattatttaaagaaagt

SEQ ID NO: 331488 - DNA, 23 bp, Homo sapiens
aagcaattatttaaagaaagtga

SEQ ID NO: 331489 - DNA, 13 bp, Homo sapiens
aagcaattgctgc

SEQ ID NO: 331490 - DNA, 16 bp, Homo sapiens
aagcacaagttcctgg

SEQ ID NO: 331491 - DNA, 13 bp, Homo sapiens
aagcacagctctc

SEQ ID NO: 331492 - DNA, 18 bp, Homo sapiens
aagcacagtgttaaatga

SEQ ID NO: 331493 - DNA, 16 bp, Homo sapiens
aagcacatctgcattt

SEQ ID NO: 331494 - DNA, 16 bp, Homo sapiens
aagcacatgccaggga

SEQ ID NO: 331495 - DNA, 17 bp, Homo sapiens
aagcaccgcagcatgtg

SEQ ID NO: 331496 - DNA, 18 bp, Homo sapiens
aagcaccgcagcatgtgg

SEQ ID NO: 331497 - DNA, 16 bp, Homo sapiens
aagcacctactatgtg

SEQ ID NO: 331498 - DNA, 19 bp, Homo sapiens
aagcacctactatgtgctg

SEQ ID NO: 331499 - DNA, 14 bp, Homo sapiens
aagcacctatgaaa

SEQ ID NO: 331500 - DNA, 18 bp, Homo sapiens
aagcacctatgaaagcaa

SEQ ID NO: 331501 - DNA, 21 bp, Homo sapiens
aagcactattgtttagatatt

SEQ ID NO: 331502 - DNA, 20 bp, Homo sapiens
aagcactcgagaccatcctg

SEQ ID NO: 331503 - DNA, 15 bp, Homo sapiens
aagcactctgctggc

SEQ ID NO: 331504 - DNA, 17 bp, Homo sapiens
aagcactcttaaagcaa

SEQ ID NO: 331505 - DNA, 19 bp, Homo sapiens
aagcacttggactcttgct

SEQ ID NO: 331506 - DNA, 15 bp, Homo sapiens
aagcactttgaaaat

SEQ ID NO: 331507 - DNA, 18 bp, Homo sapiens
aagcactttgaaaatatt

SEQ ID NO: 331508 - DNA, 21 bp, Homo sapiens
aagcactttgaaaatatttct

SEQ ID NO: 331509 - DNA, 22 bp, Homo sapiens
aagcactttgaaaatatttcta

SEQ ID NO: 331510 - DNA, 17 bp, Homo sapiens
aagcagaatcctcagtt

SEQ ID NO: 331511 - DNA, 22 bp, Homo sapiens
aagcagagacctttgttgggag

SEQ ID NO: 331512 - DNA, 13 bp, Homo sapiens
aagcagaggctgg

SEQ ID NO: 331513 - DNA, 19 bp, Homo sapiens
aagcagaggtggaaaatga

SEQ ID NO: 331514 - DNA, 20 bp, Homo sapiens
aagcagatggaatgctgtgt

SEQ ID NO: 331515 - DNA, 13 bp, Homo sapiens
aagcagccagcca

SEQ ID NO: 331516 - DNA, 16 bp, Homo sapiens
aagcagccagccgtga

SEQ ID NO: 331517 - DNA, 18 bp, Homo sapiens
aagcagcctttctgtgga

SEQ ID NO: 331518 - DNA, 16 bp, Homo sapiens
aagcaggagcagctgt

SEQ ID NO: 331519 - DNA, 17 bp, Homo sapiens
aagcagggaatttctat

SEQ ID NO: 331520 - DNA, 21 bp, Homo sapiens
aagcagtagaaataatatgca

SEQ ID NO: 331521 - DNA, 22 bp, Homo sapiens
aagcagtagaaataatatgcat

SEQ ID NO: 331522 - DNA, 18 bp, Homo sapiens
aagcagtctacccacctc

SEQ ID NO: 331523 - DNA, 12 bp, Homo sapiens
aagcagtgcctc

SEQ ID NO: 331524 - DNA, 14 bp, Homo sapiens
aagcagtgcctcga

SEQ ID NO: 331525 - DNA, 20 bp, Homo sapiens
aagcagtgcctcgaggcacc

SEQ ID NO: 331526 - DNA, 15 bp, Homo sapiens
aagcagtgccttcca

SEQ ID NO: 331527 - DNA, 23 bp, Homo sapiens
aagcagtgtcgccgtccctctgc

SEQ ID NO: 331528 - DNA, 14 bp, Homo sapiens
tccctgaccctgca

SEQ ID NO: 331529 - DNA, 16 bp, Homo sapiens
tccctgaccctgcaga

SEQ ID NO: 331530 - DNA, 15 bp, Homo sapiens
tccctgacttgcttt

SEQ ID NO: 331531 - DNA, 16 bp, Homo sapiens
tccctgacttgcttta

SEQ ID NO: 331532 - DNA, 21 bp, Homo sapiens
tccctgagaagcctcatggga

SEQ ID NO: 331533 - DNA, 18 bp, Homo sapiens
tccctgagcagtctactt

SEQ ID NO: 331534 - DNA, 11 bp, Homo sapiens
tccctgagcct

SEQ ID NO: 331535 - DNA, 22 bp, Homo sapiens
tccctgagttgcaccattcttt

SEQ ID NO: 331536 - DNA, 18 bp, Homo sapiens
tccctgatcaagcttcag

SEQ ID NO: 331537 - DNA, 18 bp, Homo sapiens
tccctgcacaagccaggg

SEQ ID NO: 331538 - DNA, 14 bp, Homo sapiens
tccctgcagggtag

SEQ ID NO: 331539 - DNA, 21 bp, Homo sapiens
tccctgcatcccttggcccct

SEQ ID NO: 331540 - DNA, 22 bp, Homo sapiens
tccctgccaccaggcactgcct

SEQ ID NO: 331541 - DNA, 13 bp, Homo sapiens
tccctgccaccgt

SEQ ID NO: 331542 - DNA, 21 bp, Homo sapiens
tccctgccaccgtcacacagt

SEQ ID NO: 331543 - DNA, 12 bp, Homo sapiens
tccctgcccagg

SEQ ID NO: 331544 - DNA, 13 bp, Homo sapiens
tccctgcccaggc

SEQ ID NO: 331545 - DNA, 19 bp, Homo sapiens
tccctgcccaggccggcca

SEQ ID NO: 331546 - DNA, 19 bp, Homo sapiens
tccctgccccgccccccag

SEQ ID NO: 331547 - DNA, 22 bp, Homo sapiens
tccctgccccgccccccagagc

SEQ ID NO: 331548 - DNA, 17 bp, Homo sapiens
tccctgcctaggagctg

SEQ ID NO: 331549 - DNA, 19 bp, Homo sapiens
tccctgcctaggagctggg

SEQ ID NO: 331550 - DNA, 18 bp, Homo sapiens
tccctgcctcacatctcc

SEQ ID NO: 331551 - DNA, 23 bp, Homo sapiens
tccctgcctgctccttggcaccc

SEQ ID NO: 331552 - DNA, 13 bp, Homo sapiens
tccctgctcagct

SEQ ID NO: 331553 - DNA, 20 bp, Homo sapiens
tccctgctcagctggccggg

SEQ ID NO: 331554 - DNA, 15 bp, Homo sapiens
tccctgcttatctga

SEQ ID NO: 331555 - DNA, 15 bp, Homo sapiens
tccctgcttgcccgc

SEQ ID NO: 331556 - DNA, 18 bp, Homo sapiens
tccctggaccagatgctg

SEQ ID NO: 331557 - DNA, 13 bp, Homo sapiens
tccctggactctg

SEQ ID NO: 331558 - DNA, 22 bp, Homo sapiens
tccctggactctgtggggccac

SEQ ID NO: 331559 - DNA, 22 bp, Homo sapiens
tccctggatgtgtggggcatgg

SEQ ID NO: 331560 - DNA, 12 bp, Homo sapiens
tccctggctcag

SEQ ID NO: 331561 - DNA, 17 bp, Homo sapiens
tccctggctcagggatc

SEQ ID NO: 331562 - DNA, 23 bp, Homo sapiens
tccctggctgtgagcagcctcca

SEQ ID NO: 331563 - DNA, 13 bp, Homo sapiens
tccctgggcctgt

SEQ ID NO: 331564 - DNA, 22 bp, Homo sapiens
tccctgggggccttgggtgagt

SEQ ID NO: 331565 - DNA, 15 bp, Homo sapiens
tccctgggggtccca

SEQ ID NO: 331566 - DNA, 21 bp, Homo sapiens
tccctggggtactactctcca

SEQ ID NO: 331567 - DNA, 16 bp, Homo sapiens
tccctggtccagattg

SEQ ID NO: 331568 - DNA, 17 bp, Homo sapiens
tccctggtccctcgtcc

SEQ ID NO: 331569 - DNA, 19 bp, Homo sapiens
tccctggtcccttggagac

SEQ ID NO: 331570 - DNA, 21 bp, Homo sapiens
tccctggttttaccccagctc

SEQ ID NO: 331571 - DNA, 18 bp, Homo sapiens
tccctgtaggagtaaaga

SEQ ID NO: 331572 - DNA, 18 bp, Homo sapiens
tccctgtcactcagctga

SEQ ID NO: 331573 - DNA, 12 bp, Homo sapiens
tccctgtccacc

SEQ ID NO: 331574 - DNA, 14 bp, Homo sapiens
tccctgtccacccc

SEQ ID NO: 331575 - DNA, 18 bp, Homo sapiens
tccctgtccctgccccgc

SEQ ID NO: 331576 - DNA, 16 bp, Homo sapiens
tccctgtctccagggc

SEQ ID NO: 331577 - DNA, 13 bp, Homo sapiens
tccctgtgttctg

SEQ ID NO: 331578 - DNA, 20 bp, Homo sapiens
tccctgtttgcctatagttg

SEQ ID NO: 331579 - DNA, 16 bp, Homo sapiens
tcccttagcctctccc

SEQ ID NO: 331580 - DNA, 19 bp, Homo sapiens
tcccttatttttatttatt

SEQ ID NO: 331581 - DNA, 13 bp, Homo sapiens
tcccttcatctcc

SEQ ID NO: 331582 - DNA, 12 bp, Homo sapiens
tcccttccagtt

SEQ ID NO: 331583 - DNA, 13 bp, Homo sapiens
tcccttcccagtg

SEQ ID NO: 331584 - DNA, 15 bp, Homo sapiens
tcccttcccagtggg

SEQ ID NO: 331585 - DNA, 19 bp, Homo sapiens
tcccttcccagtgggctgt

SEQ ID NO: 331586 - DNA, 17 bp, Homo sapiens
tcccttcccccataagc

SEQ ID NO: 331587 - DNA, 20 bp, Homo sapiens
tcccttcccctccctggctc

SEQ ID NO: 331588 - DNA, 15 bp, Homo sapiens
tcccttcctccgctc

SEQ ID NO: 331589 - DNA, 15 bp, Homo sapiens
tcccttcctgtcctg

SEQ ID NO: 331590 - DNA, 19 bp, Homo sapiens
tcccttcctgtcctgctca

SEQ ID NO: 331591 - DNA, 15 bp, Homo sapiens
tcccttcgtgtgtgc

SEQ ID NO: 331592 - DNA, 21 bp, Homo sapiens
tcccttctaggtgtggtccca

SEQ ID NO: 331593 - DNA, 15 bp, Homo sapiens
tcccttctttcctac

SEQ ID NO: 331594 - DNA, 17 bp, Homo sapiens
tcccttctttttcttct

SEQ ID NO: 331595 - DNA, 15 bp, Homo sapiens
tcccttgcaggggtc

SEQ ID NO: 331596 - DNA, 12 bp, Homo sapiens
tcccttgcctca

SEQ ID NO: 331597 - DNA, 21 bp, Homo sapiens
tcccttgctcagtgcctcctg

SEQ ID NO: 331598 - DNA, 19 bp, Homo sapiens
tcccttggaaacctgccct

SEQ ID NO: 331599 - DNA, 13 bp, Homo sapiens
tcccttggccacg

SEQ ID NO: 331600 - DNA, 23 bp, Homo sapiens
tcccttggccacggcctgggagg

SEQ ID NO: 331601 - DNA, 14 bp, Homo sapiens
tcccttggcctcag

SEQ ID NO: 331602 - DNA, 17 bp, Homo sapiens
tcccttgtgtctgttgc

SEQ ID NO: 331603 - DNA, 18 bp, Homo sapiens
tccctttcactgaagtga

SEQ ID NO: 331604 - DNA, 16 bp, Homo sapiens
tccctttccctacctt

SEQ ID NO: 331605 - DNA, 13 bp, Homo sapiens
tccctttccctgc

SEQ ID NO: 331606 - DNA, 14 bp, Homo sapiens
tccctttccctgca

SEQ ID NO: 331607 - DNA, 15 bp, Homo sapiens
tccctttcccttctt

SEQ ID NO: 331608 - DNA, 13 bp, Homo sapiens
tccctttctggga

SEQ ID NO: 331609 - DNA, 11 bp, Homo sapiens
tccctttgctc

SEQ ID NO: 331610 - DNA, 16 bp, Homo sapiens
tccctttgctccaccc

SEQ ID NO: 331611 - DNA, 21 bp, Homo sapiens
tccctttgttgctgtctggct

SEQ ID NO: 331612 - DNA, 18 bp, Homo sapiens
tcccttttgacacagttg

SEQ ID NO: 331613 - DNA, 20 bp, Homo sapiens
tccctttttatatcccattt

SEQ ID NO: 331614 - DNA, 20 bp, Homo sapiens
tccgaaaaaaaaatgttcat

SEQ ID NO: 331615 - DNA, 21 bp, Homo sapiens
tccgacaaccgatgctccagc

SEQ ID NO: 331616 - DNA, 14 bp, Homo sapiens
tccgagaagctctc

SEQ ID NO: 331617 - DNA, 15 bp, Homo sapiens
tccgagctctgtcct

SEQ ID NO: 331618 - DNA, 16 bp, Homo sapiens
tccgaggctccccgcc

SEQ ID NO: 331619 - DNA, 19 bp, Homo sapiens
tccgagggcggccagggac

SEQ ID NO: 331620 - DNA, 16 bp, Homo sapiens
tccgatgcccgcccgg

SEQ ID NO: 331621 - DNA, 16 bp, Homo sapiens
tccgcaccagctgctc

SEQ ID NO: 331622 - DNA, 18 bp, Homo sapiens
tccgcaccagctgctctg

SEQ ID NO: 331623 - DNA, 20 bp, Homo sapiens
tccgcaccagctgctctgcc

SEQ ID NO: 331624 - DNA, 23 bp, Homo sapiens
tccgcaccagctgctctgcccct

SEQ ID NO: 331625 - DNA, 11 bp, Homo sapiens
tccgcatgtgt

SEQ ID NO: 331626 - DNA, 12 bp, Homo sapiens
tccgcatgtgtc

SEQ ID NO: 331627 - DNA, 13 bp, Homo sapiens
tccgcatgtgtct

SEQ ID NO: 331628 - DNA, 14 bp, Homo sapiens
tccgcatgtgtctg

SEQ ID NO: 331629 - DNA, 16 bp, Homo sapiens
tccgcatgtgtctgta

SEQ ID NO: 331630 - DNA, 17 bp, Homo sapiens
tccgcatgtgtctgtat

SEQ ID NO: 331631 - DNA, 19 bp, Homo sapiens
tccgcatgtgtctgtattc

SEQ ID NO: 331632 - DNA, 12 bp, Homo sapiens
tccgccaggaaa

SEQ ID NO: 331633 - DNA, 14 bp, Homo sapiens
tccgcccgcccacc

SEQ ID NO: 331634 - DNA, 13 bp, Homo sapiens
tccgcctctgagc

SEQ ID NO: 331635 - DNA, 15 bp, Homo sapiens
tccgcctctgagcca

SEQ ID NO: 331636 - DNA, 15 bp, Homo sapiens
tccgcctggcaccca

SEQ ID NO: 331637 - DNA, 18 bp, Homo sapiens
tccgcctggcacccactc

SEQ ID NO: 331638 - DNA, 17 bp, Homo sapiens
tccgcggcggcttcgcg

SEQ ID NO: 331639 - DNA, 12 bp, Homo sapiens
tccgcggggacc

SEQ ID NO: 331640 - DNA, 16 bp, Homo sapiens
tccgcggggaccctgc

SEQ ID NO: 331641 - DNA, 19 bp, Homo sapiens
tccgcggggaccctgccga

SEQ ID NO: 331642 - DNA, 15 bp, Homo sapiens
tccgctatccaccaa

SEQ ID NO: 331643 - DNA, 16 bp, Homo sapiens
tccgctcccctttccc

SEQ ID NO: 331644 - DNA, 15 bp, Homo sapiens
tccgctctctcatgt

SEQ ID NO: 331645 - DNA, 12 bp, Homo sapiens
tccgctgccacc

SEQ ID NO: 331646 - DNA, 14 bp, Homo sapiens
tccgctgtcaccca

SEQ ID NO: 331647 - DNA, 19 bp, Homo sapiens
tccgctgtcacccagcaag

SEQ ID NO: 331648 - DNA, 22 bp, Homo sapiens
tccgctgtcacccagcaaggca

SEQ ID NO: 331649 - DNA, 15 bp, Homo sapiens
tccggaatcctgtcc

SEQ ID NO: 331650 - DNA, 18 bp, Homo sapiens
tccggaatcctgtcctca

SEQ ID NO: 331651 - DNA, 15 bp, Homo sapiens
tccggagtagctggg

SEQ ID NO: 331652 - DNA, 12 bp, Homo sapiens
tccggcagaggc

SEQ ID NO: 331653 - DNA, 16 bp, Homo sapiens
tccggccatactgcct

SEQ ID NO: 331654 - DNA, 18 bp, Homo sapiens
tccggcccccagagcgcc

SEQ ID NO: 331655 - DNA, 12 bp, Homo sapiens
tccggccctgcc

SEQ ID NO: 331656 - DNA, 13 bp, Homo sapiens
tccggccctgccc

SEQ ID NO: 331657 - DNA, 14 bp, Homo sapiens
tccggccctgcccc

SEQ ID NO: 331658 - DNA, 15 bp, Homo sapiens
tccggccctgcccca

SEQ ID NO: 331659 - DNA, 14 bp, Homo sapiens
tccggccctggctg

SEQ ID NO: 331660 - DNA, 16 bp, Homo sapiens
tccggcctgcagccca

SEQ ID NO: 331661 - DNA, 17 bp, Homo sapiens
tccggcctgcagcccag

SEQ ID NO: 331662 - DNA, 18 bp, Homo sapiens
tccggcctgcagcccaga

SEQ ID NO: 331663 - DNA, 12 bp, Homo sapiens
tccgggcagggg

SEQ ID NO: 331664 - DNA, 15 bp, Homo sapiens
aagcatcaaataata

SEQ ID NO: 331665 - DNA, 15 bp, Homo sapiens
aagcatcagcaagac

SEQ ID NO: 331666 - DNA, 12 bp, Homo sapiens
aagcatccatgt

SEQ ID NO: 331667 - DNA, 14 bp, Homo sapiens
aagcatccatgtgt

SEQ ID NO: 331668 - DNA, 21 bp, Homo sapiens
aagcatccatgtgtggactca

SEQ ID NO: 331669 - DNA, 19 bp, Homo sapiens
aagcatgagtggccttaat

SEQ ID NO: 331670 - DNA, 15 bp, Homo sapiens
aagcatgctcagtat

SEQ ID NO: 331671 - DNA, 17 bp, Homo sapiens
aagcatgctttgctgct

SEQ ID NO: 331672 - DNA, 16 bp, Homo sapiens
aagcatggagaacagt

SEQ ID NO: 331673 - DNA, 19 bp, Homo sapiens
aagcatgtctctgcttcca

SEQ ID NO: 331674 - DNA, 12 bp, Homo sapiens
aagcatgtttca

SEQ ID NO: 331675 - DNA, 17 bp, Homo sapiens
aagcattactttgtaga

SEQ ID NO: 331676 - DNA, 14 bp, Homo sapiens
aagcattgtttgct

SEQ ID NO: 331677 - DNA, 20 bp, Homo sapiens
aagcattgtttgcttattgt

SEQ ID NO: 331678 - DNA, 21 bp, Homo sapiens
aagcattgtttgcttattgtt

SEQ ID NO: 331679 - DNA, 15 bp, Homo sapiens
aagcatttatcattc

SEQ ID NO: 331680 - DNA, 22 bp, Homo sapiens
aagcattttactgtctgtaaga

SEQ ID NO: 331681 - DNA, 20 bp, Homo sapiens
aagcattttctttctgtttt

SEQ ID NO: 331682 - DNA, 22 bp, Homo sapiens
aagccaaaaaccttagctccct

SEQ ID NO: 331683 - DNA, 16 bp, Homo sapiens
aagccaagaagtgagg

SEQ ID NO: 331684 - DNA, 13 bp, Homo sapiens
aagccaagacagt

SEQ ID NO: 331685 - DNA, 20 bp, Homo sapiens
aagccaataaataatattat

SEQ ID NO: 331686 - DNA, 21 bp, Homo sapiens
aagccaatatttactcatcag

SEQ ID NO: 331687 - DNA, 21 bp, Homo sapiens
aagccacaaggctggccagca

SEQ ID NO: 331688 - DNA, 21 bp, Homo sapiens
aagccacgtgctggagagtag

SEQ ID NO: 331689 - DNA, 19 bp, Homo sapiens
aagccagggttccagacag

SEQ ID NO: 331690 - DNA, 22 bp, Homo sapiens
aagccagtgactccaggagagg

SEQ ID NO: 331691 - DNA, 16 bp, Homo sapiens
aagccagttttcattt

SEQ ID NO: 331692 - DNA, 22 bp, Homo sapiens
aagccatatgacaatttcaaaa

SEQ ID NO: 331693 - DNA, 22 bp, Homo sapiens
aagccatcaattttaacatttg

SEQ ID NO: 331694 - DNA, 23 bp, Homo sapiens
aagccatcaattttaacatttga

SEQ ID NO: 331695 - DNA, 14 bp, Homo sapiens
aagccatcacttct

SEQ ID NO: 331696 - DNA, 23 bp, Homo sapiens
aagccatcatcagcttaatttaa

SEQ ID NO: 331697 - DNA, 15 bp, Homo sapiens
aagccatcttcccgc

SEQ ID NO: 331698 - DNA, 22 bp, Homo sapiens
aagccatcttcccgcctcagcc

SEQ ID NO: 331699 - DNA, 18 bp, Homo sapiens
aagcccaatattataatt

SEQ ID NO: 331700 - DNA, 22 bp, Homo sapiens
aagcccacctgaaagcctgtct

SEQ ID NO: 331701 - DNA, 12 bp, Homo sapiens
aagcccacctgg

SEQ ID NO: 331702 - DNA, 14 bp, Homo sapiens
aagcccacctgggc

SEQ ID NO: 331703 - DNA, 16 bp, Homo sapiens
aagcccacctgggctg

SEQ ID NO: 331704 - DNA, 12 bp, Homo sapiens
aagcccaggagg

SEQ ID NO: 331705 - DNA, 14 bp, Homo sapiens
aagccccaggcagg

SEQ ID NO: 331706 - DNA, 15 bp, Homo sapiens
aagccccctttgatt

SEQ ID NO: 331707 - DNA, 20 bp, Homo sapiens
aagccccgcatatgtgagtg

SEQ ID NO: 331708 - DNA, 16 bp, Homo sapiens
aagcccctcagccctt

SEQ ID NO: 331709 - DNA, 12 bp, Homo sapiens
aagcccctgtct

SEQ ID NO: 331710 - DNA, 15 bp, Homo sapiens
aagcccgacttgctg

SEQ ID NO: 331711 - DNA, 22 bp, Homo sapiens
aagcccgtcatcttccctttcc

SEQ ID NO: 331712 - DNA, 17 bp, Homo sapiens
aagccctccttgccacc

SEQ ID NO: 331713 - DNA, 18 bp, Homo sapiens
aagccctccttgccaccc

SEQ ID NO: 331714 - DNA, 23 bp, Homo sapiens
aagccctcttcaggggtcacctc

SEQ ID NO: 331715 - DNA, 13 bp, Homo sapiens
aagccctgcaaat

SEQ ID NO: 331716 - DNA, 14 bp, Homo sapiens
aagccgtctgactc

SEQ ID NO: 331717 - DNA, 16 bp, Homo sapiens
aagccgtctgactcca

SEQ ID NO: 331718 - DNA, 14 bp, Homo sapiens
tcctagagtagagt

SEQ ID NO: 331719 - DNA, 16 bp, Homo sapiens
tcctagataaaaagat

SEQ ID NO: 331720 - DNA, 17 bp, Homo sapiens
tcctagataaaaagatg

SEQ ID NO: 331721 - DNA, 21 bp, Homo sapiens
tcctagatggcagtcactgaa

SEQ ID NO: 331722 - DNA, 21 bp, Homo sapiens
tcctagcacaaggagtgcccg

SEQ ID NO: 331723 - DNA, 14 bp, Homo sapiens
tcctagctgacgcc

SEQ ID NO: 331724 - DNA, 21 bp, Homo sapiens
tcctagcttatctccctgctt

SEQ ID NO: 331725 - DNA, 23 bp, Homo sapiens
tcctagcttatctccctgcttca

SEQ ID NO: 331726 - DNA, 19 bp, Homo sapiens
tcctaggacatctctgtaa

SEQ ID NO: 331727 - DNA, 15 bp, Homo sapiens
tcctaggtgacccca

SEQ ID NO: 331728 - DNA, 17 bp, Homo sapiens
tcctagttcttaagcat

SEQ ID NO: 331729 - DNA, 19 bp, Homo sapiens
tcctagttttatgtttctt

SEQ ID NO: 331730 - DNA, 19 bp, Homo sapiens
tcctatccccaggccaggt

SEQ ID NO: 331731 - DNA, 19 bp, Homo sapiens
tcctatccttggagagcag

SEQ ID NO: 331732 - DNA, 19 bp, Homo sapiens
tcctatcgatctggaaaga

SEQ ID NO: 331733 - DNA, 14 bp, Homo sapiens
tcctatctgtgttt

SEQ ID NO: 331734 - DNA, 17 bp, Homo sapiens
tcctatctgtgttttga

SEQ ID NO: 331735 - DNA, 21 bp, Homo sapiens
tcctatgcccaggtaccaccc

SEQ ID NO: 331736 - DNA, 21 bp, Homo sapiens
tcctatgctggggtacacagt

SEQ ID NO: 331737 - DNA, 14 bp, Homo sapiens
tcctatgtggcagc

SEQ ID NO: 331738 - DNA, 17 bp, Homo sapiens
tcctatgtggcagctgg

SEQ ID NO: 331739 - DNA, 19 bp, Homo sapiens
tcctattactgatgtgtgc

SEQ ID NO: 331740 - DNA, 14 bp, Homo sapiens
tcctatttgttttc

SEQ ID NO: 331741 - DNA, 23 bp, Homo sapiens
tcctcaactcacctaatgtttat

SEQ ID NO: 331742 - DNA, 21 bp, Homo sapiens
tcctcacagttgccatgtaga

SEQ ID NO: 331743 - DNA, 16 bp, Homo sapiens
tcctcacatgcccgct

SEQ ID NO: 331744 - DNA, 22 bp, Homo sapiens
tcctcaccctgatttcttgctt

SEQ ID NO: 331745 - DNA, 21 bp, Homo sapiens
tcctcacctaccctcaaagta

SEQ ID NO: 331746 - DNA, 22 bp, Homo sapiens
tcctcacctaccctcaaagtag

SEQ ID NO: 331747 - DNA, 12 bp, Homo sapiens
tcctcacctctg

SEQ ID NO: 331748 - DNA, 22 bp, Homo sapiens
tcctcacctctggactggctag

SEQ ID NO: 331749 - DNA, 22 bp, Homo sapiens
tcctcactgggtggggtgagga

SEQ ID NO: 331750 - DNA, 22 bp, Homo sapiens
tcctcagccccagggccctgct

SEQ ID NO: 331751 - DNA, 17 bp, Homo sapiens
tcctcagggtggggggt

SEQ ID NO: 331752 - DNA, 17 bp, Homo sapiens
tcctcagttggaatcat

SEQ ID NO: 331753 - DNA, 15 bp, Homo sapiens
tcctcatcctttcct

SEQ ID NO: 331754 - DNA, 22 bp, Homo sapiens
tcctcatctctaacagctcagg

SEQ ID NO: 331755 - DNA, 15 bp, Homo sapiens
tcctcatgaatgtaa

SEQ ID NO: 331756 - DNA, 21 bp, Homo sapiens
tcctcatgaatgtaaatttgt

SEQ ID NO: 331757 - DNA, 22 bp, Homo sapiens
tcctcatggctgttatctgtct

SEQ ID NO: 331758 - DNA, 23 bp, Homo sapiens
tcctcatggctgttatctgtctt

SEQ ID NO: 331759 - DNA, 14 bp, Homo sapiens
tcctcattcctgaa

SEQ ID NO: 331760 - DNA, 12 bp, Homo sapiens
tcctccaaaaca

SEQ ID NO: 331761 - DNA, 15 bp, Homo sapiens
tcctccaaaacacaa

SEQ ID NO: 331762 - DNA, 17 bp, Homo sapiens
tcctccaaaacacaagg

SEQ ID NO: 331763 - DNA, 20 bp, Homo sapiens
tcctccaaactcctgcctgt

SEQ ID NO: 331764 - DNA, 16 bp, Homo sapiens
tcctccaaatgctgtc

SEQ ID NO: 331765 - DNA, 17 bp, Homo sapiens
tcctccaaatgctgtcg

SEQ ID NO: 331766 - DNA, 16 bp, Homo sapiens
tcctccaagaagccct

SEQ ID NO: 331767 - DNA, 20 bp, Homo sapiens
tcctccaagaagccctcctt

SEQ ID NO: 331768 - DNA, 22 bp, Homo sapiens
tcctccaagaagccctccttgc

SEQ ID NO: 331769 - DNA, 13 bp, Homo sapiens
tcctccacagtgc

SEQ ID NO: 331770 - DNA, 18 bp, Homo sapiens
tcctccacagtgctgctt

SEQ ID NO: 331771 - DNA, 17 bp, Homo sapiens
tcctccactcactccag

SEQ ID NO: 331772 - DNA, 21 bp, Homo sapiens
tcctccagaagcctctggcta

SEQ ID NO: 331773 - DNA, 17 bp, Homo sapiens
tcctccagaccaccagc

SEQ ID NO: 331774 - DNA, 22 bp, Homo sapiens
tcctccagactcgagagggctg

SEQ ID NO: 331775 - DNA, 14 bp, Homo sapiens
tcctccagcccacc

SEQ ID NO: 331776 - DNA, 16 bp, Homo sapiens
tcctccagcccaccca

SEQ ID NO: 331777 - DNA, 10 bp, Homo sapiens
tcctccagct

SEQ ID NO: 331778 - DNA, 13 bp, Homo sapiens
tcctccagcttct

SEQ ID NO: 331779 - DNA, 14 bp, Homo sapiens
tcctccagcttctg

SEQ ID NO: 331780 - DNA, 21 bp, Homo sapiens
tcctccagggatgatcaacag

SEQ ID NO: 331781 - DNA, 19 bp, Homo sapiens
tcctcccaactctggcctt

SEQ ID NO: 331782 - DNA, 17 bp, Homo sapiens
tcctcccatctccttcc

SEQ ID NO: 331783 - DNA, 14 bp, Homo sapiens
tcctccccaccagt

SEQ ID NO: 331784 - DNA, 14 bp, Homo sapiens
tcctcccccagagc

SEQ ID NO: 331785 - DNA, 20 bp, Homo sapiens
tcctcccctcctcttccctt

SEQ ID NO: 331786 - DNA, 14 bp, Homo sapiens
tcctccccttccct

SEQ ID NO: 331787 - DNA, 15 bp, Homo sapiens
tcctcccgggccctc

SEQ ID NO: 331788 - DNA, 17 bp, Homo sapiens
tcctcccgggccctccc

SEQ ID NO: 331789 - DNA, 14 bp, Homo sapiens
tcctccctgctcag

SEQ ID NO: 331790 - DNA, 15 bp, Homo sapiens
tcctccctgctcagc

SEQ ID NO: 331791 - DNA, 16 bp, Homo sapiens
tcctccctgctcagct

SEQ ID NO: 331792 - DNA, 15 bp, Homo sapiens
tcctccgctcccctt

SEQ ID NO: 331793 - DNA, 17 bp, Homo sapiens
tcctccgctcccctttc

SEQ ID NO: 331794 - DNA, 22 bp, Homo sapiens
tcctccgctcccctttcccatc

SEQ ID NO: 331795 - DNA, 21 bp, Homo sapiens
tcctccgtccacccaggctgc

SEQ ID NO: 331796 - DNA, 18 bp, Homo sapiens
tcctccgtccagccgcca

SEQ ID NO: 331797 - DNA, 18 bp, Homo sapiens
tcctcctccacagtgctg

SEQ ID NO: 331798 - DNA, 14 bp, Homo sapiens
tcctcctcccctcc

SEQ ID NO: 331799 - DNA, 14 bp, Homo sapiens
tcctcctcctcctc

SEQ ID NO: 331800 - DNA, 14 bp, Homo sapiens
tcctcctgaagcct

SEQ ID NO: 331801 - DNA, 14 bp, Homo sapiens
gcaccttcagactt

SEQ ID NO: 331802 - DNA, 17 bp, Homo sapiens
gcaccttgctgcagtgt

SEQ ID NO: 331803 - DNA, 23 bp, Homo sapiens
gcaccttgggcacgggagagcgc

SEQ ID NO: 331804 - DNA, 15 bp, Homo sapiens
gcacgaaatgttatt

SEQ ID NO: 331805 - DNA, 23 bp, Homo sapiens
gcacgaggccttcagaaaagaca

SEQ ID NO: 331806 - DNA, 15 bp, Homo sapiens
gcacgatctcagctc

SEQ ID NO: 331807 - DNA, 12 bp, Homo sapiens
gcacgcacacac

SEQ ID NO: 331808 - DNA, 13 bp, Homo sapiens
gcacgcacacaca

SEQ ID NO: 331809 - DNA, 15 bp, Homo sapiens
gcacgcacacacaca

SEQ ID NO: 331810 - DNA, 16 bp, Homo sapiens
gcacgcacacacacaa

SEQ ID NO: 331811 - DNA, 15 bp, Homo sapiens
gcacgcccatgtgtg

SEQ ID NO: 331812 - DNA, 17 bp, Homo sapiens
gcacgcccatgtgtgag

SEQ ID NO: 331813 - DNA, 16 bp, Homo sapiens
gcacgccgtggagcat

SEQ ID NO: 331814 - DNA, 20 bp, Homo sapiens
gcacgcttgcgtatgtctgt

SEQ ID NO: 331815 - DNA, 21 bp, Homo sapiens
gcacggctccgagggcggcca

SEQ ID NO: 331816 - DNA, 13 bp, Homo sapiens
gcacgggagagcg

SEQ ID NO: 331817 - DNA, 20 bp, Homo sapiens
gcacgggagagcgccacccg

SEQ ID NO: 331818 - DNA, 22 bp, Homo sapiens
gcacgggagagcgccacccgcc

SEQ ID NO: 331819 - DNA, 17 bp, Homo sapiens
gcacgggcaaagaaaac

SEQ ID NO: 331820 - DNA, 18 bp, Homo sapiens
gcacgggcaaagaaaaca

SEQ ID NO: 331821 - DNA, 20 bp, Homo sapiens
gcacgtagtagggtcaggcc

SEQ ID NO: 331822 - DNA, 21 bp, Homo sapiens
gcacgtagtagggtcaggcca

SEQ ID NO: 331823 - DNA, 16 bp, Homo sapiens
gcacgtcgccatccgt

SEQ ID NO: 331824 - DNA, 18 bp, Homo sapiens
gcacgtggagagctggtg

SEQ ID NO: 331825 - DNA, 20 bp, Homo sapiens
gcacgtggagagctggtgcc

SEQ ID NO: 331826 - DNA, 20 bp, Homo sapiens
gcacgtggagatagtgccag

SEQ ID NO: 331827 - DNA, 14 bp, Homo sapiens
gcacgtggcctctt

SEQ ID NO: 331828 - DNA, 17 bp, Homo sapiens
gcacgtggcctcttgag

SEQ ID NO: 331829 - DNA, 22 bp, Homo sapiens
gcacgttaaaaattaaaagaag

SEQ ID NO: 331830 - DNA, 22 bp, Homo sapiens
gcactaaaaagtggctaattca

SEQ ID NO: 331831 - DNA, 15 bp, Homo sapiens
gcactaaaagtgatg

SEQ ID NO: 331832 - DNA, 19 bp, Homo sapiens
gcactaaagtatgtaaagt

SEQ ID NO: 331833 - DNA, 22 bp, Homo sapiens
gcactaaagtatgtaaagtatg

SEQ ID NO: 331834 - DNA, 14 bp, Homo sapiens
gcactacataaact

SEQ ID NO: 331835 - DNA, 15 bp, Homo sapiens
gcactacataaactg

SEQ ID NO: 331836 - DNA, 14 bp, Homo sapiens
gcactaccgggggc

SEQ ID NO: 331837 - DNA, 19 bp, Homo sapiens
gcactactcctctgcagtg

SEQ ID NO: 331838 - DNA, 18 bp, Homo sapiens
gcactactgacatgtggg

SEQ ID NO: 331839 - DNA, 20 bp, Homo sapiens
gcactagcattttcttgaac

SEQ ID NO: 331840 - DNA, 23 bp, Homo sapiens
gcactagccaacccaactgactt

SEQ ID NO: 331841 - DNA, 21 bp, Homo sapiens
gcactaggggatataggagag

SEQ ID NO: 331842 - DNA, 16 bp, Homo sapiens
gcactatagccatttg

SEQ ID NO: 331843 - DNA, 20 bp, Homo sapiens
gcactatagccatttgcccc

SEQ ID NO: 331844 - DNA, 14 bp, Homo sapiens
gcactcacatgctg

SEQ ID NO: 331845 - DNA, 13 bp, Homo sapiens
gcactccatggcc

SEQ ID NO: 331846 - DNA, 14 bp, Homo sapiens
gcactccatggcca

SEQ ID NO: 331847 - DNA, 16 bp, Homo sapiens
gcactccatggccacc

SEQ ID NO: 331848 - DNA, 17 bp, Homo sapiens
tcctctcggctggaaga

SEQ ID NO: 331849 - DNA, 14 bp, Homo sapiens
tcctctctccctgc

SEQ ID NO: 331850 - DNA, 15 bp, Homo sapiens
tcctctctccctgcc

SEQ ID NO: 331851 - DNA, 22 bp, Homo sapiens
tcctctctccctgcctcacatc

SEQ ID NO: 331852 - DNA, 21 bp, Homo sapiens
tcctctctctcacctacttcc

SEQ ID NO: 331853 - DNA, 22 bp, Homo sapiens
tcctctctctctctctctctgt

SEQ ID NO: 331854 - DNA, 13 bp, Homo sapiens
tcctctctgctgg

SEQ ID NO: 331855 - DNA, 15 bp, Homo sapiens
tcctctctgctgggt

SEQ ID NO: 331856 - DNA, 13 bp, Homo sapiens
tcctctctggact

SEQ ID NO: 331857 - DNA, 18 bp, Homo sapiens
tcctctgcagtgccttgg

SEQ ID NO: 331858 - DNA, 15 bp, Homo sapiens
tcctctgccccctcc

SEQ ID NO: 331859 - DNA, 12 bp, Homo sapiens
tcctctgccttg

SEQ ID NO: 331860 - DNA, 13 bp, Homo sapiens
tcctctgccttgg

SEQ ID NO: 331861 - DNA, 17 bp, Homo sapiens
tcctctgccttggacac

SEQ ID NO: 331862 - DNA, 17 bp, Homo sapiens
tcctctggggctctagg

SEQ ID NO: 331863 - DNA, 12 bp, Homo sapiens
tcctctgtcagt

SEQ ID NO: 331864 - DNA, 17 bp, Homo sapiens
tcctctgtccaggcact

SEQ ID NO: 331865 - DNA, 16 bp, Homo sapiens
tcctctgtccccgagc

SEQ ID NO: 331866 - DNA, 18 bp, Homo sapiens
tcctcttaagacactagt

SEQ ID NO: 331867 - DNA, 20 bp, Homo sapiens
tcctcttaccgtagcctccg

SEQ ID NO: 331868 - DNA, 13 bp, Homo sapiens
tcctcttacctgt

SEQ ID NO: 331869 - DNA, 11 bp, Homo sapiens
tcctcttccct

SEQ ID NO: 331870 - DNA, 23 bp, Homo sapiens
tcctcttcctgtagtgcccctcc

SEQ ID NO: 331871 - DNA, 16 bp, Homo sapiens
tcctcttccttctcta

SEQ ID NO: 331872 - DNA, 19 bp, Homo sapiens
tcctcttccttctctactc

SEQ ID NO: 331873 - DNA, 19 bp, Homo sapiens
tcctcttgccactgcctct

SEQ ID NO: 331874 - DNA, 13 bp, Homo sapiens
tcctcttgctcaa

SEQ ID NO: 331875 - DNA, 14 bp, Homo sapiens
tcctcttggagctg

SEQ ID NO: 331876 - DNA, 11 bp, Homo sapiens
tcctctttgtt

SEQ ID NO: 331877 - DNA, 21 bp, Homo sapiens
tcctcttttatcttggactga

SEQ ID NO: 331878 - DNA, 15 bp, Homo sapiens
tcctgaaataaaact

SEQ ID NO: 331879 - DNA, 17 bp, Homo sapiens
tcctgaagcctctgccc

SEQ ID NO: 331880 - DNA, 19 bp, Homo sapiens
tcctgaagcctctgccctg

SEQ ID NO: 331881 - DNA, 19 bp, Homo sapiens
tcctgaatgaaatatcaga

SEQ ID NO: 331882 - DNA, 20 bp, Homo sapiens
tcctgacagcgacagaaaac

SEQ ID NO: 331883 - DNA, 15 bp, Homo sapiens
tcctgacccagtccc

SEQ ID NO: 331884 - DNA, 17 bp, Homo sapiens
tcctgacctcctggact

SEQ ID NO: 331885 - DNA, 13 bp, Homo sapiens
tcctgacgccctg

SEQ ID NO: 331886 - DNA, 14 bp, Homo sapiens
tcctgacgccctgc

SEQ ID NO: 331887 - DNA, 22 bp, Homo sapiens
tcctgacggcgcccccagtgtg

SEQ ID NO: 331888 - DNA, 19 bp, Homo sapiens
tcctgactcaacatgttac

SEQ ID NO: 331889 - DNA, 23 bp, Homo sapiens
tcctgagaaacgtccatctctct

SEQ ID NO: 331890 - DNA, 18 bp, Homo sapiens
tcctgagaaagcccacct

SEQ ID NO: 331891 - DNA, 19 bp, Homo sapiens
tcctgagaaagcccacctg

SEQ ID NO: 331892 - DNA, 22 bp, Homo sapiens
tcctgagaaagcccacctgggc

SEQ ID NO: 331893 - DNA, 18 bp, Homo sapiens
tcctgagaaggcgaggag

SEQ ID NO: 331894 - DNA, 14 bp, Homo sapiens
tcctgagattctgg

SEQ ID NO: 331895 - DNA, 15 bp, Homo sapiens
tcctgagattctggg

SEQ ID NO: 331896 - DNA, 16 bp, Homo sapiens
tcctgagattctggga

SEQ ID NO: 331897 - DNA, 18 bp, Homo sapiens
tcctgagattctgggaaa

SEQ ID NO: 331898 - DNA, 19 bp, Homo sapiens
tcctgagattctgggaaag

SEQ ID NO: 331899 - DNA, 17 bp, Homo sapiens
tcctgagcctgtctctc

SEQ ID NO: 331900 - DNA, 15 bp, Homo sapiens
tcctgagcctgtggg

SEQ ID NO: 331901 - DNA, 19 bp, Homo sapiens
tcctgagcctgtgggtccc

SEQ ID NO: 331902 - DNA, 12 bp, Homo sapiens
tcctgagcttgg

SEQ ID NO: 331903 - DNA, 14 bp, Homo sapiens
tcctgaggaataaa

SEQ ID NO: 331904 - DNA, 16 bp, Homo sapiens
tcctgaggcagaacct

SEQ ID NO: 331905 - DNA, 18 bp, Homo sapiens
tcctgaggcagaacctgg

SEQ ID NO: 331906 - DNA, 19 bp, Homo sapiens
tcctgaggcagaacctggt

SEQ ID NO: 331907 - DNA, 20 bp, Homo sapiens
tcctgaggggcatctgcccc

SEQ ID NO: 331908 - DNA, 22 bp, Homo sapiens
tcctgaggggcatctgcccctc

SEQ ID NO: 331909 - DNA, 19 bp, Homo sapiens
tcctgagtagctggattac

SEQ ID NO: 331910 - DNA, 15 bp, Homo sapiens
tcctgagtggtgcca

SEQ ID NO: 331911 - DNA, 19 bp, Homo sapiens
tcctgataaacattaaaca

SEQ ID NO: 331912 - DNA, 19 bp, Homo sapiens
tcctgataataattgatca

SEQ ID NO: 331913 - DNA, 19 bp, Homo sapiens
tcctgatactgggtacaag

SEQ ID NO: 331914 - DNA, 21 bp, Homo sapiens
tcctgatggaattgttatact

SEQ ID NO: 331915 - DNA, 13 bp, Homo sapiens
tcctgatggccaa

SEQ ID NO: 331916 - DNA, 16 bp, Homo sapiens
tcctgatggccaagag

SEQ ID NO: 331917 - DNA, 18 bp, Homo sapiens
tcctgatggtacaggaaa

SEQ ID NO: 331918 - DNA, 17 bp, Homo sapiens
tcctgatggtcagctcc

SEQ ID NO: 331919 - DNA, 19 bp, Homo sapiens
tcctgatggtcagctccct

SEQ ID NO: 331920 - DNA, 22 bp, Homo sapiens
tcctgatgtgccagaacttcga

SEQ ID NO: 331921 - DNA, 15 bp, Homo sapiens
tcctgattaaaacag

SEQ ID NO: 331922 - DNA, 14 bp, Homo sapiens
tcctgattattgaa

SEQ ID NO: 331923 - DNA, 20 bp, Homo sapiens
tcctgattatttatcacata

SEQ ID NO: 331924 - DNA, 14 bp, Homo sapiens
tcctgattgctctg

SEQ ID NO: 331925 - DNA, 13 bp, Homo sapiens
tcctgattttgta

SEQ ID NO: 331926 - DNA, 17 bp, Homo sapiens
tcctgcaactcaaggac

SEQ ID NO: 331927 - DNA, 14 bp, Homo sapiens
tcctgcaagagtgg

SEQ ID NO: 331928 - DNA, 23 bp, Homo sapiens
tcctgcaagagtgggctttccag

SEQ ID NO: 331929 - DNA, 20 bp, Homo sapiens
tcctgcaatctccagggctg

SEQ ID NO: 331930 - DNA, 14 bp, Homo sapiens
tcctgcaccccagc

SEQ ID NO: 331931 - DNA, 12 bp, Homo sapiens
tcctgcaccctc

SEQ ID NO: 331932 - DNA, 15 bp, Homo sapiens
tcctgcaccctctgc

SEQ ID NO: 331933 - DNA, 16 bp, Homo sapiens
tcctgcagagctgggg

SEQ ID NO: 331934 - DNA, 19 bp, Homo sapiens
tcctgcagaggcccagcca

SEQ ID NO: 331935 - DNA, 20 bp, Homo sapiens
tcctgcaggaacgagcactg

SEQ ID NO: 331936 - DNA, 20 bp, Homo sapiens
tcctgcaggctggctgttgg

SEQ ID NO: 331937 - DNA, 15 bp, Homo sapiens
tcctgcatccctcca

SEQ ID NO: 331938 - DNA, 21 bp, Homo sapiens
tcctgcatccctccaccccag

SEQ ID NO: 331939 - DNA, 17 bp, Homo sapiens
gcagagctcagcacagc

SEQ ID NO: 331940 - DNA, 20 bp, Homo sapiens
gcagagctgagtcggctggg

SEQ ID NO: 331941 - DNA, 22 bp, Homo sapiens
gcagagctgagtcggctgggca

SEQ ID NO: 331942 - DNA, 11 bp, Homo sapiens
gcagagctggg

SEQ ID NO: 331943 - DNA, 19 bp, Homo sapiens
gcagagctggggggaaggc

SEQ ID NO: 331944 - DNA, 11 bp, Homo sapiens
gcagaggacag

SEQ ID NO: 331945 - DNA, 15 bp, Homo sapiens
gcagaggaggagaaa

SEQ ID NO: 331946 - DNA, 11 bp, Homo sapiens
gcagaggcagg

SEQ ID NO: 331947 - DNA, 12 bp, Homo sapiens
gcagaggcaggg

SEQ ID NO: 331948 - DNA, 14 bp, Homo sapiens
gcagaggcagggcc

SEQ ID NO: 331949 - DNA, 20 bp, Homo sapiens
gcagaggcagggccctgggg

SEQ ID NO: 331950 - DNA, 17 bp, Homo sapiens
gcagaggctggcctcag

SEQ ID NO: 331951 - DNA, 17 bp, Homo sapiens
gcagagggaatgttccc

SEQ ID NO: 331952 - DNA, 21 bp, Homo sapiens
gcagagggaatgttccctgca

SEQ ID NO: 331953 - DNA, 18 bp, Homo sapiens
gcagaggggagaggaagc

SEQ ID NO: 331954 - DNA, 16 bp, Homo sapiens
gcagaggggcagccgc

SEQ ID NO: 331955 - DNA, 19 bp, Homo sapiens
gcagaggtggaaaatgatc

SEQ ID NO: 331956 - DNA, 17 bp, Homo sapiens
gcagagtaattcaggca

SEQ ID NO: 331957 - DNA, 12 bp, Homo sapiens
gcagagtctggg

SEQ ID NO: 331958 - DNA, 14 bp, Homo sapiens
gcagagtctgggcc

SEQ ID NO: 331959 - DNA, 16 bp, Homo sapiens
gcagagtctgggcctc

SEQ ID NO: 331960 - DNA, 21 bp, Homo sapiens
gcagagtgccccacctgccac

SEQ ID NO: 331961 - DNA, 15 bp, Homo sapiens
gcagagttctttgca

SEQ ID NO: 331962 - DNA, 14 bp, Homo sapiens
gcagatctagccag

SEQ ID NO: 331963 - DNA, 22 bp, Homo sapiens
gcagatctagccaggcctcccg

SEQ ID NO: 331964 - DNA, 20 bp, Homo sapiens
gcagatctgtgccccatgcc

SEQ ID NO: 331965 - DNA, 14 bp, Homo sapiens
gcagatgatccatg

SEQ ID NO: 331966 - DNA, 13 bp, Homo sapiens
gcagatgccaaaa

SEQ ID NO: 331967 - DNA, 15 bp, Homo sapiens
gcagatggaaagaaa

SEQ ID NO: 331968 - DNA, 22 bp, Homo sapiens
gcagatggcggtgatcagcaga

SEQ ID NO: 331969 - DNA, 13 bp, Homo sapiens
gcagattcctggg

SEQ ID NO: 331970 - DNA, 14 bp, Homo sapiens
gcagattcctgggc

SEQ ID NO: 331971 - DNA, 18 bp, Homo sapiens
gcagattcctgggcctgt

SEQ ID NO: 331972 - DNA, 20 bp, Homo sapiens
gcagattgtgtaacaatttt

SEQ ID NO: 331973 - DNA, 16 bp, Homo sapiens
gcagcaacacccaagt

SEQ ID NO: 331974 - DNA, 15 bp, Homo sapiens
gcagcaacaggacca

SEQ ID NO: 331975 - DNA, 20 bp, Homo sapiens
gcagcaacaggaccaggagc

SEQ ID NO: 331976 - DNA, 23 bp, Homo sapiens
gcagcaatatattaccagcaaga

SEQ ID NO: 331977 - DNA, 14 bp, Homo sapiens
gcagcaccagcctg

SEQ ID NO: 331978 - DNA, 17 bp, Homo sapiens
gcagcacccacagcacc

SEQ ID NO: 331979 - DNA, 13 bp, Homo sapiens
tcctggagccagc

SEQ ID NO: 331980 - DNA, 22 bp, Homo sapiens
tcctggagccccagaaccccaa

SEQ ID NO: 331981 - DNA, 14 bp, Homo sapiens
tcctggataaaaaa

SEQ ID NO: 331982 - DNA, 15 bp, Homo sapiens
tcctggataaaaaag

SEQ ID NO: 331983 - DNA, 15 bp, Homo sapiens
tcctggcaagtgacc

SEQ ID NO: 331984 - DNA, 20 bp, Homo sapiens
tcctggcaatagtgtgttct

SEQ ID NO: 331985 - DNA, 16 bp, Homo sapiens
tcctggcatgacactc

SEQ ID NO: 331986 - DNA, 23 bp, Homo sapiens
tcctggccccgggctctggccac

SEQ ID NO: 331987 - DNA, 13 bp, Homo sapiens
tcctggccctctg

SEQ ID NO: 331988 - DNA, 23 bp, Homo sapiens
tcctggcctcaagccatcttccc

SEQ ID NO: 331989 - DNA, 19 bp, Homo sapiens
tcctggcctcactggctgg

SEQ ID NO: 331990 - DNA, 21 bp, Homo sapiens
tcctggcctcagccagctgcc

SEQ ID NO: 331991 - DNA, 14 bp, Homo sapiens
tcctggccttctga

SEQ ID NO: 331992 - DNA, 15 bp, Homo sapiens
tcctggccttctgaa

SEQ ID NO: 331993 - DNA, 13 bp, Homo sapiens
tcctggctcctga

SEQ ID NO: 331994 - DNA, 13 bp, Homo sapiens
tcctggctgccag

SEQ ID NO: 331995 - DNA, 15 bp, Homo sapiens
tcctggctttgccca

SEQ ID NO: 331996 - DNA, 17 bp, Homo sapiens
tcctggctttgcccaac

SEQ ID NO: 331997 - DNA, 20 bp, Homo sapiens
tcctgggagtgggagtcaag

SEQ ID NO: 331998 - DNA, 16 bp, Homo sapiens
tcctgggcatccccag

SEQ ID NO: 331999 - DNA, 20 bp, Homo sapiens
tcctgggcatccccagcccc

SEQ ID NO: 332000 - DNA, 20 bp, Homo sapiens
tcctgggcatgtttgtctgt

SEQ ID NO: 332001 - DNA, 12 bp, Homo sapiens
tcctgggccagg

SEQ ID NO: 332002 - DNA, 15 bp, Homo sapiens
tcctgggcccaggca

SEQ ID NO: 332003 - DNA, 15 bp, Homo sapiens
tcctgggcccctccc

SEQ ID NO: 332004 - DNA, 21 bp, Homo sapiens
tcctgggcccctccctacctc

SEQ ID NO: 332005 - DNA, 18 bp, Homo sapiens
tcctgggccttctcagct

SEQ ID NO: 332006 - DNA, 18 bp, Homo sapiens
tcctgggcgccctggaag

SEQ ID NO: 332007 - DNA, 19 bp, Homo sapiens
tcctgggcgccctggaagc

SEQ ID NO: 332008 - DNA, 12 bp, Homo sapiens
tcctgggctcag

SEQ ID NO: 332009 - DNA, 17 bp, Homo sapiens
tcctggggaggctgaga

SEQ ID NO: 332010 - DNA, 21 bp, Homo sapiens
tcctggggaggctgagactgc

SEQ ID NO: 332011 - DNA, 15 bp, Homo sapiens
tcctggggcctcttg

SEQ ID NO: 332012 - DNA, 17 bp, Homo sapiens
tcctggggtgccctcca

SEQ ID NO: 332013 - DNA, 19 bp, Homo sapiens
tcctggggtgccctccact

SEQ ID NO: 332014 - DNA, 22 bp, Homo sapiens
tcctggggtggttggaggcctg

SEQ ID NO: 332015 - DNA, 17 bp, Homo sapiens
tcctggtacagcagggt

SEQ ID NO: 332016 - DNA, 23 bp, Homo sapiens
tcctggtacagcagggtcttgct

SEQ ID NO: 332017 - DNA, 18 bp, Homo sapiens
tcctggtcaaagctcctt

SEQ ID NO: 332018 - DNA, 18 bp, Homo sapiens
tcctggtgaggcccagcc

SEQ ID NO: 332019 - DNA, 19 bp, Homo sapiens
tcctggtgaggcccagcct

SEQ ID NO: 332020 - DNA, 24 bp, Homo sapiens
tcctggtgaggcccagcctgtcct

SEQ ID NO: 332021 - DNA, 15 bp, Homo sapiens
tcctggtgtctagtt

SEQ ID NO: 332022 - DNA, 20 bp, Homo sapiens
tcctggtttgaatcctggct

SEQ ID NO: 332023 - DNA, 20 bp, Homo sapiens
tcctgtaaacactcagctgt

SEQ ID NO: 332024 - DNA, 16 bp, Homo sapiens
tcctgtaatcacaact

SEQ ID NO: 332025 - DNA, 16 bp, Homo sapiens
tcctgtaattttgtag

SEQ ID NO: 332026 - DNA, 19 bp, Homo sapiens
tcctgtaattttgtagtag

SEQ ID NO: 332027 - DNA, 16 bp, Homo sapiens
tcctgtacactgaata

SEQ ID NO: 332028 - DNA, 21 bp, Homo sapiens
tcctgtagaggttttgttgtt

SEQ ID NO: 332029 - DNA, 22 bp, Homo sapiens
tcctgtataatctctctcctgt

SEQ ID NO: 332030 - DNA, 14 bp, Homo sapiens
tcctgtcaatgttt

SEQ ID NO: 332031 - DNA, 18 bp, Homo sapiens
tcctgtcaatgtttgctt

SEQ ID NO: 332032 - DNA, 19 bp, Homo sapiens
tcctgtcaatgtttgcttt

SEQ ID NO: 332033 - DNA, 22 bp, Homo sapiens
tcctgtcccctccttccagcct

SEQ ID NO: 332034 - DNA, 18 bp, Homo sapiens
tcctgtcccgccttcctc

SEQ ID NO: 332035 - DNA, 15 bp, Homo sapiens
tcctgtccgccctct

SEQ ID NO: 332036 - DNA, 16 bp, Homo sapiens
tcctgtcctcagcttc

SEQ ID NO: 332037 - DNA, 22 bp, Homo sapiens
tcctgtccttctctcacctcct

SEQ ID NO: 332038 - DNA, 21 bp, Homo sapiens
tcctgtctccaagaatgtttt

SEQ ID NO: 332039 - DNA, 17 bp, Homo sapiens
tcctgtctcccctctgc

SEQ ID NO: 332040 - DNA, 16 bp, Homo sapiens
tcctgtctcctctgtc

SEQ ID NO: 332041 - DNA, 13 bp, Homo sapiens
tcctgtctgttca

SEQ ID NO: 332042 - DNA, 19 bp, Homo sapiens
tcctgtcttctttctcctg

SEQ ID NO: 332043 - DNA, 11 bp, Homo sapiens
tcctgtgactg

SEQ ID NO: 332044 - DNA, 18 bp, Homo sapiens
tcctgtgacttcagctct

SEQ ID NO: 332045 - DNA, 14 bp, Homo sapiens
tcctgtgagctccc

SEQ ID NO: 332046 - DNA, 16 bp, Homo sapiens
tcctgtgcatgggtga

SEQ ID NO: 332047 - DNA, 22 bp, Homo sapiens
tcctgtgccaggactctctttc

SEQ ID NO: 332048 - DNA, 18 bp, Homo sapiens
tcctgtgcccatcatctc

SEQ ID NO: 332049 - DNA, 19 bp, Homo sapiens
tcctgtgcccatcatctct

SEQ ID NO: 332050 - DNA, 21 bp, Homo sapiens
tcctgtgcccatcatctctgc

SEQ ID NO: 332051 - DNA, 14 bp, Homo sapiens
tcctgtgctacaga

SEQ ID NO: 332052 - DNA, 16 bp, Homo sapiens
tcctgtgctttctgca

SEQ ID NO: 332053 - DNA, 23 bp, Homo sapiens
tcctgtgtaatcatttcttgggc

SEQ ID NO: 332054 - DNA, 19 bp, Homo sapiens
tcctgtgtcatctgtcagc

SEQ ID NO: 332055 - DNA, 15 bp, Homo sapiens
tcctgtgtcccctga

SEQ ID NO: 332056 - DNA, 22 bp, Homo sapiens
tcctgtgtcccctgacctgtcc

SEQ ID NO: 332057 - DNA, 22 bp, Homo sapiens
tcctgtgtctggtccacacacc

SEQ ID NO: 332058 - DNA, 15 bp, Homo sapiens
tcctgtgtgcagtga

SEQ ID NO: 332059 - DNA, 21 bp, Homo sapiens
tcctgtgtggagagggaatgt

SEQ ID NO: 332060 - DNA, 18 bp, Homo sapiens
tcctgttaacactgtaat

SEQ ID NO: 332061 - DNA, 13 bp, Homo sapiens
tcctgttactgaa

SEQ ID NO: 332062 - DNA, 17 bp, Homo sapiens
tcctgttctcagcatcc

SEQ ID NO: 332063 - DNA, 18 bp, Homo sapiens
tcctgttctcagcatcca

SEQ ID NO: 332064 - DNA, 16 bp, Homo sapiens
tcctgttctctttgcc

SEQ ID NO: 332065 - DNA, 17 bp, Homo sapiens
tcctgttggctgctgcc

SEQ ID NO: 332066 - DNA, 20 bp, Homo sapiens
tcctgttgttatggaaactg

SEQ ID NO: 332067 - DNA, 16 bp, Homo sapiens
tcctgtttaactccct

SEQ ID NO: 332068 - DNA, 21 bp, Homo sapiens
tcctgtttcccttcccttcca

SEQ ID NO: 332069 - DNA, 11 bp, Homo sapiens
tcctgtttcta

SEQ ID NO: 332070 - DNA, 13 bp, Homo sapiens
tccttaagaacac

SEQ ID NO: 332071 - DNA, 14 bp, Homo sapiens
tccttacctcttcc

SEQ ID NO: 332072 - DNA, 17 bp, Homo sapiens
tccttacctcttccgga

SEQ ID NO: 332073 - DNA, 14 bp, Homo sapiens
tccttactctgagc

SEQ ID NO: 332074 - DNA, 22 bp, Homo sapiens
tccttactctgagcccaggccg

SEQ ID NO: 332075 - DNA, 13 bp, Homo sapiens
tccttagaaaaga

SEQ ID NO: 332076 - DNA, 20 bp, Homo sapiens
tccttagaatactgtattgt

SEQ ID NO: 332077 - DNA, 18 bp, Homo sapiens
gcagctcaggcgcagccc

SEQ ID NO: 332078 - DNA, 19 bp, Homo sapiens
gcagctcaggcgcagccct

SEQ ID NO: 332079 - DNA, 21 bp, Homo sapiens
gcagctcaggcgcagccctag

SEQ ID NO: 332080 - DNA, 23 bp, Homo sapiens
gcagctcatagagtcccccctcc

SEQ ID NO: 332081 - DNA, 15 bp, Homo sapiens
gcagctcccaggttt

SEQ ID NO: 332082 - DNA, 18 bp, Homo sapiens
gcagctccccaggagctc

SEQ ID NO: 332083 - DNA, 20 bp, Homo sapiens
gcagctccccaggagctcag

SEQ ID NO: 332084 - DNA, 17 bp, Homo sapiens
gcagctccgcctggcac

SEQ ID NO: 332085 - DNA, 13 bp, Homo sapiens
gcagctcctctcc

SEQ ID NO: 332086 - DNA, 14 bp, Homo sapiens
gcagctctgagaca

SEQ ID NO: 332087 - DNA, 14 bp, Homo sapiens
gcagctgacctctg

SEQ ID NO: 332088 - DNA, 15 bp, Homo sapiens
gcagctgaggcccca

SEQ ID NO: 332089 - DNA, 14 bp, Homo sapiens
gcagctgattttaa

SEQ ID NO: 332090 - DNA, 14 bp, Homo sapiens
gcagctgccagaga

SEQ ID NO: 332091 - DNA, 20 bp, Homo sapiens
gcagctgcgggtctgaagga

SEQ ID NO: 332092 - DNA, 18 bp, Homo sapiens
gcagctgctcttagtgcc

SEQ ID NO: 332093 - DNA, 18 bp, Homo sapiens
gcagctggcaggagagag

SEQ ID NO: 332094 - DNA, 13 bp, Homo sapiens
gcagctggctctc

SEQ ID NO: 332095 - DNA, 15 bp, Homo sapiens
gcagctggctctcca

SEQ ID NO: 332096 - DNA, 18 bp, Homo sapiens
gcagctggctctccacct

SEQ ID NO: 332097 - DNA, 12 bp, Homo sapiens
gcagctgggccc

SEQ ID NO: 332098 - DNA, 13 bp, Homo sapiens
gcagctgggcccc

SEQ ID NO: 332099 - DNA, 16 bp, Homo sapiens
gcagctgggccccatg

SEQ ID NO: 332100 - DNA, 18 bp, Homo sapiens
gcagctgggccccatgct

SEQ ID NO: 332101 - DNA, 20 bp, Homo sapiens
gcagctgggccccatgctct

SEQ ID NO: 332102 - DNA, 20 bp, Homo sapiens
gcagctggggccggagcctt

SEQ ID NO: 332103 - DNA, 21 bp, Homo sapiens
gcagctggggggctgtcctga

SEQ ID NO: 332104 - DNA, 23 bp, Homo sapiens
gcagctgtgtttgagtttctggc

SEQ ID NO: 332105 - DNA, 14 bp, Homo sapiens
gcagctgttagagt

SEQ ID NO: 332106 - DNA, 19 bp, Homo sapiens
gcagcttcagtctctgcag

SEQ ID NO: 332107 - DNA, 13 bp, Homo sapiens
gcagcttcagttg

SEQ ID NO: 332108 - DNA, 16 bp, Homo sapiens
gcagcttccttccaag

SEQ ID NO: 332109 - DNA, 16 bp, Homo sapiens
tccttcccactgtcct

SEQ ID NO: 332110 - DNA, 19 bp, Homo sapiens
tccttcccactgtcctttc

SEQ ID NO: 332111 - DNA, 17 bp, Homo sapiens
tccttcccccagcccaa

SEQ ID NO: 332112 - DNA, 18 bp, Homo sapiens
tccttcccccagcccaat

SEQ ID NO: 332113 - DNA, 21 bp, Homo sapiens
tccttcccccagcccaataaa

SEQ ID NO: 332114 - DNA, 12 bp, Homo sapiens
tccttcccgcag

SEQ ID NO: 332115 - DNA, 18 bp, Homo sapiens
tccttcccgcagcaccag

SEQ ID NO: 332116 - DNA, 22 bp, Homo sapiens
tccttcccgcagcaccagcctg

SEQ ID NO: 332117 - DNA, 23 bp, Homo sapiens
tccttcccgcagcaccagcctga

SEQ ID NO: 332118 - DNA, 14 bp, Homo sapiens
tccttccctgggaa

SEQ ID NO: 332119 - DNA, 15 bp, Homo sapiens
tccttccctgggaag

SEQ ID NO: 332120 - DNA, 18 bp, Homo sapiens
tccttccctgggaaggct

SEQ ID NO: 332121 - DNA, 16 bp, Homo sapiens
tccttcctctttgctt

SEQ ID NO: 332122 - DNA, 13 bp, Homo sapiens
tccttcctgccct

SEQ ID NO: 332123 - DNA, 16 bp, Homo sapiens
tccttcctgccctgta

SEQ ID NO: 332124 - DNA, 20 bp, Homo sapiens
tccttcctgccctgtacctc

SEQ ID NO: 332125 - DNA, 22 bp, Homo sapiens
tccttcctgccctgtacctctc

SEQ ID NO: 332126 - DNA, 19 bp, Homo sapiens
tccttcctgttctgaactg

SEQ ID NO: 332127 - DNA, 20 bp, Homo sapiens
tccttcctgttctgtgtctg

SEQ ID NO: 332128 - DNA, 20 bp, Homo sapiens
tccttcgagggttccaggct

SEQ ID NO: 332129 - DNA, 19 bp, Homo sapiens
tccttcgtgtctctcccac

SEQ ID NO: 332130 - DNA, 13 bp, Homo sapiens
tccttctccccaa

SEQ ID NO: 332131 - DNA, 12 bp, Homo sapiens
tccttctcccct

SEQ ID NO: 332132 - DNA, 12 bp, Homo sapiens
tccttctccctt

SEQ ID NO: 332133 - DNA, 18 bp, Homo sapiens
tccttctcgtcttcctct

SEQ ID NO: 332134 - DNA, 20 bp, Homo sapiens
tccttctcgtcttcctctct

SEQ ID NO: 332135 - DNA, 23 bp, Homo sapiens
tccttctcgtcttcctctctctc

SEQ ID NO: 332136 - DNA, 14 bp, Homo sapiens
tccttctgacccca

SEQ ID NO: 332137 - DNA, 15 bp, Homo sapiens
tccttctgccttttt

SEQ ID NO: 332138 - DNA, 12 bp, Homo sapiens
tccttctggcct

SEQ ID NO: 332139 - DNA, 20 bp, Homo sapiens
tccttctggcctttcctctc

SEQ ID NO: 332140 - DNA, 20 bp, Homo sapiens
tccttctgtgaaagtacatt

SEQ ID NO: 332141 - DNA, 16 bp, Homo sapiens
tccttcttgtagtagt

SEQ ID NO: 332142 - DNA, 12 bp, Homo sapiens
tccttgaaacag

SEQ ID NO: 332143 - DNA, 17 bp, Homo sapiens
tccttgaccttcctctg

SEQ ID NO: 332144 - DNA, 21 bp, Homo sapiens
tccttgaccttcctctggggc

SEQ ID NO: 332145 - DNA, 23 bp, Homo sapiens
tccttgataaaaaatttattatg

SEQ ID NO: 332146 - DNA, 19 bp, Homo sapiens
tccttgattacataatgtt

SEQ ID NO: 332147 - DNA, 22 bp, Homo sapiens
tccttgatttatcacacaaagc

SEQ ID NO: 332148 - DNA, 12 bp, Homo sapiens
tccttgccaccc

SEQ ID NO: 332149 - DNA, 14 bp, Homo sapiens
tccttgccaccccc

SEQ ID NO: 332150 - DNA, 22 bp, Homo sapiens
tccttgccctgggccagcccag

SEQ ID NO: 332151 - DNA, 20 bp, Homo sapiens
tccttgccgctgggagagcc

SEQ ID NO: 332152 - DNA, 17 bp, Homo sapiens
tccttgcctcctgtgta

SEQ ID NO: 332153 - DNA, 16 bp, Homo sapiens
tccttgctagccctgg

SEQ ID NO: 332154 - DNA, 13 bp, Homo sapiens
tccttgctctccc

SEQ ID NO: 332155 - DNA, 20 bp, Homo sapiens
tccttgctctccctcttctc

SEQ ID NO: 332156 - DNA, 21 bp, Homo sapiens
tccttgctctccctcttctca

SEQ ID NO: 332157 - DNA, 16 bp, Homo sapiens
tccttgcttttatgtt

SEQ ID NO: 332158 - DNA, 19 bp, Homo sapiens
tccttggagagcagctggc

SEQ ID NO: 332159 - DNA, 14 bp, Homo sapiens
tccttggatttgca

SEQ ID NO: 332160 - DNA, 12 bp, Homo sapiens
tccttggcacca

SEQ ID NO: 332161 - DNA, 13 bp, Homo sapiens
tccttggcacccc

SEQ ID NO: 332162 - DNA, 17 bp, Homo sapiens
tccttggcacccccatg

SEQ ID NO: 332163 - DNA, 16 bp, Homo sapiens
tccttggcccagcagc

SEQ ID NO: 332164 - DNA, 17 bp, Homo sapiens
tccttggcccagcagcg

SEQ ID NO: 332165 - DNA, 15 bp, Homo sapiens
tccttgggctcctgg

SEQ ID NO: 332166 - DNA, 17 bp, Homo sapiens
tccttgggctcctggct

SEQ ID NO: 332167 - DNA, 19 bp, Homo sapiens
tccttgggctcctggctgc

SEQ ID NO: 332168 - DNA, 22 bp, Homo sapiens
tccttgggctcctggctgccag

SEQ ID NO: 332169 - DNA, 14 bp, Homo sapiens
tccttgttcctaga

SEQ ID NO: 332170 - DNA, 17 bp, Homo sapiens
tcctttaaattctccaa

SEQ ID NO: 332171 - DNA, 18 bp, Homo sapiens
tcctttaaattctccaac

SEQ ID NO: 332172 - DNA, 15 bp, Homo sapiens
tcctttaactctgcg

SEQ ID NO: 332173 - DNA, 14 bp, Homo sapiens
tcctttaggcagcc

SEQ ID NO: 332174 - DNA, 18 bp, Homo sapiens
tcctttcacaaccttctg

SEQ ID NO: 332175 - DNA, 17 bp, Homo sapiens
tcctttcatcctcagca

SEQ ID NO: 332176 - DNA, 12 bp, Homo sapiens
tcctttccctgg

SEQ ID NO: 332177 - DNA, 16 bp, Homo sapiens
tcctttcctgcatctt

SEQ ID NO: 332178 - DNA, 22 bp, Homo sapiens
tcctttctaacaaaaaaatata

SEQ ID NO: 332179 - DNA, 18 bp, Homo sapiens
tcctttctccagccagca

SEQ ID NO: 332180 - DNA, 15 bp, Homo sapiens
tcctttctccaggcc

SEQ ID NO: 332181 - DNA, 22 bp, Homo sapiens
tcctttcttccctcatgttctc

SEQ ID NO: 332182 - DNA, 17 bp, Homo sapiens
tcctttctttttcttct

SEQ ID NO: 332183 - DNA, 17 bp, Homo sapiens
tcctttcttttttttct

SEQ ID NO: 332184 - DNA, 20 bp, Homo sapiens
tcctttcttttttttcttgg

SEQ ID NO: 332185 - DNA, 21 bp, Homo sapiens
tcctttcttttttttcttggt

SEQ ID NO: 332186 - DNA, 15 bp, Homo sapiens
tcctttgagaaagaa

SEQ ID NO: 332187 - DNA, 15 bp, Homo sapiens
tcctttgcactgagg

SEQ ID NO: 332188 - DNA, 17 bp, Homo sapiens
tcctttgcgcaaacttt

SEQ ID NO: 332189 - DNA, 15 bp, Homo sapiens
tcctttgctctggat

SEQ ID NO: 332190 - DNA, 11 bp, Homo sapiens
tcctttgtctt

SEQ ID NO: 332191 - DNA, 20 bp, Homo sapiens
tcctttgtcttacattggct

SEQ ID NO: 332192 - DNA, 13 bp, Homo sapiens
tccttttagccta

SEQ ID NO: 332193 - DNA, 14 bp, Homo sapiens
tccttttagcctag

SEQ ID NO: 332194 - DNA, 13 bp, Homo sapiens
tccttttctcttt

SEQ ID NO: 332195 - DNA, 16 bp, Homo sapiens
tccttttgtatcctcc

SEQ ID NO: 332196 - DNA, 14 bp, Homo sapiens
tccttttgtcccca

SEQ ID NO: 332197 - DNA, 17 bp, Homo sapiens
tccttttttatacagga

SEQ ID NO: 332198 - DNA, 14 bp, Homo sapiens
tcgaaaacagatga

SEQ ID NO: 332199 - DNA, 21 bp, Homo sapiens
tcgaaccaaggcagcctccag

SEQ ID NO: 332200 - DNA, 16 bp, Homo sapiens
tcgaagctcagcccac

SEQ ID NO: 332201 - DNA, 21 bp, Homo sapiens
tcgaattaatagcttttattg

SEQ ID NO: 332202 - DNA, 15 bp, Homo sapiens
tcgacctcactgtca

SEQ ID NO: 332203 - DNA, 14 bp, Homo sapiens
tcgactcaggatcc

SEQ ID NO: 332204 - DNA, 18 bp, Homo sapiens
tcgagaccatcctggccc

SEQ ID NO: 332205 - DNA, 17 bp, Homo sapiens
tcgagagggctgagccc

SEQ ID NO: 332206 - DNA, 17 bp, Homo sapiens
tcgagcagtcctgcctc

SEQ ID NO: 332207 - DNA, 22 bp, Homo sapiens
tcgagcagtcctgcctcagcct

SEQ ID NO: 332208 - DNA, 21 bp, Homo sapiens
tcgagcatgttgttttttcat

SEQ ID NO: 332209 - DNA, 15 bp, Homo sapiens
tcgagccccctggat

SEQ ID NO: 332210 - DNA, 19 bp, Homo sapiens
tcgaggcaccggcgctgca

SEQ ID NO: 332211 - DNA, 14 bp, Homo sapiens
tcgaggtgtcaccc

SEQ ID NO: 332212 - DNA, 17 bp, Homo sapiens
tcgatgcaagtgtttct

SEQ ID NO: 332213 - DNA, 22 bp, Homo sapiens
tcgatgcaagtgtttctgttct

SEQ ID NO: 332214 - DNA, 22 bp, Homo sapiens
tcgatgggggatgcttcatgtg

SEQ ID NO: 332215 - DNA, 22 bp, Homo sapiens
gcaggtgtcatatatggggggc

SEQ ID NO: 332216 - DNA, 19 bp, Homo sapiens
gcaggtgtggtggctcatg

SEQ ID NO: 332217 - DNA, 18 bp, Homo sapiens
gcaggttatgtcagcagc

SEQ ID NO: 332218 - DNA, 20 bp, Homo sapiens
gcaggttatgtcagcagctc

SEQ ID NO: 332219 - DNA, 22 bp, Homo sapiens
gcaggttatgtcagcagctctg

SEQ ID NO: 332220 - DNA, 13 bp, Homo sapiens
gcaggttggatgg

SEQ ID NO: 332221 - DNA, 23 bp, Homo sapiens
gcaggttggatgggagtgggcac

SEQ ID NO: 332222 - DNA, 14 bp, Homo sapiens
gcagtaccatccca

SEQ ID NO: 332223 - DNA, 20 bp, Homo sapiens
gcagtaccatcccactgata

SEQ ID NO: 332224 - DNA, 18 bp, Homo sapiens
gcagtagagtcatctcca

SEQ ID NO: 332225 - DNA, 17 bp, Homo sapiens
gcagtataaaatgtaaa

SEQ ID NO: 332226 - DNA, 13 bp, Homo sapiens
gcagtatgaatga

SEQ ID NO: 332227 - DNA, 17 bp, Homo sapiens
gcagtatggcggaggcc

SEQ ID NO: 332228 - DNA, 16 bp, Homo sapiens
gcagtcacactgctgg

SEQ ID NO: 332229 - DNA, 17 bp, Homo sapiens
gcagtcatcaacaaaag

SEQ ID NO: 332230 - DNA, 13 bp, Homo sapiens
gcagtccagagct

SEQ ID NO: 332231 - DNA, 15 bp, Homo sapiens
gcagtccagagcttt

SEQ ID NO: 332232 - DNA, 18 bp, Homo sapiens
gcagtccagagcttttca

SEQ ID NO: 332233 - DNA, 22 bp, Homo sapiens
gcagtcccagtattctcagagc

SEQ ID NO: 332234 - DNA, 14 bp, Homo sapiens
gcagtccccagccc

SEQ ID NO: 332235 - DNA, 15 bp, Homo sapiens
gcagtcgcaggatcc

SEQ ID NO: 332236 - DNA, 13 bp, Homo sapiens
gcagtctgaaccc

SEQ ID NO: 332237 - DNA, 22 bp, Homo sapiens
gcagtctgaacccttgtgcttg

SEQ ID NO: 332238 - DNA, 12 bp, Homo sapiens
gcagtctggagg

SEQ ID NO: 332239 - DNA, 13 bp, Homo sapiens
gcagtctggaggg

SEQ ID NO: 332240 - DNA, 18 bp, Homo sapiens
tcgcggcgcagcccctgg

SEQ ID NO: 332241 - DNA, 20 bp, Homo sapiens
tcgcggctgggagcctcgcc

SEQ ID NO: 332242 - DNA, 18 bp, Homo sapiens
tcgcgtgccctcgctgct

SEQ ID NO: 332243 - DNA, 13 bp, Homo sapiens
tcgctattcccag

SEQ ID NO: 332244 - DNA, 16 bp, Homo sapiens
tcgctattcccaggca

SEQ ID NO: 332245 - DNA, 22 bp, Homo sapiens
tcgctattcccaggcagggagg

SEQ ID NO: 332246 - DNA, 17 bp, Homo sapiens
tcgctctgtcgcccagg

SEQ ID NO: 332247 - DNA, 21 bp, Homo sapiens
tcgctctgttgcccaggctgg

SEQ ID NO: 332248 - DNA, 17 bp, Homo sapiens
tcgctgctctagctggc

SEQ ID NO: 332249 - DNA, 12 bp, Homo sapiens
tcgctggaaaac

SEQ ID NO: 332250 - DNA, 19 bp, Homo sapiens
tcgctgtatgatttaggct

SEQ ID NO: 332251 - DNA, 15 bp, Homo sapiens
tcgctgtccaagtgt

SEQ ID NO: 332252 - DNA, 14 bp, Homo sapiens
tcgctgtgccacca

SEQ ID NO: 332253 - DNA, 18 bp, Homo sapiens
tcgctgtgccaccacccc

SEQ ID NO: 332254 - DNA, 16 bp, Homo sapiens
tcgcttcataggcaga

SEQ ID NO: 332255 - DNA, 17 bp, Homo sapiens
tcgcttcataggcagag

SEQ ID NO: 332256 - DNA, 15 bp, Homo sapiens
tcgcttctttttcaa

SEQ ID NO: 332257 - DNA, 18 bp, Homo sapiens
tcgcttgagcccaggagt

SEQ ID NO: 332258 - DNA, 13 bp, Homo sapiens
tcggaagcagtgc

SEQ ID NO: 332259 - DNA, 12 bp, Homo sapiens
tcggaagcctgt

SEQ ID NO: 332260 - DNA, 15 bp, Homo sapiens
tcggaagcctgtcct

SEQ ID NO: 332261 - DNA, 19 bp, Homo sapiens
tcggaagcctgtcctcacc

SEQ ID NO: 332262 - DNA, 11 bp, Homo sapiens
tcggacacagt

SEQ ID NO: 332263 - DNA, 21 bp, Homo sapiens
tcggacccaccaaactgcaca

SEQ ID NO: 332264 - DNA, 22 bp, Homo sapiens
tcggacccaccaaactgcacac

SEQ ID NO: 332265 - DNA, 13 bp, Homo sapiens
tcggacccacccc

SEQ ID NO: 332266 - DNA, 20 bp, Homo sapiens
tcggacccaccccaactctc

SEQ ID NO: 332267 - DNA, 19 bp, Homo sapiens
tcggacctcagtttctgtt

SEQ ID NO: 332268 - DNA, 19 bp, Homo sapiens
tcggactgcccccagaaag

SEQ ID NO: 332269 - DNA, 20 bp, Homo sapiens
tcggactgcccccagaaagc

SEQ ID NO: 332270 - DNA, 14 bp, Homo sapiens
tcggagacagtgat

SEQ ID NO: 332271 - DNA, 15 bp, Homo sapiens
tcggagacagtgatc

SEQ ID NO: 332272 - DNA, 21 bp, Homo sapiens
tcggagacagtgatctccata

SEQ ID NO: 332273 - DNA, 17 bp, Homo sapiens
tcggagactgccccacg

SEQ ID NO: 332274 - DNA, 16 bp, Homo sapiens
tcggagtagaaattgt

SEQ ID NO: 332275 - DNA, 19 bp, Homo sapiens
tcggagtatctgggaactg

SEQ ID NO: 332276 - DNA, 18 bp, Homo sapiens
tcggatctagccatggct

SEQ ID NO: 332277 - DNA, 19 bp, Homo sapiens
tcggatctagccatggctg

SEQ ID NO: 332278 - DNA, 16 bp, Homo sapiens
tcggcagaactctctg

SEQ ID NO: 332279 - DNA, 17 bp, Homo sapiens
tcggcagaactctctgt

SEQ ID NO: 332280 - DNA, 19 bp, Homo sapiens
tcggcagaactctctgtct

SEQ ID NO: 332281 - DNA, 20 bp, Homo sapiens
tcggcattcacacacagcct

SEQ ID NO: 332282 - DNA, 16 bp, Homo sapiens
tcggccagagctccca

SEQ ID NO: 332283 - DNA, 17 bp, Homo sapiens
tcggccagagctcccag

SEQ ID NO: 332284 - DNA, 24 bp, Homo sapiens
tcggccccacccaccctctggtcc

SEQ ID NO: 332285 - DNA, 17 bp, Homo sapiens
tcggcctccgaggctcc

SEQ ID NO: 332286 - DNA, 20 bp, Homo sapiens
tcggcctccgaggctccccg

SEQ ID NO: 332287 - DNA, 23 bp, Homo sapiens
tcggcctctactttgtcccctca

SEQ ID NO: 332288 - DNA, 12 bp, Homo sapiens
tcggctctgccg

SEQ ID NO: 332289 - DNA, 12 bp, Homo sapiens
tcggctggaaga

SEQ ID NO: 332290 - DNA, 13 bp, Homo sapiens
tcggctgggcagg

SEQ ID NO: 332291 - DNA, 16 bp, Homo sapiens
tcggcttgtgggctgg

SEQ ID NO: 332292 - DNA, 17 bp, Homo sapiens
tcggcttgtgggctggt

SEQ ID NO: 332293 - DNA, 23 bp, Homo sapiens
tcggcttgtgggctggtgcccca

SEQ ID NO: 332294 - DNA, 19 bp, Homo sapiens
tcgggaaattctgctgctt

SEQ ID NO: 332295 - DNA, 20 bp, Homo sapiens
tcgggaaattctgctgcttg

SEQ ID NO: 332296 - DNA, 15 bp, Homo sapiens
tcgggaagagaggag

SEQ ID NO: 332297 - DNA, 20 bp, Homo sapiens
tcgggaagagaggagttcaa

SEQ ID NO: 332298 - DNA, 15 bp, Homo sapiens
tcgggagcagtgtct

SEQ ID NO: 332299 - DNA, 19 bp, Homo sapiens
tcgggagcagtgtcttcca

SEQ ID NO: 332300 - DNA, 22 bp, Homo sapiens
tcgggagcagtgtcttccataa

SEQ ID NO: 332301 - DNA, 12 bp, Homo sapiens
tcgggattcttt

SEQ ID NO: 332302 - DNA, 21 bp, Homo sapiens
tcgggcgcctgcgctcctctg

SEQ ID NO: 332303 - DNA, 14 bp, Homo sapiens
tcggggcaggaagt

SEQ ID NO: 332304 - DNA, 14 bp, Homo sapiens
tcggggccagaggc

SEQ ID NO: 332305 - DNA, 17 bp, Homo sapiens
tcggggcccttggggcc

SEQ ID NO: 332306 - DNA, 20 bp, Homo sapiens
tcggggcccttggggcctgg

SEQ ID NO: 332307 - DNA, 22 bp, Homo sapiens
tcggggcccttggggcctggct

SEQ ID NO: 332308 - DNA, 16 bp, Homo sapiens
tcgggggaggagcacc

SEQ ID NO: 332309 - DNA, 17 bp, Homo sapiens
tcgggggaggagcaccc

SEQ ID NO: 332310 - DNA, 19 bp, Homo sapiens
tcggggggcgagggagggg

SEQ ID NO: 332311 - DNA, 15 bp, Homo sapiens
tcggtgcagcggtgg

SEQ ID NO: 332312 - DNA, 15 bp, Homo sapiens
tcggttccacgtccc

SEQ ID NO: 332313 - DNA, 14 bp, Homo sapiens
tcgtacagttcttc

SEQ ID NO: 332314 - DNA, 15 bp, Homo sapiens
tcgtagatgctgcct

SEQ ID NO: 332315 - DNA, 17 bp, Homo sapiens
tcgtagatgctgcctag

SEQ ID NO: 332316 - DNA, 21 bp, Homo sapiens
tcgtagcaaattctgtggcag

SEQ ID NO: 332317 - DNA, 14 bp, Homo sapiens
tcgtataaggaaat

SEQ ID NO: 332318 - DNA, 22 bp, Homo sapiens
tcgtataaggaaatccagcccc

SEQ ID NO: 332319 - DNA, 23 bp, Homo sapiens
tcgtataaggaaatccagcccca

SEQ ID NO: 332320 - DNA, 18 bp, Homo sapiens
tcgtatagaaaaagcaca

SEQ ID NO: 332321 - DNA, 22 bp, Homo sapiens
tcgtatagaaaaagcacagctc

SEQ ID NO: 332322 - DNA, 20 bp, Homo sapiens
tcgtatatacacacaaaaag

SEQ ID NO: 332323 - DNA, 17 bp, Homo sapiens
tcgtattgcaaataaga

SEQ ID NO: 332324 - DNA, 22 bp, Homo sapiens
tcgtcaggaggtgcctgagagc

SEQ ID NO: 332325 - DNA, 20 bp, Homo sapiens
tcgtccacaggggcaggcct

SEQ ID NO: 332326 - DNA, 20 bp, Homo sapiens
tcgtccggcctgcagcccag

SEQ ID NO: 332327 - DNA, 16 bp, Homo sapiens
tcgtccttttggttta

SEQ ID NO: 332328 - DNA, 16 bp, Homo sapiens
tcgtctccctggccac

SEQ ID NO: 332329 - DNA, 17 bp, Homo sapiens
tcgtctgatgttttgat

SEQ ID NO: 332330 - DNA, 21 bp, Homo sapiens
tcgtctgatgttttgatgcca

SEQ ID NO: 332331 - DNA, 12 bp, Homo sapiens
tcgtcttcctct

SEQ ID NO: 332332 - DNA, 19 bp, Homo sapiens
tcgtcttgagcccaggagt

SEQ ID NO: 332333 - DNA, 18 bp, Homo sapiens
tcgtgacccttcagggcc

SEQ ID NO: 332334 - DNA, 19 bp, Homo sapiens
tcgtgacccttcagggcca

SEQ ID NO: 332335 - DNA, 15 bp, Homo sapiens
tcgtgcactctgcta

SEQ ID NO: 332336 - DNA, 13 bp, Homo sapiens
tcgtgcatttgtg

SEQ ID NO: 332337 - DNA, 20 bp, Homo sapiens
tcgtgcctccttccacctcc

SEQ ID NO: 332338 - DNA, 13 bp, Homo sapiens
tcgtgctggagga

SEQ ID NO: 332339 - DNA, 19 bp, Homo sapiens
tcgtggacacctgccctgc

SEQ ID NO: 332340 - DNA, 20 bp, Homo sapiens
tcgtggcagataatcagcct

SEQ ID NO: 332341 - DNA, 21 bp, Homo sapiens
tcgtggcagataatcagcctc

SEQ ID NO: 332342 - DNA, 21 bp, Homo sapiens
tcgtggccaacgtggacctgc

SEQ ID NO: 332343 - DNA, 16 bp, Homo sapiens
tcgtgggctctggctc

SEQ ID NO: 332344 - DNA, 19 bp, Homo sapiens
tcgtgggttcttcctctgt

SEQ ID NO: 332345 - DNA, 14 bp, Homo sapiens
tcgtggtggagaat

SEQ ID NO: 332346 - DNA, 19 bp, Homo sapiens
tcgtgtagtggaagagcag

SEQ ID NO: 332347 - DNA, 22 bp, Homo sapiens
tcgtgtatcctggggctccctt

SEQ ID NO: 332348 - DNA, 17 bp, Homo sapiens
tcgttaacattgaccaa

SEQ ID NO: 332349 - DNA, 15 bp, Homo sapiens
tcgttaactgtgtat

SEQ ID NO: 332350 - DNA, 19 bp, Homo sapiens
tcgttagtatctaacatgt

SEQ ID NO: 332351 - DNA, 18 bp, Homo sapiens
tcgttcccttgtgtctgt

SEQ ID NO: 332352 - DNA, 15 bp, Homo sapiens
gcatgagaatgtcat

SEQ ID NO: 332353 - DNA, 13 bp, Homo sapiens
gcatgagccacca

SEQ ID NO: 332354 - DNA, 22 bp, Homo sapiens
gcatgagctccctcgctgtatg

SEQ ID NO: 332355 - DNA, 21 bp, Homo sapiens
gcatgattttggctcactgca

SEQ ID NO: 332356 - DNA, 18 bp, Homo sapiens
gcatgcaaaccaggagca

SEQ ID NO: 332357 - DNA, 14 bp, Homo sapiens
gcatgcaagctcag

SEQ ID NO: 332358 - DNA, 13 bp, Homo sapiens
gcatgcagaaagg

SEQ ID NO: 332359 - DNA, 18 bp, Homo sapiens
gcatgcagaaagggagca

SEQ ID NO: 332360 - DNA, 21 bp, Homo sapiens
gcatgcattttgcagcagtga

SEQ ID NO: 332361 - DNA, 19 bp, Homo sapiens
gcatgccacgccccgtgtc

SEQ ID NO: 332362 - DNA, 21 bp, Homo sapiens
gcatgccacgccccgtgtctg

SEQ ID NO: 332363 - DNA, 11 bp, Homo sapiens
gcatgccaggc

SEQ ID NO: 332364 - DNA, 18 bp, Homo sapiens
gcatgccccttggctgga

SEQ ID NO: 332365 - DNA, 14 bp, Homo sapiens
gcatgcctggacaa

SEQ ID NO: 332366 - DNA, 15 bp, Homo sapiens
gcatgcctgtgtgac

SEQ ID NO: 332367 - DNA, 18 bp, Homo sapiens
gcatgcgggcttcctcct

SEQ ID NO: 332368 - DNA, 16 bp, Homo sapiens
gcatgctcagtattga

SEQ ID NO: 332369 - DNA, 16 bp, Homo sapiens
gcatgctgcctgcctc

SEQ ID NO: 332370 - DNA, 13 bp, Homo sapiens
tctaaaagattct

SEQ ID NO: 332371 - DNA, 16 bp, Homo sapiens
tctaaaaggaggacag

SEQ ID NO: 332372 - DNA, 13 bp, Homo sapiens
tctaaacaaataa

SEQ ID NO: 332373 - DNA, 15 bp, Homo sapiens
tctaaacacacaagt

SEQ ID NO: 332374 - DNA, 15 bp, Homo sapiens
tctaaagaggaagcc

SEQ ID NO: 332375 - DNA, 15 bp, Homo sapiens
tctaaagttttattg

SEQ ID NO: 332376 - DNA, 17 bp, Homo sapiens
tctaaatagatactttt

SEQ ID NO: 332377 - DNA, 19 bp, Homo sapiens
tctaaatagatacttttga

SEQ ID NO: 332378 - DNA, 17 bp, Homo sapiens
tctaaatcaagtattta

SEQ ID NO: 332379 - DNA, 13 bp, Homo sapiens
tctaaatcataat

SEQ ID NO: 332380 - DNA, 13 bp, Homo sapiens
tctaaatgcagtt

SEQ ID NO: 332381 - DNA, 19 bp, Homo sapiens
tctaaatgcagttttaaga

SEQ ID NO: 332382 - DNA, 14 bp, Homo sapiens
tctaaatgcatatc

SEQ ID NO: 332383 - DNA, 15 bp, Homo sapiens
tctaaattgatcatt

SEQ ID NO: 332384 - DNA, 17 bp, Homo sapiens
tctaacaccacactgac

SEQ ID NO: 332385 - DNA, 18 bp, Homo sapiens
tctaacaccacactgacc

SEQ ID NO: 332386 - DNA, 20 bp, Homo sapiens
tctaacaccacactgaccac

SEQ ID NO: 332387 - DNA, 19 bp, Homo sapiens
tctaacctacgaccccaga

SEQ ID NO: 332388 - DNA, 15 bp, Homo sapiens
tctaacctgatggca

SEQ ID NO: 332389 - DNA, 14 bp, Homo sapiens
tctaacctttctaa

SEQ ID NO: 332390 - DNA, 15 bp, Homo sapiens
tctaactaaggacag

SEQ ID NO: 332391 - DNA, 19 bp, Homo sapiens
tctaactccttgaggtctt

SEQ ID NO: 332392 - DNA, 17 bp, Homo sapiens
tctaactgtgctcaaga

SEQ ID NO: 332393 - DNA, 23 bp, Homo sapiens
tctaagaaatggctttccacatc

SEQ ID NO: 332394 - DNA, 22 bp, Homo sapiens
tctaagacattcaccaacaaca

SEQ ID NO: 332395 - DNA, 15 bp, Homo sapiens
tctaagagcagagtc

SEQ ID NO: 332396 - DNA, 22 bp, Homo sapiens
tctaagatgccagcatatactg

SEQ ID NO: 332397 - DNA, 14 bp, Homo sapiens
tctaagcttatttc

SEQ ID NO: 332398 - DNA, 19 bp, Homo sapiens
tctaagcttatttctaact

SEQ ID NO: 332399 - DNA, 19 bp, Homo sapiens
tctaaggatagcctttgta

SEQ ID NO: 332400 - DNA, 19 bp, Homo sapiens
tctaaggccaaggcctcag

SEQ ID NO: 332401 - DNA, 15 bp, Homo sapiens
tctaaggtctatcaa

SEQ ID NO: 332402 - DNA, 17 bp, Homo sapiens
tctaagtatttaaatgt

SEQ ID NO: 332403 - DNA, 21 bp, Homo sapiens
tctaagtatttaaatgttcta

SEQ ID NO: 332404 - DNA, 19 bp, Homo sapiens
tctaagtggcctgcagggg

SEQ ID NO: 332405 - DNA, 20 bp, Homo sapiens
tctaagttcatgtttgtaaa

SEQ ID NO: 332406 - DNA, 13 bp, Homo sapiens
tctaatagtgctt

SEQ ID NO: 332407 - DNA, 15 bp, Homo sapiens
tctaatatattttta

SEQ ID NO: 332408 - DNA, 20 bp, Homo sapiens
tctaatatggcaaaaatggc

SEQ ID NO: 332409 - DNA, 16 bp, Homo sapiens
tctaatctcttattct

SEQ ID NO: 332410 - DNA, 15 bp, Homo sapiens
tctaatgctcacgct

SEQ ID NO: 332411 - DNA, 13 bp, Homo sapiens
tctaatggaatat

SEQ ID NO: 332412 - DNA, 20 bp, Homo sapiens
tctaatgggtatttaaacaa

SEQ ID NO: 332413 - DNA, 13 bp, Homo sapiens
tctaatgtagcta

SEQ ID NO: 332414 - DNA, 17 bp, Homo sapiens
tctaatgtcttcatttc

SEQ ID NO: 332415 - DNA, 21 bp, Homo sapiens
tctaattccatccataaatcc

SEQ ID NO: 332416 - DNA, 18 bp, Homo sapiens
tctaattcccattttgca

SEQ ID NO: 332417 - DNA, 22 bp, Homo sapiens
tctaattcccattttgcaaaat

SEQ ID NO: 332418 - DNA, 14 bp, Homo sapiens
tctaattgccatgt

SEQ ID NO: 332419 - DNA, 24 bp, Homo sapiens
tctaattggtcattcctaatgcat

SEQ ID NO: 332420 - DNA, 19 bp, Homo sapiens
tctaatttcaaaaatataa

SEQ ID NO: 332421 - DNA, 14 bp, Homo sapiens
tctaatttgctgct

SEQ ID NO: 332422 - DNA, 15 bp, Homo sapiens
tctaattttggatgg

SEQ ID NO: 332423 - DNA, 16 bp, Homo sapiens
tctaattttggatgga

SEQ ID NO: 332424 - DNA, 17 bp, Homo sapiens
tctaattttgtgctctt

SEQ ID NO: 332425 - DNA, 14 bp, Homo sapiens
tctacaaaagcaaa

SEQ ID NO: 332426 - DNA, 19 bp, Homo sapiens
tctacaaaagcaaagtgaa

SEQ ID NO: 332427 - DNA, 18 bp, Homo sapiens
tctacaaatataagattt

SEQ ID NO: 332428 - DNA, 17 bp, Homo sapiens
tctacaaccagagcccc

SEQ ID NO: 332429 - DNA, 23 bp, Homo sapiens
tctacaaccagagccccccacaa

SEQ ID NO: 332430 - DNA, 14 bp, Homo sapiens
tctacacaacatgt

SEQ ID NO: 332431 - DNA, 16 bp, Homo sapiens
tctacacaatttaatt

SEQ ID NO: 332432 - DNA, 12 bp, Homo sapiens
tctacacctgga

SEQ ID NO: 332433 - DNA, 12 bp, Homo sapiens
tctacactctcc

SEQ ID NO: 332434 - DNA, 17 bp, Homo sapiens
tctacagaacaaagaac

SEQ ID NO: 332435 - DNA, 20 bp, Homo sapiens
tctacagctaatcagcattc

SEQ ID NO: 332436 - DNA, 11 bp, Homo sapiens
tctacaggcat

SEQ ID NO: 332437 - DNA, 20 bp, Homo sapiens
tctacagttaattatgtgca

SEQ ID NO: 332438 - DNA, 23 bp, Homo sapiens
tctacatatgataggcagcactg

SEQ ID NO: 332439 - DNA, 15 bp, Homo sapiens
tctacatgactgggc

SEQ ID NO: 332440 - DNA, 13 bp, Homo sapiens
tctacattctcta

SEQ ID NO: 332441 - DNA, 15 bp, Homo sapiens
tctacattctctatt

SEQ ID NO: 332442 - DNA, 17 bp, Homo sapiens
tctacattctctatttt

SEQ ID NO: 332443 - DNA, 22 bp, Homo sapiens
tctacattctctatttttgtta

SEQ ID NO: 332444 - DNA, 20 bp, Homo sapiens
tctaccattttctggttctt

SEQ ID NO: 332445 - DNA, 16 bp, Homo sapiens
tctacccagcccatct

SEQ ID NO: 332446 - DNA, 17 bp, Homo sapiens
tctacccagcccatctt

SEQ ID NO: 332447 - DNA, 19 bp, Homo sapiens
tctacccatgttgggaaaa

SEQ ID NO: 332448 - DNA, 20 bp, Homo sapiens
tctaccctggtaggaaagca

SEQ ID NO: 332449 - DNA, 14 bp, Homo sapiens
tctaccttcctgca

SEQ ID NO: 332450 - DNA, 20 bp, Homo sapiens
tctacgccaaagtgcagccc

SEQ ID NO: 332451 - DNA, 16 bp, Homo sapiens
tctacgtataaatatg

SEQ ID NO: 332452 - DNA, 23 bp, Homo sapiens
tctactgcttggatccatacaaa

SEQ ID NO: 332453 - DNA, 18 bp, Homo sapiens
tctactggagtggaaggt

SEQ ID NO: 332454 - DNA, 13 bp, Homo sapiens
tctacttcagctt

SEQ ID NO: 332455 - DNA, 15 bp, Homo sapiens
tctacttcagctttg

SEQ ID NO: 332456 - DNA, 17 bp, Homo sapiens
tctacttcagctttgga

SEQ ID NO: 332457 - DNA, 14 bp, Homo sapiens
tctacttctgtgtc

SEQ ID NO: 332458 - DNA, 17 bp, Homo sapiens
tctacttgtttaacatt

SEQ ID NO: 332459 - DNA, 14 bp, Homo sapiens
tctacttttaaaga

SEQ ID NO: 332460 - DNA, 18 bp, Homo sapiens
tctactttttttttaatt

SEQ ID NO: 332461 - DNA, 17 bp, Homo sapiens
tctagaaaagcttccta

SEQ ID NO: 332462 - DNA, 16 bp, Homo sapiens
tctagaaagaaaagac

SEQ ID NO: 332463 - DNA, 22 bp, Homo sapiens
tctagaaagcctgttcccctca

SEQ ID NO: 332464 - DNA, 18 bp, Homo sapiens
tctagaacattcagattt

SEQ ID NO: 332465 - DNA, 16 bp, Homo sapiens
tctagaaggggcgagg

SEQ ID NO: 332466 - DNA, 17 bp, Homo sapiens
tctagaatcctgcttta

SEQ ID NO: 332467 - DNA, 12 bp, Homo sapiens
tctagaatggtt

SEQ ID NO: 332468 - DNA, 17 bp, Homo sapiens
tctagaattataagtca

SEQ ID NO: 332469 - DNA, 19 bp, Homo sapiens
tctagaatttatcacactt

SEQ ID NO: 332470 - DNA, 19 bp, Homo sapiens
tctagaattttaagtgctt

SEQ ID NO: 332471 - DNA, 20 bp, Homo sapiens
tctagacactgaaggcaaat

SEQ ID NO: 332472 - DNA, 21 bp, Homo sapiens
tctagacagtattgccacctc

SEQ ID NO: 332473 - DNA, 14 bp, Homo sapiens
tctagacgcccctc

SEQ ID NO: 332474 - DNA, 15 bp, Homo sapiens
tctagacgcccctcc

SEQ ID NO: 332475 - DNA, 13 bp, Homo sapiens
tctagactttctg

SEQ ID NO: 332476 - DNA, 14 bp, Homo sapiens
tctagactttctgt

SEQ ID NO: 332477 - DNA, 18 bp, Homo sapiens
tctagagatatatatact

SEQ ID NO: 332478 - DNA, 15 bp, Homo sapiens
tctagagcagggatt

SEQ ID NO: 332479 - DNA, 16 bp, Homo sapiens
tctagagctatgcaca

SEQ ID NO: 332480 - DNA, 22 bp, Homo sapiens
tctagagctatgcacaccaaat

SEQ ID NO: 332481 - DNA, 15 bp, Homo sapiens
tctagatatgagaaa

SEQ ID NO: 332482 - DNA, 13 bp, Homo sapiens
tctagatcaatta

SEQ ID NO: 332483 - DNA, 20 bp, Homo sapiens
tctagatcaattaattctta

SEQ ID NO: 332484 - DNA, 15 bp, Homo sapiens
tctagatcagagagc

SEQ ID NO: 332485 - DNA, 16 bp, Homo sapiens
tctagcaaacagatgt

SEQ ID NO: 332486 - DNA, 13 bp, Homo sapiens
tctagcaactgtt

SEQ ID NO: 332487 - DNA, 14 bp, Homo sapiens
tctagcaagaagat

SEQ ID NO: 332488 - DNA, 19 bp, Homo sapiens
tctagcaagaagattctaa

SEQ ID NO: 332489 - DNA, 18 bp, Homo sapiens
tctagcacatcatggcag

SEQ ID NO: 332490 - DNA, 19 bp, Homo sapiens
tctagcacatcatggcagt

SEQ ID NO: 332491 - DNA, 12 bp, Homo sapiens
gccaaagtgtta

SEQ ID NO: 332492 - DNA, 15 bp, Homo sapiens
gccaaatatgtcctg

SEQ ID NO: 332493 - DNA, 18 bp, Homo sapiens
gccaaattatttgtgtaa

SEQ ID NO: 332494 - DNA, 23 bp, Homo sapiens
gccaaattatttgtgtaatagaa

SEQ ID NO: 332495 - DNA, 13 bp, Homo sapiens
gccaacagccccc

SEQ ID NO: 332496 - DNA, 22 bp, Homo sapiens
gccaacatcgtgaaaccctgtc

SEQ ID NO: 332497 - DNA, 15 bp, Homo sapiens
gccaacccctgtgga

SEQ ID NO: 332498 - DNA, 21 bp, Homo sapiens
gccaacctgatgccccttccc

SEQ ID NO: 332499 - DNA, 15 bp, Homo sapiens
gccaacgtggacctg

SEQ ID NO: 332500 - DNA, 17 bp, Homo sapiens
gccaacgtggacctgcc

SEQ ID NO: 332501 - DNA, 15 bp, Homo sapiens
tctagcctctttgtg

SEQ ID NO: 332502 - DNA, 17 bp, Homo sapiens
tctagcctgggccagag

SEQ ID NO: 332503 - DNA, 20 bp, Homo sapiens
tctagcctgggccagagaag

SEQ ID NO: 332504 - DNA, 13 bp, Homo sapiens
tctagctggcagg

SEQ ID NO: 332505 - DNA, 14 bp, Homo sapiens
tctagctggcagga

SEQ ID NO: 332506 - DNA, 15 bp, Homo sapiens
tctagctggcaggac

SEQ ID NO: 332507 - DNA, 19 bp, Homo sapiens
tctagctgttgagctgttt

SEQ ID NO: 332508 - DNA, 15 bp, Homo sapiens
tctaggcctcagtgt

SEQ ID NO: 332509 - DNA, 17 bp, Homo sapiens
tctagggttgctggagc

SEQ ID NO: 332510 - DNA, 20 bp, Homo sapiens
tctaggtaggggcccacttc

SEQ ID NO: 332511 - DNA, 14 bp, Homo sapiens
tctaggtctcctca

SEQ ID NO: 332512 - DNA, 15 bp, Homo sapiens
tctaggtcttggtta

SEQ ID NO: 332513 - DNA, 14 bp, Homo sapiens
tctaggttctaaaa

SEQ ID NO: 332514 - DNA, 17 bp, Homo sapiens
tctaggtttaactcaga

SEQ ID NO: 332515 - DNA, 21 bp, Homo sapiens
tctagtaggtctgcacacata

SEQ ID NO: 332516 - DNA, 19 bp, Homo sapiens
tctagtcctattctattgc

SEQ ID NO: 332517 - DNA, 14 bp, Homo sapiens
tctagtctctgatt

SEQ ID NO: 332518 - DNA, 22 bp, Homo sapiens
tctagtgaattttttaaatgaa

SEQ ID NO: 332519 - DNA, 16 bp, Homo sapiens
tctagtgacttcctgg

SEQ ID NO: 332520 - DNA, 21 bp, Homo sapiens
tctagtttacagaaaaatctt

SEQ ID NO: 332521 - DNA, 13 bp, Homo sapiens
tctagtttgcata

SEQ ID NO: 332522 - DNA, 18 bp, Homo sapiens
tctagttttttttgtaaa

SEQ ID NO: 332523 - DNA, 22 bp, Homo sapiens
tctataaagcgatatacagatg

SEQ ID NO: 332524 - DNA, 19 bp, Homo sapiens
tctataatcccagcacttt

SEQ ID NO: 332525 - DNA, 21 bp, Homo sapiens
tctataatcccagcactttgg

SEQ ID NO: 332526 - DNA, 13 bp, Homo sapiens
tctatacattcct

SEQ ID NO: 332527 - DNA, 13 bp, Homo sapiens
tctatagactcta

SEQ ID NO: 332528 - DNA, 18 bp, Homo sapiens
tctatagcagtcatcatt

SEQ ID NO: 332529 - DNA, 22 bp, Homo sapiens
tctatataaaatgtattcaagc

SEQ ID NO: 332530 - DNA, 21 bp, Homo sapiens
tctatatagtacctttgctct

SEQ ID NO: 332531 - DNA, 22 bp, Homo sapiens
tctatatatacatatacacaaa

SEQ ID NO: 332532 - DNA, 21 bp, Homo sapiens
tctatatatacatgtatagtg

SEQ ID NO: 332533 - DNA, 20 bp, Homo sapiens
tctatatctttaaataaatg

SEQ ID NO: 332534 - DNA, 21 bp, Homo sapiens
tctatatctttaaataaatgt

SEQ ID NO: 332535 - DNA, 20 bp, Homo sapiens
tctatatgtgcggcttttca

SEQ ID NO: 332536 - DNA, 17 bp, Homo sapiens
tctatatttaaatcatt

SEQ ID NO: 332537 - DNA, 11 bp, Homo sapiens
tctatatttca

SEQ ID NO: 332538 - DNA, 14 bp, Homo sapiens
tctatatttcatat

SEQ ID NO: 332539 - DNA, 17 bp, Homo sapiens
tctatatttcatattga

SEQ ID NO: 332540 - DNA, 13 bp, Homo sapiens
tctatatttgtaa

SEQ ID NO: 332541 - DNA, 15 bp, Homo sapiens
tctatatttgtaact

SEQ ID NO: 332542 - DNA, 17 bp, Homo sapiens
tctatcaagtcaatcat

SEQ ID NO: 332543 - DNA, 13 bp, Homo sapiens
tctatcacctgtc

SEQ ID NO: 332544 - DNA, 16 bp, Homo sapiens
tctatcacctgtcatc

SEQ ID NO: 332545 - DNA, 22 bp, Homo sapiens
tctatcatgttgaagtcaaatt

SEQ ID NO: 332546 - DNA, 22 bp, Homo sapiens
tctatccaaagaacttgatttg

SEQ ID NO: 332547 - DNA, 12 bp, Homo sapiens
tctatctctcaa

SEQ ID NO: 332548 - DNA, 23 bp, Homo sapiens
tctatctgcaatgtttttgtgta

SEQ ID NO: 332549 - DNA, 12 bp, Homo sapiens
tctatctgggcc

SEQ ID NO: 332550 - DNA, 17 bp, Homo sapiens
tctatctgggcctgggc

SEQ ID NO: 332551 - DNA, 18 bp, Homo sapiens
tctatctgggcctgggct

SEQ ID NO: 332552 - DNA, 15 bp, Homo sapiens
tctatcttgcatcta

SEQ ID NO: 332553 - DNA, 21 bp, Homo sapiens
tctatcttgcatctacctgct

SEQ ID NO: 332554 - DNA, 14 bp, Homo sapiens
tctatgagcatctc

SEQ ID NO: 332555 - DNA, 22 bp, Homo sapiens
tctatgcaaaatgtctgtttta

SEQ ID NO: 332556 - DNA, 18 bp, Homo sapiens
tctatgcctgtatttcca

SEQ ID NO: 332557 - DNA, 14 bp, Homo sapiens
tctatggattcact

SEQ ID NO: 332558 - DNA, 19 bp, Homo sapiens
tctatggattcacttctat

SEQ ID NO: 332559 - DNA, 23 bp, Homo sapiens
tctatgggagattaaaaccagag

SEQ ID NO: 332560 - DNA, 13 bp, Homo sapiens
tctatggtaaaga

SEQ ID NO: 332561 - DNA, 17 bp, Homo sapiens
tctatggtaaagatatt

SEQ ID NO: 332562 - DNA, 18 bp, Homo sapiens
tctatgtaaattattgta

SEQ ID NO: 332563 - DNA, 23 bp, Homo sapiens
tctatgtaaattattgtaaactt

SEQ ID NO: 332564 - DNA, 14 bp, Homo sapiens
tctatgtagaactg

SEQ ID NO: 332565 - DNA, 15 bp, Homo sapiens
tctatgtagaactgt

SEQ ID NO: 332566 - DNA, 20 bp, Homo sapiens
tctatgtagaactgttcatt

SEQ ID NO: 332567 - DNA, 22 bp, Homo sapiens
tctatgtatgtgccaattttgt

SEQ ID NO: 332568 - DNA, 15 bp, Homo sapiens
tctatgtccaacaga

SEQ ID NO: 332569 - DNA, 16 bp, Homo sapiens
tctattacccctcatt

SEQ ID NO: 332570 - DNA, 19 bp, Homo sapiens
tctattacccctcatttaa

SEQ ID NO: 332571 - DNA, 15 bp, Homo sapiens
tctattatggaaata

SEQ ID NO: 332572 - DNA, 21 bp, Homo sapiens
tctattcccatcgctggaaaa

SEQ ID NO: 332573 - DNA, 15 bp, Homo sapiens
tctattccctggaat

SEQ ID NO: 332574 - DNA, 18 bp, Homo sapiens
tctattccttctggcctt

SEQ ID NO: 332575 - DNA, 16 bp, Homo sapiens
tctattctgagccttg

SEQ ID NO: 332576 - DNA, 15 bp, Homo sapiens
tctattgaaagtttt

SEQ ID NO: 332577 - DNA, 23 bp, Homo sapiens
tctattgcagttatagaaaatct

SEQ ID NO: 332578 - DNA, 16 bp, Homo sapiens
tctattgggttcatta

SEQ ID NO: 332579 - DNA, 17 bp, Homo sapiens
tctattgggttcattat

SEQ ID NO: 332580 - DNA, 22 bp, Homo sapiens
tctatttgtatatatacataac

SEQ ID NO: 332581 - DNA, 13 bp, Homo sapiens
tctattttacttt

SEQ ID NO: 332582 - DNA, 11 bp, Homo sapiens
tctattttcag

SEQ ID NO: 332583 - DNA, 14 bp, Homo sapiens
tctattttgatttt

SEQ ID NO: 332584 - DNA, 23 bp, Homo sapiens
tctcaaaaatacaaaataaaaac

SEQ ID NO: 332585 - DNA, 21 bp, Homo sapiens
tctcaaaagcatttatcattc

SEQ ID NO: 332586 - DNA, 21 bp, Homo sapiens
tctcaaaccctgtttacggta

SEQ ID NO: 332587 - DNA, 13 bp, Homo sapiens
tctcaaacctcca

SEQ ID NO: 332588 - DNA, 14 bp, Homo sapiens
tctcaaactcctga

SEQ ID NO: 332589 - DNA, 14 bp, Homo sapiens
tctcaaactggggc

SEQ ID NO: 332590 - DNA, 22 bp, Homo sapiens
tctcaaagtttcctaatcagaa

SEQ ID NO: 332591 - DNA, 20 bp, Homo sapiens
tctcaaagtttttacagtgt

SEQ ID NO: 332592 - DNA, 16 bp, Homo sapiens
tctcaaatgatacagt

SEQ ID NO: 332593 - DNA, 17 bp, Homo sapiens
tctcaagagggcactgg

SEQ ID NO: 332594 - DNA, 15 bp, Homo sapiens
tctcaagcactgaca

SEQ ID NO: 332595 - DNA, 20 bp, Homo sapiens
tctcaagcgctatccacaga

SEQ ID NO: 332596 - DNA, 20 bp, Homo sapiens
tctcaaggtgggccttgcta

SEQ ID NO: 332597 - DNA, 14 bp, Homo sapiens
tctcaatatataat

SEQ ID NO: 332598 - DNA, 21 bp, Homo sapiens
tctcaatatataataaatggg

SEQ ID NO: 332599 - DNA, 19 bp, Homo sapiens
tctcaatgtgcaataactt

SEQ ID NO: 332600 - DNA, 23 bp, Homo sapiens
tctcacaaataagtaatatcttt

SEQ ID NO: 332601 - DNA, 16 bp, Homo sapiens
tctcacagcacatgct

SEQ ID NO: 332602 - DNA, 21 bp, Homo sapiens
tctcaccagctcagccccggc

SEQ ID NO: 332603 - DNA, 15 bp, Homo sapiens
tctcaccccatccca

SEQ ID NO: 332604 - DNA, 19 bp, Homo sapiens
tctcacccccatccctggg

SEQ ID NO: 332605 - DNA, 18 bp, Homo sapiens
tctcacctacttcctcct

SEQ ID NO: 332606 - DNA, 13 bp, Homo sapiens
tctcacctctagg

SEQ ID NO: 332607 - DNA, 17 bp, Homo sapiens
tctcactaaactttacc

SEQ ID NO: 332608 - DNA, 16 bp, Homo sapiens
tctcactatgtttctc

SEQ ID NO: 332609 - DNA, 15 bp, Homo sapiens
tctcactccctttgt

SEQ ID NO: 332610 - DNA, 18 bp, Homo sapiens
tctcactcctacctggta

SEQ ID NO: 332611 - DNA, 22 bp, Homo sapiens
tctcactgagaagattgtgaat

SEQ ID NO: 332612 - DNA, 14 bp, Homo sapiens
tctcactgttccct

SEQ ID NO: 332613 - DNA, 21 bp, Homo sapiens
tctcactgttccctctgctcc

SEQ ID NO: 332614 - DNA, 20 bp, Homo sapiens
tctcacttttctccatgagt

SEQ ID NO: 332615 - DNA, 21 bp, Homo sapiens
tctcagaactgttggctgctc

SEQ ID NO: 332616 - DNA, 17 bp, Homo sapiens
tctcagaatctattcag

SEQ ID NO: 332617 - DNA, 20 bp, Homo sapiens
tctcagactggtctcgaact

SEQ ID NO: 332618 - DNA, 14 bp, Homo sapiens
tctcagagccaagt

SEQ ID NO: 332619 - DNA, 18 bp, Homo sapiens
tctcagataaagtgacca

SEQ ID NO: 332620 - DNA, 16 bp, Homo sapiens
tctcagatatttatat

SEQ ID NO: 332621 - DNA, 18 bp, Homo sapiens
tctcagcaagtgtacagt

SEQ ID NO: 332622 - DNA, 13 bp, Homo sapiens
tctcagcctccca

SEQ ID NO: 332623 - DNA, 13 bp, Homo sapiens
tctcagctccact

SEQ ID NO: 332624 - DNA, 15 bp, Homo sapiens
tctcagctccactct

SEQ ID NO: 332625 - DNA, 20 bp, Homo sapiens
tctcaggcatgcctgtgtga

SEQ ID NO: 332626 - DNA, 14 bp, Homo sapiens
tctcagtgctctcc

SEQ ID NO: 332627 - DNA, 19 bp, Homo sapiens
tctcataggaaaagtacat

SEQ ID NO: 332628 - DNA, 14 bp, Homo sapiens
tctcatccccaggg

SEQ ID NO: 332629 - DNA, 17 bp, Homo sapiens
gccactaggctgggtgc

SEQ ID NO: 332630 - DNA, 17 bp, Homo sapiens
gccactaggtgtcccca

SEQ ID NO: 332631 - DNA, 15 bp, Homo sapiens
gccaggctctccctc

SEQ ID NO: 332632 - DNA, 20 bp, Homo sapiens
gccaggctgcggtgggcagc

SEQ ID NO: 332633 - DNA, 22 bp, Homo sapiens
tctcatccccaggggtcccagc

SEQ ID NO: 332634 - DNA, 16 bp, Homo sapiens
tctcatgccagcagca

SEQ ID NO: 332635 - DNA, 19 bp, Homo sapiens
tctcatgccagcagcacgt

SEQ ID NO: 332636 - DNA, 21 bp, Homo sapiens
tctcatggagaagacttcttt

SEQ ID NO: 332637 - DNA, 14 bp, Homo sapiens
tctcatgtttgtgc

SEQ ID NO: 332638 - DNA, 18 bp, Homo sapiens
tctcatgtttgtgcatgt

SEQ ID NO: 332639 - DNA, 12 bp, Homo sapiens
tctcattcttgc

SEQ ID NO: 332640 - DNA, 22 bp, Homo sapiens
tctcattgatcacagatgtgcc

SEQ ID NO: 332641 - DNA, 20 bp, Homo sapiens
tctcattttgcttttctcta

SEQ ID NO: 332642 - DNA, 22 bp, Homo sapiens
tctcattttgtatgtatgtgta

SEQ ID NO: 332643 - DNA, 21 bp, Homo sapiens
tctccaaagctttcctggaga

SEQ ID NO: 332644 - DNA, 18 bp, Homo sapiens
tctccaaaggcactgacc

SEQ ID NO: 332645 - DNA, 19 bp, Homo sapiens
tctccaaaggggctgctgg

SEQ ID NO: 332646 - DNA, 18 bp, Homo sapiens
tctccaagtctctctgtg

SEQ ID NO: 332647 - DNA, 23 bp, Homo sapiens
tctccaagtctctctgtgaatac

SEQ ID NO: 332648 - DNA, 22 bp, Homo sapiens
tctccacagggacacagtctgg

SEQ ID NO: 332649 - DNA, 21 bp, Homo sapiens
tctccacccaaaccccttccc

SEQ ID NO: 332650 - DNA, 16 bp, Homo sapiens
tctccacccctcaagc

SEQ ID NO: 332651 - DNA, 23 bp, Homo sapiens
tctccacccctcaagccaggaga

SEQ ID NO: 332652 - DNA, 20 bp, Homo sapiens
tctccacctcccccaaaccc

SEQ ID NO: 332653 - DNA, 15 bp, Homo sapiens
tctccactcactgca

SEQ ID NO: 332654 - DNA, 16 bp, Homo sapiens
tctccactcactgcat

SEQ ID NO: 332655 - DNA, 13 bp, Homo sapiens
tctccactccaga

SEQ ID NO: 332656 - DNA, 14 bp, Homo sapiens
tctccacttctggt

SEQ ID NO: 332657 - DNA, 20 bp, Homo sapiens
tctccacttctggtcccctg

SEQ ID NO: 332658 - DNA, 22 bp, Homo sapiens
tctccacttctggtcccctgtg

SEQ ID NO: 332659 - DNA, 16 bp, Homo sapiens
tctccagaaccagtgt

SEQ ID NO: 332660 - DNA, 13 bp, Homo sapiens
tctccagaatgta

SEQ ID NO: 332661 - DNA, 15 bp, Homo sapiens
tctccagaatgtaag

SEQ ID NO: 332662 - DNA, 11 bp, Homo sapiens
tctccaggccc

SEQ ID NO: 332663 - DNA, 14 bp, Homo sapiens
tctccaggcccagc

SEQ ID NO: 332664 - DNA, 15 bp, Homo sapiens
tctccaggcccagcc

SEQ ID NO: 332665 - DNA, 16 bp, Homo sapiens
tctccaggcccagcct

SEQ ID NO: 332666 - DNA, 22 bp, Homo sapiens
tctccaggcccagcctggcccc

SEQ ID NO: 332667 - DNA, 19 bp, Homo sapiens
tctccaggccctcagatgg

SEQ ID NO: 332668 - DNA, 20 bp, Homo sapiens
tctccagggagcaagacaga

SEQ ID NO: 332669 - DNA, 21 bp, Homo sapiens
tctccagggagcaagacagag

SEQ ID NO: 332670 - DNA, 24 bp, Homo sapiens
tctccagggctgcccctgtaggtt

SEQ ID NO: 332671 - DNA, 17 bp, Homo sapiens
tctccagtatcctgctg

SEQ ID NO: 332672 - DNA, 18 bp, Homo sapiens
tctccataaggcagtggc

SEQ ID NO: 332673 - DNA, 17 bp, Homo sapiens
tctccatcagctgtaag

SEQ ID NO: 332674 - DNA, 14 bp, Homo sapiens
tctccatcatatgc

SEQ ID NO: 332675 - DNA, 13 bp, Homo sapiens
tctccatccccat

SEQ ID NO: 332676 - DNA, 23 bp, Homo sapiens
tctccatcccctccctgcctgct

SEQ ID NO: 332677 - DNA, 16 bp, Homo sapiens
tctccatggccctgcc

SEQ ID NO: 332678 - DNA, 19 bp, Homo sapiens
tctccatttttcccaggac

SEQ ID NO: 332679 - DNA, 12 bp, Homo sapiens
tctcccacactg

SEQ ID NO: 332680 - DNA, 17 bp, Homo sapiens
tctcccacatcccactg

SEQ ID NO: 332681 - DNA, 18 bp, Homo sapiens
tctcccacatcccactgg

SEQ ID NO: 332682 - DNA, 21 bp, Homo sapiens
tctcccaccccggcctccact

SEQ ID NO: 332683 - DNA, 22 bp, Homo sapiens
tctcccacccggccacagctgc

SEQ ID NO: 332684 - DNA, 17 bp, Homo sapiens
tctcccagaggctcctg

SEQ ID NO: 332685 - DNA, 19 bp, Homo sapiens
tctcccagaggctcctgga

SEQ ID NO: 332686 - DNA, 21 bp, Homo sapiens
tctcccagaggctcctggagc

SEQ ID NO: 332687 - DNA, 12 bp, Homo sapiens
tctcccaggccc

SEQ ID NO: 332688 - DNA, 21 bp, Homo sapiens
tctcccaggtggattttgtgg

SEQ ID NO: 332689 - DNA, 13 bp, Homo sapiens
tctcccatggggg

SEQ ID NO: 332690 - DNA, 22 bp, Homo sapiens
tctcccatgggggctccagaca

SEQ ID NO: 332691 - DNA, 13 bp, Homo sapiens
tctccccaaccct

SEQ ID NO: 332692 - DNA, 10 bp, Homo sapiens
tctccccaca

SEQ ID NO: 332693 - DNA, 12 bp, Homo sapiens
tctccccactga

SEQ ID NO: 332694 - DNA, 14 bp, Homo sapiens
tctccccaggcctc

SEQ ID NO: 332695 - DNA, 20 bp, Homo sapiens
tctccccaggcctccagcct

SEQ ID NO: 332696 - DNA, 11 bp, Homo sapiens
tctccccagtg

SEQ ID NO: 332697 - DNA, 12 bp, Homo sapiens
tctccccagtgc

SEQ ID NO: 332698 - DNA, 16 bp, Homo sapiens
tctccccagtgcctgc

SEQ ID NO: 332699 - DNA, 21 bp, Homo sapiens
tctccccagtgcctgccactc

SEQ ID NO: 332700 - DNA, 22 bp, Homo sapiens
tctccccatgtgcctgcaccag

SEQ ID NO: 332701 - DNA, 18 bp, Homo sapiens
tctcccccgacactgctg

SEQ ID NO: 332702 - DNA, 22 bp, Homo sapiens
tctccccgcagcccgcctgccg

SEQ ID NO: 332703 - DNA, 12 bp, Homo sapiens
tctccccgctct

SEQ ID NO: 332704 - DNA, 15 bp, Homo sapiens
tctcccctccagacc

SEQ ID NO: 332705 - DNA, 19 bp, Homo sapiens
tctccctaccctcttctca

SEQ ID NO: 332706 - DNA, 15 bp, Homo sapiens
tctccctccactcct

SEQ ID NO: 332707 - DNA, 16 bp, Homo sapiens
tctccctccactcctc

SEQ ID NO: 332708 - DNA, 12 bp, Homo sapiens
tctccctcccct

SEQ ID NO: 332709 - DNA, 13 bp, Homo sapiens
tctccctctctgc

SEQ ID NO: 332710 - DNA, 15 bp, Homo sapiens
tctccctcttctcaa

SEQ ID NO: 332711 - DNA, 22 bp, Homo sapiens
tctccctcttctcaagtgcctt

SEQ ID NO: 332712 - DNA, 20 bp, Homo sapiens
tctccctgagcctgccccag

SEQ ID NO: 332713 - DNA, 16 bp, Homo sapiens
tctccctgcctcacat

SEQ ID NO: 332714 - DNA, 18 bp, Homo sapiens
tctccctgcctcacatct

SEQ ID NO: 332715 - DNA, 13 bp, Homo sapiens
tctccctgcttca

SEQ ID NO: 332716 - DNA, 14 bp, Homo sapiens
tctccctggactct

SEQ ID NO: 332717 - DNA, 19 bp, Homo sapiens
tctccctggttttacccca

SEQ ID NO: 332718 - DNA, 23 bp, Homo sapiens
tctcccttggccacggcctggga

SEQ ID NO: 332719 - DNA, 16 bp, Homo sapiens
tctccggggtctgtgc

SEQ ID NO: 332720 - DNA, 17 bp, Homo sapiens
tctccggggtctgtgct

SEQ ID NO: 332721 - DNA, 20 bp, Homo sapiens
tctccggggtctgtgctgtg

SEQ ID NO: 332722 - DNA, 23 bp, Homo sapiens
tctccggggtctgtgctgtgcct

SEQ ID NO: 332723 - DNA, 13 bp, Homo sapiens
tctccgtcactcc

SEQ ID NO: 332724 - DNA, 19 bp, Homo sapiens
tctcctaagtttaattaca

SEQ ID NO: 332725 - DNA, 15 bp, Homo sapiens
tctcctaccccacct

SEQ ID NO: 332726 - DNA, 22 bp, Homo sapiens
tctcctaccccacctcatgcct

SEQ ID NO: 332727 - DNA, 23 bp, Homo sapiens
tctcctatcttttatttcattca

SEQ ID NO: 332728 - DNA, 19 bp, Homo sapiens
tctcctatgtggcagctgg

SEQ ID NO: 332729 - DNA, 13 bp, Homo sapiens
tctcctcacccca

SEQ ID NO: 332730 - DNA, 12 bp, Homo sapiens
tctcctcagggt

SEQ ID NO: 332731 - DNA, 14 bp, Homo sapiens
tctcctcatctcta

SEQ ID NO: 332732 - DNA, 15 bp, Homo sapiens
tctcctcatctctaa

SEQ ID NO: 332733 - DNA, 17 bp, Homo sapiens
tctcctccatactcagg

SEQ ID NO: 332734 - DNA, 18 bp, Homo sapiens
tctcctccatactcagga

SEQ ID NO: 332735 - DNA, 16 bp, Homo sapiens
tctcctcccatggcct

SEQ ID NO: 332736 - DNA, 11 bp, Homo sapiens
tctcctccctc

SEQ ID NO: 332737 - DNA, 15 bp, Homo sapiens
tctcctcctcccctc

SEQ ID NO: 332738 - DNA, 16 bp, Homo sapiens
tctcctcctcccctcc

SEQ ID NO: 332739 - DNA, 24 bp, Homo sapiens
tctcctcggtggcatttgctgaat

SEQ ID NO: 332740 - DNA, 15 bp, Homo sapiens
tctcctcgtccggcc

SEQ ID NO: 332741 - DNA, 18 bp, Homo sapiens
tctcctcgtccggcctgc

SEQ ID NO: 332742 - DNA, 12 bp, Homo sapiens
tctcctctcagc

SEQ ID NO: 332743 - DNA, 18 bp, Homo sapiens
tctcctctcccaaataaa

SEQ ID NO: 332744 - DNA, 12 bp, Homo sapiens
tctcctctctgg

SEQ ID NO: 332745 - DNA, 20 bp, Homo sapiens
tctcctctctgggcctttgt

SEQ ID NO: 332746 - DNA, 13 bp, Homo sapiens
tctcctctgtcag

SEQ ID NO: 332747 - DNA, 22 bp, Homo sapiens
tctcctcttgccactgcctctt

SEQ ID NO: 332748 - DNA, 16 bp, Homo sapiens
tctcctgacctcatga

SEQ ID NO: 332749 - DNA, 14 bp, Homo sapiens
tctcctgactttta

SEQ ID NO: 332750 - DNA, 18 bp, Homo sapiens
tctcctgatagtcacctg

SEQ ID NO: 332751 - DNA, 14 bp, Homo sapiens
tctcctgcccagat

SEQ ID NO: 332752 - DNA, 16 bp, Homo sapiens
tctcctgcctcagcct

SEQ ID NO: 332753 - DNA, 16 bp, Homo sapiens
tctcctgcttgtacta

SEQ ID NO: 332754 - DNA, 15 bp, Homo sapiens
tctcctgggcccctc

SEQ ID NO: 332755 - DNA, 20 bp, Homo sapiens
tctcctgggcccctccctac

SEQ ID NO: 332756 - DNA, 18 bp, Homo sapiens
tctcctggtagcatgacc

SEQ ID NO: 332757 - DNA, 19 bp, Homo sapiens
tctcctgtagccactggca

SEQ ID NO: 332758 - DNA, 18 bp, Homo sapiens
tctcctgtgagctcccca

SEQ ID NO: 332759 - DNA, 17 bp, Homo sapiens
tctcctgtgcatgggtg

SEQ ID NO: 332760 - DNA, 16 bp, Homo sapiens
tctcctgtgcccacat

SEQ ID NO: 332761 - DNA, 12 bp, Homo sapiens
aaggcctgggtg

SEQ ID NO: 332762 - DNA, 17 bp, Homo sapiens
aaggcctgtgctgcatg

SEQ ID NO: 332763 - DNA, 12 bp, Homo sapiens
aaggccttctcc

SEQ ID NO: 332764 - DNA, 13 bp, Homo sapiens
aaggccttgctgt

SEQ ID NO: 332765 - DNA, 14 bp, Homo sapiens
aaggcctttgggat

SEQ ID NO: 332766 - DNA, 23 bp, Homo sapiens
aaggccttttgcccgttgaggta

SEQ ID NO: 332767 - DNA, 16 bp, Homo sapiens
aaggctaaaacttaac

SEQ ID NO: 332768 - DNA, 22 bp, Homo sapiens
aaggctaaagaagacacacagc

SEQ ID NO: 332769 - DNA, 15 bp, Homo sapiens
aaggctactcacctt

SEQ ID NO: 332770 - DNA, 18 bp, Homo sapiens
aaggctgaaaagtgcttt

SEQ ID NO: 332771 - DNA, 14 bp, Homo sapiens
gccaggctgggcac

SEQ ID NO: 332772 - DNA, 13 bp, Homo sapiens
gccagggagcccg

SEQ ID NO: 332773 - DNA, 19 bp, Homo sapiens
gccagggatggggccacag

SEQ ID NO: 332774 - DNA, 15 bp, Homo sapiens
gccagggcagtgcta

SEQ ID NO: 332775 - DNA, 15 bp, Homo sapiens
gccagggctccacgg

SEQ ID NO: 332776 - DNA, 14 bp, Homo sapiens
gccagggctctggc

SEQ ID NO: 332777 - DNA, 17 bp, Homo sapiens
gccagggtagacttgga

SEQ ID NO: 332778 - DNA, 20 bp, Homo sapiens
gccagggtggtcttgatctc

SEQ ID NO: 332779 - DNA, 13 bp, Homo sapiens
gccagggttccag

SEQ ID NO: 332780 - DNA, 16 bp, Homo sapiens
gccagggttccagaca

SEQ ID NO: 332781 - DNA, 15 bp, Homo sapiens
gccaggtaatgtgaa

SEQ ID NO: 332782 - DNA, 22 bp, Homo sapiens
gccaggtcaccctttgctgtga

SEQ ID NO: 332783 - DNA, 22 bp, Homo sapiens
gccaggtccctggaccagcctc

SEQ ID NO: 332784 - DNA, 13 bp, Homo sapiens
gccaggtggctca

SEQ ID NO: 332785 - DNA, 14 bp, Homo sapiens
gccaggttgcagct

SEQ ID NO: 332786 - DNA, 18 bp, Homo sapiens
gccaggttgcagctgctc

SEQ ID NO: 332787 - DNA, 19 bp, Homo sapiens
gccaggttgcagctgctct

SEQ ID NO: 332788 - DNA, 15 bp, Homo sapiens
gccagtaaaagtata

SEQ ID NO: 332789 - DNA, 18 bp, Homo sapiens
gccagtatataagctgtt

SEQ ID NO: 332790 - DNA, 17 bp, Homo sapiens
gccagtcctgcctggcc

SEQ ID NO: 332791 - DNA, 13 bp, Homo sapiens
gccagtctgggct

SEQ ID NO: 332792 - DNA, 17 bp, Homo sapiens
gccagtctgggctgccg

SEQ ID NO: 332793 - DNA, 18 bp, Homo sapiens
gccagtcttgcctaggcc

SEQ ID NO: 332794 - DNA, 23 bp, Homo sapiens
gccagtcttgcctaggccaaatg

SEQ ID NO: 332795 - DNA, 16 bp, Homo sapiens
gccagtgaagtccttc

SEQ ID NO: 332796 - DNA, 13 bp, Homo sapiens
gccagtgactcca

SEQ ID NO: 332797 - DNA, 18 bp, Homo sapiens
gccagtgactccaggaga

SEQ ID NO: 332798 - DNA, 20 bp, Homo sapiens
gccagtggacagagggagaa

SEQ ID NO: 332799 - DNA, 16 bp, Homo sapiens
gccatagagtttaaca

SEQ ID NO: 332800 - DNA, 16 bp, Homo sapiens
gccatattcacacctc

SEQ ID NO: 332801 - DNA, 14 bp, Homo sapiens
gccatattccagca

SEQ ID NO: 332802 - DNA, 14 bp, Homo sapiens
gccatcagcccctg

SEQ ID NO: 332803 - DNA, 20 bp, Homo sapiens
gccatccaaataagaaacct

SEQ ID NO: 332804 - DNA, 19 bp, Homo sapiens
gccatccacattttaacag

SEQ ID NO: 332805 - DNA, 22 bp, Homo sapiens
gccatccggcccccagagcgcc

SEQ ID NO: 332806 - DNA, 18 bp, Homo sapiens
gccatccgtcaccagaat

SEQ ID NO: 332807 - DNA, 17 bp, Homo sapiens
gccatcggtcctgtctc

SEQ ID NO: 332808 - DNA, 18 bp, Homo sapiens
gccatcggtcctgtctcc

SEQ ID NO: 332809 - DNA, 20 bp, Homo sapiens
gccatctgtacatattactg

SEQ ID NO: 332810 - DNA, 18 bp, Homo sapiens
gccatctgtgtcctggtt

SEQ ID NO: 332811 - DNA, 19 bp, Homo sapiens
gccatcttcccgcctcagc

SEQ ID NO: 332812 - DNA, 21 bp, Homo sapiens
gccatcttcccgcctcagcct

SEQ ID NO: 332813 - DNA, 22 bp, Homo sapiens
gccatcttcccgcctcagcctc

SEQ ID NO: 332814 - DNA, 14 bp, Homo sapiens
gccatgagctccag

SEQ ID NO: 332815 - DNA, 18 bp, Homo sapiens
gccatgagctccagaccc

SEQ ID NO: 332816 - DNA, 19 bp, Homo sapiens
gccatgagctccagacccc

SEQ ID NO: 332817 - DNA, 23 bp, Homo sapiens
gccatgagctccagacccccagc

SEQ ID NO: 332818 - DNA, 19 bp, Homo sapiens
gccatgaggcctcagtgga

SEQ ID NO: 332819 - DNA, 20 bp, Homo sapiens
gccatgaggcctcagtggac

SEQ ID NO: 332820 - DNA, 20 bp, Homo sapiens
gccatgatgtcgttcatttt

SEQ ID NO: 332821 - DNA, 20 bp, Homo sapiens
gccatgattcgcccaaagcc

SEQ ID NO: 332822 - DNA, 19 bp, Homo sapiens
gccatgcaactccatgcct

SEQ ID NO: 332823 - DNA, 12 bp, Homo sapiens
gccatgccactg

SEQ ID NO: 332824 - DNA, 13 bp, Homo sapiens
gccatgccactgc

SEQ ID NO: 332825 - DNA, 17 bp, Homo sapiens
gccatgcctcatgccac

SEQ ID NO: 332826 - DNA, 19 bp, Homo sapiens
gccatgctcaacccccctc

SEQ ID NO: 332827 - DNA, 14 bp, Homo sapiens
gccatgctgctatg

SEQ ID NO: 332828 - DNA, 20 bp, Homo sapiens
gccatgctgctatgaagact

SEQ ID NO: 332829 - DNA, 17 bp, Homo sapiens
gccatggccaaggggcc

SEQ ID NO: 332830 - DNA, 18 bp, Homo sapiens
gccatggccaaggggcca

SEQ ID NO: 332831 - DNA, 15 bp, Homo sapiens
gccatggctcaggca

SEQ ID NO: 332832 - DNA, 17 bp, Homo sapiens
gccatggctcaggcaag

SEQ ID NO: 332833 - DNA, 22 bp, Homo sapiens
gccatggctcaggcaagcccct

SEQ ID NO: 332834 - DNA, 23 bp, Homo sapiens
gccatggctcaggcaagcccctc

SEQ ID NO: 332835 - DNA, 16 bp, Homo sapiens
gccatggctttcatcc

SEQ ID NO: 332836 - DNA, 18 bp, Homo sapiens
gccatgggccctctgagc

SEQ ID NO: 332837 - DNA, 15 bp, Homo sapiens
gccatgggcctgctg

SEQ ID NO: 332838 - DNA, 14 bp, Homo sapiens
gccatgggcctggg

SEQ ID NO: 332839 - DNA, 15 bp, Homo sapiens
gccatgggcctgggc

SEQ ID NO: 332840 - DNA, 16 bp, Homo sapiens
gccatgggcctgggcc

SEQ ID NO: 332841 - DNA, 20 bp, Homo sapiens
gccatgggcctgggcctgct

SEQ ID NO: 332842 - DNA, 18 bp, Homo sapiens
gccatgggggcccctcgg

SEQ ID NO: 332843 - DNA, 16 bp, Homo sapiens
gccatgtctacaaaag

SEQ ID NO: 332844 - DNA, 17 bp, Homo sapiens
gccatgtgaagagggag

SEQ ID NO: 332845 - DNA, 18 bp, Homo sapiens
gccatgtgagccaccgct

SEQ ID NO: 332846 - DNA, 21 bp, Homo sapiens
gccatgtggcagaagtgctct

SEQ ID NO: 332847 - DNA, 16 bp, Homo sapiens
gccattcctgttctct

SEQ ID NO: 332848 - DNA, 18 bp, Homo sapiens
gccattgccaccaggaga

SEQ ID NO: 332849 - DNA, 19 bp, Homo sapiens
gccattgccaccaggagaa

SEQ ID NO: 332850 - DNA, 16 bp, Homo sapiens
gccattggcttcaaga

SEQ ID NO: 332851 - DNA, 17 bp, Homo sapiens
gccattgtactccagcc

SEQ ID NO: 332852 - DNA, 20 bp, Homo sapiens
gccattgtactccagcctgg

SEQ ID NO: 332853 - DNA, 18 bp, Homo sapiens
gccattgtgtatgatttt

SEQ ID NO: 332854 - DNA, 22 bp, Homo sapiens
gccatttcattgagggaaaaca

SEQ ID NO: 332855 - DNA, 16 bp, Homo sapiens
gccatttcttcccaag

SEQ ID NO: 332856 - DNA, 18 bp, Homo sapiens
gccattttgtctggctgt

SEQ ID NO: 332857 - DNA, 18 bp, Homo sapiens
gcccaaagctggagccaa

SEQ ID NO: 332858 - DNA, 13 bp, Homo sapiens
gcccaaagtgggg

SEQ ID NO: 332859 - DNA, 15 bp, Homo sapiens
gcccaaagtggggag

SEQ ID NO: 332860 - DNA, 16 bp, Homo sapiens
gcccaaagtggggagg

SEQ ID NO: 332861 - DNA, 21 bp, Homo sapiens
gcccaaccaggaggggtctgc

SEQ ID NO: 332862 - DNA, 13 bp, Homo sapiens
gcccaacccccac

SEQ ID NO: 332863 - DNA, 15 bp, Homo sapiens
gcccaacccccacct

SEQ ID NO: 332864 - DNA, 16 bp, Homo sapiens
gcccaacccccacctc

SEQ ID NO: 332865 - DNA, 23 bp, Homo sapiens
gcccaaccggggagcccccgccc

SEQ ID NO: 332866 - DNA, 17 bp, Homo sapiens
gcccaacctcagcaacc

SEQ ID NO: 332867 - DNA, 14 bp, Homo sapiens
gcccaacctgctct

SEQ ID NO: 332868 - DNA, 12 bp, Homo sapiens
gcccaactccca

SEQ ID NO: 332869 - DNA, 13 bp, Homo sapiens
gcccaactcccag

SEQ ID NO: 332870 - DNA, 14 bp, Homo sapiens
gcccaactcccagc

SEQ ID NO: 332871 - DNA, 17 bp, Homo sapiens
gcccaactcccagccac

SEQ ID NO: 332872 - DNA, 21 bp, Homo sapiens
gcccaagaatagatgctgact

SEQ ID NO: 332873 - DNA, 19 bp, Homo sapiens
gcccaagacagatgcccca

SEQ ID NO: 332874 - DNA, 21 bp, Homo sapiens
gcccaagacagatgccccaga

SEQ ID NO: 332875 - DNA, 17 bp, Homo sapiens
gcccaagagcagagtct

SEQ ID NO: 332876 - DNA, 21 bp, Homo sapiens
gcccaagagcagagtctgggc

SEQ ID NO: 332877 - DNA, 22 bp, Homo sapiens
gcccaagagcagagtctgggcc

SEQ ID NO: 332878 - DNA, 20 bp, Homo sapiens
gcccaatgctttgggaggcc

SEQ ID NO: 332879 - DNA, 14 bp, Homo sapiens
gcccacaccaccgc

SEQ ID NO: 332880 - DNA, 21 bp, Homo sapiens
gcccacaccaccgccctcctc

SEQ ID NO: 332881 - DNA, 23 bp, Homo sapiens
gcccacacccgacaccagccctg

SEQ ID NO: 332882 - DNA, 17 bp, Homo sapiens
gcccacacctgcctctg

SEQ ID NO: 332883 - DNA, 12 bp, Homo sapiens
gcccacagagga

SEQ ID NO: 332884 - DNA, 14 bp, Homo sapiens
gcccacagcccgca

SEQ ID NO: 332885 - DNA, 24 bp, Homo sapiens
gcccacaggaggcaagcaagctct

SEQ ID NO: 332886 - DNA, 23 bp, Homo sapiens
gcccacaggtgtccccagcccac

SEQ ID NO: 332887 - DNA, 20 bp, Homo sapiens
gcccacatagtgatggttcc

SEQ ID NO: 332888 - DNA, 15 bp, Homo sapiens
gcccacatccagtgg

SEQ ID NO: 332889 - DNA, 16 bp, Homo sapiens
gcccacatccagtggg

SEQ ID NO: 332890 - DNA, 17 bp, Homo sapiens
gcccacatggccgggcc

SEQ ID NO: 332891 - DNA, 18 bp, Homo sapiens
aagtaccaatgctgttgt

SEQ ID NO: 332892 - DNA, 16 bp, Homo sapiens
aagtactaaaactaga

SEQ ID NO: 332893 - DNA, 17 bp, Homo sapiens
aagtacttccctcaggc

SEQ ID NO: 332894 - DNA, 15 bp, Homo sapiens
aagtagaataaaaac

SEQ ID NO: 332895 - DNA, 23 bp, Homo sapiens
aagtagacttcatttttcctaac

SEQ ID NO: 332896 - DNA, 12 bp, Homo sapiens
aagtagagaagt

SEQ ID NO: 332897 - DNA, 22 bp, Homo sapiens
aagtagattgatctaaggcatg

SEQ ID NO: 332898 - DNA, 18 bp, Homo sapiens
aagtagcaggcccagctg

SEQ ID NO: 332899 - DNA, 20 bp, Homo sapiens
aagtaggtatacaaaagact

SEQ ID NO: 332900 - DNA, 12 bp, Homo sapiens
aagtagtttgta

SEQ ID NO: 332901 - DNA, 15 bp, Homo sapiens
aagtatacttatatt

SEQ ID NO: 332902 - DNA, 22 bp, Homo sapiens
aagtatataatttttttatgtt

SEQ ID NO: 332903 - DNA, 16 bp, Homo sapiens
aagtatatatagaatc

SEQ ID NO: 332904 - DNA, 12 bp, Homo sapiens
aagtatcatgca

SEQ ID NO: 332905 - DNA, 16 bp, Homo sapiens
aagtatccaattatgt

SEQ ID NO: 332906 - DNA, 13 bp, Homo sapiens
aagtatgtaaaca

SEQ ID NO: 332907 - DNA, 12 bp, Homo sapiens
aagtatgtaaag

SEQ ID NO: 332908 - DNA, 17 bp, Homo sapiens
aagtatgtgatatctga

SEQ ID NO: 332909 - DNA, 15 bp, Homo sapiens
tctccttccaactgc

SEQ ID NO: 332910 - DNA, 16 bp, Homo sapiens
tctccttccaactgct

SEQ ID NO: 332911 - DNA, 11 bp, Homo sapiens
tctccttcccc

SEQ ID NO: 332912 - DNA, 22 bp, Homo sapiens
tctccttcccccagcccaataa

SEQ ID NO: 332913 - DNA, 15 bp, Homo sapiens
tctccttgccctggg

SEQ ID NO: 332914 - DNA, 21 bp, Homo sapiens
tctccttgggctcctggctgc

SEQ ID NO: 332915 - DNA, 22 bp, Homo sapiens
tctccttgggctcctggctgcc

SEQ ID NO: 332916 - DNA, 14 bp, Homo sapiens
tctcctttaaagag

SEQ ID NO: 332917 - DNA, 13 bp, Homo sapiens
tctcctttgatat

SEQ ID NO: 332918 - DNA, 21 bp, Homo sapiens
tctcctttgcactgagggcca

SEQ ID NO: 332919 - DNA, 21 bp, Homo sapiens
tctcgaagtcttccatcagca

SEQ ID NO: 332920 - DNA, 16 bp, Homo sapiens
tctcgctcccctctgc

SEQ ID NO: 332921 - DNA, 21 bp, Homo sapiens
tctcggacctttcagctgtga

SEQ ID NO: 332922 - DNA, 17 bp, Homo sapiens
tctcgtagatgctgcct

SEQ ID NO: 332923 - DNA, 22 bp, Homo sapiens
tctcgtgattgataagaacctt

SEQ ID NO: 332924 - DNA, 20 bp, Homo sapiens
tctcgtggtagaagccagta

SEQ ID NO: 332925 - DNA, 13 bp, Homo sapiens
tctcgttggtagt

SEQ ID NO: 332926 - DNA, 17 bp, Homo sapiens
tctctaaaaataaaatg

SEQ ID NO: 332927 - DNA, 19 bp, Homo sapiens
tctctaaaaataaaatgat

SEQ ID NO: 332928 - DNA, 15 bp, Homo sapiens
tctctaatcgaaaga

SEQ ID NO: 332929 - DNA, 15 bp, Homo sapiens
tctctactaaaaata

SEQ ID NO: 332930 - DNA, 18 bp, Homo sapiens
tctctactcatgccagat

SEQ ID NO: 332931 - DNA, 23 bp, Homo sapiens
tctctactggtaggaagaggtac

SEQ ID NO: 332932 - DNA, 13 bp, Homo sapiens
tctctcaaaatgt

SEQ ID NO: 332933 - DNA, 16 bp, Homo sapiens
tctctcaaaatgtgcc

SEQ ID NO: 332934 - DNA, 13 bp, Homo sapiens
tctctcacctact

SEQ ID NO: 332935 - DNA, 16 bp, Homo sapiens
tctctcacctagacct

SEQ ID NO: 332936 - DNA, 22 bp, Homo sapiens
tctctcaggagcacaggcagct

SEQ ID NO: 332937 - DNA, 13 bp, Homo sapiens
tctctccaggatc

SEQ ID NO: 332938 - DNA, 11 bp, Homo sapiens
tctctccatct

SEQ ID NO: 332939 - DNA, 21 bp, Homo sapiens
tctctcccacacaagcagtct

SEQ ID NO: 332940 - DNA, 19 bp, Homo sapiens
tctctcccaccccggcctc

SEQ ID NO: 332941 - DNA, 21 bp, Homo sapiens
tctctcccaccccggcctcca

SEQ ID NO: 332942 - DNA, 19 bp, Homo sapiens
tctctccccatatataaat

SEQ ID NO: 332943 - DNA, 21 bp, Homo sapiens
tctctccccttttccttcaga

SEQ ID NO: 332944 - DNA, 18 bp, Homo sapiens
tctctccctaccctcttc

SEQ ID NO: 332945 - DNA, 14 bp, Homo sapiens
tctctcccttcctc

SEQ ID NO: 332946 - DNA, 18 bp, Homo sapiens
tctctcggttccacgtcc

SEQ ID NO: 332947 - DNA, 23 bp, Homo sapiens
tctctcggttccacgtccccctg

SEQ ID NO: 332948 - DNA, 17 bp, Homo sapiens
tctctctatatatacat

SEQ ID NO: 332949 - DNA, 19 bp, Homo sapiens
tctctctatatatacatgt

SEQ ID NO: 332950 - DNA, 11 bp, Homo sapiens
tctctctcacc

SEQ ID NO: 332951 - DNA, 12 bp, Homo sapiens
tctctctccctc

SEQ ID NO: 332952 - DNA, 15 bp, Homo sapiens
tctctctccctccac

SEQ ID NO: 332953 - DNA, 16 bp, Homo sapiens
tctctctccctccact

SEQ ID NO: 332954 - DNA, 13 bp, Homo sapiens
tctctctctctgt

SEQ ID NO: 332955 - DNA, 11 bp, Homo sapiens
tctctctctgt

SEQ ID NO: 332956 - DNA, 13 bp, Homo sapiens
tctctctctgttc

SEQ ID NO: 332957 - DNA, 14 bp, Homo sapiens
tctctctctgttcc

SEQ ID NO: 332958 - DNA, 14 bp, Homo sapiens
tctctctctgttgt

SEQ ID NO: 332959 - DNA, 13 bp, Homo sapiens
tctctctgtgaat

SEQ ID NO: 332960 - DNA, 23 bp, Homo sapiens
tctctctgtgaatacaattaaag

SEQ ID NO: 332961 - DNA, 18 bp, Homo sapiens
tctctctgtgtggcaaac

SEQ ID NO: 332962 - DNA, 10 bp, Homo sapiens
tctctctgtt

SEQ ID NO: 332963 - DNA, 13 bp, Homo sapiens
tctctcttaccct

SEQ ID NO: 332964 - DNA, 13 bp, Homo sapiens
tctctcttggtct

SEQ ID NO: 332965 - DNA, 23 bp, Homo sapiens
tctctctttttcttttctatgga

SEQ ID NO: 332966 - DNA, 13 bp, Homo sapiens
tctctgaagatga

SEQ ID NO: 332967 - DNA, 12 bp, Homo sapiens
tctctgaagcat

SEQ ID NO: 332968 - DNA, 13 bp, Homo sapiens
tctctgaagcatg

SEQ ID NO: 332969 - DNA, 21 bp, Homo sapiens
tctctgaagcatgtttcatgt

SEQ ID NO: 332970 - DNA, 14 bp, Homo sapiens
tctctgaatcctaa

SEQ ID NO: 332971 - DNA, 22 bp, Homo sapiens
tctctgagatgcccctctgcct

SEQ ID NO: 332972 - DNA, 16 bp, Homo sapiens
tctctgagcagtgggg

SEQ ID NO: 332973 - DNA, 22 bp, Homo sapiens
tctctgattaaatttaatatac

SEQ ID NO: 332974 - DNA, 14 bp, Homo sapiens
tctctgatttgcaa

SEQ ID NO: 332975 - DNA, 21 bp, Homo sapiens
tctctgcaatttgtttaaaga

SEQ ID NO: 332976 - DNA, 23 bp, Homo sapiens
tctctgcaatttgtttaaagaat

SEQ ID NO: 332977 - DNA, 12 bp, Homo sapiens
tctctgccaccc

SEQ ID NO: 332978 - DNA, 15 bp, Homo sapiens
tctctgccacccact

SEQ ID NO: 332979 - DNA, 13 bp, Homo sapiens
tctctgccagctc

SEQ ID NO: 332980 - DNA, 19 bp, Homo sapiens
tctctgccagctccacagg

SEQ ID NO: 332981 - DNA, 13 bp, Homo sapiens
tctctgcctttga

SEQ ID NO: 332982 - DNA, 15 bp, Homo sapiens
tctctgctctagcca

SEQ ID NO: 332983 - DNA, 14 bp, Homo sapiens
tctctgctgcttct

SEQ ID NO: 332984 - DNA, 17 bp, Homo sapiens
tctctgctgcttctggg

SEQ ID NO: 332985 - DNA, 19 bp, Homo sapiens
tctctgctggcccagccaa

SEQ ID NO: 332986 - DNA, 23 bp, Homo sapiens
tctctgctgggtttccacacagc

SEQ ID NO: 332987 - DNA, 13 bp, Homo sapiens
tctctgcttccat

SEQ ID NO: 332988 - DNA, 14 bp, Homo sapiens
tctctgcttccatg

SEQ ID NO: 332989 - DNA, 18 bp, Homo sapiens
tctctgcttgagtcaggt

SEQ ID NO: 332990 - DNA, 16 bp, Homo sapiens
tctctggaaaggagga

SEQ ID NO: 332991 - DNA, 22 bp, Homo sapiens
tctctggaaaggggggagctgg

SEQ ID NO: 332992 - DNA, 14 bp, Homo sapiens
tctctggagtgtgt

SEQ ID NO: 332993 - DNA, 17 bp, Homo sapiens
tctctgggacctcctta

SEQ ID NO: 332994 - DNA, 16 bp, Homo sapiens
tctctgggactctcct

SEQ ID NO: 332995 - DNA, 23 bp, Homo sapiens
tctctgggactctcctcctcccc

SEQ ID NO: 332996 - DNA, 24 bp, Homo sapiens
tctctgggtaggtgttgaaaatga

SEQ ID NO: 332997 - DNA, 22 bp, Homo sapiens
tctctggttgccaaatactcat

SEQ ID NO: 332998 - DNA, 18 bp, Homo sapiens
tctctgtagggaactctg

SEQ ID NO: 332999 - DNA, 14 bp, Homo sapiens
tctctgtccagggc

SEQ ID NO: 333000 - DNA, 16 bp, Homo sapiens
tctctgtccagggctt

SEQ ID NO: 333001 - DNA, 17 bp, Homo sapiens
tctctgtcgtggacacg

SEQ ID NO: 333002 - DNA, 19 bp, Homo sapiens
tctctgtctttttccttcc

SEQ ID NO: 333003 - DNA, 23 bp, Homo sapiens
tctctgtgaacgatttagaaaga

SEQ ID NO: 333004 - DNA, 22 bp, Homo sapiens
tctctgtgaatacaattaaagg

SEQ ID NO: 333005 - DNA, 13 bp, Homo sapiens
tctctgtgctctg

SEQ ID NO: 333006 - DNA, 13 bp, Homo sapiens
tctctgtgtggca

SEQ ID NO: 333007 - DNA, 20 bp, Homo sapiens
tctctgtgtttgttcctaca

SEQ ID NO: 333008 - DNA, 12 bp, Homo sapiens
tctctgttccaa

SEQ ID NO: 333009 - DNA, 21 bp, Homo sapiens
tctcttacccttctgtgccca

SEQ ID NO: 333010 - DNA, 19 bp, Homo sapiens
tctcttacgctctctgtct

SEQ ID NO: 333011 - DNA, 13 bp, Homo sapiens
tctcttagaaata

SEQ ID NO: 333012 - DNA, 18 bp, Homo sapiens
tctcttatagaatattta

SEQ ID NO: 333013 - DNA, 16 bp, Homo sapiens
tctcttcaatctctgg

SEQ ID NO: 333014 - DNA, 23 bp, Homo sapiens
tctcttcaggttcttagtgtcac

SEQ ID NO: 333015 - DNA, 13 bp, Homo sapiens
tctcttcagtgtg

SEQ ID NO: 333016 - DNA, 19 bp, Homo sapiens
tctcttcagtgtgttgact

SEQ ID NO: 333017 - DNA, 16 bp, Homo sapiens
tctcttcattcccact

SEQ ID NO: 333018 - DNA, 18 bp, Homo sapiens
tctcttccagcccagaca

SEQ ID NO: 333019 - DNA, 14 bp, Homo sapiens
tctcttccgggagc

SEQ ID NO: 333020 - DNA, 19 bp, Homo sapiens
tctcttccttgctttctct

SEQ ID NO: 333021 - DNA, 13 bp, Homo sapiens
tctcttcgctgtg

SEQ ID NO: 333022 - DNA, 16 bp, Homo sapiens
tctgcaaatagaaaac

SEQ ID NO: 333023 - DNA, 21 bp, Homo sapiens
tctgcaaatagaaaacaggaa

SEQ ID NO: 333024 - DNA, 14 bp, Homo sapiens
tctgcaacagcctg

SEQ ID NO: 333025 - DNA, 22 bp, Homo sapiens
tctgcaacatggattccaaagc

SEQ ID NO: 333026 - DNA, 14 bp, Homo sapiens
tctgcaagcccact

SEQ ID NO: 333027 - DNA, 15 bp, Homo sapiens
tctgcaagcccactg

SEQ ID NO: 333028 - DNA, 18 bp, Homo sapiens
tctgcaatgtttttgtgt

SEQ ID NO: 333029 - DNA, 20 bp, Homo sapiens
tctgcaatttgtttaaagaa

SEQ ID NO: 333030 - DNA, 15 bp, Homo sapiens
tctgcacacataaca

SEQ ID NO: 333031 - DNA, 19 bp, Homo sapiens
tctgcacacataacacaca

SEQ ID NO: 333032 - DNA, 20 bp, Homo sapiens
tctgcacacataacacacat

SEQ ID NO: 333033 - DNA, 13 bp, Homo sapiens
tctgcacattaga

SEQ ID NO: 333034 - DNA, 24 bp, Homo sapiens
tctgcaccctggggcctggacctg

SEQ ID NO: 333035 - DNA, 21 bp, Homo sapiens
tctgcaccgacgcctgccccc

SEQ ID NO: 333036 - DNA, 22 bp, Homo sapiens
tctgcacctatgtagctctgca

SEQ ID NO: 333037 - DNA, 14 bp, Homo sapiens
tctgcacctgtctc

SEQ ID NO: 333038 - DNA, 20 bp, Homo sapiens
tctgcactactcctctgcag

SEQ ID NO: 333039 - DNA, 23 bp, Homo sapiens
tctgcactactcctctgcagtgc

SEQ ID NO: 333040 - DNA, 18 bp, Homo sapiens
tctgcactactgacatgt

SEQ ID NO: 333041 - DNA, 19 bp, Homo sapiens
tctgcactccatggccacc

SEQ ID NO: 333042 - DNA, 13 bp, Homo sapiens
tctgcagaggcag

SEQ ID NO: 333043 - DNA, 16 bp, Homo sapiens
tctgcagaggcagcag

SEQ ID NO: 333044 - DNA, 19 bp, Homo sapiens
tctgcagaggcagcaggag

SEQ ID NO: 333045 - DNA, 20 bp, Homo sapiens
tctgcagcccacagaggaca

SEQ ID NO: 333046 - DNA, 23 bp, Homo sapiens
tctgcagcccggcgccaccatcc

SEQ ID NO: 333047 - DNA, 20 bp, Homo sapiens
gcccacccgccccagagact

SEQ ID NO: 333048 - DNA, 10 bp, Homo sapiens
gcccaccctg

SEQ ID NO: 333049 - DNA, 23 bp, Homo sapiens
gcccaccctgctcctcctgccct

SEQ ID NO: 333050 - DNA, 15 bp, Homo sapiens
gcccaccctgctgcc

SEQ ID NO: 333051 - DNA, 15 bp, Homo sapiens
gcccaccctgggcct

SEQ ID NO: 333052 - DNA, 16 bp, Homo sapiens
gcccacctcctccagc

SEQ ID NO: 333053 - DNA, 19 bp, Homo sapiens
gcccacctctgctgcccac

SEQ ID NO: 333054 - DNA, 9 bp, Homo sapiens
gcccacctg

SEQ ID NO: 333055 - DNA, 20 bp, Homo sapiens
gcccacctgaaagcctgtct

SEQ ID NO: 333056 - DNA, 14 bp, Homo sapiens
gcccacctgcatca

SEQ ID NO: 333057 - DNA, 12 bp, Homo sapiens
gcccacctgccc

SEQ ID NO: 333058 - DNA, 15 bp, Homo sapiens
gcccacctgcccatc

SEQ ID NO: 333059 - DNA, 12 bp, Homo sapiens
gcccacctgggc

SEQ ID NO: 333060 - DNA, 22 bp, Homo sapiens
gcccacctgggccctaggcata

SEQ ID NO: 333061 - DNA, 13 bp, Homo sapiens
gcccacctgggct

SEQ ID NO: 333062 - DNA, 19 bp, Homo sapiens
gcccacgcagagccccgga

SEQ ID NO: 333063 - DNA, 15 bp, Homo sapiens
gcccacggctaagag

SEQ ID NO: 333064 - DNA, 23 bp, Homo sapiens
gcccacggctaagaggctgctga

SEQ ID NO: 333065 - DNA, 13 bp, Homo sapiens
gcccactggatca

SEQ ID NO: 333066 - DNA, 16 bp, Homo sapiens
gcccactgtcctgggc

SEQ ID NO: 333067 - DNA, 13 bp, Homo sapiens
gcccacttcaggg

SEQ ID NO: 333068 - DNA, 23 bp, Homo sapiens
gcccacttgtatcctctggttct

SEQ ID NO: 333069 - DNA, 17 bp, Homo sapiens
gcccagaacgggcctcc

SEQ ID NO: 333070 - DNA, 18 bp, Homo sapiens
gcccagaactgcccccac

SEQ ID NO: 333071 - DNA, 19 bp, Homo sapiens
gcccagaactgcccccact

SEQ ID NO: 333072 - DNA, 17 bp, Homo sapiens
gcccagacccccagtgt

SEQ ID NO: 333073 - DNA, 21 bp, Homo sapiens
gcccagacccctctggccagg

SEQ ID NO: 333074 - DNA, 15 bp, Homo sapiens
gcccagactacaggg

SEQ ID NO: 333075 - DNA, 19 bp, Homo sapiens
gcccagagagaccctgcca

SEQ ID NO: 333076 - DNA, 20 bp, Homo sapiens
gcccagagagaggcgtcctg

SEQ ID NO: 333077 - DNA, 11 bp, Homo sapiens
gcccagagagc

SEQ ID NO: 333078 - DNA, 17 bp, Homo sapiens
gcccagaggagccaagt

SEQ ID NO: 333079 - DNA, 19 bp, Homo sapiens
gcccagaggggcggggcca

SEQ ID NO: 333080 - DNA, 22 bp, Homo sapiens
gcccagaggggcggggccagga

SEQ ID NO: 333081 - DNA, 17 bp, Homo sapiens
gcccagagtagcccagg

SEQ ID NO: 333082 - DNA, 19 bp, Homo sapiens
gcccagcaaggaccagtga

SEQ ID NO: 333083 - DNA, 14 bp, Homo sapiens
gcccagcagagccg

SEQ ID NO: 333084 - DNA, 22 bp, Homo sapiens
gcccagcagagccgttcctggg

SEQ ID NO: 333085 - DNA, 23 bp, Homo sapiens
gcccagcagagccgttcctggga

SEQ ID NO: 333086 - DNA, 18 bp, Homo sapiens
gcccagcagcggcccaga

SEQ ID NO: 333087 - DNA, 15 bp, Homo sapiens
gcccagcagcttggc

SEQ ID NO: 333088 - DNA, 12 bp, Homo sapiens
gcccagccagca

SEQ ID NO: 333089 - DNA, 22 bp, Homo sapiens
gcccagccatgggccctctgag

SEQ ID NO: 333090 - DNA, 15 bp, Homo sapiens
gcccagccctgttct

SEQ ID NO: 333091 - DNA, 16 bp, Homo sapiens
gcccagccctgttctg

SEQ ID NO: 333092 - DNA, 14 bp, Homo sapiens
gcccagcctaggcc

SEQ ID NO: 333093 - DNA, 14 bp, Homo sapiens
gcccagcctggagc

SEQ ID NO: 333094 - DNA, 11 bp, Homo sapiens
gcccagcctgt

SEQ ID NO: 333095 - DNA, 18 bp, Homo sapiens
gcccagcggcccctccca

SEQ ID NO: 333096 - DNA, 16 bp, Homo sapiens
gcccagctacattcct

SEQ ID NO: 333097 - DNA, 12 bp, Homo sapiens
gcccagctcagt

SEQ ID NO: 333098 - DNA, 14 bp, Homo sapiens
gcccagctcagtct

SEQ ID NO: 333099 - DNA, 21 bp, Homo sapiens
gcccagctccactcagggctg

SEQ ID NO: 333100 - DNA, 11 bp, Homo sapiens
gcccagctctg

SEQ ID NO: 333101 - DNA, 11 bp, Homo sapiens
gcccagctgct

SEQ ID NO: 333102 - DNA, 14 bp, Homo sapiens
gcccagctgctctg

SEQ ID NO: 333103 - DNA, 15 bp, Homo sapiens
gcccagctgggctct

SEQ ID NO: 333104 - DNA, 19 bp, Homo sapiens
gcccagctgggctctgcca

SEQ ID NO: 333105 - DNA, 20 bp, Homo sapiens
gcccagctggggcccctcgg

SEQ ID NO: 333106 - DNA, 23 bp, Homo sapiens
gcccagctggggcccctcggcta

SEQ ID NO: 333107 - DNA, 13 bp, Homo sapiens
gcccagcttcctg

SEQ ID NO: 333108 - DNA, 13 bp, Homo sapiens
gcccagcttgggc

SEQ ID NO: 333109 - DNA, 18 bp, Homo sapiens
gcccagcttgggcccagc

SEQ ID NO: 333110 - DNA, 21 bp, Homo sapiens
gcccagcttgggcccagctgg

SEQ ID NO: 333111 - DNA, 18 bp, Homo sapiens
gcccaggaaaaacctgtg

SEQ ID NO: 333112 - DNA, 20 bp, Homo sapiens
gcccaggaaaaacctgtggg

SEQ ID NO: 333113 - DNA, 19 bp, Homo sapiens
gcccaggagagcccccacc

SEQ ID NO: 333114 - DNA, 15 bp, Homo sapiens
gcccaggaggacctg

SEQ ID NO: 333115 - DNA, 24 bp, Homo sapiens
gcccaggatatttctgagagtgaa

SEQ ID NO: 333116 - DNA, 20 bp, Homo sapiens
gcccaggcagcacctggagc

SEQ ID NO: 333117 - DNA, 13 bp, Homo sapiens
gcccaggccggcc

SEQ ID NO: 333118 - DNA, 18 bp, Homo sapiens
gcccaggccggccagcct

SEQ ID NO: 333119 - DNA, 22 bp, Homo sapiens
gcccaggccgttccccttggct

SEQ ID NO: 333120 - DNA, 17 bp, Homo sapiens
gcccaggcctgcctgtt

SEQ ID NO: 333121 - DNA, 13 bp, Homo sapiens
gcccaggcctgga

SEQ ID NO: 333122 - DNA, 17 bp, Homo sapiens
gcccaggcctggcctcg

SEQ ID NO: 333123 - DNA, 14 bp, Homo sapiens
gcccaggctctgct

SEQ ID NO: 333124 - DNA, 20 bp, Homo sapiens
gcccaggctggagggcagtg

SEQ ID NO: 333125 - DNA, 19 bp, Homo sapiens
gcccaggctggagtgcagt

SEQ ID NO: 333126 - DNA, 20 bp, Homo sapiens
gcccaggctggagtgcagtg

SEQ ID NO: 333127 - DNA, 19 bp, Homo sapiens
gcccagggagaggccatga

SEQ ID NO: 333128 - DNA, 15 bp, Homo sapiens
gcccagggtcctgtg

SEQ ID NO: 333129 - DNA, 16 bp, Homo sapiens
gcccagggtcctgtgc

SEQ ID NO: 333130 - DNA, 18 bp, Homo sapiens
gcccagggtcctgtgcct

SEQ ID NO: 333131 - DNA, 18 bp, Homo sapiens
gcccaggtcccagtgcca

SEQ ID NO: 333132 - DNA, 23 bp, Homo sapiens
gcccagtcatgacatttctcaaa

SEQ ID NO: 333133 - DNA, 17 bp, Homo sapiens
gcccagtccctggagct

SEQ ID NO: 333134 - DNA, 18 bp, Homo sapiens
gcccagtccctggagctg

SEQ ID NO: 333135 - DNA, 18 bp, Homo sapiens
gcccagtcctctcccaag

SEQ ID NO: 333136 - DNA, 23 bp, Homo sapiens
gcccagtcctctcccaagtccac

SEQ ID NO: 333137 - DNA, 14 bp, Homo sapiens
gcccagtcttgagt

SEQ ID NO: 333138 - DNA, 23 bp, Homo sapiens
gcccagtgttgtttgtaaataag

SEQ ID NO: 333139 - DNA, 13 bp, Homo sapiens
gcccagttagccc

SEQ ID NO: 333140 - DNA, 15 bp, Homo sapiens
gcccagttagcccgg

SEQ ID NO: 333141 - DNA, 16 bp, Homo sapiens
gcccagttagcccggc

SEQ ID NO: 333142 - DNA, 20 bp, Homo sapiens
gcccagttagcccggccaag

SEQ ID NO: 333143 - DNA, 19 bp, Homo sapiens
gcccataatagttagccct

SEQ ID NO: 333144 - DNA, 17 bp, Homo sapiens
gcccatcacagggttgg

SEQ ID NO: 333145 - DNA, 21 bp, Homo sapiens
gcccatcactcggctgtggag

SEQ ID NO: 333146 - DNA, 17 bp, Homo sapiens
gcccatcatctctgcct

SEQ ID NO: 333147 - DNA, 18 bp, Homo sapiens
gcccatcatctctgcctt

SEQ ID NO: 333148 - DNA, 22 bp, Homo sapiens
gcccatcatctctgcctttgag

SEQ ID NO: 333149 - DNA, 23 bp, Homo sapiens
gcccatctcagcctcctgagcct

SEQ ID NO: 333150 - DNA, 16 bp, Homo sapiens
gcccatctcaggtgcc

SEQ ID NO: 333151 - DNA, 16 bp, Homo sapiens
gcccatcttgcctcca

SEQ ID NO: 333152 - DNA, 14 bp, Homo sapiens
tctgctggcctgga

SEQ ID NO: 333153 - DNA, 16 bp, Homo sapiens
tctgctggcctggatc

SEQ ID NO: 333154 - DNA, 15 bp, Homo sapiens
tctgctgggtttcca

SEQ ID NO: 333155 - DNA, 21 bp, Homo sapiens
tctgctgggtttccacacagc

SEQ ID NO: 333156 - DNA, 15 bp, Homo sapiens
tctgctggtcttcaa

SEQ ID NO: 333157 - DNA, 12 bp, Homo sapiens
tctgctgttgcc

SEQ ID NO: 333158 - DNA, 18 bp, Homo sapiens
tctgctgttgccatagcc

SEQ ID NO: 333159 - DNA, 19 bp, Homo sapiens
tctgctgttgccatagccc

SEQ ID NO: 333160 - DNA, 21 bp, Homo sapiens
tctgctgttgccatagcccca

SEQ ID NO: 333161 - DNA, 17 bp, Homo sapiens
tctgcttacaattccct

SEQ ID NO: 333162 - DNA, 21 bp, Homo sapiens
tctgcttacaattccctgctg

SEQ ID NO: 333163 - DNA, 23 bp, Homo sapiens
tctgcttacaattccctgctgtc

SEQ ID NO: 333164 - DNA, 14 bp, Homo sapiens
tctgcttaccaaaa

SEQ ID NO: 333165 - DNA, 17 bp, Homo sapiens
tctgcttaggagagacc

SEQ ID NO: 333166 - DNA, 13 bp, Homo sapiens
tctgcttcagtgg

SEQ ID NO: 333167 - DNA, 24 bp, Homo sapiens
tctgcttcatttcctctgagctgt

SEQ ID NO: 333168 - DNA, 13 bp, Homo sapiens
tctgcttctctca

SEQ ID NO: 333169 - DNA, 20 bp, Homo sapiens
tctgctttcttgccacacag

SEQ ID NO: 333170 - DNA, 18 bp, Homo sapiens
tctgctttgactgagcag

SEQ ID NO: 333171 - DNA, 21 bp, Homo sapiens
tctgctttgactgagcagact

SEQ ID NO: 333172 - DNA, 15 bp, Homo sapiens
tctggaaaactcagg

SEQ ID NO: 333173 - DNA, 19 bp, Homo sapiens
tctggaaaagaactgttta

SEQ ID NO: 333174 - DNA, 14 bp, Homo sapiens
tctggaaagagctg

SEQ ID NO: 333175 - DNA, 14 bp, Homo sapiens
tctggaaaggagga

SEQ ID NO: 333176 - DNA, 13 bp, Homo sapiens
tctggaaagggca

SEQ ID NO: 333177 - DNA, 19 bp, Homo sapiens
tctggaaattcttccctgg

SEQ ID NO: 333178 - DNA, 21 bp, Homo sapiens
tctggaaattcttccctgggg

SEQ ID NO: 333179 - DNA, 18 bp, Homo sapiens
tctggaagacgtggctct

SEQ ID NO: 333180 - DNA, 19 bp, Homo sapiens
tctggaagacgtggctctg

SEQ ID NO: 333181 - DNA, 19 bp, Homo sapiens
tctggaataaggagaatga

SEQ ID NO: 333182 - DNA, 21 bp, Homo sapiens
tctggacaagccaacttgtaa

SEQ ID NO: 333183 - DNA, 23 bp, Homo sapiens
tctggacaagccaacttgtaaat

SEQ ID NO: 333184 - DNA, 13 bp, Homo sapiens
tctggacctcccc

SEQ ID NO: 333185 - DNA, 22 bp, Homo sapiens
aagtattaggggtaatatattg

SEQ ID NO: 333186 - DNA, 16 bp, Homo sapiens
aagtattccaccttaa

SEQ ID NO: 333187 - DNA, 17 bp, Homo sapiens
aagtattccaccttaaa

SEQ ID NO: 333188 - DNA, 18 bp, Homo sapiens
aagtattccaccttaaat

SEQ ID NO: 333189 - DNA, 19 bp, Homo sapiens
aagtattccaccttaaatt

SEQ ID NO: 333190 - DNA, 15 bp, Homo sapiens
aagtattccttggcc

SEQ ID NO: 333191 - DNA, 19 bp, Homo sapiens
aagtattccttggcccagc

SEQ ID NO: 333192 - DNA, 13 bp, Homo sapiens
aagtatttaaatg

SEQ ID NO: 333193 - DNA, 21 bp, Homo sapiens
aagtatttaaatgttctaaca

SEQ ID NO: 333194 - DNA, 16 bp, Homo sapiens
aagtatttatatattt

SEQ ID NO: 333195 - DNA, 18 bp, Homo sapiens
aagtatttatatatttat

SEQ ID NO: 333196 - DNA, 14 bp, Homo sapiens
aagtatttttgtct

SEQ ID NO: 333197 - DNA, 16 bp, Homo sapiens
aagtcaaacagtgtgg

SEQ ID NO: 333198 - DNA, 16 bp, Homo sapiens
aagtcaacactcttct

SEQ ID NO: 333199 - DNA, 17 bp, Homo sapiens
aagtcaacactcttctt

SEQ ID NO: 333200 - DNA, 22 bp, Homo sapiens
aagtcaatcatttctcactgtg

SEQ ID NO: 333201 - DNA, 12 bp, Homo sapiens
aagtcacagctg

SEQ ID NO: 333202 - DNA, 19 bp, Homo sapiens
aagtcacagctgcagctgg

SEQ ID NO: 333203 - DNA, 22 bp, Homo sapiens
aagtcacagctgcagctgggcc

SEQ ID NO: 333204 - DNA, 20 bp, Homo sapiens
aagtcactaaatttctcagt

SEQ ID NO: 333205 - DNA, 22 bp, Homo sapiens
aagtcactaaatttctcagttt

SEQ ID NO: 333206 - DNA, 12 bp, Homo sapiens
aagtcactgcac

SEQ ID NO: 333207 - DNA, 18 bp, Homo sapiens
aagtcagagaaaacactt

SEQ ID NO: 333208 - DNA, 19 bp, Homo sapiens
aagtcagagaaaacacttt

SEQ ID NO: 333209 - DNA, 20 bp, Homo sapiens
aagtcagctttcagagccag

SEQ ID NO: 333210 - DNA, 12 bp, Homo sapiens
aagtcaggagcc

SEQ ID NO: 333211 - DNA, 13 bp, Homo sapiens
aagtcaggagcca

SEQ ID NO: 333212 - DNA, 18 bp, Homo sapiens
aagtcagttggagaaaat

SEQ ID NO: 333213 - DNA, 13 bp, Homo sapiens
aagtcatcataaa

SEQ ID NO: 333214 - DNA, 23 bp, Homo sapiens
aagtcatctttgagataatttaa

SEQ ID NO: 333215 - DNA, 17 bp, Homo sapiens
aagtcatggagaatctg

SEQ ID NO: 333216 - DNA, 17 bp, Homo sapiens
aagtcatgggaacgcag

SEQ ID NO: 333217 - DNA, 20 bp, Homo sapiens
aagtcatgggaacgcagcct

SEQ ID NO: 333218 - DNA, 20 bp, Homo sapiens
aagtcattgtcgctcagcaa

SEQ ID NO: 333219 - DNA, 12 bp, Homo sapiens
aagtccaaagtc

SEQ ID NO: 333220 - DNA, 18 bp, Homo sapiens
aagtccaccccaattaac

SEQ ID NO: 333221 - DNA, 17 bp, Homo sapiens
aagtccacctgcctatc

SEQ ID NO: 333222 - DNA, 20 bp, Homo sapiens
aagtccatagctgagctgga

SEQ ID NO: 333223 - DNA, 19 bp, Homo sapiens
aagtcccgaggcagcaaca

SEQ ID NO: 333224 - DNA, 17 bp, Homo sapiens
aagtccctgccccctcc

SEQ ID NO: 333225 - DNA, 18 bp, Homo sapiens
aagtcccttcctgtcctg

SEQ ID NO: 333226 - DNA, 19 bp, Homo sapiens
aagtcctccctcctgcagg

SEQ ID NO: 333227 - DNA, 15 bp, Homo sapiens
aagtcctgcctttgg

SEQ ID NO: 333228 - DNA, 20 bp, Homo sapiens
aagtccttagaatgagggaa

SEQ ID NO: 333229 - DNA, 20 bp, Homo sapiens
aagtcgggaaattctgctgc

SEQ ID NO: 333230 - DNA, 11 bp, Homo sapiens
aagtctaaagt

SEQ ID NO: 333231 - DNA, 14 bp, Homo sapiens
aagtctaaagttta

SEQ ID NO: 333232 - DNA, 15 bp, Homo sapiens
aagtctaaagtttac

SEQ ID NO: 333233 - DNA, 19 bp, Homo sapiens
aagtctaaagtttacagta

SEQ ID NO: 333234 - DNA, 20 bp, Homo sapiens
aagtctaaagtttacagtaa

SEQ ID NO: 333235 - DNA, 16 bp, Homo sapiens
aagtctaaatatttcc

SEQ ID NO: 333236 - DNA, 13 bp, Homo sapiens
aagtctatgctta

SEQ ID NO: 333237 - DNA, 23 bp, Homo sapiens
aagtctatttttttaactgaaaa

SEQ ID NO: 333238 - DNA, 15 bp, Homo sapiens
aagtctcaaagatct

SEQ ID NO: 333239 - DNA, 21 bp, Homo sapiens
aagtctccaagaatacagaaa

SEQ ID NO: 333240 - DNA, 15 bp, Homo sapiens
aagtctcctgtatca

SEQ ID NO: 333241 - DNA, 18 bp, Homo sapiens
aagtctctctgtgaatac

SEQ ID NO: 333242 - DNA, 21 bp, Homo sapiens
aagtctctgctggcccagcca

SEQ ID NO: 333243 - DNA, 19 bp, Homo sapiens
aagtctctttttcttcctc

SEQ ID NO: 333244 - DNA, 20 bp, Homo sapiens
aagtctgcttaccaaaacat

SEQ ID NO: 333245 - DNA, 17 bp, Homo sapiens
aagtctgggatgtagaa

SEQ ID NO: 333246 - DNA, 18 bp, Homo sapiens
aagtctgggatgtagaac

SEQ ID NO: 333247 - DNA, 18 bp, Homo sapiens
aagtctgtgcctggagct

SEQ ID NO: 333248 - DNA, 22 bp, Homo sapiens
aagtctgtgtgatgaactttct

SEQ ID NO: 333249 - DNA, 15 bp, Homo sapiens
aagtcttactgtttt

SEQ ID NO: 333250 - DNA, 22 bp, Homo sapiens
aagtcttcaagggctgcttcaa

SEQ ID NO: 333251 - DNA, 13 bp, Homo sapiens
aagtcttgctgtg

SEQ ID NO: 333252 - DNA, 20 bp, Homo sapiens
aagtcttgtgactagtgctg

SEQ ID NO: 333253 - DNA, 21 bp, Homo sapiens
aagtcttgtgactagtgctga

SEQ ID NO: 333254 - DNA, 14 bp, Homo sapiens
aagtcttttctgtc

SEQ ID NO: 333255 - DNA, 22 bp, Homo sapiens
aagtcttttctgtcaccaaatt

SEQ ID NO: 333256 - DNA, 15 bp, Homo sapiens
aagtgaaagacattt

SEQ ID NO: 333257 - DNA, 16 bp, Homo sapiens
aagtgaataaaaatta

SEQ ID NO: 333258 - DNA, 16 bp, Homo sapiens
aagtgaatctaataaa

SEQ ID NO: 333259 - DNA, 20 bp, Homo sapiens
aagtgaatttgaatgaaaaa

SEQ ID NO: 333260 - DNA, 18 bp, Homo sapiens
aagtgacaaggccccaga

SEQ ID NO: 333261 - DNA, 20 bp, Homo sapiens
aagtgactaccacttatttc

SEQ ID NO: 333262 - DNA, 13 bp, Homo sapiens
aagtgactaccag

SEQ ID NO: 333263 - DNA, 21 bp, Homo sapiens
aagtgacttgaatgtacaaag

SEQ ID NO: 333264 - DNA, 20 bp, Homo sapiens
aagtgagatgggaagggctt

SEQ ID NO: 333265 - DNA, 20 bp, Homo sapiens
aagtgaggcaagagaaatga

SEQ ID NO: 333266 - DNA, 14 bp, Homo sapiens
aagtgaggcctggg

SEQ ID NO: 333267 - DNA, 17 bp, Homo sapiens
aagtgagggctttttaa

SEQ ID NO: 333268 - DNA, 17 bp, Homo sapiens
aagtgagtggcatgtgg

SEQ ID NO: 333269 - DNA, 14 bp, Homo sapiens
aagtgatcaataaa

SEQ ID NO: 333270 - DNA, 14 bp, Homo sapiens
aagtgatgtgattt

SEQ ID NO: 333271 - DNA, 19 bp, Homo sapiens
aagtgatgtgatttatgca

SEQ ID NO: 333272 - DNA, 22 bp, Homo sapiens
aagtgatgtgatttatgcattt

SEQ ID NO: 333273 - DNA, 14 bp, Homo sapiens
aagtgattgaaaat

SEQ ID NO: 333274 - DNA, 21 bp, Homo sapiens
aagtgattgacaactgaagag

SEQ ID NO: 333275 - DNA, 15 bp, Homo sapiens
aagtgattgacattt

SEQ ID NO: 333276 - DNA, 14 bp, Homo sapiens
aagtgatttataaa

SEQ ID NO: 333277 - DNA, 22 bp, Homo sapiens
aagtgatttgggggtgcaatga

SEQ ID NO: 333278 - DNA, 14 bp, Homo sapiens
aagtgatttgtaat

SEQ ID NO: 333279 - DNA, 20 bp, Homo sapiens
aagtgatttgtaatatgatt

SEQ ID NO: 333280 - DNA, 21 bp, Homo sapiens
aagtgcaattgcacaaataca

SEQ ID NO: 333281 - DNA, 17 bp, Homo sapiens
aagtgcagcccttcctc

SEQ ID NO: 333282 - DNA, 22 bp, Homo sapiens
tctggtatgaacttgaggacac

SEQ ID NO: 333283 - DNA, 23 bp, Homo sapiens
tctggtcagtgaagcccaggagg

SEQ ID NO: 333284 - DNA, 13 bp, Homo sapiens
tctggtcccttgc

SEQ ID NO: 333285 - DNA, 11 bp, Homo sapiens
tctggtccttc

SEQ ID NO: 333286 - DNA, 20 bp, Homo sapiens
tctggtgccaatcctgtagg

SEQ ID NO: 333287 - DNA, 13 bp, Homo sapiens
tctggtggcccca

SEQ ID NO: 333288 - DNA, 23 bp, Homo sapiens
tctggtggggtgtgttccaactg

SEQ ID NO: 333289 - DNA, 16 bp, Homo sapiens
tctggtggtttaatac

SEQ ID NO: 333290 - DNA, 17 bp, Homo sapiens
tctggttagctcagccc

SEQ ID NO: 333291 - DNA, 18 bp, Homo sapiens
tctggttagctcagcccc

SEQ ID NO: 333292 - DNA, 15 bp, Homo sapiens
tctggttgtatttct

SEQ ID NO: 333293 - DNA, 17 bp, Homo sapiens
tctggttgtatttctat

SEQ ID NO: 333294 - DNA, 13 bp, Homo sapiens
tctggttttaaca

SEQ ID NO: 333295 - DNA, 23 bp, Homo sapiens
tctgtaaaaaagaaaaacaagtt

SEQ ID NO: 333296 - DNA, 18 bp, Homo sapiens
tctgtaaaaagcaggtga

SEQ ID NO: 333297 - DNA, 23 bp, Homo sapiens
tctgtaaatatcccagagaacaa

SEQ ID NO: 333298 - DNA, 15 bp, Homo sapiens
tctgtaaatttaact

SEQ ID NO: 333299 - DNA, 16 bp, Homo sapiens
tctgtaaatttaactg

SEQ ID NO: 333300 - DNA, 22 bp, Homo sapiens
tctgtaaccacctctctgtctt

SEQ ID NO: 333301 - DNA, 20 bp, Homo sapiens
tctgtaatatattgccagta

SEQ ID NO: 333302 - DNA, 23 bp, Homo sapiens
tctgtaatatattgccagtatat

SEQ ID NO: 333303 - DNA, 23 bp, Homo sapiens
tctgtaatcacactctcttctta

SEQ ID NO: 333304 - DNA, 20 bp, Homo sapiens
tctgtaatggaactgacccc

SEQ ID NO: 333305 - DNA, 16 bp, Homo sapiens
tctgtaccatttattt

SEQ ID NO: 333306 - DNA, 21 bp, Homo sapiens
tctgtactccttggatttgca

SEQ ID NO: 333307 - DNA, 18 bp, Homo sapiens
tctgtagaatgctgtaga

SEQ ID NO: 333308 - DNA, 21 bp, Homo sapiens
tctgtagaatgctgtagaatc

SEQ ID NO: 333309 - DNA, 14 bp, Homo sapiens
tctgtagaatttag

SEQ ID NO: 333310 - DNA, 14 bp, Homo sapiens
tctgtagacttctg

SEQ ID NO: 333311 - DNA, 22 bp, Homo sapiens
tctgtagacttctggttgtatt

SEQ ID NO: 333312 - DNA, 13 bp, Homo sapiens
tctgtagaggagc

SEQ ID NO: 333313 - DNA, 15 bp, Homo sapiens
tctgtagctccctcc

SEQ ID NO: 333314 - DNA, 17 bp, Homo sapiens
tctgtagctccctcctc

SEQ ID NO: 333315 - DNA, 18 bp, Homo sapiens
tctgtagctccctcctcc

SEQ ID NO: 333316 - DNA, 19 bp, Homo sapiens
tctgtagctccctcctccc

SEQ ID NO: 333317 - DNA, 14 bp, Homo sapiens
tctgtagctcctca

SEQ ID NO: 333318 - DNA, 17 bp, Homo sapiens
tctgtagggctggacct

SEQ ID NO: 333319 - DNA, 19 bp, Homo sapiens
tctgtagtactccttaaga

SEQ ID NO: 333320 - DNA, 23 bp, Homo sapiens
tctgtagtactccttaagaacac

SEQ ID NO: 333321 - DNA, 22 bp, Homo sapiens
tctgtataaaatgcaaaataaa

SEQ ID NO: 333322 - DNA, 13 bp, Homo sapiens
gccccacaggcca

SEQ ID NO: 333323 - DNA, 19 bp, Homo sapiens
gccccacccctaagtgccc

SEQ ID NO: 333324 - DNA, 20 bp, Homo sapiens
gccccaccctcgtggacacc

SEQ ID NO: 333325 - DNA, 23 bp, Homo sapiens
gccccacctacttgtgactgaag

SEQ ID NO: 333326 - DNA, 14 bp, Homo sapiens
gccccacctgagcc

SEQ ID NO: 333327 - DNA, 15 bp, Homo sapiens
gccccacctgccact

SEQ ID NO: 333328 - DNA, 17 bp, Homo sapiens
gccccacctgccactag

SEQ ID NO: 333329 - DNA, 18 bp, Homo sapiens
gccccacttcacccccaa

SEQ ID NO: 333330 - DNA, 18 bp, Homo sapiens
gccccagaaatgccgctg

SEQ ID NO: 333331 - DNA, 23 bp, Homo sapiens
gccccagaaatgccgctgtgtcc

SEQ ID NO: 333332 - DNA, 23 bp, Homo sapiens
gccccagagaagcctcagtccct

SEQ ID NO: 333333 - DNA, 13 bp, Homo sapiens
gccccagagactg

SEQ ID NO: 333334 - DNA, 17 bp, Homo sapiens
gccccagagactgccca

SEQ ID NO: 333335 - DNA, 21 bp, Homo sapiens
gccccagagactgcccaccct

SEQ ID NO: 333336 - DNA, 23 bp, Homo sapiens
gccccagagactgcccaccctgg

SEQ ID NO: 333337 - DNA, 12 bp, Homo sapiens
gccccagagccc

SEQ ID NO: 333338 - DNA, 11 bp, Homo sapiens
gccccagagct

SEQ ID NO: 333339 - DNA, 12 bp, Homo sapiens
gccccagagctc

SEQ ID NO: 333340 - DNA, 14 bp, Homo sapiens
gccccagagctgtt

SEQ ID NO: 333341 - DNA, 22 bp, Homo sapiens
gccccagagctgtttatggcct

SEQ ID NO: 333342 - DNA, 23 bp, Homo sapiens
gccccagagctgtttatggcctc

SEQ ID NO: 333343 - DNA, 20 bp, Homo sapiens
gccccagataccagcccctg

SEQ ID NO: 333344 - DNA, 15 bp, Homo sapiens
gccccagatctgcct

SEQ ID NO: 333345 - DNA, 16 bp, Homo sapiens
gccccagatctgcctg

SEQ ID NO: 333346 - DNA, 22 bp, Homo sapiens
gccccagatctgcctgggcctg

SEQ ID NO: 333347 - DNA, 23 bp, Homo sapiens
gccccagatctgcctgggcctgt

SEQ ID NO: 333348 - DNA, 21 bp, Homo sapiens
gccccagatgcctcctctgtc

SEQ ID NO: 333349 - DNA, 21 bp, Homo sapiens
gccccagcaagagcacaagag

SEQ ID NO: 333350 - DNA, 12 bp, Homo sapiens
gccccagccagc

SEQ ID NO: 333351 - DNA, 14 bp, Homo sapiens
gccccagctggctg

SEQ ID NO: 333352 - DNA, 15 bp, Homo sapiens
gccccaggcaggctg

SEQ ID NO: 333353 - DNA, 20 bp, Homo sapiens
gccccaggcaggctgtgcgc

SEQ ID NO: 333354 - DNA, 12 bp, Homo sapiens
gccccaggcctg

SEQ ID NO: 333355 - DNA, 17 bp, Homo sapiens
gccccaggcggaggggc

SEQ ID NO: 333356 - DNA, 17 bp, Homo sapiens
gccccaggctcccctgg

SEQ ID NO: 333357 - DNA, 12 bp, Homo sapiens
gccccagggccc

SEQ ID NO: 333358 - DNA, 21 bp, Homo sapiens
gccccagggccctgctcaggc

SEQ ID NO: 333359 - DNA, 17 bp, Homo sapiens
gccccagggtcttccct

SEQ ID NO: 333360 - DNA, 21 bp, Homo sapiens
gccccagggtcttccctacct

SEQ ID NO: 333361 - DNA, 12 bp, Homo sapiens
gccccagggtga

SEQ ID NO: 333362 - DNA, 23 bp, Homo sapiens
gccccagggtgagcagggccctc

SEQ ID NO: 333363 - DNA, 15 bp, Homo sapiens
gccccaggtgccacc

SEQ ID NO: 333364 - DNA, 19 bp, Homo sapiens
gccccaggtgccaccaata

SEQ ID NO: 333365 - DNA, 20 bp, Homo sapiens
gccccaggtgccaccaataa

SEQ ID NO: 333366 - DNA, 18 bp, Homo sapiens
gccccagtcctggttcag

SEQ ID NO: 333367 - DNA, 18 bp, Homo sapiens
gccccagttcaatctccc

SEQ ID NO: 333368 - DNA, 19 bp, Homo sapiens
gccccatcagcagcttgac

SEQ ID NO: 333369 - DNA, 20 bp, Homo sapiens
gccccatccagcatgtgtgt

SEQ ID NO: 333370 - DNA, 22 bp, Homo sapiens
gccccatccagcatgtgtgtgt

SEQ ID NO: 333371 - DNA, 19 bp, Homo sapiens
gccccatccctgcttgccc

SEQ ID NO: 333372 - DNA, 13 bp, Homo sapiens
gccccatctcctc

SEQ ID NO: 333373 - DNA, 22 bp, Homo sapiens
gccccatctcctcccatggcct

SEQ ID NO: 333374 - DNA, 14 bp, Homo sapiens
gccccatgcctgtc

SEQ ID NO: 333375 - DNA, 23 bp, Homo sapiens
gccccatgcctgtccagcctggg

SEQ ID NO: 333376 - DNA, 18 bp, Homo sapiens
gccccatgctctgcccca

SEQ ID NO: 333377 - DNA, 20 bp, Homo sapiens
gccccatgctctgccccaag

SEQ ID NO: 333378 - DNA, 23 bp, Homo sapiens
gccccattcagaactctcagact

SEQ ID NO: 333379 - DNA, 15 bp, Homo sapiens
gccccattctccctc

SEQ ID NO: 333380 - DNA, 23 bp, Homo sapiens
gcccccaactccgcccagcctct

SEQ ID NO: 333381 - DNA, 23 bp, Homo sapiens
gcccccacaatggtcccaaacag

SEQ ID NO: 333382 - DNA, 15 bp, Homo sapiens
gcccccaccagcagc

SEQ ID NO: 333383 - DNA, 16 bp, Homo sapiens
gcccccacctgcctga

SEQ ID NO: 333384 - DNA, 16 bp, Homo sapiens
gcccccagaaagcctc

SEQ ID NO: 333385 - DNA, 19 bp, Homo sapiens
gcccccagaaagcctcctg

SEQ ID NO: 333386 - DNA, 17 bp, Homo sapiens
gcccccagatagagctg

SEQ ID NO: 333387 - DNA, 21 bp, Homo sapiens
gcccccagatagagctgggtg

SEQ ID NO: 333388 - DNA, 18 bp, Homo sapiens
gcccccagctgtgggtac

SEQ ID NO: 333389 - DNA, 16 bp, Homo sapiens
gcccccaggctgctgg

SEQ ID NO: 333390 - DNA, 23 bp, Homo sapiens
gcccccagtgtgcacgagtggga

SEQ ID NO: 333391 - DNA, 14 bp, Homo sapiens
gcccccatccctcg

SEQ ID NO: 333392 - DNA, 16 bp, Homo sapiens
gcccccatctccccag

SEQ ID NO: 333393 - DNA, 20 bp, Homo sapiens
gcccccatctccccaggcct

SEQ ID NO: 333394 - DNA, 21 bp, Homo sapiens
gcccccatctccccaggcctc

SEQ ID NO: 333395 - DNA, 23 bp, Homo sapiens
gcccccatctccccaggcctcca

SEQ ID NO: 333396 - DNA, 18 bp, Homo sapiens
gccccccaccccacagat

SEQ ID NO: 333397 - DNA, 14 bp, Homo sapiens
gccccccacctttg

SEQ ID NO: 333398 - DNA, 20 bp, Homo sapiens
gccccccagagagagctctg

SEQ ID NO: 333399 - DNA, 12 bp, Homo sapiens
gccccccagagc

SEQ ID NO: 333400 - DNA, 16 bp, Homo sapiens
gccccccagagccagg

SEQ ID NO: 333401 - DNA, 17 bp, Homo sapiens
gccccccagagccaggg

SEQ ID NO: 333402 - DNA, 18 bp, Homo sapiens
gccccccagagccagggc

SEQ ID NO: 333403 - DNA, 21 bp, Homo sapiens
gccccccagagccagggctgt

SEQ ID NO: 333404 - DNA, 16 bp, Homo sapiens
gccccccagctcaggg

SEQ ID NO: 333405 - DNA, 12 bp, Homo sapiens
gccccccagtgt

SEQ ID NO: 333406 - DNA, 16 bp, Homo sapiens
gccccccctcttttgg

SEQ ID NO: 333407 - DNA, 14 bp, Homo sapiens
gcccccctccaggc

SEQ ID NO: 333408 - DNA, 15 bp, Homo sapiens
gcccccctccaggca

SEQ ID NO: 333409 - DNA, 16 bp, Homo sapiens
gcccccctcctccagt

SEQ ID NO: 333410 - DNA, 13 bp, Homo sapiens
gccccccttccca

SEQ ID NO: 333411 - DNA, 11 bp, Homo sapiens
tctgtgtctct

SEQ ID NO: 333412 - DNA, 13 bp, Homo sapiens
tctgtgtctgtgt

SEQ ID NO: 333413 - DNA, 20 bp, Homo sapiens
tctgtgtgatgaactttctc

SEQ ID NO: 333414 - DNA, 22 bp, Homo sapiens
tctgtgtgcaagtgtgtgcaca

SEQ ID NO: 333415 - DNA, 11 bp, Homo sapiens
tctgtgtggca

SEQ ID NO: 333416 - DNA, 21 bp, Homo sapiens
tctgtgttggcccaagctctt

SEQ ID NO: 333417 - DNA, 16 bp, Homo sapiens
tctgttaaaatcagga

SEQ ID NO: 333418 - DNA, 17 bp, Homo sapiens
tctgttacacaatatgt

SEQ ID NO: 333419 - DNA, 19 bp, Homo sapiens
tctgttacacaatatgtgt

SEQ ID NO: 333420 - DNA, 19 bp, Homo sapiens
tctgttaccatgtcactgt

SEQ ID NO: 333421 - DNA, 21 bp, Homo sapiens
tctgttaccatgtcactgtgg

SEQ ID NO: 333422 - DNA, 14 bp, Homo sapiens
tctgttagatgcta

SEQ ID NO: 333423 - DNA, 10 bp, Homo sapiens
tctgttccaa

SEQ ID NO: 333424 - DNA, 15 bp, Homo sapiens
tctgttccaagtgtg

SEQ ID NO: 333425 - DNA, 22 bp, Homo sapiens
tctgttccttatgatattctca

SEQ ID NO: 333426 - DNA, 15 bp, Homo sapiens
tctgttctaacatgt

SEQ ID NO: 333427 - DNA, 17 bp, Homo sapiens
tctgttctacttgatat

SEQ ID NO: 333428 - DNA, 22 bp, Homo sapiens
tctgttctcacataacagagta

SEQ ID NO: 333429 - DNA, 12 bp, Homo sapiens
tctgttctgata

SEQ ID NO: 333430 - DNA, 17 bp, Homo sapiens
tctgttctgccccctca

SEQ ID NO: 333431 - DNA, 19 bp, Homo sapiens
tctgttctggtggccccag

SEQ ID NO: 333432 - DNA, 13 bp, Homo sapiens
tctgttgcctcct

SEQ ID NO: 333433 - DNA, 14 bp, Homo sapiens
tctgttgcctcctc

SEQ ID NO: 333434 - DNA, 16 bp, Homo sapiens
tctgttgcctcctctc

SEQ ID NO: 333435 - DNA, 22 bp, Homo sapiens
tctgttgcctcctctctccctg

SEQ ID NO: 333436 - DNA, 21 bp, Homo sapiens
tctgttgtcctccccttgggc

SEQ ID NO: 333437 - DNA, 15 bp, Homo sapiens
tctgttgtttgaaga

SEQ ID NO: 333438 - DNA, 20 bp, Homo sapiens
tctgtttaccctccctgtcc

SEQ ID NO: 333439 - DNA, 23 bp, Homo sapiens
tctgtttaccctccctgtcccct

SEQ ID NO: 333440 - DNA, 22 bp, Homo sapiens
tctgtttggtaaggaggacaat

SEQ ID NO: 333441 - DNA, 13 bp, Homo sapiens
tctgtttgttaaa

SEQ ID NO: 333442 - DNA, 14 bp, Homo sapiens
tctgtttgttaaaa

SEQ ID NO: 333443 - DNA, 13 bp, Homo sapiens
tctgttttactgc

SEQ ID NO: 333444 - DNA, 12 bp, Homo sapiens
tctgttttctgt

SEQ ID NO: 333445 - DNA, 13 bp, Homo sapiens
tctgtttttctca

SEQ ID NO: 333446 - DNA, 14 bp, Homo sapiens
tctgtttttctcaa

SEQ ID NO: 333447 - DNA, 16 bp, Homo sapiens
tctgtttttctcaaat

SEQ ID NO: 333448 - DNA, 18 bp, Homo sapiens
tctgtttttctcaaataa

SEQ ID NO: 333449 - DNA, 19 bp, Homo sapiens
tctgtttttctcaaataaa

SEQ ID NO: 333450 - DNA, 21 bp, Homo sapiens
tctgtttttctcaaataaagt

SEQ ID NO: 333451 - DNA, 14 bp, Homo sapiens
tctgtttttctttt

SEQ ID NO: 333452 - DNA, 22 bp, Homo sapiens
tctgttttttttttttgtattt

SEQ ID NO: 333453 - DNA, 22 bp, Homo sapiens
tcttaaaaagttataaccaact

SEQ ID NO: 333454 - DNA, 13 bp, Homo sapiens
tcttaaaaattat

SEQ ID NO: 333455 - DNA, 21 bp, Homo sapiens
tcttaaaattcaagaaaataa

SEQ ID NO: 333456 - DNA, 16 bp, Homo sapiens
tcttaaagaaacagct

SEQ ID NO: 333457 - DNA, 17 bp, Homo sapiens
tcttaaagaaacagctt

SEQ ID NO: 333458 - DNA, 18 bp, Homo sapiens
tcttaaagaaacagcttt

SEQ ID NO: 333459 - DNA, 16 bp, Homo sapiens
tcttaaagctgcctgt

SEQ ID NO: 333460 - DNA, 15 bp, Homo sapiens
tcttaaaggcctgga

SEQ ID NO: 333461 - DNA, 15 bp, Homo sapiens
tcttaaataaaacta

SEQ ID NO: 333462 - DNA, 14 bp, Homo sapiens
tcttaaatctgtga

SEQ ID NO: 333463 - DNA, 11 bp, Homo sapiens
tcttaaatttt

SEQ ID NO: 333464 - DNA, 13 bp, Homo sapiens
tcttaaattttgt

SEQ ID NO: 333465 - DNA, 14 bp, Homo sapiens
tcttaacaacagct

SEQ ID NO: 333466 - DNA, 22 bp, Homo sapiens
tcttaagcactttgaaaatatt

SEQ ID NO: 333467 - DNA, 19 bp, Homo sapiens
tcttaagggggccttggaa

SEQ ID NO: 333468 - DNA, 20 bp, Homo sapiens
tcttaagggggccttggaat

SEQ ID NO: 333469 - DNA, 15 bp, Homo sapiens
tcttaatctttattt

SEQ ID NO: 333470 - DNA, 17 bp, Homo sapiens
tcttacaaccaagaaca

SEQ ID NO: 333471 - DNA, 21 bp, Homo sapiens
tcttacaattgcactgctgtt

SEQ ID NO: 333472 - DNA, 22 bp, Homo sapiens
tcttacaattgcactgctgttc

SEQ ID NO: 333473 - DNA, 12 bp, Homo sapiens
tcttacatctgc

SEQ ID NO: 333474 - DNA, 15 bp, Homo sapiens
tcttacattggcttt

SEQ ID NO: 333475 - DNA, 17 bp, Homo sapiens
tcttaccctctctttca

SEQ ID NO: 333476 - DNA, 21 bp, Homo sapiens
tcttaccctctctttcaattg

SEQ ID NO: 333477 - DNA, 18 bp, Homo sapiens
tcttacccttctgtgccc

SEQ ID NO: 333478 - DNA, 22 bp, Homo sapiens
tcttacccttctgtgcccagct

SEQ ID NO: 333479 - DNA, 13 bp, Homo sapiens
tcttaccctttct

SEQ ID NO: 333480 - DNA, 15 bp, Homo sapiens
tcttaccgtagcctc

SEQ ID NO: 333481 - DNA, 17 bp, Homo sapiens
tcttaccgtagcctccg

SEQ ID NO: 333482 - DNA, 21 bp, Homo sapiens
tcttacctacaaaatgagatt

SEQ ID NO: 333483 - DNA, 14 bp, Homo sapiens
tcttacctcatttg

SEQ ID NO: 333484 - DNA, 16 bp, Homo sapiens
tcttacctcatttgca

SEQ ID NO: 333485 - DNA, 16 bp, Homo sapiens
tcttactaaacatttt

SEQ ID NO: 333486 - DNA, 16 bp, Homo sapiens
tcttactactttaaat

SEQ ID NO: 333487 - DNA, 13 bp, Homo sapiens
tcttactgttttg

SEQ ID NO: 333488 - DNA, 17 bp, Homo sapiens
tcttactgttttgtgcg

SEQ ID NO: 333489 - DNA, 13 bp, Homo sapiens
tcttagagaataa

SEQ ID NO: 333490 - DNA, 13 bp, Homo sapiens
tcttagagagaga

SEQ ID NO: 333491 - DNA, 14 bp, Homo sapiens
tcttagctgccaag

SEQ ID NO: 333492 - DNA, 17 bp, Homo sapiens
tcttaggggagagcttt

SEQ ID NO: 333493 - DNA, 19 bp, Homo sapiens
tcttaggggagagctttct

SEQ ID NO: 333494 - DNA, 13 bp, Homo sapiens
tcttaggggcttg

SEQ ID NO: 333495 - DNA, 17 bp, Homo sapiens
tcttaggtcccgggagg

SEQ ID NO: 333496 - DNA, 17 bp, Homo sapiens
tcttagtttcagaagta

SEQ ID NO: 333497 - DNA, 19 bp, Homo sapiens
tcttagtttttaaaaaggc

SEQ ID NO: 333498 - DNA, 23 bp, Homo sapiens
tcttagtttttaaaaaggccttt

SEQ ID NO: 333499 - DNA, 14 bp, Homo sapiens
tcttatacatttga

SEQ ID NO: 333500 - DNA, 20 bp, Homo sapiens
tcttatcatggtctcagtca

SEQ ID NO: 333501 - DNA, 18 bp, Homo sapiens
tcttatctagcaagaaga

SEQ ID NO: 333502 - DNA, 14 bp, Homo sapiens
tcttatgccatttg

SEQ ID NO: 333503 - DNA, 12 bp, Homo sapiens
tcttatgttgat

SEQ ID NO: 333504 - DNA, 21 bp, Homo sapiens
tcttattcatgctttctcctt

SEQ ID NO: 333505 - DNA, 16 bp, Homo sapiens
tcttattcccaaacta

SEQ ID NO: 333506 - DNA, 13 bp, Homo sapiens
tcttattctaata

SEQ ID NO: 333507 - DNA, 21 bp, Homo sapiens
tcttattggccaaatgcctgt

SEQ ID NO: 333508 - DNA, 16 bp, Homo sapiens
tcttatttatatatga

SEQ ID NO: 333509 - DNA, 17 bp, Homo sapiens
tcttatttatatatgaa

SEQ ID NO: 333510 - DNA, 15 bp, Homo sapiens
tcttatttccccttt

SEQ ID NO: 333511 - DNA, 14 bp, Homo sapiens
tcttatttgaaagt

SEQ ID NO: 333512 - DNA, 11 bp, Homo sapiens
tcttatttgct

SEQ ID NO: 333513 - DNA, 14 bp, Homo sapiens
tcttcaaactttca

SEQ ID NO: 333514 - DNA, 15 bp, Homo sapiens
tcttcaaactttcac

SEQ ID NO: 333515 - DNA, 17 bp, Homo sapiens
tcttcaaatccttccaa

SEQ ID NO: 333516 - DNA, 19 bp, Homo sapiens
tcttcaaatccttccaaaa

SEQ ID NO: 333517 - DNA, 22 bp, Homo sapiens
tcttcaaatccttccaaaaatt

SEQ ID NO: 333518 - DNA, 14 bp, Homo sapiens
tcttcaaccctgcc

SEQ ID NO: 333519 - DNA, 19 bp, Homo sapiens
tcttcaaccctgccctgca

SEQ ID NO: 333520 - DNA, 13 bp, Homo sapiens
tcttcaaggccaa

SEQ ID NO: 333521 - DNA, 16 bp, Homo sapiens
tcttcaagtgagtggc

SEQ ID NO: 333522 - DNA, 14 bp, Homo sapiens
tcttcaatttgaaa

SEQ ID NO: 333523 - DNA, 20 bp, Homo sapiens
tcttcacccagctaatctgt

SEQ ID NO: 333524 - DNA, 23 bp, Homo sapiens
tcttcaccccggcaggccctgca

SEQ ID NO: 333525 - DNA, 16 bp, Homo sapiens
tcttcacctctatcca

SEQ ID NO: 333526 - DNA, 14 bp, Homo sapiens
tcttcactcgcccc

SEQ ID NO: 333527 - DNA, 15 bp, Homo sapiens
tcttcactgaatatc

SEQ ID NO: 333528 - DNA, 23 bp, Homo sapiens
tcttcagaaagtgtgctttatgc

SEQ ID NO: 333529 - DNA, 11 bp, Homo sapiens
tcttcagctgg

SEQ ID NO: 333530 - DNA, 14 bp, Homo sapiens
tcttcagctggtgg

SEQ ID NO: 333531 - DNA, 19 bp, Homo sapiens
tcttcaggagatgatgtga

SEQ ID NO: 333532 - DNA, 15 bp, Homo sapiens
tcttcaggcctccct

SEQ ID NO: 333533 - DNA, 13 bp, Homo sapiens
tcttcagggcact

SEQ ID NO: 333534 - DNA, 14 bp, Homo sapiens
tcttcaggttctta

SEQ ID NO: 333535 - DNA, 20 bp, Homo sapiens
tcttcagtgtgttgacttct

SEQ ID NO: 333536 - DNA, 22 bp, Homo sapiens
tcttcagtgtgttgacttctat

SEQ ID NO: 333537 - DNA, 18 bp, Homo sapiens
tcttcatccatagacaca

SEQ ID NO: 333538 - DNA, 19 bp, Homo sapiens
tcttcatccatagacacag

SEQ ID NO: 333539 - DNA, 22 bp, Homo sapiens
tcttccaatgatgcttactaca

SEQ ID NO: 333540 - DNA, 18 bp, Homo sapiens
tcttccagagcctaagaa

SEQ ID NO: 333541 - DNA, 17 bp, Homo sapiens
tcttccaggaagcacag

SEQ ID NO: 333542 - DNA, 17 bp, Homo sapiens
gccccttccccctccaa

SEQ ID NO: 333543 - DNA, 19 bp, Homo sapiens
gccccttctacactctcct

SEQ ID NO: 333544 - DNA, 17 bp, Homo sapiens
gccccttgaccccacac

SEQ ID NO: 333545 - DNA, 19 bp, Homo sapiens
gccccttgaccccacacgc

SEQ ID NO: 333546 - DNA, 22 bp, Homo sapiens
gccccttggctggatcagggaa

SEQ ID NO: 333547 - DNA, 13 bp, Homo sapiens
gccccttgggcat

SEQ ID NO: 333548 - DNA, 22 bp, Homo sapiens
gccccttgggcatccacccagt

SEQ ID NO: 333549 - DNA, 23 bp, Homo sapiens
gcccctttttcatatgttgctca

SEQ ID NO: 333550 - DNA, 14 bp, Homo sapiens
gcccgaatgcctgt

SEQ ID NO: 333551 - DNA, 16 bp, Homo sapiens
gcccgacagcctggca

SEQ ID NO: 333552 - DNA, 15 bp, Homo sapiens
gcccgactagcaggc

SEQ ID NO: 333553 - DNA, 15 bp, Homo sapiens
gcccgagcgcgtgcc

SEQ ID NO: 333554 - DNA, 16 bp, Homo sapiens
gcccgatattctccct

SEQ ID NO: 333555 - DNA, 13 bp, Homo sapiens
gcccgcacaccct

SEQ ID NO: 333556 - DNA, 15 bp, Homo sapiens
gcccgcacagcagcc

SEQ ID NO: 333557 - DNA, 17 bp, Homo sapiens
gcccgcacagcagcctg

SEQ ID NO: 333558 - DNA, 18 bp, Homo sapiens
gcccgcacagcagcctgc

SEQ ID NO: 333559 - DNA, 17 bp, Homo sapiens
gcccgcacccccaccct

SEQ ID NO: 333560 - DNA, 12 bp, Homo sapiens
gcccgcagagcc

SEQ ID NO: 333561 - DNA, 16 bp, Homo sapiens
gcccgcatgcagcagc

SEQ ID NO: 333562 - DNA, 15 bp, Homo sapiens
gcccgccagcctcag

SEQ ID NO: 333563 - DNA, 20 bp, Homo sapiens
gcccgccagcctcagtgcca

SEQ ID NO: 333564 - DNA, 13 bp, Homo sapiens
gcccgcccacccc

SEQ ID NO: 333565 - DNA, 21 bp, Homo sapiens
gcccgcccaccccgctgcctg

SEQ ID NO: 333566 - DNA, 14 bp, Homo sapiens
gcccgcccacctct

SEQ ID NO: 333567 - DNA, 18 bp, Homo sapiens
gcccgcccacctctgctg

SEQ ID NO: 333568 - DNA, 19 bp, Homo sapiens
gcccgcccacctctgctgc

SEQ ID NO: 333569 - DNA, 13 bp, Homo sapiens
gcccgcccacctg

SEQ ID NO: 333570 - DNA, 17 bp, Homo sapiens
gcccgcccacctgggcc

SEQ ID NO: 333571 - DNA, 21 bp, Homo sapiens
gcccgcccacctgggccctag

SEQ ID NO: 333572 - DNA, 13 bp, Homo sapiens
gcccgcccactgt

SEQ ID NO: 333573 - DNA, 14 bp, Homo sapiens
gcccgcccactgtc

SEQ ID NO: 333574 - DNA, 22 bp, Homo sapiens
gcccgcccactgtcctgggcgc

SEQ ID NO: 333575 - DNA, 16 bp, Homo sapiens
gcccgccctcctctgc

SEQ ID NO: 333576 - DNA, 17 bp, Homo sapiens
gcccgccctcctctgcc

SEQ ID NO: 333577 - DNA, 21 bp, Homo sapiens
gcccgccctcctctgccccct

SEQ ID NO: 333578 - DNA, 22 bp, Homo sapiens
gcccgccctcctctgccccctc

SEQ ID NO: 333579 - DNA, 18 bp, Homo sapiens
gcccgccggttggccggc

SEQ ID NO: 333580 - DNA, 18 bp, Homo sapiens
gcccgcctaggagttgag

SEQ ID NO: 333581 - DNA, 20 bp, Homo sapiens
gcccgcctgccgtgcatggc

SEQ ID NO: 333582 - DNA, 17 bp, Homo sapiens
gcccgctcaacctctca

SEQ ID NO: 333583 - DNA, 21 bp, Homo sapiens
gcccgctgcgtgccatcactc

SEQ ID NO: 333584 - DNA, 12 bp, Homo sapiens
gcccgctgggct

SEQ ID NO: 333585 - DNA, 17 bp, Homo sapiens
gcccgctgggctgagcc

SEQ ID NO: 333586 - DNA, 16 bp, Homo sapiens
gcccgctgtcccaggg

SEQ ID NO: 333587 - DNA, 17 bp, Homo sapiens
gcccgctgtcccagggg

SEQ ID NO: 333588 - DNA, 18 bp, Homo sapiens
gcccggaagttgctgtgc

SEQ ID NO: 333589 - DNA, 19 bp, Homo sapiens
gcccggaagttgctgtgcc

SEQ ID NO: 333590 - DNA, 21 bp, Homo sapiens
gcccggagattggacggcctg

SEQ ID NO: 333591 - DNA, 22 bp, Homo sapiens
gcccggagattggacggcctga

SEQ ID NO: 333592 - DNA, 17 bp, Homo sapiens
gcccggatgcccacccc

SEQ ID NO: 333593 - DNA, 19 bp, Homo sapiens
gcccggatgcccacccctg

SEQ ID NO: 333594 - DNA, 15 bp, Homo sapiens
gcccggcacagagtc

SEQ ID NO: 333595 - DNA, 22 bp, Homo sapiens
gcccggccaaggacactgatgg

SEQ ID NO: 333596 - DNA, 16 bp, Homo sapiens
gcccggcccacgcaga

SEQ ID NO: 333597 - DNA, 18 bp, Homo sapiens
gcccggcccacgcagagc

SEQ ID NO: 333598 - DNA, 13 bp, Homo sapiens
tcttctccactgg

SEQ ID NO: 333599 - DNA, 13 bp, Homo sapiens
tcttctctccact

SEQ ID NO: 333600 - DNA, 20 bp, Homo sapiens
tcttctctccccttttcctt

SEQ ID NO: 333601 - DNA, 15 bp, Homo sapiens
tcttctctcttcaat

SEQ ID NO: 333602 - DNA, 18 bp, Homo sapiens
tcttctctttttccagaa

SEQ ID NO: 333603 - DNA, 13 bp, Homo sapiens
tcttctgaaatga

SEQ ID NO: 333604 - DNA, 16 bp, Homo sapiens
tcttctgaatatttta

SEQ ID NO: 333605 - DNA, 22 bp, Homo sapiens
tcttctgacacttgtggtatag

SEQ ID NO: 333606 - DNA, 22 bp, Homo sapiens
tcttctgctccacccttggcct

SEQ ID NO: 333607 - DNA, 22 bp, Homo sapiens
tcttctgctctttcttcttcca

SEQ ID NO: 333608 - DNA, 19 bp, Homo sapiens
tcttctgggcagagcctgt

SEQ ID NO: 333609 - DNA, 22 bp, Homo sapiens
tcttctgtattttttttttcca

SEQ ID NO: 333610 - DNA, 12 bp, Homo sapiens
tcttctgtccat

SEQ ID NO: 333611 - DNA, 13 bp, Homo sapiens
tcttctgtttttc

SEQ ID NO: 333612 - DNA, 16 bp, Homo sapiens
tcttctgtttttctca

SEQ ID NO: 333613 - DNA, 17 bp, Homo sapiens
tcttctgtttttctcaa

SEQ ID NO: 333614 - DNA, 21 bp, Homo sapiens
tcttctgtttttctcaaataa

SEQ ID NO: 333615 - DNA, 14 bp, Homo sapiens
tcttcttccaggta

SEQ ID NO: 333616 - DNA, 13 bp, Homo sapiens
tcttcttgtgaaa

SEQ ID NO: 333617 - DNA, 15 bp, Homo sapiens
tcttcttgtgaaatg

SEQ ID NO: 333618 - DNA, 21 bp, Homo sapiens
tcttctttaaggaagaataaa

SEQ ID NO: 333619 - DNA, 19 bp, Homo sapiens
tcttctttttgcttcaaaa

SEQ ID NO: 333620 - DNA, 17 bp, Homo sapiens
tcttctttttttgtgat

SEQ ID NO: 333621 - DNA, 18 bp, Homo sapiens
tcttctttttttgtgatg

SEQ ID NO: 333622 - DNA, 11 bp, Homo sapiens
tcttgaagaat

SEQ ID NO: 333623 - DNA, 19 bp, Homo sapiens
tcttgaaggaaaatgatac

SEQ ID NO: 333624 - DNA, 11 bp, Homo sapiens
tcttgaataaa

SEQ ID NO: 333625 - DNA, 23 bp, Homo sapiens
tcttgaatatgggcggaagtact

SEQ ID NO: 333626 - DNA, 21 bp, Homo sapiens
tcttgactcaggtggtgtcct

SEQ ID NO: 333627 - DNA, 19 bp, Homo sapiens
tcttgagagcgctggcctc

SEQ ID NO: 333628 - DNA, 20 bp, Homo sapiens
tcttgagagcgctggcctct

SEQ ID NO: 333629 - DNA, 14 bp, Homo sapiens
tcttgagagctgct

SEQ ID NO: 333630 - DNA, 22 bp, Homo sapiens
tcttgagatgtattatgcaaag

SEQ ID NO: 333631 - DNA, 23 bp, Homo sapiens
tcttgagatgtattatgcaaagt

SEQ ID NO: 333632 - DNA, 19 bp, Homo sapiens
tcttgagtttcatttttca

SEQ ID NO: 333633 - DNA, 13 bp, Homo sapiens
tcttgatctcctg

SEQ ID NO: 333634 - DNA, 14 bp, Homo sapiens
tcttgatctcctga

SEQ ID NO: 333635 - DNA, 14 bp, Homo sapiens
tcttgatgtaaaat

SEQ ID NO: 333636 - DNA, 19 bp, Homo sapiens
tcttgatgtaaaatcttgt

SEQ ID NO: 333637 - DNA, 16 bp, Homo sapiens
tcttgatgtgaagata

SEQ ID NO: 333638 - DNA, 21 bp, Homo sapiens
tcttgatgtgaagataatttg

SEQ ID NO: 333639 - DNA, 13 bp, Homo sapiens
tcttgattcataa

SEQ ID NO: 333640 - DNA, 14 bp, Homo sapiens
tcttgattgatttt

SEQ ID NO: 333641 - DNA, 19 bp, Homo sapiens
tcttgcactgtatccaagt

SEQ ID NO: 333642 - DNA, 20 bp, Homo sapiens
tcttgcatctacctgctcct

SEQ ID NO: 333643 - DNA, 12 bp, Homo sapiens
tcttgccagctc

SEQ ID NO: 333644 - DNA, 11 bp, Homo sapiens
tcttgccctga

SEQ ID NO: 333645 - DNA, 14 bp, Homo sapiens
tcttgccctgagct

SEQ ID NO: 333646 - DNA, 15 bp, Homo sapiens
tcttgccctgagctt

SEQ ID NO: 333647 - DNA, 16 bp, Homo sapiens
tcttgcctaggccaaa

SEQ ID NO: 333648 - DNA, 18 bp, Homo sapiens
tcttgccttccccttgaa

SEQ ID NO: 333649 - DNA, 19 bp, Homo sapiens
tcttgcggcaccgcccacc

SEQ ID NO: 333650 - DNA, 21 bp, Homo sapiens
tcttgcggcaccgcccaccca

SEQ ID NO: 333651 - DNA, 17 bp, Homo sapiens
tcttgctaagctccagc

SEQ ID NO: 333652 - DNA, 18 bp, Homo sapiens
tcttgctatataaataaa

SEQ ID NO: 333653 - DNA, 16 bp, Homo sapiens
tcttgctcactcccta

SEQ ID NO: 333654 - DNA, 14 bp, Homo sapiens
tcttgctcagagct

SEQ ID NO: 333655 - DNA, 17 bp, Homo sapiens
tcttgctctatctctca

SEQ ID NO: 333656 - DNA, 22 bp, Homo sapiens
tcttgctggttgtcatttttgc

SEQ ID NO: 333657 - DNA, 12 bp, Homo sapiens
tcttgctgtgaa

SEQ ID NO: 333658 - DNA, 14 bp, Homo sapiens
tcttgctgtggtct

SEQ ID NO: 333659 - DNA, 19 bp, Homo sapiens
tcttgcttgtaaaaatatg

SEQ ID NO: 333660 - DNA, 19 bp, Homo sapiens
tcttggacacttaattctg

SEQ ID NO: 333661 - DNA, 16 bp, Homo sapiens
tcttggactaagaaga

SEQ ID NO: 333662 - DNA, 18 bp, Homo sapiens
tcttggagacaattacaa

SEQ ID NO: 333663 - DNA, 21 bp, Homo sapiens
tcttggattggtaccagagcc

SEQ ID NO: 333664 - DNA, 16 bp, Homo sapiens
tcttggcttctgggac

SEQ ID NO: 333665 - DNA, 21 bp, Homo sapiens
tcttgggaactccactctcct

SEQ ID NO: 333666 - DNA, 11 bp, Homo sapiens
tcttgggccct

SEQ ID NO: 333667 - DNA, 21 bp, Homo sapiens
tcttgggctactggcagctcc

SEQ ID NO: 333668 - DNA, 22 bp, Homo sapiens
tcttgggctactggcagctcct

SEQ ID NO: 333669 - DNA, 14 bp, Homo sapiens
tcttggtagagatt

SEQ ID NO: 333670 - DNA, 16 bp, Homo sapiens
tcttggtagttctgtg

SEQ ID NO: 333671 - DNA, 22 bp, Homo sapiens
tcttggtagttctgtgcctccc

SEQ ID NO: 333672 - DNA, 18 bp, Homo sapiens
gccctccttcttgccctg

SEQ ID NO: 333673 - DNA, 16 bp, Homo sapiens
gccctcgctgcttctg

SEQ ID NO: 333674 - DNA, 13 bp, Homo sapiens
gccctctccacac

SEQ ID NO: 333675 - DNA, 20 bp, Homo sapiens
gccctctcccatgcacacaa

SEQ ID NO: 333676 - DNA, 13 bp, Homo sapiens
gccctctctctgg

SEQ ID NO: 333677 - DNA, 17 bp, Homo sapiens
gccctctgagcaactgt

SEQ ID NO: 333678 - DNA, 21 bp, Homo sapiens
gccctctgagcaactgtgcag

SEQ ID NO: 333679 - DNA, 10 bp, Homo sapiens
gccctctgcc

SEQ ID NO: 333680 - DNA, 15 bp, Homo sapiens
gccctctgcccccag

SEQ ID NO: 333681 - DNA, 12 bp, Homo sapiens
gccctctgtagc

SEQ ID NO: 333682 - DNA, 13 bp, Homo sapiens
gccctctgtagct

SEQ ID NO: 333683 - DNA, 19 bp, Homo sapiens
gccctctgtagctccctcc

SEQ ID NO: 333684 - DNA, 14 bp, Homo sapiens
gccctctgtccaca

SEQ ID NO: 333685 - DNA, 12 bp, Homo sapiens
gccctctgtgcc

SEQ ID NO: 333686 - DNA, 20 bp, Homo sapiens
gccctctgtgcctaataaag

SEQ ID NO: 333687 - DNA, 13 bp, Homo sapiens
gccctctttctct

SEQ ID NO: 333688 - DNA, 21 bp, Homo sapiens
gccctctttctctctgtgtgg

SEQ ID NO: 333689 - DNA, 19 bp, Homo sapiens
gccctgacaaaaaggtgct

SEQ ID NO: 333690 - DNA, 15 bp, Homo sapiens
gccctgaccttggct

SEQ ID NO: 333691 - DNA, 22 bp, Homo sapiens
gccctgaggaaggaggggaagc

SEQ ID NO: 333692 - DNA, 22 bp, Homo sapiens
gccctgatgcgtctacccagac

SEQ ID NO: 333693 - DNA, 11 bp, Homo sapiens
gccctgcaaat

SEQ ID NO: 333694 - DNA, 17 bp, Homo sapiens
gccctgcacctgtgcag

SEQ ID NO: 333695 - DNA, 23 bp, Homo sapiens
gccctgcaggaggcctgggaggg

SEQ ID NO: 333696 - DNA, 22 bp, Homo sapiens
gccctgcagtgttcgcttggct

SEQ ID NO: 333697 - DNA, 15 bp, Homo sapiens
gccctgccaagcctg

SEQ ID NO: 333698 - DNA, 13 bp, Homo sapiens
gccctgccacctg

SEQ ID NO: 333699 - DNA, 16 bp, Homo sapiens
gccctgccacctgtct

SEQ ID NO: 333700 - DNA, 17 bp, Homo sapiens
gccctgccacctgtctg

SEQ ID NO: 333701 - DNA, 13 bp, Homo sapiens
gccctgccaggct

SEQ ID NO: 333702 - DNA, 20 bp, Homo sapiens
gccctgcccccatctcccca

SEQ ID NO: 333703 - DNA, 15 bp, Homo sapiens
gccctgccctccccc

SEQ ID NO: 333704 - DNA, 16 bp, Homo sapiens
gccctgccctccccca

SEQ ID NO: 333705 - DNA, 13 bp, Homo sapiens
gccctgccctgcc

SEQ ID NO: 333706 - DNA, 23 bp, Homo sapiens
gccctgcctccaccgagccagct

SEQ ID NO: 333707 - DNA, 12 bp, Homo sapiens
gccctgcctgag

SEQ ID NO: 333708 - DNA, 14 bp, Homo sapiens
gccctgcctgaggg

SEQ ID NO: 333709 - DNA, 19 bp, Homo sapiens
gccctgcctgagggcccct

SEQ ID NO: 333710 - DNA, 14 bp, Homo sapiens
gccctgcctgccca

SEQ ID NO: 333711 - DNA, 16 bp, Homo sapiens
gccctgctcaggcctc

SEQ ID NO: 333712 - DNA, 17 bp, Homo sapiens
gccctgctcaggcctca

SEQ ID NO: 333713 - DNA, 19 bp, Homo sapiens
gccctgctcaggcctcacc

SEQ ID NO: 333714 - DNA, 18 bp, Homo sapiens
gccctgctgcttcctaac

SEQ ID NO: 333715 - DNA, 16 bp, Homo sapiens
gccctgctttgggctg

SEQ ID NO: 333716 - DNA, 21 bp, Homo sapiens
gccctgctttgggctgccctg

SEQ ID NO: 333717 - DNA, 21 bp, Homo sapiens
gccctggaactctatctgggc

SEQ ID NO: 333718 - DNA, 18 bp, Homo sapiens
gccctggacacccctgct

SEQ ID NO: 333719 - DNA, 14 bp, Homo sapiens
gccctggccagagg

SEQ ID NO: 333720 - DNA, 15 bp, Homo sapiens
gccctggccagaggc

SEQ ID NO: 333721 - DNA, 16 bp, Homo sapiens
gccctggccagaggct

SEQ ID NO: 333722 - DNA, 20 bp, Homo sapiens
gccctggctcccaagggagg

SEQ ID NO: 333723 - DNA, 23 bp, Homo sapiens
gccctggctcccaagggaggccc

SEQ ID NO: 333724 - DNA, 15 bp, Homo sapiens
gccctggctcccaca

SEQ ID NO: 333725 - DNA, 13 bp, Homo sapiens
gccctggctgggt

SEQ ID NO: 333726 - DNA, 18 bp, Homo sapiens
gccctgggcacccacctc

SEQ ID NO: 333727 - DNA, 13 bp, Homo sapiens
gccctgggctctg

SEQ ID NO: 333728 - DNA, 14 bp, Homo sapiens
gccctgggctctgg

SEQ ID NO: 333729 - DNA, 21 bp, Homo sapiens
gccctgggctggactggaggt

SEQ ID NO: 333730 - DNA, 17 bp, Homo sapiens
gccctggggaagaggcc

SEQ ID NO: 333731 - DNA, 16 bp, Homo sapiens
gccctggggagtgagc

SEQ ID NO: 333732 - DNA, 15 bp, Homo sapiens
gccctggggctgggc

SEQ ID NO: 333733 - DNA, 16 bp, Homo sapiens
gccctggggctgggcc

SEQ ID NO: 333734 - DNA, 14 bp, Homo sapiens
gccctggggtcccc

SEQ ID NO: 333735 - DNA, 20 bp, Homo sapiens
gccctggggtccccactccc

SEQ ID NO: 333736 - DNA, 13 bp, Homo sapiens
tctttcatctagc

SEQ ID NO: 333737 - DNA, 12 bp, Homo sapiens
tctttccaggct

SEQ ID NO: 333738 - DNA, 20 bp, Homo sapiens
tctttccccagaggctccca

SEQ ID NO: 333739 - DNA, 18 bp, Homo sapiens
tctttcccctcctttgtc

SEQ ID NO: 333740 - DNA, 20 bp, Homo sapiens
tctttcccctcctttgtctt

SEQ ID NO: 333741 - DNA, 22 bp, Homo sapiens
tctttcctagatggcagtcact

SEQ ID NO: 333742 - DNA, 13 bp, Homo sapiens
tctttcctgccct

SEQ ID NO: 333743 - DNA, 14 bp, Homo sapiens
tctttcctgccctt

SEQ ID NO: 333744 - DNA, 16 bp, Homo sapiens
tctttccttaataaat

SEQ ID NO: 333745 - DNA, 16 bp, Homo sapiens
tctttctaatgtagct

SEQ ID NO: 333746 - DNA, 17 bp, Homo sapiens
tctttctacatgactgg

SEQ ID NO: 333747 - DNA, 16 bp, Homo sapiens
tctttctactctgaac

SEQ ID NO: 333748 - DNA, 12 bp, Homo sapiens
tctttctatgta

SEQ ID NO: 333749 - DNA, 24 bp, Homo sapiens
tctttctccttagtcttctcatag

SEQ ID NO: 333750 - DNA, 15 bp, Homo sapiens
tctttctctcctttc

SEQ ID NO: 333751 - DNA, 15 bp, Homo sapiens
tctttctctctgtgt

SEQ ID NO: 333752 - DNA, 17 bp, Homo sapiens
tctttctctctgtgtgg

SEQ ID NO: 333753 - DNA, 19 bp, Homo sapiens
tctttctctctgtgtggca

SEQ ID NO: 333754 - DNA, 17 bp, Homo sapiens
tctttctctctttccat

SEQ ID NO: 333755 - DNA, 13 bp, Homo sapiens
tctttctctgcca

SEQ ID NO: 333756 - DNA, 16 bp, Homo sapiens
tctttctctgccagtg

SEQ ID NO: 333757 - DNA, 18 bp, Homo sapiens
tctttctggcctgccttc

SEQ ID NO: 333758 - DNA, 22 bp, Homo sapiens
tctttcttccactaccctccct

SEQ ID NO: 333759 - DNA, 12 bp, Homo sapiens
tctttcttcctc

SEQ ID NO: 333760 - DNA, 14 bp, Homo sapiens
tctttcttcctctg

SEQ ID NO: 333761 - DNA, 16 bp, Homo sapiens
tctttcttcctctgct

SEQ ID NO: 333762 - DNA, 12 bp, Homo sapiens
tctttctttcca

SEQ ID NO: 333763 - DNA, 19 bp, Homo sapiens
tctttctttgctgctgtgg

SEQ ID NO: 333764 - DNA, 20 bp, Homo sapiens
tctttctttgctgctgtgga

SEQ ID NO: 333765 - DNA, 22 bp, Homo sapiens
tctttgaaagaaggaagacttt

SEQ ID NO: 333766 - DNA, 17 bp, Homo sapiens
tctttgaaatatgcatg

SEQ ID NO: 333767 - DNA, 14 bp, Homo sapiens
tctttgaatgcttt

SEQ ID NO: 333768 - DNA, 17 bp, Homo sapiens
tctttgaccaaactgtg

SEQ ID NO: 333769 - DNA, 18 bp, Homo sapiens
tctttgactataacaaaa

SEQ ID NO: 333770 - DNA, 21 bp, Homo sapiens
tctttgagaaaggattaagat

SEQ ID NO: 333771 - DNA, 21 bp, Homo sapiens
tctttgagaatattataaaaa

SEQ ID NO: 333772 - DNA, 19 bp, Homo sapiens
tctttgagggactgcctct

SEQ ID NO: 333773 - DNA, 22 bp, Homo sapiens
tctttgagggactgcctctgcc

SEQ ID NO: 333774 - DNA, 17 bp, Homo sapiens
tctttgagtcaagtcaa

SEQ ID NO: 333775 - DNA, 12 bp, Homo sapiens
tctttgatggac

SEQ ID NO: 333776 - DNA, 21 bp, Homo sapiens
tctttgcaacaataataaatg

SEQ ID NO: 333777 - DNA, 16 bp, Homo sapiens
tctttgcattcgtcct

SEQ ID NO: 333778 - DNA, 17 bp, Homo sapiens
tctttgccttgatgttg

SEQ ID NO: 333779 - DNA, 21 bp, Homo sapiens
tctttgccttgggctgctcct

SEQ ID NO: 333780 - DNA, 12 bp, Homo sapiens
tctttgctgccc

SEQ ID NO: 333781 - DNA, 22 bp, Homo sapiens
tctttgcttccttgcttttatg

SEQ ID NO: 333782 - DNA, 15 bp, Homo sapiens
tctttggttcctcat

SEQ ID NO: 333783 - DNA, 14 bp, Homo sapiens
tctttgtaattatt

SEQ ID NO: 333784 - DNA, 18 bp, Homo sapiens
tctttgtctcaccagctc

SEQ ID NO: 333785 - DNA, 13 bp, Homo sapiens
tctttgttcctgc

SEQ ID NO: 333786 - DNA, 15 bp, Homo sapiens
tctttgtttacatga

SEQ ID NO: 333787 - DNA, 12 bp, Homo sapiens
tctttgttttgt

SEQ ID NO: 333788 - DNA, 18 bp, Homo sapiens
tcttttaaaaattcaaat

SEQ ID NO: 333789 - DNA, 13 bp, Homo sapiens
tcttttaaatggg

SEQ ID NO: 333790 - DNA, 15 bp, Homo sapiens
tcttttagagtaaac

SEQ ID NO: 333791 - DNA, 11 bp, Homo sapiens
tcttttatata

SEQ ID NO: 333792 - DNA, 16 bp, Homo sapiens
tcttttatatataaaa

SEQ ID NO: 333793 - DNA, 23 bp, Homo sapiens
tcttttatatataaaataaatat

SEQ ID NO: 333794 - DNA, 14 bp, Homo sapiens
tcttttatatctgt

SEQ ID NO: 333795 - DNA, 17 bp, Homo sapiens
tcttttatatctgtaaa

SEQ ID NO: 333796 - DNA, 19 bp, Homo sapiens
tcttttatatctgtaaatt

SEQ ID NO: 333797 - DNA, 16 bp, Homo sapiens
tcttttcagcttgttt

SEQ ID NO: 333798 - DNA, 16 bp, Homo sapiens
tcttttcattctcatt

SEQ ID NO: 333799 - DNA, 19 bp, Homo sapiens
tcttttcccatcaccagaa

SEQ ID NO: 333800 - DNA, 21 bp, Homo sapiens
tcttttcccctcattgcattt

SEQ ID NO: 333801 - DNA, 15 bp, Homo sapiens
tcttttccctctcta

SEQ ID NO: 333802 - DNA, 11 bp, Homo sapiens
tcttttcctcg

SEQ ID NO: 333803 - DNA, 13 bp, Homo sapiens
tcttttctctgtg

SEQ ID NO: 333804 - DNA, 20 bp, Homo sapiens
gccgcagggcgctccggcag

SEQ ID NO: 333805 - DNA, 21 bp, Homo sapiens
gccgcagggcgctccggcaga

SEQ ID NO: 333806 - DNA, 12 bp, Homo sapiens
gccgcatggccc

SEQ ID NO: 333807 - DNA, 19 bp, Homo sapiens
gccgcatgtctgcatggca

SEQ ID NO: 333808 - DNA, 13 bp, Homo sapiens
gccgccactggct

SEQ ID NO: 333809 - DNA, 15 bp, Homo sapiens
gccgccactggctgt

SEQ ID NO: 333810 - DNA, 22 bp, Homo sapiens
gccgccactggctgtgcctccc

SEQ ID NO: 333811 - DNA, 16 bp, Homo sapiens
gccgccattgccacca

SEQ ID NO: 333812 - DNA, 15 bp, Homo sapiens
gccgcccacctgcat

SEQ ID NO: 333813 - DNA, 14 bp, Homo sapiens
gccgcccagacacc

SEQ ID NO: 333814 - DNA, 19 bp, Homo sapiens
gccgcccagacaccacaga

SEQ ID NO: 333815 - DNA, 14 bp, Homo sapiens
gccgccccagcccc

SEQ ID NO: 333816 - DNA, 15 bp, Homo sapiens
gccgccccagcccct

SEQ ID NO: 333817 - DNA, 17 bp, Homo sapiens
gccgccccagccccttc

SEQ ID NO: 333818 - DNA, 17 bp, Homo sapiens
gccgccccgccccagag

SEQ ID NO: 333819 - DNA, 18 bp, Homo sapiens
gccgccccgccccagagc

SEQ ID NO: 333820 - DNA, 16 bp, Homo sapiens
gccgcccgggcccaga

SEQ ID NO: 333821 - DNA, 13 bp, Homo sapiens
gccgcctcccagc

SEQ ID NO: 333822 - DNA, 17 bp, Homo sapiens
gccgcctcctccagact

SEQ ID NO: 333823 - DNA, 20 bp, Homo sapiens
gccgcctcgggccgcctcct

SEQ ID NO: 333824 - DNA, 24 bp, Homo sapiens
gccgcctcgggccgcctcctccag

SEQ ID NO: 333825 - DNA, 20 bp, Homo sapiens
gccgcctctggttccactca

SEQ ID NO: 333826 - DNA, 13 bp, Homo sapiens
gccgcctgtcctt

SEQ ID NO: 333827 - DNA, 13 bp, Homo sapiens
gccgcctgtgccc

SEQ ID NO: 333828 - DNA, 17 bp, Homo sapiens
gccgcctgtgcccttgc

SEQ ID NO: 333829 - DNA, 22 bp, Homo sapiens
gccgccttccttgaccttcctc

SEQ ID NO: 333830 - DNA, 18 bp, Homo sapiens
gccgcgctctgcccctcc

SEQ ID NO: 333831 - DNA, 17 bp, Homo sapiens
gccgctagaggcctgag

SEQ ID NO: 333832 - DNA, 18 bp, Homo sapiens
gccgctagaggcctgagg

SEQ ID NO: 333833 - DNA, 18 bp, Homo sapiens
gccgctaggagagactga

SEQ ID NO: 333834 - DNA, 19 bp, Homo sapiens
gccgctaggagagactgaa

SEQ ID NO: 333835 - DNA, 12 bp, Homo sapiens
gccgctgggaga

SEQ ID NO: 333836 - DNA, 15 bp, Homo sapiens
gccgctgggagagcc

SEQ ID NO: 333837 - DNA, 17 bp, Homo sapiens
gccgctgggagagccaa

SEQ ID NO: 333838 - DNA, 23 bp, Homo sapiens
gccgcttccctacccacagggcc

SEQ ID NO: 333839 - DNA, 20 bp, Homo sapiens
gccggaccgcgtagagagcc

SEQ ID NO: 333840 - DNA, 15 bp, Homo sapiens
gccggatcttggaga

SEQ ID NO: 333841 - DNA, 13 bp, Homo sapiens
gccggcacagggt

SEQ ID NO: 333842 - DNA, 22 bp, Homo sapiens
gccggcacccacaagtgccact

SEQ ID NO: 333843 - DNA, 14 bp, Homo sapiens
gccggcagcctggt

SEQ ID NO: 333844 - DNA, 15 bp, Homo sapiens
gccggcaggggcccc

SEQ ID NO: 333845 - DNA, 13 bp, Homo sapiens
gccggccccaggc

SEQ ID NO: 333846 - DNA, 14 bp, Homo sapiens
gccggccccaggct

SEQ ID NO: 333847 - DNA, 22 bp, Homo sapiens
gccggccccaggctcccctggt

SEQ ID NO: 333848 - DNA, 12 bp, Homo sapiens
gccggccttggc

SEQ ID NO: 333849 - DNA, 13 bp, Homo sapiens
gccggccttggcc

SEQ ID NO: 333850 - DNA, 15 bp, Homo sapiens
gccggctgtggagca

SEQ ID NO: 333851 - DNA, 16 bp, Homo sapiens
gccggctgtggagcaa

SEQ ID NO: 333852 - DNA, 12 bp, Homo sapiens
gccgggcacagc

SEQ ID NO: 333853 - DNA, 13 bp, Homo sapiens
gccgggcctggac

SEQ ID NO: 333854 - DNA, 15 bp, Homo sapiens
gccgggcctggactg

SEQ ID NO: 333855 - DNA, 12 bp, Homo sapiens
gccgggcctggg

SEQ ID NO: 333856 - DNA, 17 bp, Homo sapiens
gccgggctgctgctgat

SEQ ID NO: 333857 - DNA, 18 bp, Homo sapiens
gccgggctggcttctccc

SEQ ID NO: 333858 - DNA, 16 bp, Homo sapiens
gccggggctggccctg

SEQ ID NO: 333859 - DNA, 17 bp, Homo sapiens
gccggggggagcaggag

SEQ ID NO: 333860 - DNA, 14 bp, Homo sapiens
gccgggggtggggg

SEQ ID NO: 333861 - DNA, 18 bp, Homo sapiens
gccggggtggggtgcctg

SEQ ID NO: 333862 - DNA, 19 bp, Homo sapiens
gccggggtggggtgcctga

SEQ ID NO: 333863 - DNA, 14 bp, Homo sapiens
gccggtccaccccg

SEQ ID NO: 333864 - DNA, 18 bp, Homo sapiens
gccggtccaccccgtccc

SEQ ID NO: 333865 - DNA, 17 bp, Homo sapiens
gccggtcccccatgcca

SEQ ID NO: 333866 - DNA, 23 bp, Homo sapiens
gccgtagcgtttccgtgagctca

SEQ ID NO: 333867 - DNA, 18 bp, Homo sapiens
gccgtccatggcaccagc

SEQ ID NO: 333868 - DNA, 20 bp, Homo sapiens
gccgtccatggcaccagccc

SEQ ID NO: 333869 - DNA, 18 bp, Homo sapiens
gccgtcccgcgttcaaga

SEQ ID NO: 333870 - DNA, 19 bp, Homo sapiens
gccgtcccgcgttcaagac

SEQ ID NO: 333871 - DNA, 17 bp, Homo sapiens
gccgtccctgacttccc

SEQ ID NO: 333872 - DNA, 14 bp, Homo sapiens
gccgtctgactcca

SEQ ID NO: 333873 - DNA, 17 bp, Homo sapiens
gccgtctgactccagag

SEQ ID NO: 333874 - DNA, 21 bp, Homo sapiens
gccgtctgactccagagtctg

SEQ ID NO: 333875 - DNA, 19 bp, Homo sapiens
gccgtctggcgagccctta

SEQ ID NO: 333876 - DNA, 22 bp, Homo sapiens
tgaaaatttgagactatttaaa

SEQ ID NO: 333877 - DNA, 13 bp, Homo sapiens
tgaaaattttact

SEQ ID NO: 333878 - DNA, 15 bp, Homo sapiens
tgaaaattttacttc

SEQ ID NO: 333879 - DNA, 18 bp, Homo sapiens
tgaaaattttacttccat

SEQ ID NO: 333880 - DNA, 14 bp, Homo sapiens
tgaaacaaagctgc

SEQ ID NO: 333881 - DNA, 22 bp, Homo sapiens
tgaaacaaataatcacattgac

SEQ ID NO: 333882 - DNA, 21 bp, Homo sapiens
tgaaacacacaggccatttca

SEQ ID NO: 333883 - DNA, 18 bp, Homo sapiens
tgaaacacaccaggctgt

SEQ ID NO: 333884 - DNA, 19 bp, Homo sapiens
tgaaacacaccaggctgtg

SEQ ID NO: 333885 - DNA, 22 bp, Homo sapiens
tgaaacacaccaggctgtgggc

SEQ ID NO: 333886 - DNA, 20 bp, Homo sapiens
tgaaacactcgtgtgcatga

SEQ ID NO: 333887 - DNA, 11 bp, Homo sapiens
tgaaacacttt

SEQ ID NO: 333888 - DNA, 20 bp, Homo sapiens
tgaaacagtgtggatgtaaa

SEQ ID NO: 333889 - DNA, 21 bp, Homo sapiens
tgaaacattcacacagggctc

SEQ ID NO: 333890 - DNA, 20 bp, Homo sapiens
tgaaacattccgaagaggga

SEQ ID NO: 333891 - DNA, 20 bp, Homo sapiens
tgaaacatttgacacataaa

SEQ ID NO: 333892 - DNA, 14 bp, Homo sapiens
tgaaacattttgtc

SEQ ID NO: 333893 - DNA, 20 bp, Homo sapiens
tgaaactagacttgaggaaa

SEQ ID NO: 333894 - DNA, 16 bp, Homo sapiens
tgaaactcacaaatga

SEQ ID NO: 333895 - DNA, 22 bp, Homo sapiens
tgaaagaaaataccaaggaaca

SEQ ID NO: 333896 - DNA, 22 bp, Homo sapiens
tgaaagaaacagttaactttca

SEQ ID NO: 333897 - DNA, 13 bp, Homo sapiens
tgaaagaagaaca

SEQ ID NO: 333898 - DNA, 17 bp, Homo sapiens
tgaaagaagtcaaatga

SEQ ID NO: 333899 - DNA, 16 bp, Homo sapiens
tgaaagaattattttt

SEQ ID NO: 333900 - DNA, 22 bp, Homo sapiens
tgaaagacaaagaaggaaaaga

SEQ ID NO: 333901 - DNA, 15 bp, Homo sapiens
tgaaagacagtaaag

SEQ ID NO: 333902 - DNA, 13 bp, Homo sapiens
tgaaagacatttc

SEQ ID NO: 333903 - DNA, 14 bp, Homo sapiens
tgaaagacatttca

SEQ ID NO: 333904 - DNA, 21 bp, Homo sapiens
tgaaagaggctgaggcctgga

SEQ ID NO: 333905 - DNA, 16 bp, Homo sapiens
tgaaagagttaagaat

SEQ ID NO: 333906 - DNA, 23 bp, Homo sapiens
tgaaagatggctgtgcctctgcc

SEQ ID NO: 333907 - DNA, 22 bp, Homo sapiens
tgaaagcagcagctaggactga

SEQ ID NO: 333908 - DNA, 22 bp, Homo sapiens
tgaaagcagggaatttctatct

SEQ ID NO: 333909 - DNA, 15 bp, Homo sapiens
tgaaagcatccatgt

SEQ ID NO: 333910 - DNA, 12 bp, Homo sapiens
tgaaagcctgtc

SEQ ID NO: 333911 - DNA, 14 bp, Homo sapiens
tgaaagcctgtctc

SEQ ID NO: 333912 - DNA, 17 bp, Homo sapiens
tgaaaggaaagaggctc

SEQ ID NO: 333913 - DNA, 18 bp, Homo sapiens
tgaaaggagacaatggtt

SEQ ID NO: 333914 - DNA, 15 bp, Homo sapiens
tgaaagggagcccct

SEQ ID NO: 333915 - DNA, 23 bp, Homo sapiens
tgaaagggagtattacaaaaaca

SEQ ID NO: 333916 - DNA, 15 bp, Homo sapiens
tgaaaggtttacatt

SEQ ID NO: 333917 - DNA, 14 bp, Homo sapiens
tgaaagtacatttg

SEQ ID NO: 333918 - DNA, 14 bp, Homo sapiens
tgaaagtcagttta

SEQ ID NO: 333919 - DNA, 22 bp, Homo sapiens
tgaaagtggggtgttgaagacc

SEQ ID NO: 333920 - DNA, 20 bp, Homo sapiens
tgaaagtgggtttcaattta

SEQ ID NO: 333921 - DNA, 22 bp, Homo sapiens
tgaaagtgttttactctttttc

SEQ ID NO: 333922 - DNA, 13 bp, Homo sapiens
tgaaagtgttttt

SEQ ID NO: 333923 - DNA, 21 bp, Homo sapiens
tgaaagtgtttttctttaatc

SEQ ID NO: 333924 - DNA, 20 bp, Homo sapiens
tgaaagttttcagaacctct

SEQ ID NO: 333925 - DNA, 14 bp, Homo sapiens
tgaaagttttccag

SEQ ID NO: 333926 - DNA, 18 bp, Homo sapiens
tgaaagttttccagtatt

SEQ ID NO: 333927 - DNA, 20 bp, Homo sapiens
tgaaagttttccagtattga

SEQ ID NO: 333928 - DNA, 23 bp, Homo sapiens
tgaaagttttccagtattgaaaa

SEQ ID NO: 333929 - DNA, 17 bp, Homo sapiens
tgaaataacatggcctt

SEQ ID NO: 333930 - DNA, 14 bp, Homo sapiens
tgaaataactcctt

SEQ ID NO: 333931 - DNA, 16 bp, Homo sapiens
tgaaatataaactgtg

SEQ ID NO: 333932 - DNA, 17 bp, Homo sapiens
tgaaatataaactgtga

SEQ ID NO: 333933 - DNA, 18 bp, Homo sapiens
tgaaatataaactgtgag

SEQ ID NO: 333934 - DNA, 18 bp, Homo sapiens
gcctcacctggcttccca

SEQ ID NO: 333935 - DNA, 20 bp, Homo sapiens
gcctcacctggcttcccagg

SEQ ID NO: 333936 - DNA, 21 bp, Homo sapiens
gcctcacctggcttcccagga

SEQ ID NO: 333937 - DNA, 22 bp, Homo sapiens
gcctcaccttccctagttcttt

SEQ ID NO: 333938 - DNA, 23 bp, Homo sapiens
gcctcacggggttggctgttcca

SEQ ID NO: 333939 - DNA, 16 bp, Homo sapiens
gcctcactggctgggg

SEQ ID NO: 333940 - DNA, 16 bp, Homo sapiens
gcctcacttgaatgtg

SEQ ID NO: 333941 - DNA, 23 bp, Homo sapiens
gcctcagaattgatcattttccc

SEQ ID NO: 333942 - DNA, 12 bp, Homo sapiens
gcctcagaccaa

SEQ ID NO: 333943 - DNA, 13 bp, Homo sapiens
gcctcagactcat

SEQ ID NO: 333944 - DNA, 13 bp, Homo sapiens
gcctcagagacag

SEQ ID NO: 333945 - DNA, 16 bp, Homo sapiens
gcctcagccagctgcc

SEQ ID NO: 333946 - DNA, 22 bp, Homo sapiens
gcctcagccagctgcccacaag

SEQ ID NO: 333947 - DNA, 16 bp, Homo sapiens
gcctcagcgctgccca

SEQ ID NO: 333948 - DNA, 17 bp, Homo sapiens
gcctcagcgctgcccac

SEQ ID NO: 333949 - DNA, 15 bp, Homo sapiens
gcctcagctgcctca

SEQ ID NO: 333950 - DNA, 12 bp, Homo sapiens
gcctcagggctt

SEQ ID NO: 333951 - DNA, 16 bp, Homo sapiens
gcctcagggcttcctt

SEQ ID NO: 333952 - DNA, 16 bp, Homo sapiens
gcctcagtccctccct

SEQ ID NO: 333953 - DNA, 16 bp, Homo sapiens
gcctcagtgccacttg

SEQ ID NO: 333954 - DNA, 24 bp, Homo sapiens
gcctcagtgccacttgacattcct

SEQ ID NO: 333955 - DNA, 21 bp, Homo sapiens
gcctcagtggactttccaccc

SEQ ID NO: 333956 - DNA, 22 bp, Homo sapiens
gcctcagtggactttccacccc

SEQ ID NO: 333957 - DNA, 21 bp, Homo sapiens
gcctcagtgtcctcatctata

SEQ ID NO: 333958 - DNA, 22 bp, Homo sapiens
gcctcagtgtcctcatctataa

SEQ ID NO: 333959 - DNA, 16 bp, Homo sapiens
gcctcagtttctccat

SEQ ID NO: 333960 - DNA, 14 bp, Homo sapiens
gcctcatccctcgg

SEQ ID NO: 333961 - DNA, 24 bp, Homo sapiens
gcctcatccctcggaagccgtctg

SEQ ID NO: 333962 - DNA, 21 bp, Homo sapiens
gcctcatcctcctggacccag

SEQ ID NO: 333963 - DNA, 14 bp, Homo sapiens
gcctcatgccacac

SEQ ID NO: 333964 - DNA, 16 bp, Homo sapiens
gcctcatgccacacct

SEQ ID NO: 333965 - DNA, 17 bp, Homo sapiens
gcctcatgccacacctt

SEQ ID NO: 333966 - DNA, 12 bp, Homo sapiens
gcctcattcact

SEQ ID NO: 333967 - DNA, 17 bp, Homo sapiens
gcctcattcactgtcct

SEQ ID NO: 333968 - DNA, 21 bp, Homo sapiens
gcctcatttcactagagacaa

SEQ ID NO: 333969 - DNA, 14 bp, Homo sapiens
gcctccaagaaact

SEQ ID NO: 333970 - DNA, 23 bp, Homo sapiens
gcctccactcccccacctgacaa

SEQ ID NO: 333971 - DNA, 12 bp, Homo sapiens
gcctccactcta

SEQ ID NO: 333972 - DNA, 18 bp, Homo sapiens
gcctccagagccagcctg

SEQ ID NO: 333973 - DNA, 21 bp, Homo sapiens
gcctccagagccagcctggga

SEQ ID NO: 333974 - DNA, 22 bp, Homo sapiens
gcctccagagccagcctgggac

SEQ ID NO: 333975 - DNA, 20 bp, Homo sapiens
gcctccagcacatgcggctt

SEQ ID NO: 333976 - DNA, 12 bp, Homo sapiens
gcctccagcctc

SEQ ID NO: 333977 - DNA, 20 bp, Homo sapiens
gcctccagcctctcccggct

SEQ ID NO: 333978 - DNA, 21 bp, Homo sapiens
gcctccaggcccccaactccg

SEQ ID NO: 333979 - DNA, 23 bp, Homo sapiens
gcctccaggctggggcctggcct

SEQ ID NO: 333980 - DNA, 11 bp, Homo sapiens
gcctccatgct

SEQ ID NO: 333981 - DNA, 17 bp, Homo sapiens
gcctcccaataaagctg

SEQ ID NO: 333982 - DNA, 19 bp, Homo sapiens
gcctcccacacttgctggg

SEQ ID NO: 333983 - DNA, 20 bp, Homo sapiens
gcctcccacacttgctgggg

SEQ ID NO: 333984 - DNA, 22 bp, Homo sapiens
gcctcccacacttgctggggct

SEQ ID NO: 333985 - DNA, 17 bp, Homo sapiens
gcctcccacccccatct

SEQ ID NO: 333986 - DNA, 15 bp, Homo sapiens
gcctcccacgctggg

SEQ ID NO: 333987 - DNA, 17 bp, Homo sapiens
gcctcccactcctgttc

SEQ ID NO: 333988 - DNA, 14 bp, Homo sapiens
gcctcccagccacc

SEQ ID NO: 333989 - DNA, 13 bp, Homo sapiens
gcctcccagcctg

SEQ ID NO: 333990 - DNA, 17 bp, Homo sapiens
gcctcccatagtgctgg

SEQ ID NO: 333991 - DNA, 19 bp, Homo sapiens
gcctccccaaccctgcccc

SEQ ID NO: 333992 - DNA, 20 bp, Homo sapiens
gcctccccaaccctgcccct

SEQ ID NO: 333993 - DNA, 22 bp, Homo sapiens
gcctccccaaccctgcccctgc

SEQ ID NO: 333994 - DNA, 13 bp, Homo sapiens
gcctcccccaaag

SEQ ID NO: 333995 - DNA, 17 bp, Homo sapiens
gcctcccccagccagga

SEQ ID NO: 333996 - DNA, 12 bp, Homo sapiens
gcctcccccagg

SEQ ID NO: 333997 - DNA, 15 bp, Homo sapiens
gcctcccccaggctg

SEQ ID NO: 333998 - DNA, 23 bp, Homo sapiens
gcctcccccaggctgcgcctgcc

SEQ ID NO: 333999 - DNA, 15 bp, Homo sapiens
gcctccccccagacc

SEQ ID NO: 334000 - DNA, 14 bp, Homo sapiens
gcctcccccgccac

SEQ ID NO: 334001 - DNA, 22 bp, Homo sapiens
gcctccccgggggtccccggac

SEQ ID NO: 334002 - DNA, 14 bp, Homo sapiens
gcctcccctcccct

SEQ ID NO: 334003 - DNA, 17 bp, Homo sapiens
gcctcccctcccctggg

SEQ ID NO: 334004 - DNA, 22 bp, Homo sapiens
gcctcccctcctctcctgccca

SEQ ID NO: 334005 - DNA, 13 bp, Homo sapiens
gcctcccctgcgg

SEQ ID NO: 334006 - DNA, 14 bp, Homo sapiens
gcctcccctgcgga

SEQ ID NO: 334007 - DNA, 24 bp, Homo sapiens
gcctcccctgcggagctgcatgga

SEQ ID NO: 334008 - DNA, 17 bp, Homo sapiens
gcctcccgcatgctgcc

SEQ ID NO: 334009 - DNA, 22 bp, Homo sapiens
gcctcccgcatgctgcctgcct

SEQ ID NO: 334010 - DNA, 13 bp, Homo sapiens
gcctcccgccgcc

SEQ ID NO: 334011 - DNA, 20 bp, Homo sapiens
gcctcccggctttgcaggga

SEQ ID NO: 334012 - DNA, 18 bp, Homo sapiens
tgaagcaaatcagaaact

SEQ ID NO: 334013 - DNA, 15 bp, Homo sapiens
tgaagcaagttcact

SEQ ID NO: 334014 - DNA, 13 bp, Homo sapiens
tgaagcacaagtt

SEQ ID NO: 334015 - DNA, 15 bp, Homo sapiens
tgaagcagtgcctcg

SEQ ID NO: 334016 - DNA, 17 bp, Homo sapiens
tgaagcagttgtgtcag

SEQ ID NO: 334017 - DNA, 19 bp, Homo sapiens
tgaagcatgctttgctgct

SEQ ID NO: 334018 - DNA, 14 bp, Homo sapiens
tgaagcatgtttca

SEQ ID NO: 334019 - DNA, 19 bp, Homo sapiens
tgaagcatgtttcatgttt

SEQ ID NO: 334020 - DNA, 13 bp, Homo sapiens
tgaagcctctgcc

SEQ ID NO: 334021 - DNA, 20 bp, Homo sapiens
tgaagcctctgccctgcctc

SEQ ID NO: 334022 - DNA, 20 bp, Homo sapiens
tgaagctgaaccccctccag

SEQ ID NO: 334023 - DNA, 18 bp, Homo sapiens
tgaagcttattaatgcta

SEQ ID NO: 334024 - DNA, 19 bp, Homo sapiens
tgaaggaatagccagagag

SEQ ID NO: 334025 - DNA, 20 bp, Homo sapiens
tgaaggaatagccagagagg

SEQ ID NO: 334026 - DNA, 15 bp, Homo sapiens
tgaaggacctgggct

SEQ ID NO: 334027 - DNA, 19 bp, Homo sapiens
tgaaggccttattctacat

SEQ ID NO: 334028 - DNA, 14 bp, Homo sapiens
tgaagggagagcca

SEQ ID NO: 334029 - DNA, 16 bp, Homo sapiens
tgaagggagagccagc

SEQ ID NO: 334030 - DNA, 19 bp, Homo sapiens
tgaagggagagccagctcc

SEQ ID NO: 334031 - DNA, 19 bp, Homo sapiens
tgaaggggcacaccactgc

SEQ ID NO: 334032 - DNA, 19 bp, Homo sapiens
tgaagggggatatgaatgg

SEQ ID NO: 334033 - DNA, 16 bp, Homo sapiens
tgaagggtgacatccc

SEQ ID NO: 334034 - DNA, 19 bp, Homo sapiens
tgaaggtaactaagaagtg

SEQ ID NO: 334035 - DNA, 15 bp, Homo sapiens
tgaaggtgcccagga

SEQ ID NO: 334036 - DNA, 15 bp, Homo sapiens
tgaaggtgtgctaca

SEQ ID NO: 334037 - DNA, 16 bp, Homo sapiens
tgaaggtgtgctacag

SEQ ID NO: 334038 - DNA, 16 bp, Homo sapiens
tgaaggttaggattta

SEQ ID NO: 334039 - DNA, 20 bp, Homo sapiens
tgaaggttaggatttaacag

SEQ ID NO: 334040 - DNA, 17 bp, Homo sapiens
tgaagtaagttctgaaa

SEQ ID NO: 334041 - DNA, 14 bp, Homo sapiens
tgaagtaatgaatt

SEQ ID NO: 334042 - DNA, 17 bp, Homo sapiens
tgaagtacagtcccagc

SEQ ID NO: 334043 - DNA, 18 bp, Homo sapiens
tgaagtacagtcccagca

SEQ ID NO: 334044 - DNA, 20 bp, Homo sapiens
tgaagtacagtcccagcaca

SEQ ID NO: 334045 - DNA, 23 bp, Homo sapiens
tgaagtacagtcccagcacattt

SEQ ID NO: 334046 - DNA, 16 bp, Homo sapiens
tgaagtactgcaccca

SEQ ID NO: 334047 - DNA, 13 bp, Homo sapiens
tgaagtagaacaa

SEQ ID NO: 334048 - DNA, 14 bp, Homo sapiens
tgaagtagtttgta

SEQ ID NO: 334049 - DNA, 16 bp, Homo sapiens
tgaagtatctgtacct

SEQ ID NO: 334050 - DNA, 19 bp, Homo sapiens
tgaagtcaaaccttaagat

SEQ ID NO: 334051 - DNA, 20 bp, Homo sapiens
tgaagtcaaaccttaagata

SEQ ID NO: 334052 - DNA, 15 bp, Homo sapiens
tgaagtcactgcaca

SEQ ID NO: 334053 - DNA, 20 bp, Homo sapiens
tgaagtcccaatttaagagt

SEQ ID NO: 334054 - DNA, 17 bp, Homo sapiens
tgaagtctttgtacaga

SEQ ID NO: 334055 - DNA, 14 bp, Homo sapiens
tgaagtcttttctg

SEQ ID NO: 334056 - DNA, 18 bp, Homo sapiens
tgaagtgatgatggatga

SEQ ID NO: 334057 - DNA, 16 bp, Homo sapiens
tgaagtgattgacatt

SEQ ID NO: 334058 - DNA, 15 bp, Homo sapiens
tgaagtgtggctggt

SEQ ID NO: 334059 - DNA, 18 bp, Homo sapiens
tgaagtgtggctggtgtc

SEQ ID NO: 334060 - DNA, 16 bp, Homo sapiens
tgaagttcatggtgat

SEQ ID NO: 334061 - DNA, 20 bp, Homo sapiens
tgaagttcatggtgatcagt

SEQ ID NO: 334062 - DNA, 14 bp, Homo sapiens
tgaagttctcctga

SEQ ID NO: 334063 - DNA, 14 bp, Homo sapiens
tgaagttggacagc

SEQ ID NO: 334064 - DNA, 18 bp, Homo sapiens
tgacacctaccatgctgc

SEQ ID NO: 334065 - DNA, 17 bp, Homo sapiens
tgacacgtccaccccag

SEQ ID NO: 334066 - DNA, 22 bp, Homo sapiens
tgacactctagtgacttcctgg

SEQ ID NO: 334067 - DNA, 14 bp, Homo sapiens
tgacactgacattt

SEQ ID NO: 334068 - DNA, 23 bp, Homo sapiens
tgacacttcagagagctggtagt

SEQ ID NO: 334069 - DNA, 13 bp, Homo sapiens
tgacagaaaaaaa

SEQ ID NO: 334070 - DNA, 22 bp, Homo sapiens
tgacagaaaaaaaaatgtttta

SEQ ID NO: 334071 - DNA, 15 bp, Homo sapiens
tgacagacaggctct

SEQ ID NO: 334072 - DNA, 16 bp, Homo sapiens
tgacagagagttctgg

SEQ ID NO: 334073 - DNA, 22 bp, Homo sapiens
tgacagagcaggtctgcaggcc

SEQ ID NO: 334074 - DNA, 14 bp, Homo sapiens
tgacagatgttcca

SEQ ID NO: 334075 - DNA, 20 bp, Homo sapiens
tgacagcatttcagctgtga

SEQ ID NO: 334076 - DNA, 22 bp, Homo sapiens
tgacagcctcccacccccatct

SEQ ID NO: 334077 - DNA, 20 bp, Homo sapiens
tgacagccttgggcctttca

SEQ ID NO: 334078 - DNA, 13 bp, Homo sapiens
tgacagctgtgct

SEQ ID NO: 334079 - DNA, 18 bp, Homo sapiens
tgacaggaagactggaga

SEQ ID NO: 334080 - DNA, 23 bp, Homo sapiens
tgacaggaagcccaaggcagtgt

SEQ ID NO: 334081 - DNA, 14 bp, Homo sapiens
tgacaggcagacac

SEQ ID NO: 334082 - DNA, 20 bp, Homo sapiens
tgacaggcccagtggaacag

SEQ ID NO: 334083 - DNA, 14 bp, Homo sapiens
tgacagtgcctggg

SEQ ID NO: 334084 - DNA, 16 bp, Homo sapiens
tgacagtgccttctct

SEQ ID NO: 334085 - DNA, 16 bp, Homo sapiens
tgacataaacccatct

SEQ ID NO: 334086 - DNA, 17 bp, Homo sapiens
tgacataatgtagtgag

SEQ ID NO: 334087 - DNA, 21 bp, Homo sapiens
tgacatcaggtgatccacctg

SEQ ID NO: 334088 - DNA, 15 bp, Homo sapiens
tgacatccaaatcta

SEQ ID NO: 334089 - DNA, 16 bp, Homo sapiens
tgacatccaaatctag

SEQ ID NO: 334090 - DNA, 12 bp, Homo sapiens
tgacatcccagg

SEQ ID NO: 334091 - DNA, 17 bp, Homo sapiens
tgacatctacctcccga

SEQ ID NO: 334092 - DNA, 16 bp, Homo sapiens
tgacatgattccttcc

SEQ ID NO: 334093 - DNA, 18 bp, Homo sapiens
tgacatgattccttcctg

SEQ ID NO: 334094 - DNA, 18 bp, Homo sapiens
tgacatgcacagtttgca

SEQ ID NO: 334095 - DNA, 22 bp, Homo sapiens
tgacatgcgggctgggcagctg

SEQ ID NO: 334096 - DNA, 19 bp, Homo sapiens
tgacatgtgacatctacct

SEQ ID NO: 334097 - DNA, 21 bp, Homo sapiens
tgacatgtggaaagtgaattt

SEQ ID NO: 334098 - DNA, 17 bp, Homo sapiens
tgacatgtggggccagg

SEQ ID NO: 334099 - DNA, 19 bp, Homo sapiens
tgacatgttatatattttt

SEQ ID NO: 334100 - DNA, 15 bp, Homo sapiens
tgacatgttgtcaca

SEQ ID NO: 334101 - DNA, 12 bp, Homo sapiens
tgacattccaca

SEQ ID NO: 334102 - DNA, 10 bp, Homo sapiens
tgacattcct

SEQ ID NO: 334103 - DNA, 11 bp, Homo sapiens
tgacattcctt

SEQ ID NO: 334104 - DNA, 20 bp, Homo sapiens
tgacattccttgtcaccagc

SEQ ID NO: 334105 - DNA, 18 bp, Homo sapiens
tgacattgtagagcttct

SEQ ID NO: 334106 - DNA, 19 bp, Homo sapiens
tgacattgtatgtatctat

SEQ ID NO: 334107 - DNA, 12 bp, Homo sapiens
tgacatttcact

SEQ ID NO: 334108 - DNA, 20 bp, Homo sapiens
tgacatttgtcctgcagagc

SEQ ID NO: 334109 - DNA, 20 bp, Homo sapiens
tgacattttgtagctagttt

SEQ ID NO: 334110 - DNA, 23 bp, Homo sapiens
tgaccaaaagtgagatgggaagg

SEQ ID NO: 334111 - DNA, 15 bp, Homo sapiens
tgaccaagaactgca

SEQ ID NO: 334112 - DNA, 19 bp, Homo sapiens
tgaccaagaactgcatgga

SEQ ID NO: 334113 - DNA, 21 bp, Homo sapiens
tgaccaatcctatgtcatttc

SEQ ID NO: 334114 - DNA, 16 bp, Homo sapiens
tgaccaattgccctgc

SEQ ID NO: 334115 - DNA, 22 bp, Homo sapiens
tgaccaattgccctgccaggct

SEQ ID NO: 334116 - DNA, 13 bp, Homo sapiens
tgaccacccacca

SEQ ID NO: 334117 - DNA, 21 bp, Homo sapiens
tgaccacgctttctagctgtt

SEQ ID NO: 334118 - DNA, 21 bp, Homo sapiens
tgaccacggacgtttccatca

SEQ ID NO: 334119 - DNA, 16 bp, Homo sapiens
tgaccacggctgttcc

SEQ ID NO: 334120 - DNA, 15 bp, Homo sapiens
tgaccactgggcctg

SEQ ID NO: 334121 - DNA, 21 bp, Homo sapiens
tgaccagaaaatatgatatat

SEQ ID NO: 334122 - DNA, 13 bp, Homo sapiens
tgaccagtttacc

SEQ ID NO: 334123 - DNA, 23 bp, Homo sapiens
tgaccatccactctaccctccca

SEQ ID NO: 334124 - DNA, 14 bp, Homo sapiens
tgaccatcccatga

SEQ ID NO: 334125 - DNA, 22 bp, Homo sapiens
tgaccatctcttaggtctaatg

SEQ ID NO: 334126 - DNA, 14 bp, Homo sapiens
tgaccatttataat

SEQ ID NO: 334127 - DNA, 23 bp, Homo sapiens
tgaccatttataatgttagtaga

SEQ ID NO: 334128 - DNA, 12 bp, Homo sapiens
tgacccaccagt

SEQ ID NO: 334129 - DNA, 17 bp, Homo sapiens
tgacccaccagtgcctt

SEQ ID NO: 334130 - DNA, 21 bp, Homo sapiens
tgacccagccccttgagaaac

SEQ ID NO: 334131 - DNA, 23 bp, Homo sapiens
tgacccagccccttgagaaacct

SEQ ID NO: 334132 - DNA, 21 bp, Homo sapiens
tgacccagctcttctccccca

SEQ ID NO: 334133 - DNA, 19 bp, Homo sapiens
tgaccccacacgccggggc

SEQ ID NO: 334134 - DNA, 22 bp, Homo sapiens
tgaccccacacgccggggctgg

SEQ ID NO: 334135 - DNA, 19 bp, Homo sapiens
tgaccccacttatgctgct

SEQ ID NO: 334136 - DNA, 22 bp, Homo sapiens
tgacccccaaccaagtggctcc

SEQ ID NO: 334137 - DNA, 11 bp, Homo sapiens
tgaccccttcc

SEQ ID NO: 334138 - DNA, 13 bp, Homo sapiens
tgaccccttcctg

SEQ ID NO: 334139 - DNA, 15 bp, Homo sapiens
tgaccccttcctgtc

SEQ ID NO: 334140 - DNA, 21 bp, Homo sapiens
tgacccggaggccacatgagt

SEQ ID NO: 334141 - DNA, 23 bp, Homo sapiens
tgacccggcccccgccctctgcc

SEQ ID NO: 334142 - DNA, 22 bp, Homo sapiens
tgacccggcccctaccagccac

SEQ ID NO: 334143 - DNA, 22 bp, Homo sapiens
tgacccggctgggtcggccctg

SEQ ID NO: 334144 - DNA, 16 bp, Homo sapiens
tgacccggggcagctg

SEQ ID NO: 334145 - DNA, 15 bp, Homo sapiens
tgaccctactgtgga

SEQ ID NO: 334146 - DNA, 18 bp, Homo sapiens
tgaccctagaattccttt

SEQ ID NO: 334147 - DNA, 12 bp, Homo sapiens
tgaccctccctt

SEQ ID NO: 334148 - DNA, 16 bp, Homo sapiens
tgaccctcccttcctg

SEQ ID NO: 334149 - DNA, 14 bp, Homo sapiens
tgaccctctcactt

SEQ ID NO: 334150 - DNA, 16 bp, Homo sapiens
tgaccctggagcccgg

SEQ ID NO: 334151 - DNA, 20 bp, Homo sapiens
tgaccctgtgatgcctgaca

SEQ ID NO: 334152 - DNA, 20 bp, Homo sapiens
aagtgtggctggtgtcccct

SEQ ID NO: 334153 - DNA, 16 bp, Homo sapiens
aagtgtgtgtgcaatg

SEQ ID NO: 334154 - DNA, 14 bp, Homo sapiens
aagtgtttctgttc

SEQ ID NO: 334155 - DNA, 15 bp, Homo sapiens
aagtgttttactctt

SEQ ID NO: 334156 - DNA, 19 bp, Homo sapiens
aagtgttttactctttttc

SEQ ID NO: 334157 - DNA, 13 bp, Homo sapiens
aagtgttttcaca

SEQ ID NO: 334158 - DNA, 18 bp, Homo sapiens
aagttaaaaaaaataata

SEQ ID NO: 334159 - DNA, 20 bp, Homo sapiens
aagttaaaaaaaataataaa

SEQ ID NO: 334160 - DNA, 22 bp, Homo sapiens
aagttaaagagacaaatagtag

SEQ ID NO: 334161 - DNA, 12 bp, Homo sapiens
aagttaaataaa

SEQ ID NO: 334162 - DNA, 15 bp, Homo sapiens
aagttaagtgtcatt

SEQ ID NO: 334163 - DNA, 21 bp, Homo sapiens
aagttaatattggaagtgaaa

SEQ ID NO: 334164 - DNA, 13 bp, Homo sapiens
aagttactgggca

SEQ ID NO: 334165 - DNA, 19 bp, Homo sapiens
aagttataaatcaatgtca

SEQ ID NO: 334166 - DNA, 15 bp, Homo sapiens
aagttataccagcaa

SEQ ID NO: 334167 - DNA, 16 bp, Homo sapiens
aagttatagtatatct

SEQ ID NO: 334168 - DNA, 15 bp, Homo sapiens
aagttattaacattt

SEQ ID NO: 334169 - DNA, 11 bp, Homo sapiens
aagttattgta

SEQ ID NO: 334170 - DNA, 15 bp, Homo sapiens
aagttatttcttgtt

SEQ ID NO: 334171 - DNA, 17 bp, Homo sapiens
aagttatttgatctggt

SEQ ID NO: 334172 - DNA, 13 bp, Homo sapiens
aagttcacagtag

SEQ ID NO: 334173 - DNA, 19 bp, Homo sapiens
aagttcatagtttctgtaa

SEQ ID NO: 334174 - DNA, 21 bp, Homo sapiens
aagttcatgggcacctcatgg

SEQ ID NO: 334175 - DNA, 16 bp, Homo sapiens
aagttcattaaacaga

SEQ ID NO: 334176 - DNA, 17 bp, Homo sapiens
aagttcattaaacagaa

SEQ ID NO: 334177 - DNA, 20 bp, Homo sapiens
aagttcccccatcagttccc

SEQ ID NO: 334178 - DNA, 17 bp, Homo sapiens
aagttccctacttcctg

SEQ ID NO: 334179 - DNA, 15 bp, Homo sapiens
aagttctaagttcat

SEQ ID NO: 334180 - DNA, 19 bp, Homo sapiens
aagttctgaaaactgttta

SEQ ID NO: 334181 - DNA, 16 bp, Homo sapiens
aagttcttaggcacca

SEQ ID NO: 334182 - DNA, 14 bp, Homo sapiens
aagttcttcacctc

SEQ ID NO: 334183 - DNA, 20 bp, Homo sapiens
aagttgacctttatttatta

SEQ ID NO: 334184 - DNA, 18 bp, Homo sapiens
aagttgaggggagaggaa

SEQ ID NO: 334185 - DNA, 16 bp, Homo sapiens
aagttgattctgtccc

SEQ ID NO: 334186 - DNA, 20 bp, Homo sapiens
aagttgcgacggagagaaaa

SEQ ID NO: 334187 - DNA, 22 bp, Homo sapiens
aagttgcgacggagagaaaaaa

SEQ ID NO: 334188 - DNA, 13 bp, Homo sapiens
aagttgctgtaag

SEQ ID NO: 334189 - DNA, 16 bp, Homo sapiens
aagttgctgtgcccca

SEQ ID NO: 334190 - DNA, 15 bp, Homo sapiens
aagttggtcttactt

SEQ ID NO: 334191 - DNA, 17 bp, Homo sapiens
aagttgtaaacacagtg

SEQ ID NO: 334192 - DNA, 14 bp, Homo sapiens
aagttgtcttaaaa

SEQ ID NO: 334193 - DNA, 18 bp, Homo sapiens
aagttgtgccttttatag

SEQ ID NO: 334194 - DNA, 12 bp, Homo sapiens
tgacgccctgcg

SEQ ID NO: 334195 - DNA, 19 bp, Homo sapiens
tgacgcctgccctccccag

SEQ ID NO: 334196 - DNA, 18 bp, Homo sapiens
tgacgcgtggtcacagga

SEQ ID NO: 334197 - DNA, 20 bp, Homo sapiens
tgacgcgtggtcacaggacg

SEQ ID NO: 334198 - DNA, 21 bp, Homo sapiens
tgacggaaggacctatgtttg

SEQ ID NO: 334199 - DNA, 23 bp, Homo sapiens
tgacggaaggacctatgtttgct

SEQ ID NO: 334200 - DNA, 12 bp, Homo sapiens
tgacggccctgc

SEQ ID NO: 334201 - DNA, 18 bp, Homo sapiens
tgacggcgcccccagtgt

SEQ ID NO: 334202 - DNA, 21 bp, Homo sapiens
tgacggctgggtgtttcagtt

SEQ ID NO: 334203 - DNA, 19 bp, Homo sapiens
tgacgggggttggggtggg

SEQ ID NO: 334204 - DNA, 20 bp, Homo sapiens
tgacgggggttggggtgggg

SEQ ID NO: 334205 - DNA, 21 bp, Homo sapiens
tgacggtcctttaggcagcct

SEQ ID NO: 334206 - DNA, 23 bp, Homo sapiens
tgacggtcctttaggcagcctgc

SEQ ID NO: 334207 - DNA, 13 bp, Homo sapiens
tgacgtaagctct

SEQ ID NO: 334208 - DNA, 20 bp, Homo sapiens
tgacgtaagctctatctgca

SEQ ID NO: 334209 - DNA, 23 bp, Homo sapiens
tgacgttgatctcctggtagcat

SEQ ID NO: 334210 - DNA, 19 bp, Homo sapiens
tgactaattttgtattttt

SEQ ID NO: 334211 - DNA, 20 bp, Homo sapiens
tgactacagacattaaataa

SEQ ID NO: 334212 - DNA, 17 bp, Homo sapiens
tgactagggattcaggc

SEQ ID NO: 334213 - DNA, 15 bp, Homo sapiens
tgactagtacaaatt

SEQ ID NO: 334214 - DNA, 13 bp, Homo sapiens
tgactagtgctga

SEQ ID NO: 334215 - DNA, 17 bp, Homo sapiens
tgactagtgctgaagct

SEQ ID NO: 334216 - DNA, 21 bp, Homo sapiens
tgactatatagagatgttttt

SEQ ID NO: 334217 - DNA, 17 bp, Homo sapiens
tgactattttcgttcat

SEQ ID NO: 334218 - DNA, 22 bp, Homo sapiens
tgactcaggtggtgtccttctt

SEQ ID NO: 334219 - DNA, 18 bp, Homo sapiens
tgactccagagtctgagc

SEQ ID NO: 334220 - DNA, 11 bp, Homo sapiens
tgactccagga

SEQ ID NO: 334221 - DNA, 12 bp, Homo sapiens
tgactccaggag

SEQ ID NO: 334222 - DNA, 14 bp, Homo sapiens
tgactccaggagag

SEQ ID NO: 334223 - DNA, 18 bp, Homo sapiens
tgactccaggagaggagc

SEQ ID NO: 334224 - DNA, 18 bp, Homo sapiens
tgactcccaaagagctgc

SEQ ID NO: 334225 - DNA, 21 bp, Homo sapiens
tgactcgtatatgtctcaggt

SEQ ID NO: 334226 - DNA, 14 bp, Homo sapiens
tgactctaaatgca

SEQ ID NO: 334227 - DNA, 23 bp, Homo sapiens
tgactcttactaaccaccatttc

SEQ ID NO: 334228 - DNA, 15 bp, Homo sapiens
tgactgaaagaagaa

SEQ ID NO: 334229 - DNA, 19 bp, Homo sapiens
tgactgaaggggcacacca

SEQ ID NO: 334230 - DNA, 20 bp, Homo sapiens
tgactgaatttgggcctctt

SEQ ID NO: 334231 - DNA, 19 bp, Homo sapiens
tgactgagcagactggtga

SEQ ID NO: 334232 - DNA, 13 bp, Homo sapiens
tgactgagggcct

SEQ ID NO: 334233 - DNA, 14 bp, Homo sapiens
tgactgagggcctg

SEQ ID NO: 334234 - DNA, 20 bp, Homo sapiens
tgactgatgctgagattctt

SEQ ID NO: 334235 - DNA, 19 bp, Homo sapiens
tgactgcaacttctgtccc

SEQ ID NO: 334236 - DNA, 16 bp, Homo sapiens
tgactgcacccagctc

SEQ ID NO: 334237 - DNA, 21 bp, Homo sapiens
tgactgcattttactgtacag

SEQ ID NO: 334238 - DNA, 11 bp, Homo sapiens
tgactggcagg

SEQ ID NO: 334239 - DNA, 14 bp, Homo sapiens
tgactggcaggtgc

SEQ ID NO: 334240 - DNA, 18 bp, Homo sapiens
tgactggctgtctgcctg

SEQ ID NO: 334241 - DNA, 14 bp, Homo sapiens
tgactgggcctccc

SEQ ID NO: 334242 - DNA, 17 bp, Homo sapiens
tgactgggcctcccttg

SEQ ID NO: 334243 - DNA, 15 bp, Homo sapiens
tgactggggctgggg

SEQ ID NO: 334244 - DNA, 19 bp, Homo sapiens
tgactgggggcctctgcct

SEQ ID NO: 334245 - DNA, 20 bp, Homo sapiens
tgactgggggcctctgcctc

SEQ ID NO: 334246 - DNA, 14 bp, Homo sapiens
tgactgtaattaat

SEQ ID NO: 334247 - DNA, 21 bp, Homo sapiens
tgactgtaggcgcccctgggg

SEQ ID NO: 334248 - DNA, 16 bp, Homo sapiens
tgactgtgaccacctt

SEQ ID NO: 334249 - DNA, 17 bp, Homo sapiens
tgactgtgaccaccttc

SEQ ID NO: 334250 - DNA, 14 bp, Homo sapiens
tgactgtgatttat

SEQ ID NO: 334251 - DNA, 19 bp, Homo sapiens
tgactgtgatttatttgga

SEQ ID NO: 334252 - DNA, 15 bp, Homo sapiens
tgactgtttggctta

SEQ ID NO: 334253 - DNA, 18 bp, Homo sapiens
tgactgtttggcttataa

SEQ ID NO: 334254 - DNA, 14 bp, Homo sapiens
tgacttatgggccc

SEQ ID NO: 334255 - DNA, 19 bp, Homo sapiens
tgacttcagactctctcct

SEQ ID NO: 334256 - DNA, 15 bp, Homo sapiens
tgacttctatcctgt

SEQ ID NO: 334257 - DNA, 16 bp, Homo sapiens
tgacttcttgttcatg

SEQ ID NO: 334258 - DNA, 17 bp, Homo sapiens
tgacttgaatgtacaaa

SEQ ID NO: 334259 - DNA, 17 bp, Homo sapiens
tgactttatctcctgct

SEQ ID NO: 334260 - DNA, 20 bp, Homo sapiens
tgacttttaaggctaaaact

SEQ ID NO: 334261 - DNA, 16 bp, Homo sapiens
tgagaaaaaaacagca

SEQ ID NO: 334262 - DNA, 14 bp, Homo sapiens
tgagaaaacaggct

SEQ ID NO: 334263 - DNA, 21 bp, Homo sapiens
tgagaaaacgttttgtttgaa

SEQ ID NO: 334264 - DNA, 15 bp, Homo sapiens
tgagaaaaggggcat

SEQ ID NO: 334265 - DNA, 23 bp, Homo sapiens
tgagaaaccttattgtacctctc

SEQ ID NO: 334266 - DNA, 15 bp, Homo sapiens
tgagaaagcccacct

SEQ ID NO: 334267 - DNA, 18 bp, Homo sapiens
tgagaaagcccacctggg

SEQ ID NO: 334268 - DNA, 20 bp, Homo sapiens
tgagaaatgaataatttccc

SEQ ID NO: 334269 - DNA, 19 bp, Homo sapiens
tgagaacaagtcacagctg

SEQ ID NO: 334270 - DNA, 23 bp, Homo sapiens
tgagaacatggtgtgtgtctctg

SEQ ID NO: 334271 - DNA, 15 bp, Homo sapiens
tgagaactaaataga

SEQ ID NO: 334272 - DNA, 16 bp, Homo sapiens
tgagaactaaatagat

SEQ ID NO: 334273 - DNA, 15 bp, Homo sapiens
tgagaacttgacaag

SEQ ID NO: 334274 - DNA, 13 bp, Homo sapiens
tgagaagactagc

SEQ ID NO: 334275 - DNA, 15 bp, Homo sapiens
tgagaagagggcctg

SEQ ID NO: 334276 - DNA, 16 bp, Homo sapiens
tgagaagagggcctgt

SEQ ID NO: 334277 - DNA, 20 bp, Homo sapiens
tgagaagagggcctgtggga

SEQ ID NO: 334278 - DNA, 16 bp, Homo sapiens
tgagaagttaagcagc

SEQ ID NO: 334279 - DNA, 18 bp, Homo sapiens
tgagaagttaagcagcct

SEQ ID NO: 334280 - DNA, 19 bp, Homo sapiens
tgagaagttaagcagcctt

SEQ ID NO: 334281 - DNA, 12 bp, Homo sapiens
tgagaataaagc

SEQ ID NO: 334282 - DNA, 16 bp, Homo sapiens
tgagaataattgtgta

SEQ ID NO: 334283 - DNA, 19 bp, Homo sapiens
tgagaataattgtgtacaa

SEQ ID NO: 334284 - DNA, 17 bp, Homo sapiens
tgagaatattataaaaa

SEQ ID NO: 334285 - DNA, 14 bp, Homo sapiens
tgagaatcctgcct

SEQ ID NO: 334286 - DNA, 19 bp, Homo sapiens
tgagaatcgacctcactgt

SEQ ID NO: 334287 - DNA, 19 bp, Homo sapiens
tgagaatgtcatttgctaa

SEQ ID NO: 334288 - DNA, 15 bp, Homo sapiens
tgagaattaaaataa

SEQ ID NO: 334289 - DNA, 17 bp, Homo sapiens
tgagaattcagctgccc

SEQ ID NO: 334290 - DNA, 22 bp, Homo sapiens
tgagaattcagctgcccccgct

SEQ ID NO: 334291 - DNA, 22 bp, Homo sapiens
aataaccatggcaagagagaaa

SEQ ID NO: 334292 - DNA, 16 bp, Homo sapiens
aataaccccaaaatga

SEQ ID NO: 334293 - DNA, 17 bp, Homo sapiens
aataaccccaaaatgaa

SEQ ID NO: 334294 - DNA, 14 bp, Homo sapiens
aataacctgtgaat

SEQ ID NO: 334295 - DNA, 15 bp, Homo sapiens
aataactagatctcc

SEQ ID NO: 334296 - DNA, 19 bp, Homo sapiens
aataactagatctcctgta

SEQ ID NO: 334297 - DNA, 13 bp, Homo sapiens
aataactattgct

SEQ ID NO: 334298 - DNA, 14 bp, Homo sapiens
aataactccttctt

SEQ ID NO: 334299 - DNA, 13 bp, Homo sapiens
aataactgtgaag

SEQ ID NO: 334300 - DNA, 16 bp, Homo sapiens
aataactgtgaagttt

SEQ ID NO: 334301 - DNA, 19 bp, Homo sapiens
aataacttcagagaagtca

SEQ ID NO: 334302 - DNA, 12 bp, Homo sapiens
aataacttgaag

SEQ ID NO: 334303 - DNA, 14 bp, Homo sapiens
aataactttgctgg

SEQ ID NO: 334304 - DNA, 14 bp, Homo sapiens
aataagaatgattt

SEQ ID NO: 334305 - DNA, 16 bp, Homo sapiens
aataagaattgaatgt

SEQ ID NO: 334306 - DNA, 15 bp, Homo sapiens
aataagagaaagaaa

SEQ ID NO: 334307 - DNA, 13 bp, Homo sapiens
aataagctaaaga

SEQ ID NO: 334308 - DNA, 15 bp, Homo sapiens
aataagctctagttc

SEQ ID NO: 334309 - DNA, 22 bp, Homo sapiens
aataagctctagttcttaacaa

SEQ ID NO: 334310 - DNA, 16 bp, Homo sapiens
aataaggaagagggct

SEQ ID NO: 334311 - DNA, 22 bp, Homo sapiens
aataaggaagagggctgagctg

SEQ ID NO: 334312 - DNA, 17 bp, Homo sapiens
aataaggccttaatatg

SEQ ID NO: 334313 - DNA, 20 bp, Homo sapiens
aataagtgaatctaataaaa

SEQ ID NO: 334314 - DNA, 15 bp, Homo sapiens
aataagttaaaggca

SEQ ID NO: 334315 - DNA, 14 bp, Homo sapiens
aataataaatattt

SEQ ID NO: 334316 - DNA, 14 bp, Homo sapiens
aataatacactaat

SEQ ID NO: 334317 - DNA, 13 bp, Homo sapiens
aataatagtacta

SEQ ID NO: 334318 - DNA, 19 bp, Homo sapiens
aataatagttcaggatttg

SEQ ID NO: 334319 - DNA, 12 bp, Homo sapiens
aataatatgcat

SEQ ID NO: 334320 - DNA, 17 bp, Homo sapiens
aataatatgcattgtca

SEQ ID NO: 334321 - DNA, 17 bp, Homo sapiens
aataatattatattgta

SEQ ID NO: 334322 - DNA, 21 bp, Homo sapiens
aataatctggtgttcttgcta

SEQ ID NO: 334323 - DNA, 23 bp, Homo sapiens
aataatgacgtattgtgaaattt

SEQ ID NO: 334324 - DNA, 11 bp, Homo sapiens
aataatgattt

SEQ ID NO: 334325 - DNA, 20 bp, Homo sapiens
aataatggaattatgtataa

SEQ ID NO: 334326 - DNA, 21 bp, Homo sapiens
aataattaaaacaaaatcctt

SEQ ID NO: 334327 - DNA, 16 bp, Homo sapiens
aataattgtggagagg

SEQ ID NO: 334328 - DNA, 12 bp, Homo sapiens
aataattgtgta

SEQ ID NO: 334329 - DNA, 16 bp, Homo sapiens
aataattgtgtacaaa

SEQ ID NO: 334330 - DNA, 22 bp, Homo sapiens
aataatttaagccaataaataa

SEQ ID NO: 334331 - DNA, 23 bp, Homo sapiens
aataatttaagccaataaataat

SEQ ID NO: 334332 - DNA, 22 bp, Homo sapiens
aataatttcccaattaggaagt

SEQ ID NO: 334333 - DNA, 19 bp, Homo sapiens
aataatttttatatttaat

SEQ ID NO: 334334 - DNA, 20 bp, Homo sapiens
aataattttttagttaaaat

SEQ ID NO: 334335 - DNA, 20 bp, Homo sapiens
aatacaacttcattgctaca

SEQ ID NO: 334336 - DNA, 15 bp, Homo sapiens
aatacaattaaaggt

SEQ ID NO: 334337 - DNA, 22 bp, Homo sapiens
aatacaattaaaggtcctgccc

SEQ ID NO: 334338 - DNA, 17 bp, Homo sapiens
aatacaattactcacca

SEQ ID NO: 334339 - DNA, 23 bp, Homo sapiens
aatacacatagcatgtaatggta

SEQ ID NO: 334340 - DNA, 20 bp, Homo sapiens
aatacactaattcctttcta

SEQ ID NO: 334341 - DNA, 13 bp, Homo sapiens
aatacagacacta

SEQ ID NO: 334342 - DNA, 20 bp, Homo sapiens
aatacagacactaagttata

SEQ ID NO: 334343 - DNA, 19 bp, Homo sapiens
aatacataagttaatattg

SEQ ID NO: 334344 - DNA, 16 bp, Homo sapiens
aatacatctttatcat

SEQ ID NO: 334345 - DNA, 19 bp, Homo sapiens
aatacatgtgtggatgtgt

SEQ ID NO: 334346 - DNA, 20 bp, Homo sapiens
aatacattccatcacagcca

SEQ ID NO: 334347 - DNA, 15 bp, Homo sapiens
aatacctctttgaaa

SEQ ID NO: 334348 - DNA, 13 bp, Homo sapiens
aatacctttaaat

SEQ ID NO: 334349 - DNA, 15 bp, Homo sapiens
aatacctttaaatat

SEQ ID NO: 334350 - DNA, 19 bp, Homo sapiens
aatacctttaaatatcatt

SEQ ID NO: 334351 - DNA, 20 bp, Homo sapiens
aatacgccagaactgcttta

SEQ ID NO: 334352 - DNA, 16 bp, Homo sapiens
aatactaaatatgaaa

SEQ ID NO: 334353 - DNA, 18 bp, Homo sapiens
aatactaaatatgaaatt

SEQ ID NO: 334354 - DNA, 19 bp, Homo sapiens
aatactaaatatgaaattt

SEQ ID NO: 334355 - DNA, 16 bp, Homo sapiens
aatactataaatatat

SEQ ID NO: 334356 - DNA, 17 bp, Homo sapiens
aatactataaatatatt

SEQ ID NO: 334357 - DNA, 20 bp, Homo sapiens
aatactatgtatgtaaaata

SEQ ID NO: 334358 - DNA, 22 bp, Homo sapiens
aatactattggacagacacaga

SEQ ID NO: 334359 - DNA, 20 bp, Homo sapiens
aatactctagcctgggccag

SEQ ID NO: 334360 - DNA, 17 bp, Homo sapiens
aatacttaaaaatatgt

SEQ ID NO: 334361 - DNA, 23 bp, Homo sapiens
aatacttaaaaatatgtgagcat

SEQ ID NO: 334362 - DNA, 22 bp, Homo sapiens
aatacttatatttttaataaaa

SEQ ID NO: 334363 - DNA, 18 bp, Homo sapiens
aatacttatgttgtattg

SEQ ID NO: 334364 - DNA, 14 bp, Homo sapiens
aatactttatttct

SEQ ID NO: 334365 - DNA, 14 bp, Homo sapiens
aatactttgtgtct

SEQ ID NO: 334366 - DNA, 17 bp, Homo sapiens
aatactttgtgtctttt

SEQ ID NO: 334367 - DNA, 21 bp, Homo sapiens
aatacttttgtgtattctgtg

SEQ ID NO: 334368 - DNA, 13 bp, Homo sapiens
aatagaaaactga

SEQ ID NO: 334369 - DNA, 18 bp, Homo sapiens
aatagaaaactgaaaatc

SEQ ID NO: 334370 - DNA, 19 bp, Homo sapiens
aatagaaaactgaaaatct

SEQ ID NO: 334371 - DNA, 17 bp, Homo sapiens
aatagaatataattatc

SEQ ID NO: 334372 - DNA, 18 bp, Homo sapiens
aatagagatgagctttct

SEQ ID NO: 334373 - DNA, 13 bp, Homo sapiens
aatagagtactta

SEQ ID NO: 334374 - DNA, 20 bp, Homo sapiens
aatagagtcacagctttccc

SEQ ID NO: 334375 - DNA, 23 bp, Homo sapiens
aatagagtcacagctttcccagg

SEQ ID NO: 334376 - DNA, 17 bp, Homo sapiens
aatagagtttttatatt

SEQ ID NO: 334377 - DNA, 21 bp, Homo sapiens
aatagatttaccctttataga

SEQ ID NO: 334378 - DNA, 22 bp, Homo sapiens
aatagatttaccctttatagaa

SEQ ID NO: 334379 - DNA, 18 bp, Homo sapiens
aatagatttttagattcc

SEQ ID NO: 334380 - DNA, 20 bp, Homo sapiens
aatagcatgtcactaaagca

SEQ ID NO: 334381 - DNA, 16 bp, Homo sapiens
aatagcatgttgtaga

SEQ ID NO: 334382 - DNA, 14 bp, Homo sapiens
aatagcctcacctt

SEQ ID NO: 334383 - DNA, 15 bp, Homo sapiens
aatagctatatccat

SEQ ID NO: 334384 - DNA, 18 bp, Homo sapiens
aatagctatatccatgta

SEQ ID NO: 334385 - DNA, 21 bp, Homo sapiens
aatagctatatccatgtactg

SEQ ID NO: 334386 - DNA, 23 bp, Homo sapiens
aatagctatatccatgtactgta

SEQ ID NO: 334387 - DNA, 20 bp, Homo sapiens
aatagctatcctaaatttga

SEQ ID NO: 334388 - DNA, 21 bp, Homo sapiens
aatagctttaccctcaggcat

SEQ ID NO: 334389 - DNA, 16 bp, Homo sapiens
aataggaaagatttaa

SEQ ID NO: 334390 - DNA, 16 bp, Homo sapiens
aataggaagaacagta

SEQ ID NO: 334391 - DNA, 22 bp, Homo sapiens
aataggacaaaacgggttacta

SEQ ID NO: 334392 - DNA, 18 bp, Homo sapiens
aataggaggacagaacca

SEQ ID NO: 334393 - DNA, 20 bp, Homo sapiens
aatagtaagcctccctcctc

SEQ ID NO: 334394 - DNA, 13 bp, Homo sapiens
aatagtatatcta

SEQ ID NO: 334395 - DNA, 14 bp, Homo sapiens
aatagtatatctaa

SEQ ID NO: 334396 - DNA, 22 bp, Homo sapiens
aatagtatttgagagttctaaa

SEQ ID NO: 334397 - DNA, 16 bp, Homo sapiens
aatagtcatatgtgaa

SEQ ID NO: 334398 - DNA, 16 bp, Homo sapiens
aatagtcattccaaat

SEQ ID NO: 334399 - DNA, 18 bp, Homo sapiens
aatagtcctccaaaacac

SEQ ID NO: 334400 - DNA, 19 bp, Homo sapiens
aatagtcctccaaaacaca

SEQ ID NO: 334401 - DNA, 15 bp, Homo sapiens
aatagtctgtgtgaa

SEQ ID NO: 334402 - DNA, 19 bp, Homo sapiens
aatagtgaaaattttattg

SEQ ID NO: 334403 - DNA, 21 bp, Homo sapiens
aatagtgcctcagcgctgccc

SEQ ID NO: 334404 - DNA, 14 bp, Homo sapiens
aatagtgtgttctg

SEQ ID NO: 334405 - DNA, 15 bp, Homo sapiens
aatagtgtgttctga

SEQ ID NO: 334406 - DNA, 21 bp, Homo sapiens
aatagtgtgttctgattagaa

SEQ ID NO: 334407 - DNA, 22 bp, Homo sapiens
aatagtgtgttctgattagaaa

SEQ ID NO: 334408 - DNA, 18 bp, Homo sapiens
aatagttcaggatttggt

SEQ ID NO: 334409 - DNA, 19 bp, Homo sapiens
aatagttctatttctatct

SEQ ID NO: 334410 - DNA, 16 bp, Homo sapiens
aatagttttacattaa

SEQ ID NO: 334411 - DNA, 16 bp, Homo sapiens
aatataaaaataatta

SEQ ID NO: 334412 - DNA, 15 bp, Homo sapiens
aatataaactgtgag

SEQ ID NO: 334413 - DNA, 16 bp, Homo sapiens
aatataaactgtgaga

SEQ ID NO: 334414 - DNA, 19 bp, Homo sapiens
aatataaactgtgagataa

SEQ ID NO: 334415 - DNA, 21 bp, Homo sapiens
aatataaactgtgagataaat

SEQ ID NO: 334416 - DNA, 19 bp, Homo sapiens
aatataaataaataaaaat

SEQ ID NO: 334417 - DNA, 22 bp, Homo sapiens
aatataaatgaatgaaatataa

SEQ ID NO: 334418 - DNA, 17 bp, Homo sapiens
aatataaatgtactaca

SEQ ID NO: 334419 - DNA, 19 bp, Homo sapiens
aatataaatgtactacatt

SEQ ID NO: 334420 - DNA, 23 bp, Homo sapiens
aatataaatgtactacatttgca

SEQ ID NO: 334421 - DNA, 22 bp, Homo sapiens
aatataactgccttaaaacttt

SEQ ID NO: 334422 - DNA, 13 bp, Homo sapiens
aatataattctgt

SEQ ID NO: 334423 - DNA, 10 bp, Homo sapiens
aatatactaa

SEQ ID NO: 334424 - DNA, 20 bp, Homo sapiens
tgagaattttatattctaag

SEQ ID NO: 334425 - DNA, 14 bp, Homo sapiens
tgagacaaaaatta

SEQ ID NO: 334426 - DNA, 15 bp, Homo sapiens
tgagacaaaaattat

SEQ ID NO: 334427 - DNA, 16 bp, Homo sapiens
tgagacaaaaattatc

SEQ ID NO: 334428 - DNA, 18 bp, Homo sapiens
tgagacaaaaattatcta

SEQ ID NO: 334429 - DNA, 18 bp, Homo sapiens
tgagacaagccctggcaa

SEQ ID NO: 334430 - DNA, 19 bp, Homo sapiens
tgagacaagccctggcaac

SEQ ID NO: 334431 - DNA, 15 bp, Homo sapiens
tgagacactgtcaag

SEQ ID NO: 334432 - DNA, 13 bp, Homo sapiens
tgagacagaatct

SEQ ID NO: 334433 - DNA, 21 bp, Homo sapiens
tgagacagccggatcttggag

SEQ ID NO: 334434 - DNA, 23 bp, Homo sapiens
tgagacagggttttttcattttt

SEQ ID NO: 334435 - DNA, 15 bp, Homo sapiens
tgagaccacctctca

SEQ ID NO: 334436 - DNA, 21 bp, Homo sapiens
tgagaccagttgggagcactg

SEQ ID NO: 334437 - DNA, 18 bp, Homo sapiens
tgagacccccaagcttcc

SEQ ID NO: 334438 - DNA, 14 bp, Homo sapiens
tgagacccccacac

SEQ ID NO: 334439 - DNA, 16 bp, Homo sapiens
tgagacccccacacct

SEQ ID NO: 334440 - DNA, 14 bp, Homo sapiens
tgagaccctcttct

SEQ ID NO: 334441 - DNA, 22 bp, Homo sapiens
tgagaccctcttctctgggccc

SEQ ID NO: 334442 - DNA, 15 bp, Homo sapiens
tgagacctggaacca

SEQ ID NO: 334443 - DNA, 15 bp, Homo sapiens
tgagaccttgatgag

SEQ ID NO: 334444 - DNA, 23 bp, Homo sapiens
tgagacgtttttggaagagtagt

SEQ ID NO: 334445 - DNA, 13 bp, Homo sapiens
tgagactccagaa

SEQ ID NO: 334446 - DNA, 17 bp, Homo sapiens
tgagactgcagaggagc

SEQ ID NO: 334447 - DNA, 18 bp, Homo sapiens
tgagactgggtctcgctt

SEQ ID NO: 334448 - DNA, 12 bp, Homo sapiens
tgagacttccaa

SEQ ID NO: 334449 - DNA, 20 bp, Homo sapiens
tgagagaaaaagtgcccctt

SEQ ID NO: 334450 - DNA, 14 bp, Homo sapiens
tgagagagacaaga

SEQ ID NO: 334451 - DNA, 15 bp, Homo sapiens
tgagagagacaagaa

SEQ ID NO: 334452 - DNA, 11 bp, Homo sapiens
tgagagagtgt

SEQ ID NO: 334453 - DNA, 15 bp, Homo sapiens
tgagagagtgtggaa

SEQ ID NO: 334454 - DNA, 14 bp, Homo sapiens
aatatcactttgta

SEQ ID NO: 334455 - DNA, 20 bp, Homo sapiens
aatatcactttgtattctct

SEQ ID NO: 334456 - DNA, 19 bp, Homo sapiens
aatatcagtagaaactcta

SEQ ID NO: 334457 - DNA, 14 bp, Homo sapiens
aatatcatatgtat

SEQ ID NO: 334458 - DNA, 22 bp, Homo sapiens
aatatcattatagcatgtaata

SEQ ID NO: 334459 - DNA, 14 bp, Homo sapiens
aatatcattcagca

SEQ ID NO: 334460 - DNA, 11 bp, Homo sapiens
aatatcattct

SEQ ID NO: 334461 - DNA, 20 bp, Homo sapiens
aatatcattctttgtatctt

SEQ ID NO: 334462 - DNA, 13 bp, Homo sapiens
aatatcatttatt

SEQ ID NO: 334463 - DNA, 14 bp, Homo sapiens
aatatcattttatt

SEQ ID NO: 334464 - DNA, 19 bp, Homo sapiens
aatatcattttcctgggag

SEQ ID NO: 334465 - DNA, 14 bp, Homo sapiens
aatatccaaagact

SEQ ID NO: 334466 - DNA, 14 bp, Homo sapiens
aatatcctatactg

SEQ ID NO: 334467 - DNA, 23 bp, Homo sapiens
aatatcgatcagatgactagaaa

SEQ ID NO: 334468 - DNA, 19 bp, Homo sapiens
aatatctatttatctgtct

SEQ ID NO: 334469 - DNA, 20 bp, Homo sapiens
aatatctgacagttactctt

SEQ ID NO: 334470 - DNA, 17 bp, Homo sapiens
aatatctgactgaaatt

SEQ ID NO: 334471 - DNA, 14 bp, Homo sapiens
aatatctgctgtat

SEQ ID NO: 334472 - DNA, 13 bp, Homo sapiens
aatatcttgaaga

SEQ ID NO: 334473 - DNA, 18 bp, Homo sapiens
aatatcttgaagaatatt

SEQ ID NO: 334474 - DNA, 14 bp, Homo sapiens
aatatctttcagtt

SEQ ID NO: 334475 - DNA, 16 bp, Homo sapiens
aatatgaaatgataaa

SEQ ID NO: 334476 - DNA, 11 bp, Homo sapiens
aatatgaaatt

SEQ ID NO: 334477 - DNA, 21 bp, Homo sapiens
aatatgaaattttaccatttt

SEQ ID NO: 334478 - DNA, 18 bp, Homo sapiens
aatatgaatacagggcat

SEQ ID NO: 334479 - DNA, 17 bp, Homo sapiens
aatatgacctaaatcca

SEQ ID NO: 334480 - DNA, 22 bp, Homo sapiens
aatatgaggggactgcatgcaa

SEQ ID NO: 334481 - DNA, 17 bp, Homo sapiens
aatatgatatatatgta

SEQ ID NO: 334482 - DNA, 16 bp, Homo sapiens
aatatgatctgtggag

SEQ ID NO: 334483 - DNA, 11 bp, Homo sapiens
aatatgatgac

SEQ ID NO: 334484 - DNA, 20 bp, Homo sapiens
aatatgattctcctctccca

SEQ ID NO: 334485 - DNA, 15 bp, Homo sapiens
aatatgcatctttga

SEQ ID NO: 334486 - DNA, 14 bp, Homo sapiens
aatatgctgccaaa

SEQ ID NO: 334487 - DNA, 12 bp, Homo sapiens
aatatgctgtgg

SEQ ID NO: 334488 - DNA, 17 bp, Homo sapiens
aatatgctgtggggcat

SEQ ID NO: 334489 - DNA, 12 bp, Homo sapiens
aatatgctttac

SEQ ID NO: 334490 - DNA, 18 bp, Homo sapiens
aatatggaacatatgcac

SEQ ID NO: 334491 - DNA, 17 bp, Homo sapiens
aatatggaacttctaat

SEQ ID NO: 334492 - DNA, 18 bp, Homo sapiens
aatatggaacttctaata

SEQ ID NO: 334493 - DNA, 17 bp, Homo sapiens
aatatggtggccctggg

SEQ ID NO: 334494 - DNA, 18 bp, Homo sapiens
aatatggtggccctgggg

SEQ ID NO: 334495 - DNA, 14 bp, Homo sapiens
aatatgtattgtaa

SEQ ID NO: 334496 - DNA, 12 bp, Homo sapiens
aatatgtcctgg

SEQ ID NO: 334497 - DNA, 23 bp, Homo sapiens
aatatgtggagttcatcttgaat

SEQ ID NO: 334498 - DNA, 22 bp, Homo sapiens
aatatgttgagtgttcatttta

SEQ ID NO: 334499 - DNA, 15 bp, Homo sapiens
aatatgtttgaggtt

SEQ ID NO: 334500 - DNA, 17 bp, Homo sapiens
aatattaaatacagaca

SEQ ID NO: 334501 - DNA, 14 bp, Homo sapiens
aatattaagaaaca

SEQ ID NO: 334502 - DNA, 18 bp, Homo sapiens
aatattaatttatatttg

SEQ ID NO: 334503 - DNA, 21 bp, Homo sapiens
aatattacattgcattcaaaa

SEQ ID NO: 334504 - DNA, 17 bp, Homo sapiens
aatattaccatcttaat

SEQ ID NO: 334505 - DNA, 15 bp, Homo sapiens
aatattatactaaga

SEQ ID NO: 334506 - DNA, 16 bp, Homo sapiens
aatattatactaagaa

SEQ ID NO: 334507 - DNA, 18 bp, Homo sapiens
aatattatacttctttat

SEQ ID NO: 334508 - DNA, 14 bp, Homo sapiens
aatattatcatttc

SEQ ID NO: 334509 - DNA, 14 bp, Homo sapiens
aatattatgtgttt

SEQ ID NO: 334510 - DNA, 11 bp, Homo sapiens
aatattattat

SEQ ID NO: 334511 - DNA, 15 bp, Homo sapiens
aatattcaataaagc

SEQ ID NO: 334512 - DNA, 15 bp, Homo sapiens
aatattcagaaaaat

SEQ ID NO: 334513 - DNA, 16 bp, Homo sapiens
aatattctatatgaat

SEQ ID NO: 334514 - DNA, 17 bp, Homo sapiens
aatattctctgatgttt

SEQ ID NO: 334515 - DNA, 19 bp, Homo sapiens
aatattctgataatgtatt

SEQ ID NO: 334516 - DNA, 15 bp, Homo sapiens
aatattcttgtccac

SEQ ID NO: 334517 - DNA, 16 bp, Homo sapiens
aatattgagaaagaaa

SEQ ID NO: 334518 - DNA, 17 bp, Homo sapiens
aatattgatatgcttat

SEQ ID NO: 334519 - DNA, 19 bp, Homo sapiens
aatattgcccaaataatat

SEQ ID NO: 334520 - DNA, 12 bp, Homo sapiens
aatattgttaaa

SEQ ID NO: 334521 - DNA, 22 bp, Homo sapiens
aatattgttaaaaccttactta

SEQ ID NO: 334522 - DNA, 15 bp, Homo sapiens
aatatttaatgatgt

SEQ ID NO: 334523 - DNA, 19 bp, Homo sapiens
aatatttaatgatgtgtca

SEQ ID NO: 334524 - DNA, 14 bp, Homo sapiens
aatatttatatttc

SEQ ID NO: 334525 - DNA, 15 bp, Homo sapiens
aatatttatgacctc

SEQ ID NO: 334526 - DNA, 16 bp, Homo sapiens
aatatttccatatgga

SEQ ID NO: 334527 - DNA, 23 bp, Homo sapiens
aatatttccatatggattttcta

SEQ ID NO: 334528 - DNA, 13 bp, Homo sapiens
aatatttctatgt

SEQ ID NO: 334529 - DNA, 16 bp, Homo sapiens
aatatttctatgtaaa

SEQ ID NO: 334530 - DNA, 21 bp, Homo sapiens
aatattttaccactgctgtga

SEQ ID NO: 334531 - DNA, 20 bp, Homo sapiens
aatattttgataataaattg

SEQ ID NO: 334532 - DNA, 15 bp, Homo sapiens
aatatttttttctag

SEQ ID NO: 334533 - DNA, 17 bp, Homo sapiens
aatatttttttctagct

SEQ ID NO: 334534 - DNA, 18 bp, Homo sapiens
aatatttttttctagcta

SEQ ID NO: 334535 - DNA, 14 bp, Homo sapiens
aatcaaaaaattat

SEQ ID NO: 334536 - DNA, 14 bp, Homo sapiens
aatcaaaagtcctt

SEQ ID NO: 334537 - DNA, 20 bp, Homo sapiens
aatcaaaagtccttagaatg

SEQ ID NO: 334538 - DNA, 22 bp, Homo sapiens
aatcaaacctttttatatttta

SEQ ID NO: 334539 - DNA, 19 bp, Homo sapiens
aatcaaatttgtagggttt

SEQ ID NO: 334540 - DNA, 13 bp, Homo sapiens
aatcaagtattta

SEQ ID NO: 334541 - DNA, 15 bp, Homo sapiens
aatcaatatttaaga

SEQ ID NO: 334542 - DNA, 22 bp, Homo sapiens
aatcaatgaatattgaagtttc

SEQ ID NO: 334543 - DNA, 14 bp, Homo sapiens
aatcaattaaaagt

SEQ ID NO: 334544 - DNA, 13 bp, Homo sapiens
aatcacaaaagct

SEQ ID NO: 334545 - DNA, 16 bp, Homo sapiens
aatcacacctctgggc

SEQ ID NO: 334546 - DNA, 14 bp, Homo sapiens
aatcacagaaaaaa

SEQ ID NO: 334547 - DNA, 23 bp, Homo sapiens
aatcacagatgggtattaaactt

SEQ ID NO: 334548 - DNA, 15 bp, Homo sapiens
aatcaccaaaggctc

SEQ ID NO: 334549 - DNA, 20 bp, Homo sapiens
aatcacctaattaatttcag

SEQ ID NO: 334550 - DNA, 22 bp, Homo sapiens
aatcactattcttaagcacttt

SEQ ID NO: 334551 - DNA, 23 bp, Homo sapiens
aatcactattcttaagcactttg

SEQ ID NO: 334552 - DNA, 13 bp, Homo sapiens
aatcactgaggca

SEQ ID NO: 334553 - DNA, 14 bp, Homo sapiens
aatcagacacaatt

SEQ ID NO: 334554 - DNA, 17 bp, Homo sapiens
aatcagactcatctaca

SEQ ID NO: 334555 - DNA, 24 bp, Homo sapiens
aatcagagcagtgattctctcttc

SEQ ID NO: 334556 - DNA, 14 bp, Homo sapiens
aatcagaggagaga

SEQ ID NO: 334557 - DNA, 16 bp, Homo sapiens
aatcagagtggccaat

SEQ ID NO: 334558 - DNA, 23 bp, Homo sapiens
aatcagagtggccaatccctgtg

SEQ ID NO: 334559 - DNA, 15 bp, Homo sapiens
aatcagatctttatt

SEQ ID NO: 334560 - DNA, 12 bp, Homo sapiens
aatcagcattct

SEQ ID NO: 334561 - DNA, 16 bp, Homo sapiens
aatcagcctcttaaag

SEQ ID NO: 334562 - DNA, 11 bp, Homo sapiens
aatcagctgct

SEQ ID NO: 334563 - DNA, 20 bp, Homo sapiens
aatcagcttttaataaaatt

SEQ ID NO: 334564 - DNA, 21 bp, Homo sapiens
tgagcgggtctagtggaaaga

SEQ ID NO: 334565 - DNA, 22 bp, Homo sapiens
tgagcgtgtagcgtcctgagga

SEQ ID NO: 334566 - DNA, 21 bp, Homo sapiens
tgagctatttccattccagaa

SEQ ID NO: 334567 - DNA, 16 bp, Homo sapiens
tgagctccaccctccc

SEQ ID NO: 334568 - DNA, 20 bp, Homo sapiens
tgagctccaccctcccctct

SEQ ID NO: 334569 - DNA, 15 bp, Homo sapiens
tgagctccagacccc

SEQ ID NO: 334570 - DNA, 18 bp, Homo sapiens
tgagctccagacccccag

SEQ ID NO: 334571 - DNA, 20 bp, Homo sapiens
tgagctccccaccaccccag

SEQ ID NO: 334572 - DNA, 17 bp, Homo sapiens
tgagctcccccttccca

SEQ ID NO: 334573 - DNA, 16 bp, Homo sapiens
tgagctccctcgctgt

SEQ ID NO: 334574 - DNA, 14 bp, Homo sapiens
tgagctcctctggg

SEQ ID NO: 334575 - DNA, 15 bp, Homo sapiens
tgagctcctctgggc

SEQ ID NO: 334576 - DNA, 16 bp, Homo sapiens
tgagctctctcagacc

SEQ ID NO: 334577 - DNA, 17 bp, Homo sapiens
tgagctctctcagaccc

SEQ ID NO: 334578 - DNA, 23 bp, Homo sapiens
tgagctctgacctgcccccgctc

SEQ ID NO: 334579 - DNA, 12 bp, Homo sapiens
tgagctgcagcc

SEQ ID NO: 334580 - DNA, 17 bp, Homo sapiens
tgagctgcctgctctgc

SEQ ID NO: 334581 - DNA, 20 bp, Homo sapiens
tgagctgcctgctctgcagc

SEQ ID NO: 334582 - DNA, 22 bp, Homo sapiens
tgagctgcctgctctgcagccc

SEQ ID NO: 334583 - DNA, 20 bp, Homo sapiens
tgagctgcctgtaacttgag

SEQ ID NO: 334584 - DNA, 14 bp, Homo sapiens
tgagctgggcatgg

SEQ ID NO: 334585 - DNA, 20 bp, Homo sapiens
tgagtagagagcaagggaag

SEQ ID NO: 334586 - DNA, 14 bp, Homo sapiens
tgagtagaggctta

SEQ ID NO: 334587 - DNA, 12 bp, Homo sapiens
tgagtagcatat

SEQ ID NO: 334588 - DNA, 13 bp, Homo sapiens
tgagtatgtgtgg

SEQ ID NO: 334589 - DNA, 15 bp, Homo sapiens
tgagtattctatgta

SEQ ID NO: 334590 - DNA, 13 bp, Homo sapiens
tgagtatttgctg

SEQ ID NO: 334591 - DNA, 14 bp, Homo sapiens
tgagtatttgctgt

SEQ ID NO: 334592 - DNA, 16 bp, Homo sapiens
tgagtatttgctgttt

SEQ ID NO: 334593 - DNA, 15 bp, Homo sapiens
tgagtcaaaagcctg

SEQ ID NO: 334594 - DNA, 13 bp, Homo sapiens
tgagtcacctcct

SEQ ID NO: 334595 - DNA, 18 bp, Homo sapiens
tgagtcagggcccagagg

SEQ ID NO: 334596 - DNA, 23 bp, Homo sapiens
tgagtcattgtcagaatccacta

SEQ ID NO: 334597 - DNA, 13 bp, Homo sapiens
tgagtcccagtgg

SEQ ID NO: 334598 - DNA, 15 bp, Homo sapiens
tgagtccccacctgc

SEQ ID NO: 334599 - DNA, 18 bp, Homo sapiens
tgagtcccttccaggcca

SEQ ID NO: 334600 - DNA, 22 bp, Homo sapiens
tgagtcctggcatgggaatgaa

SEQ ID NO: 334601 - DNA, 22 bp, Homo sapiens
tgagtcgattaacctgcatgca

SEQ ID NO: 334602 - DNA, 14 bp, Homo sapiens
tgagtcggctgggc

SEQ ID NO: 334603 - DNA, 15 bp, Homo sapiens
tgagtcggctgggca

SEQ ID NO: 334604 - DNA, 17 bp, Homo sapiens
tgagtcggctgggcagg

SEQ ID NO: 334605 - DNA, 21 bp, Homo sapiens
tgagtcggctgggcagggccg

SEQ ID NO: 334606 - DNA, 15 bp, Homo sapiens
tgagtctcttcagaa

SEQ ID NO: 334607 - DNA, 15 bp, Homo sapiens
tgagtctgaggcccc

SEQ ID NO: 334608 - DNA, 14 bp, Homo sapiens
tgagtctggcaaac

SEQ ID NO: 334609 - DNA, 18 bp, Homo sapiens
tgagtctggcaaacatgt

SEQ ID NO: 334610 - DNA, 19 bp, Homo sapiens
tgagtcttcacatttagaa

SEQ ID NO: 334611 - DNA, 12 bp, Homo sapiens
tgagtgaacacc

SEQ ID NO: 334612 - DNA, 16 bp, Homo sapiens
tgagtgacatgcggct

SEQ ID NO: 334613 - DNA, 14 bp, Homo sapiens
tgagtgagccggga

SEQ ID NO: 334614 - DNA, 20 bp, Homo sapiens
tgagtgattatttgttattt

SEQ ID NO: 334615 - DNA, 16 bp, Homo sapiens
tgagtgcctgcagcat

SEQ ID NO: 334616 - DNA, 16 bp, Homo sapiens
tgagtgccttacacaa

SEQ ID NO: 334617 - DNA, 17 bp, Homo sapiens
tgagtgccttacacaat

SEQ ID NO: 334618 - DNA, 14 bp, Homo sapiens
tgagtggaatgcag

SEQ ID NO: 334619 - DNA, 16 bp, Homo sapiens
tgagtggcagccatgc

SEQ ID NO: 334620 - DNA, 20 bp, Homo sapiens
tgagtggcagccatgcctca

SEQ ID NO: 334621 - DNA, 13 bp, Homo sapiens
tgagtggcatgtg

SEQ ID NO: 334622 - DNA, 15 bp, Homo sapiens
tgagtgggagctgtc

SEQ ID NO: 334623 - DNA, 15 bp, Homo sapiens
tgagtgggccccctc

SEQ ID NO: 334624 - DNA, 20 bp, Homo sapiens
tgagtggggagacacctcag

SEQ ID NO: 334625 - DNA, 21 bp, Homo sapiens
tgagtggggagacacctcaga

SEQ ID NO: 334626 - DNA, 22 bp, Homo sapiens
tgagtggggagacacctcagag

SEQ ID NO: 334627 - DNA, 22 bp, Homo sapiens
tgagtggtgaggggccactggg

SEQ ID NO: 334628 - DNA, 21 bp, Homo sapiens
tgagtggtgttggcagtgttt

SEQ ID NO: 334629 - DNA, 15 bp, Homo sapiens
tgagtgtaagtgtga

SEQ ID NO: 334630 - DNA, 11 bp, Homo sapiens
tgagtgtacca

SEQ ID NO: 334631 - DNA, 20 bp, Homo sapiens
tgagtgtcaaacgtgccccc

SEQ ID NO: 334632 - DNA, 21 bp, Homo sapiens
tgagtgtgcaagcaaagaacc

SEQ ID NO: 334633 - DNA, 12 bp, Homo sapiens
tgagtgtggaag

SEQ ID NO: 334634 - DNA, 17 bp, Homo sapiens
tgagtgtggctcccctc

SEQ ID NO: 334635 - DNA, 12 bp, Homo sapiens
tgagtgttcatt

SEQ ID NO: 334636 - DNA, 15 bp, Homo sapiens
tgagttactgaaggt

SEQ ID NO: 334637 - DNA, 15 bp, Homo sapiens
tgagttacttcctat

SEQ ID NO: 334638 - DNA, 21 bp, Homo sapiens
tgagttacttgtctgaggcct

SEQ ID NO: 334639 - DNA, 20 bp, Homo sapiens
tgagttctacataagtaatt

SEQ ID NO: 334640 - DNA, 14 bp, Homo sapiens
tgagttctcatcca

SEQ ID NO: 334641 - DNA, 20 bp, Homo sapiens
tgagttggacacactgtaaa

SEQ ID NO: 334642 - DNA, 19 bp, Homo sapiens
tgagttggttacctattgc

SEQ ID NO: 334643 - DNA, 21 bp, Homo sapiens
tgagttggttacctattgctg

SEQ ID NO: 334644 - DNA, 15 bp, Homo sapiens
tgagtttaccatttg

SEQ ID NO: 334645 - DNA, 18 bp, Homo sapiens
tgagtttaccatttgtaa

SEQ ID NO: 334646 - DNA, 16 bp, Homo sapiens
tgagtttcctcaggct

SEQ ID NO: 334647 - DNA, 13 bp, Homo sapiens
tgagtttcttcta

SEQ ID NO: 334648 - DNA, 22 bp, Homo sapiens
tgagtttgccctggtttcactg

SEQ ID NO: 334649 - DNA, 17 bp, Homo sapiens
tgagttttaaagaagtc

SEQ ID NO: 334650 - DNA, 17 bp, Homo sapiens
tgagttttatccaagac

SEQ ID NO: 334651 - DNA, 13 bp, Homo sapiens
tgagtttttgata

SEQ ID NO: 334652 - DNA, 18 bp, Homo sapiens
tgagtttttgatagcttt

SEQ ID NO: 334653 - DNA, 19 bp, Homo sapiens
tgagtttttgatagcttta

SEQ ID NO: 334654 - DNA, 22 bp, Homo sapiens
tgataaaaaatttattatgtcc

SEQ ID NO: 334655 - DNA, 12 bp, Homo sapiens
tgataaaaggaa

SEQ ID NO: 334656 - DNA, 16 bp, Homo sapiens
tgataaaatgttcctt

SEQ ID NO: 334657 - DNA, 13 bp, Homo sapiens
tgataaacacaga

SEQ ID NO: 334658 - DNA, 16 bp, Homo sapiens
tgataaacattaaaca

SEQ ID NO: 334659 - DNA, 16 bp, Homo sapiens
tgataaagaaaccttt

SEQ ID NO: 334660 - DNA, 21 bp, Homo sapiens
tgataactagatggtgctgag

SEQ ID NO: 334661 - DNA, 22 bp, Homo sapiens
tgataactagatggtgctgaga

SEQ ID NO: 334662 - DNA, 20 bp, Homo sapiens
tgataagaaccttttgagtg

SEQ ID NO: 334663 - DNA, 18 bp, Homo sapiens
tgataagatgaggaaata

SEQ ID NO: 334664 - DNA, 12 bp, Homo sapiens
tgataagtaaat

SEQ ID NO: 334665 - DNA, 15 bp, Homo sapiens
tgataataaattgaa

SEQ ID NO: 334666 - DNA, 23 bp, Homo sapiens
tgataataaattgaaattgtgaa

SEQ ID NO: 334667 - DNA, 19 bp, Homo sapiens
tgataatgagttttacatt

SEQ ID NO: 334668 - DNA, 18 bp, Homo sapiens
tgataatgatgatgacga

SEQ ID NO: 334669 - DNA, 15 bp, Homo sapiens
tgatacaaactttgt

SEQ ID NO: 334670 - DNA, 20 bp, Homo sapiens
tgatacactgtatctaaaaa

SEQ ID NO: 334671 - DNA, 21 bp, Homo sapiens
tgatacactgtatctaaaaaa

SEQ ID NO: 334672 - DNA, 12 bp, Homo sapiens
tgatacatttat

SEQ ID NO: 334673 - DNA, 13 bp, Homo sapiens
tgataccacctgc

SEQ ID NO: 334674 - DNA, 16 bp, Homo sapiens
tgatactgtctaagaa

SEQ ID NO: 334675 - DNA, 17 bp, Homo sapiens
tgatactgtctaagaat

SEQ ID NO: 334676 - DNA, 15 bp, Homo sapiens
tgatacttattcaaa

SEQ ID NO: 334677 - DNA, 19 bp, Homo sapiens
tgatacttgttccagatgg

SEQ ID NO: 334678 - DNA, 16 bp, Homo sapiens
tgatagacttcgaaaa

SEQ ID NO: 334679 - DNA, 20 bp, Homo sapiens
tgatagcaagcgttattttg

SEQ ID NO: 334680 - DNA, 15 bp, Homo sapiens
tgatagcactggttt

SEQ ID NO: 334681 - DNA, 16 bp, Homo sapiens
tgatagcactggtttg

SEQ ID NO: 334682 - DNA, 20 bp, Homo sapiens
tgatagcgttggaattaaaa

SEQ ID NO: 334683 - DNA, 13 bp, Homo sapiens
tgatagctttatt

SEQ ID NO: 334684 - DNA, 20 bp, Homo sapiens
tgatagtctttttttttaag

SEQ ID NO: 334685 - DNA, 18 bp, Homo sapiens
tgatagtgttttgtactt

SEQ ID NO: 334686 - DNA, 23 bp, Homo sapiens
tgatatataaaccttaaatgaaa

SEQ ID NO: 334687 - DNA, 12 bp, Homo sapiens
tgatatatatgt

SEQ ID NO: 334688 - DNA, 21 bp, Homo sapiens
tgatatattctttccatgcag

SEQ ID NO: 334689 - DNA, 22 bp, Homo sapiens
tgatatattctttccatgcagt

SEQ ID NO: 334690 - DNA, 21 bp, Homo sapiens
tgatatccattctttctgata

SEQ ID NO: 334691 - DNA, 15 bp, Homo sapiens
tgatatctgtttgct

SEQ ID NO: 334692 - DNA, 11 bp, Homo sapiens
tgatatgcatg

SEQ ID NO: 334693 - DNA, 16 bp, Homo sapiens
tgatatgcatgtagca

SEQ ID NO: 334694 - DNA, 21 bp, Homo sapiens
tgatatggtactaaggagaat

SEQ ID NO: 334695 - DNA, 16 bp, Homo sapiens
tgatatgtgtaatatc

SEQ ID NO: 334696 - DNA, 18 bp, Homo sapiens
tgatatgtgtaatatcat

SEQ ID NO: 334697 - DNA, 19 bp, Homo sapiens
tgatatgtgtaatatcatt

SEQ ID NO: 334698 - DNA, 22 bp, Homo sapiens
tgatatgtgtaatatcatttca

SEQ ID NO: 334699 - DNA, 17 bp, Homo sapiens
tgatattcaaacacaca

SEQ ID NO: 334700 - DNA, 18 bp, Homo sapiens
tgatattccatgaatgta

SEQ ID NO: 334701 - DNA, 20 bp, Homo sapiens
tgatattccatgaatgtatc

SEQ ID NO: 334702 - DNA, 16 bp, Homo sapiens
tgatattgaccatgtg

SEQ ID NO: 334703 - DNA, 18 bp, Homo sapiens
tgatattgaccatgtgat

SEQ ID NO: 334704 - DNA, 19 bp, Homo sapiens
tgatattgaccatgtgatt

SEQ ID NO: 334705 - DNA, 17 bp, Homo sapiens
tgatattggtgtgaatg

SEQ ID NO: 334706 - DNA, 21 bp, Homo sapiens
aatcagcttttaataaaattg

SEQ ID NO: 334707 - DNA, 20 bp, Homo sapiens
aatcagcttttgttctagac

SEQ ID NO: 334708 - DNA, 16 bp, Homo sapiens
aatcaggattttagtg

SEQ ID NO: 334709 - DNA, 17 bp, Homo sapiens
aatcagtatgaagacac

SEQ ID NO: 334710 - DNA, 17 bp, Homo sapiens
aatcagtgatgggagta

SEQ ID NO: 334711 - DNA, 18 bp, Homo sapiens
aatcagtgggcaggataa

SEQ ID NO: 334712 - DNA, 14 bp, Homo sapiens
aatcagtgtgtcta

SEQ ID NO: 334713 - DNA, 17 bp, Homo sapiens
aatcagtgtgtctaaat

SEQ ID NO: 334714 - DNA, 14 bp, Homo sapiens
aatcataacatagt

SEQ ID NO: 334715 - DNA, 19 bp, Homo sapiens
aatcataacatagttgaaa

SEQ ID NO: 334716 - DNA, 19 bp, Homo sapiens
tgatcaataaaatgtgatt

SEQ ID NO: 334717 - DNA, 21 bp, Homo sapiens
tgatcaataaaatgtgatttt

SEQ ID NO: 334718 - DNA, 15 bp, Homo sapiens
tgatcaattaaatgt

SEQ ID NO: 334719 - DNA, 15 bp, Homo sapiens
tgatcacagatgtgc

SEQ ID NO: 334720 - DNA, 22 bp, Homo sapiens
tgatcagaactgggaaaacagt

SEQ ID NO: 334721 - DNA, 23 bp, Homo sapiens
tgatcagatctgacatgattcct

SEQ ID NO: 334722 - DNA, 17 bp, Homo sapiens
tgatcagatcttacaag

SEQ ID NO: 334723 - DNA, 17 bp, Homo sapiens
tgatcagctgtttgtca

SEQ ID NO: 334724 - DNA, 15 bp, Homo sapiens
tgatcatagaattgt

SEQ ID NO: 334725 - DNA, 14 bp, Homo sapiens
tgatcatgcattgt

SEQ ID NO: 334726 - DNA, 15 bp, Homo sapiens
tgatcatgcattgtt

SEQ ID NO: 334727 - DNA, 16 bp, Homo sapiens
tgatcatgcattgttg

SEQ ID NO: 334728 - DNA, 17 bp, Homo sapiens
tgatcatgcattgttga

SEQ ID NO: 334729 - DNA, 23 bp, Homo sapiens
tgatcatgcattgttgaggtggt

SEQ ID NO: 334730 - DNA, 17 bp, Homo sapiens
tgatcatttgcagctgc

SEQ ID NO: 334731 - DNA, 19 bp, Homo sapiens
tgatcatttgcagctgctg

SEQ ID NO: 334732 - DNA, 16 bp, Homo sapiens
tgatccagctgtgtgt

SEQ ID NO: 334733 - DNA, 14 bp, Homo sapiens
tgatccagggattg

SEQ ID NO: 334734 - DNA, 16 bp, Homo sapiens
tgatcccataaagaaa

SEQ ID NO: 334735 - DNA, 19 bp, Homo sapiens
tgatccctgtgttgtctct

SEQ ID NO: 334736 - DNA, 20 bp, Homo sapiens
tgatccctgtgttgtctcta

SEQ ID NO: 334737 - DNA, 18 bp, Homo sapiens
tgatcctcatatggccca

SEQ ID NO: 334738 - DNA, 17 bp, Homo sapiens
tgatcctccaacttcat

SEQ ID NO: 334739 - DNA, 20 bp, Homo sapiens
tgatcctgaacaagaaagag

SEQ ID NO: 334740 - DNA, 17 bp, Homo sapiens
tgatcgatgttaaacgt

SEQ ID NO: 334741 - DNA, 18 bp, Homo sapiens
tgatcgatgttaaacgtc

SEQ ID NO: 334742 - DNA, 20 bp, Homo sapiens
tgatcgatgttaaacgtcac

SEQ ID NO: 334743 - DNA, 15 bp, Homo sapiens
tgatcgccttattta

SEQ ID NO: 334744 - DNA, 15 bp, Homo sapiens
tgatcgtgctaaatt

SEQ ID NO: 334745 - DNA, 16 bp, Homo sapiens
tgatcgtgtgttgcca

SEQ ID NO: 334746 - DNA, 16 bp, Homo sapiens
tgatctaaggcatgct

SEQ ID NO: 334747 - DNA, 14 bp, Homo sapiens
tgatctaggtttaa

SEQ ID NO: 334748 - DNA, 17 bp, Homo sapiens
tgatctaggtttaactc

SEQ ID NO: 334749 - DNA, 19 bp, Homo sapiens
tgatctaggtttaactcag

SEQ ID NO: 334750 - DNA, 21 bp, Homo sapiens
tgatctaggtttaactcagat

SEQ ID NO: 334751 - DNA, 22 bp, Homo sapiens
tgatctaggtttaactcagatc

SEQ ID NO: 334752 - DNA, 20 bp, Homo sapiens
tgatctattactctgacata

SEQ ID NO: 334753 - DNA, 22 bp, Homo sapiens
tgatctattgcagatatttgat

SEQ ID NO: 334754 - DNA, 21 bp, Homo sapiens
tgatctccatatgttacacta

SEQ ID NO: 334755 - DNA, 18 bp, Homo sapiens
tgatctccgtggctttgg

SEQ ID NO: 334756 - DNA, 22 bp, Homo sapiens
tgatctcctgacctcatgatcc

SEQ ID NO: 334757 - DNA, 18 bp, Homo sapiens
tgatctcctggtagcatg

SEQ ID NO: 334758 - DNA, 23 bp, Homo sapiens
tgatctctactaccacaaggaaa

SEQ ID NO: 334759 - DNA, 18 bp, Homo sapiens
tgatctgggaactcccaa

SEQ ID NO: 334760 - DNA, 18 bp, Homo sapiens
tgatctgtagacttctgg

SEQ ID NO: 334761 - DNA, 20 bp, Homo sapiens
tgatctgtggagaatgtaca

SEQ ID NO: 334762 - DNA, 20 bp, Homo sapiens
tgatcttctttataattcta

SEQ ID NO: 334763 - DNA, 15 bp, Homo sapiens
tgatcttgtgctcag

SEQ ID NO: 334764 - DNA, 16 bp, Homo sapiens
tgatcttgtgctcagc

SEQ ID NO: 334765 - DNA, 15 bp, Homo sapiens
tgatgaaaagattta

SEQ ID NO: 334766 - DNA, 23 bp, Homo sapiens
tgatgaactttctcttcatactt

SEQ ID NO: 334767 - DNA, 20 bp, Homo sapiens
tgatgaagaaaagtgggcca

SEQ ID NO: 334768 - DNA, 13 bp, Homo sapiens
tgatgaataaaca

SEQ ID NO: 334769 - DNA, 17 bp, Homo sapiens
tgatgaataaacacttt

SEQ ID NO: 334770 - DNA, 20 bp, Homo sapiens
tgatgaatgaggaacaatca

SEQ ID NO: 334771 - DNA, 15 bp, Homo sapiens
tgatgaccaatctct

SEQ ID NO: 334772 - DNA, 19 bp, Homo sapiens
tgatgaccaatctctgtga

SEQ ID NO: 334773 - DNA, 18 bp, Homo sapiens
tgatgagacaacacacac

SEQ ID NO: 334774 - DNA, 18 bp, Homo sapiens
tgatgagcactcctgatt

SEQ ID NO: 334775 - DNA, 19 bp, Homo sapiens
tgatgagcactcctgattt

SEQ ID NO: 334776 - DNA, 14 bp, Homo sapiens
tgatgataatgatg

SEQ ID NO: 334777 - DNA, 13 bp, Homo sapiens
tgatgatcaaaac

SEQ ID NO: 334778 - DNA, 21 bp, Homo sapiens
tgatgatcaaaacctgtgcca

SEQ ID NO: 334779 - DNA, 17 bp, Homo sapiens
tgatgatgctgtgacaa

SEQ ID NO: 334780 - DNA, 21 bp, Homo sapiens
tgatgatgggaattgtgtgat

SEQ ID NO: 334781 - DNA, 15 bp, Homo sapiens
tgatgatgtctcttg

SEQ ID NO: 334782 - DNA, 21 bp, Homo sapiens
tgatgatgtctcttgtagaag

SEQ ID NO: 334783 - DNA, 18 bp, Homo sapiens
tgatgattaaacacctga

SEQ ID NO: 334784 - DNA, 21 bp, Homo sapiens
tgatgattaaacacctgacac

SEQ ID NO: 334785 - DNA, 16 bp, Homo sapiens
tgatgattcaatcatt

SEQ ID NO: 334786 - DNA, 16 bp, Homo sapiens
tgatgatttcagaaac

SEQ ID NO: 334787 - DNA, 23 bp, Homo sapiens
tgatgcacttattttttaatgtg

SEQ ID NO: 334788 - DNA, 17 bp, Homo sapiens
tgatgcatgagctccct

SEQ ID NO: 334789 - DNA, 20 bp, Homo sapiens
tgatgcatggagtgtttgac

SEQ ID NO: 334790 - DNA, 13 bp, Homo sapiens
tgatgccagctgt

SEQ ID NO: 334791 - DNA, 16 bp, Homo sapiens
tgatgccatttgtctt

SEQ ID NO: 334792 - DNA, 17 bp, Homo sapiens
tgatgccatttgtcttt

SEQ ID NO: 334793 - DNA, 20 bp, Homo sapiens
tgatgcctgacacaggggac

SEQ ID NO: 334794 - DNA, 11 bp, Homo sapiens
tgatgctaaat

SEQ ID NO: 334795 - DNA, 15 bp, Homo sapiens
tgatgctagatagtt

SEQ ID NO: 334796 - DNA, 16 bp, Homo sapiens
tgatgctaggttgttt

SEQ ID NO: 334797 - DNA, 20 bp, Homo sapiens
tgatgctccctcccctgccc

SEQ ID NO: 334798 - DNA, 14 bp, Homo sapiens
tgatgctgagattc

SEQ ID NO: 334799 - DNA, 16 bp, Homo sapiens
tgatgctgagtcatgc

SEQ ID NO: 334800 - DNA, 16 bp, Homo sapiens
tgatggaacacacaca

SEQ ID NO: 334801 - DNA, 19 bp, Homo sapiens
tgatggaccgggtgggcct

SEQ ID NO: 334802 - DNA, 20 bp, Homo sapiens
tgatggaccttctagaatta

SEQ ID NO: 334803 - DNA, 23 bp, Homo sapiens
tgatggaccttctagaattataa

SEQ ID NO: 334804 - DNA, 14 bp, Homo sapiens
tgatggagaggaga

SEQ ID NO: 334805 - DNA, 16 bp, Homo sapiens
tgatggagaggagaac

SEQ ID NO: 334806 - DNA, 16 bp, Homo sapiens
tgatggatgagaaaaa

SEQ ID NO: 334807 - DNA, 19 bp, Homo sapiens
tgatgggagagtagatggt

SEQ ID NO: 334808 - DNA, 16 bp, Homo sapiens
tgatgggcactggaaa

SEQ ID NO: 334809 - DNA, 20 bp, Homo sapiens
tgatgggcactggaaaacat

SEQ ID NO: 334810 - DNA, 16 bp, Homo sapiens
tgatgggcacttgaga

SEQ ID NO: 334811 - DNA, 15 bp, Homo sapiens
tgatgggcgagtccc

SEQ ID NO: 334812 - DNA, 22 bp, Homo sapiens
tgatgggcgagtcccggagccc

SEQ ID NO: 334813 - DNA, 12 bp, Homo sapiens
tgatgggtgggc

SEQ ID NO: 334814 - DNA, 23 bp, Homo sapiens
tgatggtagaaattttatctctt

SEQ ID NO: 334815 - DNA, 22 bp, Homo sapiens
tgatgtaaaacagaatattctg

SEQ ID NO: 334816 - DNA, 15 bp, Homo sapiens
tgatgtaaaatcttg

SEQ ID NO: 334817 - DNA, 16 bp, Homo sapiens
tgatgtaaaatcttgt

SEQ ID NO: 334818 - DNA, 23 bp, Homo sapiens
tgatgtaaaatcttgtcatgtgt

SEQ ID NO: 334819 - DNA, 17 bp, Homo sapiens
tgatgtaattaaaaaat

SEQ ID NO: 334820 - DNA, 16 bp, Homo sapiens
tgatgtacagtctgtc

SEQ ID NO: 334821 - DNA, 18 bp, Homo sapiens
tgatgtacagtctgtcat

SEQ ID NO: 334822 - DNA, 19 bp, Homo sapiens
tgatgtacagtctgtcatg

SEQ ID NO: 334823 - DNA, 20 bp, Homo sapiens
tgatgtaccatgaaacaaag

SEQ ID NO: 334824 - DNA, 13 bp, Homo sapiens
tgatgtaggagct

SEQ ID NO: 334825 - DNA, 15 bp, Homo sapiens
tgatgtagttttctt

SEQ ID NO: 334826 - DNA, 13 bp, Homo sapiens
tgatgtattctag

SEQ ID NO: 334827 - DNA, 14 bp, Homo sapiens
tgatgtattctagc

SEQ ID NO: 334828 - DNA, 15 bp, Homo sapiens
tgatgtccagaagaa

SEQ ID NO: 334829 - DNA, 23 bp, Homo sapiens
tgatgtccagaagaatattcagg

SEQ ID NO: 334830 - DNA, 19 bp, Homo sapiens
tgatgtcctgtaaacactc

SEQ ID NO: 334831 - DNA, 18 bp, Homo sapiens
tgatgtctcttgtagaag

SEQ ID NO: 334832 - DNA, 20 bp, Homo sapiens
tgatgtcttgagagcgctgg

SEQ ID NO: 334833 - DNA, 22 bp, Homo sapiens
tgatgtgaagataatttgcata

SEQ ID NO: 334834 - DNA, 20 bp, Homo sapiens
tgatgtgatggaacacacac

SEQ ID NO: 334835 - DNA, 21 bp, Homo sapiens
tgatgtgatggaacacacaca

SEQ ID NO: 334836 - DNA, 18 bp, Homo sapiens
tgatgtgatttatgcatt

SEQ ID NO: 334837 - DNA, 19 bp, Homo sapiens
tgatgtgatttatgcattt

SEQ ID NO: 334838 - DNA, 17 bp, Homo sapiens
tgatgtgcgtgctgtct

SEQ ID NO: 334839 - DNA, 18 bp, Homo sapiens
tgatgtgcgtgctgtctg

SEQ ID NO: 334840 - DNA, 20 bp, Homo sapiens
tgatgtgcgtgctgtctgtc

SEQ ID NO: 334841 - DNA, 19 bp, Homo sapiens
tgatgtgctcatcagaaac

SEQ ID NO: 334842 - DNA, 16 bp, Homo sapiens
tgatgttaaaattcca

SEQ ID NO: 334843 - DNA, 18 bp, Homo sapiens
gcctgggggcagtgactg

SEQ ID NO: 334844 - DNA, 19 bp, Homo sapiens
gcctgggggcagtgactgg

SEQ ID NO: 334845 - DNA, 17 bp, Homo sapiens
gccttgtaattctaaat

SEQ ID NO: 334846 - DNA, 17 bp, Homo sapiens
tgatgttaggctgggcc

SEQ ID NO: 334847 - DNA, 10 bp, Homo sapiens
tgatgttata

SEQ ID NO: 334848 - DNA, 22 bp, Homo sapiens
tgatgttgggaagctatttcct

SEQ ID NO: 334849 - DNA, 16 bp, Homo sapiens
tgatgttgtgttgtta

SEQ ID NO: 334850 - DNA, 18 bp, Homo sapiens
tgatgtttgtggcctcag

SEQ ID NO: 334851 - DNA, 19 bp, Homo sapiens
tgatgtttgtggcctcaga

SEQ ID NO: 334852 - DNA, 14 bp, Homo sapiens
tgattaaacacctg

SEQ ID NO: 334853 - DNA, 21 bp, Homo sapiens
tgattaaacacctgacacatc

SEQ ID NO: 334854 - DNA, 15 bp, Homo sapiens
tgattaaactgtatg

SEQ ID NO: 334855 - DNA, 14 bp, Homo sapiens
tgattaacagagag

SEQ ID NO: 334856 - DNA, 17 bp, Homo sapiens
tgattaagattttacaa

SEQ ID NO: 334857 - DNA, 14 bp, Homo sapiens
tgattaatccattt

SEQ ID NO: 334858 - DNA, 14 bp, Homo sapiens
tgattactgtcaat

SEQ ID NO: 334859 - DNA, 15 bp, Homo sapiens
tgattactgtcaata

SEQ ID NO: 334860 - DNA, 13 bp, Homo sapiens
tgattagaagcca

SEQ ID NO: 334861 - DNA, 16 bp, Homo sapiens
tgattagacaatgtgg

SEQ ID NO: 334862 - DNA, 19 bp, Homo sapiens
tgattagcagttgaggcca

SEQ ID NO: 334863 - DNA, 13 bp, Homo sapiens
tgattatcttgaa

SEQ ID NO: 334864 - DNA, 22 bp, Homo sapiens
tgattattgaatgttatatcat

SEQ ID NO: 334865 - DNA, 21 bp, Homo sapiens
tgattcaataaaatgcactga

SEQ ID NO: 334866 - DNA, 23 bp, Homo sapiens
tgattcaataaaatgcactgacc

SEQ ID NO: 334867 - DNA, 19 bp, Homo sapiens
tgattcactattagagaaa

SEQ ID NO: 334868 - DNA, 14 bp, Homo sapiens
tgattcacttttat

SEQ ID NO: 334869 - DNA, 15 bp, Homo sapiens
tgattcataacaatg

SEQ ID NO: 334870 - DNA, 21 bp, Homo sapiens
tgattcataatgacttaagca

SEQ ID NO: 334871 - DNA, 13 bp, Homo sapiens
tgattccaaataa

SEQ ID NO: 334872 - DNA, 14 bp, Homo sapiens
tgattccaaataaa

SEQ ID NO: 334873 - DNA, 13 bp, Homo sapiens
tgattccatctcc

SEQ ID NO: 334874 - DNA, 16 bp, Homo sapiens
tgattcccataacata

SEQ ID NO: 334875 - DNA, 18 bp, Homo sapiens
tgattccttcctgttctg

SEQ ID NO: 334876 - DNA, 19 bp, Homo sapiens
tgattccttcctgttctga

SEQ ID NO: 334877 - DNA, 17 bp, Homo sapiens
tgattcgtctgcgattt

SEQ ID NO: 334878 - DNA, 22 bp, Homo sapiens
tgattctatgcctgtatttcca

SEQ ID NO: 334879 - DNA, 11 bp, Homo sapiens
tgattctcctc

SEQ ID NO: 334880 - DNA, 14 bp, Homo sapiens
tgattctctcttct

SEQ ID NO: 334881 - DNA, 15 bp, Homo sapiens
tgattctctcttctc

SEQ ID NO: 334882 - DNA, 21 bp, Homo sapiens
tgattcttgattttcaagctt

SEQ ID NO: 334883 - DNA, 14 bp, Homo sapiens
tgattctttgttac

SEQ ID NO: 334884 - DNA, 20 bp, Homo sapiens
tgattgaaccagctcatctc

SEQ ID NO: 334885 - DNA, 22 bp, Homo sapiens
tgattgacattttgtagctagt

SEQ ID NO: 334886 - DNA, 15 bp, Homo sapiens
tgattgcacattgtt

SEQ ID NO: 334887 - DNA, 17 bp, Homo sapiens
tgattgccaaattgaca

SEQ ID NO: 334888 - DNA, 18 bp, Homo sapiens
tgattgccatttcttccc

SEQ ID NO: 334889 - DNA, 13 bp, Homo sapiens
tgattgctgccat

SEQ ID NO: 334890 - DNA, 12 bp, Homo sapiens
tgattgctttta

SEQ ID NO: 334891 - DNA, 14 bp, Homo sapiens
tgattggattattc

SEQ ID NO: 334892 - DNA, 21 bp, Homo sapiens
tgattggtgcaacccttaccc

SEQ ID NO: 334893 - DNA, 23 bp, Homo sapiens
tgattgtacagaatcattgctta

SEQ ID NO: 334894 - DNA, 14 bp, Homo sapiens
tgattgtcagctac

SEQ ID NO: 334895 - DNA, 19 bp, Homo sapiens
tgattgttaatttacagct

SEQ ID NO: 334896 - DNA, 21 bp, Homo sapiens
tgatttaaacttcttaactgg

SEQ ID NO: 334897 - DNA, 13 bp, Homo sapiens
tgatttaacatta

SEQ ID NO: 334898 - DNA, 15 bp, Homo sapiens
tgatttaagcatttt

SEQ ID NO: 334899 - DNA, 18 bp, Homo sapiens
tgatttaagcattttact

SEQ ID NO: 334900 - DNA, 17 bp, Homo sapiens
tgatttacagtgcctgt

SEQ ID NO: 334901 - DNA, 14 bp, Homo sapiens
tgatttacatgctg

SEQ ID NO: 334902 - DNA, 19 bp, Homo sapiens
tgatttagggaagcaggga

SEQ ID NO: 334903 - DNA, 16 bp, Homo sapiens
tgatttatagtttgta

SEQ ID NO: 334904 - DNA, 18 bp, Homo sapiens
tgatttatcacacaaagc

SEQ ID NO: 334905 - DNA, 22 bp, Homo sapiens
tgatttatgcatggaaacctga

SEQ ID NO: 334906 - DNA, 15 bp, Homo sapiens
tgatttcaatgattg

SEQ ID NO: 334907 - DNA, 16 bp, Homo sapiens
tgatttcacaacagat

SEQ ID NO: 334908 - DNA, 13 bp, Homo sapiens
tgatttcagaaac

SEQ ID NO: 334909 - DNA, 15 bp, Homo sapiens
tgatttcattaatac

SEQ ID NO: 334910 - DNA, 13 bp, Homo sapiens
tgatttccaggcc

SEQ ID NO: 334911 - DNA, 17 bp, Homo sapiens
tgatttccatttctgat

SEQ ID NO: 334912 - DNA, 15 bp, Homo sapiens
tgatttcgatgtaca

SEQ ID NO: 334913 - DNA, 13 bp, Homo sapiens
tgatttctagaat

SEQ ID NO: 334914 - DNA, 14 bp, Homo sapiens
tgatttgaagtgga

SEQ ID NO: 334915 - DNA, 14 bp, Homo sapiens
tgatttgcatggat

SEQ ID NO: 334916 - DNA, 22 bp, Homo sapiens
tgatttgcatggattttggata

SEQ ID NO: 334917 - DNA, 12 bp, Homo sapiens
tgatttgctatc

SEQ ID NO: 334918 - DNA, 20 bp, Homo sapiens
tgatttggaagagaggcacc

SEQ ID NO: 334919 - DNA, 13 bp, Homo sapiens
tgattttaacaat

SEQ ID NO: 334920 - DNA, 18 bp, Homo sapiens
tgattttaacaataacta

SEQ ID NO: 334921 - DNA, 13 bp, Homo sapiens
tgattttaattac

SEQ ID NO: 334922 - DNA, 16 bp, Homo sapiens
tgattttagatttctt

SEQ ID NO: 334923 - DNA, 13 bp, Homo sapiens
tgattttcatcaa

SEQ ID NO: 334924 - DNA, 16 bp, Homo sapiens
tgattttcatcaattt

SEQ ID NO: 334925 - DNA, 12 bp, Homo sapiens
tgattttctgtt

SEQ ID NO: 334926 - DNA, 21 bp, Homo sapiens
tgattttggccactttgcaga

SEQ ID NO: 334927 - DNA, 17 bp, Homo sapiens
tgattttggctcactgc

SEQ ID NO: 334928 - DNA, 20 bp, Homo sapiens
tgattttgtagttaatttat

SEQ ID NO: 334929 - DNA, 14 bp, Homo sapiens
tgatttttaaagtt

SEQ ID NO: 334930 - DNA, 21 bp, Homo sapiens
tgatttttaaagtttaaatac

SEQ ID NO: 334931 - DNA, 15 bp, Homo sapiens
tgatttttgtgtatc

SEQ ID NO: 334932 - DNA, 21 bp, Homo sapiens
tgatttttgtgtatccagtat

SEQ ID NO: 334933 - DNA, 17 bp, Homo sapiens
tgcaaaaagaggatccg

SEQ ID NO: 334934 - DNA, 21 bp, Homo sapiens
tgcaaaaccggcaacctgtaa

SEQ ID NO: 334935 - DNA, 23 bp, Homo sapiens
tgcaaaaccggcaacctgtaact

SEQ ID NO: 334936 - DNA, 14 bp, Homo sapiens
tgcaaaacctttga

SEQ ID NO: 334937 - DNA, 17 bp, Homo sapiens
tgcaaaagaagttgatc

SEQ ID NO: 334938 - DNA, 15 bp, Homo sapiens
tgcaaaagcaggctt

SEQ ID NO: 334939 - DNA, 22 bp, Homo sapiens
tgcaaaaggttcactaaagcag

SEQ ID NO: 334940 - DNA, 23 bp, Homo sapiens
tgcaaaatacatgatgatttcag

SEQ ID NO: 334941 - DNA, 16 bp, Homo sapiens
tgcaaaattacctacc

SEQ ID NO: 334942 - DNA, 18 bp, Homo sapiens
tgcaaaattacctacccc

SEQ ID NO: 334943 - DNA, 14 bp, Homo sapiens
tgcaaacaataaac

SEQ ID NO: 334944 - DNA, 12 bp, Homo sapiens
tgcaaacagtgt

SEQ ID NO: 334945 - DNA, 14 bp, Homo sapiens
tgcaaaccctgctg

SEQ ID NO: 334946 - DNA, 16 bp, Homo sapiens
tgcaaactcactgctc

SEQ ID NO: 334947 - DNA, 18 bp, Homo sapiens
tgcaaagaaaattctcaa

SEQ ID NO: 334948 - DNA, 19 bp, Homo sapiens
tgcaaagaaaattctcaag

SEQ ID NO: 334949 - DNA, 13 bp, Homo sapiens
tgcaaagccttta

SEQ ID NO: 334950 - DNA, 16 bp, Homo sapiens
tgcaaagcctttaaat

SEQ ID NO: 334951 - DNA, 21 bp, Homo sapiens
tgcaaaggagggcctcagaga

SEQ ID NO: 334952 - DNA, 22 bp, Homo sapiens
tgcaaagtataaatttgtgtaa

SEQ ID NO: 334953 - DNA, 18 bp, Homo sapiens
tgcaaatagtttcaaatg

SEQ ID NO: 334954 - DNA, 17 bp, Homo sapiens
tgcaaatgcacatttgt

SEQ ID NO: 334955 - DNA, 12 bp, Homo sapiens
tgcaaattaaag

SEQ ID NO: 334956 - DNA, 18 bp, Homo sapiens
tgcaaattaaagggcaga

SEQ ID NO: 334957 - DNA, 19 bp, Homo sapiens
tgcaaattaaagggcagat

SEQ ID NO: 334958 - DNA, 22 bp, Homo sapiens
tgcaaattagggctacattgta

SEQ ID NO: 334959 - DNA, 13 bp, Homo sapiens
tgcaaattattct

SEQ ID NO: 334960 - DNA, 15 bp, Homo sapiens
tgcaaattattctag

SEQ ID NO: 334961 - DNA, 21 bp, Homo sapiens
tgcaaattattctagtcaact

SEQ ID NO: 334962 - DNA, 13 bp, Homo sapiens
tgcaacaaaattc

SEQ ID NO: 334963 - DNA, 20 bp, Homo sapiens
tgcaacaataataaatgtta

SEQ ID NO: 334964 - DNA, 13 bp, Homo sapiens
tgcaacagcctgt

SEQ ID NO: 334965 - DNA, 15 bp, Homo sapiens
tgcaacatttacagt

SEQ ID NO: 334966 - DNA, 17 bp, Homo sapiens
tgcaacccttacccctt

SEQ ID NO: 334967 - DNA, 13 bp, Homo sapiens
tgcaacggcatga

SEQ ID NO: 334968 - DNA, 13 bp, Homo sapiens
tgcaacgtgtaac

SEQ ID NO: 334969 - DNA, 22 bp, Homo sapiens
tgcaacgtgtaacttgtgcttt

SEQ ID NO: 334970 - DNA, 19 bp, Homo sapiens
tgcaactaattcaataaaa

SEQ ID NO: 334971 - DNA, 17 bp, Homo sapiens
tgcaactcaaggacttt

SEQ ID NO: 334972 - DNA, 13 bp, Homo sapiens
tgcaactcttgta

SEQ ID NO: 334973 - DNA, 14 bp, Homo sapiens
tgcaacttctgtcc

SEQ ID NO: 334974 - DNA, 13 bp, Homo sapiens
tgcaagaagaata

SEQ ID NO: 334975 - DNA, 15 bp, Homo sapiens
tgcaagacacccagt

SEQ ID NO: 334976 - DNA, 14 bp, Homo sapiens
tgcaagagaaggag

SEQ ID NO: 334977 - DNA, 17 bp, Homo sapiens
gcggcccgtgcgcagcc

SEQ ID NO: 334978 - DNA, 20 bp, Homo sapiens
gcggcccgtgcgcagccgcg

SEQ ID NO: 334979 - DNA, 15 bp, Homo sapiens
gcggccgcctgtcct

SEQ ID NO: 334980 - DNA, 17 bp, Homo sapiens
gcggcgatttttgtatg

SEQ ID NO: 334981 - DNA, 12 bp, Homo sapiens
gcggcgcagagg

SEQ ID NO: 334982 - DNA, 14 bp, Homo sapiens
gcggcgcagcccct

SEQ ID NO: 334983 - DNA, 18 bp, Homo sapiens
gcggctgagagccccagc

SEQ ID NO: 334984 - DNA, 22 bp, Homo sapiens
gcggctgaggacggggcagagc

SEQ ID NO: 334985 - DNA, 15 bp, Homo sapiens
gcggctgctggcaca

SEQ ID NO: 334986 - DNA, 14 bp, Homo sapiens
tgcaaggaccagga

SEQ ID NO: 334987 - DNA, 11 bp, Homo sapiens
tgcaaggcact

SEQ ID NO: 334988 - DNA, 17 bp, Homo sapiens
tgcaaggcactgtacta

SEQ ID NO: 334989 - DNA, 12 bp, Homo sapiens
tgcaagggaatg

SEQ ID NO: 334990 - DNA, 22 bp, Homo sapiens
tgcaagggatgaattgtaaaag

SEQ ID NO: 334991 - DNA, 14 bp, Homo sapiens
tgcaagtcactaaa

SEQ ID NO: 334992 - DNA, 23 bp, Homo sapiens
tgcaagtgagcaaacctgcccca

SEQ ID NO: 334993 - DNA, 17 bp, Homo sapiens
tgcaagtgggagatgaa

SEQ ID NO: 334994 - DNA, 19 bp, Homo sapiens
tgcaagtgggagatgaaaa

SEQ ID NO: 334995 - DNA, 21 bp, Homo sapiens
tgcaagtgggagatgaaaacc

SEQ ID NO: 334996 - DNA, 17 bp, Homo sapiens
tgcaagtgtctgtgtgc

SEQ ID NO: 334997 - DNA, 18 bp, Homo sapiens
tgcaagtgtctgtgtgca

SEQ ID NO: 334998 - DNA, 21 bp, Homo sapiens
tgcaagtgtgtgcacatgtgt

SEQ ID NO: 334999 - DNA, 23 bp, Homo sapiens
tgcaagtgtgtgcacatgtgtgc

SEQ ID NO: 335000 - DNA, 23 bp, Homo sapiens
tgcaagtgtgtgcatgtgtgcga

SEQ ID NO: 335001 - DNA, 18 bp, Homo sapiens
tgcaagtgtttctgttct

SEQ ID NO: 335002 - DNA, 18 bp, Homo sapiens
tgcaagttcaagactgaa

SEQ ID NO: 335003 - DNA, 12 bp, Homo sapiens
tgcaataaaaaa

SEQ ID NO: 335004 - DNA, 14 bp, Homo sapiens
tgcaatatgagggg

SEQ ID NO: 335005 - DNA, 22 bp, Homo sapiens
tgcaatatgaggggactgcatg

SEQ ID NO: 335006 - DNA, 14 bp, Homo sapiens
tgcaatccatgcca

SEQ ID NO: 335007 - DNA, 12 bp, Homo sapiens
tgcaatgaatta

SEQ ID NO: 335008 - DNA, 15 bp, Homo sapiens
tgcaatgcctagact

SEQ ID NO: 335009 - DNA, 20 bp, Homo sapiens
tgcaatgtcacaacctctct

SEQ ID NO: 335010 - DNA, 20 bp, Homo sapiens
tgcaatgtcttaaataaaac

SEQ ID NO: 335011 - DNA, 17 bp, Homo sapiens
tgcaattaactctggac

SEQ ID NO: 335012 - DNA, 12 bp, Homo sapiens
tgcaattcaact

SEQ ID NO: 335013 - DNA, 21 bp, Homo sapiens
tgcaattgtaggggtgtgtgt

SEQ ID NO: 335014 - DNA, 22 bp, Homo sapiens
tgcaatttattaaaatgattgt

SEQ ID NO: 335015 - DNA, 14 bp, Homo sapiens
tgcaatttcatatg

SEQ ID NO: 335016 - DNA, 14 bp, Homo sapiens
tgcaatttcttctg

SEQ ID NO: 335017 - DNA, 16 bp, Homo sapiens
tgcaatttcttctgta

SEQ ID NO: 335018 - DNA, 18 bp, Homo sapiens
tgcaatttgtttaaagaa

SEQ ID NO: 335019 - DNA, 16 bp, Homo sapiens
tgcacaaaaagcacaa

SEQ ID NO: 335020 - DNA, 15 bp, Homo sapiens
tgcacaaagcccttc

SEQ ID NO: 335021 - DNA, 22 bp, Homo sapiens
tgcacaactagttaaaagcctt

SEQ ID NO: 335022 - DNA, 18 bp, Homo sapiens
tgcacacaaacacctcct

SEQ ID NO: 335023 - DNA, 14 bp, Homo sapiens
tgcacacacagctc

SEQ ID NO: 335024 - DNA, 16 bp, Homo sapiens
tgcacacacagctcct

SEQ ID NO: 335025 - DNA, 15 bp, Homo sapiens
tgcacacacctgcct

SEQ ID NO: 335026 - DNA, 16 bp, Homo sapiens
tgcacacacctgcctg

SEQ ID NO: 335027 - DNA, 13 bp, Homo sapiens
tgcacaccaaatt

SEQ ID NO: 335028 - DNA, 20 bp, Homo sapiens
tgcacactgacataatgtag

SEQ ID NO: 335029 - DNA, 23 bp, Homo sapiens
tgcacagatggatttgcctgtgc

SEQ ID NO: 335030 - DNA, 17 bp, Homo sapiens
tgcacagattaaacttc

SEQ ID NO: 335031 - DNA, 20 bp, Homo sapiens
tgcacagcccaaccaggagg

SEQ ID NO: 335032 - DNA, 20 bp, Homo sapiens
tgcacaggccacttgctcag

SEQ ID NO: 335033 - DNA, 16 bp, Homo sapiens
tgcacaggttttcagc

SEQ ID NO: 335034 - DNA, 18 bp, Homo sapiens
tgcacagtgcatctcagc

SEQ ID NO: 335035 - DNA, 17 bp, Homo sapiens
tgcacatatcaagaagt

SEQ ID NO: 335036 - DNA, 19 bp, Homo sapiens
tgcacatatcaagaagtca

SEQ ID NO: 335037 - DNA, 23 bp, Homo sapiens
tgcacatgacatttgtcctgcag

SEQ ID NO: 335038 - DNA, 21 bp, Homo sapiens
tgcacattaggaacagagtat

SEQ ID NO: 335039 - DNA, 11 bp, Homo sapiens
tgcacattcct

SEQ ID NO: 335040 - DNA, 13 bp, Homo sapiens
tgcacattttcca

SEQ ID NO: 335041 - DNA, 18 bp, Homo sapiens
tgcacattttccacggaa

SEQ ID NO: 335042 - DNA, 21 bp, Homo sapiens
tgcaccaacctcactgccctc

SEQ ID NO: 335043 - DNA, 12 bp, Homo sapiens
tgcaccagagtg

SEQ ID NO: 335044 - DNA, 23 bp, Homo sapiens
tgcaccagagtgaaagggctatg

SEQ ID NO: 335045 - DNA, 19 bp, Homo sapiens
tgcaccagcccttccctgc

SEQ ID NO: 335046 - DNA, 21 bp, Homo sapiens
tgcaccagcccttccctgctt

SEQ ID NO: 335047 - DNA, 15 bp, Homo sapiens
tgcaccaggagacag

SEQ ID NO: 335048 - DNA, 17 bp, Homo sapiens
tgcacccacccctgccc

SEQ ID NO: 335049 - DNA, 12 bp, Homo sapiens
tgcacccagctc

SEQ ID NO: 335050 - DNA, 17 bp, Homo sapiens
tgcacccagctccaggg

SEQ ID NO: 335051 - DNA, 21 bp, Homo sapiens
tgcaccccaaagctttcctgc

SEQ ID NO: 335052 - DNA, 14 bp, Homo sapiens
tgcaccccaagtcc

SEQ ID NO: 335053 - DNA, 23 bp, Homo sapiens
tgcaccccatgtgggtgaccagg

SEQ ID NO: 335054 - DNA, 15 bp, Homo sapiens
tgcaccctggggcct

SEQ ID NO: 335055 - DNA, 18 bp, Homo sapiens
tgcaccctgtatggagct

SEQ ID NO: 335056 - DNA, 17 bp, Homo sapiens
tgcaccgacgcctgccc

SEQ ID NO: 335057 - DNA, 17 bp, Homo sapiens
tgcacctcctaccctcc

SEQ ID NO: 335058 - DNA, 22 bp, Homo sapiens
tgcacctgaggcccagcagagc

SEQ ID NO: 335059 - DNA, 19 bp, Homo sapiens
tgcacctgtggcctctcag

SEQ ID NO: 335060 - DNA, 15 bp, Homo sapiens
tgcacggggccagca

SEQ ID NO: 335061 - DNA, 22 bp, Homo sapiens
tgcacggtttctgttctgcccc

SEQ ID NO: 335062 - DNA, 19 bp, Homo sapiens
tgcacgtagtagggtcagg

SEQ ID NO: 335063 - DNA, 16 bp, Homo sapiens
tgcacgtggagagctg

SEQ ID NO: 335064 - DNA, 14 bp, Homo sapiens
tgcacgtggcctct

SEQ ID NO: 335065 - DNA, 15 bp, Homo sapiens
tgcacgtggcctctt

SEQ ID NO: 335066 - DNA, 16 bp, Homo sapiens
tgcacgtggcctcttg

SEQ ID NO: 335067 - DNA, 19 bp, Homo sapiens
tgcacgtggcctcttgagc

SEQ ID NO: 335068 - DNA, 21 bp, Homo sapiens
tgcactaaaagtgatgtgatt

SEQ ID NO: 335069 - DNA, 18 bp, Homo sapiens
tgcactaaagtatgtaaa

SEQ ID NO: 335070 - DNA, 16 bp, Homo sapiens
tgcactactcctctgc

SEQ ID NO: 335071 - DNA, 18 bp, Homo sapiens
tgcactactcctctgcag

SEQ ID NO: 335072 - DNA, 23 bp, Homo sapiens
tgcactactcctctgcagtgcct

SEQ ID NO: 335073 - DNA, 16 bp, Homo sapiens
tgcactagccaaccca

SEQ ID NO: 335074 - DNA, 19 bp, Homo sapiens
tgcactatagccatttgcc

SEQ ID NO: 335075 - DNA, 16 bp, Homo sapiens
tgcactattccacagg

SEQ ID NO: 335076 - DNA, 16 bp, Homo sapiens
tgcactccatggccac

SEQ ID NO: 335077 - DNA, 20 bp, Homo sapiens
tgcactccatggccaccccg

SEQ ID NO: 335078 - DNA, 21 bp, Homo sapiens
tgcactcttttgagcagtaaa

SEQ ID NO: 335079 - DNA, 20 bp, Homo sapiens
tgcactgaatcgtttcatgt

SEQ ID NO: 335080 - DNA, 23 bp, Homo sapiens
tgcactgaatcgtttcatgtaag

SEQ ID NO: 335081 - DNA, 23 bp, Homo sapiens
tgcactgacctgctccgccagga

SEQ ID NO: 335082 - DNA, 22 bp, Homo sapiens
tgcactgggggaacagatgcta

SEQ ID NO: 335083 - DNA, 14 bp, Homo sapiens
tgcactgtaaaatg

SEQ ID NO: 335084 - DNA, 17 bp, Homo sapiens
tgcactgtaaaatgtgg

SEQ ID NO: 335085 - DNA, 19 bp, Homo sapiens
tgcactgtcactttgctct

SEQ ID NO: 335086 - DNA, 21 bp, Homo sapiens
tgcactgtcactttgctctgg

SEQ ID NO: 335087 - DNA, 18 bp, Homo sapiens
tgcactgtgcttgctcct

SEQ ID NO: 335088 - DNA, 22 bp, Homo sapiens
tgcacttattttttaatgtgag

SEQ ID NO: 335089 - DNA, 15 bp, Homo sapiens
tgcacttcagacacc

SEQ ID NO: 335090 - DNA, 15 bp, Homo sapiens
tgcacttcatatcta

SEQ ID NO: 335091 - DNA, 22 bp, Homo sapiens
tgcacttcatatctagatttct

SEQ ID NO: 335092 - DNA, 19 bp, Homo sapiens
tgcactttccctagaaagc

SEQ ID NO: 335093 - DNA, 21 bp, Homo sapiens
tgcagaaatgtggatgctctt

SEQ ID NO: 335094 - DNA, 13 bp, Homo sapiens
tgcagaacacctg

SEQ ID NO: 335095 - DNA, 15 bp, Homo sapiens
tgcagaacacctggc

SEQ ID NO: 335096 - DNA, 17 bp, Homo sapiens
tgcagaacacctggccg

SEQ ID NO: 335097 - DNA, 14 bp, Homo sapiens
tgcagaagggagga

SEQ ID NO: 335098 - DNA, 17 bp, Homo sapiens
tgcagaccccttggcca

SEQ ID NO: 335099 - DNA, 15 bp, Homo sapiens
tgcagacctgggact

SEQ ID NO: 335100 - DNA, 19 bp, Homo sapiens
tgcagactcagtttgtcag

SEQ ID NO: 335101 - DNA, 23 bp, Homo sapiens
tgcagagactttatccatgccaa

SEQ ID NO: 335102 - DNA, 18 bp, Homo sapiens
tgcagagaggttgtgaaa

SEQ ID NO: 335103 - DNA, 19 bp, Homo sapiens
tgcagagatgcggtggcta

SEQ ID NO: 335104 - DNA, 21 bp, Homo sapiens
tgcagagcaggaaacatgact

SEQ ID NO: 335105 - DNA, 14 bp, Homo sapiens
tgcagagctatggt

SEQ ID NO: 335106 - DNA, 14 bp, Homo sapiens
tgcatcaggaaaca

SEQ ID NO: 335107 - DNA, 17 bp, Homo sapiens
tgcatccacaggattcc

SEQ ID NO: 335108 - DNA, 18 bp, Homo sapiens
tgcatccacaggattcca

SEQ ID NO: 335109 - DNA, 14 bp, Homo sapiens
tgcatccctccacc

SEQ ID NO: 335110 - DNA, 12 bp, Homo sapiens
tgcatcctcagc

SEQ ID NO: 335111 - DNA, 19 bp, Homo sapiens
tgcatcgttttctttgctg

SEQ ID NO: 335112 - DNA, 22 bp, Homo sapiens
tgcatcgttttctttgctgtgc

SEQ ID NO: 335113 - DNA, 13 bp, Homo sapiens
tgcatctcagccc

SEQ ID NO: 335114 - DNA, 18 bp, Homo sapiens
tgcatctgggccagaagt

SEQ ID NO: 335115 - DNA, 18 bp, Homo sapiens
tgcatgaaggtctacctg

SEQ ID NO: 335116 - DNA, 20 bp, Homo sapiens
tgcatgagaatgtcatttgc

SEQ ID NO: 335117 - DNA, 22 bp, Homo sapiens
tgcatgagaatgtcatttgcta

SEQ ID NO: 335118 - DNA, 17 bp, Homo sapiens
tgcatgatattgtatgt

SEQ ID NO: 335119 - DNA, 20 bp, Homo sapiens
tgcatgatctgtcaaagtga

SEQ ID NO: 335120 - DNA, 20 bp, Homo sapiens
tgcatgcagcaacacccaag

SEQ ID NO: 335121 - DNA, 16 bp, Homo sapiens
tgcatgccaggctggg

SEQ ID NO: 335122 - DNA, 14 bp, Homo sapiens
tgcatgccgctgca

SEQ ID NO: 335123 - DNA, 17 bp, Homo sapiens
tgcatgctgctggacag

SEQ ID NO: 335124 - DNA, 13 bp, Homo sapiens
tgcatgctgcttt

SEQ ID NO: 335125 - DNA, 15 bp, Homo sapiens
tgcatgctgctttaa

SEQ ID NO: 335126 - DNA, 15 bp, Homo sapiens
gctaccgccctgggc

SEQ ID NO: 335127 - DNA, 16 bp, Homo sapiens
gctaccgccctgggct

SEQ ID NO: 335128 - DNA, 18 bp, Homo sapiens
gctaccgccctgggctgg

SEQ ID NO: 335129 - DNA, 17 bp, Homo sapiens
gctacctcaagggggac

SEQ ID NO: 335130 - DNA, 19 bp, Homo sapiens
gctacctgatcccactcct

SEQ ID NO: 335131 - DNA, 18 bp, Homo sapiens
gctactaatgatgttttc

SEQ ID NO: 335132 - DNA, 19 bp, Homo sapiens
gctactacccgagcccagc

SEQ ID NO: 335133 - DNA, 21 bp, Homo sapiens
gctactacccgagcccagcta

SEQ ID NO: 335134 - DNA, 14 bp, Homo sapiens
gctactctcttgcc

SEQ ID NO: 335135 - DNA, 13 bp, Homo sapiens
gctactctgtcca

SEQ ID NO: 335136 - DNA, 14 bp, Homo sapiens
gctactctgtccag

SEQ ID NO: 335137 - DNA, 21 bp, Homo sapiens
gctactctgtccaggccactg

SEQ ID NO: 335138 - DNA, 16 bp, Homo sapiens
gctactgatttttgtg

SEQ ID NO: 335139 - DNA, 18 bp, Homo sapiens
gctactgcagctttacat

SEQ ID NO: 335140 - DNA, 19 bp, Homo sapiens
gctactgcagctttacatg

SEQ ID NO: 335141 - DNA, 14 bp, Homo sapiens
gctactggcagctc

SEQ ID NO: 335142 - DNA, 16 bp, Homo sapiens
gctactggcagctcct

SEQ ID NO: 335143 - DNA, 14 bp, Homo sapiens
gctactgtcagtgt

SEQ ID NO: 335144 - DNA, 15 bp, Homo sapiens
gctacttgggagcct

SEQ ID NO: 335145 - DNA, 14 bp, Homo sapiens
gctagaaagtggca

SEQ ID NO: 335146 - DNA, 17 bp, Homo sapiens
gctagaacgtgtttaat

SEQ ID NO: 335147 - DNA, 21 bp, Homo sapiens
gctagaagaaagtaaaaagaa

SEQ ID NO: 335148 - DNA, 23 bp, Homo sapiens
gctagaagaaagtaaaaagaaca

SEQ ID NO: 335149 - DNA, 16 bp, Homo sapiens
gctagactaggagacc

SEQ ID NO: 335150 - DNA, 16 bp, Homo sapiens
gctagactggagtgag

SEQ ID NO: 335151 - DNA, 18 bp, Homo sapiens
gctagagaggggcctctg

SEQ ID NO: 335152 - DNA, 21 bp, Homo sapiens
gctagagcaacccctgtaccc

SEQ ID NO: 335153 - DNA, 18 bp, Homo sapiens
gctagaggccagccccac

SEQ ID NO: 335154 - DNA, 20 bp, Homo sapiens
gctagaggccagccccaccc

SEQ ID NO: 335155 - DNA, 13 bp, Homo sapiens
gctagaggcctga

SEQ ID NO: 335156 - DNA, 20 bp, Homo sapiens
gctagagtcctcactcccag

SEQ ID NO: 335157 - DNA, 17 bp, Homo sapiens
gctagccccagggtgag

SEQ ID NO: 335158 - DNA, 12 bp, Homo sapiens
gctagccctggg

SEQ ID NO: 335159 - DNA, 18 bp, Homo sapiens
gctagctatttctatgta

SEQ ID NO: 335160 - DNA, 17 bp, Homo sapiens
gctagctgtagaaatgt

SEQ ID NO: 335161 - DNA, 18 bp, Homo sapiens
gctagctgtagaaatgta

SEQ ID NO: 335162 - DNA, 14 bp, Homo sapiens
gctaggaaaggcag

SEQ ID NO: 335163 - DNA, 19 bp, Homo sapiens
gctaggactgaggagtggg

SEQ ID NO: 335164 - DNA, 18 bp, Homo sapiens
gctaggcatacaagtagg

SEQ ID NO: 335165 - DNA, 19 bp, Homo sapiens
gctaggctgagatgcacca

SEQ ID NO: 335166 - DNA, 19 bp, Homo sapiens
gctaggggccgagtccagg

SEQ ID NO: 335167 - DNA, 14 bp, Homo sapiens
gctagggtgcctgc

SEQ ID NO: 335168 - DNA, 22 bp, Homo sapiens
gctaggtagaggcatttgtctt

SEQ ID NO: 335169 - DNA, 18 bp, Homo sapiens
gctaggtataaaaaataa

SEQ ID NO: 335170 - DNA, 20 bp, Homo sapiens
gctaggttaataggaggaca

SEQ ID NO: 335171 - DNA, 14 bp, Homo sapiens
gctagtacctgtaa

SEQ ID NO: 335172 - DNA, 17 bp, Homo sapiens
gctagtatcttcaaact

SEQ ID NO: 335173 - DNA, 22 bp, Homo sapiens
gctagtccggacccacctcacc

SEQ ID NO: 335174 - DNA, 19 bp, Homo sapiens
gctagtgggccctctctct

SEQ ID NO: 335175 - DNA, 22 bp, Homo sapiens
gctagtgggccctctctctggg

SEQ ID NO: 335176 - DNA, 14 bp, Homo sapiens
gctagtttaaaatt

SEQ ID NO: 335177 - DNA, 15 bp, Homo sapiens
gctagttttacagat

SEQ ID NO: 335178 - DNA, 21 bp, Homo sapiens
gctagttttacagattgcctc

SEQ ID NO: 335179 - DNA, 13 bp, Homo sapiens
gctataaatatat

SEQ ID NO: 335180 - DNA, 23 bp, Homo sapiens
gctataacaactctattttttac

SEQ ID NO: 335181 - DNA, 22 bp, Homo sapiens
gctatagtgtataccacctgta

SEQ ID NO: 335182 - DNA, 12 bp, Homo sapiens
gctatatatgaa

SEQ ID NO: 335183 - DNA, 14 bp, Homo sapiens
gctatatccatgta

SEQ ID NO: 335184 - DNA, 15 bp, Homo sapiens
gctatatccatgtac

SEQ ID NO: 335185 - DNA, 21 bp, Homo sapiens
gctatatccatgtactgtagt

SEQ ID NO: 335186 - DNA, 23 bp, Homo sapiens
gctatatccatgtactgtagttt

SEQ ID NO: 335187 - DNA, 22 bp, Homo sapiens
gctatatgttatggcttattgt

SEQ ID NO: 335188 - DNA, 22 bp, Homo sapiens
gctatattttcatgacttttcc

SEQ ID NO: 335189 - DNA, 19 bp, Homo sapiens
gctatccacagaacctttg

SEQ ID NO: 335190 - DNA, 21 bp, Homo sapiens
gctatccacagaacctttgtc

SEQ ID NO: 335191 - DNA, 22 bp, Homo sapiens
gctatccacagaacctttgtca

SEQ ID NO: 335192 - DNA, 12 bp, Homo sapiens
gctatccaccaa

SEQ ID NO: 335193 - DNA, 12 bp, Homo sapiens
gctatccagccg

SEQ ID NO: 335194 - DNA, 16 bp, Homo sapiens
gctatgagaataactt

SEQ ID NO: 335195 - DNA, 12 bp, Homo sapiens
gctatgcacacc

SEQ ID NO: 335196 - DNA, 17 bp, Homo sapiens
gctatgctgttcattga

SEQ ID NO: 335197 - DNA, 15 bp, Homo sapiens
gctatggactgcaca

SEQ ID NO: 335198 - DNA, 19 bp, Homo sapiens
gctatggatggggcccagg

SEQ ID NO: 335199 - DNA, 21 bp, Homo sapiens
gctatggcaagggggtgtcat

SEQ ID NO: 335200 - DNA, 18 bp, Homo sapiens
gctattactagtactatt

SEQ ID NO: 335201 - DNA, 15 bp, Homo sapiens
gctattactgtctgg

SEQ ID NO: 335202 - DNA, 20 bp, Homo sapiens
gctattagaagggctgaata

SEQ ID NO: 335203 - DNA, 15 bp, Homo sapiens
gctattcacacacac

SEQ ID NO: 335204 - DNA, 22 bp, Homo sapiens
gctatttagagatattttccat

SEQ ID NO: 335205 - DNA, 14 bp, Homo sapiens
gctatttctatgta

SEQ ID NO: 335206 - DNA, 22 bp, Homo sapiens
gctatttctatgtatgtgccaa

SEQ ID NO: 335207 - DNA, 19 bp, Homo sapiens
gctatttgctttagagaca

SEQ ID NO: 335208 - DNA, 16 bp, Homo sapiens
gctatttgtgtgtatg

SEQ ID NO: 335209 - DNA, 17 bp, Homo sapiens
gctatttgttcagagag

SEQ ID NO: 335210 - DNA, 18 bp, Homo sapiens
gctatttgttcagagagg

SEQ ID NO: 335211 - DNA, 23 bp, Homo sapiens
gctatttttcttgttgcatcttt

SEQ ID NO: 335212 - DNA, 18 bp, Homo sapiens
gctcaaagagtaaaacat

SEQ ID NO: 335213 - DNA, 23 bp, Homo sapiens
gctcaaagatgtactgagaggag

SEQ ID NO: 335214 - DNA, 14 bp, Homo sapiens
gctcaaataaaaat

SEQ ID NO: 335215 - DNA, 20 bp, Homo sapiens
gctcaaatctattcagacaa

SEQ ID NO: 335216 - DNA, 21 bp, Homo sapiens
gctcaagaagacatggagact

SEQ ID NO: 335217 - DNA, 18 bp, Homo sapiens
gctcaagcaatcctcctg

SEQ ID NO: 335218 - DNA, 23 bp, Homo sapiens
gctcaagcaatcctcctgagtga

SEQ ID NO: 335219 - DNA, 22 bp, Homo sapiens
gctcaaggcaccgcagcctgtc

SEQ ID NO: 335220 - DNA, 17 bp, Homo sapiens
gctcaaggctgcagtga

SEQ ID NO: 335221 - DNA, 14 bp, Homo sapiens
gctcaataaaggtc

SEQ ID NO: 335222 - DNA, 22 bp, Homo sapiens
gctcaataaatgtgtgttgact

SEQ ID NO: 335223 - DNA, 21 bp, Homo sapiens
gctcaatattcctgaatgaaa

SEQ ID NO: 335224 - DNA, 23 bp, Homo sapiens
gctcaatgcattgtcttgtggag

SEQ ID NO: 335225 - DNA, 12 bp, Homo sapiens
gctcacagccac

SEQ ID NO: 335226 - DNA, 15 bp, Homo sapiens
gctcacagccaccac

SEQ ID NO: 335227 - DNA, 22 bp, Homo sapiens
gctcacagtacaatgtttcaga

SEQ ID NO: 335228 - DNA, 23 bp, Homo sapiens
gctcacattccctctcatccagg

SEQ ID NO: 335229 - DNA, 12 bp, Homo sapiens
gctcacccctgg

SEQ ID NO: 335230 - DNA, 14 bp, Homo sapiens
gctcacccctgggc

SEQ ID NO: 335231 - DNA, 23 bp, Homo sapiens
gctcacgactcttcctgcaaagg

SEQ ID NO: 335232 - DNA, 23 bp, Homo sapiens
gctcacgcctgtaatcccagcac

SEQ ID NO: 335233 - DNA, 22 bp, Homo sapiens
gctcacggggcctccaacccat

SEQ ID NO: 335234 - DNA, 15 bp, Homo sapiens
gctcacgtgtgtgac

SEQ ID NO: 335235 - DNA, 22 bp, Homo sapiens
gctccgagggcggccagggaca

SEQ ID NO: 335236 - DNA, 12 bp, Homo sapiens
gctccgccagga

SEQ ID NO: 335237 - DNA, 14 bp, Homo sapiens
gctccgcctctgct

SEQ ID NO: 335238 - DNA, 12 bp, Homo sapiens
gctccggcagag

SEQ ID NO: 335239 - DNA, 14 bp, Homo sapiens
gctccggcagaggc

SEQ ID NO: 335240 - DNA, 20 bp, Homo sapiens
gctccggcagaggcagggcc

SEQ ID NO: 335241 - DNA, 21 bp, Homo sapiens
gctccgtggccccgccctcag

SEQ ID NO: 335242 - DNA, 13 bp, Homo sapiens
gctccgtgtgtct

SEQ ID NO: 335243 - DNA, 15 bp, Homo sapiens
gctccgtgtgtctca

SEQ ID NO: 335244 - DNA, 14 bp, Homo sapiens
gctcctatctgtgt

SEQ ID NO: 335245 - DNA, 20 bp, Homo sapiens
gctcctcacccccacccctg

SEQ ID NO: 335246 - DNA, 21 bp, Homo sapiens
gctcctcacccccacccctgt

SEQ ID NO: 335247 - DNA, 16 bp, Homo sapiens
gctcctcactgcccgc

SEQ ID NO: 335248 - DNA, 17 bp, Homo sapiens
gctcctcccctcttgag

SEQ ID NO: 335249 - DNA, 14 bp, Homo sapiens
gctcctcccggtgc

SEQ ID NO: 335250 - DNA, 16 bp, Homo sapiens
gctcctcccggtgccc

SEQ ID NO: 335251 - DNA, 19 bp, Homo sapiens
gctcctcctcttggagctg

SEQ ID NO: 335252 - DNA, 15 bp, Homo sapiens
gctcctcggccagag

SEQ ID NO: 335253 - DNA, 17 bp, Homo sapiens
gctcctcggccagagct

SEQ ID NO: 335254 - DNA, 18 bp, Homo sapiens
gctcctcggccagagctc

SEQ ID NO: 335255 - DNA, 22 bp, Homo sapiens
gctcctcggccagagctcccag

SEQ ID NO: 335256 - DNA, 24 bp, Homo sapiens
gctcctcggccagagctcccagga

SEQ ID NO: 335257 - DNA, 19 bp, Homo sapiens
gctcctctccttgggctcc

SEQ ID NO: 335258 - DNA, 14 bp, Homo sapiens
gctcctctgcagcc

SEQ ID NO: 335259 - DNA, 14 bp, Homo sapiens
gctcctctgccttg

SEQ ID NO: 335260 - DNA, 14 bp, Homo sapiens
gctcctctgggcag

SEQ ID NO: 335261 - DNA, 16 bp, Homo sapiens
gctcctctgggcagga

SEQ ID NO: 335262 - DNA, 14 bp, Homo sapiens
gctcctctgttcag

SEQ ID NO: 335263 - DNA, 19 bp, Homo sapiens
gctcctctgttcagtcgca

SEQ ID NO: 335264 - DNA, 17 bp, Homo sapiens
gctcctctttcccctcc

SEQ ID NO: 335265 - DNA, 18 bp, Homo sapiens
gctcctgacttagcccgt

SEQ ID NO: 335266 - DNA, 20 bp, Homo sapiens
tgccagaaagagagaaccaa

SEQ ID NO: 335267 - DNA, 17 bp, Homo sapiens
tgccagaaggataatat

SEQ ID NO: 335268 - DNA, 20 bp, Homo sapiens
tgccagagcaaagggccagg

SEQ ID NO: 335269 - DNA, 14 bp, Homo sapiens
tgccagagctacac

SEQ ID NO: 335270 - DNA, 20 bp, Homo sapiens
tgccagagctacactcgcct

SEQ ID NO: 335271 - DNA, 13 bp, Homo sapiens
tgccagcacagag

SEQ ID NO: 335272 - DNA, 17 bp, Homo sapiens
tgccagcacaggggccc

SEQ ID NO: 335273 - DNA, 19 bp, Homo sapiens
tgccagcacaggggcccca

SEQ ID NO: 335274 - DNA, 11 bp, Homo sapiens
tgccagcccaa

SEQ ID NO: 335275 - DNA, 13 bp, Homo sapiens
tgccagcccaaag

SEQ ID NO: 335276 - DNA, 17 bp, Homo sapiens
tgccagcccaaagctgg

SEQ ID NO: 335277 - DNA, 20 bp, Homo sapiens
tgccagccgtgatgctcagg

SEQ ID NO: 335278 - DNA, 12 bp, Homo sapiens
tgccagccttcc

SEQ ID NO: 335279 - DNA, 17 bp, Homo sapiens
tgccagccttcctctgc

SEQ ID NO: 335280 - DNA, 23 bp, Homo sapiens
tgccagccttcctctgcagctga

SEQ ID NO: 335281 - DNA, 14 bp, Homo sapiens
tgccagccttggag

SEQ ID NO: 335282 - DNA, 10 bp, Homo sapiens
tgccagctca

SEQ ID NO: 335283 - DNA, 12 bp, Homo sapiens
tgccagctccac

SEQ ID NO: 335284 - DNA, 15 bp, Homo sapiens
tgccagctgccttcc

SEQ ID NO: 335285 - DNA, 21 bp, Homo sapiens
tgccagctgccttcctcatcc

SEQ ID NO: 335286 - DNA, 23 bp, Homo sapiens
tgccagcttcccttttctcccaa

SEQ ID NO: 335287 - DNA, 14 bp, Homo sapiens
tgccaggacagctg

SEQ ID NO: 335288 - DNA, 19 bp, Homo sapiens
tgccaggacagctgcaggt

SEQ ID NO: 335289 - DNA, 20 bp, Homo sapiens
tgccaggacagctgcaggtg

SEQ ID NO: 335290 - DNA, 13 bp, Homo sapiens
tgccaggactctc

SEQ ID NO: 335291 - DNA, 15 bp, Homo sapiens
tgccaggactctctt

SEQ ID NO: 335292 - DNA, 21 bp, Homo sapiens
tgccaggagcagcctccaaga

SEQ ID NO: 335293 - DNA, 17 bp, Homo sapiens
tgccaggagtgggtggg

SEQ ID NO: 335294 - DNA, 23 bp, Homo sapiens
tgccaggagtgggtgggacacag

SEQ ID NO: 335295 - DNA, 17 bp, Homo sapiens
tgccaggcacctggcct

SEQ ID NO: 335296 - DNA, 20 bp, Homo sapiens
tgccaggcagaaaactggca

SEQ ID NO: 335297 - DNA, 15 bp, Homo sapiens
tgccaggccagtaaa

SEQ ID NO: 335298 - DNA, 12 bp, Homo sapiens
tgccaggcccat

SEQ ID NO: 335299 - DNA, 21 bp, Homo sapiens
tgccaggcccatctcaggtgc

SEQ ID NO: 335300 - DNA, 21 bp, Homo sapiens
tgccaggcgttggtgccactt

SEQ ID NO: 335301 - DNA, 22 bp, Homo sapiens
tgccaggcgttggtgccacttc

SEQ ID NO: 335302 - DNA, 22 bp, Homo sapiens
tgccaggctctccctctctgca

SEQ ID NO: 335303 - DNA, 19 bp, Homo sapiens
tgccagggcagtgctagtg

SEQ ID NO: 335304 - DNA, 17 bp, Homo sapiens
tgccaggttgcagctgc

SEQ ID NO: 335305 - DNA, 24 bp, Homo sapiens
tgccaggttgcagctgctcttgca

SEQ ID NO: 335306 - DNA, 19 bp, Homo sapiens
tgccagtatataagctgtt

SEQ ID NO: 335307 - DNA, 20 bp, Homo sapiens
tgccagtccccctgccccag

SEQ ID NO: 335308 - DNA, 13 bp, Homo sapiens
tgccagtcctgca

SEQ ID NO: 335309 - DNA, 22 bp, Homo sapiens
tgccagtgaagtccttcagtga

SEQ ID NO: 335310 - DNA, 16 bp, Homo sapiens
tgccagtgacagacag

SEQ ID NO: 335311 - DNA, 23 bp, Homo sapiens
tgccagttgaaaatggattttta

SEQ ID NO: 335312 - DNA, 13 bp, Homo sapiens
tgccatagagttt

SEQ ID NO: 335313 - DNA, 18 bp, Homo sapiens
tgccatagagtttaacac

SEQ ID NO: 335314 - DNA, 19 bp, Homo sapiens
tgccatcagcccctgctgc

SEQ ID NO: 335315 - DNA, 20 bp, Homo sapiens
tgccatcagcccctgctgct

SEQ ID NO: 335316 - DNA, 14 bp, Homo sapiens
tgccatcatgcctg

SEQ ID NO: 335317 - DNA, 15 bp, Homo sapiens
tgccatcatgcctga

SEQ ID NO: 335318 - DNA, 14 bp, Homo sapiens
tgccatctgtacat

SEQ ID NO: 335319 - DNA, 23 bp, Homo sapiens
tgccatctgtacatattactgtt

SEQ ID NO: 335320 - DNA, 18 bp, Homo sapiens
tgccatctgtgggcacgc

SEQ ID NO: 335321 - DNA, 20 bp, Homo sapiens
tgccatctgtgtcctggtta

SEQ ID NO: 335322 - DNA, 20 bp, Homo sapiens
tgccatgacaacttctaatt

SEQ ID NO: 335323 - DNA, 13 bp, Homo sapiens
tgccatgccactg

SEQ ID NO: 335324 - DNA, 20 bp, Homo sapiens
tgccatgccactgccaggca

SEQ ID NO: 335325 - DNA, 17 bp, Homo sapiens
tgccatgctcagaaatg

SEQ ID NO: 335326 - DNA, 18 bp, Homo sapiens
tgccatgctgctatgaag

SEQ ID NO: 335327 - DNA, 18 bp, Homo sapiens
tgccatggaggcacacag

SEQ ID NO: 335328 - DNA, 13 bp, Homo sapiens
tgccatggcctgt

SEQ ID NO: 335329 - DNA, 16 bp, Homo sapiens
tgccatggcctgtgct

SEQ ID NO: 335330 - DNA, 22 bp, Homo sapiens
tgccatgtagaccccttgaaga

SEQ ID NO: 335331 - DNA, 16 bp, Homo sapiens
tgccatgtgaagaggg

SEQ ID NO: 335332 - DNA, 14 bp, Homo sapiens
tgccatgtggcaga

SEQ ID NO: 335333 - DNA, 17 bp, Homo sapiens
tgccattgtctttcctc

SEQ ID NO: 335334 - DNA, 23 bp, Homo sapiens
tgccatttcctcctgggcaacag

SEQ ID NO: 335335 - DNA, 19 bp, Homo sapiens
tgccatttcttcccaaggc

SEQ ID NO: 335336 - DNA, 14 bp, Homo sapiens
tgccattttgtctg

SEQ ID NO: 335337 - DNA, 16 bp, Homo sapiens
tgccattttgtctggc

SEQ ID NO: 335338 - DNA, 18 bp, Homo sapiens
tgccattttgtctggctg

SEQ ID NO: 335339 - DNA, 23 bp, Homo sapiens
tgcccaaagcagcacttataaat

SEQ ID NO: 335340 - DNA, 17 bp, Homo sapiens
tgcccaaagtggggagg

SEQ ID NO: 335341 - DNA, 15 bp, Homo sapiens
tgcccaaatcccctc

SEQ ID NO: 335342 - DNA, 17 bp, Homo sapiens
tgcccaacctcagcaac

SEQ ID NO: 335343 - DNA, 18 bp, Homo sapiens
tgcccaacctgctctcct

SEQ ID NO: 335344 - DNA, 22 bp, Homo sapiens
tgcccaacctgctctcctcttg

SEQ ID NO: 335345 - DNA, 14 bp, Homo sapiens
tgcccaactcccag

SEQ ID NO: 335346 - DNA, 17 bp, Homo sapiens
tgcccaagggcctccca

SEQ ID NO: 335347 - DNA, 18 bp, Homo sapiens
tgcccaagggcctcccac

SEQ ID NO: 335348 - DNA, 19 bp, Homo sapiens
tgcccaagggcctcccacc

SEQ ID NO: 335349 - DNA, 21 bp, Homo sapiens
tgcccaagggcctcccaccag

SEQ ID NO: 335350 - DNA, 11 bp, Homo sapiens
tgcccacacca

SEQ ID NO: 335351 - DNA, 13 bp, Homo sapiens
tgcccacaccacc

SEQ ID NO: 335352 - DNA, 16 bp, Homo sapiens
tgcccacatcccaggc

SEQ ID NO: 335353 - DNA, 20 bp, Homo sapiens
tgcccacccagggcccggca

SEQ ID NO: 335354 - DNA, 21 bp, Homo sapiens
tgcccacccagggcccggcac

SEQ ID NO: 335355 - DNA, 15 bp, Homo sapiens
tgcccacccctgctg

SEQ ID NO: 335356 - DNA, 19 bp, Homo sapiens
tgcccacccgtggagatgg

SEQ ID NO: 335357 - DNA, 22 bp, Homo sapiens
tgcccaccctctggagaaggtg

SEQ ID NO: 335358 - DNA, 20 bp, Homo sapiens
tgcccaccctgggcctcccg

SEQ ID NO: 335359 - DNA, 15 bp, Homo sapiens
tgcccacctgcccat

SEQ ID NO: 335360 - DNA, 14 bp, Homo sapiens
tgcccacggccacc

SEQ ID NO: 335361 - DNA, 16 bp, Homo sapiens
tgcccacggccaccca

SEQ ID NO: 335362 - DNA, 21 bp, Homo sapiens
tgcccactaggatcccactgg

SEQ ID NO: 335363 - DNA, 23 bp, Homo sapiens
tgcccacttagccgtccatggca

SEQ ID NO: 335364 - DNA, 15 bp, Homo sapiens
tgcccagagatggga

SEQ ID NO: 335365 - DNA, 14 bp, Homo sapiens
tgcctgaaacagcc

SEQ ID NO: 335366 - DNA, 20 bp, Homo sapiens
tgcctgaaacagccatgtcc

SEQ ID NO: 335367 - DNA, 19 bp, Homo sapiens
tgcctgaagttggagtgag

SEQ ID NO: 335368 - DNA, 15 bp, Homo sapiens
tgcctgacactgagc

SEQ ID NO: 335369 - DNA, 19 bp, Homo sapiens
tgcctgacactgagcccca

SEQ ID NO: 335370 - DNA, 18 bp, Homo sapiens
tgcctgaccatcccatga

SEQ ID NO: 335371 - DNA, 17 bp, Homo sapiens
tgcctgagagcagaatg

SEQ ID NO: 335372 - DNA, 20 bp, Homo sapiens
tgcctgagcccgaatttctc

SEQ ID NO: 335373 - DNA, 14 bp, Homo sapiens
tgcctgagggcccc

SEQ ID NO: 335374 - DNA, 16 bp, Homo sapiens
tgcctgagggcccctc

SEQ ID NO: 335375 - DNA, 19 bp, Homo sapiens
tgcctgagggcccctctgc

SEQ ID NO: 335376 - DNA, 22 bp, Homo sapiens
tgcctgagggcccctctgccca

SEQ ID NO: 335377 - DNA, 18 bp, Homo sapiens
tgcctgagggtggagact

SEQ ID NO: 335378 - DNA, 16 bp, Homo sapiens
tgcctgcaccaggaga

SEQ ID NO: 335379 - DNA, 17 bp, Homo sapiens
tgcctgcaccaggagac

SEQ ID NO: 335380 - DNA, 12 bp, Homo sapiens
tgcctgcagcat

SEQ ID NO: 335381 - DNA, 14 bp, Homo sapiens
tgcctgccactctc

SEQ ID NO: 335382 - DNA, 18 bp, Homo sapiens
tgcctgccactctctggg

SEQ ID NO: 335383 - DNA, 15 bp, Homo sapiens
tgcctgcccacccgt

SEQ ID NO: 335384 - DNA, 18 bp, Homo sapiens
tgcctgcccccctcatct

SEQ ID NO: 335385 - DNA, 19 bp, Homo sapiens
tgcctgcccgcacagcagc

SEQ ID NO: 335386 - DNA, 20 bp, Homo sapiens
tgcctgcccgcacagcagcc

SEQ ID NO: 335387 - DNA, 16 bp, Homo sapiens
tgcctgccgcccaaag

SEQ ID NO: 335388 - DNA, 20 bp, Homo sapiens
tgcctgccggccgcccagac

SEQ ID NO: 335389 - DNA, 12 bp, Homo sapiens
tgcctgcctggg

SEQ ID NO: 335390 - DNA, 14 bp, Homo sapiens
tgcctgcctgggaa

SEQ ID NO: 335391 - DNA, 15 bp, Homo sapiens
tgcctgcctgtctgt

SEQ ID NO: 335392 - DNA, 16 bp, Homo sapiens
tgcctgctccttggca

SEQ ID NO: 335393 - DNA, 14 bp, Homo sapiens
tgcctgctctgcag

SEQ ID NO: 335394 - DNA, 17 bp, Homo sapiens
tgcctgctctgcagccc

SEQ ID NO: 335395 - DNA, 23 bp, Homo sapiens
tgcctgctctgcagcccacagag

SEQ ID NO: 335396 - DNA, 14 bp, Homo sapiens
tgcctggccaggca

SEQ ID NO: 335397 - DNA, 12 bp, Homo sapiens
tgcctggcccag

SEQ ID NO: 335398 - DNA, 16 bp, Homo sapiens
tgcctggcccagggag

SEQ ID NO: 335399 - DNA, 19 bp, Homo sapiens
tgcctggcccagggaggaa

SEQ ID NO: 335400 - DNA, 16 bp, Homo sapiens
tgcctggcccccctcc

SEQ ID NO: 335401 - DNA, 19 bp, Homo sapiens
tgcctggcccccctccagg

SEQ ID NO: 335402 - DNA, 12 bp, Homo sapiens
tgcctggcctgg

SEQ ID NO: 335403 - DNA, 14 bp, Homo sapiens
tgcctggcctggct

SEQ ID NO: 335404 - DNA, 13 bp, Homo sapiens
tgcctggcgggca

SEQ ID NO: 335405 - DNA, 15 bp, Homo sapiens
tgcctggcgggcagc

SEQ ID NO: 335406 - DNA, 16 bp, Homo sapiens
tgcctggcgggcagcc

SEQ ID NO: 335407 - DNA, 22 bp, Homo sapiens
gctcctgaggggcatctgcccc

SEQ ID NO: 335408 - DNA, 17 bp, Homo sapiens
gctcctggagccagcca

SEQ ID NO: 335409 - DNA, 12 bp, Homo sapiens
gctcctggctgc

SEQ ID NO: 335410 - DNA, 17 bp, Homo sapiens
gctcctggctgccaggc

SEQ ID NO: 335411 - DNA, 12 bp, Homo sapiens
gctcctgggaag

SEQ ID NO: 335412 - DNA, 22 bp, Homo sapiens
gctcctgtatttgagactagga

SEQ ID NO: 335413 - DNA, 13 bp, Homo sapiens
gctcctgtttcca

SEQ ID NO: 335414 - DNA, 22 bp, Homo sapiens
gctccttgaagacatatcatgt

SEQ ID NO: 335415 - DNA, 21 bp, Homo sapiens
gctccttggcacccccatgct

SEQ ID NO: 335416 - DNA, 22 bp, Homo sapiens
gctccttggcacccccatgctg

SEQ ID NO: 335417 - DNA, 16 bp, Homo sapiens
gctccttgggtcctgc

SEQ ID NO: 335418 - DNA, 13 bp, Homo sapiens
gctcctttcccac

SEQ ID NO: 335419 - DNA, 16 bp, Homo sapiens
gctcctttcccacagt

SEQ ID NO: 335420 - DNA, 14 bp, Homo sapiens
gctcctttctccag

SEQ ID NO: 335421 - DNA, 18 bp, Homo sapiens
gctcctttctccagccag

SEQ ID NO: 335422 - DNA, 15 bp, Homo sapiens
gctccttttctgtga

SEQ ID NO: 335423 - DNA, 18 bp, Homo sapiens
gctccttttgtccccagg

SEQ ID NO: 335424 - DNA, 22 bp, Homo sapiens
gctccttttgtccccagggccc

SEQ ID NO: 335425 - DNA, 17 bp, Homo sapiens
gctcgagcagtcctgcc

SEQ ID NO: 335426 - DNA, 20 bp, Homo sapiens
gctcgagcagtcctgcctca

SEQ ID NO: 335427 - DNA, 16 bp, Homo sapiens
gctcgagtgcccctgc

SEQ ID NO: 335428 - DNA, 18 bp, Homo sapiens
gctcgatgcctttgctgt

SEQ ID NO: 335429 - DNA, 15 bp, Homo sapiens
gctcgccccacccag

SEQ ID NO: 335430 - DNA, 12 bp, Homo sapiens
gctcggacacag

SEQ ID NO: 335431 - DNA, 17 bp, Homo sapiens
gctcggacccaccccaa

SEQ ID NO: 335432 - DNA, 20 bp, Homo sapiens
gctcggacccaccccaactc

SEQ ID NO: 335433 - DNA, 15 bp, Homo sapiens
gctcgggaaggcctg

SEQ ID NO: 335434 - DNA, 19 bp, Homo sapiens
gctcgggaaggcctgaggg

SEQ ID NO: 335435 - DNA, 15 bp, Homo sapiens
gctcgggacttcaaa

SEQ ID NO: 335436 - DNA, 13 bp, Homo sapiens
gctcgtggccttc

SEQ ID NO: 335437 - DNA, 13 bp, Homo sapiens
gctcgtgggctct

SEQ ID NO: 335438 - DNA, 17 bp, Homo sapiens
gctcgtgggctctggct

SEQ ID NO: 335439 - DNA, 18 bp, Homo sapiens
gctcgtgtatcctggggc

SEQ ID NO: 335440 - DNA, 19 bp, Homo sapiens
gctcgtgtatcctggggct

SEQ ID NO: 335441 - DNA, 12 bp, Homo sapiens
gctctaataaaa

SEQ ID NO: 335442 - DNA, 20 bp, Homo sapiens
gctctacacaacatgtatgt

SEQ ID NO: 335443 - DNA, 20 bp, Homo sapiens
gctctacagctaatcagcat

SEQ ID NO: 335444 - DNA, 17 bp, Homo sapiens
gctctaccaagacataa

SEQ ID NO: 335445 - DNA, 18 bp, Homo sapiens
gctctacccatgagcctg

SEQ ID NO: 335446 - DNA, 19 bp, Homo sapiens
gctctagacaaccctgcaa

SEQ ID NO: 335447 - DNA, 14 bp, Homo sapiens
gctctagccaggag

SEQ ID NO: 335448 - DNA, 19 bp, Homo sapiens
gctctagctggcaggacac

SEQ ID NO: 335449 - DNA, 16 bp, Homo sapiens
gctctatctgcaatgt

SEQ ID NO: 335450 - DNA, 17 bp, Homo sapiens
gctctattgtagcattt

SEQ ID NO: 335451 - DNA, 20 bp, Homo sapiens
gctctatttcggaaatacac

SEQ ID NO: 335452 - DNA, 14 bp, Homo sapiens
gctctcacccccat

SEQ ID NO: 335453 - DNA, 17 bp, Homo sapiens
gctctccaaaccacttt

SEQ ID NO: 335454 - DNA, 20 bp, Homo sapiens
gctctccaaaggggctgctg

SEQ ID NO: 335455 - DNA, 21 bp, Homo sapiens
gctctccatcataggctgaca

SEQ ID NO: 335456 - DNA, 22 bp, Homo sapiens
gctctcccacatcccactggat

SEQ ID NO: 335457 - DNA, 22 bp, Homo sapiens
gctctcccctctcgccccatcc

SEQ ID NO: 335458 - DNA, 19 bp, Homo sapiens
gctctcccctgcgcaggcc

SEQ ID NO: 335459 - DNA, 15 bp, Homo sapiens
gctctccctcttctc

SEQ ID NO: 335460 - DNA, 16 bp, Homo sapiens
gctctccctcttctca

SEQ ID NO: 335461 - DNA, 18 bp, Homo sapiens
gctctcctaccccacctc

SEQ ID NO: 335462 - DNA, 14 bp, Homo sapiens
gctctcctgggcca

SEQ ID NO: 335463 - DNA, 15 bp, Homo sapiens
gctctccttgccctg

SEQ ID NO: 335464 - DNA, 19 bp, Homo sapiens
gctctccttgccctgggcc

SEQ ID NO: 335465 - DNA, 21 bp, Homo sapiens
gctctcggaactgcatgctgc

SEQ ID NO: 335466 - DNA, 20 bp, Homo sapiens
gctctctacccagcccatct

SEQ ID NO: 335467 - DNA, 23 bp, Homo sapiens
gctctctcagacccttgaagatg

SEQ ID NO: 335468 - DNA, 12 bp, Homo sapiens
gctctctccagg

SEQ ID NO: 335469 - DNA, 17 bp, Homo sapiens
gctctctgggacctcct

SEQ ID NO: 335470 - DNA, 11 bp, Homo sapiens
gctctctgtct

SEQ ID NO: 335471 - DNA, 13 bp, Homo sapiens
gctctctgtctgg

SEQ ID NO: 335472 - DNA, 16 bp, Homo sapiens
gctctcttaaatgaag

SEQ ID NO: 335473 - DNA, 23 bp, Homo sapiens
gctctcttccagaagatgccctc

SEQ ID NO: 335474 - DNA, 23 bp, Homo sapiens
gctctcttgccgaggagccaggc

SEQ ID NO: 335475 - DNA, 15 bp, Homo sapiens
gctctgaaagctgct

SEQ ID NO: 335476 - DNA, 23 bp, Homo sapiens
gctctgaatctctcaaaatgtgc

SEQ ID NO: 335477 - DNA, 19 bp, Homo sapiens
gctctgaatgggagccaga

SEQ ID NO: 335478 - DNA, 16 bp, Homo sapiens
gctctgacccaagtgg

SEQ ID NO: 335479 - DNA, 17 bp, Homo sapiens
gctctgacccagtgaga

SEQ ID NO: 335480 - DNA, 12 bp, Homo sapiens
gctctgacctgc

SEQ ID NO: 335481 - DNA, 20 bp, Homo sapiens
gctctgagacggatggaagg

SEQ ID NO: 335482 - DNA, 23 bp, Homo sapiens
gctctgagacggatggaaggaga

SEQ ID NO: 335483 - DNA, 14 bp, Homo sapiens
gctctgaggcaacc

SEQ ID NO: 335484 - DNA, 13 bp, Homo sapiens
gctctgcacagat

SEQ ID NO: 335485 - DNA, 18 bp, Homo sapiens
gctctgcacagatggatt

SEQ ID NO: 335486 - DNA, 16 bp, Homo sapiens
gctctgcagcccacag

SEQ ID NO: 335487 - DNA, 17 bp, Homo sapiens
gctctgcagcccacaga

SEQ ID NO: 335488 - DNA, 19 bp, Homo sapiens
gctctgcagcccacagagg

SEQ ID NO: 335489 - DNA, 20 bp, Homo sapiens
gctctgcagcccacagagga

SEQ ID NO: 335490 - DNA, 18 bp, Homo sapiens
gctctgccaccctacctg

SEQ ID NO: 335491 - DNA, 22 bp, Homo sapiens
gctctgccatcagcccctgctg

SEQ ID NO: 335492 - DNA, 18 bp, Homo sapiens
gctctgcccagagctggg

SEQ ID NO: 335493 - DNA, 20 bp, Homo sapiens
gctctgcccagagctgggtg

SEQ ID NO: 335494 - DNA, 16 bp, Homo sapiens
gctctgccccaagccc

SEQ ID NO: 335495 - DNA, 16 bp, Homo sapiens
gctctgcccctccgtc

SEQ ID NO: 335496 - DNA, 23 bp, Homo sapiens
tgctcatctcagtcctcaaagct

SEQ ID NO: 335497 - DNA, 15 bp, Homo sapiens
tgctcatctgatatt

SEQ ID NO: 335498 - DNA, 18 bp, Homo sapiens
tgctcattcatattcctg

SEQ ID NO: 335499 - DNA, 23 bp, Homo sapiens
tgctcattcatattcctgccttt

SEQ ID NO: 335500 - DNA, 15 bp, Homo sapiens
tgctccaccccactc

SEQ ID NO: 335501 - DNA, 16 bp, Homo sapiens
tgctccaccccactca

SEQ ID NO: 335502 - DNA, 18 bp, Homo sapiens
tgctccacccttggcctg

SEQ ID NO: 335503 - DNA, 20 bp, Homo sapiens
tgctccacgaagccttaagc

SEQ ID NO: 335504 - DNA, 21 bp, Homo sapiens
tgctccacgaagccttaagcc

SEQ ID NO: 335505 - DNA, 14 bp, Homo sapiens
tgctccagaattaa

SEQ ID NO: 335506 - DNA, 12 bp, Homo sapiens
tgctccagcagt

SEQ ID NO: 335507 - DNA, 23 bp, Homo sapiens
tgctccagccaacccctgtggag

SEQ ID NO: 335508 - DNA, 12 bp, Homo sapiens
tgctccagggtc

SEQ ID NO: 335509 - DNA, 23 bp, Homo sapiens
tgctccagggtcttgggctactg

SEQ ID NO: 335510 - DNA, 23 bp, Homo sapiens
tgctccatgcagatctagccagg

SEQ ID NO: 335511 - DNA, 22 bp, Homo sapiens
tgctccatttataaccccagcc

SEQ ID NO: 335512 - DNA, 18 bp, Homo sapiens
tgctccattttcttgtca

SEQ ID NO: 335513 - DNA, 18 bp, Homo sapiens
tgctcccagcatttgtcc

SEQ ID NO: 335514 - DNA, 12 bp, Homo sapiens
tgctcccagcct

SEQ ID NO: 335515 - DNA, 19 bp, Homo sapiens
tgctcccagtgccaaactt

SEQ ID NO: 335516 - DNA, 17 bp, Homo sapiens
tgctcccattcctccct

SEQ ID NO: 335517 - DNA, 20 bp, Homo sapiens
tgctcccattcctccctccg

SEQ ID NO: 335518 - DNA, 18 bp, Homo sapiens
tgctccccacccctaccg

SEQ ID NO: 335519 - DNA, 19 bp, Homo sapiens
tgctcccccatcctcccct

SEQ ID NO: 335520 - DNA, 21 bp, Homo sapiens
tgctcccccatcctccccttc

SEQ ID NO: 335521 - DNA, 14 bp, Homo sapiens
tgctcccctccctc

SEQ ID NO: 335522 - DNA, 23 bp, Homo sapiens
tgctcccgcctgattggggcctc

SEQ ID NO: 335523 - DNA, 13 bp, Homo sapiens
tgctccctcccct

SEQ ID NO: 335524 - DNA, 14 bp, Homo sapiens
tgctccctcccctg

SEQ ID NO: 335525 - DNA, 15 bp, Homo sapiens
tgctccgtgtgtctc

SEQ ID NO: 335526 - DNA, 21 bp, Homo sapiens
tgctcctacccctgtcctggg

SEQ ID NO: 335527 - DNA, 23 bp, Homo sapiens
tgctcctacccctgtcctggggc

SEQ ID NO: 335528 - DNA, 14 bp, Homo sapiens
tgctcctcacctgt

SEQ ID NO: 335529 - DNA, 15 bp, Homo sapiens
tgctcctcacctgtc

SEQ ID NO: 335530 - DNA, 12 bp, Homo sapiens
tgctcctcagga

SEQ ID NO: 335531 - DNA, 13 bp, Homo sapiens
tgctcctcagggt

SEQ ID NO: 335532 - DNA, 23 bp, Homo sapiens
tgctcctcggccagagctcccag

SEQ ID NO: 335533 - DNA, 14 bp, Homo sapiens
tgctcctctttccc

SEQ ID NO: 335534 - DNA, 19 bp, Homo sapiens
tgctcctctttcccctcct

SEQ ID NO: 335535 - DNA, 19 bp, Homo sapiens
tgctcctgcatgcaactaa

SEQ ID NO: 335536 - DNA, 21 bp, Homo sapiens
tgctcctgtttaactccctag

SEQ ID NO: 335537 - DNA, 23 bp, Homo sapiens
tgctccttggcctagtcagatgg

SEQ ID NO: 335538 - DNA, 17 bp, Homo sapiens
tgctccttgttcctaga

SEQ ID NO: 335539 - DNA, 14 bp, Homo sapiens
tgctccttttctct

SEQ ID NO: 335540 - DNA, 14 bp, Homo sapiens
tgctcggacacagt

SEQ ID NO: 335541 - DNA, 14 bp, Homo sapiens
tgctctaagaggct

SEQ ID NO: 335542 - DNA, 19 bp, Homo sapiens
tgctctacccatgagcctg

SEQ ID NO: 335543 - DNA, 14 bp, Homo sapiens
tgctctagccagga

SEQ ID NO: 335544 - DNA, 15 bp, Homo sapiens
tgctctagccaggag

SEQ ID NO: 335545 - DNA, 15 bp, Homo sapiens
tgctctagctggcag

SEQ ID NO: 335546 - DNA, 18 bp, Homo sapiens
tgctctagctggcaggac

SEQ ID NO: 335547 - DNA, 19 bp, Homo sapiens
tgctctagctggcaggaca

SEQ ID NO: 335548 - DNA, 13 bp, Homo sapiens
aatctttctgcag

SEQ ID NO: 335549 - DNA, 15 bp, Homo sapiens
aatctttctttacct

SEQ ID NO: 335550 - DNA, 21 bp, Homo sapiens
aatctttctttacctgagacc

SEQ ID NO: 335551 - DNA, 22 bp, Homo sapiens
aatctttctttacctgagacca

SEQ ID NO: 335552 - DNA, 23 bp, Homo sapiens
aatcttttactgtggaggtggct

SEQ ID NO: 335553 - DNA, 17 bp, Homo sapiens
aatctttttctccaccc

SEQ ID NO: 335554 - DNA, 21 bp, Homo sapiens
aatgaaaagaaaatgtgccat

SEQ ID NO: 335555 - DNA, 13 bp, Homo sapiens
aatgaaaatgtca

SEQ ID NO: 335556 - DNA, 14 bp, Homo sapiens
aatgaaaatgtcag

SEQ ID NO: 335557 - DNA, 20 bp, Homo sapiens
aatgaaacaaataatcacat

SEQ ID NO: 335558 - DNA, 23 bp, Homo sapiens
aatgaaaccttcctcttgagggt

SEQ ID NO: 335559 - DNA, 15 bp, Homo sapiens
aatgaaagcatgtgg

SEQ ID NO: 335560 - DNA, 22 bp, Homo sapiens
aatgaaagcatgtggcatgttc

SEQ ID NO: 335561 - DNA, 21 bp, Homo sapiens
aatgaaagggaaagtcagctt

SEQ ID NO: 335562 - DNA, 23 bp, Homo sapiens
aatgaaagtcttgtgactagtgc

SEQ ID NO: 335563 - DNA, 16 bp, Homo sapiens
aatgaaatacttgaca

SEQ ID NO: 335564 - DNA, 15 bp, Homo sapiens
aatgaaatatttgct

SEQ ID NO: 335565 - DNA, 21 bp, Homo sapiens
aatgaaatatttgcttattta

SEQ ID NO: 335566 - DNA, 17 bp, Homo sapiens
aatgaaattactacaaa

SEQ ID NO: 335567 - DNA, 14 bp, Homo sapiens
aatgaacagctcct

SEQ ID NO: 335568 - DNA, 11 bp, Homo sapiens
aatgaactgaa

SEQ ID NO: 335569 - DNA, 15 bp, Homo sapiens
aatgaactgaagttt

SEQ ID NO: 335570 - DNA, 15 bp, Homo sapiens
aatgaagcatgtagc

SEQ ID NO: 335571 - DNA, 18 bp, Homo sapiens
aatgaaggtgtgctacag

SEQ ID NO: 335572 - DNA, 21 bp, Homo sapiens
aatgaaggttaggatttaaca

SEQ ID NO: 335573 - DNA, 15 bp, Homo sapiens
aatgaatattgaagt

SEQ ID NO: 335574 - DNA, 19 bp, Homo sapiens
aatgaatattgaagtttca

SEQ ID NO: 335575 - DNA, 13 bp, Homo sapiens
aatgaatgaaata

SEQ ID NO: 335576 - DNA, 18 bp, Homo sapiens
aatgaatgaaatataaac

SEQ ID NO: 335577 - DNA, 23 bp, Homo sapiens
aatgaatgaaatataaactgtga

SEQ ID NO: 335578 - DNA, 12 bp, Homo sapiens
aatgaatgcatt

SEQ ID NO: 335579 - DNA, 14 bp, Homo sapiens
aatgaatgtcagtg

SEQ ID NO: 335580 - DNA, 15 bp, Homo sapiens
aatgaatgtcagtgt

SEQ ID NO: 335581 - DNA, 20 bp, Homo sapiens
aatgaatgtcagtgtgactg

SEQ ID NO: 335582 - DNA, 12 bp, Homo sapiens
aatgaatgtcta

SEQ ID NO: 335583 - DNA, 23 bp, Homo sapiens
aatgaatgtttacactctttgta

SEQ ID NO: 335584 - DNA, 15 bp, Homo sapiens
aatgaattaaatatt

SEQ ID NO: 335585 - DNA, 22 bp, Homo sapiens
aatgaattctctctaaaaataa

SEQ ID NO: 335586 - DNA, 13 bp, Homo sapiens
aatgaattttaaa

SEQ ID NO: 335587 - DNA, 16 bp, Homo sapiens
aatgaattttaaaagc

SEQ ID NO: 335588 - DNA, 18 bp, Homo sapiens
aatgaattttaaaagcat

SEQ ID NO: 335589 - DNA, 21 bp, Homo sapiens
aatgaattttaaaagcatata

SEQ ID NO: 335590 - DNA, 13 bp, Homo sapiens
aatgacaacagaa

SEQ ID NO: 335591 - DNA, 15 bp, Homo sapiens
aatgacaacagaagc

SEQ ID NO: 335592 - DNA, 20 bp, Homo sapiens
aatgacagagagttctggtg

SEQ ID NO: 335593 - DNA, 13 bp, Homo sapiens
aatgacagggatg

SEQ ID NO: 335594 - DNA, 14 bp, Homo sapiens
aatgacatgtgtca

SEQ ID NO: 335595 - DNA, 20 bp, Homo sapiens
aatgacgtattgtgaaattt

SEQ ID NO: 335596 - DNA, 23 bp, Homo sapiens
aatgacgtattgtgaaatttgtt

SEQ ID NO: 335597 - DNA, 22 bp, Homo sapiens
aatgactgtctaagagatctgg

SEQ ID NO: 335598 - DNA, 19 bp, Homo sapiens
aatgagaattttatattct

SEQ ID NO: 335599 - DNA, 15 bp, Homo sapiens
aatgagacttgctct

SEQ ID NO: 335600 - DNA, 16 bp, Homo sapiens
aatgagagagtgtgga

SEQ ID NO: 335601 - DNA, 15 bp, Homo sapiens
aatgagattcagtga

SEQ ID NO: 335602 - DNA, 18 bp, Homo sapiens
aatgagctttcaggaagt

SEQ ID NO: 335603 - DNA, 22 bp, Homo sapiens
aatgagggaaacaaaatattta

SEQ ID NO: 335604 - DNA, 14 bp, Homo sapiens
aatgagtaaataaa

SEQ ID NO: 335605 - DNA, 17 bp, Homo sapiens
aatgagtaaataaactc

SEQ ID NO: 335606 - DNA, 15 bp, Homo sapiens
aatgatacagtcagg

SEQ ID NO: 335607 - DNA, 20 bp, Homo sapiens
aatgatactgtctaagaata

SEQ ID NO: 335608 - DNA, 21 bp, Homo sapiens
aatgatagtgttttgtacttg

SEQ ID NO: 335609 - DNA, 12 bp, Homo sapiens
aatgatatcttt

SEQ ID NO: 335610 - DNA, 16 bp, Homo sapiens
aatgatatgtctttaa

SEQ ID NO: 335611 - DNA, 22 bp, Homo sapiens
aatgatcgttctgggtcagctt

SEQ ID NO: 335612 - DNA, 13 bp, Homo sapiens
aatgatctaggtt

SEQ ID NO: 335613 - DNA, 18 bp, Homo sapiens
aatgatctaggtttaact

SEQ ID NO: 335614 - DNA, 12 bp, Homo sapiens
aatgatgatgac

SEQ ID NO: 335615 - DNA, 21 bp, Homo sapiens
aatgatgatgtggaagaactt

SEQ ID NO: 335616 - DNA, 16 bp, Homo sapiens
aatgatgattcaatca

SEQ ID NO: 335617 - DNA, 21 bp, Homo sapiens
aatgatgcttactacagaaag

SEQ ID NO: 335618 - DNA, 14 bp, Homo sapiens
aatgatgtccagaa

SEQ ID NO: 335619 - DNA, 15 bp, Homo sapiens
aatgatgtccagaag

SEQ ID NO: 335620 - DNA, 14 bp, Homo sapiens
aatgatgtgaaagg

SEQ ID NO: 335621 - DNA, 16 bp, Homo sapiens
aatgattatcttgaaa

SEQ ID NO: 335622 - DNA, 19 bp, Homo sapiens
aatgattcataacaatgta

SEQ ID NO: 335623 - DNA, 19 bp, Homo sapiens
aatgattttatctgtgaat

SEQ ID NO: 335624 - DNA, 15 bp, Homo sapiens
aatgatttttgtgta

SEQ ID NO: 335625 - DNA, 21 bp, Homo sapiens
aatgcaaaaattagccgggcg

SEQ ID NO: 335626 - DNA, 21 bp, Homo sapiens
tgcttaatgtcagtctacagg

SEQ ID NO: 335627 - DNA, 15 bp, Homo sapiens
tgcttaatttctaaa

SEQ ID NO: 335628 - DNA, 20 bp, Homo sapiens
tgcttacaattccctgctgt

SEQ ID NO: 335629 - DNA, 22 bp, Homo sapiens
tgcttacaattccctgctgtcg

SEQ ID NO: 335630 - DNA, 16 bp, Homo sapiens
tgcttacacatctcag

SEQ ID NO: 335631 - DNA, 12 bp, Homo sapiens
tgcttacatttt

SEQ ID NO: 335632 - DNA, 14 bp, Homo sapiens
tgcttaccaaaaca

SEQ ID NO: 335633 - DNA, 16 bp, Homo sapiens
tgcttaccaaaacata

SEQ ID NO: 335634 - DNA, 14 bp, Homo sapiens
tgcttactacagaa

SEQ ID NO: 335635 - DNA, 19 bp, Homo sapiens
tgcttagaacccttctgct

SEQ ID NO: 335636 - DNA, 20 bp, Homo sapiens
tgcttagtgtcccttacctg

SEQ ID NO: 335637 - DNA, 15 bp, Homo sapiens
tgcttatctgaaact

SEQ ID NO: 335638 - DNA, 14 bp, Homo sapiens
tgcttattgttcca

SEQ ID NO: 335639 - DNA, 17 bp, Homo sapiens
tgcttattgttccaaga

SEQ ID NO: 335640 - DNA, 13 bp, Homo sapiens
tgcttatttatat

SEQ ID NO: 335641 - DNA, 19 bp, Homo sapiens
tgcttatttatattcagag

SEQ ID NO: 335642 - DNA, 20 bp, Homo sapiens
tgcttatttatattcagaga

SEQ ID NO: 335643 - DNA, 16 bp, Homo sapiens
tgcttcacacccctca

SEQ ID NO: 335644 - DNA, 17 bp, Homo sapiens
tgcttcacacccctcag

SEQ ID NO: 335645 - DNA, 22 bp, Homo sapiens
tgcttcacacccctcagcgctc

SEQ ID NO: 335646 - DNA, 22 bp, Homo sapiens
tgcttcacagtacttcccaaca

SEQ ID NO: 335647 - DNA, 23 bp, Homo sapiens
tgcttcacggactctttgctgtt

SEQ ID NO: 335648 - DNA, 12 bp, Homo sapiens
tgcttcatatct

SEQ ID NO: 335649 - DNA, 17 bp, Homo sapiens
tgcttcatgaaaatcct

SEQ ID NO: 335650 - DNA, 18 bp, Homo sapiens
tgcttcatgaaaatccta

SEQ ID NO: 335651 - DNA, 22 bp, Homo sapiens
tgcttccaagcccttccctctg

SEQ ID NO: 335652 - DNA, 11 bp, Homo sapiens
tgcttccagga

SEQ ID NO: 335653 - DNA, 18 bp, Homo sapiens
tgcttccaggtatgggac

SEQ ID NO: 335654 - DNA, 17 bp, Homo sapiens
tgcttcccacctccctg

SEQ ID NO: 335655 - DNA, 19 bp, Homo sapiens
tgcttcccacctccctgcc

SEQ ID NO: 335656 - DNA, 23 bp, Homo sapiens
tgcttcccacctccctgcccagg

SEQ ID NO: 335657 - DNA, 23 bp, Homo sapiens
tgcttcccattgtggctcctatc

SEQ ID NO: 335658 - DNA, 15 bp, Homo sapiens
tgcttccccttttgc

SEQ ID NO: 335659 - DNA, 18 bp, Homo sapiens
tgcttccccttttgccaa

SEQ ID NO: 335660 - DNA, 13 bp, Homo sapiens
tgcttccctctgc

SEQ ID NO: 335661 - DNA, 14 bp, Homo sapiens
tgcttcctaactta

SEQ ID NO: 335662 - DNA, 17 bp, Homo sapiens
tgcttccttgcttttat

SEQ ID NO: 335663 - DNA, 19 bp, Homo sapiens
tgcttctaatgttccccta

SEQ ID NO: 335664 - DNA, 21 bp, Homo sapiens
tgcttctagaaagcccctcac

SEQ ID NO: 335665 - DNA, 21 bp, Homo sapiens
tgcttctcaactaaagaatag

SEQ ID NO: 335666 - DNA, 13 bp, Homo sapiens
tgcttctccacct

SEQ ID NO: 335667 - DNA, 17 bp, Homo sapiens
tgcttctccacctcccc

SEQ ID NO: 335668 - DNA, 18 bp, Homo sapiens
tgcttctcggaggccagg

SEQ ID NO: 335669 - DNA, 19 bp, Homo sapiens
tgcttctcggaggccaggc

SEQ ID NO: 335670 - DNA, 16 bp, Homo sapiens
tgcttctctaaaacag

SEQ ID NO: 335671 - DNA, 22 bp, Homo sapiens
tgcttctcttgggaactccact

SEQ ID NO: 335672 - DNA, 12 bp, Homo sapiens
tgcttctgctca

SEQ ID NO: 335673 - DNA, 14 bp, Homo sapiens
tgcttctgctgccc

SEQ ID NO: 335674 - DNA, 14 bp, Homo sapiens
tgcttctgcttttt

SEQ ID NO: 335675 - DNA, 16 bp, Homo sapiens
tgcttctggctttgtt

SEQ ID NO: 335676 - DNA, 23 bp, Homo sapiens
tgcttctggctttgttcttgtca

SEQ ID NO: 335677 - DNA, 12 bp, Homo sapiens
tgcttctgggaa

SEQ ID NO: 335678 - DNA, 17 bp, Homo sapiens
tgcttctgtagtactcc

SEQ ID NO: 335679 - DNA, 14 bp, Homo sapiens
tgcttcttgtaata

SEQ ID NO: 335680 - DNA, 19 bp, Homo sapiens
tgcttcttgtaatatttct

SEQ ID NO: 335681 - DNA, 21 bp, Homo sapiens
tgcttcttgtaatatttcttc

SEQ ID NO: 335682 - DNA, 17 bp, Homo sapiens
tgcttgaacccaggaga

SEQ ID NO: 335683 - DNA, 19 bp, Homo sapiens
tgcttgaccgtactctcac

SEQ ID NO: 335684 - DNA, 20 bp, Homo sapiens
tgcttgaccgtactctcaca

SEQ ID NO: 335685 - DNA, 20 bp, Homo sapiens
tgcttgagtcaggtttgagt

SEQ ID NO: 335686 - DNA, 18 bp, Homo sapiens
tgcttgatggtttatgtt

SEQ ID NO: 335687 - DNA, 14 bp, Homo sapiens
tgcttgcatttctt

SEQ ID NO: 335688 - DNA, 15 bp, Homo sapiens
tgcttgcccgctccc

SEQ ID NO: 335689 - DNA, 21 bp, Homo sapiens
tgcttgccgactggctgtgag

SEQ ID NO: 335690 - DNA, 23 bp, Homo sapiens
tgcttgccgactggctgtgagac

SEQ ID NO: 335691 - DNA, 20 bp, Homo sapiens
tgcttgccgagcctaatgaa

SEQ ID NO: 335692 - DNA, 22 bp, Homo sapiens
tgcttgcctagggcctggtcca

SEQ ID NO: 335693 - DNA, 14 bp, Homo sapiens
tgcttgctgtgtga

SEQ ID NO: 335694 - DNA, 22 bp, Homo sapiens
gctcttctgggcagagcctgtc

SEQ ID NO: 335695 - DNA, 15 bp, Homo sapiens
gctcttgcagagaag

SEQ ID NO: 335696 - DNA, 22 bp, Homo sapiens
gctcttggaaagctgatgatgt

SEQ ID NO: 335697 - DNA, 17 bp, Homo sapiens
gctcttggcattttcct

SEQ ID NO: 335698 - DNA, 15 bp, Homo sapiens
gctcttggtccctgg

SEQ ID NO: 335699 - DNA, 19 bp, Homo sapiens
gctcttggtccctggtccc

SEQ ID NO: 335700 - DNA, 18 bp, Homo sapiens
gctctttaagtaaaatgt

SEQ ID NO: 335701 - DNA, 21 bp, Homo sapiens
gctctttatgaatgaaaaaac

SEQ ID NO: 335702 - DNA, 13 bp, Homo sapiens
gctctttcagaga

SEQ ID NO: 335703 - DNA, 14 bp, Homo sapiens
gctctttcctcctt

SEQ ID NO: 335704 - DNA, 15 bp, Homo sapiens
gctctttcctccttc

SEQ ID NO: 335705 - DNA, 17 bp, Homo sapiens
gctctttcctccttcca

SEQ ID NO: 335706 - DNA, 13 bp, Homo sapiens
gctctttcctgcc

SEQ ID NO: 335707 - DNA, 22 bp, Homo sapiens
gctctttcctgcccttttcctg

SEQ ID NO: 335708 - DNA, 22 bp, Homo sapiens
gctctttctacatgactgggcc

SEQ ID NO: 335709 - DNA, 15 bp, Homo sapiens
gctctttctctgcca

SEQ ID NO: 335710 - DNA, 21 bp, Homo sapiens
gctctttctctgccagtgaca

SEQ ID NO: 335711 - DNA, 10 bp, Homo sapiens
gctctttctt

SEQ ID NO: 335712 - DNA, 21 bp, Homo sapiens
gctctttcttcttccacacat

SEQ ID NO: 335713 - DNA, 21 bp, Homo sapiens
gctctttgaaatagtctgtgt

SEQ ID NO: 335714 - DNA, 12 bp, Homo sapiens
gctctttgagaa

SEQ ID NO: 335715 - DNA, 23 bp, Homo sapiens
gctctttgagaactgcttctaag

SEQ ID NO: 335716 - DNA, 19 bp, Homo sapiens
gctctttgtctcaccagct

SEQ ID NO: 335717 - DNA, 21 bp, Homo sapiens
gctctttgtctcaccagctca

SEQ ID NO: 335718 - DNA, 23 bp, Homo sapiens
gctctttgtggcagtggccaggc

SEQ ID NO: 335719 - DNA, 12 bp, Homo sapiens
gctcttttacta

SEQ ID NO: 335720 - DNA, 18 bp, Homo sapiens
gctcttttactaagacat

SEQ ID NO: 335721 - DNA, 20 bp, Homo sapiens
gctcttttggtggggagcac

SEQ ID NO: 335722 - DNA, 12 bp, Homo sapiens
gctgaaaagtgc

SEQ ID NO: 335723 - DNA, 13 bp, Homo sapiens
gctgaaaatcact

SEQ ID NO: 335724 - DNA, 18 bp, Homo sapiens
gctgaaacaaaaatgcca

SEQ ID NO: 335725 - DNA, 16 bp, Homo sapiens
gctgaaagacagtaaa

SEQ ID NO: 335726 - DNA, 14 bp, Homo sapiens
gctgaaagagaaaa

SEQ ID NO: 335727 - DNA, 16 bp, Homo sapiens
gctgaaattatgtcaa

SEQ ID NO: 335728 - DNA, 13 bp, Homo sapiens
gctgaacagtgga

SEQ ID NO: 335729 - DNA, 21 bp, Homo sapiens
gctgaagcttattaatgctaa

SEQ ID NO: 335730 - DNA, 19 bp, Homo sapiens
gctgaaggaaaccagtgca

SEQ ID NO: 335731 - DNA, 21 bp, Homo sapiens
gctgaaggattatatgtatta

SEQ ID NO: 335732 - DNA, 20 bp, Homo sapiens
gctgaagtctctttttcttc

SEQ ID NO: 335733 - DNA, 15 bp, Homo sapiens
gctgaataaagggaa

SEQ ID NO: 335734 - DNA, 12 bp, Homo sapiens
gctgaataacaa

SEQ ID NO: 335735 - DNA, 18 bp, Homo sapiens
gctgaataacaacaattt

SEQ ID NO: 335736 - DNA, 13 bp, Homo sapiens
gctgaattccttt

SEQ ID NO: 335737 - DNA, 23 bp, Homo sapiens
gctgacaaccaccgctccccagc

SEQ ID NO: 335738 - DNA, 17 bp, Homo sapiens
gctgacacctaccatgc

SEQ ID NO: 335739 - DNA, 21 bp, Homo sapiens
gctgacacctaccatgctgct

SEQ ID NO: 335740 - DNA, 22 bp, Homo sapiens
gctgacacctaccatgctgctt

SEQ ID NO: 335741 - DNA, 22 bp, Homo sapiens
gctgacagagcaggtctgcagg

SEQ ID NO: 335742 - DNA, 24 bp, Homo sapiens
gctgacagagcaggtctgcaggcc

SEQ ID NO: 335743 - DNA, 22 bp, Homo sapiens
gctgacccagccccttgagaaa

SEQ ID NO: 335744 - DNA, 14 bp, Homo sapiens
gctgacctctgttg

SEQ ID NO: 335745 - DNA, 19 bp, Homo sapiens
gctgacctctgttgtcctc

SEQ ID NO: 335746 - DNA, 15 bp, Homo sapiens
gctgaccttggagga

SEQ ID NO: 335747 - DNA, 14 bp, Homo sapiens
gctgacgaggctgg

SEQ ID NO: 335748 - DNA, 15 bp, Homo sapiens
gctgacgaggctggg

SEQ ID NO: 335749 - DNA, 17 bp, Homo sapiens
gctgacgaggctgggcc

SEQ ID NO: 335750 - DNA, 22 bp, Homo sapiens
gctgacgtttgacaccagggcc

SEQ ID NO: 335751 - DNA, 20 bp, Homo sapiens
gctgactgggaacaccccat

SEQ ID NO: 335752 - DNA, 19 bp, Homo sapiens
gctgactgggggcctctgc

SEQ ID NO: 335753 - DNA, 19 bp, Homo sapiens
gctgactgtactcctccca

SEQ ID NO: 335754 - DNA, 20 bp, Homo sapiens
gctgactgtggccccctccg

SEQ ID NO: 335755 - DNA, 14 bp, Homo sapiens
tgctttgtttggat

SEQ ID NO: 335756 - DNA, 13 bp, Homo sapiens
tgcttttatccac

SEQ ID NO: 335757 - DNA, 14 bp, Homo sapiens
tgcttttcatgtag

SEQ ID NO: 335758 - DNA, 12 bp, Homo sapiens
tgcttttccagg

SEQ ID NO: 335759 - DNA, 13 bp, Homo sapiens
tgcttttccagga

SEQ ID NO: 335760 - DNA, 21 bp, Homo sapiens
tgcttttccaggatcctgcag

SEQ ID NO: 335761 - DNA, 19 bp, Homo sapiens
tgcttttgatggctatgtt

SEQ ID NO: 335762 - DNA, 19 bp, Homo sapiens
tgcttttgttgtgactttt

SEQ ID NO: 335763 - DNA, 13 bp, Homo sapiens
tgctttttctttc

SEQ ID NO: 335764 - DNA, 16 bp, Homo sapiens
tggaaaaaaaaaacaa

SEQ ID NO: 335765 - DNA, 21 bp, Homo sapiens
tggaaaaaagagaaaaaccaa

SEQ ID NO: 335766 - DNA, 13 bp, Homo sapiens
tggaaaaaatatt

SEQ ID NO: 335767 - DNA, 15 bp, Homo sapiens
tggaaaaaatatttt

SEQ ID NO: 335768 - DNA, 17 bp, Homo sapiens
tggaaaaagaaattctg

SEQ ID NO: 335769 - DNA, 16 bp, Homo sapiens
tggaaaacttagtttg

SEQ ID NO: 335770 - DNA, 16 bp, Homo sapiens
tggaaaaggaagacta

SEQ ID NO: 335771 - DNA, 22 bp, Homo sapiens
tggaaaaggaagactagaggct

SEQ ID NO: 335772 - DNA, 22 bp, Homo sapiens
tggaaaatctgtaaaaaagaaa

SEQ ID NO: 335773 - DNA, 21 bp, Homo sapiens
tggaaaatgttctgacagcat

SEQ ID NO: 335774 - DNA, 16 bp, Homo sapiens
tggaaaccatgcacta

SEQ ID NO: 335775 - DNA, 15 bp, Homo sapiens
tggaaacctgaaaaa

SEQ ID NO: 335776 - DNA, 17 bp, Homo sapiens
tggaaacctgaaaaaaa

SEQ ID NO: 335777 - DNA, 14 bp, Homo sapiens
tggaaacctgccct

SEQ ID NO: 335778 - DNA, 19 bp, Homo sapiens
tggaaacctgccctgcctg

SEQ ID NO: 335779 - DNA, 21 bp, Homo sapiens
tggaaacctgccctgcctgag

SEQ ID NO: 335780 - DNA, 22 bp, Homo sapiens
tggaaacctgccctgcctgagg

SEQ ID NO: 335781 - DNA, 20 bp, Homo sapiens
tggaaacctgttatgccaaa

SEQ ID NO: 335782 - DNA, 21 bp, Homo sapiens
tggaaactgttggttgagata

SEQ ID NO: 335783 - DNA, 14 bp, Homo sapiens
tggaaacttttctt

SEQ ID NO: 335784 - DNA, 21 bp, Homo sapiens
tggaaagaaaagaatgtacat

SEQ ID NO: 335785 - DNA, 22 bp, Homo sapiens
tggaaagaaaagaatgtacatt

SEQ ID NO: 335786 - DNA, 16 bp, Homo sapiens
tggaaagaatctaata

SEQ ID NO: 335787 - DNA, 20 bp, Homo sapiens
tggaaagagctgttttggat

SEQ ID NO: 335788 - DNA, 23 bp, Homo sapiens
tggaaaggatgcttctgctcaca

SEQ ID NO: 335789 - DNA, 18 bp, Homo sapiens
tggaaaggggggagctgg

SEQ ID NO: 335790 - DNA, 19 bp, Homo sapiens
tggaaaggggggagctggg

SEQ ID NO: 335791 - DNA, 13 bp, Homo sapiens
tggaaagggtgtg

SEQ ID NO: 335792 - DNA, 21 bp, Homo sapiens
tggaaagggtgtggcttggaa

SEQ ID NO: 335793 - DNA, 19 bp, Homo sapiens
tggaaaggtcattgtggct

SEQ ID NO: 335794 - DNA, 16 bp, Homo sapiens
tggaaaggtcctgctg

SEQ ID NO: 335795 - DNA, 17 bp, Homo sapiens
tggaaagtgaatttgaa

SEQ ID NO: 335796 - DNA, 20 bp, Homo sapiens
tggaaagtgaatttgaatga

SEQ ID NO: 335797 - DNA, 22 bp, Homo sapiens
tggaaatcctgttacttaaata

SEQ ID NO: 335798 - DNA, 13 bp, Homo sapiens
tggaacacacaca

SEQ ID NO: 335799 - DNA, 20 bp, Homo sapiens
tggaacactaaagagctagg

SEQ ID NO: 335800 - DNA, 17 bp, Homo sapiens
tggaacaggaggaactg

SEQ ID NO: 335801 - DNA, 18 bp, Homo sapiens
tggaacagtcacccttct

SEQ ID NO: 335802 - DNA, 15 bp, Homo sapiens
tggaacatatgcaca

SEQ ID NO: 335803 - DNA, 21 bp, Homo sapiens
tggaaccacggagatctcctt

SEQ ID NO: 335804 - DNA, 20 bp, Homo sapiens
tggaaccagcaagtcccaga

SEQ ID NO: 335805 - DNA, 21 bp, Homo sapiens
tggaaccagggaggagaggaa

SEQ ID NO: 335806 - DNA, 18 bp, Homo sapiens
tggaactctaccctggta

SEQ ID NO: 335807 - DNA, 20 bp, Homo sapiens
tggaactctatctgggcctg

SEQ ID NO: 335808 - DNA, 22 bp, Homo sapiens
tggaactctatctgggcctggg

SEQ ID NO: 335809 - DNA, 22 bp, Homo sapiens
tggaactctcctgctcctcagg

SEQ ID NO: 335810 - DNA, 20 bp, Homo sapiens
tggaactctgtgcaggtgct

SEQ ID NO: 335811 - DNA, 21 bp, Homo sapiens
tggaactgaccccctcccctg

SEQ ID NO: 335812 - DNA, 15 bp, Homo sapiens
tggaacttctaatat

SEQ ID NO: 335813 - DNA, 21 bp, Homo sapiens
tggaacttctaatatattttt

SEQ ID NO: 335814 - DNA, 13 bp, Homo sapiens
tggaagaacatca

SEQ ID NO: 335815 - DNA, 21 bp, Homo sapiens
tggaagaacatcaagatacct

SEQ ID NO: 335816 - DNA, 18 bp, Homo sapiens
tggaagacaaaatgtttt

SEQ ID NO: 335817 - DNA, 21 bp, Homo sapiens
tggaagagaggcacctgctgg

SEQ ID NO: 335818 - DNA, 12 bp, Homo sapiens
tggaagagcagc

SEQ ID NO: 335819 - DNA, 13 bp, Homo sapiens
tggaagagcagcc

SEQ ID NO: 335820 - DNA, 15 bp, Homo sapiens
tggaagagcagcctg

SEQ ID NO: 335821 - DNA, 23 bp, Homo sapiens
tggaagagctgggtaccaggcca

SEQ ID NO: 335822 - DNA, 14 bp, Homo sapiens
tggaagaggttctc

SEQ ID NO: 335823 - DNA, 17 bp, Homo sapiens
tggaagaggttctcagc

SEQ ID NO: 335824 - DNA, 18 bp, Homo sapiens
tggaagaggttctcagca

SEQ ID NO: 335825 - DNA, 22 bp, Homo sapiens
tggaagaggttctcagcaagtg

SEQ ID NO: 335826 - DNA, 22 bp, Homo sapiens
tggaagatttaccttttctgtt

SEQ ID NO: 335827 - DNA, 23 bp, Homo sapiens
tggaagcactgccattagactga

SEQ ID NO: 335828 - DNA, 17 bp, Homo sapiens
tggaagccggcggccca

SEQ ID NO: 335829 - DNA, 12 bp, Homo sapiens
tggaagcctgct

SEQ ID NO: 335830 - DNA, 16 bp, Homo sapiens
tggaagcctgctgatt

SEQ ID NO: 335831 - DNA, 23 bp, Homo sapiens
tggaagctctgttgcaggtgtcc

SEQ ID NO: 335832 - DNA, 21 bp, Homo sapiens
tggaagctgattcccagagca

SEQ ID NO: 335833 - DNA, 14 bp, Homo sapiens
tggaaggagagagg

SEQ ID NO: 335834 - DNA, 18 bp, Homo sapiens
gctggaagaacatcaaga

SEQ ID NO: 335835 - DNA, 16 bp, Homo sapiens
gctggaaggcagggca

SEQ ID NO: 335836 - DNA, 18 bp, Homo sapiens
gctggaaggcagggcaga

SEQ ID NO: 335837 - DNA, 22 bp, Homo sapiens
gctggaaggcagggcagaggga

SEQ ID NO: 335838 - DNA, 19 bp, Homo sapiens
gctggaatggggacctggg

SEQ ID NO: 335839 - DNA, 15 bp, Homo sapiens
gctggacaagaagct

SEQ ID NO: 335840 - DNA, 19 bp, Homo sapiens
gctggacaagaagctgcta

SEQ ID NO: 335841 - DNA, 20 bp, Homo sapiens
gctggacagtatcactgtct

SEQ ID NO: 335842 - DNA, 15 bp, Homo sapiens
gctggaccaaggtgc

SEQ ID NO: 335843 - DNA, 22 bp, Homo sapiens
gctggactggaggtgggcatgc

SEQ ID NO: 335844 - DNA, 12 bp, Homo sapiens
gctggactggct

SEQ ID NO: 335845 - DNA, 13 bp, Homo sapiens
gctggactggctg

SEQ ID NO: 335846 - DNA, 20 bp, Homo sapiens
gctggagaggaaaagccagt

SEQ ID NO: 335847 - DNA, 19 bp, Homo sapiens
gctggagcctgagtcaggg

SEQ ID NO: 335848 - DNA, 15 bp, Homo sapiens
gctggaggcagactc

SEQ ID NO: 335849 - DNA, 19 bp, Homo sapiens
gctggaggcagactcgagg

SEQ ID NO: 335850 - DNA, 20 bp, Homo sapiens
gctggagtgcagtggtgtga

SEQ ID NO: 335851 - DNA, 19 bp, Homo sapiens
gctggagtgctgcttgtgc

SEQ ID NO: 335852 - DNA, 16 bp, Homo sapiens
gctggagtgctggctc

SEQ ID NO: 335853 - DNA, 14 bp, Homo sapiens
gctggataaaatga

SEQ ID NO: 335854 - DNA, 20 bp, Homo sapiens
gctggatgagacttccaaac

SEQ ID NO: 335855 - DNA, 16 bp, Homo sapiens
gctggatttgggagct

SEQ ID NO: 335856 - DNA, 21 bp, Homo sapiens
gctggatttgggagctctgct

SEQ ID NO: 335857 - DNA, 14 bp, Homo sapiens
gctggcaagcaggg

SEQ ID NO: 335858 - DNA, 15 bp, Homo sapiens
gctggcaagcaggga

SEQ ID NO: 335859 - DNA, 13 bp, Homo sapiens
gctggcagagggg

SEQ ID NO: 335860 - DNA, 14 bp, Homo sapiens
gctggcagcgcctc

SEQ ID NO: 335861 - DNA, 19 bp, Homo sapiens
gctggcagcgcctcccgcc

SEQ ID NO: 335862 - DNA, 13 bp, Homo sapiens
gctggcagctctc

SEQ ID NO: 335863 - DNA, 17 bp, Homo sapiens
gctggcagctctccagt

SEQ ID NO: 335864 - DNA, 21 bp, Homo sapiens
gctggcaggacacatcccggc

SEQ ID NO: 335865 - DNA, 23 bp, Homo sapiens
gctggcaggagacactggtctca

SEQ ID NO: 335866 - DNA, 23 bp, Homo sapiens
gctggcaggagagagccttggcc

SEQ ID NO: 335867 - DNA, 17 bp, Homo sapiens
gctggcagtacagagtg

SEQ ID NO: 335868 - DNA, 14 bp, Homo sapiens
gctggcatgcagtg

SEQ ID NO: 335869 - DNA, 23 bp, Homo sapiens
gctggccaaagtcagtaggagag

SEQ ID NO: 335870 - DNA, 17 bp, Homo sapiens
gctggccagcaaggcag

SEQ ID NO: 335871 - DNA, 20 bp, Homo sapiens
gctggccagcaaggcaggtt

SEQ ID NO: 335872 - DNA, 12 bp, Homo sapiens
gctggccagcct

SEQ ID NO: 335873 - DNA, 16 bp, Homo sapiens
gctggccagcctgggg

SEQ ID NO: 335874 - DNA, 22 bp, Homo sapiens
gctggccagcctggggcctggc

SEQ ID NO: 335875 - DNA, 14 bp, Homo sapiens
gctggcccagccaa

SEQ ID NO: 335876 - DNA, 14 bp, Homo sapiens
gctggcccaggaga

SEQ ID NO: 335877 - DNA, 11 bp, Homo sapiens
gctggcccctc

SEQ ID NO: 335878 - DNA, 12 bp, Homo sapiens
gctggcccctca

SEQ ID NO: 335879 - DNA, 19 bp, Homo sapiens
gctggcccctcacctgggc

SEQ ID NO: 335880 - DNA, 20 bp, Homo sapiens
gctggcccctcacctgggca

SEQ ID NO: 335881 - DNA, 14 bp, Homo sapiens
gctggccctgccct

SEQ ID NO: 335882 - DNA, 19 bp, Homo sapiens
gctggccctgccctccccc

SEQ ID NO: 335883 - DNA, 21 bp, Homo sapiens
gctggccctgccctcccccac

SEQ ID NO: 335884 - DNA, 22 bp, Homo sapiens
gctgtctccagacccccacccc

SEQ ID NO: 335885 - DNA, 12 bp, Homo sapiens
gctgtctgcctg

SEQ ID NO: 335886 - DNA, 17 bp, Homo sapiens
gctgtctgcctgtattt

SEQ ID NO: 335887 - DNA, 16 bp, Homo sapiens
gctgtgaaaattacac

SEQ ID NO: 335888 - DNA, 20 bp, Homo sapiens
gctgtgaaatgactgcatca

SEQ ID NO: 335889 - DNA, 16 bp, Homo sapiens
gctgtgagcagcctcc

SEQ ID NO: 335890 - DNA, 22 bp, Homo sapiens
gctgtgagcagcctccactgtg

SEQ ID NO: 335891 - DNA, 15 bp, Homo sapiens
gctgtgaggctgtcc

SEQ ID NO: 335892 - DNA, 18 bp, Homo sapiens
gctgtgaggctgtcctgt

SEQ ID NO: 335893 - DNA, 10 bp, Homo sapiens
gctgtgccaa

SEQ ID NO: 335894 - DNA, 11 bp, Homo sapiens
gctgtgccaaa

SEQ ID NO: 335895 - DNA, 14 bp, Homo sapiens
gctgtgccaaagca

SEQ ID NO: 335896 - DNA, 18 bp, Homo sapiens
gctgtgccaccacccctc

SEQ ID NO: 335897 - DNA, 19 bp, Homo sapiens
gctgtgccaggactgtgac

SEQ ID NO: 335898 - DNA, 22 bp, Homo sapiens
gctgtgccccatcagcagcttg

SEQ ID NO: 335899 - DNA, 14 bp, Homo sapiens
gctgtgcctgctag

SEQ ID NO: 335900 - DNA, 15 bp, Homo sapiens
gctgtgcctgctaga

SEQ ID NO: 335901 - DNA, 20 bp, Homo sapiens
gctgtgcctgctagagcaac

SEQ ID NO: 335902 - DNA, 22 bp, Homo sapiens
gctgtgcctgctagagcaaccc

SEQ ID NO: 335903 - DNA, 15 bp, Homo sapiens
gctgtgctatgaatt

SEQ ID NO: 335904 - DNA, 16 bp, Homo sapiens
gctgtgctccagcagt

SEQ ID NO: 335905 - DNA, 22 bp, Homo sapiens
gctgtgctccagcagtgctggg

SEQ ID NO: 335906 - DNA, 20 bp, Homo sapiens
gctgtggagcaaaaggcagc

SEQ ID NO: 335907 - DNA, 14 bp, Homo sapiens
gctgtggaggcctg

SEQ ID NO: 335908 - DNA, 16 bp, Homo sapiens
gctgtggaggcctgat

SEQ ID NO: 335909 - DNA, 21 bp, Homo sapiens
gctgtggattttgtggcttca

SEQ ID NO: 335910 - DNA, 12 bp, Homo sapiens
gctgtggcacag

SEQ ID NO: 335911 - DNA, 13 bp, Homo sapiens
gctgtggcacaga

SEQ ID NO: 335912 - DNA, 19 bp, Homo sapiens
gctgtggcatcaggaaagg

SEQ ID NO: 335913 - DNA, 14 bp, Homo sapiens
gctgtggcccctcc

SEQ ID NO: 335914 - DNA, 22 bp, Homo sapiens
gctgtggcccctccttctcccc

SEQ ID NO: 335915 - DNA, 23 bp, Homo sapiens
gctgtggcccctccttctcccct

SEQ ID NO: 335916 - DNA, 15 bp, Homo sapiens
gctgtggccgtctcc

SEQ ID NO: 335917 - DNA, 19 bp, Homo sapiens
gctgtggctgggtggtcag

SEQ ID NO: 335918 - DNA, 13 bp, Homo sapiens
gctgtgggcaggt

SEQ ID NO: 335919 - DNA, 14 bp, Homo sapiens
gctgtgggcaggtg

SEQ ID NO: 335920 - DNA, 23 bp, Homo sapiens
gctgtgggcaggtgggagcttga

SEQ ID NO: 335921 - DNA, 16 bp, Homo sapiens
gctgtggggagctggt

SEQ ID NO: 335922 - DNA, 18 bp, Homo sapiens
gctgtggggcatagaact

SEQ ID NO: 335923 - DNA, 20 bp, Homo sapiens
gctgtgggtattcaccaccc

SEQ ID NO: 335924 - DNA, 20 bp, Homo sapiens
gctgtgggtcagtgtgccac

SEQ ID NO: 335925 - DNA, 16 bp, Homo sapiens
gctgtgtatttctgta

SEQ ID NO: 335926 - DNA, 18 bp, Homo sapiens
gctgtgtatttctgtaga

SEQ ID NO: 335927 - DNA, 19 bp, Homo sapiens
gctgtgtatttctgtagaa

SEQ ID NO: 335928 - DNA, 19 bp, Homo sapiens
gctgtgtcacactctgtgt

SEQ ID NO: 335929 - DNA, 24 bp, Homo sapiens
gctgtgtcacactctgtgttttgt

SEQ ID NO: 335930 - DNA, 15 bp, Homo sapiens
gctgtgtctcccttc

SEQ ID NO: 335931 - DNA, 12 bp, Homo sapiens
gctgtgtgactt

SEQ ID NO: 335932 - DNA, 13 bp, Homo sapiens
gctgtgtgcagtc

SEQ ID NO: 335933 - DNA, 19 bp, Homo sapiens
gctgtgtggggagggtggg

SEQ ID NO: 335934 - DNA, 18 bp, Homo sapiens
gctgtgtgtggggcccaa

SEQ ID NO: 335935 - DNA, 18 bp, Homo sapiens
gctgtgttaaataaacct

SEQ ID NO: 335936 - DNA, 18 bp, Homo sapiens
gctgtgttttgtctgagc

SEQ ID NO: 335937 - DNA, 23 bp, Homo sapiens
gctgttactttctttcagatgtt

SEQ ID NO: 335938 - DNA, 21 bp, Homo sapiens
gctgttccagactcaggttcc

SEQ ID NO: 335939 - DNA, 12 bp, Homo sapiens
gctgttcctgtg

SEQ ID NO: 335940 - DNA, 20 bp, Homo sapiens
gctgttcctgtgttcttcgt

SEQ ID NO: 335941 - DNA, 22 bp, Homo sapiens
gctgttgacgttgatctcctgg

SEQ ID NO: 335942 - DNA, 16 bp, Homo sapiens
gctgttgattctttca

SEQ ID NO: 335943 - DNA, 16 bp, Homo sapiens
gctgttgccatagccc

SEQ ID NO: 335944 - DNA, 15 bp, Homo sapiens
gctgttggtggcagt

SEQ ID NO: 335945 - DNA, 22 bp, Homo sapiens
gctgttgtctgccgtgagagcc

SEQ ID NO: 335946 - DNA, 14 bp, Homo sapiens
gctgttgtgcagtg

SEQ ID NO: 335947 - DNA, 17 bp, Homo sapiens
gctgttgtgcagtgtgc

SEQ ID NO: 335948 - DNA, 21 bp, Homo sapiens
gctgttgttcagaagttgtta

SEQ ID NO: 335949 - DNA, 17 bp, Homo sapiens
gctgtttatggcctcag

SEQ ID NO: 335950 - DNA, 15 bp, Homo sapiens
gctgtttcccctgca

SEQ ID NO: 335951 - DNA, 19 bp, Homo sapiens
gctgttttaacggcctgca

SEQ ID NO: 335952 - DNA, 17 bp, Homo sapiens
gctgttttccctgacct

SEQ ID NO: 335953 - DNA, 22 bp, Homo sapiens
gctgttttggatgaatgcagta

SEQ ID NO: 335954 - DNA, 14 bp, Homo sapiens
gcttaaaaaaagga

SEQ ID NO: 335955 - DNA, 16 bp, Homo sapiens
gcttaaaaaaaggaaa

SEQ ID NO: 335956 - DNA, 17 bp, Homo sapiens
gcttaaaaaaaggaaaa

SEQ ID NO: 335957 - DNA, 19 bp, Homo sapiens
gcttaaaataaacagttgt

SEQ ID NO: 335958 - DNA, 12 bp, Homo sapiens
gcttaaacaaag

SEQ ID NO: 335959 - DNA, 17 bp, Homo sapiens
gcttaaattgcttttgt

SEQ ID NO: 335960 - DNA, 22 bp, Homo sapiens
gcttaatctagagctatgcaca

SEQ ID NO: 335961 - DNA, 13 bp, Homo sapiens
gcttaattccaat

SEQ ID NO: 335962 - DNA, 22 bp, Homo sapiens
gcttacaagccagctggagaaa

SEQ ID NO: 335963 - DNA, 14 bp, Homo sapiens
gcttacctcccacc

SEQ ID NO: 335964 - DNA, 19 bp, Homo sapiens
gcttactaatgtgccccat

SEQ ID NO: 335965 - DNA, 22 bp, Homo sapiens
gcttagaacccttctgctttct

SEQ ID NO: 335966 - DNA, 13 bp, Homo sapiens
gcttagaatgggg

SEQ ID NO: 335967 - DNA, 21 bp, Homo sapiens
gcttagacttcgactcaggat

SEQ ID NO: 335968 - DNA, 17 bp, Homo sapiens
gcttagccttgtgccct

SEQ ID NO: 335969 - DNA, 21 bp, Homo sapiens
gcttagctgaaacctaaggca

SEQ ID NO: 335970 - DNA, 13 bp, Homo sapiens
gcttaggagagac

SEQ ID NO: 335971 - DNA, 13 bp, Homo sapiens
gcttataaacaca

SEQ ID NO: 335972 - DNA, 19 bp, Homo sapiens
gcttataaacacattgaat

SEQ ID NO: 335973 - DNA, 17 bp, Homo sapiens
gcttatctccctgcttc

SEQ ID NO: 335974 - DNA, 19 bp, Homo sapiens
gcttatctccctgcttcat

SEQ ID NO: 335975 - DNA, 21 bp, Homo sapiens
gcttatgaatatttataacag

SEQ ID NO: 335976 - DNA, 23 bp, Homo sapiens
tggagagtgagaataattgtgta

SEQ ID NO: 335977 - DNA, 13 bp, Homo sapiens
tggagatagtgcc

SEQ ID NO: 335978 - DNA, 21 bp, Homo sapiens
tggagatagtgccaggtggct

SEQ ID NO: 335979 - DNA, 18 bp, Homo sapiens
tggagatgggatgcttgc

SEQ ID NO: 335980 - DNA, 21 bp, Homo sapiens
tggagcaaaaggcagctcacc

SEQ ID NO: 335981 - DNA, 15 bp, Homo sapiens
tggagcaaagctgat

SEQ ID NO: 335982 - DNA, 18 bp, Homo sapiens
tggagcacaaaagcctct

SEQ ID NO: 335983 - DNA, 22 bp, Homo sapiens
tggagcacgtggagatagtgcc

SEQ ID NO: 335984 - DNA, 21 bp, Homo sapiens
tggagcactctgagtttacca

SEQ ID NO: 335985 - DNA, 22 bp, Homo sapiens
tggagcactctgagtttaccat

SEQ ID NO: 335986 - DNA, 15 bp, Homo sapiens
tggagcagaggtggg

SEQ ID NO: 335987 - DNA, 14 bp, Homo sapiens
tggagcatcccagg

SEQ ID NO: 335988 - DNA, 15 bp, Homo sapiens
tggagcatcccaggc

SEQ ID NO: 335989 - DNA, 22 bp, Homo sapiens
tggagccaatggtgagggctga

SEQ ID NO: 335990 - DNA, 23 bp, Homo sapiens
tggagccactcctgtcccgcctt

SEQ ID NO: 335991 - DNA, 14 bp, Homo sapiens
tggagccactggga

SEQ ID NO: 335992 - DNA, 15 bp, Homo sapiens
tggagccagcagggc

SEQ ID NO: 335993 - DNA, 17 bp, Homo sapiens
tggagccagcagggctg

SEQ ID NO: 335994 - DNA, 22 bp, Homo sapiens
tggagcccccagatagagctgg

SEQ ID NO: 335995 - DNA, 16 bp, Homo sapiens
tggagcccctgtgtgg

SEQ ID NO: 335996 - DNA, 22 bp, Homo sapiens
tggagcccgcacccccaccctt

SEQ ID NO: 335997 - DNA, 13 bp, Homo sapiens
tggagcccgtgca

SEQ ID NO: 335998 - DNA, 21 bp, Homo sapiens
tggagcctgagtcagggccca

SEQ ID NO: 335999 - DNA, 22 bp, Homo sapiens
tggagcctgagtcagggcccag

SEQ ID NO: 336000 - DNA, 15 bp, Homo sapiens
tggagcctgcagggt

SEQ ID NO: 336001 - DNA, 12 bp, Homo sapiens
tggagcggctca

SEQ ID NO: 336002 - DNA, 22 bp, Homo sapiens
tggagcggctcatcagaactga

SEQ ID NO: 336003 - DNA, 14 bp, Homo sapiens
tggagctagagagg

SEQ ID NO: 336004 - DNA, 22 bp, Homo sapiens
tggagctagagaggggcctctg

SEQ ID NO: 336005 - DNA, 13 bp, Homo sapiens
tggagctcctggg

SEQ ID NO: 336006 - DNA, 14 bp, Homo sapiens
tggagctcctggga

SEQ ID NO: 336007 - DNA, 13 bp, Homo sapiens
tggagctgcttcc

SEQ ID NO: 336008 - DNA, 18 bp, Homo sapiens
tggagctggcgtctgtct

SEQ ID NO: 336009 - DNA, 12 bp, Homo sapiens
tggagctgtcct

SEQ ID NO: 336010 - DNA, 17 bp, Homo sapiens
tggagctgtcctccaga

SEQ ID NO: 336011 - DNA, 21 bp, Homo sapiens
tggagcttttttctttaagat

SEQ ID NO: 336012 - DNA, 22 bp, Homo sapiens
tggaggaacttgctgctgtgcc

SEQ ID NO: 336013 - DNA, 18 bp, Homo sapiens
tggaggaagagggacaga

SEQ ID NO: 336014 - DNA, 14 bp, Homo sapiens
gctttcagggcctc

SEQ ID NO: 336015 - DNA, 18 bp, Homo sapiens
gctttcatgattagcaag

SEQ ID NO: 336016 - DNA, 20 bp, Homo sapiens
gctttccagaaggccacagg

SEQ ID NO: 336017 - DNA, 19 bp, Homo sapiens
gctttcccccaggcgcctg

SEQ ID NO: 336018 - DNA, 16 bp, Homo sapiens
gctttccggggaggag

SEQ ID NO: 336019 - DNA, 11 bp, Homo sapiens
gctttcctgcc
